United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 86

SEQ ID NO: 3634895 - DNA, 22 bp, Homo sapiens
ttaaattcccgttttgtcactt

SEQ ID NO: 3634896 - DNA, 18 bp, Homo sapiens
ttaaattctcaaagtttt

SEQ ID NO: 3634897 - DNA, 15 bp, Homo sapiens
ttaaatttctaccgc

SEQ ID NO: 3634898 - DNA, 20 bp, Homo sapiens
ttaaatttgttctttgttta

SEQ ID NO: 3634899 - DNA, 17 bp, Homo sapiens
ttaaattttttttacat

SEQ ID NO: 3634900 - DNA, 20 bp, Homo sapiens
ttaaattttttttacatttt

SEQ ID NO: 3634901 - DNA, 12 bp, Homo sapiens
ttaacaagaagc

SEQ ID NO: 3634902 - DNA, 21 bp, Homo sapiens
ttaacatattatttcattggt

SEQ ID NO: 3634903 - DNA, 19 bp, Homo sapiens
ttaacatgggctcttcact

SEQ ID NO: 3634904 - DNA, 15 bp, Homo sapiens
ttaaccacagtgaaa

SEQ ID NO: 3634905 - DNA, 14 bp, Homo sapiens
ttaactaaagaaga

SEQ ID NO: 3634906 - DNA, 16 bp, Homo sapiens
ttaactaaagaagagg

SEQ ID NO: 3634907 - DNA, 16 bp, Homo sapiens
ttaactatgacagata

SEQ ID NO: 3634908 - DNA, 16 bp, Homo sapiens
ttaactatttcacatg

SEQ ID NO: 3634909 - DNA, 13 bp, Homo sapiens
ttaactgtatttt

SEQ ID NO: 3634910 - DNA, 15 bp, Homo sapiens
ttaacttattgctag

SEQ ID NO: 3634911 - DNA, 14 bp, Homo sapiens
ttaacttcttgctt

SEQ ID NO: 3634912 - DNA, 17 bp, Homo sapiens
ttaacttttaatttaaa

SEQ ID NO: 3634913 - DNA, 13 bp, Homo sapiens
ttaagaaaccttg

SEQ ID NO: 3634914 - DNA, 20 bp, Homo sapiens
ttaagaaagaaatactgtat

SEQ ID NO: 3634915 - DNA, 15 bp, Homo sapiens
ttaagaaagtaattt

SEQ ID NO: 3634916 - DNA, 16 bp, Homo sapiens
ttaagaaagtaattta

SEQ ID NO: 3634917 - DNA, 18 bp, Homo sapiens
ttaagaaagtaatttaat

SEQ ID NO: 3634918 - DNA, 18 bp, Homo sapiens
ttaagacataaacaaaga

SEQ ID NO: 3634919 - DNA, 20 bp, Homo sapiens
ttaagacataaacaaagaca

SEQ ID NO: 3634920 - DNA, 18 bp, Homo sapiens
ttaagatgtacatttaat

SEQ ID NO: 3634921 - DNA, 15 bp, Homo sapiens
ttaagcaaattttgt

SEQ ID NO: 3634922 - DNA, 19 bp, Homo sapiens
ttaagcaacatctttttaa

SEQ ID NO: 3634923 - DNA, 22 bp, Homo sapiens
ttaagcagcatggaaaaatggt

SEQ ID NO: 3634924 - DNA, 16 bp, Homo sapiens
ttaagcagcttgaatg

SEQ ID NO: 3634925 - DNA, 22 bp, Homo sapiens
ttaagcatctggctctaattca

SEQ ID NO: 3634926 - DNA, 20 bp, Homo sapiens
ttaagccaaactcaggccca

SEQ ID NO: 3634927 - DNA, 21 bp, Homo sapiens
ttaagccaaactcaggcccag

SEQ ID NO: 3634928 - DNA, 23 bp, Homo sapiens
ttaagccaaagaaacaagctgtg

SEQ ID NO: 3634929 - DNA, 19 bp, Homo sapiens
ttaagccttacaaagggaa

SEQ ID NO: 3634930 - DNA, 20 bp, Homo sapiens
ttaaggcacagtgggagctg

SEQ ID NO: 3634931 - DNA, 16 bp, Homo sapiens
ttaagtcttcaaattt

SEQ ID NO: 3634932 - DNA, 19 bp, Homo sapiens
ttaagtgaatacattaacg

SEQ ID NO: 3634933 - DNA, 21 bp, Homo sapiens
ttaataaaatattcgaaattc

SEQ ID NO: 3634934 - DNA, 19 bp, Homo sapiens
ttaataatttttgctgaat

SEQ ID NO: 3634935 - DNA, 21 bp, Homo sapiens
ttaatacaagtaatattatta

SEQ ID NO: 3634936 - DNA, 13 bp, Homo sapiens
ttaatagcaacag

SEQ ID NO: 3634937 - DNA, 20 bp, Homo sapiens
ttaatatccctacatgtatt

SEQ ID NO: 3634938 - DNA, 17 bp, Homo sapiens
ttaatattttatgtgta

SEQ ID NO: 3634939 - DNA, 16 bp, Homo sapiens
ttaatcaagagaaact

SEQ ID NO: 3634940 - DNA, 17 bp, Homo sapiens
ttaatcaagagaaactt

SEQ ID NO: 3634941 - DNA, 20 bp, Homo sapiens
ttaatcaagatttttttcct

SEQ ID NO: 3634942 - DNA, 19 bp, Homo sapiens
ttaatcacaaatttcactt

SEQ ID NO: 3634943 - DNA, 22 bp, Homo sapiens
ttaatcatatttgaaaaccata

SEQ ID NO: 3634944 - DNA, 21 bp, Homo sapiens
ttaatcctgtaccaaatctga

SEQ ID NO: 3634945 - DNA, 18 bp, Homo sapiens
ttaatctctaacagtgga

SEQ ID NO: 3634946 - DNA, 22 bp, Homo sapiens
ttaatctggtttatttttgttc

SEQ ID NO: 3634947 - DNA, 16 bp, Homo sapiens
ttaatcttagtgtatg

SEQ ID NO: 3634948 - DNA, 15 bp, Homo sapiens
ttaatgacaacactt

SEQ ID NO: 3634949 - DNA, 19 bp, Homo sapiens
ttaatggtagttttacagt

SEQ ID NO: 3634950 - DNA, 18 bp, Homo sapiens
ttaatggtttattctttg

SEQ ID NO: 3634951 - DNA, 17 bp, Homo sapiens
ttaatgtatcaaactgt

SEQ ID NO: 3634952 - DNA, 23 bp, Homo sapiens
ttaattaaaattggtaaaaataa

SEQ ID NO: 3634953 - DNA, 18 bp, Homo sapiens
ttaattaaagaaaattaa

SEQ ID NO: 3634954 - DNA, 16 bp, Homo sapiens
ttaattactgctataa

SEQ ID NO: 3634955 - DNA, 20 bp, Homo sapiens
ttaattatgtgtagttataa

SEQ ID NO: 3634956 - DNA, 22 bp, Homo sapiens
ttaattatgtgtagttataaac

SEQ ID NO: 3634957 - DNA, 17 bp, Homo sapiens
ttaattcaggtttttta

SEQ ID NO: 3634958 - DNA, 16 bp, Homo sapiens
ttaattgaaagaatgt

SEQ ID NO: 3634959 - DNA, 20 bp, Homo sapiens
ttaattgaaagaatgtaaag

SEQ ID NO: 3634960 - DNA, 17 bp, Homo sapiens
ttaatttaatttttcct

SEQ ID NO: 3634961 - DNA, 16 bp, Homo sapiens
ttaatttataatgtat

SEQ ID NO: 3634962 - DNA, 17 bp, Homo sapiens
ttaatttataatgtatt

SEQ ID NO: 3634963 - DNA, 20 bp, Homo sapiens
ttaatttataatgtatttga

SEQ ID NO: 3634964 - DNA, 20 bp, Homo sapiens
ttaatttgaaaccaggacat

SEQ ID NO: 3634965 - DNA, 18 bp, Homo sapiens
ttaatttgtaaaacttct

SEQ ID NO: 3634966 - DNA, 17 bp, Homo sapiens
ttaattttcagttctat

SEQ ID NO: 3634967 - DNA, 12 bp, Homo sapiens
ttaatttttcct

SEQ ID NO: 3634968 - DNA, 14 bp, Homo sapiens
ttaatttttccttt

SEQ ID NO: 3634969 - DNA, 21 bp, Homo sapiens
ttacaaaacctatttttcctt

SEQ ID NO: 3634970 - DNA, 22 bp, Homo sapiens
ttacaaaacctatttttccttt

SEQ ID NO: 3634971 - DNA, 23 bp, Homo sapiens
ttacaaaacctatttttccttta

SEQ ID NO: 3634972 - DNA, 19 bp, Homo sapiens
ttacaaaagaaaaaagcaa

SEQ ID NO: 3634973 - DNA, 21 bp, Homo sapiens
ttacaaacaataagaacaagt

SEQ ID NO: 3634974 - DNA, 20 bp, Homo sapiens
ttacaaagaaccatgcagga

SEQ ID NO: 3634975 - DNA, 22 bp, Homo sapiens
ttacaaagggaaagcctctggc

SEQ ID NO: 3634976 - DNA, 16 bp, Homo sapiens
ttacaaatcagaagtc

SEQ ID NO: 3634977 - DNA, 14 bp, Homo sapiens
ttacaactaaataa

SEQ ID NO: 3634978 - DNA, 20 bp, Homo sapiens
ttacaagggcataaagtaaa

SEQ ID NO: 3634979 - DNA, 15 bp, Homo sapiens
ttacaagtttctagc

SEQ ID NO: 3634980 - DNA, 21 bp, Homo sapiens
ttacacaaagaacttgctgct

SEQ ID NO: 3634981 - DNA, 20 bp, Homo sapiens
ttacacaattcttaccctgt

SEQ ID NO: 3634982 - DNA, 22 bp, Homo sapiens
ttacactctgtattgaaaatgg

SEQ ID NO: 3634983 - DNA, 13 bp, Homo sapiens
ttacactttatgc

SEQ ID NO: 3634984 - DNA, 20 bp, Homo sapiens
ttacactttatgcacaaaat

SEQ ID NO: 3634985 - DNA, 14 bp, Homo sapiens
ttacagaaactgat

SEQ ID NO: 3634986 - DNA, 15 bp, Homo sapiens
ttacagaggacagta

SEQ ID NO: 3634987 - DNA, 20 bp, Homo sapiens
ttacagatttattcctttgt

SEQ ID NO: 3634988 - DNA, 22 bp, Homo sapiens
ttacagccaagtgccaaatgct

SEQ ID NO: 3634989 - DNA, 11 bp, Homo sapiens
ttacaggagcc

SEQ ID NO: 3634990 - DNA, 13 bp, Homo sapiens
ttacaggagccag

SEQ ID NO: 3634991 - DNA, 20 bp, Homo sapiens
ttacagggatgagccaccgc

SEQ ID NO: 3634992 - DNA, 11 bp, Homo sapiens
ttacagtgttg

SEQ ID NO: 3634993 - DNA, 13 bp, Homo sapiens
ttacagttctgtg

SEQ ID NO: 3634994 - DNA, 14 bp, Homo sapiens
ttacagttctgtgg

SEQ ID NO: 3634995 - DNA, 19 bp, Homo sapiens
ttacataacggaaagtttt

SEQ ID NO: 3634996 - DNA, 12 bp, Homo sapiens
ttacatgaagct

SEQ ID NO: 3634997 - DNA, 10 bp, Homo sapiens
ttacatttca

SEQ ID NO: 3634998 - DNA, 23 bp, Homo sapiens
ttacattttctggtactctgtga

SEQ ID NO: 3634999 - DNA, 21 bp, Homo sapiens
ttaccagggactatctttgct

SEQ ID NO: 3635000 - DNA, 14 bp, Homo sapiens
ttaccatcatctct

SEQ ID NO: 3635001 - DNA, 15 bp, Homo sapiens
ttaccatcatctctg

SEQ ID NO: 3635002 - DNA, 14 bp, Homo sapiens
ttacctaagattac

SEQ ID NO: 3635003 - DNA, 23 bp, Homo sapiens
ttacctattctgaaaaagacata

SEQ ID NO: 3635004 - DNA, 22 bp, Homo sapiens
ttacctgaaggggttttcttga

SEQ ID NO: 3635005 - DNA, 14 bp, Homo sapiens
ttaccttacagaag

SEQ ID NO: 3635006 - DNA, 17 bp, Homo sapiens
ttacctttatctttcac

SEQ ID NO: 3635007 - DNA, 19 bp, Homo sapiens
ttacctttatctttcacct

SEQ ID NO: 3635008 - DNA, 20 bp, Homo sapiens
ttacctttatctttcacctt

SEQ ID NO: 3635009 - DNA, 15 bp, Homo sapiens
ttactaaaaagtata

SEQ ID NO: 3635010 - DNA, 13 bp, Homo sapiens
ttactatgcacaa

SEQ ID NO: 3635011 - DNA, 15 bp, Homo sapiens
ttactcagtttatgt

SEQ ID NO: 3635012 - DNA, 16 bp, Homo sapiens
ttactcccccaccact

SEQ ID NO: 3635013 - DNA, 18 bp, Homo sapiens
ttactccctacactgatg

SEQ ID NO: 3635014 - DNA, 19 bp, Homo sapiens
ttactccctacactgatgc

SEQ ID NO: 3635015 - DNA, 21 bp, Homo sapiens
ttactccctacactgatgcaa

SEQ ID NO: 3635016 - DNA, 20 bp, Homo sapiens
ttactggcctttttcattta

SEQ ID NO: 3635017 - DNA, 19 bp, Homo sapiens
ttacttaattgccagcaaa

SEQ ID NO: 3635018 - DNA, 13 bp, Homo sapiens
ttacttatgtaga

SEQ ID NO: 3635019 - DNA, 19 bp, Homo sapiens
ttacttcaaagtgcctggg

SEQ ID NO: 3635020 - DNA, 22 bp, Homo sapiens
ttacttcaaagtgcctgggctc

SEQ ID NO: 3635021 - DNA, 16 bp, Homo sapiens
ttacttgcctatctga

SEQ ID NO: 3635022 - DNA, 16 bp, Homo sapiens
ttactttaaacttgtc

SEQ ID NO: 3635023 - DNA, 19 bp, Homo sapiens
ttagaaaaaacaatttttg

SEQ ID NO: 3635024 - DNA, 13 bp, Homo sapiens
ttagaaacactgc

SEQ ID NO: 3635025 - DNA, 10 bp, Homo sapiens
ttagaaactg

SEQ ID NO: 3635026 - DNA, 14 bp, Homo sapiens
ttagaaatataatt

SEQ ID NO: 3635027 - DNA, 20 bp, Homo sapiens
ttagaaccagccgtatttta

SEQ ID NO: 3635028 - DNA, 17 bp, Homo sapiens
ttagaagattctatgtt

SEQ ID NO: 3635029 - DNA, 21 bp, Homo sapiens
ttagaagtaaggattataaac

SEQ ID NO: 3635030 - DNA, 23 bp, Homo sapiens
ttagacaaagccttaagcaaatt

SEQ ID NO: 3635031 - DNA, 23 bp, Homo sapiens
ttagactgttgggacagccattt

SEQ ID NO: 3635032 - DNA, 12 bp, Homo sapiens
ttagagaaaacc

SEQ ID NO: 3635033 - DNA, 16 bp, Homo sapiens
ttagagaaaataaatt

SEQ ID NO: 3635034 - DNA, 20 bp, Homo sapiens
ttagagaaaataaatttaac

SEQ ID NO: 3635035 - DNA, 21 bp, Homo sapiens
ttagagaagtatacataagtt

SEQ ID NO: 3635036 - DNA, 14 bp, Homo sapiens
ttagagataattgc

SEQ ID NO: 3635037 - DNA, 18 bp, Homo sapiens
ttagagataggaaactga

SEQ ID NO: 3635038 - DNA, 12 bp, Homo sapiens
ttagagctcttg

SEQ ID NO: 3635039 - DNA, 17 bp, Homo sapiens
ttagaggcaacaggatt

SEQ ID NO: 3635040 - DNA, 17 bp, Homo sapiens
ttagagtttctgtttga

SEQ ID NO: 3635041 - DNA, 18 bp, Homo sapiens
ttagcaaggcagagcctt

SEQ ID NO: 3635042 - DNA, 14 bp, Homo sapiens
ttagcagtttcctc

SEQ ID NO: 3635043 - DNA, 13 bp, Homo sapiens
ttagcatttgtat

SEQ ID NO: 3635044 - DNA, 14 bp, Homo sapiens
ttagccccataatt

SEQ ID NO: 3635045 - DNA, 18 bp, Homo sapiens
ttagccgggcatggtggc

SEQ ID NO: 3635046 - DNA, 14 bp, Homo sapiens
ttagctcttcccac

SEQ ID NO: 3635047 - DNA, 19 bp, Homo sapiens
ttagctgacagtcagctgt

SEQ ID NO: 3635048 - DNA, 16 bp, Homo sapiens
ttagcttacctgggca

SEQ ID NO: 3635049 - DNA, 13 bp, Homo sapiens
ttaggactagaag

SEQ ID NO: 3635050 - DNA, 12 bp, Homo sapiens
ttaggagaagcc

SEQ ID NO: 3635051 - DNA, 13 bp, Homo sapiens
ttaggagaagcca

SEQ ID NO: 3635052 - DNA, 17 bp, Homo sapiens
ttaggagaagccaggaa

SEQ ID NO: 3635053 - DNA, 23 bp, Homo sapiens
ttaggagaagtcttctatttatt

SEQ ID NO: 3635054 - DNA, 22 bp, Homo sapiens
ttaggattttgtgtcttttaaa

SEQ ID NO: 3635055 - DNA, 22 bp, Homo sapiens
ttaggccaaaaaaatgtaagat

SEQ ID NO: 3635056 - DNA, 14 bp, Homo sapiens
ttaggctgtaacta

SEQ ID NO: 3635057 - DNA, 20 bp, Homo sapiens
ttaggtcgttttccaaagag

SEQ ID NO: 3635058 - DNA, 15 bp, Homo sapiens
ttaggttaacaatat

SEQ ID NO: 3635059 - DNA, 15 bp, Homo sapiens
ttagtattttaatcc

SEQ ID NO: 3635060 - DNA, 18 bp, Homo sapiens
ttagtgtatgattactgg

SEQ ID NO: 3635061 - DNA, 14 bp, Homo sapiens
ttagtgtgaatatt

SEQ ID NO: 3635062 - DNA, 14 bp, Homo sapiens
ttagttaatggatt

SEQ ID NO: 3635063 - DNA, 16 bp, Homo sapiens
ttagttctttttgcca

SEQ ID NO: 3635064 - DNA, 15 bp, Homo sapiens
ttagttgacagtatt

SEQ ID NO: 3635065 - DNA, 18 bp, Homo sapiens
ttagttggaaaaacaatt

SEQ ID NO: 3635066 - DNA, 16 bp, Homo sapiens
ttagttttgatgagtt

SEQ ID NO: 3635067 - DNA, 16 bp, Homo sapiens
ttataaaccaatgaaa

SEQ ID NO: 3635068 - DNA, 17 bp, Homo sapiens
ttataaaccaatgaaat

SEQ ID NO: 3635069 - DNA, 19 bp, Homo sapiens
ttataaagtggaagtatgt

SEQ ID NO: 3635070 - DNA, 16 bp, Homo sapiens
ttataaattaaaaggt

SEQ ID NO: 3635071 - DNA, 18 bp, Homo sapiens
ttataacaatataactga

SEQ ID NO: 3635072 - DNA, 12 bp, Homo sapiens
ttataactatta

SEQ ID NO: 3635073 - DNA, 13 bp, Homo sapiens
ttataataaactc

SEQ ID NO: 3635074 - DNA, 18 bp, Homo sapiens
ttataataaaggactgta

SEQ ID NO: 3635075 - DNA, 15 bp, Homo sapiens
ttataataatgttaa

SEQ ID NO: 3635076 - DNA, 17 bp, Homo sapiens
ttataatgtatttgaaa

SEQ ID NO: 3635077 - DNA, 18 bp, Homo sapiens
ttataatgtatttgaaaa

SEQ ID NO: 3635078 - DNA, 19 bp, Homo sapiens
ttataatgtatttgaaaat

SEQ ID NO: 3635079 - DNA, 13 bp, Homo sapiens
ttatacactgtaa

SEQ ID NO: 3635080 - DNA, 19 bp, Homo sapiens
ttatactgtaggtgttatg

SEQ ID NO: 3635081 - DNA, 14 bp, Homo sapiens
ttatagagaatgat

SEQ ID NO: 3635082 - DNA, 21 bp, Homo sapiens
ttatagagaatgatgataaca

SEQ ID NO: 3635083 - DNA, 21 bp, Homo sapiens
ttatagtgtttggacagctga

SEQ ID NO: 3635084 - DNA, 19 bp, Homo sapiens
ttatagttactgtgtaatt

SEQ ID NO: 3635085 - DNA, 19 bp, Homo sapiens
ttatataaataaagttttt

SEQ ID NO: 3635086 - DNA, 13 bp, Homo sapiens
ttatatattataa

SEQ ID NO: 3635087 - DNA, 17 bp, Homo sapiens
ttatatcctgacaagat

SEQ ID NO: 3635088 - DNA, 14 bp, Homo sapiens
ttatatctccccca

SEQ ID NO: 3635089 - DNA, 15 bp, Homo sapiens
ttatatgatatgcat

SEQ ID NO: 3635090 - DNA, 17 bp, Homo sapiens
ttatatgccctcaagta

SEQ ID NO: 3635091 - DNA, 16 bp, Homo sapiens
ttatatgtaccgtagg

SEQ ID NO: 3635092 - DNA, 20 bp, Homo sapiens
ttatattctaatagtttttc

SEQ ID NO: 3635093 - DNA, 23 bp, Homo sapiens
ttatattctcttatgatacttga

SEQ ID NO: 3635094 - DNA, 22 bp, Homo sapiens
ttatattggaattataaatatt

SEQ ID NO: 3635095 - DNA, 17 bp, Homo sapiens
ttatatttattgttaga

SEQ ID NO: 3635096 - DNA, 20 bp, Homo sapiens
ttatcaaaatagtctaaggc

SEQ ID NO: 3635097 - DNA, 14 bp, Homo sapiens
ttatcaacatttgt

SEQ ID NO: 3635098 - DNA, 16 bp, Homo sapiens
ttatcaatagcccagg

SEQ ID NO: 3635099 - DNA, 18 bp, Homo sapiens
ttatcacccccttgttgt

SEQ ID NO: 3635100 - DNA, 22 bp, Homo sapiens
ttatcagactcggaatctattt

SEQ ID NO: 3635101 - DNA, 21 bp, Homo sapiens
ttatcagccttttatgtattt

SEQ ID NO: 3635102 - DNA, 15 bp, Homo sapiens
ttatcagtgtgcaat

SEQ ID NO: 3635103 - DNA, 21 bp, Homo sapiens
ttatccacaattattggcaaa

SEQ ID NO: 3635104 - DNA, 14 bp, Homo sapiens
ttatcccatttagt

SEQ ID NO: 3635105 - DNA, 15 bp, Homo sapiens
ttatccctctcttcc

SEQ ID NO: 3635106 - DNA, 16 bp, Homo sapiens
ttatccctctcttccc

SEQ ID NO: 3635107 - DNA, 17 bp, Homo sapiens
ttatcctgaaatttcag

SEQ ID NO: 3635108 - DNA, 15 bp, Homo sapiens
ttatctataatttac

SEQ ID NO: 3635109 - DNA, 22 bp, Homo sapiens
ttatctataatttacctaagat

SEQ ID NO: 3635110 - DNA, 13 bp, Homo sapiens
ttatctcaagtaa

SEQ ID NO: 3635111 - DNA, 17 bp, Homo sapiens
ttatctccttgtggcct

SEQ ID NO: 3635112 - DNA, 17 bp, Homo sapiens
ttatctcctttgaagaa

SEQ ID NO: 3635113 - DNA, 16 bp, Homo sapiens
ttatctttacttttaa

SEQ ID NO: 3635114 - DNA, 15 bp, Homo sapiens
ttatgactatgtaaa

SEQ ID NO: 3635115 - DNA, 13 bp, Homo sapiens
ttatgagggccac

SEQ ID NO: 3635116 - DNA, 20 bp, Homo sapiens
ttatgcaaatacaatcagcc

SEQ ID NO: 3635117 - DNA, 17 bp, Homo sapiens
ttatgccagttgttaaa

SEQ ID NO: 3635118 - DNA, 22 bp, Homo sapiens
ttatgctataaattttttgaaa

SEQ ID NO: 3635119 - DNA, 15 bp, Homo sapiens
ttatgctgtttccta

SEQ ID NO: 3635120 - DNA, 16 bp, Homo sapiens
ttatggccgggcaggg

SEQ ID NO: 3635121 - DNA, 11 bp, Homo sapiens
ttatgtaaatt

SEQ ID NO: 3635122 - DNA, 16 bp, Homo sapiens
ttatgtaaatttttta

SEQ ID NO: 3635123 - DNA, 11 bp, Homo sapiens
ttatgtacata

SEQ ID NO: 3635124 - DNA, 14 bp, Homo sapiens
ttatgtattcctat

SEQ ID NO: 3635125 - DNA, 22 bp, Homo sapiens
ttatgtattttccaagtaaaat

SEQ ID NO: 3635126 - DNA, 21 bp, Homo sapiens
ttatgtgaaatgctttctgta

SEQ ID NO: 3635127 - DNA, 14 bp, Homo sapiens
ttatgtgacatttt

SEQ ID NO: 3635128 - DNA, 19 bp, Homo sapiens
ttatgtgacattttacatt

SEQ ID NO: 3635129 - DNA, 15 bp, Homo sapiens
ttatgtgcactgcct

SEQ ID NO: 3635130 - DNA, 16 bp, Homo sapiens
ttatgtgcactgcctg

SEQ ID NO: 3635131 - DNA, 12 bp, Homo sapiens
ttatgtggagac

SEQ ID NO: 3635132 - DNA, 10 bp, Homo sapiens
ttatgtgtgt

SEQ ID NO: 3635133 - DNA, 12 bp, Homo sapiens
ttattaaacttc

SEQ ID NO: 3635134 - DNA, 17 bp, Homo sapiens
ttattaatcttagtgta

SEQ ID NO: 3635135 - DNA, 15 bp, Homo sapiens
ttattaattgctttg

SEQ ID NO: 3635136 - DNA, 14 bp, Homo sapiens
ttattacacaaaga

SEQ ID NO: 3635137 - DNA, 20 bp, Homo sapiens
ttattaccttctttctaata

SEQ ID NO: 3635138 - DNA, 22 bp, Homo sapiens
ttattaccttctttctaataca

SEQ ID NO: 3635139 - DNA, 12 bp, Homo sapiens
ttattactttaa

SEQ ID NO: 3635140 - DNA, 21 bp, Homo sapiens
ttattataaattctactaagt

SEQ ID NO: 3635141 - DNA, 13 bp, Homo sapiens
ttattatgttctt

SEQ ID NO: 3635142 - DNA, 18 bp, Homo sapiens
ttattccccagtgactcc

SEQ ID NO: 3635143 - DNA, 20 bp, Homo sapiens
ttattccccattcttcctag

SEQ ID NO: 3635144 - DNA, 21 bp, Homo sapiens
ttattccctgcccaaaccctt

SEQ ID NO: 3635145 - DNA, 18 bp, Homo sapiens
ttattctttgcaaataaa

SEQ ID NO: 3635146 - DNA, 21 bp, Homo sapiens
ttattgccaaaacccagctgc

SEQ ID NO: 3635147 - DNA, 14 bp, Homo sapiens
ttattggcaaagtt

SEQ ID NO: 3635148 - DNA, 23 bp, Homo sapiens
ttattggcaaagtttaaatgtat

SEQ ID NO: 3635149 - DNA, 12 bp, Homo sapiens
ttattgtcccaa

SEQ ID NO: 3635150 - DNA, 17 bp, Homo sapiens
ttattgtttaaaatcat

SEQ ID NO: 3635151 - DNA, 20 bp, Homo sapiens
ttatttaaactctgttgcaa

SEQ ID NO: 3635152 - DNA, 15 bp, Homo sapiens
ttatttaagactaaa

SEQ ID NO: 3635153 - DNA, 15 bp, Homo sapiens
ttatttacagctgtg

SEQ ID NO: 3635154 - DNA, 18 bp, Homo sapiens
ttatttacagctgtgctc

SEQ ID NO: 3635155 - DNA, 15 bp, Homo sapiens
ttatttagtcaacat

SEQ ID NO: 3635156 - DNA, 17 bp, Homo sapiens
ttatttattaaacttca

SEQ ID NO: 3635157 - DNA, 11 bp, Homo sapiens
ttatttattga

SEQ ID NO: 3635158 - DNA, 14 bp, Homo sapiens
ttatttcaataaat

SEQ ID NO: 3635159 - DNA, 16 bp, Homo sapiens
ttatttcaataaatct

SEQ ID NO: 3635160 - DNA, 16 bp, Homo sapiens
ttatttctaagtattt

SEQ ID NO: 3635161 - DNA, 17 bp, Homo sapiens
ttatttctaagtattta

SEQ ID NO: 3635162 - DNA, 19 bp, Homo sapiens
ttatttctaagtatttaaa

SEQ ID NO: 3635163 - DNA, 19 bp, Homo sapiens
ttatttctagttctttcct

SEQ ID NO: 3635164 - DNA, 14 bp, Homo sapiens
ttatttcttccctg

SEQ ID NO: 3635165 - DNA, 17 bp, Homo sapiens
ttatttgaggtcagtgt

SEQ ID NO: 3635166 - DNA, 15 bp, Homo sapiens
ttatttgctgttaac

SEQ ID NO: 3635167 - DNA, 13 bp, Homo sapiens
ttatttgtattac

SEQ ID NO: 3635168 - DNA, 18 bp, Homo sapiens
ttattttcccctatcatt

SEQ ID NO: 3635169 - DNA, 16 bp, Homo sapiens
ttattttccttctgaa

SEQ ID NO: 3635170 - DNA, 21 bp, Homo sapiens
ttattttctttttcttaagaa

SEQ ID NO: 3635171 - DNA, 22 bp, Homo sapiens
ttattttggaaaataaattatt

SEQ ID NO: 3635172 - DNA, 17 bp, Homo sapiens
ttattttgtaataaact

SEQ ID NO: 3635173 - DNA, 16 bp, Homo sapiens
ttatttttaagaaaga

SEQ ID NO: 3635174 - DNA, 14 bp, Homo sapiens
ttatttttagaatt

SEQ ID NO: 3635175 - DNA, 19 bp, Homo sapiens
ttattttttcagaccgaaa

SEQ ID NO: 3635176 - DNA, 19 bp, Homo sapiens
ttcaaaagccataacttga

SEQ ID NO: 3635177 - DNA, 21 bp, Homo sapiens
ttcaaaagccataacttgaaa

SEQ ID NO: 3635178 - DNA, 23 bp, Homo sapiens
ttcaaacccagagggttgctggt

SEQ ID NO: 3635179 - DNA, 21 bp, Homo sapiens
ttcaaacttaaacaaaaaact

SEQ ID NO: 3635180 - DNA, 11 bp, Homo sapiens
ttcaaagcact

SEQ ID NO: 3635181 - DNA, 19 bp, Homo sapiens
ttcaaagcacttaagtgtt

SEQ ID NO: 3635182 - DNA, 15 bp, Homo sapiens
ttcaaatgttttaaa

SEQ ID NO: 3635183 - DNA, 17 bp, Homo sapiens
ttcaaatgttttaaagt

SEQ ID NO: 3635184 - DNA, 19 bp, Homo sapiens
ttcaacagccaagctggca

SEQ ID NO: 3635185 - DNA, 14 bp, Homo sapiens
ttcaaccagataac

SEQ ID NO: 3635186 - DNA, 19 bp, Homo sapiens
ttcaacgcagccctgcttt

SEQ ID NO: 3635187 - DNA, 17 bp, Homo sapiens
ttcaactgaccagcctc

SEQ ID NO: 3635188 - DNA, 14 bp, Homo sapiens
ttcaacttaactat

SEQ ID NO: 3635189 - DNA, 13 bp, Homo sapiens
ttcaagacaagag

SEQ ID NO: 3635190 - DNA, 15 bp, Homo sapiens
ttcaagcaaacatca

SEQ ID NO: 3635191 - DNA, 17 bp, Homo sapiens
ttcaagcaaacatcaaa

SEQ ID NO: 3635192 - DNA, 20 bp, Homo sapiens
ttcaagcaaacatcaaataa

SEQ ID NO: 3635193 - DNA, 19 bp, Homo sapiens
ttcaagcaatcctcctacc

SEQ ID NO: 3635194 - DNA, 15 bp, Homo sapiens
ttcaagcctctaaac

SEQ ID NO: 3635195 - DNA, 19 bp, Homo sapiens
ttcaaggagcaagaaatga

SEQ ID NO: 3635196 - DNA, 17 bp, Homo sapiens
ttcaaggccatccttcc

SEQ ID NO: 3635197 - DNA, 19 bp, Homo sapiens
ttcaagtgactctcctgcc

SEQ ID NO: 3635198 - DNA, 22 bp, Homo sapiens
ttcaagtttgctgcaacccaag

SEQ ID NO: 3635199 - DNA, 12 bp, Homo sapiens
ttcaataaagca

SEQ ID NO: 3635200 - DNA, 23 bp, Homo sapiens
ttcaatacttacatatctgactt

SEQ ID NO: 3635201 - DNA, 18 bp, Homo sapiens
ttcaatctcaattgcttt

SEQ ID NO: 3635202 - DNA, 11 bp, Homo sapiens
ttcaattaaac

SEQ ID NO: 3635203 - DNA, 14 bp, Homo sapiens
ttcaattaaacgga

SEQ ID NO: 3635204 - DNA, 15 bp, Homo sapiens
ttcaattaaacggat

SEQ ID NO: 3635205 - DNA, 15 bp, Homo sapiens
ttcaattgtttatat

SEQ ID NO: 3635206 - DNA, 20 bp, Homo sapiens
ttcacagttctttgggccag

SEQ ID NO: 3635207 - DNA, 15 bp, Homo sapiens
ttcaccaagaacagc

SEQ ID NO: 3635208 - DNA, 14 bp, Homo sapiens
ttcaccacagactt

SEQ ID NO: 3635209 - DNA, 18 bp, Homo sapiens
ttcaccagatttgctaat

SEQ ID NO: 3635210 - DNA, 14 bp, Homo sapiens
ttcaccagtgttcc

SEQ ID NO: 3635211 - DNA, 15 bp, Homo sapiens
ttcaccagtgttcct

SEQ ID NO: 3635212 - DNA, 11 bp, Homo sapiens
ttcacccatcc

SEQ ID NO: 3635213 - DNA, 19 bp, Homo sapiens
ttcacccccctctgctgcc

SEQ ID NO: 3635214 - DNA, 19 bp, Homo sapiens
ttcacctactaatgtctct

SEQ ID NO: 3635215 - DNA, 13 bp, Homo sapiens
ttcaccttcccct

SEQ ID NO: 3635216 - DNA, 22 bp, Homo sapiens
ttcactagaagccgtgggaaga

SEQ ID NO: 3635217 - DNA, 14 bp, Homo sapiens
ttcactctggcttc

SEQ ID NO: 3635218 - DNA, 22 bp, Homo sapiens
ttcactgtcctccaagccagcg

SEQ ID NO: 3635219 - DNA, 15 bp, Homo sapiens
ttcacttaacaaaca

SEQ ID NO: 3635220 - DNA, 22 bp, Homo sapiens
ttcacttacaagaaaggcctga

SEQ ID NO: 3635221 - DNA, 11 bp, Homo sapiens
ttcagaagaat

SEQ ID NO: 3635222 - DNA, 23 bp, Homo sapiens
ttcagaagaatcttcctggcaca

SEQ ID NO: 3635223 - DNA, 14 bp, Homo sapiens
ttcagaccccccca

SEQ ID NO: 3635224 - DNA, 17 bp, Homo sapiens
ttcagaccctgggtcag

SEQ ID NO: 3635225 - DNA, 21 bp, Homo sapiens
ttcagactcccattcctgaag

SEQ ID NO: 3635226 - DNA, 14 bp, Homo sapiens
ttcagactggccct

SEQ ID NO: 3635227 - DNA, 20 bp, Homo sapiens
ttcagagaaaggactgtgga

SEQ ID NO: 3635228 - DNA, 11 bp, Homo sapiens
ttcagagaaat

SEQ ID NO: 3635229 - DNA, 19 bp, Homo sapiens
ttcagagaaatttagagct

SEQ ID NO: 3635230 - DNA, 20 bp, Homo sapiens
ttcagagaattatctcaagt

SEQ ID NO: 3635231 - DNA, 22 bp, Homo sapiens
ttcagaggctcagattgtaata

SEQ ID NO: 3635232 - DNA, 22 bp, Homo sapiens
ttcagatgaaaagaaaacttaa

SEQ ID NO: 3635233 - DNA, 14 bp, Homo sapiens
ttcagattcccaga

SEQ ID NO: 3635234 - DNA, 22 bp, Homo sapiens
ttcagcaccaagcatgtcccag

SEQ ID NO: 3635235 - DNA, 13 bp, Homo sapiens
ttcagcctcctgt

SEQ ID NO: 3635236 - DNA, 14 bp, Homo sapiens
ttcagctaagctag

SEQ ID NO: 3635237 - DNA, 14 bp, Homo sapiens
ttcagctctggaga

SEQ ID NO: 3635238 - DNA, 15 bp, Homo sapiens
ttcagctctggagaa

SEQ ID NO: 3635239 - DNA, 11 bp, Homo sapiens
ttcaggagcct

SEQ ID NO: 3635240 - DNA, 20 bp, Homo sapiens
ttcaggagcctggccaggca

SEQ ID NO: 3635241 - DNA, 20 bp, Homo sapiens
ttcaggattaactaaagaag

SEQ ID NO: 3635242 - DNA, 18 bp, Homo sapiens
ttcaggcagctgaaattc

SEQ ID NO: 3635243 - DNA, 13 bp, Homo sapiens
ttcaggccagccc

SEQ ID NO: 3635244 - DNA, 20 bp, Homo sapiens
ttcaggccagcccagccagg

SEQ ID NO: 3635245 - DNA, 23 bp, Homo sapiens
ttcaggggctagctaagccaaga

SEQ ID NO: 3635246 - DNA, 19 bp, Homo sapiens
ttcagggtggtaaagtatg

SEQ ID NO: 3635247 - DNA, 14 bp, Homo sapiens
ttcaggtctgtatg

SEQ ID NO: 3635248 - DNA, 20 bp, Homo sapiens
ttcaggtctgtatgtcatgg

SEQ ID NO: 3635249 - DNA, 20 bp, Homo sapiens
ttcagtaagttatctttgaa

SEQ ID NO: 3635250 - DNA, 22 bp, Homo sapiens
ttcagtcatagcaagcttttgc

SEQ ID NO: 3635251 - DNA, 15 bp, Homo sapiens
ttcagtcctttgtct

SEQ ID NO: 3635252 - DNA, 20 bp, Homo sapiens
ttcagtcttggtaaaacatt

SEQ ID NO: 3635253 - DNA, 19 bp, Homo sapiens
ttcagtgactcctgctggt

SEQ ID NO: 3635254 - DNA, 19 bp, Homo sapiens
ttcagtgagcccctcccca

SEQ ID NO: 3635255 - DNA, 21 bp, Homo sapiens
ttcagtgagcccctccccagc

SEQ ID NO: 3635256 - DNA, 23 bp, Homo sapiens
ttcagtgcatcattactgttcca

SEQ ID NO: 3635257 - DNA, 15 bp, Homo sapiens
ttcagtgccttcaac

SEQ ID NO: 3635258 - DNA, 20 bp, Homo sapiens
ttcagtgtatggaaataaat

SEQ ID NO: 3635259 - DNA, 14 bp, Homo sapiens
ttcagttctaggcc

SEQ ID NO: 3635260 - DNA, 17 bp, Homo sapiens
ttcagttctaggccttt

SEQ ID NO: 3635261 - DNA, 13 bp, Homo sapiens
ttcagttctattt

SEQ ID NO: 3635262 - DNA, 14 bp, Homo sapiens
ttcataaatcatgt

SEQ ID NO: 3635263 - DNA, 14 bp, Homo sapiens
ttcataaattattt

SEQ ID NO: 3635264 - DNA, 13 bp, Homo sapiens
ttcataacggaaa

SEQ ID NO: 3635265 - DNA, 18 bp, Homo sapiens
ttcataattctgaaacaa

SEQ ID NO: 3635266 - DNA, 14 bp, Homo sapiens
ttcataccttgatg

SEQ ID NO: 3635267 - DNA, 18 bp, Homo sapiens
ttcatagagaatataaaa

SEQ ID NO: 3635268 - DNA, 20 bp, Homo sapiens
ttcataggtaacacattata

SEQ ID NO: 3635269 - DNA, 18 bp, Homo sapiens
ttcatatatgaggacttg

SEQ ID NO: 3635270 - DNA, 18 bp, Homo sapiens
ttcatatttaatttgaag

SEQ ID NO: 3635271 - DNA, 23 bp, Homo sapiens
ttcatcatttcagccaaagtcct

SEQ ID NO: 3635272 - DNA, 14 bp, Homo sapiens
ttcatccatcctga

SEQ ID NO: 3635273 - DNA, 15 bp, Homo sapiens
ttcatccatcctgag

SEQ ID NO: 3635274 - DNA, 21 bp, Homo sapiens
ttcatccatcctgagccaaat

SEQ ID NO: 3635275 - DNA, 13 bp, Homo sapiens
ttcatccattcct

SEQ ID NO: 3635276 - DNA, 17 bp, Homo sapiens
ttcatctaccttttctg

SEQ ID NO: 3635277 - DNA, 19 bp, Homo sapiens
ttcatctaccttttctggc

SEQ ID NO: 3635278 - DNA, 22 bp, Homo sapiens
ttcatcttgcagcatttactat

SEQ ID NO: 3635279 - DNA, 16 bp, Homo sapiens
ttcatctttgccatat

SEQ ID NO: 3635280 - DNA, 13 bp, Homo sapiens
ttcatgcagctgt

SEQ ID NO: 3635281 - DNA, 18 bp, Homo sapiens
ttcatgctatctctgtgt

SEQ ID NO: 3635282 - DNA, 19 bp, Homo sapiens
ttcatggttcaagtattaa

SEQ ID NO: 3635283 - DNA, 22 bp, Homo sapiens
ttcatgtccagtgagcagtgtt

SEQ ID NO: 3635284 - DNA, 16 bp, Homo sapiens
ttcatgtcttgtcata

SEQ ID NO: 3635285 - DNA, 22 bp, Homo sapiens
ttcatgttagttaccttatagt

SEQ ID NO: 3635286 - DNA, 23 bp, Homo sapiens
ttcatgtttggaaaataatttct

SEQ ID NO: 3635287 - DNA, 19 bp, Homo sapiens
ttcattaccctacagacag

SEQ ID NO: 3635288 - DNA, 20 bp, Homo sapiens
ttcattaccctacagacagc

SEQ ID NO: 3635289 - DNA, 19 bp, Homo sapiens
ttcattagttttgaagatt

SEQ ID NO: 3635290 - DNA, 17 bp, Homo sapiens
ttcattctaccaagctg

SEQ ID NO: 3635291 - DNA, 21 bp, Homo sapiens
ttcattctgaaccctccaaag

SEQ ID NO: 3635292 - DNA, 18 bp, Homo sapiens
ttcattctggaggggcag

SEQ ID NO: 3635293 - DNA, 15 bp, Homo sapiens
ttcattctttactgc

SEQ ID NO: 3635294 - DNA, 16 bp, Homo sapiens
ttcattctttactgca

SEQ ID NO: 3635295 - DNA, 19 bp, Homo sapiens
ttcattctttttgaaatgt

SEQ ID NO: 3635296 - DNA, 22 bp, Homo sapiens
ttcattggtactgccttaaaga

SEQ ID NO: 3635297 - DNA, 18 bp, Homo sapiens
ttcatttatctataattt

SEQ ID NO: 3635298 - DNA, 12 bp, Homo sapiens
ttcatttcactg

SEQ ID NO: 3635299 - DNA, 19 bp, Homo sapiens
ttccaaaatattgacattg

SEQ ID NO: 3635300 - DNA, 13 bp, Homo sapiens
ttccaaatgaact

SEQ ID NO: 3635301 - DNA, 16 bp, Homo sapiens
ttccaacatttcttgt

SEQ ID NO: 3635302 - DNA, 15 bp, Homo sapiens
ttccaagaggctgta

SEQ ID NO: 3635303 - DNA, 21 bp, Homo sapiens
ttccaaggctttaaagctgag

SEQ ID NO: 3635304 - DNA, 14 bp, Homo sapiens
ttccaatcactgtg

SEQ ID NO: 3635305 - DNA, 16 bp, Homo sapiens
ttccacacgcattaat

SEQ ID NO: 3635306 - DNA, 20 bp, Homo sapiens
ttccacccacaaactccagg

SEQ ID NO: 3635307 - DNA, 18 bp, Homo sapiens
ttccactaccaaaagaca

SEQ ID NO: 3635308 - DNA, 23 bp, Homo sapiens
ttccactaccaaaagacattaga

SEQ ID NO: 3635309 - DNA, 21 bp, Homo sapiens
ttccacttgagtgtcaagctg

SEQ ID NO: 3635310 - DNA, 13 bp, Homo sapiens
ttccagagagtgg

SEQ ID NO: 3635311 - DNA, 16 bp, Homo sapiens
ttccagctccgtgttt

SEQ ID NO: 3635312 - DNA, 17 bp, Homo sapiens
ttccagctccgtgtttc

SEQ ID NO: 3635313 - DNA, 21 bp, Homo sapiens
ttccagctccgtgtttctcta

SEQ ID NO: 3635314 - DNA, 14 bp, Homo sapiens
ttccagcttgcatt

SEQ ID NO: 3635315 - DNA, 16 bp, Homo sapiens
ttccaggactgtttca

SEQ ID NO: 3635316 - DNA, 23 bp, Homo sapiens
ttccaggactgtttcaaacatgc

SEQ ID NO: 3635317 - DNA, 13 bp, Homo sapiens
ttccagtattgaa

SEQ ID NO: 3635318 - DNA, 15 bp, Homo sapiens
ttccagtattgaaaa

SEQ ID NO: 3635319 - DNA, 18 bp, Homo sapiens
ttccagtattgaaaactt

SEQ ID NO: 3635320 - DNA, 22 bp, Homo sapiens
ttccatattgggaatatgtaga

SEQ ID NO: 3635321 - DNA, 14 bp, Homo sapiens
ttccatcatttctg

SEQ ID NO: 3635322 - DNA, 12 bp, Homo sapiens
ttccatctgaaa

SEQ ID NO: 3635323 - DNA, 17 bp, Homo sapiens
ttccatggcaattttgt

SEQ ID NO: 3635324 - DNA, 16 bp, Homo sapiens
ttccatgtcgcctctg

SEQ ID NO: 3635325 - DNA, 17 bp, Homo sapiens
ttccatgtcgcctctgc

SEQ ID NO: 3635326 - DNA, 13 bp, Homo sapiens
ttccatgtgcctt

SEQ ID NO: 3635327 - DNA, 17 bp, Homo sapiens
ttccatgtgcctttctt

SEQ ID NO: 3635328 - DNA, 22 bp, Homo sapiens
ttccatgttttttcttcaaatg

SEQ ID NO: 3635329 - DNA, 16 bp, Homo sapiens
ttccattacaccacag

SEQ ID NO: 3635330 - DNA, 15 bp, Homo sapiens
ttccattcatggata

SEQ ID NO: 3635331 - DNA, 22 bp, Homo sapiens
ttcccaaatcctagactgctcc

SEQ ID NO: 3635332 - DNA, 15 bp, Homo sapiens
ttcccaactctagct

SEQ ID NO: 3635333 - DNA, 21 bp, Homo sapiens
ttcccacaggagggccagcgc

SEQ ID NO: 3635334 - DNA, 14 bp, Homo sapiens
ttcccactccagct

SEQ ID NO: 3635335 - DNA, 11 bp, Homo sapiens
ttcccagcctg

SEQ ID NO: 3635336 - DNA, 11 bp, Homo sapiens
ttcccaggacc

SEQ ID NO: 3635337 - DNA, 19 bp, Homo sapiens
ttcccaggaccctgaaggg

SEQ ID NO: 3635338 - DNA, 12 bp, Homo sapiens
ttcccagggaga

SEQ ID NO: 3635339 - DNA, 19 bp, Homo sapiens
ttcccattggttcacctgt

SEQ ID NO: 3635340 - DNA, 23 bp, Homo sapiens
ttcccattggttcacctgtgact

SEQ ID NO: 3635341 - DNA, 18 bp, Homo sapiens
ttcccatttctctacact

SEQ ID NO: 3635342 - DNA, 21 bp, Homo sapiens
ttccccaagtaattgtaggaa

SEQ ID NO: 3635343 - DNA, 15 bp, Homo sapiens
ttccccactcccccg

SEQ ID NO: 3635344 - DNA, 15 bp, Homo sapiens
ttccccagtgactcc

SEQ ID NO: 3635345 - DNA, 11 bp, Homo sapiens
ttccccatggg

SEQ ID NO: 3635346 - DNA, 20 bp, Homo sapiens
ttcccccagcaacgcccctc

SEQ ID NO: 3635347 - DNA, 23 bp, Homo sapiens
ttcccccagcaacgcccctccaa

SEQ ID NO: 3635348 - DNA, 16 bp, Homo sapiens
ttcccccaggcgcctg

SEQ ID NO: 3635349 - DNA, 21 bp, Homo sapiens
ttccccccatgttgtaatgct

SEQ ID NO: 3635350 - DNA, 17 bp, Homo sapiens
ttcccccttcacaaagc

SEQ ID NO: 3635351 - DNA, 19 bp, Homo sapiens
ttcccccttcatccatcct

SEQ ID NO: 3635352 - DNA, 16 bp, Homo sapiens
ttcccccttcccattt

SEQ ID NO: 3635353 - DNA, 15 bp, Homo sapiens
ttcccctcccacctc

SEQ ID NO: 3635354 - DNA, 12 bp, Homo sapiens
ttccccttcctg

SEQ ID NO: 3635355 - DNA, 19 bp, Homo sapiens
ttcccgccgcccagcccac

SEQ ID NO: 3635356 - DNA, 22 bp, Homo sapiens
ttcccgctcagccctccctgcc

SEQ ID NO: 3635357 - DNA, 16 bp, Homo sapiens
ttcccgtaaggctgta

SEQ ID NO: 3635358 - DNA, 20 bp, Homo sapiens
ttcccgtaaggctgtacata

SEQ ID NO: 3635359 - DNA, 23 bp, Homo sapiens
ttcccgtaaggctgtacatagtc

SEQ ID NO: 3635360 - DNA, 14 bp, Homo sapiens
ttccctaaactgca

SEQ ID NO: 3635361 - DNA, 15 bp, Homo sapiens
ttccctaaactgcag

SEQ ID NO: 3635362 - DNA, 17 bp, Homo sapiens
ttccctaaactgcagcc

SEQ ID NO: 3635363 - DNA, 17 bp, Homo sapiens
ttccctacttcctgtga

SEQ ID NO: 3635364 - DNA, 19 bp, Homo sapiens
ttccctcccagaggagcca

SEQ ID NO: 3635365 - DNA, 13 bp, Homo sapiens
ttccctccccctc

SEQ ID NO: 3635366 - DNA, 15 bp, Homo sapiens
ttccctccccctcct

SEQ ID NO: 3635367 - DNA, 20 bp, Homo sapiens
ttccctgacctcccaactct

SEQ ID NO: 3635368 - DNA, 13 bp, Homo sapiens
ttccctgccaggc

SEQ ID NO: 3635369 - DNA, 12 bp, Homo sapiens
ttccctgcccaa

SEQ ID NO: 3635370 - DNA, 12 bp, Homo sapiens
ttccctgctgaa

SEQ ID NO: 3635371 - DNA, 22 bp, Homo sapiens
ttccctggaaaccttccaccca

SEQ ID NO: 3635372 - DNA, 15 bp, Homo sapiens
ttccctgttctccct

SEQ ID NO: 3635373 - DNA, 18 bp, Homo sapiens
ttccctgttctccctttc

SEQ ID NO: 3635374 - DNA, 14 bp, Homo sapiens
ttcccttacaaggt

SEQ ID NO: 3635375 - DNA, 18 bp, Homo sapiens
ttccgcccactcctggga

SEQ ID NO: 3635376 - DNA, 19 bp, Homo sapiens
ttccgctttgaaagaagca

SEQ ID NO: 3635377 - DNA, 14 bp, Homo sapiens
ttcctaaggctgca

SEQ ID NO: 3635378 - DNA, 17 bp, Homo sapiens
ttcctactgcgcctcgt

SEQ ID NO: 3635379 - DNA, 22 bp, Homo sapiens
ttcctagctaggagcaggcttg

SEQ ID NO: 3635380 - DNA, 18 bp, Homo sapiens
ttcctagttttctcctcc

SEQ ID NO: 3635381 - DNA, 15 bp, Homo sapiens
ttcctatttatttga

SEQ ID NO: 3635382 - DNA, 21 bp, Homo sapiens
ttcctccagcctcccctcccc

SEQ ID NO: 3635383 - DNA, 18 bp, Homo sapiens
ttcctcctcccaaggcat

SEQ ID NO: 3635384 - DNA, 23 bp, Homo sapiens
ttcctcctcccaaggcattctcc

SEQ ID NO: 3635385 - DNA, 15 bp, Homo sapiens
ttcctcctttacctt

SEQ ID NO: 3635386 - DNA, 14 bp, Homo sapiens
ttcctctccactgc

SEQ ID NO: 3635387 - DNA, 19 bp, Homo sapiens
ttcctctccactgccttcg

SEQ ID NO: 3635388 - DNA, 14 bp, Homo sapiens
ttcctctttgcttt

SEQ ID NO: 3635389 - DNA, 16 bp, Homo sapiens
ttcctctttgctttgc

SEQ ID NO: 3635390 - DNA, 12 bp, Homo sapiens
ttcctgaaatgt

SEQ ID NO: 3635391 - DNA, 18 bp, Homo sapiens
ttcctgaagctgctgtgt

SEQ ID NO: 3635392 - DNA, 18 bp, Homo sapiens
ttcctgagctggcctgtc

SEQ ID NO: 3635393 - DNA, 13 bp, Homo sapiens
ttcctgagggcta

SEQ ID NO: 3635394 - DNA, 21 bp, Homo sapiens
ttcctgcaggccaggccagct

SEQ ID NO: 3635395 - DNA, 15 bp, Homo sapiens
ttcctgcatttgtga

SEQ ID NO: 3635396 - DNA, 16 bp, Homo sapiens
ttcctgcatttgtgaa

SEQ ID NO: 3635397 - DNA, 17 bp, Homo sapiens
ttcctggaaacagcatg

SEQ ID NO: 3635398 - DNA, 19 bp, Homo sapiens
ttcctggaaacagcatgaa

SEQ ID NO: 3635399 - DNA, 22 bp, Homo sapiens
ttcctggcacaatgttggagca

SEQ ID NO: 3635400 - DNA, 15 bp, Homo sapiens
ttcctggcagctgct

SEQ ID NO: 3635401 - DNA, 16 bp, Homo sapiens
ttcctggcagctgctg

SEQ ID NO: 3635402 - DNA, 15 bp, Homo sapiens
ttcctggtgactcct

SEQ ID NO: 3635403 - DNA, 16 bp, Homo sapiens
ttcctggtgactcctg

SEQ ID NO: 3635404 - DNA, 21 bp, Homo sapiens
ttcctgtgtgaccctgggcag

SEQ ID NO: 3635405 - DNA, 19 bp, Homo sapiens
ttccttaagtatatcatgt

SEQ ID NO: 3635406 - DNA, 23 bp, Homo sapiens
ttccttaggtttttttccttctg

SEQ ID NO: 3635407 - DNA, 15 bp, Homo sapiens
ttccttatccctctc

SEQ ID NO: 3635408 - DNA, 17 bp, Homo sapiens
ttccttatccctctctt

SEQ ID NO: 3635409 - DNA, 14 bp, Homo sapiens
ttccttctctgggt

SEQ ID NO: 3635410 - DNA, 17 bp, Homo sapiens
ttccttggactcatttt

SEQ ID NO: 3635411 - DNA, 22 bp, Homo sapiens
ttccttttaaaacacttccata

SEQ ID NO: 3635412 - DNA, 15 bp, Homo sapiens
ttccttttcaggaga

SEQ ID NO: 3635413 - DNA, 18 bp, Homo sapiens
ttccttttcaggagatgg

SEQ ID NO: 3635414 - DNA, 20 bp, Homo sapiens
ttccttttgaacgccccccc

SEQ ID NO: 3635415 - DNA, 14 bp, Homo sapiens
ttcctttttcttcg

SEQ ID NO: 3635416 - DNA, 16 bp, Homo sapiens
ttcctttttcttcgct

SEQ ID NO: 3635417 - DNA, 22 bp, Homo sapiens
ttcgaatcttaatttattattt

SEQ ID NO: 3635418 - DNA, 17 bp, Homo sapiens
ttcgactggtccagctc

SEQ ID NO: 3635419 - DNA, 22 bp, Homo sapiens
ttcgactggtccagctctgaca

SEQ ID NO: 3635420 - DNA, 14 bp, Homo sapiens
ttcgagaccagcct

SEQ ID NO: 3635421 - DNA, 20 bp, Homo sapiens
ttcgagacccaaacccccaa

SEQ ID NO: 3635422 - DNA, 18 bp, Homo sapiens
ttcgatatttattgatgt

SEQ ID NO: 3635423 - DNA, 17 bp, Homo sapiens
ttcggacagacatatgg

SEQ ID NO: 3635424 - DNA, 16 bp, Homo sapiens
ttcgggagccttgtca

SEQ ID NO: 3635425 - DNA, 13 bp, Homo sapiens
ttcgggctgtgcc

SEQ ID NO: 3635426 - DNA, 14 bp, Homo sapiens
ttcgggctgtgccc

SEQ ID NO: 3635427 - DNA, 15 bp, Homo sapiens
ttcggtacccaccac

SEQ ID NO: 3635428 - DNA, 15 bp, Homo sapiens
ttcgtgagctgggga

SEQ ID NO: 3635429 - DNA, 15 bp, Homo sapiens
ttcgtgatgacatat

SEQ ID NO: 3635430 - DNA, 16 bp, Homo sapiens
ttcgtgatgacatatc

SEQ ID NO: 3635431 - DNA, 19 bp, Homo sapiens
ttcgtgctgtgctctggca

SEQ ID NO: 3635432 - DNA, 15 bp, Homo sapiens
ttctaaaagtttcta

SEQ ID NO: 3635433 - DNA, 15 bp, Homo sapiens
ttctaaaatctaaaa

SEQ ID NO: 3635434 - DNA, 19 bp, Homo sapiens
ttctaaaatgttaaaacat

SEQ ID NO: 3635435 - DNA, 20 bp, Homo sapiens
ttctaaaatgttaaaacata

SEQ ID NO: 3635436 - DNA, 15 bp, Homo sapiens
ttctaaagatggaaa

SEQ ID NO: 3635437 - DNA, 20 bp, Homo sapiens
ttctaaaggtgttgtccctt

SEQ ID NO: 3635438 - DNA, 22 bp, Homo sapiens
ttctaaaggtgttgtcccttct

SEQ ID NO: 3635439 - DNA, 22 bp, Homo sapiens
ttctaaatatcccttggacatt

SEQ ID NO: 3635440 - DNA, 14 bp, Homo sapiens
ttctaacaagtcat

SEQ ID NO: 3635441 - DNA, 23 bp, Homo sapiens
ttctaacagatcagaacatgaaa

SEQ ID NO: 3635442 - DNA, 15 bp, Homo sapiens
ttctaagtaaaacca

SEQ ID NO: 3635443 - DNA, 17 bp, Homo sapiens
ttctaagtaaaaccaca

SEQ ID NO: 3635444 - DNA, 20 bp, Homo sapiens
ttctaagtaaaaccacagca

SEQ ID NO: 3635445 - DNA, 16 bp, Homo sapiens
ttctaatagtttttca

SEQ ID NO: 3635446 - DNA, 15 bp, Homo sapiens
ttctaatccttttcc

SEQ ID NO: 3635447 - DNA, 14 bp, Homo sapiens
ttctaatgttattt

SEQ ID NO: 3635448 - DNA, 21 bp, Homo sapiens
ttctaatgttattttccttct

SEQ ID NO: 3635449 - DNA, 14 bp, Homo sapiens
ttctaccaagctgt

SEQ ID NO: 3635450 - DNA, 15 bp, Homo sapiens
ttctaccatttcaga

SEQ ID NO: 3635451 - DNA, 22 bp, Homo sapiens
ttctaccgtggatttgtacttg

SEQ ID NO: 3635452 - DNA, 12 bp, Homo sapiens
ttctactcccct

SEQ ID NO: 3635453 - DNA, 13 bp, Homo sapiens
ttctactcctgcc

SEQ ID NO: 3635454 - DNA, 16 bp, Homo sapiens
ttctactcctgcctca

SEQ ID NO: 3635455 - DNA, 22 bp, Homo sapiens
ttctagaaagagaaacagttgg

SEQ ID NO: 3635456 - DNA, 15 bp, Homo sapiens
ttctaggcatacttt

SEQ ID NO: 3635457 - DNA, 19 bp, Homo sapiens
ttctaggcctttcctctgc

SEQ ID NO: 3635458 - DNA, 20 bp, Homo sapiens
ttctaggcctttcctctgca

SEQ ID NO: 3635459 - DNA, 16 bp, Homo sapiens
ttctagggacatgaaa

SEQ ID NO: 3635460 - DNA, 19 bp, Homo sapiens
ttctagtacctgtgactct

SEQ ID NO: 3635461 - DNA, 14 bp, Homo sapiens
ttctagtttctctt

SEQ ID NO: 3635462 - DNA, 13 bp, Homo sapiens
ttctatacagtag

SEQ ID NO: 3635463 - DNA, 18 bp, Homo sapiens
ttctatattcctccagct

SEQ ID NO: 3635464 - DNA, 22 bp, Homo sapiens
ttctattaatcaagagaaactt

SEQ ID NO: 3635465 - DNA, 13 bp, Homo sapiens
ttctattctccag

SEQ ID NO: 3635466 - DNA, 14 bp, Homo sapiens
ttctatttatttgt

SEQ ID NO: 3635467 - DNA, 16 bp, Homo sapiens
ttctatttcttgaaga

SEQ ID NO: 3635468 - DNA, 18 bp, Homo sapiens
ttctatttcttgaagaat

SEQ ID NO: 3635469 - DNA, 13 bp, Homo sapiens
ttctattttctat

SEQ ID NO: 3635470 - DNA, 13 bp, Homo sapiens
ttctattttgtaa

SEQ ID NO: 3635471 - DNA, 16 bp, Homo sapiens
ttctattttgtaaact

SEQ ID NO: 3635472 - DNA, 15 bp, Homo sapiens
ttctcaaatctgctt

SEQ ID NO: 3635473 - DNA, 14 bp, Homo sapiens
ttctcaaatgctgg

SEQ ID NO: 3635474 - DNA, 14 bp, Homo sapiens
ttctcactcaccac

SEQ ID NO: 3635475 - DNA, 18 bp, Homo sapiens
ttctcactgaactccacc

SEQ ID NO: 3635476 - DNA, 15 bp, Homo sapiens
ttctcagatttctga

SEQ ID NO: 3635477 - DNA, 12 bp, Homo sapiens
ttctcagggctg

SEQ ID NO: 3635478 - DNA, 22 bp, Homo sapiens
ttctcatgttgaaactttaaga

SEQ ID NO: 3635479 - DNA, 13 bp, Homo sapiens
ttctcattgctct

SEQ ID NO: 3635480 - DNA, 12 bp, Homo sapiens
ttctccactgga

SEQ ID NO: 3635481 - DNA, 16 bp, Homo sapiens
ttctccatggagccta

SEQ ID NO: 3635482 - DNA, 19 bp, Homo sapiens
ttctccatggagcctacct

SEQ ID NO: 3635483 - DNA, 15 bp, Homo sapiens
ttctcccaagaaacc

SEQ ID NO: 3635484 - DNA, 17 bp, Homo sapiens
ttctcccaagaaacctg

SEQ ID NO: 3635485 - DNA, 21 bp, Homo sapiens
ttctcccagtgtgagacccca

SEQ ID NO: 3635486 - DNA, 13 bp, Homo sapiens
ttctcccctccct

SEQ ID NO: 3635487 - DNA, 16 bp, Homo sapiens
ttctcccctccctcca

SEQ ID NO: 3635488 - DNA, 19 bp, Homo sapiens
ttctccctttctctctcct

SEQ ID NO: 3635489 - DNA, 18 bp, Homo sapiens
ttctcctcactgtatcca

SEQ ID NO: 3635490 - DNA, 13 bp, Homo sapiens
ttctcctcccagg

SEQ ID NO: 3635491 - DNA, 17 bp, Homo sapiens
ttctccttctccttccc

SEQ ID NO: 3635492 - DNA, 17 bp, Homo sapiens
ttctcctttgtactttg

SEQ ID NO: 3635493 - DNA, 13 bp, Homo sapiens
ttctctaaggaat

SEQ ID NO: 3635494 - DNA, 21 bp, Homo sapiens
ttctctaattcttcctttgta

SEQ ID NO: 3635495 - DNA, 18 bp, Homo sapiens
ttctctagtcatttgtta

SEQ ID NO: 3635496 - DNA, 12 bp, Homo sapiens
ttctctcagtga

SEQ ID NO: 3635497 - DNA, 15 bp, Homo sapiens
ttctctctccagggt

SEQ ID NO: 3635498 - DNA, 14 bp, Homo sapiens
ttctctctcctctc

SEQ ID NO: 3635499 - DNA, 15 bp, Homo sapiens
ttctctcttgttgtc

SEQ ID NO: 3635500 - DNA, 16 bp, Homo sapiens
ttctctgaggacaaga

SEQ ID NO: 3635501 - DNA, 20 bp, Homo sapiens
ttctctgaggacaagagaaa

SEQ ID NO: 3635502 - DNA, 14 bp, Homo sapiens
ttctctgcctcacc

SEQ ID NO: 3635503 - DNA, 18 bp, Homo sapiens
ttctctgtggcaaagcag

SEQ ID NO: 3635504 - DNA, 18 bp, Homo sapiens
ttctcttccccttcctgt

SEQ ID NO: 3635505 - DNA, 18 bp, Homo sapiens
ttctcttccttttatata

SEQ ID NO: 3635506 - DNA, 18 bp, Homo sapiens
ttctcttgagtcacactg

SEQ ID NO: 3635507 - DNA, 14 bp, Homo sapiens
ttctcttgctttct

SEQ ID NO: 3635508 - DNA, 15 bp, Homo sapiens
ttctcttttcctttg

SEQ ID NO: 3635509 - DNA, 15 bp, Homo sapiens
ttctgaataaagcaa

SEQ ID NO: 3635510 - DNA, 16 bp, Homo sapiens
ttctgaataaagcaat

SEQ ID NO: 3635511 - DNA, 15 bp, Homo sapiens
ttctgaataacttga

SEQ ID NO: 3635512 - DNA, 22 bp, Homo sapiens
ttctgaatattttatctttcct

SEQ ID NO: 3635513 - DNA, 16 bp, Homo sapiens
ttctgagaaagactat

SEQ ID NO: 3635514 - DNA, 21 bp, Homo sapiens
ttctgagaaagactattcaaa

SEQ ID NO: 3635515 - DNA, 15 bp, Homo sapiens
ttctgaggtccttat

SEQ ID NO: 3635516 - DNA, 13 bp, Homo sapiens
ttctgattctgat

SEQ ID NO: 3635517 - DNA, 20 bp, Homo sapiens
ttctgattctgattgctatc

SEQ ID NO: 3635518 - DNA, 16 bp, Homo sapiens
ttctgcatcagctgct

SEQ ID NO: 3635519 - DNA, 23 bp, Homo sapiens
ttctgcatcagctgctgaaacaa

SEQ ID NO: 3635520 - DNA, 20 bp, Homo sapiens
ttctgccaataaattctaaa

SEQ ID NO: 3635521 - DNA, 16 bp, Homo sapiens
ttctgcctagagtgta

SEQ ID NO: 3635522 - DNA, 20 bp, Homo sapiens
ttctgcctagagtgtagcct

SEQ ID NO: 3635523 - DNA, 15 bp, Homo sapiens
ttctgcgctgtgtac

SEQ ID NO: 3635524 - DNA, 20 bp, Homo sapiens
ttctgcgctgtgtacaatgt

SEQ ID NO: 3635525 - DNA, 19 bp, Homo sapiens
ttctgctactggcaaaagg

SEQ ID NO: 3635526 - DNA, 23 bp, Homo sapiens
ttctgctctggaataaagttgca

SEQ ID NO: 3635527 - DNA, 21 bp, Homo sapiens
ttctgctgaaagactcgagaa

SEQ ID NO: 3635528 - DNA, 15 bp, Homo sapiens
ttctgctttaaaaat

SEQ ID NO: 3635529 - DNA, 19 bp, Homo sapiens
ttctggaatacatgaaata

SEQ ID NO: 3635530 - DNA, 22 bp, Homo sapiens
ttctggagatggaagcttgttg

SEQ ID NO: 3635531 - DNA, 15 bp, Homo sapiens
ttctggcaaacgttt

SEQ ID NO: 3635532 - DNA, 18 bp, Homo sapiens
ttctggcgcccctgcctg

SEQ ID NO: 3635533 - DNA, 20 bp, Homo sapiens
ttctgggagttgctgttaat

SEQ ID NO: 3635534 - DNA, 22 bp, Homo sapiens
ttctggggggagaaaaaaaaag

SEQ ID NO: 3635535 - DNA, 19 bp, Homo sapiens
ttctggttgtttttaaaca

SEQ ID NO: 3635536 - DNA, 11 bp, Homo sapiens
ttctgtaccag

SEQ ID NO: 3635537 - DNA, 13 bp, Homo sapiens
ttctgtaccagtt

SEQ ID NO: 3635538 - DNA, 21 bp, Homo sapiens
ttctgtaccagttaatttttc

SEQ ID NO: 3635539 - DNA, 13 bp, Homo sapiens
ttctgtctgggga

SEQ ID NO: 3635540 - DNA, 17 bp, Homo sapiens
ttctgtcttcacaacag

SEQ ID NO: 3635541 - DNA, 20 bp, Homo sapiens
ttctgtgctaatcaaaactt

SEQ ID NO: 3635542 - DNA, 22 bp, Homo sapiens
ttctgtgtaccacttcctgagg

SEQ ID NO: 3635543 - DNA, 14 bp, Homo sapiens
ttctgtttaatttt

SEQ ID NO: 3635544 - DNA, 19 bp, Homo sapiens
ttctgtttaattttcactt

SEQ ID NO: 3635545 - DNA, 16 bp, Homo sapiens
ttcttaaaagtttcta

SEQ ID NO: 3635546 - DNA, 12 bp, Homo sapiens
ttcttaaaatgt

SEQ ID NO: 3635547 - DNA, 17 bp, Homo sapiens
ttcttaacttcttgctt

SEQ ID NO: 3635548 - DNA, 16 bp, Homo sapiens
ttcttaagaaatgcca

SEQ ID NO: 3635549 - DNA, 18 bp, Homo sapiens
ttcttaagaaatgccagt

SEQ ID NO: 3635550 - DNA, 13 bp, Homo sapiens
ttcttagagtgta

SEQ ID NO: 3635551 - DNA, 22 bp, Homo sapiens
ttcttagagtgtagctgtaagg

SEQ ID NO: 3635552 - DNA, 17 bp, Homo sapiens
ttcttagcaataaatgc

SEQ ID NO: 3635553 - DNA, 23 bp, Homo sapiens
ttcttagggattaaatatagatg

SEQ ID NO: 3635554 - DNA, 16 bp, Homo sapiens
ttcttatgcaaaatgg

SEQ ID NO: 3635555 - DNA, 17 bp, Homo sapiens
ttcttatgcaaaatgga

SEQ ID NO: 3635556 - DNA, 19 bp, Homo sapiens
ttcttattttgtaataaac

SEQ ID NO: 3635557 - DNA, 21 bp, Homo sapiens
ttcttattttgtaataaactc

SEQ ID NO: 3635558 - DNA, 22 bp, Homo sapiens
ttcttattttgtaataaactct

SEQ ID NO: 3635559 - DNA, 18 bp, Homo sapiens
ttcttcagcgtaaaatgg

SEQ ID NO: 3635560 - DNA, 18 bp, Homo sapiens
ttcttcagtcctttgtct

SEQ ID NO: 3635561 - DNA, 19 bp, Homo sapiens
ttcttccattccttcatgt

SEQ ID NO: 3635562 - DNA, 21 bp, Homo sapiens
ttcttccctgctttgcatctt

SEQ ID NO: 3635563 - DNA, 21 bp, Homo sapiens
ttcttccttttcactgctgtt

SEQ ID NO: 3635564 - DNA, 21 bp, Homo sapiens
ttcttcgctggactattgtgc

SEQ ID NO: 3635565 - DNA, 17 bp, Homo sapiens
ttcttctatagtgatga

SEQ ID NO: 3635566 - DNA, 13 bp, Homo sapiens
ttcttctgaagat

SEQ ID NO: 3635567 - DNA, 19 bp, Homo sapiens
ttcttctgaagattcttaa

SEQ ID NO: 3635568 - DNA, 19 bp, Homo sapiens
ttcttgctgccatgatgta

SEQ ID NO: 3635569 - DNA, 12 bp, Homo sapiens
ttcttgctgctt

SEQ ID NO: 3635570 - DNA, 18 bp, Homo sapiens
ttctttagcttacctggg

SEQ ID NO: 3635571 - DNA, 19 bp, Homo sapiens
ttctttagcttacctgggc

SEQ ID NO: 3635572 - DNA, 16 bp, Homo sapiens
ttctttcacccatcct

SEQ ID NO: 3635573 - DNA, 19 bp, Homo sapiens
ttctttccaaaacatttct

SEQ ID NO: 3635574 - DNA, 19 bp, Homo sapiens
ttctttcctccccctgcaa

SEQ ID NO: 3635575 - DNA, 18 bp, Homo sapiens
ttctttcctttactcctg

SEQ ID NO: 3635576 - DNA, 12 bp, Homo sapiens
ttctttctagaa

SEQ ID NO: 3635577 - DNA, 13 bp, Homo sapiens
ttctttctagaaa

SEQ ID NO: 3635578 - DNA, 17 bp, Homo sapiens
ttctttctccatggagc

SEQ ID NO: 3635579 - DNA, 21 bp, Homo sapiens
ttctttctgctctatactgtg

SEQ ID NO: 3635580 - DNA, 15 bp, Homo sapiens
ttctttcttcctctg

SEQ ID NO: 3635581 - DNA, 13 bp, Homo sapiens
ttctttgaataaa

SEQ ID NO: 3635582 - DNA, 14 bp, Homo sapiens
ttctttgaataaat

SEQ ID NO: 3635583 - DNA, 13 bp, Homo sapiens
ttctttgaattta

SEQ ID NO: 3635584 - DNA, 22 bp, Homo sapiens
ttctttgcaccaaagacatcag

SEQ ID NO: 3635585 - DNA, 13 bp, Homo sapiens
ttctttgcctctg

SEQ ID NO: 3635586 - DNA, 13 bp, Homo sapiens
ttctttgctgccc

SEQ ID NO: 3635587 - DNA, 17 bp, Homo sapiens
ttctttgctgcccctgt

SEQ ID NO: 3635588 - DNA, 12 bp, Homo sapiens
ttctttggctgc

SEQ ID NO: 3635589 - DNA, 13 bp, Homo sapiens
ttcttttcacatt

SEQ ID NO: 3635590 - DNA, 15 bp, Homo sapiens
ttcttttgattttgt

SEQ ID NO: 3635591 - DNA, 15 bp, Homo sapiens
ttctttttgaaatgt

SEQ ID NO: 3635592 - DNA, 15 bp, Homo sapiens
ttgaaaaaaacttca

SEQ ID NO: 3635593 - DNA, 13 bp, Homo sapiens
ttgaaaagaaaga

SEQ ID NO: 3635594 - DNA, 22 bp, Homo sapiens
ttgaaaagactccaaagaaatg

SEQ ID NO: 3635595 - DNA, 13 bp, Homo sapiens
ttgaaacagaaaa

SEQ ID NO: 3635596 - DNA, 16 bp, Homo sapiens
ttgaaagaatgtaaag

SEQ ID NO: 3635597 - DNA, 15 bp, Homo sapiens
ttgaaagttctggaa

SEQ ID NO: 3635598 - DNA, 23 bp, Homo sapiens
ttgaaagttttccagtattgaaa

SEQ ID NO: 3635599 - DNA, 12 bp, Homo sapiens
ttgaaatacctt

SEQ ID NO: 3635600 - DNA, 21 bp, Homo sapiens
ttgaaatatggtcttttggtt

SEQ ID NO: 3635601 - DNA, 20 bp, Homo sapiens
ttgaaatgaggtctgtttaa

SEQ ID NO: 3635602 - DNA, 14 bp, Homo sapiens
ttgaaatgatttca

SEQ ID NO: 3635603 - DNA, 12 bp, Homo sapiens
ttgaacctggga

SEQ ID NO: 3635604 - DNA, 18 bp, Homo sapiens
ttgaacctgggaggcaga

SEQ ID NO: 3635605 - DNA, 14 bp, Homo sapiens
ttgaagaaggcaag

SEQ ID NO: 3635606 - DNA, 15 bp, Homo sapiens
ttgaagggccagagc

SEQ ID NO: 3635607 - DNA, 17 bp, Homo sapiens
ttgaagggccagagcca

SEQ ID NO: 3635608 - DNA, 15 bp, Homo sapiens
ttgaaggtagaatgt

SEQ ID NO: 3635609 - DNA, 15 bp, Homo sapiens
ttgaatataatagat

SEQ ID NO: 3635610 - DNA, 22 bp, Homo sapiens
ttgaatatctttcgataaacaa

SEQ ID NO: 3635611 - DNA, 18 bp, Homo sapiens
ttgaatctatttcactta

SEQ ID NO: 3635612 - DNA, 16 bp, Homo sapiens
ttgaatgcagaaaaca

SEQ ID NO: 3635613 - DNA, 23 bp, Homo sapiens
ttgaatggtttttcttttcttta

SEQ ID NO: 3635614 - DNA, 23 bp, Homo sapiens
ttgaatttatttttaagaaagaa

SEQ ID NO: 3635615 - DNA, 16 bp, Homo sapiens
ttgacactgctctaac

SEQ ID NO: 3635616 - DNA, 13 bp, Homo sapiens
ttgacagcaattc

SEQ ID NO: 3635617 - DNA, 14 bp, Homo sapiens
ttgacagctttgct

SEQ ID NO: 3635618 - DNA, 18 bp, Homo sapiens
ttgaccaacagaaacctt

SEQ ID NO: 3635619 - DNA, 20 bp, Homo sapiens
ttgaccagtttaagccgcag

SEQ ID NO: 3635620 - DNA, 23 bp, Homo sapiens
ttgacgagtgtgaagcttccttg

SEQ ID NO: 3635621 - DNA, 14 bp, Homo sapiens
ttgactgtcagcaa

SEQ ID NO: 3635622 - DNA, 11 bp, Homo sapiens
ttgagaaaaat

SEQ ID NO: 3635623 - DNA, 17 bp, Homo sapiens
ttgagagaagagacaaa

SEQ ID NO: 3635624 - DNA, 23 bp, Homo sapiens
ttgagattcaagacaagagctgt

SEQ ID NO: 3635625 - DNA, 17 bp, Homo sapiens
ttgagcaaataaactta

SEQ ID NO: 3635626 - DNA, 15 bp, Homo sapiens
ttgaggtcagtgttt

SEQ ID NO: 3635627 - DNA, 19 bp, Homo sapiens
ttgagtataagaaatgcat

SEQ ID NO: 3635628 - DNA, 18 bp, Homo sapiens
ttgagttaacaggacagt

SEQ ID NO: 3635629 - DNA, 14 bp, Homo sapiens
ttgataattttcct

SEQ ID NO: 3635630 - DNA, 17 bp, Homo sapiens
ttgataattttccttta

SEQ ID NO: 3635631 - DNA, 17 bp, Homo sapiens
ttgatagtgatgtattt

SEQ ID NO: 3635632 - DNA, 14 bp, Homo sapiens
ttgatattgaagga

SEQ ID NO: 3635633 - DNA, 23 bp, Homo sapiens
ttgatatttgcattgaggaaata

SEQ ID NO: 3635634 - DNA, 22 bp, Homo sapiens
ttgatattttcaacgcagccct

SEQ ID NO: 3635635 - DNA, 20 bp, Homo sapiens
ttgatcgcctctttgacatt

SEQ ID NO: 3635636 - DNA, 12 bp, Homo sapiens
ttgatctctctt

SEQ ID NO: 3635637 - DNA, 13 bp, Homo sapiens
ttgatctctcttg

SEQ ID NO: 3635638 - DNA, 22 bp, Homo sapiens
ttgatctctcttgtcctcttct

SEQ ID NO: 3635639 - DNA, 13 bp, Homo sapiens
ttgatctgttttg

SEQ ID NO: 3635640 - DNA, 14 bp, Homo sapiens
ttgatggaaaataa

SEQ ID NO: 3635641 - DNA, 15 bp, Homo sapiens
ttgatggaaaataaa

SEQ ID NO: 3635642 - DNA, 15 bp, Homo sapiens
ttgatggagccccag

SEQ ID NO: 3635643 - DNA, 17 bp, Homo sapiens
ttgatggagccccaggg

SEQ ID NO: 3635644 - DNA, 14 bp, Homo sapiens
ttgatgtaaagatg

SEQ ID NO: 3635645 - DNA, 20 bp, Homo sapiens
ttgatgtacataactcctgt

SEQ ID NO: 3635646 - DNA, 13 bp, Homo sapiens
ttgattaaagatg

SEQ ID NO: 3635647 - DNA, 19 bp, Homo sapiens
ttgattaaccttttcaaat

SEQ ID NO: 3635648 - DNA, 21 bp, Homo sapiens
ttgattaaccttttcaaatta

SEQ ID NO: 3635649 - DNA, 23 bp, Homo sapiens
ttgatttccgtgaactctggtgc

SEQ ID NO: 3635650 - DNA, 13 bp, Homo sapiens
ttgatttgagatt

SEQ ID NO: 3635651 - DNA, 21 bp, Homo sapiens
ttgcaaataaaacgctttccc

SEQ ID NO: 3635652 - DNA, 16 bp, Homo sapiens
ttgcaatctaatctga

SEQ ID NO: 3635653 - DNA, 17 bp, Homo sapiens
ttgcaatctaatctgaa

SEQ ID NO: 3635654 - DNA, 19 bp, Homo sapiens
ttgcaatctaatctgaact

SEQ ID NO: 3635655 - DNA, 23 bp, Homo sapiens
ttgcacactctcccattatattt

SEQ ID NO: 3635656 - DNA, 18 bp, Homo sapiens
ttgcacctatctcagcca

SEQ ID NO: 3635657 - DNA, 17 bp, Homo sapiens
ttgcactaaaatgagga

SEQ ID NO: 3635658 - DNA, 14 bp, Homo sapiens
ttgcactgaacagg

SEQ ID NO: 3635659 - DNA, 12 bp, Homo sapiens
ttgcactgaagt

SEQ ID NO: 3635660 - DNA, 18 bp, Homo sapiens
ttgcactgaagtttttga

SEQ ID NO: 3635661 - DNA, 22 bp, Homo sapiens
ttgcacttctaagactttactt

SEQ ID NO: 3635662 - DNA, 21 bp, Homo sapiens
ttgcagaaggcaaggccctgc

SEQ ID NO: 3635663 - DNA, 11 bp, Homo sapiens
ttgcagaggct

SEQ ID NO: 3635664 - DNA, 15 bp, Homo sapiens
ttgcagatattctct

SEQ ID NO: 3635665 - DNA, 19 bp, Homo sapiens
ttgcagatggaaagaggtg

SEQ ID NO: 3635666 - DNA, 17 bp, Homo sapiens
ttgcagcacagctgaga

SEQ ID NO: 3635667 - DNA, 18 bp, Homo sapiens
ttgcagcatttactatgc

SEQ ID NO: 3635668 - DNA, 20 bp, Homo sapiens
ttgcagccgcagagaaatgc

SEQ ID NO: 3635669 - DNA, 18 bp, Homo sapiens
ttgcagcctcaaccaaca

SEQ ID NO: 3635670 - DNA, 15 bp, Homo sapiens
ttgcagcggctcctg

SEQ ID NO: 3635671 - DNA, 19 bp, Homo sapiens
ttgcataggctcttaagca

SEQ ID NO: 3635672 - DNA, 19 bp, Homo sapiens
ttgcatattataaaggata

SEQ ID NO: 3635673 - DNA, 22 bp, Homo sapiens
ttgcatattttgagaaactgct

SEQ ID NO: 3635674 - DNA, 17 bp, Homo sapiens
ttgccaaaacccagctg

SEQ ID NO: 3635675 - DNA, 21 bp, Homo sapiens
ttgccaaaacccagctgcacc

SEQ ID NO: 3635676 - DNA, 19 bp, Homo sapiens
ttgccaaggctctcccctc

SEQ ID NO: 3635677 - DNA, 11 bp, Homo sapiens
ttgccaataaa

SEQ ID NO: 3635678 - DNA, 20 bp, Homo sapiens
ttgccaataaagcttttgga

SEQ ID NO: 3635679 - DNA, 19 bp, Homo sapiens
ttgccaatctaaaatggca

SEQ ID NO: 3635680 - DNA, 20 bp, Homo sapiens
ttgccacaagtccagctggg

SEQ ID NO: 3635681 - DNA, 15 bp, Homo sapiens
ttgccactgcctctt

SEQ ID NO: 3635682 - DNA, 17 bp, Homo sapiens
ttgccagcaaataaata

SEQ ID NO: 3635683 - DNA, 15 bp, Homo sapiens
ttgccagcccatttg

SEQ ID NO: 3635684 - DNA, 17 bp, Homo sapiens
ttgccagttttccctgg

SEQ ID NO: 3635685 - DNA, 15 bp, Homo sapiens
ttgccagttttccga

SEQ ID NO: 3635686 - DNA, 17 bp, Homo sapiens
ttgccatctctgctcca

SEQ ID NO: 3635687 - DNA, 18 bp, Homo sapiens
ttgcccacaccgagggcg

SEQ ID NO: 3635688 - DNA, 17 bp, Homo sapiens
ttgcccctggctttgcc

SEQ ID NO: 3635689 - DNA, 19 bp, Homo sapiens
ttgcccctggctttgcctc

SEQ ID NO: 3635690 - DNA, 18 bp, Homo sapiens
ttgcctaaatttaatgct

SEQ ID NO: 3635691 - DNA, 12 bp, Homo sapiens
ttgcctatgata

SEQ ID NO: 3635692 - DNA, 12 bp, Homo sapiens
ttgcctctactt

SEQ ID NO: 3635693 - DNA, 19 bp, Homo sapiens
ttgcctctgcagtctcatt

SEQ ID NO: 3635694 - DNA, 14 bp, Homo sapiens
ttgcctctgccctg

SEQ ID NO: 3635695 - DNA, 15 bp, Homo sapiens
ttgcctctgccctgg

SEQ ID NO: 3635696 - DNA, 19 bp, Homo sapiens
ttgcctctgccctggattg

SEQ ID NO: 3635697 - DNA, 18 bp, Homo sapiens
ttgcctgagaaggggcag

SEQ ID NO: 3635698 - DNA, 15 bp, Homo sapiens
ttgcctgaggctgta

SEQ ID NO: 3635699 - DNA, 20 bp, Homo sapiens
ttgccttccatttcccctct

SEQ ID NO: 3635700 - DNA, 18 bp, Homo sapiens
ttgccttctactcccctt

SEQ ID NO: 3635701 - DNA, 17 bp, Homo sapiens
ttgccttttatgtaaat

SEQ ID NO: 3635702 - DNA, 15 bp, Homo sapiens
ttgcgcctaatgtgt

SEQ ID NO: 3635703 - DNA, 16 bp, Homo sapiens
ttgcgtctgaggcctg

SEQ ID NO: 3635704 - DNA, 15 bp, Homo sapiens
ttgctaacaggatat

SEQ ID NO: 3635705 - DNA, 16 bp, Homo sapiens
ttgctaccagtattta

SEQ ID NO: 3635706 - DNA, 20 bp, Homo sapiens
ttgctaccagtatttagaag

SEQ ID NO: 3635707 - DNA, 14 bp, Homo sapiens
ttgctatacatgtt

SEQ ID NO: 3635708 - DNA, 22 bp, Homo sapiens
ttgctatacatgttggaaatgt

SEQ ID NO: 3635709 - DNA, 16 bp, Homo sapiens
ttgctatagtgacatg

SEQ ID NO: 3635710 - DNA, 12 bp, Homo sapiens
ttgctatttcca

SEQ ID NO: 3635711 - DNA, 22 bp, Homo sapiens
ttgctcaaaattgcttctaaaa

SEQ ID NO: 3635712 - DNA, 23 bp, Homo sapiens
ttgctgaacaggaaagagctagg

SEQ ID NO: 3635713 - DNA, 19 bp, Homo sapiens
ttgctgaattcctttacaa

SEQ ID NO: 3635714 - DNA, 19 bp, Homo sapiens
ttgctgcatatttgacctt

SEQ ID NO: 3635715 - DNA, 22 bp, Homo sapiens
ttgctgcattcctttttcttca

SEQ ID NO: 3635716 - DNA, 22 bp, Homo sapiens
ttgctgcctcggatccccttcc

SEQ ID NO: 3635717 - DNA, 17 bp, Homo sapiens
ttgctggtcctgcacat

SEQ ID NO: 3635718 - DNA, 11 bp, Homo sapiens
ttgctgtgctt

SEQ ID NO: 3635719 - DNA, 16 bp, Homo sapiens
ttgctgttttcctccc

SEQ ID NO: 3635720 - DNA, 18 bp, Homo sapiens
ttgctgttttcctccctt

SEQ ID NO: 3635721 - DNA, 19 bp, Homo sapiens
ttgctgttttcctcccttc

SEQ ID NO: 3635722 - DNA, 18 bp, Homo sapiens
ttgcttactgatattatc

SEQ ID NO: 3635723 - DNA, 13 bp, Homo sapiens
ttgcttatgacat

SEQ ID NO: 3635724 - DNA, 12 bp, Homo sapiens
ttgcttctttct

SEQ ID NO: 3635725 - DNA, 17 bp, Homo sapiens
ttgcttgtactgggaca

SEQ ID NO: 3635726 - DNA, 16 bp, Homo sapiens
ttgctttaaaacaaag

SEQ ID NO: 3635727 - DNA, 15 bp, Homo sapiens
ttgctttctgctcag

SEQ ID NO: 3635728 - DNA, 17 bp, Homo sapiens
ttgctttggaagtttta

SEQ ID NO: 3635729 - DNA, 20 bp, Homo sapiens
ttgctttgtattgtatatta

SEQ ID NO: 3635730 - DNA, 13 bp, Homo sapiens
ttggaaataaagt

SEQ ID NO: 3635731 - DNA, 21 bp, Homo sapiens
ttggaaatcaaatgtaaagtt

SEQ ID NO: 3635732 - DNA, 15 bp, Homo sapiens
ttggaacaacatgtt

SEQ ID NO: 3635733 - DNA, 22 bp, Homo sapiens
ttggaagatggcataacctgtc

SEQ ID NO: 3635734 - DNA, 21 bp, Homo sapiens
ttggaagggtctctctccagg

SEQ ID NO: 3635735 - DNA, 16 bp, Homo sapiens
ttggaatacacatgca

SEQ ID NO: 3635736 - DNA, 16 bp, Homo sapiens
ttggaatagcagcctc

SEQ ID NO: 3635737 - DNA, 15 bp, Homo sapiens
ttggacagtggcctc

SEQ ID NO: 3635738 - DNA, 15 bp, Homo sapiens
ttggacattttatgt

SEQ ID NO: 3635739 - DNA, 18 bp, Homo sapiens
ttggacattttatgtctt

SEQ ID NO: 3635740 - DNA, 13 bp, Homo sapiens
ttggagaaagaaa

SEQ ID NO: 3635741 - DNA, 22 bp, Homo sapiens
ttggagaaggtctgtggtgcag

SEQ ID NO: 3635742 - DNA, 18 bp, Homo sapiens
ttggagagtttcctgaaa

SEQ ID NO: 3635743 - DNA, 20 bp, Homo sapiens
ttggagataatctagaacac

SEQ ID NO: 3635744 - DNA, 14 bp, Homo sapiens
ttggagcagcaggc

SEQ ID NO: 3635745 - DNA, 18 bp, Homo sapiens
ttggagtgctcttcccac

SEQ ID NO: 3635746 - DNA, 14 bp, Homo sapiens
ttggatttcctaat

SEQ ID NO: 3635747 - DNA, 13 bp, Homo sapiens
ttggcaccagaca

SEQ ID NO: 3635748 - DNA, 20 bp, Homo sapiens
ttggcaccagacacccagga

SEQ ID NO: 3635749 - DNA, 12 bp, Homo sapiens
ttggcaccccca

SEQ ID NO: 3635750 - DNA, 21 bp, Homo sapiens
ttggcacccccatgctgcctt

SEQ ID NO: 3635751 - DNA, 23 bp, Homo sapiens
ttggcagagaccataagagaaac

SEQ ID NO: 3635752 - DNA, 20 bp, Homo sapiens
ttggcaggcccactccccag

SEQ ID NO: 3635753 - DNA, 16 bp, Homo sapiens
ttggcagggatcccca

SEQ ID NO: 3635754 - DNA, 22 bp, Homo sapiens
ttggcatctctccccatatata

SEQ ID NO: 3635755 - DNA, 15 bp, Homo sapiens
ttggcattgctgcat

SEQ ID NO: 3635756 - DNA, 12 bp, Homo sapiens
ttggccacagac

SEQ ID NO: 3635757 - DNA, 18 bp, Homo sapiens
ttggccatccttctgtgt

SEQ ID NO: 3635758 - DNA, 21 bp, Homo sapiens
ttggccatgatgtccttggac

SEQ ID NO: 3635759 - DNA, 15 bp, Homo sapiens
ttggccctcctcagc

SEQ ID NO: 3635760 - DNA, 18 bp, Homo sapiens
ttggcctctgtatgcagt

SEQ ID NO: 3635761 - DNA, 22 bp, Homo sapiens
ttggcctggggtgcatctcctc

SEQ ID NO: 3635762 - DNA, 18 bp, Homo sapiens
ttggctcacaaggcccag

SEQ ID NO: 3635763 - DNA, 15 bp, Homo sapiens
ttggctcccgggggc

SEQ ID NO: 3635764 - DNA, 16 bp, Homo sapiens
ttggctgacccctctg

SEQ ID NO: 3635765 - DNA, 18 bp, Homo sapiens
ttggctgacccctctggt

SEQ ID NO: 3635766 - DNA, 21 bp, Homo sapiens
ttggctgcaggaagaaacttt

SEQ ID NO: 3635767 - DNA, 23 bp, Homo sapiens
ttggctggtagcagcaggctcag

SEQ ID NO: 3635768 - DNA, 16 bp, Homo sapiens
ttggctttatgcaaat

SEQ ID NO: 3635769 - DNA, 20 bp, Homo sapiens
ttggctttatgcaaatacaa

SEQ ID NO: 3635770 - DNA, 19 bp, Homo sapiens
ttggctttcacatttaaat

SEQ ID NO: 3635771 - DNA, 23 bp, Homo sapiens
ttggctttcagagccagcctggc

SEQ ID NO: 3635772 - DNA, 20 bp, Homo sapiens
ttggctttcgatgcgtgtgt

SEQ ID NO: 3635773 - DNA, 23 bp, Homo sapiens
ttggctttgcccacccctcactc

SEQ ID NO: 3635774 - DNA, 14 bp, Homo sapiens
ttgggaattttatt

SEQ ID NO: 3635775 - DNA, 21 bp, Homo sapiens
ttgggacagccattttccaac

SEQ ID NO: 3635776 - DNA, 21 bp, Homo sapiens
ttgggagccaggactcccaga

SEQ ID NO: 3635777 - DNA, 17 bp, Homo sapiens
ttgggagcttgggaatg

SEQ ID NO: 3635778 - DNA, 19 bp, Homo sapiens
ttgggagcttgggaatgga

SEQ ID NO: 3635779 - DNA, 19 bp, Homo sapiens
ttgggatccaggcccctcc

SEQ ID NO: 3635780 - DNA, 22 bp, Homo sapiens
ttgggatgttccttttttcaat

SEQ ID NO: 3635781 - DNA, 12 bp, Homo sapiens
ttgggcctcagg

SEQ ID NO: 3635782 - DNA, 15 bp, Homo sapiens
ttgggctgacccagc

SEQ ID NO: 3635783 - DNA, 17 bp, Homo sapiens
ttgggctgacccagcat

SEQ ID NO: 3635784 - DNA, 21 bp, Homo sapiens
ttggggagttaagacctggca

SEQ ID NO: 3635785 - DNA, 17 bp, Homo sapiens
ttgggggtcagcatcca

SEQ ID NO: 3635786 - DNA, 16 bp, Homo sapiens
ttggggtgagaggtga

SEQ ID NO: 3635787 - DNA, 13 bp, Homo sapiens
ttgggttcacagc

SEQ ID NO: 3635788 - DNA, 14 bp, Homo sapiens
ttggtaacttttgt

SEQ ID NO: 3635789 - DNA, 16 bp, Homo sapiens
ttggtattttcagaga

SEQ ID NO: 3635790 - DNA, 19 bp, Homo sapiens
ttggtctgccttctgctga

SEQ ID NO: 3635791 - DNA, 20 bp, Homo sapiens
ttggttcacctgtgactcct

SEQ ID NO: 3635792 - DNA, 18 bp, Homo sapiens
ttggttcgatacctggag

SEQ ID NO: 3635793 - DNA, 15 bp, Homo sapiens
ttggttctgtgaaca

SEQ ID NO: 3635794 - DNA, 22 bp, Homo sapiens
ttggtttaaagaaagtgtattt

SEQ ID NO: 3635795 - DNA, 23 bp, Homo sapiens
ttggtttgccttttatgtaaatt

SEQ ID NO: 3635796 - DNA, 22 bp, Homo sapiens
ttgtaaaaattaaaagttatgg

SEQ ID NO: 3635797 - DNA, 17 bp, Homo sapiens
ttgtaaaacttctgctc

SEQ ID NO: 3635798 - DNA, 19 bp, Homo sapiens
ttgtaaaacttctgctcgt

SEQ ID NO: 3635799 - DNA, 18 bp, Homo sapiens
ttgtaaaagcattttgta

SEQ ID NO: 3635800 - DNA, 20 bp, Homo sapiens
ttgtaaaagcattttgtaat

SEQ ID NO: 3635801 - DNA, 17 bp, Homo sapiens
ttgtaaaatagaaaaag

SEQ ID NO: 3635802 - DNA, 22 bp, Homo sapiens
ttgtaaactcaaaatatttgta

SEQ ID NO: 3635803 - DNA, 18 bp, Homo sapiens
ttgtaaatgaaacttaag

SEQ ID NO: 3635804 - DNA, 18 bp, Homo sapiens
ttgtaactaaaataattt

SEQ ID NO: 3635805 - DNA, 21 bp, Homo sapiens
ttgtaactaaaataattttgt

SEQ ID NO: 3635806 - DNA, 22 bp, Homo sapiens
ttgtaactaaaataattttgta

SEQ ID NO: 3635807 - DNA, 13 bp, Homo sapiens
ttgtaactgtaaa

SEQ ID NO: 3635808 - DNA, 21 bp, Homo sapiens
ttgtaactgtttagatgaatg

SEQ ID NO: 3635809 - DNA, 21 bp, Homo sapiens
ttgtaagacaaaggttttcct

SEQ ID NO: 3635810 - DNA, 13 bp, Homo sapiens
ttgtaataaactc

SEQ ID NO: 3635811 - DNA, 15 bp, Homo sapiens
ttgtaataaactctc

SEQ ID NO: 3635812 - DNA, 17 bp, Homo sapiens
ttgtaataaactctcta

SEQ ID NO: 3635813 - DNA, 14 bp, Homo sapiens
ttgtaatatgtaaa

SEQ ID NO: 3635814 - DNA, 15 bp, Homo sapiens
ttgtaatatgtaaat

SEQ ID NO: 3635815 - DNA, 17 bp, Homo sapiens
ttgtaatctagttgtca

SEQ ID NO: 3635816 - DNA, 13 bp, Homo sapiens
ttgtaatgctgca

SEQ ID NO: 3635817 - DNA, 14 bp, Homo sapiens
ttgtaatgctgcac

SEQ ID NO: 3635818 - DNA, 16 bp, Homo sapiens
ttgtaatgctgcactt

SEQ ID NO: 3635819 - DNA, 22 bp, Homo sapiens
ttgtaattgcttttttaaatat

SEQ ID NO: 3635820 - DNA, 12 bp, Homo sapiens
ttgtacaaaata

SEQ ID NO: 3635821 - DNA, 11 bp, Homo sapiens
ttgtacaataa

SEQ ID NO: 3635822 - DNA, 13 bp, Homo sapiens
ttgtacaataaat

SEQ ID NO: 3635823 - DNA, 23 bp, Homo sapiens
ttgtaccttttgtagttttattt

SEQ ID NO: 3635824 - DNA, 18 bp, Homo sapiens
ttgtactttgtggagaga

SEQ ID NO: 3635825 - DNA, 17 bp, Homo sapiens
ttgtagaaattaaacat

SEQ ID NO: 3635826 - DNA, 21 bp, Homo sapiens
ttgtagtagcgttttttaaat

SEQ ID NO: 3635827 - DNA, 11 bp, Homo sapiens
ttgtataattg

SEQ ID NO: 3635828 - DNA, 20 bp, Homo sapiens
ttgtataattggatttccta

SEQ ID NO: 3635829 - DNA, 20 bp, Homo sapiens
ttgtatacaccatatactgt

SEQ ID NO: 3635830 - DNA, 22 bp, Homo sapiens
ttgtatagcatgaaataaaata

SEQ ID NO: 3635831 - DNA, 14 bp, Homo sapiens
ttgtatattacaat

SEQ ID NO: 3635832 - DNA, 22 bp, Homo sapiens
ttgtatgaaagatggctgtgcc

SEQ ID NO: 3635833 - DNA, 17 bp, Homo sapiens
ttgtattccaagcatat

SEQ ID NO: 3635834 - DNA, 19 bp, Homo sapiens
ttgtattgatttttaagaa

SEQ ID NO: 3635835 - DNA, 18 bp, Homo sapiens
ttgtatttattaatttga

SEQ ID NO: 3635836 - DNA, 14 bp, Homo sapiens
ttgtatttctatac

SEQ ID NO: 3635837 - DNA, 17 bp, Homo sapiens
ttgtatttctatacagt

SEQ ID NO: 3635838 - DNA, 20 bp, Homo sapiens
ttgtcaacagatttaaagaa

SEQ ID NO: 3635839 - DNA, 23 bp, Homo sapiens
ttgtcaaggatggttttgggact

SEQ ID NO: 3635840 - DNA, 23 bp, Homo sapiens
ttgtcaataaatggcccggacat

SEQ ID NO: 3635841 - DNA, 14 bp, Homo sapiens
ttgtcatggtgaaa

SEQ ID NO: 3635842 - DNA, 23 bp, Homo sapiens
ttgtcattcagttctaggccttt

SEQ ID NO: 3635843 - DNA, 20 bp, Homo sapiens
ttgtccaggctggagtgcaa

SEQ ID NO: 3635844 - DNA, 13 bp, Homo sapiens
ttgtccctttccc

SEQ ID NO: 3635845 - DNA, 17 bp, Homo sapiens
ttgtcctgggcctgccc

SEQ ID NO: 3635846 - DNA, 22 bp, Homo sapiens
ttgtctacgggggcacttggag

SEQ ID NO: 3635847 - DNA, 23 bp, Homo sapiens
ttgtctcaacgcctccccctccc

SEQ ID NO: 3635848 - DNA, 15 bp, Homo sapiens
ttgtctcacgcagcc

SEQ ID NO: 3635849 - DNA, 18 bp, Homo sapiens
ttgtctgaagtcactgca

SEQ ID NO: 3635850 - DNA, 16 bp, Homo sapiens
ttgtctgttttccttc

SEQ ID NO: 3635851 - DNA, 19 bp, Homo sapiens
ttgtgaaacagacttgtat

SEQ ID NO: 3635852 - DNA, 14 bp, Homo sapiens
ttgtgaaatgatgg

SEQ ID NO: 3635853 - DNA, 17 bp, Homo sapiens
ttgtgaagctaatgtca

SEQ ID NO: 3635854 - DNA, 22 bp, Homo sapiens
ttgtgaaggcaggggaatgtat

SEQ ID NO: 3635855 - DNA, 21 bp, Homo sapiens
ttgtgaccagaaagcttcatc

SEQ ID NO: 3635856 - DNA, 22 bp, Homo sapiens
ttgtgatgtcccaacttgtaaa

SEQ ID NO: 3635857 - DNA, 15 bp, Homo sapiens
ttgtgattggctgca

SEQ ID NO: 3635858 - DNA, 13 bp, Homo sapiens
ttgtgcccctaaa

SEQ ID NO: 3635859 - DNA, 15 bp, Homo sapiens
ttgtgcccctaaaga

SEQ ID NO: 3635860 - DNA, 23 bp, Homo sapiens
ttgtgcccctaaagagcatcctg

SEQ ID NO: 3635861 - DNA, 18 bp, Homo sapiens
ttgtgcctaatgtgtttg

SEQ ID NO: 3635862 - DNA, 16 bp, Homo sapiens
ttgtgctcagagacac

SEQ ID NO: 3635863 - DNA, 20 bp, Homo sapiens
ttgtggacatgcataaaaat

SEQ ID NO: 3635864 - DNA, 14 bp, Homo sapiens
ttgtggagagaatg

SEQ ID NO: 3635865 - DNA, 20 bp, Homo sapiens
ttgtggccaaggagctgcta

SEQ ID NO: 3635866 - DNA, 19 bp, Homo sapiens
ttgtggggcctcaggctcc

SEQ ID NO: 3635867 - DNA, 13 bp, Homo sapiens
ttgtggttaatct

SEQ ID NO: 3635868 - DNA, 17 bp, Homo sapiens
ttgtgtacttttccttt

SEQ ID NO: 3635869 - DNA, 18 bp, Homo sapiens
ttgtgtcttttaaactgg

SEQ ID NO: 3635870 - DNA, 13 bp, Homo sapiens
ttgtgttctgctc

SEQ ID NO: 3635871 - DNA, 18 bp, Homo sapiens
ttgttaaatttagcagcc

SEQ ID NO: 3635872 - DNA, 14 bp, Homo sapiens
ttgttaatatgcag

SEQ ID NO: 3635873 - DNA, 16 bp, Homo sapiens
ttgttacttctctaat

SEQ ID NO: 3635874 - DNA, 19 bp, Homo sapiens
ttgttatattataattgga

SEQ ID NO: 3635875 - DNA, 14 bp, Homo sapiens
ttgttatcaaaata

SEQ ID NO: 3635876 - DNA, 20 bp, Homo sapiens
ttgttatttattgaaatgat

SEQ ID NO: 3635877 - DNA, 21 bp, Homo sapiens
ttgttccacaagttaaataaa

SEQ ID NO: 3635878 - DNA, 20 bp, Homo sapiens
ttgttctaaaggctgttaaa

SEQ ID NO: 3635879 - DNA, 23 bp, Homo sapiens
ttgttctgggagttgctgttaat

SEQ ID NO: 3635880 - DNA, 21 bp, Homo sapiens
ttgttgtgagaatggcctgga

SEQ ID NO: 3635881 - DNA, 23 bp, Homo sapiens
ttgttgtgagaatggcctggagc

SEQ ID NO: 3635882 - DNA, 22 bp, Homo sapiens
ttgttgtgtgtatatgtattta

SEQ ID NO: 3635883 - DNA, 18 bp, Homo sapiens
ttgtttaaaatcatttct

SEQ ID NO: 3635884 - DNA, 13 bp, Homo sapiens
ttgtttaatcttt

SEQ ID NO: 3635885 - DNA, 14 bp, Homo sapiens
ttgtttaatgttaa

SEQ ID NO: 3635886 - DNA, 18 bp, Homo sapiens
ttgtttataataaaaata

SEQ ID NO: 3635887 - DNA, 23 bp, Homo sapiens
ttgtttctcaaatcttggcaata

SEQ ID NO: 3635888 - DNA, 12 bp, Homo sapiens
ttgttttacaat

SEQ ID NO: 3635889 - DNA, 16 bp, Homo sapiens
ttgttttatttaggca

SEQ ID NO: 3635890 - DNA, 14 bp, Homo sapiens
ttgttttcattatc

SEQ ID NO: 3635891 - DNA, 16 bp, Homo sapiens
ttgtttttatatatta

SEQ ID NO: 3635892 - DNA, 21 bp, Homo sapiens
ttgtttttgtatttattaatt

SEQ ID NO: 3635893 - DNA, 18 bp, Homo sapiens
ttgttttttttttccact

SEQ ID NO: 3635894 - DNA, 13 bp, Homo sapiens
tttaaaaaaactg

SEQ ID NO: 3635895 - DNA, 15 bp, Homo sapiens
tttaaaaattgttat

SEQ ID NO: 3635896 - DNA, 22 bp, Homo sapiens
tttaaaacgcgtctgcctgggc

SEQ ID NO: 3635897 - DNA, 13 bp, Homo sapiens
tttaaaactgtta

SEQ ID NO: 3635898 - DNA, 11 bp, Homo sapiens
tttaaaatata

SEQ ID NO: 3635899 - DNA, 15 bp, Homo sapiens
tttaaaatcaactta

SEQ ID NO: 3635900 - DNA, 15 bp, Homo sapiens
tttaaaatttagagt

SEQ ID NO: 3635901 - DNA, 14 bp, Homo sapiens
tttaaacaatcttt

SEQ ID NO: 3635902 - DNA, 22 bp, Homo sapiens
tttaaagctgagagaccctggc

SEQ ID NO: 3635903 - DNA, 19 bp, Homo sapiens
tttaaataaaagcacaagt

SEQ ID NO: 3635904 - DNA, 18 bp, Homo sapiens
tttaaatgcataaatgca

SEQ ID NO: 3635905 - DNA, 19 bp, Homo sapiens
tttaaatgtgtacaatgta

SEQ ID NO: 3635906 - DNA, 23 bp, Homo sapiens
tttaaatgtgtacaatgtacaca

SEQ ID NO: 3635907 - DNA, 16 bp, Homo sapiens
tttaaattatatgata

SEQ ID NO: 3635908 - DNA, 21 bp, Homo sapiens
tttaaattatatgatatgcat

SEQ ID NO: 3635909 - DNA, 19 bp, Homo sapiens
tttaaattatgttttactg

SEQ ID NO: 3635910 - DNA, 18 bp, Homo sapiens
tttaaattccactgaaaa

SEQ ID NO: 3635911 - DNA, 20 bp, Homo sapiens
tttaaattttaaaaagcagc

SEQ ID NO: 3635912 - DNA, 22 bp, Homo sapiens
tttaacagtatccccttctcat

SEQ ID NO: 3635913 - DNA, 20 bp, Homo sapiens
tttaaccaataactagcttc

SEQ ID NO: 3635914 - DNA, 18 bp, Homo sapiens
tttaacttccagtggctg

SEQ ID NO: 3635915 - DNA, 17 bp, Homo sapiens
tttaacttttaatttaa

SEQ ID NO: 3635916 - DNA, 17 bp, Homo sapiens
tttaacttttttttctc

SEQ ID NO: 3635917 - DNA, 22 bp, Homo sapiens
tttaagaaagtaatttaatttg

SEQ ID NO: 3635918 - DNA, 20 bp, Homo sapiens
tttaagacataaacaaagac

SEQ ID NO: 3635919 - DNA, 21 bp, Homo sapiens
tttaagacataaacaaagaca

SEQ ID NO: 3635920 - DNA, 18 bp, Homo sapiens
tttaagatgtacatttaa

SEQ ID NO: 3635921 - DNA, 15 bp, Homo sapiens
tttaagcaacatctt

SEQ ID NO: 3635922 - DNA, 17 bp, Homo sapiens
tttaagcaacatctttt

SEQ ID NO: 3635923 - DNA, 22 bp, Homo sapiens
tttaagccttataaaccaatct

SEQ ID NO: 3635924 - DNA, 22 bp, Homo sapiens
tttaagggtttgtggaaaatga

SEQ ID NO: 3635925 - DNA, 20 bp, Homo sapiens
tttaaggtctaatcagtgat

SEQ ID NO: 3635926 - DNA, 20 bp, Homo sapiens
tttaataaactactctttga

SEQ ID NO: 3635927 - DNA, 16 bp, Homo sapiens
tttaataaattgctta

SEQ ID NO: 3635928 - DNA, 15 bp, Homo sapiens
tttaatatgaaattt

SEQ ID NO: 3635929 - DNA, 16 bp, Homo sapiens
tttaatattacagata

SEQ ID NO: 3635930 - DNA, 14 bp, Homo sapiens
tttaatccatttca

SEQ ID NO: 3635931 - DNA, 23 bp, Homo sapiens
tttaatgagtgcacctgcctcca

SEQ ID NO: 3635932 - DNA, 14 bp, Homo sapiens
tttaatgctgcctt

SEQ ID NO: 3635933 - DNA, 22 bp, Homo sapiens
tttaatgttaattatgcagtgt

SEQ ID NO: 3635934 - DNA, 20 bp, Homo sapiens
tttaattacaaacaataaga

SEQ ID NO: 3635935 - DNA, 22 bp, Homo sapiens
tttaattactggaattcttctg

SEQ ID NO: 3635936 - DNA, 16 bp, Homo sapiens
tttaattcacgtgctt

SEQ ID NO: 3635937 - DNA, 16 bp, Homo sapiens
tttaatttatatcagg

SEQ ID NO: 3635938 - DNA, 16 bp, Homo sapiens
tttaatttgaaatatg

SEQ ID NO: 3635939 - DNA, 22 bp, Homo sapiens
tttaatttgaaggtagaatgtt

SEQ ID NO: 3635940 - DNA, 13 bp, Homo sapiens
tttaatttgtaaa

SEQ ID NO: 3635941 - DNA, 17 bp, Homo sapiens
tttaatttgtaaaactt

SEQ ID NO: 3635942 - DNA, 14 bp, Homo sapiens
tttaattttcactt

SEQ ID NO: 3635943 - DNA, 17 bp, Homo sapiens
tttaattttcagttcta

SEQ ID NO: 3635944 - DNA, 18 bp, Homo sapiens
tttaattttcagttctat

SEQ ID NO: 3635945 - DNA, 14 bp, Homo sapiens
tttaatttttcctt

SEQ ID NO: 3635946 - DNA, 16 bp, Homo sapiens
tttacaactaaataac

SEQ ID NO: 3635947 - DNA, 14 bp, Homo sapiens
tttacacaattctt

SEQ ID NO: 3635948 - DNA, 15 bp, Homo sapiens
tttacacaattctta

SEQ ID NO: 3635949 - DNA, 19 bp, Homo sapiens
tttacactctgtattgaaa

SEQ ID NO: 3635950 - DNA, 18 bp, Homo sapiens
tttacatgaagcagaacc

SEQ ID NO: 3635951 - DNA, 22 bp, Homo sapiens
tttacatgacagatattttatc

SEQ ID NO: 3635952 - DNA, 14 bp, Homo sapiens
tttaccaaagcatc

SEQ ID NO: 3635953 - DNA, 17 bp, Homo sapiens
tttacccttttccccct

SEQ ID NO: 3635954 - DNA, 18 bp, Homo sapiens
tttacccttttccccctt

SEQ ID NO: 3635955 - DNA, 14 bp, Homo sapiens
tttacctattctga

SEQ ID NO: 3635956 - DNA, 19 bp, Homo sapiens
tttacctggcctagaaagg

SEQ ID NO: 3635957 - DNA, 13 bp, Homo sapiens
tttaccttgtata

SEQ ID NO: 3635958 - DNA, 23 bp, Homo sapiens
tttacctttttttagttatatat

SEQ ID NO: 3635959 - DNA, 16 bp, Homo sapiens
tttacgtagctatttt

SEQ ID NO: 3635960 - DNA, 12 bp, Homo sapiens
tttactaatgat

SEQ ID NO: 3635961 - DNA, 13 bp, Homo sapiens
tttacttcttata

SEQ ID NO: 3635962 - DNA, 19 bp, Homo sapiens
tttacttcttatacatttg

SEQ ID NO: 3635963 - DNA, 15 bp, Homo sapiens
tttacttttaaacag

SEQ ID NO: 3635964 - DNA, 21 bp, Homo sapiens
tttactttttttttattttat

SEQ ID NO: 3635965 - DNA, 17 bp, Homo sapiens
tttagaagaagtgtgtc

SEQ ID NO: 3635966 - DNA, 19 bp, Homo sapiens
tttagaagaagtgtgtcac

SEQ ID NO: 3635967 - DNA, 14 bp, Homo sapiens
tttagaagccaact

SEQ ID NO: 3635968 - DNA, 24 bp, Homo sapiens
tttagacaaagccttaagcaaatt

SEQ ID NO: 3635969 - DNA, 19 bp, Homo sapiens
tttagagataggaaactga

SEQ ID NO: 3635970 - DNA, 23 bp, Homo sapiens
tttagatatttgcctgtctgttt

SEQ ID NO: 3635971 - DNA, 17 bp, Homo sapiens
tttagatgaatgtcagt

SEQ ID NO: 3635972 - DNA, 22 bp, Homo sapiens
tttagatgaatgtcagttgtta

SEQ ID NO: 3635973 - DNA, 17 bp, Homo sapiens
tttagatgtaattttgt

SEQ ID NO: 3635974 - DNA, 16 bp, Homo sapiens
tttagcagtttcctca

SEQ ID NO: 3635975 - DNA, 21 bp, Homo sapiens
tttagcagtttcctcagtgat

SEQ ID NO: 3635976 - DNA, 15 bp, Homo sapiens
tttaggacatgaaaa

SEQ ID NO: 3635977 - DNA, 17 bp, Homo sapiens
tttaggacatgaaaata

SEQ ID NO: 3635978 - DNA, 16 bp, Homo sapiens
tttaggcaaagataat

SEQ ID NO: 3635979 - DNA, 15 bp, Homo sapiens
tttaggccttgccag

SEQ ID NO: 3635980 - DNA, 18 bp, Homo sapiens
tttaggctggtggcccag

SEQ ID NO: 3635981 - DNA, 17 bp, Homo sapiens
tttaggtactattctga

SEQ ID NO: 3635982 - DNA, 14 bp, Homo sapiens
tttaggtgaaaata

SEQ ID NO: 3635983 - DNA, 14 bp, Homo sapiens
tttaggttaacaat

SEQ ID NO: 3635984 - DNA, 22 bp, Homo sapiens
tttaggtttttgtttgtttcct

SEQ ID NO: 3635985 - DNA, 15 bp, Homo sapiens
tttagtgtaaaattg

SEQ ID NO: 3635986 - DNA, 13 bp, Homo sapiens
tttataaaggtct

SEQ ID NO: 3635987 - DNA, 14 bp, Homo sapiens
tttataaaggtctg

SEQ ID NO: 3635988 - DNA, 20 bp, Homo sapiens
tttataagcatttgtattat

SEQ ID NO: 3635989 - DNA, 11 bp, Homo sapiens
tttataataaa

SEQ ID NO: 3635990 - DNA, 14 bp, Homo sapiens
tttataataaaaat

SEQ ID NO: 3635991 - DNA, 14 bp, Homo sapiens
tttataattggctt

SEQ ID NO: 3635992 - DNA, 16 bp, Homo sapiens
tttatacaccagcaat

SEQ ID NO: 3635993 - DNA, 14 bp, Homo sapiens
tttatacactgtaa

SEQ ID NO: 3635994 - DNA, 23 bp, Homo sapiens
tttatacagatgccatatagtgt

SEQ ID NO: 3635995 - DNA, 15 bp, Homo sapiens
tttatactgctctat

SEQ ID NO: 3635996 - DNA, 21 bp, Homo sapiens
tttatatgtaccgtaggcttt

SEQ ID NO: 3635997 - DNA, 12 bp, Homo sapiens
tttatattattg

SEQ ID NO: 3635998 - DNA, 13 bp, Homo sapiens
tttatattctaat

SEQ ID NO: 3635999 - DNA, 15 bp, Homo sapiens
tttatatttattgtt

SEQ ID NO: 3636000 - DNA, 19 bp, Homo sapiens
tttatctataatttaccta

SEQ ID NO: 3636001 - DNA, 18 bp, Homo sapiens
tttatctccttgtggcct

SEQ ID NO: 3636002 - DNA, 19 bp, Homo sapiens
tttatctccttgtggccta

SEQ ID NO: 3636003 - DNA, 13 bp, Homo sapiens
tttatctgtttaa

SEQ ID NO: 3636004 - DNA, 21 bp, Homo sapiens
tttatgacatgaaaagttatt

SEQ ID NO: 3636005 - DNA, 12 bp, Homo sapiens
tttatgcaaata

SEQ ID NO: 3636006 - DNA, 17 bp, Homo sapiens
tttatgctataaatttt

SEQ ID NO: 3636007 - DNA, 14 bp, Homo sapiens
tttatgtaaatttt

SEQ ID NO: 3636008 - DNA, 17 bp, Homo sapiens
tttatgtctttcttgta

SEQ ID NO: 3636009 - DNA, 22 bp, Homo sapiens
tttatgtgaaatgctttctgta

SEQ ID NO: 3636010 - DNA, 11 bp, Homo sapiens
tttatgtgtgt

SEQ ID NO: 3636011 - DNA, 14 bp, Homo sapiens
tttattaaaatatt

SEQ ID NO: 3636012 - DNA, 18 bp, Homo sapiens
tttattaaaatatttcag

SEQ ID NO: 3636013 - DNA, 21 bp, Homo sapiens
tttattaaaatatttcaggtt

SEQ ID NO: 3636014 - DNA, 19 bp, Homo sapiens
tttattaatcttagtgtat

SEQ ID NO: 3636015 - DNA, 17 bp, Homo sapiens
tttattaattgctttga

SEQ ID NO: 3636016 - DNA, 12 bp, Homo sapiens
tttattaatttg

SEQ ID NO: 3636017 - DNA, 17 bp, Homo sapiens
tttattaccttctttct

SEQ ID NO: 3636018 - DNA, 19 bp, Homo sapiens
tttattataaactgtatgc

SEQ ID NO: 3636019 - DNA, 20 bp, Homo sapiens
tttattccccagtgactcca

SEQ ID NO: 3636020 - DNA, 22 bp, Homo sapiens
tttattccccagtgactccagg

SEQ ID NO: 3636021 - DNA, 18 bp, Homo sapiens
tttattctttgcaaataa

SEQ ID NO: 3636022 - DNA, 20 bp, Homo sapiens
tttattgaaatgatttcaca

SEQ ID NO: 3636023 - DNA, 20 bp, Homo sapiens
tttattgaattcatttcact

SEQ ID NO: 3636024 - DNA, 14 bp, Homo sapiens
tttattgatgtttt

SEQ ID NO: 3636025 - DNA, 18 bp, Homo sapiens
tttattgatgttttcaca

SEQ ID NO: 3636026 - DNA, 14 bp, Homo sapiens
tttattgttagaaa

SEQ ID NO: 3636027 - DNA, 22 bp, Homo sapiens
tttattgtttaaaatcatttct

SEQ ID NO: 3636028 - DNA, 13 bp, Homo sapiens
tttatttatttat

SEQ ID NO: 3636029 - DNA, 15 bp, Homo sapiens
tttatttcaattgtt

SEQ ID NO: 3636030 - DNA, 18 bp, Homo sapiens
tttattttgaaatggaaa

SEQ ID NO: 3636031 - DNA, 16 bp, Homo sapiens
tttatttttagaattt

SEQ ID NO: 3636032 - DNA, 19 bp, Homo sapiens
tttatttttagaattttgt

SEQ ID NO: 3636033 - DNA, 13 bp, Homo sapiens
tttcaaacttaaa

SEQ ID NO: 3636034 - DNA, 13 bp, Homo sapiens
tttcaaagcactt

SEQ ID NO: 3636035 - DNA, 17 bp, Homo sapiens
tttcaaagctttttcca

SEQ ID NO: 3636036 - DNA, 14 bp, Homo sapiens
tttcaaatgttctc

SEQ ID NO: 3636037 - DNA, 16 bp, Homo sapiens
tttcaaattaatgttc

SEQ ID NO: 3636038 - DNA, 19 bp, Homo sapiens
tttcaaattaatgttccag

SEQ ID NO: 3636039 - DNA, 20 bp, Homo sapiens
tttcaaccagataacatacc

SEQ ID NO: 3636040 - DNA, 21 bp, Homo sapiens
tttcaacgcagccctgctttg

SEQ ID NO: 3636041 - DNA, 16 bp, Homo sapiens
tttcaactgccaaaat

SEQ ID NO: 3636042 - DNA, 17 bp, Homo sapiens
tttcaagaaactgagga

SEQ ID NO: 3636043 - DNA, 15 bp, Homo sapiens
tttcaataaatcttt

SEQ ID NO: 3636044 - DNA, 21 bp, Homo sapiens
tttcaatatgcaagcagcttt

SEQ ID NO: 3636045 - DNA, 16 bp, Homo sapiens
tttcaatcttttaaat

SEQ ID NO: 3636046 - DNA, 23 bp, Homo sapiens
tttcaatgtgttgatacattccc

SEQ ID NO: 3636047 - DNA, 13 bp, Homo sapiens
tttcaattaaacg

SEQ ID NO: 3636048 - DNA, 20 bp, Homo sapiens
tttcacaaatccttcaaaat

SEQ ID NO: 3636049 - DNA, 17 bp, Homo sapiens
tttcacattaggctgtt

SEQ ID NO: 3636050 - DNA, 20 bp, Homo sapiens
tttcacgcctgaggcaatta

SEQ ID NO: 3636051 - DNA, 17 bp, Homo sapiens
tttcactgctggctgcc

SEQ ID NO: 3636052 - DNA, 22 bp, Homo sapiens
tttcactgctggctgccttaga

SEQ ID NO: 3636053 - DNA, 16 bp, Homo sapiens
tttcagaatcttttca

SEQ ID NO: 3636054 - DNA, 16 bp, Homo sapiens
tttcagaatgttgaag

SEQ ID NO: 3636055 - DNA, 16 bp, Homo sapiens
tttcagagaaaggact

SEQ ID NO: 3636056 - DNA, 11 bp, Homo sapiens
tttcagcctcc

SEQ ID NO: 3636057 - DNA, 23 bp, Homo sapiens
tttcagcctcctgtttggtgggg

SEQ ID NO: 3636058 - DNA, 14 bp, Homo sapiens
tttcaggagatggg

SEQ ID NO: 3636059 - DNA, 15 bp, Homo sapiens
tttcagtgttttcat

SEQ ID NO: 3636060 - DNA, 15 bp, Homo sapiens
tttcagttctattta

SEQ ID NO: 3636061 - DNA, 18 bp, Homo sapiens
tttcagttctatttaaaa

SEQ ID NO: 3636062 - DNA, 15 bp, Homo sapiens
tttcataagatattt

SEQ ID NO: 3636063 - DNA, 16 bp, Homo sapiens
tttcataattctgaaa

SEQ ID NO: 3636064 - DNA, 17 bp, Homo sapiens
tttcataattctgaaac

SEQ ID NO: 3636065 - DNA, 19 bp, Homo sapiens
tttcataattctgaaacaa

SEQ ID NO: 3636066 - DNA, 17 bp, Homo sapiens
tttcatattttaaacag

SEQ ID NO: 3636067 - DNA, 14 bp, Homo sapiens
tttcatcatttcag

SEQ ID NO: 3636068 - DNA, 19 bp, Homo sapiens
tttcatcatttcagccaaa

SEQ ID NO: 3636069 - DNA, 19 bp, Homo sapiens
tttcatcctaaagaacaaa

SEQ ID NO: 3636070 - DNA, 17 bp, Homo sapiens
tttcatctaccttttct

SEQ ID NO: 3636071 - DNA, 18 bp, Homo sapiens
tttcatctaccttttctg

SEQ ID NO: 3636072 - DNA, 15 bp, Homo sapiens
tttcatcttttgaag

SEQ ID NO: 3636073 - DNA, 15 bp, Homo sapiens
tttcatgaaaaagct

SEQ ID NO: 3636074 - DNA, 20 bp, Homo sapiens
tttcatgaaaaagctgcttc

SEQ ID NO: 3636075 - DNA, 16 bp, Homo sapiens
tttcatgctatctctg

SEQ ID NO: 3636076 - DNA, 13 bp, Homo sapiens
tttcatgctttat

SEQ ID NO: 3636077 - DNA, 16 bp, Homo sapiens
tttcatgttttagcat

SEQ ID NO: 3636078 - DNA, 22 bp, Homo sapiens
tttcatgttttagcatttgtat

SEQ ID NO: 3636079 - DNA, 14 bp, Homo sapiens
tttcatttatctat

SEQ ID NO: 3636080 - DNA, 17 bp, Homo sapiens
tttcatttatctataat

SEQ ID NO: 3636081 - DNA, 13 bp, Homo sapiens
tttcatttgtaaa

SEQ ID NO: 3636082 - DNA, 12 bp, Homo sapiens
tttccaaaacat

SEQ ID NO: 3636083 - DNA, 21 bp, Homo sapiens
tttccaaaacatttctggaca

SEQ ID NO: 3636084 - DNA, 18 bp, Homo sapiens
tttccacacgcattaata

SEQ ID NO: 3636085 - DNA, 20 bp, Homo sapiens
tttccaccataccttagaga

SEQ ID NO: 3636086 - DNA, 18 bp, Homo sapiens
tttccagctccgtgtttc

SEQ ID NO: 3636087 - DNA, 18 bp, Homo sapiens
tttccagggtgtagccta

SEQ ID NO: 3636088 - DNA, 15 bp, Homo sapiens
tttccagtattgaaa

SEQ ID NO: 3636089 - DNA, 16 bp, Homo sapiens
tttccatcatttctgt

SEQ ID NO: 3636090 - DNA, 12 bp, Homo sapiens
tttccatgtttt

SEQ ID NO: 3636091 - DNA, 21 bp, Homo sapiens
tttccattcatggatatttgt

SEQ ID NO: 3636092 - DNA, 12 bp, Homo sapiens
tttcccccaggc

SEQ ID NO: 3636093 - DNA, 19 bp, Homo sapiens
tttcccccttcatccatcc

SEQ ID NO: 3636094 - DNA, 22 bp, Homo sapiens
tttcccccttcccatttcttcc

SEQ ID NO: 3636095 - DNA, 23 bp, Homo sapiens
tttcccccttcccatttcttccc

SEQ ID NO: 3636096 - DNA, 18 bp, Homo sapiens
tttcccctatcatttatt

SEQ ID NO: 3636097 - DNA, 12 bp, Homo sapiens
tttccctgctga

SEQ ID NO: 3636098 - DNA, 22 bp, Homo sapiens
tttccctggaactcctggcctt

SEQ ID NO: 3636099 - DNA, 14 bp, Homo sapiens
tttcccttctcttc

SEQ ID NO: 3636100 - DNA, 15 bp, Homo sapiens
tttcccttgaggaaa

SEQ ID NO: 3636101 - DNA, 12 bp, Homo sapiens
tttccgcccaca

SEQ ID NO: 3636102 - DNA, 17 bp, Homo sapiens
tttccgtaaatgtctgc

SEQ ID NO: 3636103 - DNA, 17 bp, Homo sapiens
tttcctaaggctgcaag

SEQ ID NO: 3636104 - DNA, 23 bp, Homo sapiens
tttcctatagctacatgttcttt

SEQ ID NO: 3636105 - DNA, 16 bp, Homo sapiens
tttcctccccctgcaa

SEQ ID NO: 3636106 - DNA, 12 bp, Homo sapiens
tttcctcccttc

SEQ ID NO: 3636107 - DNA, 13 bp, Homo sapiens
tttcctcccttct

SEQ ID NO: 3636108 - DNA, 19 bp, Homo sapiens
tttcctcccttctgctact

SEQ ID NO: 3636109 - DNA, 14 bp, Homo sapiens
tttcctgcatctct

SEQ ID NO: 3636110 - DNA, 12 bp, Homo sapiens
tttcctgggcct

SEQ ID NO: 3636111 - DNA, 18 bp, Homo sapiens
tttccttatttgccttct

SEQ ID NO: 3636112 - DNA, 18 bp, Homo sapiens
tttccttcaggcagctga

SEQ ID NO: 3636113 - DNA, 21 bp, Homo sapiens
tttccttcaggcagctgaaat

SEQ ID NO: 3636114 - DNA, 14 bp, Homo sapiens
tttccttctgaagt

SEQ ID NO: 3636115 - DNA, 20 bp, Homo sapiens
tttccttctgaagtctgagc

SEQ ID NO: 3636116 - DNA, 15 bp, Homo sapiens
tttccttgtagcatt

SEQ ID NO: 3636117 - DNA, 13 bp, Homo sapiens
tttccttgtcccg

SEQ ID NO: 3636118 - DNA, 13 bp, Homo sapiens
tttcctttaaatt

SEQ ID NO: 3636119 - DNA, 9 bp, Homo sapiens
tttcctttt

SEQ ID NO: 3636120 - DNA, 20 bp, Homo sapiens
tttccttttgggggtaaagt

SEQ ID NO: 3636121 - DNA, 20 bp, Homo sapiens
tttcgactggtccagctctg

SEQ ID NO: 3636122 - DNA, 13 bp, Homo sapiens
tttcgataaacaa

SEQ ID NO: 3636123 - DNA, 16 bp, Homo sapiens
tttcgtctactgcaag

SEQ ID NO: 3636124 - DNA, 15 bp, Homo sapiens
tttctaaaatctaaa

SEQ ID NO: 3636125 - DNA, 15 bp, Homo sapiens
tttctaagtatttaa

SEQ ID NO: 3636126 - DNA, 21 bp, Homo sapiens
tttctaatacaagcatatgtt

SEQ ID NO: 3636127 - DNA, 17 bp, Homo sapiens
tttctaatccttttcct

SEQ ID NO: 3636128 - DNA, 18 bp, Homo sapiens
tttctaatccttttcctt

SEQ ID NO: 3636129 - DNA, 15 bp, Homo sapiens
tttctaatgtgtgaa

SEQ ID NO: 3636130 - DNA, 21 bp, Homo sapiens
tttctacattcagattatatg

SEQ ID NO: 3636131 - DNA, 16 bp, Homo sapiens
tttctaccatttcaga

SEQ ID NO: 3636132 - DNA, 23 bp, Homo sapiens
tttctacccttggaaagaaatgt

SEQ ID NO: 3636133 - DNA, 13 bp, Homo sapiens
tttctagaaagag

SEQ ID NO: 3636134 - DNA, 18 bp, Homo sapiens
tttctatacagtagcttg

SEQ ID NO: 3636135 - DNA, 23 bp, Homo sapiens
tttctatacagtagcttgaaatt

SEQ ID NO: 3636136 - DNA, 23 bp, Homo sapiens
tttctatataaaatgtattcaag

SEQ ID NO: 3636137 - DNA, 18 bp, Homo sapiens
tttctatattcctccagc

SEQ ID NO: 3636138 - DNA, 21 bp, Homo sapiens
tttctatattcctccagctgg

SEQ ID NO: 3636139 - DNA, 17 bp, Homo sapiens
tttctcataattttgca

SEQ ID NO: 3636140 - DNA, 22 bp, Homo sapiens
tttctcatgttgaagctttaag

SEQ ID NO: 3636141 - DNA, 22 bp, Homo sapiens
tttctccatcccctccctgcct

SEQ ID NO: 3636142 - DNA, 11 bp, Homo sapiens
tttctccatgt

SEQ ID NO: 3636143 - DNA, 23 bp, Homo sapiens
tttctccttgaatatctttcgat

SEQ ID NO: 3636144 - DNA, 12 bp, Homo sapiens
tttctctgggct

SEQ ID NO: 3636145 - DNA, 11 bp, Homo sapiens
tttctctgtgg

SEQ ID NO: 3636146 - DNA, 21 bp, Homo sapiens
tttctcttccttttatataaa

SEQ ID NO: 3636147 - DNA, 22 bp, Homo sapiens
tttctgagaaagactattcaaa

SEQ ID NO: 3636148 - DNA, 14 bp, Homo sapiens
tttctgattctgat

SEQ ID NO: 3636149 - DNA, 17 bp, Homo sapiens
tttctgccaataaattc

SEQ ID NO: 3636150 - DNA, 21 bp, Homo sapiens
tttctgccaataaattctaaa

SEQ ID NO: 3636151 - DNA, 15 bp, Homo sapiens
tttctgctcagcttc

SEQ ID NO: 3636152 - DNA, 18 bp, Homo sapiens
tttctgctcagcttctcc

SEQ ID NO: 3636153 - DNA, 19 bp, Homo sapiens
tttctgctctatactgtgg

SEQ ID NO: 3636154 - DNA, 22 bp, Homo sapiens
tttctgctctggaataaagttg

SEQ ID NO: 3636155 - DNA, 16 bp, Homo sapiens
tttctggcgcccctgc

SEQ ID NO: 3636156 - DNA, 15 bp, Homo sapiens
tttctgtaccagtta

SEQ ID NO: 3636157 - DNA, 13 bp, Homo sapiens
tttctgtcctggg

SEQ ID NO: 3636158 - DNA, 21 bp, Homo sapiens
tttcttaaaatgtcctatgta

SEQ ID NO: 3636159 - DNA, 13 bp, Homo sapiens
tttcttaacttct

SEQ ID NO: 3636160 - DNA, 17 bp, Homo sapiens
tttcttaacttcttgct

SEQ ID NO: 3636161 - DNA, 14 bp, Homo sapiens
tttcttaccagtct

SEQ ID NO: 3636162 - DNA, 13 bp, Homo sapiens
tttcttcctctgc

SEQ ID NO: 3636163 - DNA, 14 bp, Homo sapiens
tttcttcctctgct

SEQ ID NO: 3636164 - DNA, 13 bp, Homo sapiens
tttcttctacttt

SEQ ID NO: 3636165 - DNA, 13 bp, Homo sapiens
tttcttctattaa

SEQ ID NO: 3636166 - DNA, 17 bp, Homo sapiens
tttcttctgaagattct

SEQ ID NO: 3636167 - DNA, 20 bp, Homo sapiens
tttcttgaagaataaattct

SEQ ID NO: 3636168 - DNA, 19 bp, Homo sapiens
tttcttgataattttcctt

SEQ ID NO: 3636169 - DNA, 18 bp, Homo sapiens
tttcttgctccctgactg

SEQ ID NO: 3636170 - DNA, 12 bp, Homo sapiens
tttcttgctgct

SEQ ID NO: 3636171 - DNA, 14 bp, Homo sapiens
tttcttgtctgtta

SEQ ID NO: 3636172 - DNA, 14 bp, Homo sapiens
tttctttccaaaac

SEQ ID NO: 3636173 - DNA, 20 bp, Homo sapiens
tttctttgcaccaaagacat

SEQ ID NO: 3636174 - DNA, 19 bp, Homo sapiens
tttctttgccatctctgct

SEQ ID NO: 3636175 - DNA, 22 bp, Homo sapiens
tttctttgccatctctgctcca

SEQ ID NO: 3636176 - DNA, 14 bp, Homo sapiens
tttctttgcctctg

SEQ ID NO: 3636177 - DNA, 22 bp, Homo sapiens
tttctttgcctctgcagtctca

SEQ ID NO: 3636178 - DNA, 12 bp, Homo sapiens
tttctttggaaa

SEQ ID NO: 3636179 - DNA, 16 bp, Homo sapiens
tttctttgtcattcag

SEQ ID NO: 3636180 - DNA, 19 bp, Homo sapiens
tttctttgtcattcagttc

SEQ ID NO: 3636181 - DNA, 21 bp, Homo sapiens
tttctttgtcattcagttcta

SEQ ID NO: 3636182 - DNA, 16 bp, Homo sapiens
tttcttttctctggta

SEQ ID NO: 3636183 - DNA, 16 bp, Homo sapiens
tttcttttgaattgtt

SEQ ID NO: 3636184 - DNA, 16 bp, Homo sapiens
tttgaaaagcagacat

SEQ ID NO: 3636185 - DNA, 13 bp, Homo sapiens
tttgaaagaagca

SEQ ID NO: 3636186 - DNA, 20 bp, Homo sapiens
tttgaaatgaggtctgttta

SEQ ID NO: 3636187 - DNA, 22 bp, Homo sapiens
tttgaaattatgtgacatttta

SEQ ID NO: 3636188 - DNA, 16 bp, Homo sapiens
tttgaacacttactgt

SEQ ID NO: 3636189 - DNA, 11 bp, Homo sapiens
tttgaagaagg

SEQ ID NO: 3636190 - DNA, 18 bp, Homo sapiens
tttgaagaaggcaaggct

SEQ ID NO: 3636191 - DNA, 20 bp, Homo sapiens
tttgaagaccaatcaaatat

SEQ ID NO: 3636192 - DNA, 21 bp, Homo sapiens
tttgaagcaactgtgaattca

SEQ ID NO: 3636193 - DNA, 15 bp, Homo sapiens
tttgaaggagaatgg

SEQ ID NO: 3636194 - DNA, 21 bp, Homo sapiens
tttgaaggtagaatgttttca

SEQ ID NO: 3636195 - DNA, 20 bp, Homo sapiens
tttgaagtgctgtttattaa

SEQ ID NO: 3636196 - DNA, 15 bp, Homo sapiens
tttgaataaatgtca

SEQ ID NO: 3636197 - DNA, 13 bp, Homo sapiens
tttgaatacattt

SEQ ID NO: 3636198 - DNA, 17 bp, Homo sapiens
tttgaatacatttgtat

SEQ ID NO: 3636199 - DNA, 18 bp, Homo sapiens
tttgaatgctgcaagtta

SEQ ID NO: 3636200 - DNA, 14 bp, Homo sapiens
tttgaatttactgg

SEQ ID NO: 3636201 - DNA, 15 bp, Homo sapiens
tttgacaccttagag

SEQ ID NO: 3636202 - DNA, 15 bp, Homo sapiens
tttgacactgctcta

SEQ ID NO: 3636203 - DNA, 20 bp, Homo sapiens
tttgaccagaactttttcct

SEQ ID NO: 3636204 - DNA, 21 bp, Homo sapiens
tttgaccagtttaagccgcag

SEQ ID NO: 3636205 - DNA, 23 bp, Homo sapiens
tttgacctgttgggagtgaggat

SEQ ID NO: 3636206 - DNA, 18 bp, Homo sapiens
tttgactttcttctgaat

SEQ ID NO: 3636207 - DNA, 20 bp, Homo sapiens
tttgagcatcacttaggaga

SEQ ID NO: 3636208 - DNA, 14 bp, Homo sapiens
tttgaggtcagtgt

SEQ ID NO: 3636209 - DNA, 23 bp, Homo sapiens
tttgagtaattcaagcctctaaa

SEQ ID NO: 3636210 - DNA, 17 bp, Homo sapiens
tttgatagtaaatgtcc

SEQ ID NO: 3636211 - DNA, 17 bp, Homo sapiens
tttgatatttgcattga

SEQ ID NO: 3636212 - DNA, 21 bp, Homo sapiens
tttgatcgcctctttgacatt

SEQ ID NO: 3636213 - DNA, 23 bp, Homo sapiens
tttgatcttgtgctatgaaacaa

SEQ ID NO: 3636214 - DNA, 13 bp, Homo sapiens
tttgatttacata

SEQ ID NO: 3636215 - DNA, 14 bp, Homo sapiens
tttgatttgtacag

SEQ ID NO: 3636216 - DNA, 14 bp, Homo sapiens
tttgcaatatttat

SEQ ID NO: 3636217 - DNA, 19 bp, Homo sapiens
tttgcacaccattttgtaa

SEQ ID NO: 3636218 - DNA, 13 bp, Homo sapiens
tttgcaccaaaga

SEQ ID NO: 3636219 - DNA, 15 bp, Homo sapiens
tttgcaccaaagaca

SEQ ID NO: 3636220 - DNA, 17 bp, Homo sapiens
tttgcaccaaagacatc

SEQ ID NO: 3636221 - DNA, 22 bp, Homo sapiens
tttgcagatgtaattagttaag

SEQ ID NO: 3636222 - DNA, 13 bp, Homo sapiens
tttgcatattttg

SEQ ID NO: 3636223 - DNA, 24 bp, Homo sapiens
tttgcatattttgagaaactgctg

SEQ ID NO: 3636224 - DNA, 15 bp, Homo sapiens
tttgccagaggacca

SEQ ID NO: 3636225 - DNA, 10 bp, Homo sapiens
tttgccagcc

SEQ ID NO: 3636226 - DNA, 18 bp, Homo sapiens
tttgccagttttccctgg

SEQ ID NO: 3636227 - DNA, 18 bp, Homo sapiens
tttgccatctctgctcca

SEQ ID NO: 3636228 - DNA, 21 bp, Homo sapiens
tttgcctcttctttgtgcctt

SEQ ID NO: 3636229 - DNA, 18 bp, Homo sapiens
tttgccttttatgtaaat

SEQ ID NO: 3636230 - DNA, 21 bp, Homo sapiens
tttgcgcctcggtatctggct

SEQ ID NO: 3636231 - DNA, 12 bp, Homo sapiens
tttgctaactgg

SEQ ID NO: 3636232 - DNA, 13 bp, Homo sapiens
tttgctaactggg

SEQ ID NO: 3636233 - DNA, 15 bp, Homo sapiens
tttgctaactggtta

SEQ ID NO: 3636234 - DNA, 19 bp, Homo sapiens
tttgctatgagctggggat

SEQ ID NO: 3636235 - DNA, 17 bp, Homo sapiens
tttgctcaaaattgctt

SEQ ID NO: 3636236 - DNA, 20 bp, Homo sapiens
tttgctcaaaattgcttcta

SEQ ID NO: 3636237 - DNA, 12 bp, Homo sapiens
tttgctgcctta

SEQ ID NO: 3636238 - DNA, 12 bp, Homo sapiens
tttgctgtgctt

SEQ ID NO: 3636239 - DNA, 15 bp, Homo sapiens
tttgctttgctttct

SEQ ID NO: 3636240 - DNA, 19 bp, Homo sapiens
tttggaaatgatttactgg

SEQ ID NO: 3636241 - DNA, 19 bp, Homo sapiens
tttggagagggaaaatctt

SEQ ID NO: 3636242 - DNA, 15 bp, Homo sapiens
tttggatacagctgc

SEQ ID NO: 3636243 - DNA, 22 bp, Homo sapiens
tttggatacagctgctttgagc

SEQ ID NO: 3636244 - DNA, 12 bp, Homo sapiens
tttggatgttgc

SEQ ID NO: 3636245 - DNA, 20 bp, Homo sapiens
tttggatgttgctatagtga

SEQ ID NO: 3636246 - DNA, 20 bp, Homo sapiens
tttggattggggtccctcta

SEQ ID NO: 3636247 - DNA, 19 bp, Homo sapiens
tttggcagccatgataata

SEQ ID NO: 3636248 - DNA, 17 bp, Homo sapiens
tttggcatgatttaaag

SEQ ID NO: 3636249 - DNA, 21 bp, Homo sapiens
tttggcctggggtgcatctcc

SEQ ID NO: 3636250 - DNA, 15 bp, Homo sapiens
tttgggagccaggac

SEQ ID NO: 3636251 - DNA, 20 bp, Homo sapiens
tttgggaggaggaaaagaaa

SEQ ID NO: 3636252 - DNA, 21 bp, Homo sapiens
tttgggcagcaatttaaatgt

SEQ ID NO: 3636253 - DNA, 15 bp, Homo sapiens
tttgggttctgcctg

SEQ ID NO: 3636254 - DNA, 21 bp, Homo sapiens
tttggtccttcaaaggcttgt

SEQ ID NO: 3636255 - DNA, 19 bp, Homo sapiens
tttggtggggtggcacctg

SEQ ID NO: 3636256 - DNA, 14 bp, Homo sapiens
tttggtttcttcat

SEQ ID NO: 3636257 - DNA, 14 bp, Homo sapiens
tttgtaaaacttct

SEQ ID NO: 3636258 - DNA, 18 bp, Homo sapiens
tttgtaaaacttctgctc

SEQ ID NO: 3636259 - DNA, 16 bp, Homo sapiens
tttgtaaactcaaaat

SEQ ID NO: 3636260 - DNA, 17 bp, Homo sapiens
tttgtaaactcaaaata

SEQ ID NO: 3636261 - DNA, 19 bp, Homo sapiens
tttgtaaagttgcctttat

SEQ ID NO: 3636262 - DNA, 22 bp, Homo sapiens
tttgtaaagttgcctttatttg

SEQ ID NO: 3636263 - DNA, 14 bp, Homo sapiens
tttgtaactgtaaa

SEQ ID NO: 3636264 - DNA, 22 bp, Homo sapiens
tttgtaactgtttagatgaatg

SEQ ID NO: 3636265 - DNA, 19 bp, Homo sapiens
tttgtaataaactctctag

SEQ ID NO: 3636266 - DNA, 19 bp, Homo sapiens
tttgtaataataaagaata

SEQ ID NO: 3636267 - DNA, 15 bp, Homo sapiens
tttgtactgaaaaat

SEQ ID NO: 3636268 - DNA, 21 bp, Homo sapiens
tttgtacttgctccttttgct

SEQ ID NO: 3636269 - DNA, 17 bp, Homo sapiens
tttgtagtagcgttttt

SEQ ID NO: 3636270 - DNA, 16 bp, Homo sapiens
tttgtagtgaaataat

SEQ ID NO: 3636271 - DNA, 23 bp, Homo sapiens
tttgtagtggaaacatttatatt

SEQ ID NO: 3636272 - DNA, 17 bp, Homo sapiens
tttgtataaagaaactg

SEQ ID NO: 3636273 - DNA, 13 bp, Homo sapiens
tttgtataattgg

SEQ ID NO: 3636274 - DNA, 14 bp, Homo sapiens
tttgtatagaccaa

SEQ ID NO: 3636275 - DNA, 19 bp, Homo sapiens
tttgtatataggcttctca

SEQ ID NO: 3636276 - DNA, 16 bp, Homo sapiens
tttgtatttattaatt

SEQ ID NO: 3636277 - DNA, 13 bp, Homo sapiens
tttgtattttaca

SEQ ID NO: 3636278 - DNA, 21 bp, Homo sapiens
tttgtcaacagatttaaagaa

SEQ ID NO: 3636279 - DNA, 20 bp, Homo sapiens
tttgtcacttttttataaaa

SEQ ID NO: 3636280 - DNA, 12 bp, Homo sapiens
tttgtcatggtg

SEQ ID NO: 3636281 - DNA, 13 bp, Homo sapiens
tttgtcatggtga

SEQ ID NO: 3636282 - DNA, 16 bp, Homo sapiens
tttgtcatgttatgca

SEQ ID NO: 3636283 - DNA, 21 bp, Homo sapiens
tttgtcattcagttctaggcc

SEQ ID NO: 3636284 - DNA, 15 bp, Homo sapiens
tttgtctccaaagaa

SEQ ID NO: 3636285 - DNA, 13 bp, Homo sapiens
tttgtctgcagct

SEQ ID NO: 3636286 - DNA, 18 bp, Homo sapiens
tttgtgctttttgtcatg

SEQ ID NO: 3636287 - DNA, 21 bp, Homo sapiens
tttgtgctttttgtcatgtta

SEQ ID NO: 3636288 - DNA, 11 bp, Homo sapiens
tttgtggaaaa

SEQ ID NO: 3636289 - DNA, 15 bp, Homo sapiens
tttgtgttcagtttt

SEQ ID NO: 3636290 - DNA, 18 bp, Homo sapiens
tttgtgtttgattggctt

SEQ ID NO: 3636291 - DNA, 24 bp, Homo sapiens
tttgttaaaatacagttctgtcat

SEQ ID NO: 3636292 - DNA, 16 bp, Homo sapiens
tttgttatacttcaaa

SEQ ID NO: 3636293 - DNA, 12 bp, Homo sapiens
tttgttccctgt

SEQ ID NO: 3636294 - DNA, 15 bp, Homo sapiens
tttgttgcactaaaa

SEQ ID NO: 3636295 - DNA, 16 bp, Homo sapiens
tttgttgcactaaaat

SEQ ID NO: 3636296 - DNA, 14 bp, Homo sapiens
tttgttgctgtttt

SEQ ID NO: 3636297 - DNA, 21 bp, Homo sapiens
tttgtttagcctgaaaacctt

SEQ ID NO: 3636298 - DNA, 14 bp, Homo sapiens
tttgtttcctttgt

SEQ ID NO: 3636299 - DNA, 14 bp, Homo sapiens
tttgttttgttgga

SEQ ID NO: 3636300 - DNA, 22 bp, Homo sapiens
ttttaaaaaaactggatatttc

SEQ ID NO: 3636301 - DNA, 18 bp, Homo sapiens
ttttaaaaaggtaaatgg

SEQ ID NO: 3636302 - DNA, 13 bp, Homo sapiens
ttttaaacagtga

SEQ ID NO: 3636303 - DNA, 21 bp, Homo sapiens
ttttaaataaaagcacaagta

SEQ ID NO: 3636304 - DNA, 16 bp, Homo sapiens
ttttaaatgtatacta

SEQ ID NO: 3636305 - DNA, 13 bp, Homo sapiens
ttttaaattccac

SEQ ID NO: 3636306 - DNA, 21 bp, Homo sapiens
ttttaaattccactgaaaatt

SEQ ID NO: 3636307 - DNA, 20 bp, Homo sapiens
ttttaaattcccgttttgtc

SEQ ID NO: 3636308 - DNA, 16 bp, Homo sapiens
ttttaacaagaagcaa

SEQ ID NO: 3636309 - DNA, 14 bp, Homo sapiens
ttttaagaaagaaa

SEQ ID NO: 3636310 - DNA, 19 bp, Homo sapiens
ttttaataaactactcttt

SEQ ID NO: 3636311 - DNA, 21 bp, Homo sapiens
ttttaattcacgtgctttgtg

SEQ ID NO: 3636312 - DNA, 17 bp, Homo sapiens
ttttacaataaaatctt

SEQ ID NO: 3636313 - DNA, 15 bp, Homo sapiens
ttttacatgtttcca

SEQ ID NO: 3636314 - DNA, 13 bp, Homo sapiens
ttttacattaaat

SEQ ID NO: 3636315 - DNA, 13 bp, Homo sapiens
ttttaccaaagca

SEQ ID NO: 3636316 - DNA, 14 bp, Homo sapiens
ttttaccaaagcat

SEQ ID NO: 3636317 - DNA, 14 bp, Homo sapiens
ttttacctattctg

SEQ ID NO: 3636318 - DNA, 23 bp, Homo sapiens
ttttacctattctgaaaaagaca

SEQ ID NO: 3636319 - DNA, 14 bp, Homo sapiens
ttttactaatgata

SEQ ID NO: 3636320 - DNA, 15 bp, Homo sapiens
ttttactgaagcctt

SEQ ID NO: 3636321 - DNA, 22 bp, Homo sapiens
ttttactttttttttattttat

SEQ ID NO: 3636322 - DNA, 21 bp, Homo sapiens
ttttaggcaaagataatttat

SEQ ID NO: 3636323 - DNA, 14 bp, Homo sapiens
ttttaggtgcttta

SEQ ID NO: 3636324 - DNA, 23 bp, Homo sapiens
ttttagttggaaaaacaattcct

SEQ ID NO: 3636325 - DNA, 13 bp, Homo sapiens
ttttataaattaa

SEQ ID NO: 3636326 - DNA, 16 bp, Homo sapiens
ttttataacaatataa

SEQ ID NO: 3636327 - DNA, 13 bp, Homo sapiens
ttttatacactgt

SEQ ID NO: 3636328 - DNA, 22 bp, Homo sapiens
ttttatatacagaggaaatctg

SEQ ID NO: 3636329 - DNA, 20 bp, Homo sapiens
ttttatatttattgttagaa

SEQ ID NO: 3636330 - DNA, 23 bp, Homo sapiens
ttttatcccatttagtgtgaata

SEQ ID NO: 3636331 - DNA, 17 bp, Homo sapiens
ttttatccctcacctgt

SEQ ID NO: 3636332 - DNA, 12 bp, Homo sapiens
ttttatgtaaat

SEQ ID NO: 3636333 - DNA, 18 bp, Homo sapiens
ttttatgtctttcttgta

SEQ ID NO: 3636334 - DNA, 22 bp, Homo sapiens
ttttattaaaatatttcaggtt

SEQ ID NO: 3636335 - DNA, 15 bp, Homo sapiens
ttttatttcaattgt

SEQ ID NO: 3636336 - DNA, 13 bp, Homo sapiens
ttttatttgtaaa

SEQ ID NO: 3636337 - DNA, 23 bp, Homo sapiens
ttttcaaccagataacatacctt

SEQ ID NO: 3636338 - DNA, 14 bp, Homo sapiens
ttttcaagaaactg

SEQ ID NO: 3636339 - DNA, 16 bp, Homo sapiens
ttttcaatatatttgt

SEQ ID NO: 3636340 - DNA, 14 bp, Homo sapiens
ttttcaattaaacg

SEQ ID NO: 3636341 - DNA, 15 bp, Homo sapiens
ttttcaattaaacgg

SEQ ID NO: 3636342 - DNA, 21 bp, Homo sapiens
ttttcacactggtaaatgtta

SEQ ID NO: 3636343 - DNA, 20 bp, Homo sapiens
ttttcactgctggctgcctt

SEQ ID NO: 3636344 - DNA, 15 bp, Homo sapiens
ttttcagagaattat

SEQ ID NO: 3636345 - DNA, 23 bp, Homo sapiens
ttttcagagaattatctcaagta

SEQ ID NO: 3636346 - DNA, 15 bp, Homo sapiens
ttttcagtgcatcat

SEQ ID NO: 3636347 - DNA, 17 bp, Homo sapiens
ttttcataagatatttt

SEQ ID NO: 3636348 - DNA, 11 bp, Homo sapiens
ttttcatccat

SEQ ID NO: 3636349 - DNA, 23 bp, Homo sapiens
ttttcatgttttagcatttgtat

SEQ ID NO: 3636350 - DNA, 13 bp, Homo sapiens
ttttcatttatct

SEQ ID NO: 3636351 - DNA, 13 bp, Homo sapiens
ttttcatttgtaa

SEQ ID NO: 3636352 - DNA, 18 bp, Homo sapiens
ttttccaactactaatag

SEQ ID NO: 3636353 - DNA, 18 bp, Homo sapiens
ttttccaatcatttgact

SEQ ID NO: 3636354 - DNA, 21 bp, Homo sapiens
ttttccaggactgtttcaaac

SEQ ID NO: 3636355 - DNA, 20 bp, Homo sapiens
ttttccatttattaagcagt

SEQ ID NO: 3636356 - DNA, 22 bp, Homo sapiens
ttttcccccagcaacgcccctc

SEQ ID NO: 3636357 - DNA, 15 bp, Homo sapiens
ttttcccccttccca

SEQ ID NO: 3636358 - DNA, 19 bp, Homo sapiens
ttttccctggaactcctgg

SEQ ID NO: 3636359 - DNA, 20 bp, Homo sapiens
ttttccgtcacttaaatttg

SEQ ID NO: 3636360 - DNA, 17 bp, Homo sapiens
ttttcctagccctctca

SEQ ID NO: 3636361 - DNA, 18 bp, Homo sapiens
ttttcctccccgaagaca

SEQ ID NO: 3636362 - DNA, 13 bp, Homo sapiens
ttttcctccctca

SEQ ID NO: 3636363 - DNA, 14 bp, Homo sapiens
ttttcctcccttct

SEQ ID NO: 3636364 - DNA, 17 bp, Homo sapiens
ttttcctcccttctgct

SEQ ID NO: 3636365 - DNA, 20 bp, Homo sapiens
ttttcctcccttctgctact

SEQ ID NO: 3636366 - DNA, 21 bp, Homo sapiens
ttttcctcccttctgctactg

SEQ ID NO: 3636367 - DNA, 16 bp, Homo sapiens
ttttccttatttgcct

SEQ ID NO: 3636368 - DNA, 23 bp, Homo sapiens
ttttccttctgaagtctgagccc

SEQ ID NO: 3636369 - DNA, 22 bp, Homo sapiens
ttttcctttgctagttgtttgg

SEQ ID NO: 3636370 - DNA, 19 bp, Homo sapiens
ttttcggccccatgtatct

SEQ ID NO: 3636371 - DNA, 13 bp, Homo sapiens
ttttctaaaatct

SEQ ID NO: 3636372 - DNA, 12 bp, Homo sapiens
ttttctcccaag

SEQ ID NO: 3636373 - DNA, 14 bp, Homo sapiens
ttttctcccaagaa

SEQ ID NO: 3636374 - DNA, 19 bp, Homo sapiens
ttttctcccaagaaacctg

SEQ ID NO: 3636375 - DNA, 21 bp, Homo sapiens
ttttctcctcactgtatccag

SEQ ID NO: 3636376 - DNA, 13 bp, Homo sapiens
ttttctcctccca

SEQ ID NO: 3636377 - DNA, 14 bp, Homo sapiens
ttttctcggtgggg

SEQ ID NO: 3636378 - DNA, 20 bp, Homo sapiens
ttttctctaatgcttgattt

SEQ ID NO: 3636379 - DNA, 14 bp, Homo sapiens
ttttctctggtaat

SEQ ID NO: 3636380 - DNA, 17 bp, Homo sapiens
ttttctggaatacatga

SEQ ID NO: 3636381 - DNA, 14 bp, Homo sapiens
ttttctgtaccagt

SEQ ID NO: 3636382 - DNA, 14 bp, Homo sapiens
ttttctgtcctggg

SEQ ID NO: 3636383 - DNA, 13 bp, Homo sapiens
ttttcttcatcaa

SEQ ID NO: 3636384 - DNA, 13 bp, Homo sapiens
ttttctttgaata

SEQ ID NO: 3636385 - DNA, 16 bp, Homo sapiens
ttttctttgtgtagct

SEQ ID NO: 3636386 - DNA, 20 bp, Homo sapiens
ttttgaaaagcagacatttt

SEQ ID NO: 3636387 - DNA, 22 bp, Homo sapiens
ttttgaaatacctttgtagtta

SEQ ID NO: 3636388 - DNA, 13 bp, Homo sapiens
ttttgaaatgtca

SEQ ID NO: 3636389 - DNA, 21 bp, Homo sapiens
ttttgaagattctatgttaat

SEQ ID NO: 3636390 - DNA, 17 bp, Homo sapiens
ttttgaatacatttgta

SEQ ID NO: 3636391 - DNA, 23 bp, Homo sapiens
ttttgacagtgttgaaaatgttc

SEQ ID NO: 3636392 - DNA, 13 bp, Homo sapiens
ttttgagaaactg

SEQ ID NO: 3636393 - DNA, 18 bp, Homo sapiens
ttttgaggcaaaagaagg

SEQ ID NO: 3636394 - DNA, 15 bp, Homo sapiens
ttttgagtaattcaa

SEQ ID NO: 3636395 - DNA, 24 bp, Homo sapiens
ttttgatgagatattaaattctca

SEQ ID NO: 3636396 - DNA, 16 bp, Homo sapiens
ttttgatgagttgtga

SEQ ID NO: 3636397 - DNA, 16 bp, Homo sapiens
ttttgatgtaaagatg

SEQ ID NO: 3636398 - DNA, 18 bp, Homo sapiens
ttttgatgtaaagatgtt

SEQ ID NO: 3636399 - DNA, 21 bp, Homo sapiens
ttttgcactgaggatattcag

SEQ ID NO: 3636400 - DNA, 13 bp, Homo sapiens
ttttgccagccca

SEQ ID NO: 3636401 - DNA, 20 bp, Homo sapiens
ttttgcctgagaaggggcag

SEQ ID NO: 3636402 - DNA, 15 bp, Homo sapiens
ttttgctaactgggt

SEQ ID NO: 3636403 - DNA, 19 bp, Homo sapiens
ttttgctaactgggttaaa

SEQ ID NO: 3636404 - DNA, 16 bp, Homo sapiens
ttttgctgaattcctt

SEQ ID NO: 3636405 - DNA, 21 bp, Homo sapiens
ttttggatgttgctatagtga

SEQ ID NO: 3636406 - DNA, 24 bp, Homo sapiens
ttttggatgttgctatagtgacat

SEQ ID NO: 3636407 - DNA, 23 bp, Homo sapiens
ttttggcaatgactcaaagtctg

SEQ ID NO: 3636408 - DNA, 18 bp, Homo sapiens
ttttgggtgtttttcatg

SEQ ID NO: 3636409 - DNA, 18 bp, Homo sapiens
ttttggtccttctttcct

SEQ ID NO: 3636410 - DNA, 14 bp, Homo sapiens
ttttgtaattgctt

SEQ ID NO: 3636411 - DNA, 16 bp, Homo sapiens
ttttgtataattggat

SEQ ID NO: 3636412 - DNA, 22 bp, Homo sapiens
ttttgtcacctcaatatttact

SEQ ID NO: 3636413 - DNA, 14 bp, Homo sapiens
ttttgtcatgttat

SEQ ID NO: 3636414 - DNA, 17 bp, Homo sapiens
ttttgtcttttaatcca

SEQ ID NO: 3636415 - DNA, 22 bp, Homo sapiens
ttttgtcttttaatccatttca

SEQ ID NO: 3636416 - DNA, 23 bp, Homo sapiens
ttttgtggacatgcataaaaatt

SEQ ID NO: 3636417 - DNA, 14 bp, Homo sapiens
ttttgttgctttct

SEQ ID NO: 3636418 - DNA, 15 bp, Homo sapiens
ttttgttttcattat

SEQ ID NO: 3636419 - DNA, 15 bp, Homo sapiens
tttttaaaaataaag

SEQ ID NO: 3636420 - DNA, 15 bp, Homo sapiens
tttttaaacagggtc

SEQ ID NO: 3636421 - DNA, 14 bp, Homo sapiens
tttttaaagaatgt

SEQ ID NO: 3636422 - DNA, 18 bp, Homo sapiens
tttttaaataaaagcaca

SEQ ID NO: 3636423 - DNA, 21 bp, Homo sapiens
tttttaagaaagtaatttaat

SEQ ID NO: 3636424 - DNA, 22 bp, Homo sapiens
tttttacgtagctatttttata

SEQ ID NO: 3636425 - DNA, 13 bp, Homo sapiens
tttttactgccct

SEQ ID NO: 3636426 - DNA, 24 bp, Homo sapiens
tttttataacaatataactgagtt

SEQ ID NO: 3636427 - DNA, 17 bp, Homo sapiens
tttttatacactgtaag

SEQ ID NO: 3636428 - DNA, 17 bp, Homo sapiens
tttttatcccatttagt

SEQ ID NO: 3636429 - DNA, 16 bp, Homo sapiens
tttttatgttttgaaa

SEQ ID NO: 3636430 - DNA, 14 bp, Homo sapiens
tttttatttctaag

SEQ ID NO: 3636431 - DNA, 14 bp, Homo sapiens
tttttcaagagatc

SEQ ID NO: 3636432 - DNA, 13 bp, Homo sapiens
tttttcaattaaa

SEQ ID NO: 3636433 - DNA, 18 bp, Homo sapiens
tttttcaattaaacggat

SEQ ID NO: 3636434 - DNA, 19 bp, Homo sapiens
tttttcaattaaacggatt

SEQ ID NO: 3636435 - DNA, 11 bp, Homo sapiens
tttttcagacc

SEQ ID NO: 3636436 - DNA, 16 bp, Homo sapiens
tttttcatttgtaaaa

SEQ ID NO: 3636437 - DNA, 13 bp, Homo sapiens
tttttccagttca

SEQ ID NO: 3636438 - DNA, 13 bp, Homo sapiens
tttttccgtaaat

SEQ ID NO: 3636439 - DNA, 19 bp, Homo sapiens
tttttccgtaaatgtctgc

SEQ ID NO: 3636440 - DNA, 18 bp, Homo sapiens
tttttcctagccctctca

SEQ ID NO: 3636441 - DNA, 11 bp, Homo sapiens
tttttccttta

SEQ ID NO: 3636442 - DNA, 11 bp, Homo sapiens
tttttctaaaa

SEQ ID NO: 3636443 - DNA, 16 bp, Homo sapiens
tttttctgtaccagtt

SEQ ID NO: 3636444 - DNA, 13 bp, Homo sapiens
tttttcttcaaat

SEQ ID NO: 3636445 - DNA, 14 bp, Homo sapiens
tttttcttcgctgg

SEQ ID NO: 3636446 - DNA, 18 bp, Homo sapiens
tttttgaaaaagagattt

SEQ ID NO: 3636447 - DNA, 20 bp, Homo sapiens
tttttgaaaagcagacattt

SEQ ID NO: 3636448 - DNA, 18 bp, Homo sapiens
tttttgccagttttccct

SEQ ID NO: 3636449 - DNA, 15 bp, Homo sapiens
tttttggacacattt

SEQ ID NO: 3636450 - DNA, 24 bp, Homo sapiens
tttttggaccaccgttcagtcatt

SEQ ID NO: 3636451 - DNA, 21 bp, Homo sapiens
tttttgggcagcaatttaaat

SEQ ID NO: 3636452 - DNA, 22 bp, Homo sapiens
tttttggtcttctgttgacatt

SEQ ID NO: 3636453 - DNA, 12 bp, Homo sapiens
tttttgtatttt

SEQ ID NO: 3636454 - DNA, 18 bp, Homo sapiens
tttttgtattttacatgg

SEQ ID NO: 3636455 - DNA, 23 bp, Homo sapiens
tttttgtcacctcaatatttact

SEQ ID NO: 3636456 - DNA, 15 bp, Homo sapiens
tttttgttagcaaag

SEQ ID NO: 3636457 - DNA, 11 bp, Homo sapiens
ttttttacatt

SEQ ID NO: 3636458 - DNA, 12 bp, Homo sapiens
ttttttcaatat

SEQ ID NO: 3636459 - DNA, 11 bp, Homo sapiens
ttttttcagac

SEQ ID NO: 3636460 - DNA, 12 bp, Homo sapiens
ttttttcagacc

SEQ ID NO: 3636461 - DNA, 20 bp, Homo sapiens
ttttttgaaacacaatacct

SEQ ID NO: 3636462 - DNA, 20 bp, Homo sapiens
ttttttggtggtgaaattga

SEQ ID NO: 3636463 - DNA, 12 bp, Homo sapiens
tttttttacatt

SEQ ID NO: 3636464 - DNA, 12 bp, Homo sapiens
tttttttcctga

SEQ ID NO: 3636465 - DNA, 14 bp, Homo sapiens
aaaataatgctgca

SEQ ID NO: 3636466 - DNA, 19 bp, Homo sapiens
aaaataattttaaacaaag

SEQ ID NO: 3636467 - DNA, 14 bp, Homo sapiens
aaaataattttgta

SEQ ID NO: 3636468 - DNA, 21 bp, Homo sapiens
aaaatagagcttttaaaaatg

SEQ ID NO: 3636469 - DNA, 13 bp, Homo sapiens
aaaatatatacta

SEQ ID NO: 3636470 - DNA, 23 bp, Homo sapiens
aaaatattaacatattatttcat

SEQ ID NO: 3636471 - DNA, 22 bp, Homo sapiens
aaaatattactcagtttatgtt

SEQ ID NO: 3636472 - DNA, 13 bp, Homo sapiens
aaaatatttttgt

SEQ ID NO: 3636473 - DNA, 11 bp, Homo sapiens
aaaatcaactt

SEQ ID NO: 3636474 - DNA, 21 bp, Homo sapiens
aaaatcaccatctttgtcaaa

SEQ ID NO: 3636475 - DNA, 20 bp, Homo sapiens
aaaatcactggattataagt

SEQ ID NO: 3636476 - DNA, 12 bp, Homo sapiens
aaaatcatatag

SEQ ID NO: 3636477 - DNA, 11 bp, Homo sapiens
aaaatcatttc

SEQ ID NO: 3636478 - DNA, 21 bp, Homo sapiens
aaaatcatttctgcatcagct

SEQ ID NO: 3636479 - DNA, 17 bp, Homo sapiens
aaaatccaaaaagctct

SEQ ID NO: 3636480 - DNA, 18 bp, Homo sapiens
aaaatccaaaaagctctg

SEQ ID NO: 3636481 - DNA, 18 bp, Homo sapiens
aaaatcccaccttcccac

SEQ ID NO: 3636482 - DNA, 22 bp, Homo sapiens
aaaatcctgaactttctccctc

SEQ ID NO: 3636483 - DNA, 23 bp, Homo sapiens
aaaatcctgaactttctccctca

SEQ ID NO: 3636484 - DNA, 24 bp, Homo sapiens
aaaatctaaaatttcataattctg

SEQ ID NO: 3636485 - DNA, 15 bp, Homo sapiens
aaaatctgctaggga

SEQ ID NO: 3636486 - DNA, 12 bp, Homo sapiens
aaaatgaaagaa

SEQ ID NO: 3636487 - DNA, 16 bp, Homo sapiens
aaaatgaaatgcatat

SEQ ID NO: 3636488 - DNA, 18 bp, Homo sapiens
aaaatgaagaaggaagct

SEQ ID NO: 3636489 - DNA, 22 bp, Homo sapiens
aaaatgcattgaaagaattaga

SEQ ID NO: 3636490 - DNA, 19 bp, Homo sapiens
aaaatgctcaatttcagca

SEQ ID NO: 3636491 - DNA, 17 bp, Homo sapiens
aaaatggcgaacatgtg

SEQ ID NO: 3636492 - DNA, 17 bp, Homo sapiens
aaaatggttgatggaaa

SEQ ID NO: 3636493 - DNA, 20 bp, Homo sapiens
aaaatggttgatggaaaata

SEQ ID NO: 3636494 - DNA, 22 bp, Homo sapiens
aaaatggttgatggaaaataaa

SEQ ID NO: 3636495 - DNA, 21 bp, Homo sapiens
aaaatgtagggttataataat

SEQ ID NO: 3636496 - DNA, 17 bp, Homo sapiens
aaaatgtattcaagcaa

SEQ ID NO: 3636497 - DNA, 16 bp, Homo sapiens
aaaatgtcctgccttt

SEQ ID NO: 3636498 - DNA, 13 bp, Homo sapiens
aaaatgtgaaatg

SEQ ID NO: 3636499 - DNA, 14 bp, Homo sapiens
aaaatgtgaaatgc

SEQ ID NO: 3636500 - DNA, 15 bp, Homo sapiens
aaaatgtgaaatgct

SEQ ID NO: 3636501 - DNA, 11 bp, Homo sapiens
aaaatgtgtgg

SEQ ID NO: 3636502 - DNA, 15 bp, Homo sapiens
aaaatgttacgtgaa

SEQ ID NO: 3636503 - DNA, 16 bp, Homo sapiens
aaaattaaatggattt

SEQ ID NO: 3636504 - DNA, 21 bp, Homo sapiens
aaaattaatgcagatttctct

SEQ ID NO: 3636505 - DNA, 14 bp, Homo sapiens
aaaattacatgttt

SEQ ID NO: 3636506 - DNA, 21 bp, Homo sapiens
aaaattacatgttttttcatt

SEQ ID NO: 3636507 - DNA, 19 bp, Homo sapiens
aaaattaggatttcatgat

SEQ ID NO: 3636508 - DNA, 20 bp, Homo sapiens
aaaattgaatgtggctgaag

SEQ ID NO: 3636509 - DNA, 15 bp, Homo sapiens
aaaattgcttctaaa

SEQ ID NO: 3636510 - DNA, 19 bp, Homo sapiens
aaaattgcttctaaaacaa

SEQ ID NO: 3636511 - DNA, 20 bp, Homo sapiens
aaaattgtctgggttccaaa

SEQ ID NO: 3636512 - DNA, 21 bp, Homo sapiens
aaaatttatacaccagcaatt

SEQ ID NO: 3636513 - DNA, 20 bp, Homo sapiens
aaaatttcaggattaactaa

SEQ ID NO: 3636514 - DNA, 20 bp, Homo sapiens
aaaatttcataattctgaaa

SEQ ID NO: 3636515 - DNA, 24 bp, Homo sapiens
aaaatttgtcttaaaaatttatac

SEQ ID NO: 3636516 - DNA, 9 bp, Homo sapiens
aaacaaaac

SEQ ID NO: 3636517 - DNA, 16 bp, Homo sapiens
aaacaaaacaaacaaa

SEQ ID NO: 3636518 - DNA, 16 bp, Homo sapiens
aaacaaaatgaaacaa

SEQ ID NO: 3636519 - DNA, 12 bp, Homo sapiens
aaacaaacaaac

SEQ ID NO: 3636520 - DNA, 13 bp, Homo sapiens
aaacaaagacatt

SEQ ID NO: 3636521 - DNA, 20 bp, Homo sapiens
aaacaacgttgctatttcca

SEQ ID NO: 3636522 - DNA, 15 bp, Homo sapiens
aaacaagctgtgcag

SEQ ID NO: 3636523 - DNA, 18 bp, Homo sapiens
aaacaagtttagaaagct

SEQ ID NO: 3636524 - DNA, 15 bp, Homo sapiens
aaacaataaagcaat

SEQ ID NO: 3636525 - DNA, 12 bp, Homo sapiens
aaacaataagaa

SEQ ID NO: 3636526 - DNA, 14 bp, Homo sapiens
aaacaataagaaca

SEQ ID NO: 3636527 - DNA, 21 bp, Homo sapiens
aaacaataagaacaagttttg

SEQ ID NO: 3636528 - DNA, 20 bp, Homo sapiens
aaacaatctttcatgtcttg

SEQ ID NO: 3636529 - DNA, 14 bp, Homo sapiens
aaacacaataccta

SEQ ID NO: 3636530 - DNA, 17 bp, Homo sapiens
aaacacaatacctacaa

SEQ ID NO: 3636531 - DNA, 11 bp, Homo sapiens
aaacacagcaa

SEQ ID NO: 3636532 - DNA, 13 bp, Homo sapiens
aaacactcatccc

SEQ ID NO: 3636533 - DNA, 13 bp, Homo sapiens
aaacactgcaaat

SEQ ID NO: 3636534 - DNA, 15 bp, Homo sapiens
aaacactgcaaattt

SEQ ID NO: 3636535 - DNA, 13 bp, Homo sapiens
aaacactttcaaa

SEQ ID NO: 3636536 - DNA, 14 bp, Homo sapiens
aaacactttcaaaa

SEQ ID NO: 3636537 - DNA, 21 bp, Homo sapiens
aaacagagtggcctccctgct

SEQ ID NO: 3636538 - DNA, 12 bp, Homo sapiens
aaacagcatgaa

SEQ ID NO: 3636539 - DNA, 16 bp, Homo sapiens
aaacaggaaaggagca

SEQ ID NO: 3636540 - DNA, 12 bp, Homo sapiens
aaacaggatcag

SEQ ID NO: 3636541 - DNA, 20 bp, Homo sapiens
aaacagtctcaggaaatcaa

SEQ ID NO: 3636542 - DNA, 16 bp, Homo sapiens
aaacagttggtaactt

SEQ ID NO: 3636543 - DNA, 18 bp, Homo sapiens
aaacagttggtaactttt

SEQ ID NO: 3636544 - DNA, 19 bp, Homo sapiens
aaacagttggtaacttttg

SEQ ID NO: 3636545 - DNA, 12 bp, Homo sapiens
aaacataataaa

SEQ ID NO: 3636546 - DNA, 19 bp, Homo sapiens
aaacatcccaattctttag

SEQ ID NO: 3636547 - DNA, 18 bp, Homo sapiens
aaacattattaagtaact

SEQ ID NO: 3636548 - DNA, 15 bp, Homo sapiens
aaacattcctccagc

SEQ ID NO: 3636549 - DNA, 17 bp, Homo sapiens
aaacattttaaatgaaa

SEQ ID NO: 3636550 - DNA, 17 bp, Homo sapiens
aaacattttttcttctg

SEQ ID NO: 3636551 - DNA, 18 bp, Homo sapiens
aaacattttttcttctga

SEQ ID NO: 3636552 - DNA, 17 bp, Homo sapiens
aaaccaatgaaattttg

SEQ ID NO: 3636553 - DNA, 12 bp, Homo sapiens
aaaccacagcag

SEQ ID NO: 3636554 - DNA, 15 bp, Homo sapiens
aaaccaggacattaa

SEQ ID NO: 3636555 - DNA, 21 bp, Homo sapiens
aaaccaggctttctagaaaga

SEQ ID NO: 3636556 - DNA, 15 bp, Homo sapiens
aaaccatgcaaatgc

SEQ ID NO: 3636557 - DNA, 13 bp, Homo sapiens
aaacccaagtccc

SEQ ID NO: 3636558 - DNA, 14 bp, Homo sapiens
aaaccccctgcagc

SEQ ID NO: 3636559 - DNA, 16 bp, Homo sapiens
aaacccttgctttcct

SEQ ID NO: 3636560 - DNA, 17 bp, Homo sapiens
aaacctctcctgacccc

SEQ ID NO: 3636561 - DNA, 17 bp, Homo sapiens
aaacctgggaaggccag

SEQ ID NO: 3636562 - DNA, 18 bp, Homo sapiens
aaacctgggaaggccagc

SEQ ID NO: 3636563 - DNA, 22 bp, Homo sapiens
aaaccttaaaagtaataaagag

SEQ ID NO: 3636564 - DNA, 17 bp, Homo sapiens
aaaccttgctctcctca

SEQ ID NO: 3636565 - DNA, 20 bp, Homo sapiens
aaaccttgctctcctcatct

SEQ ID NO: 3636566 - DNA, 17 bp, Homo sapiens
aaacgcgtctgcctggg

SEQ ID NO: 3636567 - DNA, 12 bp, Homo sapiens
aaacggattatt

SEQ ID NO: 3636568 - DNA, 20 bp, Homo sapiens
aaacggattattttttcaga

SEQ ID NO: 3636569 - DNA, 17 bp, Homo sapiens
aaacggttcctggtgac

SEQ ID NO: 3636570 - DNA, 15 bp, Homo sapiens
aaactaaccttgaat

SEQ ID NO: 3636571 - DNA, 17 bp, Homo sapiens
aaactaaccttgaataa

SEQ ID NO: 3636572 - DNA, 12 bp, Homo sapiens
aaactacatttc

SEQ ID NO: 3636573 - DNA, 12 bp, Homo sapiens
aaactactcttt

SEQ ID NO: 3636574 - DNA, 13 bp, Homo sapiens
aaactactctttg

SEQ ID NO: 3636575 - DNA, 18 bp, Homo sapiens
aaactatatataatgtat

SEQ ID NO: 3636576 - DNA, 20 bp, Homo sapiens
aaactatcaactacaaatta

SEQ ID NO: 3636577 - DNA, 18 bp, Homo sapiens
aaactatttaaagaaata

SEQ ID NO: 3636578 - DNA, 13 bp, Homo sapiens
aaactcaggccca

SEQ ID NO: 3636579 - DNA, 15 bp, Homo sapiens
aaactccagatgcca

SEQ ID NO: 3636580 - DNA, 10 bp, Homo sapiens
aaactccagg

SEQ ID NO: 3636581 - DNA, 19 bp, Homo sapiens
aaactccatctcaaaacaa

SEQ ID NO: 3636582 - DNA, 22 bp, Homo sapiens
aaactccatctcaaaacaaaac

SEQ ID NO: 3636583 - DNA, 18 bp, Homo sapiens
aaactccatgatatttaa

SEQ ID NO: 3636584 - DNA, 13 bp, Homo sapiens
aaactctctgaac

SEQ ID NO: 3636585 - DNA, 11 bp, Homo sapiens
aaactctgctg

SEQ ID NO: 3636586 - DNA, 14 bp, Homo sapiens
aaactctgggtctt

SEQ ID NO: 3636587 - DNA, 20 bp, Homo sapiens
aaactctgggtcttggccat

SEQ ID NO: 3636588 - DNA, 19 bp, Homo sapiens
aaactctgttgcaagtgca

SEQ ID NO: 3636589 - DNA, 14 bp, Homo sapiens
aaactgacaatttt

SEQ ID NO: 3636590 - DNA, 18 bp, Homo sapiens
aaactgacagatgctttt

SEQ ID NO: 3636591 - DNA, 23 bp, Homo sapiens
aaactgagatgtgaacacatcag

SEQ ID NO: 3636592 - DNA, 14 bp, Homo sapiens
aaactgaggaattt

SEQ ID NO: 3636593 - DNA, 19 bp, Homo sapiens
aaactgaggaattttcttt

SEQ ID NO: 3636594 - DNA, 16 bp, Homo sapiens
aaactgaggcccagag

SEQ ID NO: 3636595 - DNA, 11 bp, Homo sapiens
aaactgcagcc

SEQ ID NO: 3636596 - DNA, 15 bp, Homo sapiens
aaactgcagcctctc

SEQ ID NO: 3636597 - DNA, 15 bp, Homo sapiens
aaactgccagcaacg

SEQ ID NO: 3636598 - DNA, 16 bp, Homo sapiens
aaactgctgcagatta

SEQ ID NO: 3636599 - DNA, 13 bp, Homo sapiens
aaattaatcacaa

SEQ ID NO: 3636600 - DNA, 22 bp, Homo sapiens
aaattaatgcagatttctcttt

SEQ ID NO: 3636601 - DNA, 19 bp, Homo sapiens
aaattaatgttccagtttg

SEQ ID NO: 3636602 - DNA, 22 bp, Homo sapiens
aaattacacccaaagaggtatt

SEQ ID NO: 3636603 - DNA, 19 bp, Homo sapiens
aaattaggatttcatgatt

SEQ ID NO: 3636604 - DNA, 22 bp, Homo sapiens
aaattataactattacagtgtt

SEQ ID NO: 3636605 - DNA, 21 bp, Homo sapiens
aaattatatgatatgcatgta

SEQ ID NO: 3636606 - DNA, 17 bp, Homo sapiens
aaattatgtgacatttt

SEQ ID NO: 3636607 - DNA, 20 bp, Homo sapiens
aaattatgtgacattttaca

SEQ ID NO: 3636608 - DNA, 22 bp, Homo sapiens
aaattatgttttactgttcatt

SEQ ID NO: 3636609 - DNA, 13 bp, Homo sapiens
aaattattacttt

SEQ ID NO: 3636610 - DNA, 20 bp, Homo sapiens
aaattcaggctactgcttca

SEQ ID NO: 3636611 - DNA, 10 bp, Homo sapiens
aaattcaggt

SEQ ID NO: 3636612 - DNA, 11 bp, Homo sapiens
aaattcaggtg

SEQ ID NO: 3636613 - DNA, 13 bp, Homo sapiens
aaattcatttttt

SEQ ID NO: 3636614 - DNA, 14 bp, Homo sapiens
aaattcctctttgc

SEQ ID NO: 3636615 - DNA, 14 bp, Homo sapiens
aaattctaaattac

SEQ ID NO: 3636616 - DNA, 21 bp, Homo sapiens
aaattctaaattacaaaggta

SEQ ID NO: 3636617 - DNA, 17 bp, Homo sapiens
aaattctactaagttat

SEQ ID NO: 3636618 - DNA, 18 bp, Homo sapiens
aaattctactaagttatt

SEQ ID NO: 3636619 - DNA, 20 bp, Homo sapiens
aaattgaatgtggctgaagt

SEQ ID NO: 3636620 - DNA, 23 bp, Homo sapiens
aaattgactgatgattttccttt

SEQ ID NO: 3636621 - DNA, 16 bp, Homo sapiens
aaattgcactgaagtt

SEQ ID NO: 3636622 - DNA, 21 bp, Homo sapiens
aaattgcactgaagtttttga

SEQ ID NO: 3636623 - DNA, 22 bp, Homo sapiens
aaattgcactgaagtttttgaa

SEQ ID NO: 3636624 - DNA, 19 bp, Homo sapiens
aaattgcagtttacagtat

SEQ ID NO: 3636625 - DNA, 14 bp, Homo sapiens
aaattgctccttga

SEQ ID NO: 3636626 - DNA, 19 bp, Homo sapiens
aaattgcttctaaaacaat

SEQ ID NO: 3636627 - DNA, 20 bp, Homo sapiens
aaattgcttctaaaacaata

SEQ ID NO: 3636628 - DNA, 17 bp, Homo sapiens
aaattggtaaaaataaa

SEQ ID NO: 3636629 - DNA, 15 bp, Homo sapiens
aaattgtgatgtgtc

SEQ ID NO: 3636630 - DNA, 16 bp, Homo sapiens
aaattgttatcaaaat

SEQ ID NO: 3636631 - DNA, 19 bp, Homo sapiens
aaatttaatccttctttgt

SEQ ID NO: 3636632 - DNA, 13 bp, Homo sapiens
aaatttaattaca

SEQ ID NO: 3636633 - DNA, 16 bp, Homo sapiens
aaatttaattacaaac

SEQ ID NO: 3636634 - DNA, 18 bp, Homo sapiens
aaatttaattacaaacaa

SEQ ID NO: 3636635 - DNA, 19 bp, Homo sapiens
aaatttaattacaaacaat

SEQ ID NO: 3636636 - DNA, 19 bp, Homo sapiens
aaatttacctttttttagt

SEQ ID NO: 3636637 - DNA, 14 bp, Homo sapiens
aaatttactttaca

SEQ ID NO: 3636638 - DNA, 16 bp, Homo sapiens
aaatttataaaggtct

SEQ ID NO: 3636639 - DNA, 14 bp, Homo sapiens
aaatttcaggatta

SEQ ID NO: 3636640 - DNA, 19 bp, Homo sapiens
aaatttcaggattaactaa

SEQ ID NO: 3636641 - DNA, 23 bp, Homo sapiens
aaatttctcatcacagggattta

SEQ ID NO: 3636642 - DNA, 22 bp, Homo sapiens
aaatttgatttacatatattat

SEQ ID NO: 3636643 - DNA, 16 bp, Homo sapiens
aaatttgtcttaaaaa

SEQ ID NO: 3636644 - DNA, 22 bp, Homo sapiens
aaatttgtcttaaaaatttata

SEQ ID NO: 3636645 - DNA, 18 bp, Homo sapiens
aaatttgttataatgaat

SEQ ID NO: 3636646 - DNA, 13 bp, Homo sapiens
aaatttgttcttt

SEQ ID NO: 3636647 - DNA, 21 bp, Homo sapiens
aaattttgattaaccttttca

SEQ ID NO: 3636648 - DNA, 16 bp, Homo sapiens
aaatttttctgcttta

SEQ ID NO: 3636649 - DNA, 16 bp, Homo sapiens
aaattttttaaaggtt

SEQ ID NO: 3636650 - DNA, 13 bp, Homo sapiens
aaattttttacgt

SEQ ID NO: 3636651 - DNA, 21 bp, Homo sapiens
aaattttttacgtagctattt

SEQ ID NO: 3636652 - DNA, 13 bp, Homo sapiens
aaattttttgaaa

SEQ ID NO: 3636653 - DNA, 23 bp, Homo sapiens
aaattttttttcatgctttatca

SEQ ID NO: 3636654 - DNA, 20 bp, Homo sapiens
aaattttttttggtcaaatt

SEQ ID NO: 3636655 - DNA, 13 bp, Homo sapiens
aacaaaaaaccca

SEQ ID NO: 3636656 - DNA, 15 bp, Homo sapiens
aacaaaacaaaacaa

SEQ ID NO: 3636657 - DNA, 13 bp, Homo sapiens
aacaaaacttaaa

SEQ ID NO: 3636658 - DNA, 14 bp, Homo sapiens
aacaaacaaaactt

SEQ ID NO: 3636659 - DNA, 15 bp, Homo sapiens
aacaaacaaaactta

SEQ ID NO: 3636660 - DNA, 22 bp, Homo sapiens
aacaaaggcctaattctatgcc

SEQ ID NO: 3636661 - DNA, 16 bp, Homo sapiens
aacaaatgaaatttaa

SEQ ID NO: 3636662 - DNA, 16 bp, Homo sapiens
aacaagaaccactcct

SEQ ID NO: 3636663 - DNA, 12 bp, Homo sapiens
aacaagctgtgc

SEQ ID NO: 3636664 - DNA, 14 bp, Homo sapiens
aacaagctgtgcag

SEQ ID NO: 3636665 - DNA, 12 bp, Homo sapiens
aacaagcttcag

SEQ ID NO: 3636666 - DNA, 21 bp, Homo sapiens
aacaagtgaaataacaaaatg

SEQ ID NO: 3636667 - DNA, 21 bp, Homo sapiens
aacaagttttggcagccatga

SEQ ID NO: 3636668 - DNA, 15 bp, Homo sapiens
aacaataaagcaata

SEQ ID NO: 3636669 - DNA, 17 bp, Homo sapiens
aacaataagaacaagtt

SEQ ID NO: 3636670 - DNA, 15 bp, Homo sapiens
aacaatccattcaca

SEQ ID NO: 3636671 - DNA, 16 bp, Homo sapiens
aacaatccattcacaa

SEQ ID NO: 3636672 - DNA, 20 bp, Homo sapiens
aacaatccattcacaagcct

SEQ ID NO: 3636673 - DNA, 18 bp, Homo sapiens
aacaatcccaatctttct

SEQ ID NO: 3636674 - DNA, 19 bp, Homo sapiens
aacaatcccaatctttcta

SEQ ID NO: 3636675 - DNA, 21 bp, Homo sapiens
aacaatcccaatctttctata

SEQ ID NO: 3636676 - DNA, 14 bp, Homo sapiens
aacaatcttccaaa

SEQ ID NO: 3636677 - DNA, 19 bp, Homo sapiens
aacaatgaatcagaacaga

SEQ ID NO: 3636678 - DNA, 17 bp, Homo sapiens
aacaattcagtaacaaa

SEQ ID NO: 3636679 - DNA, 15 bp, Homo sapiens
aacacaaaaaaaatt

SEQ ID NO: 3636680 - DNA, 17 bp, Homo sapiens
aacacaaacccccactc

SEQ ID NO: 3636681 - DNA, 21 bp, Homo sapiens
aacacaatacctacaataaac

SEQ ID NO: 3636682 - DNA, 15 bp, Homo sapiens
aacacagcaagggtg

SEQ ID NO: 3636683 - DNA, 18 bp, Homo sapiens
aacacagcaattcctcag

SEQ ID NO: 3636684 - DNA, 22 bp, Homo sapiens
aacacagctacaaccctaccct

SEQ ID NO: 3636685 - DNA, 14 bp, Homo sapiens
aacacagttctggg

SEQ ID NO: 3636686 - DNA, 14 bp, Homo sapiens
aacacatctggctg

SEQ ID NO: 3636687 - DNA, 17 bp, Homo sapiens
aacaccctggatgctgt

SEQ ID NO: 3636688 - DNA, 13 bp, Homo sapiens
aacacctcccagg

SEQ ID NO: 3636689 - DNA, 15 bp, Homo sapiens
aacactaaaaataaa

SEQ ID NO: 3636690 - DNA, 16 bp, Homo sapiens
aacactaaattgcagt

SEQ ID NO: 3636691 - DNA, 23 bp, Homo sapiens
aacactaaattgcagtttacagt

SEQ ID NO: 3636692 - DNA, 14 bp, Homo sapiens
aacactgaaatgaa

SEQ ID NO: 3636693 - DNA, 15 bp, Homo sapiens
aacactgaaatgaaa

SEQ ID NO: 3636694 - DNA, 15 bp, Homo sapiens
aacactgttttatag

SEQ ID NO: 3636695 - DNA, 15 bp, Homo sapiens
aacagaaaaataagt

SEQ ID NO: 3636696 - DNA, 16 bp, Homo sapiens
aacagaaaaataagtc

SEQ ID NO: 3636697 - DNA, 16 bp, Homo sapiens
aacagaaacaaaaaca

SEQ ID NO: 3636698 - DNA, 13 bp, Homo sapiens
aacagaaactaca

SEQ ID NO: 3636699 - DNA, 22 bp, Homo sapiens
aacagaaagcctgggtgacatt

SEQ ID NO: 3636700 - DNA, 23 bp, Homo sapiens
aacagaactcggtgtccccacca

SEQ ID NO: 3636701 - DNA, 19 bp, Homo sapiens
aacagagtggcctccctgc

SEQ ID NO: 3636702 - DNA, 21 bp, Homo sapiens
aacagagtggcctccctgctg

SEQ ID NO: 3636703 - DNA, 17 bp, Homo sapiens
aacagatcctttcaaaa

SEQ ID NO: 3636704 - DNA, 19 bp, Homo sapiens
aacagattattaccttaca

SEQ ID NO: 3636705 - DNA, 14 bp, Homo sapiens
aacagatttggaaa

SEQ ID NO: 3636706 - DNA, 15 bp, Homo sapiens
aacagatttggaaag

SEQ ID NO: 3636707 - DNA, 21 bp, Homo sapiens
aacagcagtctccttcagcac

SEQ ID NO: 3636708 - DNA, 23 bp, Homo sapiens
aacagcagtctccttcagcacgg

SEQ ID NO: 3636709 - DNA, 13 bp, Homo sapiens
aacagccaagctg

SEQ ID NO: 3636710 - DNA, 16 bp, Homo sapiens
aacagccaagctggca

SEQ ID NO: 3636711 - DNA, 19 bp, Homo sapiens
aacagccctatttcttgat

SEQ ID NO: 3636712 - DNA, 17 bp, Homo sapiens
aacagccttagagctct

SEQ ID NO: 3636713 - DNA, 19 bp, Homo sapiens
aacagccttagagctcttg

SEQ ID NO: 3636714 - DNA, 15 bp, Homo sapiens
aacagctcagccagt

SEQ ID NO: 3636715 - DNA, 18 bp, Homo sapiens
aacagctcagccagtggg

SEQ ID NO: 3636716 - DNA, 22 bp, Homo sapiens
aacagctttgtctccaaagaag

SEQ ID NO: 3636717 - DNA, 14 bp, Homo sapiens
aacaggtattttgt

SEQ ID NO: 3636718 - DNA, 22 bp, Homo sapiens
aacaggtattttgtttctttta

SEQ ID NO: 3636719 - DNA, 14 bp, Homo sapiens
aacagtctcaggaa

SEQ ID NO: 3636720 - DNA, 17 bp, Homo sapiens
aacagttggtaactttt

SEQ ID NO: 3636721 - DNA, 22 bp, Homo sapiens
aacagttggtaacttttgtgaa

SEQ ID NO: 3636722 - DNA, 13 bp, Homo sapiens
aacataataaatc

SEQ ID NO: 3636723 - DNA, 21 bp, Homo sapiens
aacatatactatttagtctca

SEQ ID NO: 3636724 - DNA, 19 bp, Homo sapiens
aacatcaaataaatttctg

SEQ ID NO: 3636725 - DNA, 19 bp, Homo sapiens
aacatgctgttatttaggt

SEQ ID NO: 3636726 - DNA, 21 bp, Homo sapiens
aacatgggagcttattgctaa

SEQ ID NO: 3636727 - DNA, 22 bp, Homo sapiens
aacatggtggaaaacgaagctc

SEQ ID NO: 3636728 - DNA, 17 bp, Homo sapiens
aacatgtgaaaagaata

SEQ ID NO: 3636729 - DNA, 21 bp, Homo sapiens
aacattaatatttaccaaagt

SEQ ID NO: 3636730 - DNA, 18 bp, Homo sapiens
aacattacttatttaact

SEQ ID NO: 3636731 - DNA, 15 bp, Homo sapiens
aagctcccaccccac

SEQ ID NO: 3636732 - DNA, 19 bp, Homo sapiens
aagctcctctccccagccc

SEQ ID NO: 3636733 - DNA, 20 bp, Homo sapiens
aagctcctctccccagccca

SEQ ID NO: 3636734 - DNA, 20 bp, Homo sapiens
aagctctccgagctctggtg

SEQ ID NO: 3636735 - DNA, 14 bp, Homo sapiens
aagctctgaaaaca

SEQ ID NO: 3636736 - DNA, 13 bp, Homo sapiens
aagctgaatattt

SEQ ID NO: 3636737 - DNA, 22 bp, Homo sapiens
aagctgagagaccctggcctca

SEQ ID NO: 3636738 - DNA, 14 bp, Homo sapiens
aagctgctgtgtcc

SEQ ID NO: 3636739 - DNA, 21 bp, Homo sapiens
aagctggcacaaaagacagct

SEQ ID NO: 3636740 - DNA, 21 bp, Homo sapiens
aagctggctgtacctgttcct

SEQ ID NO: 3636741 - DNA, 20 bp, Homo sapiens
aagctgggaagaccctttca

SEQ ID NO: 3636742 - DNA, 18 bp, Homo sapiens
aagctggtggcctctgca

SEQ ID NO: 3636743 - DNA, 14 bp, Homo sapiens
aagctgtccctgca

SEQ ID NO: 3636744 - DNA, 16 bp, Homo sapiens
aagctgtccctgcagg

SEQ ID NO: 3636745 - DNA, 15 bp, Homo sapiens
aagctgtgttgaaac

SEQ ID NO: 3636746 - DNA, 16 bp, Homo sapiens
aagctgtgttgaaaca

SEQ ID NO: 3636747 - DNA, 21 bp, Homo sapiens
aagctgtgttgaaacagaaaa

SEQ ID NO: 3636748 - DNA, 13 bp, Homo sapiens
aagcttccatgat

SEQ ID NO: 3636749 - DNA, 19 bp, Homo sapiens
aagcttccatgatgcacag

SEQ ID NO: 3636750 - DNA, 19 bp, Homo sapiens
aagcttggtgacaaaattc

SEQ ID NO: 3636751 - DNA, 20 bp, Homo sapiens
aagcttggtgacaaaattca

SEQ ID NO: 3636752 - DNA, 16 bp, Homo sapiens
aagcttggttctgtga

SEQ ID NO: 3636753 - DNA, 16 bp, Homo sapiens
aagctttgttctggga

SEQ ID NO: 3636754 - DNA, 20 bp, Homo sapiens
aagctttgttgaaagaaagt

SEQ ID NO: 3636755 - DNA, 13 bp, Homo sapiens
aagcttttgctca

SEQ ID NO: 3636756 - DNA, 16 bp, Homo sapiens
aagctttttaaaattt

SEQ ID NO: 3636757 - DNA, 22 bp, Homo sapiens
aaggaacaaaaattacaaagaa

SEQ ID NO: 3636758 - DNA, 13 bp, Homo sapiens
aaggaacaaagac

SEQ ID NO: 3636759 - DNA, 13 bp, Homo sapiens
aaggaatttaaaa

SEQ ID NO: 3636760 - DNA, 16 bp, Homo sapiens
aaggaatttaaaactg

SEQ ID NO: 3636761 - DNA, 16 bp, Homo sapiens
aaggaatttcttaact

SEQ ID NO: 3636762 - DNA, 17 bp, Homo sapiens
aaggaatttcttaactt

SEQ ID NO: 3636763 - DNA, 20 bp, Homo sapiens
aaggaatttcttaacttctt

SEQ ID NO: 3636764 - DNA, 23 bp, Homo sapiens
aaggaatttcttaacttcttgct

SEQ ID NO: 3636765 - DNA, 14 bp, Homo sapiens
aaggacatcagcaa

SEQ ID NO: 3636766 - DNA, 18 bp, Homo sapiens
aaggacccggaggggcct

SEQ ID NO: 3636767 - DNA, 22 bp, Homo sapiens
aaggacccggaggggcctggca

SEQ ID NO: 3636768 - DNA, 21 bp, Homo sapiens
aaggacctcctaaataaatta

SEQ ID NO: 3636769 - DNA, 15 bp, Homo sapiens
aaggagaatggcatg

SEQ ID NO: 3636770 - DNA, 21 bp, Homo sapiens
aaggagctgctatagcctggg

SEQ ID NO: 3636771 - DNA, 17 bp, Homo sapiens
aaggaggaagcttattg

SEQ ID NO: 3636772 - DNA, 23 bp, Homo sapiens
aaggaggccaaccagcccgacag

SEQ ID NO: 3636773 - DNA, 12 bp, Homo sapiens
aaggagggtgag

SEQ ID NO: 3636774 - DNA, 14 bp, Homo sapiens
aaggagttggtgta

SEQ ID NO: 3636775 - DNA, 16 bp, Homo sapiens
aaggatagtgtgaaga

SEQ ID NO: 3636776 - DNA, 22 bp, Homo sapiens
aaggatctgtgattggctggtt

SEQ ID NO: 3636777 - DNA, 19 bp, Homo sapiens
aaggatgatgtctttttat

SEQ ID NO: 3636778 - DNA, 16 bp, Homo sapiens
aaggattacagaaact

SEQ ID NO: 3636779 - DNA, 19 bp, Homo sapiens
aaggattacagaaactgat

SEQ ID NO: 3636780 - DNA, 17 bp, Homo sapiens
aaggattttaccaaagc

SEQ ID NO: 3636781 - DNA, 12 bp, Homo sapiens
aaggcacagtgg

SEQ ID NO: 3636782 - DNA, 14 bp, Homo sapiens
aaggcacagtggga

SEQ ID NO: 3636783 - DNA, 15 bp, Homo sapiens
aaggcagcgacccca

SEQ ID NO: 3636784 - DNA, 20 bp, Homo sapiens
aaggcagcgaccccaggacc

SEQ ID NO: 3636785 - DNA, 16 bp, Homo sapiens
aaggcagggcaagaac

SEQ ID NO: 3636786 - DNA, 18 bp, Homo sapiens
aaggcaggggaatgtatg

SEQ ID NO: 3636787 - DNA, 20 bp, Homo sapiens
aaggcaggggaatgtatgtg

SEQ ID NO: 3636788 - DNA, 14 bp, Homo sapiens
aaggcattctccca

SEQ ID NO: 3636789 - DNA, 19 bp, Homo sapiens
aaggccagcagctgatgct

SEQ ID NO: 3636790 - DNA, 22 bp, Homo sapiens
aaggccatccttccctgtctgc

SEQ ID NO: 3636791 - DNA, 12 bp, Homo sapiens
aaggcccaggag

SEQ ID NO: 3636792 - DNA, 14 bp, Homo sapiens
aaggcccctgcaat

SEQ ID NO: 3636793 - DNA, 13 bp, Homo sapiens
aaggccctgccct

SEQ ID NO: 3636794 - DNA, 17 bp, Homo sapiens
aaggcccttagagggaa

SEQ ID NO: 3636795 - DNA, 22 bp, Homo sapiens
aaggccggcagcgggcggaggg

SEQ ID NO: 3636796 - DNA, 22 bp, Homo sapiens
aaggcctaattctatgcctgtc

SEQ ID NO: 3636797 - DNA, 13 bp, Homo sapiens
aaggcctggaaga

SEQ ID NO: 3636798 - DNA, 18 bp, Homo sapiens
aaggctcagactgggcac

SEQ ID NO: 3636799 - DNA, 16 bp, Homo sapiens
aaggctgtacatagtc

SEQ ID NO: 3636800 - DNA, 15 bp, Homo sapiens
aagggaaagcctctg

SEQ ID NO: 3636801 - DNA, 16 bp, Homo sapiens
aagggaaagcctctgg

SEQ ID NO: 3636802 - DNA, 21 bp, Homo sapiens
aagggagccaagggatggaca

SEQ ID NO: 3636803 - DNA, 15 bp, Homo sapiens
aagggattgctgagg

SEQ ID NO: 3636804 - DNA, 17 bp, Homo sapiens
aagggattgctgaggca

SEQ ID NO: 3636805 - DNA, 11 bp, Homo sapiens
aagggccagag

SEQ ID NO: 3636806 - DNA, 16 bp, Homo sapiens
aagggcccacacctgg

SEQ ID NO: 3636807 - DNA, 13 bp, Homo sapiens
aagggccctggca

SEQ ID NO: 3636808 - DNA, 16 bp, Homo sapiens
aagggccctggcaccc

SEQ ID NO: 3636809 - DNA, 16 bp, Homo sapiens
aaggggagcccactgt

SEQ ID NO: 3636810 - DNA, 18 bp, Homo sapiens
aaggggcgtctgttcccc

SEQ ID NO: 3636811 - DNA, 16 bp, Homo sapiens
aaggggctcttctgag

SEQ ID NO: 3636812 - DNA, 24 bp, Homo sapiens
aagggtctccgaaatgctgtcttt

SEQ ID NO: 3636813 - DNA, 22 bp, Homo sapiens
aagggttaatcatatttgaaaa

SEQ ID NO: 3636814 - DNA, 21 bp, Homo sapiens
aagggtttcagagaaaggact

SEQ ID NO: 3636815 - DNA, 21 bp, Homo sapiens
aaggtaaatggttaaatttta

SEQ ID NO: 3636816 - DNA, 22 bp, Homo sapiens
aaggtagaacaaagaaaatgtt

SEQ ID NO: 3636817 - DNA, 14 bp, Homo sapiens
aaggtagaatgttt

SEQ ID NO: 3636818 - DNA, 19 bp, Homo sapiens
aaggtctcctaaaactggg

SEQ ID NO: 3636819 - DNA, 19 bp, Homo sapiens
aaggtctgcactcctttat

SEQ ID NO: 3636820 - DNA, 22 bp, Homo sapiens
aaggtcttgcatttaaaagaca

SEQ ID NO: 3636821 - DNA, 19 bp, Homo sapiens
aaggtctttggttcagcta

SEQ ID NO: 3636822 - DNA, 19 bp, Homo sapiens
aaggtgaggtgaactccag

SEQ ID NO: 3636823 - DNA, 20 bp, Homo sapiens
aaggtgaggtgaactccagg

SEQ ID NO: 3636824 - DNA, 21 bp, Homo sapiens
aaggtgaggtgaactccaggc

SEQ ID NO: 3636825 - DNA, 14 bp, Homo sapiens
aaggtgcactccag

SEQ ID NO: 3636826 - DNA, 16 bp, Homo sapiens
aaggtgcactccagac

SEQ ID NO: 3636827 - DNA, 12 bp, Homo sapiens
aaggtgcatctg

SEQ ID NO: 3636828 - DNA, 19 bp, Homo sapiens
aaggtttaaagtttgaaga

SEQ ID NO: 3636829 - DNA, 15 bp, Homo sapiens
aaggtttaggctggt

SEQ ID NO: 3636830 - DNA, 19 bp, Homo sapiens
aaggtttaggctggtggcc

SEQ ID NO: 3636831 - DNA, 22 bp, Homo sapiens
aaggtttaggctggtggcccag

SEQ ID NO: 3636832 - DNA, 20 bp, Homo sapiens
aaggttttcctcttctattt

SEQ ID NO: 3636833 - DNA, 15 bp, Homo sapiens
aagtaaaacaaatga

SEQ ID NO: 3636834 - DNA, 16 bp, Homo sapiens
aagtaaaacaaatgaa

SEQ ID NO: 3636835 - DNA, 18 bp, Homo sapiens
aagtaaaaccacagcagt

SEQ ID NO: 3636836 - DNA, 20 bp, Homo sapiens
aagtaaaagtctacctgtgt

SEQ ID NO: 3636837 - DNA, 21 bp, Homo sapiens
aagtaaaagtctacctgtgtt

SEQ ID NO: 3636838 - DNA, 15 bp, Homo sapiens
aagtaactcattgct

SEQ ID NO: 3636839 - DNA, 13 bp, Homo sapiens
aagtaataaagag

SEQ ID NO: 3636840 - DNA, 14 bp, Homo sapiens
aagtaataaagaga

SEQ ID NO: 3636841 - DNA, 15 bp, Homo sapiens
aagtaataaagagaa

SEQ ID NO: 3636842 - DNA, 19 bp, Homo sapiens
aagtaataaagagaaatat

SEQ ID NO: 3636843 - DNA, 13 bp, Homo sapiens
aagtaatattatt

SEQ ID NO: 3636844 - DNA, 17 bp, Homo sapiens
aagtaatgacttagaaa

SEQ ID NO: 3636845 - DNA, 19 bp, Homo sapiens
aagtaatgacttagaaact

SEQ ID NO: 3636846 - DNA, 20 bp, Homo sapiens
aagtaatgacttagaaactg

SEQ ID NO: 3636847 - DNA, 20 bp, Homo sapiens
aagtagggatgcggatcctg

SEQ ID NO: 3636848 - DNA, 22 bp, Homo sapiens
aagtataaaatagtatgaaaat

SEQ ID NO: 3636849 - DNA, 19 bp, Homo sapiens
aagtatgtatattaaaaaa

SEQ ID NO: 3636850 - DNA, 20 bp, Homo sapiens
aagtatgtatattaaaaaag

SEQ ID NO: 3636851 - DNA, 22 bp, Homo sapiens
aagtatgtatattaaaaaagag

SEQ ID NO: 3636852 - DNA, 15 bp, Homo sapiens
aagtatgttttactt

SEQ ID NO: 3636853 - DNA, 16 bp, Homo sapiens
aagtattaagcagttc

SEQ ID NO: 3636854 - DNA, 22 bp, Homo sapiens
aagtattaagcagttcattcta

SEQ ID NO: 3636855 - DNA, 14 bp, Homo sapiens
aagtatttaaatgt

SEQ ID NO: 3636856 - DNA, 16 bp, Homo sapiens
aagtatttaggttttt

SEQ ID NO: 3636857 - DNA, 12 bp, Homo sapiens
aagtcactgcac

SEQ ID NO: 3636858 - DNA, 20 bp, Homo sapiens
aagtcagatggaaaattcat

SEQ ID NO: 3636859 - DNA, 21 bp, Homo sapiens
aagtcaggcccttattttcaa

SEQ ID NO: 3636860 - DNA, 13 bp, Homo sapiens
aagtcatcttgct

SEQ ID NO: 3636861 - DNA, 14 bp, Homo sapiens
aagtcatcttgcta

SEQ ID NO: 3636862 - DNA, 14 bp, Homo sapiens
aagtcattggcaaa

SEQ ID NO: 3636863 - DNA, 16 bp, Homo sapiens
aatgaaattttgatta

SEQ ID NO: 3636864 - DNA, 15 bp, Homo sapiens
aatgaactttcagca

SEQ ID NO: 3636865 - DNA, 12 bp, Homo sapiens
aatgaagaagga

SEQ ID NO: 3636866 - DNA, 13 bp, Homo sapiens
aatgaaggaatta

SEQ ID NO: 3636867 - DNA, 17 bp, Homo sapiens
aatgaattaaataaacc

SEQ ID NO: 3636868 - DNA, 12 bp, Homo sapiens
aatgacaacact

SEQ ID NO: 3636869 - DNA, 20 bp, Homo sapiens
aatgacaacacttaatagca

SEQ ID NO: 3636870 - DNA, 16 bp, Homo sapiens
aatgacacccatgcca

SEQ ID NO: 3636871 - DNA, 15 bp, Homo sapiens
aatgacagccttgca

SEQ ID NO: 3636872 - DNA, 15 bp, Homo sapiens
aatgacaggcctgtc

SEQ ID NO: 3636873 - DNA, 15 bp, Homo sapiens
aatgaccgagccctg

SEQ ID NO: 3636874 - DNA, 19 bp, Homo sapiens
aatgaccgagccctggaga

SEQ ID NO: 3636875 - DNA, 13 bp, Homo sapiens
aatgaccttgagt

SEQ ID NO: 3636876 - DNA, 23 bp, Homo sapiens
aatgacggtgttaattttgctaa

SEQ ID NO: 3636877 - DNA, 20 bp, Homo sapiens
aatgacttatttctgctctg

SEQ ID NO: 3636878 - DNA, 21 bp, Homo sapiens
aatgacttatttctgctctgg

SEQ ID NO: 3636879 - DNA, 13 bp, Homo sapiens
aatgagacatcca

SEQ ID NO: 3636880 - DNA, 18 bp, Homo sapiens
aatgaggatccagggcag

SEQ ID NO: 3636881 - DNA, 15 bp, Homo sapiens
aatgaggtctgttta

SEQ ID NO: 3636882 - DNA, 16 bp, Homo sapiens
aatgagtcatttgttt

SEQ ID NO: 3636883 - DNA, 19 bp, Homo sapiens
aatgagtcatttgtttaaa

SEQ ID NO: 3636884 - DNA, 21 bp, Homo sapiens
aatgatacttacaagtttcta

SEQ ID NO: 3636885 - DNA, 21 bp, Homo sapiens
aatgatagacaattgaggtaa

SEQ ID NO: 3636886 - DNA, 15 bp, Homo sapiens
aatgatatgcttgta

SEQ ID NO: 3636887 - DNA, 11 bp, Homo sapiens
aatgatcctgc

SEQ ID NO: 3636888 - DNA, 12 bp, Homo sapiens
aatgatgataac

SEQ ID NO: 3636889 - DNA, 15 bp, Homo sapiens
aatgatgattatgga

SEQ ID NO: 3636890 - DNA, 14 bp, Homo sapiens
aatgatggcaattt

SEQ ID NO: 3636891 - DNA, 22 bp, Homo sapiens
aatgatttcatgctatctctgt

SEQ ID NO: 3636892 - DNA, 20 bp, Homo sapiens
aatgcagaaaacagggtctg

SEQ ID NO: 3636893 - DNA, 13 bp, Homo sapiens
aatgcatgagtaa

SEQ ID NO: 3636894 - DNA, 22 bp, Homo sapiens
aatgcattataggatcatttgt

SEQ ID NO: 3636895 - DNA, 16 bp, Homo sapiens
aatgcattgcctgtaa

SEQ ID NO: 3636896 - DNA, 19 bp, Homo sapiens
aatgccactgggacagctg

SEQ ID NO: 3636897 - DNA, 21 bp, Homo sapiens
aatgccactgggacagctggc

SEQ ID NO: 3636898 - DNA, 19 bp, Homo sapiens
aatgcccagtaaaatttca

SEQ ID NO: 3636899 - DNA, 22 bp, Homo sapiens
aatgcccagtaaaatttcagga

SEQ ID NO: 3636900 - DNA, 14 bp, Homo sapiens
aatgccccagtgtt

SEQ ID NO: 3636901 - DNA, 17 bp, Homo sapiens
aatgccttaaaatggaa

SEQ ID NO: 3636902 - DNA, 16 bp, Homo sapiens
aatgcggccttttcat

SEQ ID NO: 3636903 - DNA, 19 bp, Homo sapiens
aatgctattttttcccttc

SEQ ID NO: 3636904 - DNA, 15 bp, Homo sapiens
aatgctcagaccagc

SEQ ID NO: 3636905 - DNA, 13 bp, Homo sapiens
aatgctgcactaa

SEQ ID NO: 3636906 - DNA, 11 bp, Homo sapiens
aatgctgcctc

SEQ ID NO: 3636907 - DNA, 15 bp, Homo sapiens
aatgctgcctcagga

SEQ ID NO: 3636908 - DNA, 12 bp, Homo sapiens
aatgctggcaaa

SEQ ID NO: 3636909 - DNA, 21 bp, Homo sapiens
aatgctgtctttcttgctccc

SEQ ID NO: 3636910 - DNA, 20 bp, Homo sapiens
aatgctgttggtaaagcaca

SEQ ID NO: 3636911 - DNA, 15 bp, Homo sapiens
aatgcttttatattc

SEQ ID NO: 3636912 - DNA, 19 bp, Homo sapiens
aatgcttttatattctaat

SEQ ID NO: 3636913 - DNA, 20 bp, Homo sapiens
aatggaagaagaaaggactg

SEQ ID NO: 3636914 - DNA, 20 bp, Homo sapiens
aatggacggtttaggtgaaa

SEQ ID NO: 3636915 - DNA, 19 bp, Homo sapiens
aatggaggatctctaaaga

SEQ ID NO: 3636916 - DNA, 11 bp, Homo sapiens
aatggatattg

SEQ ID NO: 3636917 - DNA, 20 bp, Homo sapiens
aatggatttcctagtggagt

SEQ ID NO: 3636918 - DNA, 14 bp, Homo sapiens
aatggcaagttttc

SEQ ID NO: 3636919 - DNA, 16 bp, Homo sapiens
aatggcagctagtgcc

SEQ ID NO: 3636920 - DNA, 18 bp, Homo sapiens
aatggcagtgactcccca

SEQ ID NO: 3636921 - DNA, 17 bp, Homo sapiens
aatggcatggcaggagt

SEQ ID NO: 3636922 - DNA, 14 bp, Homo sapiens
aatggccattttaa

SEQ ID NO: 3636923 - DNA, 13 bp, Homo sapiens
aatggcctggagc

SEQ ID NO: 3636924 - DNA, 17 bp, Homo sapiens
aatggcctggagcaggc

SEQ ID NO: 3636925 - DNA, 22 bp, Homo sapiens
aatgggatggtcggatctcaca

SEQ ID NO: 3636926 - DNA, 23 bp, Homo sapiens
aatgggatggtcggatctcacag

SEQ ID NO: 3636927 - DNA, 13 bp, Homo sapiens
aatggggccagat

SEQ ID NO: 3636928 - DNA, 17 bp, Homo sapiens
aatggggtcctggccat

SEQ ID NO: 3636929 - DNA, 20 bp, Homo sapiens
aatggtactccacatatttc

SEQ ID NO: 3636930 - DNA, 19 bp, Homo sapiens
aatggtactcccaaactga

SEQ ID NO: 3636931 - DNA, 21 bp, Homo sapiens
aatggtactcccaaactgaca

SEQ ID NO: 3636932 - DNA, 14 bp, Homo sapiens
aatggtagttttac

SEQ ID NO: 3636933 - DNA, 23 bp, Homo sapiens
aatggtcacgtttggtgcttctc

SEQ ID NO: 3636934 - DNA, 15 bp, Homo sapiens
aatggttaaatttta

SEQ ID NO: 3636935 - DNA, 16 bp, Homo sapiens
aatggttaaattttac

SEQ ID NO: 3636936 - DNA, 22 bp, Homo sapiens
aatggttaaattttacatgaca

SEQ ID NO: 3636937 - DNA, 23 bp, Homo sapiens
aatggttaaattttacatgacag

SEQ ID NO: 3636938 - DNA, 17 bp, Homo sapiens
aatggttgatgatactt

SEQ ID NO: 3636939 - DNA, 19 bp, Homo sapiens
aatggttgatggaaaataa

SEQ ID NO: 3636940 - DNA, 16 bp, Homo sapiens
aatggtttgtcctgat

SEQ ID NO: 3636941 - DNA, 14 bp, Homo sapiens
aatgtaaactgttt

SEQ ID NO: 3636942 - DNA, 17 bp, Homo sapiens
aatgtaaactgtttctt

SEQ ID NO: 3636943 - DNA, 16 bp, Homo sapiens
aatgtaacttttgtaa

SEQ ID NO: 3636944 - DNA, 20 bp, Homo sapiens
aatgtaagggaaactgccag

SEQ ID NO: 3636945 - DNA, 22 bp, Homo sapiens
aatgtacacactggtacttaga

SEQ ID NO: 3636946 - DNA, 18 bp, Homo sapiens
aatgtaggccttaactat

SEQ ID NO: 3636947 - DNA, 20 bp, Homo sapiens
aatgtaggggaaagtttcat

SEQ ID NO: 3636948 - DNA, 20 bp, Homo sapiens
aatgtatataaactgggatg

SEQ ID NO: 3636949 - DNA, 16 bp, Homo sapiens
aatgtatcatagaaat

SEQ ID NO: 3636950 - DNA, 13 bp, Homo sapiens
aatgtatgtgtgt

SEQ ID NO: 3636951 - DNA, 12 bp, Homo sapiens
aatgtattcaag

SEQ ID NO: 3636952 - DNA, 19 bp, Homo sapiens
aatgtattcaagcaaacat

SEQ ID NO: 3636953 - DNA, 16 bp, Homo sapiens
aatgtatttgaaaatt

SEQ ID NO: 3636954 - DNA, 17 bp, Homo sapiens
aatgtcaaggaagactt

SEQ ID NO: 3636955 - DNA, 13 bp, Homo sapiens
aatgtcaataaat

SEQ ID NO: 3636956 - DNA, 18 bp, Homo sapiens
aatgtcacaattatgtgc

SEQ ID NO: 3636957 - DNA, 22 bp, Homo sapiens
aatgtcacaattatgtgcaaag

SEQ ID NO: 3636958 - DNA, 19 bp, Homo sapiens
aatgtcactttttgaggca

SEQ ID NO: 3636959 - DNA, 16 bp, Homo sapiens
aatgtcagggccaggt

SEQ ID NO: 3636960 - DNA, 15 bp, Homo sapiens
aatgtcagtatgtgg

SEQ ID NO: 3636961 - DNA, 22 bp, Homo sapiens
aatgtcagtatgtggaagtgtg

SEQ ID NO: 3636962 - DNA, 18 bp, Homo sapiens
aatgtcagttgttattta

SEQ ID NO: 3636963 - DNA, 16 bp, Homo sapiens
aatgtcctgcctttta

SEQ ID NO: 3636964 - DNA, 17 bp, Homo sapiens
aatgtcgaactcttctt

SEQ ID NO: 3636965 - DNA, 20 bp, Homo sapiens
aatgtctgcactgaggattt

SEQ ID NO: 3636966 - DNA, 15 bp, Homo sapiens
aatgtctggtgtttg

SEQ ID NO: 3636967 - DNA, 20 bp, Homo sapiens
aatgtctggtgtttgtcatg

SEQ ID NO: 3636968 - DNA, 13 bp, Homo sapiens
aatgtgaaatgct

SEQ ID NO: 3636969 - DNA, 15 bp, Homo sapiens
aatgtgagtcattat

SEQ ID NO: 3636970 - DNA, 21 bp, Homo sapiens
aatgtggcccctgaacaagaa

SEQ ID NO: 3636971 - DNA, 19 bp, Homo sapiens
aatgtggctgtatccactt

SEQ ID NO: 3636972 - DNA, 18 bp, Homo sapiens
aatgtggtttcaatctaa

SEQ ID NO: 3636973 - DNA, 13 bp, Homo sapiens
aatgtgtataaga

SEQ ID NO: 3636974 - DNA, 12 bp, Homo sapiens
aatgtgtcattg

SEQ ID NO: 3636975 - DNA, 21 bp, Homo sapiens
aatgtgtgtgtgtggcagggg

SEQ ID NO: 3636976 - DNA, 20 bp, Homo sapiens
aatgttagagtaatgaaatg

SEQ ID NO: 3636977 - DNA, 13 bp, Homo sapiens
aatgttagtattt

SEQ ID NO: 3636978 - DNA, 13 bp, Homo sapiens
aatgttataaagt

SEQ ID NO: 3636979 - DNA, 16 bp, Homo sapiens
aatgttattttccttc

SEQ ID NO: 3636980 - DNA, 17 bp, Homo sapiens
aatgttattttccttct

SEQ ID NO: 3636981 - DNA, 20 bp, Homo sapiens
aatgttattttccttctgaa

SEQ ID NO: 3636982 - DNA, 14 bp, Homo sapiens
aatgttctttctgc

SEQ ID NO: 3636983 - DNA, 19 bp, Homo sapiens
aatgttggagcagcaggcc

SEQ ID NO: 3636984 - DNA, 20 bp, Homo sapiens
aatgtttgatagtaaatgtc

SEQ ID NO: 3636985 - DNA, 23 bp, Homo sapiens
aatgttttaaagtttaatgccta

SEQ ID NO: 3636986 - DNA, 19 bp, Homo sapiens
aatgtttttatttcaattg

SEQ ID NO: 3636987 - DNA, 21 bp, Homo sapiens
aatgtttttatttcaattgtt

SEQ ID NO: 3636988 - DNA, 13 bp, Homo sapiens
aattaaaacactt

SEQ ID NO: 3636989 - DNA, 14 bp, Homo sapiens
aattaaaacacttt

SEQ ID NO: 3636990 - DNA, 14 bp, Homo sapiens
aattaaacggatta

SEQ ID NO: 3636991 - DNA, 15 bp, Homo sapiens
aattaaacggattat

SEQ ID NO: 3636992 - DNA, 21 bp, Homo sapiens
aattaaacggattattttttc

SEQ ID NO: 3636993 - DNA, 16 bp, Homo sapiens
aattaacaataaagaa

SEQ ID NO: 3636994 - DNA, 18 bp, Homo sapiens
aattaagttattaacatt

SEQ ID NO: 3636995 - DNA, 20 bp, Homo sapiens
aattaatgacttactttaat

SEQ ID NO: 3636996 - DNA, 18 bp, Homo sapiens
acacttacactttatgca

SEQ ID NO: 3636997 - DNA, 21 bp, Homo sapiens
acacttacactttatgcacaa

SEQ ID NO: 3636998 - DNA, 21 bp, Homo sapiens
acacttataaaataacttgca

SEQ ID NO: 3636999 - DNA, 19 bp, Homo sapiens
acacttcaggctcttctcc

SEQ ID NO: 3637000 - DNA, 14 bp, Homo sapiens
acactttctggcaa

SEQ ID NO: 3637001 - DNA, 17 bp, Homo sapiens
acactttgagcattttt

SEQ ID NO: 3637002 - DNA, 19 bp, Homo sapiens
acactttgcactgatatat

SEQ ID NO: 3637003 - DNA, 22 bp, Homo sapiens
acactttgcactgatatatcat

SEQ ID NO: 3637004 - DNA, 19 bp, Homo sapiens
acactttgccaaggctctc

SEQ ID NO: 3637005 - DNA, 19 bp, Homo sapiens
acagaaaagtgcctgagct

SEQ ID NO: 3637006 - DNA, 14 bp, Homo sapiens
acagaaactacatt

SEQ ID NO: 3637007 - DNA, 12 bp, Homo sapiens
acagaaactgat

SEQ ID NO: 3637008 - DNA, 17 bp, Homo sapiens
acagaaccttcaaccca

SEQ ID NO: 3637009 - DNA, 18 bp, Homo sapiens
acagaaccttcaacccag

SEQ ID NO: 3637010 - DNA, 18 bp, Homo sapiens
acagacagcttacaggag

SEQ ID NO: 3637011 - DNA, 22 bp, Homo sapiens
acagacatatatatatatatgc

SEQ ID NO: 3637012 - DNA, 19 bp, Homo sapiens
acagacatggaacagtgta

SEQ ID NO: 3637013 - DNA, 16 bp, Homo sapiens
acagacccctgggagc

SEQ ID NO: 3637014 - DNA, 19 bp, Homo sapiens
acagactcaatgtgctctg

SEQ ID NO: 3637015 - DNA, 12 bp, Homo sapiens
acagactcactg

SEQ ID NO: 3637016 - DNA, 15 bp, Homo sapiens
acagactcactggga

SEQ ID NO: 3637017 - DNA, 21 bp, Homo sapiens
acagactttggacagtggcct

SEQ ID NO: 3637018 - DNA, 22 bp, Homo sapiens
acagactttggacagtggcctc

SEQ ID NO: 3637019 - DNA, 23 bp, Homo sapiens
acagactttggacagtggcctct

SEQ ID NO: 3637020 - DNA, 23 bp, Homo sapiens
acagagaagtttgtagccaggta

SEQ ID NO: 3637021 - DNA, 19 bp, Homo sapiens
acagaggagaaagtggaaa

SEQ ID NO: 3637022 - DNA, 16 bp, Homo sapiens
acagaggccccagcct

SEQ ID NO: 3637023 - DNA, 18 bp, Homo sapiens
acagaggccccagcctcc

SEQ ID NO: 3637024 - DNA, 17 bp, Homo sapiens
acagaggctattgtccc

SEQ ID NO: 3637025 - DNA, 20 bp, Homo sapiens
acagaggtttgaaggagaat

SEQ ID NO: 3637026 - DNA, 23 bp, Homo sapiens
acagaggtttgaaggagaatggc

SEQ ID NO: 3637027 - DNA, 19 bp, Homo sapiens
acagagtggcctccctgct

SEQ ID NO: 3637028 - DNA, 20 bp, Homo sapiens
acagagtggcctccctgctg

SEQ ID NO: 3637029 - DNA, 21 bp, Homo sapiens
acagagtggcctccctgctgt

SEQ ID NO: 3637030 - DNA, 22 bp, Homo sapiens
acagataataatgggtttcttt

SEQ ID NO: 3637031 - DNA, 18 bp, Homo sapiens
acagatattgttataaat

SEQ ID NO: 3637032 - DNA, 14 bp, Homo sapiens
acagatctggaacc

SEQ ID NO: 3637033 - DNA, 16 bp, Homo sapiens
acagatctggaacctc

SEQ ID NO: 3637034 - DNA, 21 bp, Homo sapiens
acagatctggaacctcagcct

SEQ ID NO: 3637035 - DNA, 17 bp, Homo sapiens
acagatgcatatagaca

SEQ ID NO: 3637036 - DNA, 18 bp, Homo sapiens
acagatgcatatagacac

SEQ ID NO: 3637037 - DNA, 22 bp, Homo sapiens
acagatgcgttcagcagactgg

SEQ ID NO: 3637038 - DNA, 17 bp, Homo sapiens
acagatgctgagccata

SEQ ID NO: 3637039 - DNA, 18 bp, Homo sapiens
acagatgctgagccatag

SEQ ID NO: 3637040 - DNA, 17 bp, Homo sapiens
acagattcaggccagcc

SEQ ID NO: 3637041 - DNA, 18 bp, Homo sapiens
acagattcaggccagccc

SEQ ID NO: 3637042 - DNA, 22 bp, Homo sapiens
acagattcaggccagcccagcc

SEQ ID NO: 3637043 - DNA, 14 bp, Homo sapiens
acagatttaaagaa

SEQ ID NO: 3637044 - DNA, 17 bp, Homo sapiens
acagatttattcctttg

SEQ ID NO: 3637045 - DNA, 17 bp, Homo sapiens
acagcaattcctcaggc

SEQ ID NO: 3637046 - DNA, 18 bp, Homo sapiens
acagcagcccctgcacaa

SEQ ID NO: 3637047 - DNA, 16 bp, Homo sapiens
acagcagctgcagggg

SEQ ID NO: 3637048 - DNA, 16 bp, Homo sapiens
acagcagtctccttca

SEQ ID NO: 3637049 - DNA, 15 bp, Homo sapiens
acagcagttgaaaag

SEQ ID NO: 3637050 - DNA, 18 bp, Homo sapiens
acagcagttgaaaagact

SEQ ID NO: 3637051 - DNA, 23 bp, Homo sapiens
acagcagttgaaaagactccaaa

SEQ ID NO: 3637052 - DNA, 20 bp, Homo sapiens
acagcatcgggagcacccag

SEQ ID NO: 3637053 - DNA, 21 bp, Homo sapiens
acagcatcgggagcacccaga

SEQ ID NO: 3637054 - DNA, 14 bp, Homo sapiens
acagcatgaataaa

SEQ ID NO: 3637055 - DNA, 15 bp, Homo sapiens
acagcatgaataaaa

SEQ ID NO: 3637056 - DNA, 11 bp, Homo sapiens
acagcattgtg

SEQ ID NO: 3637057 - DNA, 18 bp, Homo sapiens
acagccaagctggcacaa

SEQ ID NO: 3637058 - DNA, 13 bp, Homo sapiens
acagccaagtgcc

SEQ ID NO: 3637059 - DNA, 19 bp, Homo sapiens
acagccacaccgtggcagc

SEQ ID NO: 3637060 - DNA, 15 bp, Homo sapiens
acagccagactggca

SEQ ID NO: 3637061 - DNA, 13 bp, Homo sapiens
acagccattttcc

SEQ ID NO: 3637062 - DNA, 17 bp, Homo sapiens
acagccattttccaaca

SEQ ID NO: 3637063 - DNA, 15 bp, Homo sapiens
acagccctatttctt

SEQ ID NO: 3637064 - DNA, 15 bp, Homo sapiens
acagccctgcctgag

SEQ ID NO: 3637065 - DNA, 16 bp, Homo sapiens
acagccctgcctgaga

SEQ ID NO: 3637066 - DNA, 20 bp, Homo sapiens
acagccggtcagaggagcgc

SEQ ID NO: 3637067 - DNA, 15 bp, Homo sapiens
acagcctgcaagtca

SEQ ID NO: 3637068 - DNA, 22 bp, Homo sapiens
acagcctttgcccaaaactgtc

SEQ ID NO: 3637069 - DNA, 16 bp, Homo sapiens
acagctcagccagtgg

SEQ ID NO: 3637070 - DNA, 17 bp, Homo sapiens
acagctcagccagtggg

SEQ ID NO: 3637071 - DNA, 20 bp, Homo sapiens
acagctcagccagtggggat

SEQ ID NO: 3637072 - DNA, 21 bp, Homo sapiens
acagctcagccagtggggatg

SEQ ID NO: 3637073 - DNA, 14 bp, Homo sapiens
acagctcttcattc

SEQ ID NO: 3637074 - DNA, 15 bp, Homo sapiens
acagctcttcattcc

SEQ ID NO: 3637075 - DNA, 17 bp, Homo sapiens
acagctcttccagggca

SEQ ID NO: 3637076 - DNA, 16 bp, Homo sapiens
acagctgccctagctg

SEQ ID NO: 3637077 - DNA, 19 bp, Homo sapiens
acagctgccctagctgacc

SEQ ID NO: 3637078 - DNA, 10 bp, Homo sapiens
acagctgctc

SEQ ID NO: 3637079 - DNA, 11 bp, Homo sapiens
acagctgtgct

SEQ ID NO: 3637080 - DNA, 18 bp, Homo sapiens
acagctgtgctccacact

SEQ ID NO: 3637081 - DNA, 23 bp, Homo sapiens
acagctgtgctccacactcagaa

SEQ ID NO: 3637082 - DNA, 16 bp, Homo sapiens
acagcttcctcacacc

SEQ ID NO: 3637083 - DNA, 11 bp, Homo sapiens
acagcttgtct

SEQ ID NO: 3637084 - DNA, 15 bp, Homo sapiens
acagctttgtctcca

SEQ ID NO: 3637085 - DNA, 20 bp, Homo sapiens
acagctttgtctccaaagaa

SEQ ID NO: 3637086 - DNA, 15 bp, Homo sapiens
acaggaaagagctag

SEQ ID NO: 3637087 - DNA, 13 bp, Homo sapiens
acaggaatttaga

SEQ ID NO: 3637088 - DNA, 22 bp, Homo sapiens
acaggacagttgatggagcccc

SEQ ID NO: 3637089 - DNA, 23 bp, Homo sapiens
acaggacagttgatggagcccca

SEQ ID NO: 3637090 - DNA, 18 bp, Homo sapiens
acaggaccccagctctgc

SEQ ID NO: 3637091 - DNA, 15 bp, Homo sapiens
acaggactctgcctc

SEQ ID NO: 3637092 - DNA, 16 bp, Homo sapiens
acaggactctgcctcc

SEQ ID NO: 3637093 - DNA, 15 bp, Homo sapiens
acaggagaggcagca

SEQ ID NO: 3637094 - DNA, 14 bp, Homo sapiens
acaggagatgctgt

SEQ ID NO: 3637095 - DNA, 15 bp, Homo sapiens
acaggagccagcctg

SEQ ID NO: 3637096 - DNA, 12 bp, Homo sapiens
acaggagggcca

SEQ ID NO: 3637097 - DNA, 15 bp, Homo sapiens
acaggatacaggtga

SEQ ID NO: 3637098 - DNA, 21 bp, Homo sapiens
acaggccctccctgttcccca

SEQ ID NO: 3637099 - DNA, 22 bp, Homo sapiens
acaggccctccctgttccccag

SEQ ID NO: 3637100 - DNA, 12 bp, Homo sapiens
acaggccttgct

SEQ ID NO: 3637101 - DNA, 16 bp, Homo sapiens
acaggctcgtcagcca

SEQ ID NO: 3637102 - DNA, 21 bp, Homo sapiens
acaggctgaaatatccaccca

SEQ ID NO: 3637103 - DNA, 21 bp, Homo sapiens
acaggctgaagagagggacag

SEQ ID NO: 3637104 - DNA, 15 bp, Homo sapiens
acaggctgagaactc

SEQ ID NO: 3637105 - DNA, 14 bp, Homo sapiens
acaggctgtcctta

SEQ ID NO: 3637106 - DNA, 23 bp, Homo sapiens
acagggatctgtttgaacactta

SEQ ID NO: 3637107 - DNA, 19 bp, Homo sapiens
acagggtgagggccacctc

SEQ ID NO: 3637108 - DNA, 18 bp, Homo sapiens
acaggtaaactatcttgg

SEQ ID NO: 3637109 - DNA, 14 bp, Homo sapiens
acaggtacttggag

SEQ ID NO: 3637110 - DNA, 12 bp, Homo sapiens
acaggtattttg

SEQ ID NO: 3637111 - DNA, 21 bp, Homo sapiens
acaggtattttgtttctttta

SEQ ID NO: 3637112 - DNA, 14 bp, Homo sapiens
acaggtgacagtga

SEQ ID NO: 3637113 - DNA, 19 bp, Homo sapiens
acaggtgcctaacctggga

SEQ ID NO: 3637114 - DNA, 14 bp, Homo sapiens
acaggtgggcctgg

SEQ ID NO: 3637115 - DNA, 18 bp, Homo sapiens
acaggttttcagagaatt

SEQ ID NO: 3637116 - DNA, 22 bp, Homo sapiens
acaggttttcagagaattatct

SEQ ID NO: 3637117 - DNA, 22 bp, Homo sapiens
acagtacccctctagctttgtt

SEQ ID NO: 3637118 - DNA, 18 bp, Homo sapiens
acagtacctgattgtatt

SEQ ID NO: 3637119 - DNA, 19 bp, Homo sapiens
acagtacctgattgtattt

SEQ ID NO: 3637120 - DNA, 19 bp, Homo sapiens
acagtatcgtttgtttatg

SEQ ID NO: 3637121 - DNA, 13 bp, Homo sapiens
acagtatctgctg

SEQ ID NO: 3637122 - DNA, 15 bp, Homo sapiens
acagtatctgctgtt

SEQ ID NO: 3637123 - DNA, 21 bp, Homo sapiens
acagtatctgctgttcttcag

SEQ ID NO: 3637124 - DNA, 21 bp, Homo sapiens
acagtattaacactaaattgc

SEQ ID NO: 3637125 - DNA, 22 bp, Homo sapiens
acagtattatagatataaatat

SEQ ID NO: 3637126 - DNA, 15 bp, Homo sapiens
acagtccgcagttgt

SEQ ID NO: 3637127 - DNA, 20 bp, Homo sapiens
acagtccgcagttgtagcag

SEQ ID NO: 3637128 - DNA, 16 bp, Homo sapiens
acctccggagcgccct

SEQ ID NO: 3637129 - DNA, 14 bp, Homo sapiens
acctcctcccactg

SEQ ID NO: 3637130 - DNA, 18 bp, Homo sapiens
acctcctcccactgccca

SEQ ID NO: 3637131 - DNA, 20 bp, Homo sapiens
acctcctctgtgatttcttt

SEQ ID NO: 3637132 - DNA, 22 bp, Homo sapiens
acctcgagaagtaattatcagt

SEQ ID NO: 3637133 - DNA, 23 bp, Homo sapiens
acctcgtgccaccccgagggctg

SEQ ID NO: 3637134 - DNA, 16 bp, Homo sapiens
acctctaagtgctgct

SEQ ID NO: 3637135 - DNA, 17 bp, Homo sapiens
acctctaataaacactg

SEQ ID NO: 3637136 - DNA, 18 bp, Homo sapiens
acctctaataaacactgt

SEQ ID NO: 3637137 - DNA, 16 bp, Homo sapiens
acctctattttaatta

SEQ ID NO: 3637138 - DNA, 17 bp, Homo sapiens
acctctcctgacccctg

SEQ ID NO: 3637139 - DNA, 15 bp, Homo sapiens
acctctcctgccctg

SEQ ID NO: 3637140 - DNA, 18 bp, Homo sapiens
acctctgggtccttggct

SEQ ID NO: 3637141 - DNA, 17 bp, Homo sapiens
acctctgtctgagacag

SEQ ID NO: 3637142 - DNA, 15 bp, Homo sapiens
acctctgtgccttgc

SEQ ID NO: 3637143 - DNA, 21 bp, Homo sapiens
acctctgtgggcactggtggg

SEQ ID NO: 3637144 - DNA, 13 bp, Homo sapiens
acctcttctggag

SEQ ID NO: 3637145 - DNA, 22 bp, Homo sapiens
acctcttctggagatggaagct

SEQ ID NO: 3637146 - DNA, 17 bp, Homo sapiens
acctctttttcttacca

SEQ ID NO: 3637147 - DNA, 15 bp, Homo sapiens
acctgaaagagagga

SEQ ID NO: 3637148 - DNA, 18 bp, Homo sapiens
acctgaaagagaggactg

SEQ ID NO: 3637149 - DNA, 14 bp, Homo sapiens
acctgaacttgcct

SEQ ID NO: 3637150 - DNA, 15 bp, Homo sapiens
acctgaatcagctgg

SEQ ID NO: 3637151 - DNA, 17 bp, Homo sapiens
acctgaatcagctggac

SEQ ID NO: 3637152 - DNA, 21 bp, Homo sapiens
acctgacacaccaggcgctaa

SEQ ID NO: 3637153 - DNA, 17 bp, Homo sapiens
acctgaggtctcattca

SEQ ID NO: 3637154 - DNA, 16 bp, Homo sapiens
acctgcaaagatctgt

SEQ ID NO: 3637155 - DNA, 20 bp, Homo sapiens
acctgcacactgtcctatta

SEQ ID NO: 3637156 - DNA, 19 bp, Homo sapiens
acctgccaaggagcatcct

SEQ ID NO: 3637157 - DNA, 11 bp, Homo sapiens
acctgccccaa

SEQ ID NO: 3637158 - DNA, 14 bp, Homo sapiens
acctgccccaagtg

SEQ ID NO: 3637159 - DNA, 22 bp, Homo sapiens
acctgccccaagtggtgagcaa

SEQ ID NO: 3637160 - DNA, 22 bp, Homo sapiens
acctgcccctgcctgacagcct

SEQ ID NO: 3637161 - DNA, 18 bp, Homo sapiens
acctgccctctatttatt

SEQ ID NO: 3637162 - DNA, 21 bp, Homo sapiens
acctgccctctatttattagc

SEQ ID NO: 3637163 - DNA, 15 bp, Homo sapiens
acctgcctccaccag

SEQ ID NO: 3637164 - DNA, 19 bp, Homo sapiens
acctgcctccaccagcaag

SEQ ID NO: 3637165 - DNA, 15 bp, Homo sapiens
acctgctatcagcag

SEQ ID NO: 3637166 - DNA, 17 bp, Homo sapiens
acctgctcagccctgca

SEQ ID NO: 3637167 - DNA, 23 bp, Homo sapiens
acctgctccagaagatgccagct

SEQ ID NO: 3637168 - DNA, 17 bp, Homo sapiens
acctgctctcctcttgc

SEQ ID NO: 3637169 - DNA, 16 bp, Homo sapiens
acctgcttttcaatgt

SEQ ID NO: 3637170 - DNA, 18 bp, Homo sapiens
acctggagcagaggaggg

SEQ ID NO: 3637171 - DNA, 23 bp, Homo sapiens
acctggccttaaagagggacagg

SEQ ID NO: 3637172 - DNA, 21 bp, Homo sapiens
acctgggaacacagttctggg

SEQ ID NO: 3637173 - DNA, 15 bp, Homo sapiens
acctgggaaggccag

SEQ ID NO: 3637174 - DNA, 13 bp, Homo sapiens
acctgggcacaaa

SEQ ID NO: 3637175 - DNA, 22 bp, Homo sapiens
acctggggagtggttaggcagc

SEQ ID NO: 3637176 - DNA, 23 bp, Homo sapiens
acctggggagtggttaggcagca

SEQ ID NO: 3637177 - DNA, 17 bp, Homo sapiens
acctggggtgaatactt

SEQ ID NO: 3637178 - DNA, 22 bp, Homo sapiens
acctggtcacaggactctgcct

SEQ ID NO: 3637179 - DNA, 14 bp, Homo sapiens
acctgtaatcccag

SEQ ID NO: 3637180 - DNA, 18 bp, Homo sapiens
acctgtcctgtctttgat

SEQ ID NO: 3637181 - DNA, 18 bp, Homo sapiens
acctgtctcacctggact

SEQ ID NO: 3637182 - DNA, 15 bp, Homo sapiens
acctgtctgctgcca

SEQ ID NO: 3637183 - DNA, 17 bp, Homo sapiens
acctgtctgctgccagc

SEQ ID NO: 3637184 - DNA, 20 bp, Homo sapiens
acctgtctgctgccagcaca

SEQ ID NO: 3637185 - DNA, 21 bp, Homo sapiens
acctgtcttattaagactggc

SEQ ID NO: 3637186 - DNA, 12 bp, Homo sapiens
acctgtgactct

SEQ ID NO: 3637187 - DNA, 15 bp, Homo sapiens
acctgtgactcttag

SEQ ID NO: 3637188 - DNA, 21 bp, Homo sapiens
acctgttcttagagtgtagct

SEQ ID NO: 3637189 - DNA, 15 bp, Homo sapiens
accttaaaagtaata

SEQ ID NO: 3637190 - DNA, 20 bp, Homo sapiens
accttaaaagtaataaagag

SEQ ID NO: 3637191 - DNA, 22 bp, Homo sapiens
accttaaaagtaataaagagaa

SEQ ID NO: 3637192 - DNA, 19 bp, Homo sapiens
accttaatgacaacactta

SEQ ID NO: 3637193 - DNA, 21 bp, Homo sapiens
accttagctggcattacagct

SEQ ID NO: 3637194 - DNA, 18 bp, Homo sapiens
accttatagttactgtgt

SEQ ID NO: 3637195 - DNA, 19 bp, Homo sapiens
accttatagttactgtgta

SEQ ID NO: 3637196 - DNA, 23 bp, Homo sapiens
accttatagttactgtgtaatta

SEQ ID NO: 3637197 - DNA, 19 bp, Homo sapiens
accttatcactgcattatt

SEQ ID NO: 3637198 - DNA, 16 bp, Homo sapiens
accttcaacccagtgg

SEQ ID NO: 3637199 - DNA, 18 bp, Homo sapiens
accttcacctcggaggga

SEQ ID NO: 3637200 - DNA, 17 bp, Homo sapiens
accttcccatgccctgg

SEQ ID NO: 3637201 - DNA, 17 bp, Homo sapiens
accttccccctccccca

SEQ ID NO: 3637202 - DNA, 23 bp, Homo sapiens
accttcccctaaaccccaagctt

SEQ ID NO: 3637203 - DNA, 18 bp, Homo sapiens
accttcgggctgtgcccg

SEQ ID NO: 3637204 - DNA, 19 bp, Homo sapiens
accttctagttgcccccat

SEQ ID NO: 3637205 - DNA, 15 bp, Homo sapiens
accttctatgtatta

SEQ ID NO: 3637206 - DNA, 13 bp, Homo sapiens
accttctgacttt

SEQ ID NO: 3637207 - DNA, 12 bp, Homo sapiens
accttctgtggc

SEQ ID NO: 3637208 - DNA, 16 bp, Homo sapiens
accttctgtggctcac

SEQ ID NO: 3637209 - DNA, 22 bp, Homo sapiens
accttctttctaatacaagcat

SEQ ID NO: 3637210 - DNA, 17 bp, Homo sapiens
accttgaaggtctgtca

SEQ ID NO: 3637211 - DNA, 20 bp, Homo sapiens
accttgaataaggcccactg

SEQ ID NO: 3637212 - DNA, 23 bp, Homo sapiens
accttgaataaggcccactgtaa

SEQ ID NO: 3637213 - DNA, 22 bp, Homo sapiens
accttgctgcaagcacagccct

SEQ ID NO: 3637214 - DNA, 23 bp, Homo sapiens
accttgctgcaagcacagccctt

SEQ ID NO: 3637215 - DNA, 17 bp, Homo sapiens
accttggcaccagacac

SEQ ID NO: 3637216 - DNA, 22 bp, Homo sapiens
accttggcaccagacacccagg

SEQ ID NO: 3637217 - DNA, 14 bp, Homo sapiens
acctttatctttca

SEQ ID NO: 3637218 - DNA, 19 bp, Homo sapiens
acctttatttattaaactt

SEQ ID NO: 3637219 - DNA, 15 bp, Homo sapiens
acctttcaaacccag

SEQ ID NO: 3637220 - DNA, 19 bp, Homo sapiens
acctttcagtgcagtttct

SEQ ID NO: 3637221 - DNA, 19 bp, Homo sapiens
acctttctcctttgtactt

SEQ ID NO: 3637222 - DNA, 19 bp, Homo sapiens
acctttgtagttactcaag

SEQ ID NO: 3637223 - DNA, 24 bp, Homo sapiens
acctttgtagttactcaagcagtt

SEQ ID NO: 3637224 - DNA, 23 bp, Homo sapiens
accttttatttttatttctgact

SEQ ID NO: 3637225 - DNA, 12 bp, Homo sapiens
accttttcaaat

SEQ ID NO: 3637226 - DNA, 13 bp, Homo sapiens
accttttcaaatt

SEQ ID NO: 3637227 - DNA, 23 bp, Homo sapiens
acgaaactccatctcaaaacaaa

SEQ ID NO: 3637228 - DNA, 18 bp, Homo sapiens
acgacctgtcctgtcttt

SEQ ID NO: 3637229 - DNA, 13 bp, Homo sapiens
acgagatttgcca

SEQ ID NO: 3637230 - DNA, 13 bp, Homo sapiens
acgagcagcccag

SEQ ID NO: 3637231 - DNA, 23 bp, Homo sapiens
acgagcagcccagggcctagagg

SEQ ID NO: 3637232 - DNA, 22 bp, Homo sapiens
acgaggacatttgtgggcaagc

SEQ ID NO: 3637233 - DNA, 17 bp, Homo sapiens
acgagggtctcccctcc

SEQ ID NO: 3637234 - DNA, 19 bp, Homo sapiens
acgagggtctcccctcctg

SEQ ID NO: 3637235 - DNA, 22 bp, Homo sapiens
acgagggtctcccctcctgcac

SEQ ID NO: 3637236 - DNA, 22 bp, Homo sapiens
acgatgttgtattgatttttaa

SEQ ID NO: 3637237 - DNA, 17 bp, Homo sapiens
acgattgacctgtcctc

SEQ ID NO: 3637238 - DNA, 18 bp, Homo sapiens
acgcaccccactgggaga

SEQ ID NO: 3637239 - DNA, 21 bp, Homo sapiens
acgcagctgggtgcagaagct

SEQ ID NO: 3637240 - DNA, 12 bp, Homo sapiens
acgcaggcacag

SEQ ID NO: 3637241 - DNA, 20 bp, Homo sapiens
acgccaggcaccacagcctc

SEQ ID NO: 3637242 - DNA, 16 bp, Homo sapiens
acgcccccccccaccc

SEQ ID NO: 3637243 - DNA, 22 bp, Homo sapiens
acgcccctccaaacctccagcc

SEQ ID NO: 3637244 - DNA, 12 bp, Homo sapiens
acgcccctgtgg

SEQ ID NO: 3637245 - DNA, 22 bp, Homo sapiens
acgcccctgtggccaactgcaa

SEQ ID NO: 3637246 - DNA, 18 bp, Homo sapiens
acgccctggtaaggctgg

SEQ ID NO: 3637247 - DNA, 20 bp, Homo sapiens
acgccgccctaaaagcacac

SEQ ID NO: 3637248 - DNA, 15 bp, Homo sapiens
acgcctgaggcaatt

SEQ ID NO: 3637249 - DNA, 23 bp, Homo sapiens
acgcgcctcgccggatctgaggg

SEQ ID NO: 3637250 - DNA, 17 bp, Homo sapiens
acgcggcggggactcgg

SEQ ID NO: 3637251 - DNA, 14 bp, Homo sapiens
acgcgtctgcctgg

SEQ ID NO: 3637252 - DNA, 15 bp, Homo sapiens
acgcgtctgcctggg

SEQ ID NO: 3637253 - DNA, 12 bp, Homo sapiens
acgctgacaata

SEQ ID NO: 3637254 - DNA, 13 bp, Homo sapiens
acgctgctctgcc

SEQ ID NO: 3637255 - DNA, 19 bp, Homo sapiens
acgctgctctgccccagct

SEQ ID NO: 3637256 - DNA, 20 bp, Homo sapiens
acgctgctctgccccagctt

SEQ ID NO: 3637257 - DNA, 23 bp, Homo sapiens
acgctgtccctagtaaaaataca

SEQ ID NO: 3637258 - DNA, 21 bp, Homo sapiens
acggaagtggtggctgtggaa

SEQ ID NO: 3637259 - DNA, 19 bp, Homo sapiens
acttgatggctaacttaca

SEQ ID NO: 3637260 - DNA, 12 bp, Homo sapiens
acttgcacactc

SEQ ID NO: 3637261 - DNA, 21 bp, Homo sapiens
acttgcccacaccgagggcga

SEQ ID NO: 3637262 - DNA, 22 bp, Homo sapiens
acttgcctaactaactggcagg

SEQ ID NO: 3637263 - DNA, 12 bp, Homo sapiens
acttgctgcctc

SEQ ID NO: 3637264 - DNA, 14 bp, Homo sapiens
acttgctgctgcct

SEQ ID NO: 3637265 - DNA, 14 bp, Homo sapiens
acttgctttcttct

SEQ ID NO: 3637266 - DNA, 15 bp, Homo sapiens
acttggaggacctgg

SEQ ID NO: 3637267 - DNA, 14 bp, Homo sapiens
acttgtacaaaata

SEQ ID NO: 3637268 - DNA, 20 bp, Homo sapiens
acttgtacaaaataaacaaa

SEQ ID NO: 3637269 - DNA, 20 bp, Homo sapiens
acttgtatattctattttac

SEQ ID NO: 3637270 - DNA, 13 bp, Homo sapiens
acttgtcatgtga

SEQ ID NO: 3637271 - DNA, 13 bp, Homo sapiens
acttgtgattggc

SEQ ID NO: 3637272 - DNA, 16 bp, Homo sapiens
acttgtgattggctgc

SEQ ID NO: 3637273 - DNA, 14 bp, Homo sapiens
acttgttgaattta

SEQ ID NO: 3637274 - DNA, 16 bp, Homo sapiens
acttgtttctgatcta

SEQ ID NO: 3637275 - DNA, 16 bp, Homo sapiens
acttgttttctttgtt

SEQ ID NO: 3637276 - DNA, 16 bp, Homo sapiens
actttaaattatatga

SEQ ID NO: 3637277 - DNA, 18 bp, Homo sapiens
actttaaattatatgata

SEQ ID NO: 3637278 - DNA, 20 bp, Homo sapiens
actttaacttctgttttacc

SEQ ID NO: 3637279 - DNA, 16 bp, Homo sapiens
actttataactaacat

SEQ ID NO: 3637280 - DNA, 14 bp, Homo sapiens
actttatcaattaa

SEQ ID NO: 3637281 - DNA, 15 bp, Homo sapiens
actttatttatttct

SEQ ID NO: 3637282 - DNA, 22 bp, Homo sapiens
actttcagagcccccagccctg

SEQ ID NO: 3637283 - DNA, 20 bp, Homo sapiens
actttcatctaccttttctg

SEQ ID NO: 3637284 - DNA, 17 bp, Homo sapiens
actttccgagcctccag

SEQ ID NO: 3637285 - DNA, 17 bp, Homo sapiens
actttctatctcatctg

SEQ ID NO: 3637286 - DNA, 16 bp, Homo sapiens
actttctatgtgacat

SEQ ID NO: 3637287 - DNA, 23 bp, Homo sapiens
actttgaagtgcagctcatgttt

SEQ ID NO: 3637288 - DNA, 17 bp, Homo sapiens
actttgcactgatatat

SEQ ID NO: 3637289 - DNA, 21 bp, Homo sapiens
actttgcactgatatatcatg

SEQ ID NO: 3637290 - DNA, 14 bp, Homo sapiens
actttgccaaggct

SEQ ID NO: 3637291 - DNA, 14 bp, Homo sapiens
actttgtgctcata

SEQ ID NO: 3637292 - DNA, 15 bp, Homo sapiens
actttgtgttcattt

SEQ ID NO: 3637293 - DNA, 18 bp, Homo sapiens
actttgtgttcatttcat

SEQ ID NO: 3637294 - DNA, 19 bp, Homo sapiens
actttgtgttcatttcatt

SEQ ID NO: 3637295 - DNA, 12 bp, Homo sapiens
acttttaaacag

SEQ ID NO: 3637296 - DNA, 15 bp, Homo sapiens
acttttattttcttt

SEQ ID NO: 3637297 - DNA, 21 bp, Homo sapiens
acttttcctttgctagttgtt

SEQ ID NO: 3637298 - DNA, 11 bp, Homo sapiens
acttttgagga

SEQ ID NO: 3637299 - DNA, 12 bp, Homo sapiens
actttttcctct

SEQ ID NO: 3637300 - DNA, 16 bp, Homo sapiens
actttttcctctcgag

SEQ ID NO: 3637301 - DNA, 11 bp, Homo sapiens
actttttctga

SEQ ID NO: 3637302 - DNA, 15 bp, Homo sapiens
actttttgaggcaaa

SEQ ID NO: 3637303 - DNA, 12 bp, Homo sapiens
acttttttataa

SEQ ID NO: 3637304 - DNA, 20 bp, Homo sapiens
actttttttctgtaccagtt

SEQ ID NO: 3637305 - DNA, 21 bp, Homo sapiens
actttttttctgtaccagtta

SEQ ID NO: 3637306 - DNA, 23 bp, Homo sapiens
actttttttctgtaccagttaat

SEQ ID NO: 3637307 - DNA, 19 bp, Homo sapiens
acttttttttctctctttt

SEQ ID NO: 3637308 - DNA, 18 bp, Homo sapiens
agaaaaaacaatttttga

SEQ ID NO: 3637309 - DNA, 13 bp, Homo sapiens
agaaaaaagcaag

SEQ ID NO: 3637310 - DNA, 16 bp, Homo sapiens
agaaaaacacgagaaa

SEQ ID NO: 3637311 - DNA, 17 bp, Homo sapiens
agaaaaataagtcaaaa

SEQ ID NO: 3637312 - DNA, 13 bp, Homo sapiens
agaaaacattttt

SEQ ID NO: 3637313 - DNA, 15 bp, Homo sapiens
agaaaaccacagtta

SEQ ID NO: 3637314 - DNA, 20 bp, Homo sapiens
agaaaacccacggtttttct

SEQ ID NO: 3637315 - DNA, 17 bp, Homo sapiens
agaaaacttttatgcaa

SEQ ID NO: 3637316 - DNA, 15 bp, Homo sapiens
agaaaagattcttct

SEQ ID NO: 3637317 - DNA, 20 bp, Homo sapiens
agaaaagattcttcttaaaa

SEQ ID NO: 3637318 - DNA, 18 bp, Homo sapiens
agaaaagcaatactgttt

SEQ ID NO: 3637319 - DNA, 13 bp, Homo sapiens
agaaaagccgaaa

SEQ ID NO: 3637320 - DNA, 16 bp, Homo sapiens
agaaaagccgaaaggg

SEQ ID NO: 3637321 - DNA, 15 bp, Homo sapiens
agaaaatatttttgt

SEQ ID NO: 3637322 - DNA, 17 bp, Homo sapiens
agaaaatgaaatgcata

SEQ ID NO: 3637323 - DNA, 12 bp, Homo sapiens
agaaaatgtctt

SEQ ID NO: 3637324 - DNA, 23 bp, Homo sapiens
agaaaatgttggggtaaaagtgt

SEQ ID NO: 3637325 - DNA, 17 bp, Homo sapiens
agaaaattcaggtctgt

SEQ ID NO: 3637326 - DNA, 17 bp, Homo sapiens
agaaaattccctggggt

SEQ ID NO: 3637327 - DNA, 13 bp, Homo sapiens
agaaacaagctgt

SEQ ID NO: 3637328 - DNA, 15 bp, Homo sapiens
agaaacaagctgtgc

SEQ ID NO: 3637329 - DNA, 17 bp, Homo sapiens
agaaacaagctgtgcag

SEQ ID NO: 3637330 - DNA, 22 bp, Homo sapiens
agaaacactgcaaattttaact

SEQ ID NO: 3637331 - DNA, 18 bp, Homo sapiens
agaaacagagtggcctcc

SEQ ID NO: 3637332 - DNA, 20 bp, Homo sapiens
agaaacagagtggcctccct

SEQ ID NO: 3637333 - DNA, 21 bp, Homo sapiens
agaaacagagtggcctccctg

SEQ ID NO: 3637334 - DNA, 22 bp, Homo sapiens
agaaacagagtggcctccctgc

SEQ ID NO: 3637335 - DNA, 23 bp, Homo sapiens
agaaacagagtggcctccctgct

SEQ ID NO: 3637336 - DNA, 14 bp, Homo sapiens
agaaacagctcagc

SEQ ID NO: 3637337 - DNA, 18 bp, Homo sapiens
agaaacagctcagccagt

SEQ ID NO: 3637338 - DNA, 19 bp, Homo sapiens
agaaacagttggtaacttt

SEQ ID NO: 3637339 - DNA, 22 bp, Homo sapiens
agaaacagttggtaacttttgt

SEQ ID NO: 3637340 - DNA, 22 bp, Homo sapiens
agaaaccacagtcttcccagca

SEQ ID NO: 3637341 - DNA, 15 bp, Homo sapiens
agaaaccagaaaagc

SEQ ID NO: 3637342 - DNA, 21 bp, Homo sapiens
agaaacccacgacctgtcctg

SEQ ID NO: 3637343 - DNA, 12 bp, Homo sapiens
agaaacctgcca

SEQ ID NO: 3637344 - DNA, 23 bp, Homo sapiens
agaaacctgccaaggagcatcct

SEQ ID NO: 3637345 - DNA, 19 bp, Homo sapiens
agaaacctggggtgaatac

SEQ ID NO: 3637346 - DNA, 21 bp, Homo sapiens
agaaacctggggtgaatactt

SEQ ID NO: 3637347 - DNA, 19 bp, Homo sapiens
agaaaccttgctctcctca

SEQ ID NO: 3637348 - DNA, 14 bp, Homo sapiens
agaaaccttttatt

SEQ ID NO: 3637349 - DNA, 15 bp, Homo sapiens
agaaaccttttattt

SEQ ID NO: 3637350 - DNA, 16 bp, Homo sapiens
agaaaccttttatttt

SEQ ID NO: 3637351 - DNA, 14 bp, Homo sapiens
agaaactacaaata

SEQ ID NO: 3637352 - DNA, 13 bp, Homo sapiens
agaaactgaggcc

SEQ ID NO: 3637353 - DNA, 15 bp, Homo sapiens
agaaactgaggccca

SEQ ID NO: 3637354 - DNA, 16 bp, Homo sapiens
agaaactgaggcccag

SEQ ID NO: 3637355 - DNA, 21 bp, Homo sapiens
agaaactgaggcccagagagg

SEQ ID NO: 3637356 - DNA, 12 bp, Homo sapiens
agaaactgatgc

SEQ ID NO: 3637357 - DNA, 13 bp, Homo sapiens
agaaactgatgcc

SEQ ID NO: 3637358 - DNA, 23 bp, Homo sapiens
agaaactgctgcagattagttct

SEQ ID NO: 3637359 - DNA, 21 bp, Homo sapiens
agaaactgttcccacctgctg

SEQ ID NO: 3637360 - DNA, 17 bp, Homo sapiens
agaaacttttttatttt

SEQ ID NO: 3637361 - DNA, 20 bp, Homo sapiens
agaaagactattcaaacagt

SEQ ID NO: 3637362 - DNA, 16 bp, Homo sapiens
agaaagagagaagcca

SEQ ID NO: 3637363 - DNA, 19 bp, Homo sapiens
agaaagagagaagccagcc

SEQ ID NO: 3637364 - DNA, 22 bp, Homo sapiens
agaaagagagaagccagccaca

SEQ ID NO: 3637365 - DNA, 12 bp, Homo sapiens
agaaagagctac

SEQ ID NO: 3637366 - DNA, 15 bp, Homo sapiens
agaaagagctgcctg

SEQ ID NO: 3637367 - DNA, 18 bp, Homo sapiens
agaaagagctgcctggat

SEQ ID NO: 3637368 - DNA, 19 bp, Homo sapiens
agaaagagctgcctggatg

SEQ ID NO: 3637369 - DNA, 20 bp, Homo sapiens
agaaagagctgcctggatga

SEQ ID NO: 3637370 - DNA, 13 bp, Homo sapiens
agaaagcaaaata

SEQ ID NO: 3637371 - DNA, 22 bp, Homo sapiens
agaaagcatccctcacccatcc

SEQ ID NO: 3637372 - DNA, 12 bp, Homo sapiens
agaaagcctcct

SEQ ID NO: 3637373 - DNA, 19 bp, Homo sapiens
agaaagcctgggtgacatt

SEQ ID NO: 3637374 - DNA, 11 bp, Homo sapiens
agaaaggactg

SEQ ID NO: 3637375 - DNA, 20 bp, Homo sapiens
agaaagggattgctgaggca

SEQ ID NO: 3637376 - DNA, 14 bp, Homo sapiens
agaaagggcaaggg

SEQ ID NO: 3637377 - DNA, 16 bp, Homo sapiens
agaaaggggagcccac

SEQ ID NO: 3637378 - DNA, 16 bp, Homo sapiens
agaaaggtgtgaggag

SEQ ID NO: 3637379 - DNA, 16 bp, Homo sapiens
agaaagtaagcatttc

SEQ ID NO: 3637380 - DNA, 17 bp, Homo sapiens
agaaagtaatttaattt

SEQ ID NO: 3637381 - DNA, 16 bp, Homo sapiens
agaaagtgggaggtca

SEQ ID NO: 3637382 - DNA, 17 bp, Homo sapiens
agaaagtgtatttggaa

SEQ ID NO: 3637383 - DNA, 14 bp, Homo sapiens
agaaataaatcaca

SEQ ID NO: 3637384 - DNA, 14 bp, Homo sapiens
agaaatataattga

SEQ ID NO: 3637385 - DNA, 19 bp, Homo sapiens
agaaatatatttgtcactt

SEQ ID NO: 3637386 - DNA, 23 bp, Homo sapiens
agaaatgcatatgtcactagaat

SEQ ID NO: 3637387 - DNA, 16 bp, Homo sapiens
agaaatgtcttaattt

SEQ ID NO: 3637388 - DNA, 23 bp, Homo sapiens
agaaattgacctgatttccattt

SEQ ID NO: 3637389 - DNA, 15 bp, Homo sapiens
agaacaaaacttcta

SEQ ID NO: 3637390 - DNA, 16 bp, Homo sapiens
agaacaaacaaaactt

SEQ ID NO: 3637391 - DNA, 19 bp, Homo sapiens
agaacaatattgactttgt

SEQ ID NO: 3637392 - DNA, 22 bp, Homo sapiens
agatggaaatttttacctttat

SEQ ID NO: 3637393 - DNA, 21 bp, Homo sapiens
agatggactcaggatccagtg

SEQ ID NO: 3637394 - DNA, 22 bp, Homo sapiens
agatggactcaggatccagtga

SEQ ID NO: 3637395 - DNA, 23 bp, Homo sapiens
agatggagacaccctctgggggt

SEQ ID NO: 3637396 - DNA, 16 bp, Homo sapiens
agatggagggcttggc

SEQ ID NO: 3637397 - DNA, 18 bp, Homo sapiens
agatggagggcttggccc

SEQ ID NO: 3637398 - DNA, 15 bp, Homo sapiens
agatggccatgctca

SEQ ID NO: 3637399 - DNA, 14 bp, Homo sapiens
agatggctcctctc

SEQ ID NO: 3637400 - DNA, 15 bp, Homo sapiens
agatggctcctctca

SEQ ID NO: 3637401 - DNA, 17 bp, Homo sapiens
agatggctgtgcctctg

SEQ ID NO: 3637402 - DNA, 21 bp, Homo sapiens
agatggctgtgcctctgcctg

SEQ ID NO: 3637403 - DNA, 23 bp, Homo sapiens
agatggctgtgcctctgcctgtc

SEQ ID NO: 3637404 - DNA, 15 bp, Homo sapiens
agatggtggccacag

SEQ ID NO: 3637405 - DNA, 12 bp, Homo sapiens
agatgtacattt

SEQ ID NO: 3637406 - DNA, 14 bp, Homo sapiens
agatgtacatttaa

SEQ ID NO: 3637407 - DNA, 14 bp, Homo sapiens
agatgtgcagtttg

SEQ ID NO: 3637408 - DNA, 13 bp, Homo sapiens
agatgtttacatt

SEQ ID NO: 3637409 - DNA, 14 bp, Homo sapiens
agatgtttacattt

SEQ ID NO: 3637410 - DNA, 18 bp, Homo sapiens
agattaaatgtgtcattg

SEQ ID NO: 3637411 - DNA, 18 bp, Homo sapiens
agattagttctttttgcc

SEQ ID NO: 3637412 - DNA, 14 bp, Homo sapiens
agattcaagacaag

SEQ ID NO: 3637413 - DNA, 18 bp, Homo sapiens
agattcaagacaagagct

SEQ ID NO: 3637414 - DNA, 15 bp, Homo sapiens
agattcagagaaatt

SEQ ID NO: 3637415 - DNA, 19 bp, Homo sapiens
agattcatatttacttctt

SEQ ID NO: 3637416 - DNA, 18 bp, Homo sapiens
agattcatgcaagtggag

SEQ ID NO: 3637417 - DNA, 21 bp, Homo sapiens
agattccagagagtggctcct

SEQ ID NO: 3637418 - DNA, 13 bp, Homo sapiens
agattcccagagc

SEQ ID NO: 3637419 - DNA, 15 bp, Homo sapiens
agattccctgagcag

SEQ ID NO: 3637420 - DNA, 12 bp, Homo sapiens
agattctatgtt

SEQ ID NO: 3637421 - DNA, 23 bp, Homo sapiens
agattctatgttaatattttatg

SEQ ID NO: 3637422 - DNA, 18 bp, Homo sapiens
agattgagagaagagaca

SEQ ID NO: 3637423 - DNA, 19 bp, Homo sapiens
agattgagagaagagacaa

SEQ ID NO: 3637424 - DNA, 17 bp, Homo sapiens
agattggcttgtctcac

SEQ ID NO: 3637425 - DNA, 18 bp, Homo sapiens
agatttaagccttacaaa

SEQ ID NO: 3637426 - DNA, 16 bp, Homo sapiens
agatttattcctttgt

SEQ ID NO: 3637427 - DNA, 16 bp, Homo sapiens
agatttgatatttgca

SEQ ID NO: 3637428 - DNA, 16 bp, Homo sapiens
agatttggaatacaca

SEQ ID NO: 3637429 - DNA, 23 bp, Homo sapiens
agattttgttttgttggacattt

SEQ ID NO: 3637430 - DNA, 15 bp, Homo sapiens
agatttttttcctga

SEQ ID NO: 3637431 - DNA, 19 bp, Homo sapiens
agcaaaactttactttcag

SEQ ID NO: 3637432 - DNA, 20 bp, Homo sapiens
agcaaaagaaacaccagtgt

SEQ ID NO: 3637433 - DNA, 22 bp, Homo sapiens
agcaaaagaaacaccagtgtta

SEQ ID NO: 3637434 - DNA, 21 bp, Homo sapiens
agcaaaataattttaaacaaa

SEQ ID NO: 3637435 - DNA, 19 bp, Homo sapiens
agcaaacttgttgaattta

SEQ ID NO: 3637436 - DNA, 18 bp, Homo sapiens
agcaaaggtgcactccag

SEQ ID NO: 3637437 - DNA, 14 bp, Homo sapiens
agcaaataaatacg

SEQ ID NO: 3637438 - DNA, 21 bp, Homo sapiens
agcaaataaatacgtgtcaaa

SEQ ID NO: 3637439 - DNA, 17 bp, Homo sapiens
agcaaatcagaaaaccc

SEQ ID NO: 3637440 - DNA, 22 bp, Homo sapiens
agcaacacagaggaatttatac

SEQ ID NO: 3637441 - DNA, 22 bp, Homo sapiens
agcaacattttacccacacaca

SEQ ID NO: 3637442 - DNA, 13 bp, Homo sapiens
agcaaccacactg

SEQ ID NO: 3637443 - DNA, 17 bp, Homo sapiens
agcaaccacactgcttg

SEQ ID NO: 3637444 - DNA, 19 bp, Homo sapiens
agcaaccctacagtatata

SEQ ID NO: 3637445 - DNA, 20 bp, Homo sapiens
agcaaccctacagtatataa

SEQ ID NO: 3637446 - DNA, 19 bp, Homo sapiens
agcaacccttcctgctgct

SEQ ID NO: 3637447 - DNA, 19 bp, Homo sapiens
agcaaccgcctcaaaatgt

SEQ ID NO: 3637448 - DNA, 11 bp, Homo sapiens
agcaactattc

SEQ ID NO: 3637449 - DNA, 16 bp, Homo sapiens
agcaagaaacagtttc

SEQ ID NO: 3637450 - DNA, 16 bp, Homo sapiens
agcaagataaacatta

SEQ ID NO: 3637451 - DNA, 20 bp, Homo sapiens
agcaagcaccaacctccaga

SEQ ID NO: 3637452 - DNA, 14 bp, Homo sapiens
agcaagctttggtt

SEQ ID NO: 3637453 - DNA, 15 bp, Homo sapiens
agcaaggcacagcct

SEQ ID NO: 3637454 - DNA, 14 bp, Homo sapiens
agcaaggcagagcc

SEQ ID NO: 3637455 - DNA, 20 bp, Homo sapiens
agcaagtcccttcagactgg

SEQ ID NO: 3637456 - DNA, 16 bp, Homo sapiens
agcaatgccccaaact

SEQ ID NO: 3637457 - DNA, 18 bp, Homo sapiens
agcaatgggtcttagctc

SEQ ID NO: 3637458 - DNA, 15 bp, Homo sapiens
agcaattcatggttc

SEQ ID NO: 3637459 - DNA, 21 bp, Homo sapiens
agcaattcatggttcaagtat

SEQ ID NO: 3637460 - DNA, 13 bp, Homo sapiens
agcaatttaaatg

SEQ ID NO: 3637461 - DNA, 16 bp, Homo sapiens
agcaatttaaatgtta

SEQ ID NO: 3637462 - DNA, 17 bp, Homo sapiens
agcaatttaaatgttat

SEQ ID NO: 3637463 - DNA, 19 bp, Homo sapiens
agcaatttaaatgttatga

SEQ ID NO: 3637464 - DNA, 17 bp, Homo sapiens
agcaatttaactagaca

SEQ ID NO: 3637465 - DNA, 14 bp, Homo sapiens
agcaatttactgat

SEQ ID NO: 3637466 - DNA, 15 bp, Homo sapiens
agcaatttagacaaa

SEQ ID NO: 3637467 - DNA, 13 bp, Homo sapiens
agcacaaagaaga

SEQ ID NO: 3637468 - DNA, 14 bp, Homo sapiens
agcacaaagaagaa

SEQ ID NO: 3637469 - DNA, 15 bp, Homo sapiens
agcacaaagaagaaa

SEQ ID NO: 3637470 - DNA, 22 bp, Homo sapiens
agcacactgcacagggaaaatt

SEQ ID NO: 3637471 - DNA, 12 bp, Homo sapiens
agcacagccctt

SEQ ID NO: 3637472 - DNA, 15 bp, Homo sapiens
agcaccaaccacagc

SEQ ID NO: 3637473 - DNA, 14 bp, Homo sapiens
agcaccaagcatgt

SEQ ID NO: 3637474 - DNA, 20 bp, Homo sapiens
agcaccacagccggtcagag

SEQ ID NO: 3637475 - DNA, 14 bp, Homo sapiens
agcacccagagcac

SEQ ID NO: 3637476 - DNA, 12 bp, Homo sapiens
agcaccccttcc

SEQ ID NO: 3637477 - DNA, 18 bp, Homo sapiens
agcactcacgccctaagc

SEQ ID NO: 3637478 - DNA, 18 bp, Homo sapiens
agcactccccagagctgt

SEQ ID NO: 3637479 - DNA, 23 bp, Homo sapiens
agcactggtgaactgagctgggc

SEQ ID NO: 3637480 - DNA, 18 bp, Homo sapiens
agcagaaaccaacaagaa

SEQ ID NO: 3637481 - DNA, 22 bp, Homo sapiens
agcagaaaccaacaagaaccac

SEQ ID NO: 3637482 - DNA, 21 bp, Homo sapiens
agcagaaagtaagcatttcca

SEQ ID NO: 3637483 - DNA, 22 bp, Homo sapiens
agcagaaccttctttggttcca

SEQ ID NO: 3637484 - DNA, 11 bp, Homo sapiens
agcagacattt

SEQ ID NO: 3637485 - DNA, 23 bp, Homo sapiens
agcagactgttctaaaatataat

SEQ ID NO: 3637486 - DNA, 14 bp, Homo sapiens
agcagagaattctc

SEQ ID NO: 3637487 - DNA, 13 bp, Homo sapiens
agcagagcctcct

SEQ ID NO: 3637488 - DNA, 16 bp, Homo sapiens
agcagagcctcctggg

SEQ ID NO: 3637489 - DNA, 17 bp, Homo sapiens
agcagagcctcctggga

SEQ ID NO: 3637490 - DNA, 22 bp, Homo sapiens
agcagaggcgtactacccagct

SEQ ID NO: 3637491 - DNA, 21 bp, Homo sapiens
agcagatgctgttgtgaagct

SEQ ID NO: 3637492 - DNA, 18 bp, Homo sapiens
agcagcaccaaccacagc

SEQ ID NO: 3637493 - DNA, 13 bp, Homo sapiens
agcagcagcacca

SEQ ID NO: 3637494 - DNA, 17 bp, Homo sapiens
agcagcaggagggggga

SEQ ID NO: 3637495 - DNA, 15 bp, Homo sapiens
agcagcaggcctctg

SEQ ID NO: 3637496 - DNA, 13 bp, Homo sapiens
agcagcaggctca

SEQ ID NO: 3637497 - DNA, 15 bp, Homo sapiens
agcagcatggaaaaa

SEQ ID NO: 3637498 - DNA, 16 bp, Homo sapiens
agcagcccagggccta

SEQ ID NO: 3637499 - DNA, 16 bp, Homo sapiens
agcagccccaggagaa

SEQ ID NO: 3637500 - DNA, 19 bp, Homo sapiens
agcagcccccgggccgctg

SEQ ID NO: 3637501 - DNA, 12 bp, Homo sapiens
agcagcccttgc

SEQ ID NO: 3637502 - DNA, 19 bp, Homo sapiens
agcagccgccagctgggag

SEQ ID NO: 3637503 - DNA, 18 bp, Homo sapiens
agcagcgcttcctggctg

SEQ ID NO: 3637504 - DNA, 16 bp, Homo sapiens
agcagctgatgctgta

SEQ ID NO: 3637505 - DNA, 15 bp, Homo sapiens
agcagctgcattttt

SEQ ID NO: 3637506 - DNA, 21 bp, Homo sapiens
agcagcttgaatggtttttct

SEQ ID NO: 3637507 - DNA, 20 bp, Homo sapiens
agcagctttttattccctgc

SEQ ID NO: 3637508 - DNA, 21 bp, Homo sapiens
agcagctttttattccctgcc

SEQ ID NO: 3637509 - DNA, 24 bp, Homo sapiens
agcaggaaggaacaaagacaggca

SEQ ID NO: 3637510 - DNA, 14 bp, Homo sapiens
agcaggaaggaccc

SEQ ID NO: 3637511 - DNA, 18 bp, Homo sapiens
agcaggagagactgagca

SEQ ID NO: 3637512 - DNA, 14 bp, Homo sapiens
agcaggagggggga

SEQ ID NO: 3637513 - DNA, 15 bp, Homo sapiens
agcaggcaccgccac

SEQ ID NO: 3637514 - DNA, 21 bp, Homo sapiens
agcaggcagagtggcgtggcc

SEQ ID NO: 3637515 - DNA, 15 bp, Homo sapiens
agcaggccagagaaa

SEQ ID NO: 3637516 - DNA, 21 bp, Homo sapiens
agcaggcccaatgctgctttt

SEQ ID NO: 3637517 - DNA, 15 bp, Homo sapiens
agcaggcctctggga

SEQ ID NO: 3637518 - DNA, 17 bp, Homo sapiens
agcaggcctctgggacc

SEQ ID NO: 3637519 - DNA, 20 bp, Homo sapiens
agcaggcctctgggacccac

SEQ ID NO: 3637520 - DNA, 21 bp, Homo sapiens
agcaggcctctgggacccaca

SEQ ID NO: 3637521 - DNA, 14 bp, Homo sapiens
agcaggctactgtc

SEQ ID NO: 3637522 - DNA, 16 bp, Homo sapiens
agcaggctactgtcag

SEQ ID NO: 3637523 - DNA, 17 bp, Homo sapiens
agcaggcttgtggcagc

SEQ ID NO: 3637524 - DNA, 21 bp, Homo sapiens
agcagggaaaatgcagcaggg

SEQ ID NO: 3637525 - DNA, 16 bp, Homo sapiens
agctgggtgcagaagc

SEQ ID NO: 3637526 - DNA, 21 bp, Homo sapiens
agctggtggtgcagccttccc

SEQ ID NO: 3637527 - DNA, 13 bp, Homo sapiens
agctggttgctcc

SEQ ID NO: 3637528 - DNA, 18 bp, Homo sapiens
agctgtaaaaatgttacg

SEQ ID NO: 3637529 - DNA, 13 bp, Homo sapiens
agctgtaagggca

SEQ ID NO: 3637530 - DNA, 14 bp, Homo sapiens
agctgtaagggcag

SEQ ID NO: 3637531 - DNA, 17 bp, Homo sapiens
agctgtaagggcagtgc

SEQ ID NO: 3637532 - DNA, 19 bp, Homo sapiens
agctgtaagggcagtgccc

SEQ ID NO: 3637533 - DNA, 16 bp, Homo sapiens
agctgtccctgcaggg

SEQ ID NO: 3637534 - DNA, 17 bp, Homo sapiens
agctgtctgctcagaca

SEQ ID NO: 3637535 - DNA, 13 bp, Homo sapiens
agctgtctgtctc

SEQ ID NO: 3637536 - DNA, 14 bp, Homo sapiens
agctgtctgtctct

SEQ ID NO: 3637537 - DNA, 17 bp, Homo sapiens
agctgtgcaggcatggt

SEQ ID NO: 3637538 - DNA, 17 bp, Homo sapiens
agctgtgccagcagggg

SEQ ID NO: 3637539 - DNA, 20 bp, Homo sapiens
agctgtggggaacacagcta

SEQ ID NO: 3637540 - DNA, 22 bp, Homo sapiens
agctgtggggaacacagctaca

SEQ ID NO: 3637541 - DNA, 14 bp, Homo sapiens
agctgtgttgaaac

SEQ ID NO: 3637542 - DNA, 20 bp, Homo sapiens
agctgtgttgaaacagaaaa

SEQ ID NO: 3637543 - DNA, 14 bp, Homo sapiens
agctgttatgctgt

SEQ ID NO: 3637544 - DNA, 18 bp, Homo sapiens
agctgttatgctgtttcc

SEQ ID NO: 3637545 - DNA, 18 bp, Homo sapiens
agctgttatttcttccct

SEQ ID NO: 3637546 - DNA, 19 bp, Homo sapiens
agctgttatttcttccctg

SEQ ID NO: 3637547 - DNA, 21 bp, Homo sapiens
agctgttatttcttccctgct

SEQ ID NO: 3637548 - DNA, 16 bp, Homo sapiens
agctgttcacagccag

SEQ ID NO: 3637549 - DNA, 23 bp, Homo sapiens
agctgttccattacaccacagca

SEQ ID NO: 3637550 - DNA, 18 bp, Homo sapiens
agctgtttatagagaatg

SEQ ID NO: 3637551 - DNA, 14 bp, Homo sapiens
agctgttttcttct

SEQ ID NO: 3637552 - DNA, 21 bp, Homo sapiens
agcttaatcttaatgtctggt

SEQ ID NO: 3637553 - DNA, 15 bp, Homo sapiens
agcttacaggagcca

SEQ ID NO: 3637554 - DNA, 17 bp, Homo sapiens
agcttacaggagccagc

SEQ ID NO: 3637555 - DNA, 20 bp, Homo sapiens
agcttacaggagccagcctg

SEQ ID NO: 3637556 - DNA, 23 bp, Homo sapiens
agcttacaggagccagcctgctt

SEQ ID NO: 3637557 - DNA, 15 bp, Homo sapiens
agcttacctgggcac

SEQ ID NO: 3637558 - DNA, 13 bp, Homo sapiens
agcttcagccagg

SEQ ID NO: 3637559 - DNA, 21 bp, Homo sapiens
agcttcagccaggtctgactc

SEQ ID NO: 3637560 - DNA, 22 bp, Homo sapiens
agcttcagccaggtctgactcc

SEQ ID NO: 3637561 - DNA, 22 bp, Homo sapiens
agcttcagtaagttatctttga

SEQ ID NO: 3637562 - DNA, 17 bp, Homo sapiens
agcttccaattttcctt

SEQ ID NO: 3637563 - DNA, 16 bp, Homo sapiens
agcttccatgatgcac

SEQ ID NO: 3637564 - DNA, 16 bp, Homo sapiens
agcttccgagaatagc

SEQ ID NO: 3637565 - DNA, 22 bp, Homo sapiens
agcttccgctttgaaagaagca

SEQ ID NO: 3637566 - DNA, 20 bp, Homo sapiens
agcttcctcacacccctgtc

SEQ ID NO: 3637567 - DNA, 22 bp, Homo sapiens
agcttctactcctgcctcatgc

SEQ ID NO: 3637568 - DNA, 13 bp, Homo sapiens
agcttctctgcag

SEQ ID NO: 3637569 - DNA, 17 bp, Homo sapiens
agcttgaaactgagatg

SEQ ID NO: 3637570 - DNA, 19 bp, Homo sapiens
agcttgacttgtggggcag

SEQ ID NO: 3637571 - DNA, 14 bp, Homo sapiens
agcttgctgggctt

SEQ ID NO: 3637572 - DNA, 15 bp, Homo sapiens
agcttgctgggcttt

SEQ ID NO: 3637573 - DNA, 22 bp, Homo sapiens
agcttggctcacaaggcccagg

SEQ ID NO: 3637574 - DNA, 21 bp, Homo sapiens
agcttgggcagatctcccaca

SEQ ID NO: 3637575 - DNA, 18 bp, Homo sapiens
agcttgtaataaatactg

SEQ ID NO: 3637576 - DNA, 12 bp, Homo sapiens
agcttgtgaaga

SEQ ID NO: 3637577 - DNA, 17 bp, Homo sapiens
agcttgttgaaaaccca

SEQ ID NO: 3637578 - DNA, 17 bp, Homo sapiens
agctttaaaaaaataat

SEQ ID NO: 3637579 - DNA, 13 bp, Homo sapiens
agctttctgcctt

SEQ ID NO: 3637580 - DNA, 17 bp, Homo sapiens
agctttctgccttagcc

SEQ ID NO: 3637581 - DNA, 10 bp, Homo sapiens
agctttgcta

SEQ ID NO: 3637582 - DNA, 22 bp, Homo sapiens
agctttgctgctgaaggctcat

SEQ ID NO: 3637583 - DNA, 18 bp, Homo sapiens
agctttggctctggctgc

SEQ ID NO: 3637584 - DNA, 18 bp, Homo sapiens
agctttgtagaaattaaa

SEQ ID NO: 3637585 - DNA, 21 bp, Homo sapiens
agctttgtctccaaagaagat

SEQ ID NO: 3637586 - DNA, 13 bp, Homo sapiens
agctttgttctgg

SEQ ID NO: 3637587 - DNA, 20 bp, Homo sapiens
agctttgtttagtctttata

SEQ ID NO: 3637588 - DNA, 12 bp, Homo sapiens
agcttttggaag

SEQ ID NO: 3637589 - DNA, 16 bp, Homo sapiens
agctttttattccctg

SEQ ID NO: 3637590 - DNA, 17 bp, Homo sapiens
agcttttttattttaat

SEQ ID NO: 3637591 - DNA, 18 bp, Homo sapiens
agcttttttattttaata

SEQ ID NO: 3637592 - DNA, 20 bp, Homo sapiens
aggaaaaacaaaacaaagaa

SEQ ID NO: 3637593 - DNA, 19 bp, Homo sapiens
aggaaaaccaagccgtggc

SEQ ID NO: 3637594 - DNA, 14 bp, Homo sapiens
aggaaaagaaacct

SEQ ID NO: 3637595 - DNA, 12 bp, Homo sapiens
aggaaaagcaag

SEQ ID NO: 3637596 - DNA, 21 bp, Homo sapiens
aggaaaagcaagaaacagttt

SEQ ID NO: 3637597 - DNA, 18 bp, Homo sapiens
aggaaaagtcttcctaat

SEQ ID NO: 3637598 - DNA, 15 bp, Homo sapiens
aggaaacaacagctt

SEQ ID NO: 3637599 - DNA, 16 bp, Homo sapiens
aggaaagaagggggcc

SEQ ID NO: 3637600 - DNA, 19 bp, Homo sapiens
aggaaagaagggggccctg

SEQ ID NO: 3637601 - DNA, 15 bp, Homo sapiens
aggaaagccacatct

SEQ ID NO: 3637602 - DNA, 19 bp, Homo sapiens
aggaaagccacatcttgct

SEQ ID NO: 3637603 - DNA, 19 bp, Homo sapiens
aggaaaggattttaccaaa

SEQ ID NO: 3637604 - DNA, 21 bp, Homo sapiens
aggaaaggattttaccaaagc

SEQ ID NO: 3637605 - DNA, 22 bp, Homo sapiens
aggaaaggattttaccaaagca

SEQ ID NO: 3637606 - DNA, 23 bp, Homo sapiens
aggaaaggattttaccaaagcat

SEQ ID NO: 3637607 - DNA, 13 bp, Homo sapiens
aggaaagtgtgaa

SEQ ID NO: 3637608 - DNA, 21 bp, Homo sapiens
aggaaatcaaatatgcaaagc

SEQ ID NO: 3637609 - DNA, 23 bp, Homo sapiens
aggaaatcaaatatgcaaagcac

SEQ ID NO: 3637610 - DNA, 17 bp, Homo sapiens
aggaaccacaccacatc

SEQ ID NO: 3637611 - DNA, 15 bp, Homo sapiens
aggaactgagtatgt

SEQ ID NO: 3637612 - DNA, 13 bp, Homo sapiens
aggaagaaacttt

SEQ ID NO: 3637613 - DNA, 15 bp, Homo sapiens
aggaagatgtttaca

SEQ ID NO: 3637614 - DNA, 16 bp, Homo sapiens
aggaagatgtttacat

SEQ ID NO: 3637615 - DNA, 21 bp, Homo sapiens
aggaagctgtgttgaaacaga

SEQ ID NO: 3637616 - DNA, 23 bp, Homo sapiens
aggaagctgtgttgaaacagaaa

SEQ ID NO: 3637617 - DNA, 15 bp, Homo sapiens
aggaaggaacaaaga

SEQ ID NO: 3637618 - DNA, 13 bp, Homo sapiens
aggaaggacccca

SEQ ID NO: 3637619 - DNA, 18 bp, Homo sapiens
aggaaggggccccatggc

SEQ ID NO: 3637620 - DNA, 20 bp, Homo sapiens
aggaataaattgctccttga

SEQ ID NO: 3637621 - DNA, 19 bp, Homo sapiens
aggaataatgttttgggaa

SEQ ID NO: 3637622 - DNA, 18 bp, Homo sapiens
aggaatggccctcattca

SEQ ID NO: 3637623 - DNA, 16 bp, Homo sapiens
aggaatgtcagggcca

SEQ ID NO: 3637624 - DNA, 17 bp, Homo sapiens
aggaatgtcagggccag

SEQ ID NO: 3637625 - DNA, 19 bp, Homo sapiens
aggaatgtcagggccaggt

SEQ ID NO: 3637626 - DNA, 14 bp, Homo sapiens
aggaatttatacct

SEQ ID NO: 3637627 - DNA, 15 bp, Homo sapiens
aggaatttatacctc

SEQ ID NO: 3637628 - DNA, 15 bp, Homo sapiens
aggaatttcccagga

SEQ ID NO: 3637629 - DNA, 21 bp, Homo sapiens
aggaatttcccaggaccctga

SEQ ID NO: 3637630 - DNA, 14 bp, Homo sapiens
aggaattttctttg

SEQ ID NO: 3637631 - DNA, 17 bp, Homo sapiens
aggacaaataagaaatg

SEQ ID NO: 3637632 - DNA, 18 bp, Homo sapiens
aggacaaataagaaatga

SEQ ID NO: 3637633 - DNA, 14 bp, Homo sapiens
aggacaaccattcc

SEQ ID NO: 3637634 - DNA, 16 bp, Homo sapiens
aggacaggagatgctg

SEQ ID NO: 3637635 - DNA, 19 bp, Homo sapiens
aggacagttgatggagccc

SEQ ID NO: 3637636 - DNA, 22 bp, Homo sapiens
aggacagttgatggagccccag

SEQ ID NO: 3637637 - DNA, 13 bp, Homo sapiens
aggacataatggg

SEQ ID NO: 3637638 - DNA, 12 bp, Homo sapiens
aggacatcagca

SEQ ID NO: 3637639 - DNA, 16 bp, Homo sapiens
aggacatcagcaaaca

SEQ ID NO: 3637640 - DNA, 20 bp, Homo sapiens
aggacatccccccgccaaaa

SEQ ID NO: 3637641 - DNA, 16 bp, Homo sapiens
aggacatttgtgggca

SEQ ID NO: 3637642 - DNA, 13 bp, Homo sapiens
aggaccaatgctt

SEQ ID NO: 3637643 - DNA, 14 bp, Homo sapiens
aggacccatccctg

SEQ ID NO: 3637644 - DNA, 18 bp, Homo sapiens
aggacccatccctgcctg

SEQ ID NO: 3637645 - DNA, 23 bp, Homo sapiens
aggacccatccctgcctggaggc

SEQ ID NO: 3637646 - DNA, 17 bp, Homo sapiens
aggaccccagctctgcg

SEQ ID NO: 3637647 - DNA, 17 bp, Homo sapiens
aggacccggaggggcct

SEQ ID NO: 3637648 - DNA, 20 bp, Homo sapiens
aggacccggaggggcctggc

SEQ ID NO: 3637649 - DNA, 21 bp, Homo sapiens
aggaccctcaggaattcagtg

SEQ ID NO: 3637650 - DNA, 23 bp, Homo sapiens
aggacctggcgtgctcagaccca

SEQ ID NO: 3637651 - DNA, 18 bp, Homo sapiens
aggaccttcgggctgtgc

SEQ ID NO: 3637652 - DNA, 13 bp, Homo sapiens
aggacggccggct

SEQ ID NO: 3637653 - DNA, 13 bp, Homo sapiens
aggactagaagat

SEQ ID NO: 3637654 - DNA, 18 bp, Homo sapiens
aggactccatttctttct

SEQ ID NO: 3637655 - DNA, 19 bp, Homo sapiens
aggactccatttctttctt

SEQ ID NO: 3637656 - DNA, 18 bp, Homo sapiens
aggactcccagaacctct

SEQ ID NO: 3637657 - DNA, 20 bp, Homo sapiens
agtaattcaagcctctaaac

SEQ ID NO: 3637658 - DNA, 21 bp, Homo sapiens
agtaattcaagcctctaaaca

SEQ ID NO: 3637659 - DNA, 13 bp, Homo sapiens
agtaattgaaaaa

SEQ ID NO: 3637660 - DNA, 13 bp, Homo sapiens
agtacaaatgcct

SEQ ID NO: 3637661 - DNA, 14 bp, Homo sapiens
agtacaagttccaa

SEQ ID NO: 3637662 - DNA, 19 bp, Homo sapiens
agtacatatttattttctt

SEQ ID NO: 3637663 - DNA, 22 bp, Homo sapiens
agtacatgataaatgatagaca

SEQ ID NO: 3637664 - DNA, 13 bp, Homo sapiens
agtacatgcagaa

SEQ ID NO: 3637665 - DNA, 23 bp, Homo sapiens
agtactacacatttttaaattgt

SEQ ID NO: 3637666 - DNA, 13 bp, Homo sapiens
agtacttccctca

SEQ ID NO: 3637667 - DNA, 18 bp, Homo sapiens
agtagagcttgtaataaa

SEQ ID NO: 3637668 - DNA, 21 bp, Homo sapiens
agtagatgtggcctttgaatt

SEQ ID NO: 3637669 - DNA, 15 bp, Homo sapiens
agtagctctcctgac

SEQ ID NO: 3637670 - DNA, 15 bp, Homo sapiens
agtagctgcagcctt

SEQ ID NO: 3637671 - DNA, 23 bp, Homo sapiens
agtagctgcagccttcatcagaa

SEQ ID NO: 3637672 - DNA, 23 bp, Homo sapiens
agtagctgggattacagatctgc

SEQ ID NO: 3637673 - DNA, 14 bp, Homo sapiens
agtaggtattaatc

SEQ ID NO: 3637674 - DNA, 15 bp, Homo sapiens
agtaggtcccggcca

SEQ ID NO: 3637675 - DNA, 16 bp, Homo sapiens
agtaggtcccggccag

SEQ ID NO: 3637676 - DNA, 21 bp, Homo sapiens
agtaggtcccggccagctctg

SEQ ID NO: 3637677 - DNA, 12 bp, Homo sapiens
agtagtgtggcc

SEQ ID NO: 3637678 - DNA, 15 bp, Homo sapiens
agtagttctcaaagt

SEQ ID NO: 3637679 - DNA, 13 bp, Homo sapiens
agtataaaatagt

SEQ ID NO: 3637680 - DNA, 13 bp, Homo sapiens
agtataacagttt

SEQ ID NO: 3637681 - DNA, 16 bp, Homo sapiens
agtataagaaatgcat

SEQ ID NO: 3637682 - DNA, 18 bp, Homo sapiens
agtataagaaatgcatat

SEQ ID NO: 3637683 - DNA, 14 bp, Homo sapiens
agtatataagcttt

SEQ ID NO: 3637684 - DNA, 15 bp, Homo sapiens
agtatataagctttt

SEQ ID NO: 3637685 - DNA, 17 bp, Homo sapiens
agtatataagctttttt

SEQ ID NO: 3637686 - DNA, 17 bp, Homo sapiens
agtatatcatgtaaaga

SEQ ID NO: 3637687 - DNA, 13 bp, Homo sapiens
agtatatttaatt

SEQ ID NO: 3637688 - DNA, 16 bp, Homo sapiens
agtatcctccaggttt

SEQ ID NO: 3637689 - DNA, 12 bp, Homo sapiens
agtatctgtata

SEQ ID NO: 3637690 - DNA, 20 bp, Homo sapiens
agtatctgtatataagttgc

SEQ ID NO: 3637691 - DNA, 18 bp, Homo sapiens
agtatgtatattaaaaaa

SEQ ID NO: 3637692 - DNA, 22 bp, Homo sapiens
agtatgtcagtccaataaatta

SEQ ID NO: 3637693 - DNA, 14 bp, Homo sapiens
agtatgtgaagata

SEQ ID NO: 3637694 - DNA, 15 bp, Homo sapiens
agtatgtggaagtgt

SEQ ID NO: 3637695 - DNA, 14 bp, Homo sapiens
agtatgttttactt

SEQ ID NO: 3637696 - DNA, 14 bp, Homo sapiens
agtattaacactaa

SEQ ID NO: 3637697 - DNA, 13 bp, Homo sapiens
agtattaagcagt

SEQ ID NO: 3637698 - DNA, 16 bp, Homo sapiens
agtattaagcagttca

SEQ ID NO: 3637699 - DNA, 18 bp, Homo sapiens
agtattgaaaacttcaaa

SEQ ID NO: 3637700 - DNA, 17 bp, Homo sapiens
agtatttaacttctgag

SEQ ID NO: 3637701 - DNA, 18 bp, Homo sapiens
agtatttcagtgttttca

SEQ ID NO: 3637702 - DNA, 12 bp, Homo sapiens
agtattttaatc

SEQ ID NO: 3637703 - DNA, 16 bp, Homo sapiens
agtattttaatcctgt

SEQ ID NO: 3637704 - DNA, 21 bp, Homo sapiens
agtattttcctgttgtcaaga

SEQ ID NO: 3637705 - DNA, 23 bp, Homo sapiens
agtcaaaaggaacaaaaattaca

SEQ ID NO: 3637706 - DNA, 17 bp, Homo sapiens
agtcaaagtgttgctgt

SEQ ID NO: 3637707 - DNA, 13 bp, Homo sapiens
agtcaagctcctc

SEQ ID NO: 3637708 - DNA, 15 bp, Homo sapiens
agtcaagctcctcct

SEQ ID NO: 3637709 - DNA, 16 bp, Homo sapiens
agtcaatccaagacta

SEQ ID NO: 3637710 - DNA, 19 bp, Homo sapiens
agtcaatgtacttgtttga

SEQ ID NO: 3637711 - DNA, 21 bp, Homo sapiens
agtcacccctttctgtcccac

SEQ ID NO: 3637712 - DNA, 20 bp, Homo sapiens
agtcaccctacctgtgcctg

SEQ ID NO: 3637713 - DNA, 16 bp, Homo sapiens
agtcacctgctccaga

SEQ ID NO: 3637714 - DNA, 21 bp, Homo sapiens
agtcacctgctccagaagatg

SEQ ID NO: 3637715 - DNA, 18 bp, Homo sapiens
agtcagacgccaggcacc

SEQ ID NO: 3637716 - DNA, 19 bp, Homo sapiens
agtcagacgccaggcacca

SEQ ID NO: 3637717 - DNA, 12 bp, Homo sapiens
agtcagactgat

SEQ ID NO: 3637718 - DNA, 22 bp, Homo sapiens
agtcagactgatagacaccata

SEQ ID NO: 3637719 - DNA, 23 bp, Homo sapiens
agtcagatggaaaattcattttt

SEQ ID NO: 3637720 - DNA, 15 bp, Homo sapiens
agtcaggctagctgt

SEQ ID NO: 3637721 - DNA, 19 bp, Homo sapiens
agtcaggctagctgtgctg

SEQ ID NO: 3637722 - DNA, 20 bp, Homo sapiens
agtcaggctagctgtgctgg

SEQ ID NO: 3637723 - DNA, 19 bp, Homo sapiens
agtcatcttgctaccagta

SEQ ID NO: 3637724 - DNA, 13 bp, Homo sapiens
agtcattatgtag

SEQ ID NO: 3637725 - DNA, 20 bp, Homo sapiens
agtcattatgtagctgtcgt

SEQ ID NO: 3637726 - DNA, 13 bp, Homo sapiens
agtcattctttaa

SEQ ID NO: 3637727 - DNA, 17 bp, Homo sapiens
agtcattgccatgggag

SEQ ID NO: 3637728 - DNA, 15 bp, Homo sapiens
agtcattgtttccca

SEQ ID NO: 3637729 - DNA, 15 bp, Homo sapiens
agtcatttgttaata

SEQ ID NO: 3637730 - DNA, 16 bp, Homo sapiens
agtcatttgtttaaac

SEQ ID NO: 3637731 - DNA, 15 bp, Homo sapiens
agtccaataaattat

SEQ ID NO: 3637732 - DNA, 17 bp, Homo sapiens
agtccacaggggccacc

SEQ ID NO: 3637733 - DNA, 20 bp, Homo sapiens
agtccacaggggccaccacc

SEQ ID NO: 3637734 - DNA, 14 bp, Homo sapiens
agtccactcccagt

SEQ ID NO: 3637735 - DNA, 18 bp, Homo sapiens
agtccagctctttagaat

SEQ ID NO: 3637736 - DNA, 22 bp, Homo sapiens
agtccaggatgctaacatctaa

SEQ ID NO: 3637737 - DNA, 21 bp, Homo sapiens
agtcccacactgtggccaggc

SEQ ID NO: 3637738 - DNA, 23 bp, Homo sapiens
agtcccttaatcttatggggccg

SEQ ID NO: 3637739 - DNA, 22 bp, Homo sapiens
agtccgcagttgtagcagaaac

SEQ ID NO: 3637740 - DNA, 22 bp, Homo sapiens
agtccgtgctgacagctgctcc

SEQ ID NO: 3637741 - DNA, 19 bp, Homo sapiens
agtcctcaggaagggggcc

SEQ ID NO: 3637742 - DNA, 14 bp, Homo sapiens
agtcctctgaatga

SEQ ID NO: 3637743 - DNA, 11 bp, Homo sapiens
agtcctggagg

SEQ ID NO: 3637744 - DNA, 18 bp, Homo sapiens
agtcctggaggcaggggg

SEQ ID NO: 3637745 - DNA, 19 bp, Homo sapiens
agtccttaggctactgtaa

SEQ ID NO: 3637746 - DNA, 19 bp, Homo sapiens
agtccttcagtgagcccct

SEQ ID NO: 3637747 - DNA, 12 bp, Homo sapiens
agtcctttgtct

SEQ ID NO: 3637748 - DNA, 14 bp, Homo sapiens
agtcctttgtcttt

SEQ ID NO: 3637749 - DNA, 18 bp, Homo sapiens
agtcctttgtctttcttt

SEQ ID NO: 3637750 - DNA, 22 bp, Homo sapiens
agtcctttgtctttctttgtca

SEQ ID NO: 3637751 - DNA, 23 bp, Homo sapiens
agtcctttgtctttctttgtcat

SEQ ID NO: 3637752 - DNA, 21 bp, Homo sapiens
agtcgcctgcctgcagcaggc

SEQ ID NO: 3637753 - DNA, 18 bp, Homo sapiens
agtctagatggctcctct

SEQ ID NO: 3637754 - DNA, 20 bp, Homo sapiens
agtctagatggctcctctca

SEQ ID NO: 3637755 - DNA, 14 bp, Homo sapiens
agtctccttcagca

SEQ ID NO: 3637756 - DNA, 14 bp, Homo sapiens
agtctctcttctct

SEQ ID NO: 3637757 - DNA, 23 bp, Homo sapiens
agtctctcttctctccagctgac

SEQ ID NO: 3637758 - DNA, 21 bp, Homo sapiens
agtctctgattagttgacagt

SEQ ID NO: 3637759 - DNA, 23 bp, Homo sapiens
agtctctgattagttgacagtat

SEQ ID NO: 3637760 - DNA, 20 bp, Homo sapiens
agtctctgccagttacttgg

SEQ ID NO: 3637761 - DNA, 16 bp, Homo sapiens
agtctgagatgccccg

SEQ ID NO: 3637762 - DNA, 17 bp, Homo sapiens
agtctgagcccatttct

SEQ ID NO: 3637763 - DNA, 18 bp, Homo sapiens
agtctgagcccatttctg

SEQ ID NO: 3637764 - DNA, 14 bp, Homo sapiens
agtctgctcctctt

SEQ ID NO: 3637765 - DNA, 17 bp, Homo sapiens
agtctggctgagccctg

SEQ ID NO: 3637766 - DNA, 14 bp, Homo sapiens
agtcttctatttat

SEQ ID NO: 3637767 - DNA, 23 bp, Homo sapiens
agtcttctcctccatgaacatca

SEQ ID NO: 3637768 - DNA, 15 bp, Homo sapiens
agtcttggctcactg

SEQ ID NO: 3637769 - DNA, 21 bp, Homo sapiens
agtcttggtaaaacattactt

SEQ ID NO: 3637770 - DNA, 14 bp, Homo sapiens
agtctttcttcact

SEQ ID NO: 3637771 - DNA, 23 bp, Homo sapiens
agtctttcttcactctggcttca

SEQ ID NO: 3637772 - DNA, 16 bp, Homo sapiens
agtgaaagaggcagct

SEQ ID NO: 3637773 - DNA, 22 bp, Homo sapiens
agtgaaagaggcagcttgaaac

SEQ ID NO: 3637774 - DNA, 12 bp, Homo sapiens
agtgaaataaca

SEQ ID NO: 3637775 - DNA, 18 bp, Homo sapiens
agtgaactaccatgcttt

SEQ ID NO: 3637776 - DNA, 23 bp, Homo sapiens
agtgaactaccatgctttgttta

SEQ ID NO: 3637777 - DNA, 21 bp, Homo sapiens
agtgaactatttttaaggtct

SEQ ID NO: 3637778 - DNA, 22 bp, Homo sapiens
agtgaagtccttcagtgagccc

SEQ ID NO: 3637779 - DNA, 17 bp, Homo sapiens
agtgaataaatgtcttg

SEQ ID NO: 3637780 - DNA, 18 bp, Homo sapiens
agtgaatatttttgtatt

SEQ ID NO: 3637781 - DNA, 16 bp, Homo sapiens
agtgacagaggagaaa

SEQ ID NO: 3637782 - DNA, 16 bp, Homo sapiens
agtgacagatcacagg

SEQ ID NO: 3637783 - DNA, 16 bp, Homo sapiens
agtgaccagtgcctgt

SEQ ID NO: 3637784 - DNA, 16 bp, Homo sapiens
agtgacctcactggcc

SEQ ID NO: 3637785 - DNA, 17 bp, Homo sapiens
agtgacctcactggcct

SEQ ID NO: 3637786 - DNA, 21 bp, Homo sapiens
agtgacctcactggcctgcca

SEQ ID NO: 3637787 - DNA, 22 bp, Homo sapiens
agtgacctcactggcctgccat

SEQ ID NO: 3637788 - DNA, 16 bp, Homo sapiens
agtgactccccagccc

SEQ ID NO: 3637789 - DNA, 16 bp, Homo sapiens
atagttggtcatctag

SEQ ID NO: 3637790 - DNA, 18 bp, Homo sapiens
atataaaataaaaagtca

SEQ ID NO: 3637791 - DNA, 15 bp, Homo sapiens
atataaaatgtattc

SEQ ID NO: 3637792 - DNA, 17 bp, Homo sapiens
atataaaatgtattcaa

SEQ ID NO: 3637793 - DNA, 21 bp, Homo sapiens
atataaatgtttatattgttt

SEQ ID NO: 3637794 - DNA, 15 bp, Homo sapiens
atataaattattact

SEQ ID NO: 3637795 - DNA, 22 bp, Homo sapiens
atataacacttaggactagaag

SEQ ID NO: 3637796 - DNA, 17 bp, Homo sapiens
atataactgagttatat

SEQ ID NO: 3637797 - DNA, 13 bp, Homo sapiens
atataagcttttt

SEQ ID NO: 3637798 - DNA, 16 bp, Homo sapiens
atataataatgatgat

SEQ ID NO: 3637799 - DNA, 19 bp, Homo sapiens
atataattttcacttctgt

SEQ ID NO: 3637800 - DNA, 13 bp, Homo sapiens
atatacagaggaa

SEQ ID NO: 3637801 - DNA, 14 bp, Homo sapiens
atatacagaggaaa

SEQ ID NO: 3637802 - DNA, 21 bp, Homo sapiens
atatataagactattccaact

SEQ ID NO: 3637803 - DNA, 20 bp, Homo sapiens
atatataggctattttctaa

SEQ ID NO: 3637804 - DNA, 13 bp, Homo sapiens
atatattataagt

SEQ ID NO: 3637805 - DNA, 17 bp, Homo sapiens
atatattcttataaaaa

SEQ ID NO: 3637806 - DNA, 13 bp, Homo sapiens
atatattgaatta

SEQ ID NO: 3637807 - DNA, 13 bp, Homo sapiens
atatatttaagcc

SEQ ID NO: 3637808 - DNA, 14 bp, Homo sapiens
atatatttaagcct

SEQ ID NO: 3637809 - DNA, 15 bp, Homo sapiens
atatatttgtcactt

SEQ ID NO: 3637810 - DNA, 11 bp, Homo sapiens
atatattttag

SEQ ID NO: 3637811 - DNA, 22 bp, Homo sapiens
atatattttatttttagaattt

SEQ ID NO: 3637812 - DNA, 22 bp, Homo sapiens
atatattttgtactttgtggag

SEQ ID NO: 3637813 - DNA, 22 bp, Homo sapiens
atatcaaagagaagatgcctgt

SEQ ID NO: 3637814 - DNA, 21 bp, Homo sapiens
atatcaatcaagccatgtata

SEQ ID NO: 3637815 - DNA, 18 bp, Homo sapiens
atatcaggtgtataaatg

SEQ ID NO: 3637816 - DNA, 19 bp, Homo sapiens
atatcaggtgtataaatgt

SEQ ID NO: 3637817 - DNA, 16 bp, Homo sapiens
atatcatgaatgtgag

SEQ ID NO: 3637818 - DNA, 22 bp, Homo sapiens
atatcatgaatgtgagtcatta

SEQ ID NO: 3637819 - DNA, 14 bp, Homo sapiens
atatccacccagca

SEQ ID NO: 3637820 - DNA, 20 bp, Homo sapiens
atatcccttggacattttat

SEQ ID NO: 3637821 - DNA, 21 bp, Homo sapiens
atatcccttggacattttatg

SEQ ID NO: 3637822 - DNA, 22 bp, Homo sapiens
atatcccttggacattttatgt

SEQ ID NO: 3637823 - DNA, 21 bp, Homo sapiens
atatccttaaccattctgtcc

SEQ ID NO: 3637824 - DNA, 17 bp, Homo sapiens
atatctatgttttacca

SEQ ID NO: 3637825 - DNA, 19 bp, Homo sapiens
atatctcccccactccact

SEQ ID NO: 3637826 - DNA, 20 bp, Homo sapiens
atatctcccccactccacta

SEQ ID NO: 3637827 - DNA, 13 bp, Homo sapiens
atatcttctacat

SEQ ID NO: 3637828 - DNA, 13 bp, Homo sapiens
atatgatatgcat

SEQ ID NO: 3637829 - DNA, 15 bp, Homo sapiens
atatgatatgcatgt

SEQ ID NO: 3637830 - DNA, 16 bp, Homo sapiens
atatgatatgcatgta

SEQ ID NO: 3637831 - DNA, 15 bp, Homo sapiens
atatgattggcaata

SEQ ID NO: 3637832 - DNA, 13 bp, Homo sapiens
atatgcaagcagc

SEQ ID NO: 3637833 - DNA, 17 bp, Homo sapiens
atatgcagccatatatg

SEQ ID NO: 3637834 - DNA, 18 bp, Homo sapiens
atatgccctcaagtaaaa

SEQ ID NO: 3637835 - DNA, 22 bp, Homo sapiens
atatgccctcaagtaaaagaaa

SEQ ID NO: 3637836 - DNA, 21 bp, Homo sapiens
atatgcttatacacttacact

SEQ ID NO: 3637837 - DNA, 23 bp, Homo sapiens
atatggagtgagtcacctgctcc

SEQ ID NO: 3637838 - DNA, 16 bp, Homo sapiens
atatggataatctgag

SEQ ID NO: 3637839 - DNA, 19 bp, Homo sapiens
atatggataatctgagcag

SEQ ID NO: 3637840 - DNA, 12 bp, Homo sapiens
atatggctgccc

SEQ ID NO: 3637841 - DNA, 14 bp, Homo sapiens
atatggctgcccag

SEQ ID NO: 3637842 - DNA, 20 bp, Homo sapiens
atatgtaaacataagtgtac

SEQ ID NO: 3637843 - DNA, 12 bp, Homo sapiens
atatgtacagtt

SEQ ID NO: 3637844 - DNA, 19 bp, Homo sapiens
atatgtacagtttattgat

SEQ ID NO: 3637845 - DNA, 16 bp, Homo sapiens
atatgtataactttaa

SEQ ID NO: 3637846 - DNA, 22 bp, Homo sapiens
atatgtatttaagatgtacatt

SEQ ID NO: 3637847 - DNA, 15 bp, Homo sapiens
atatgtcactagaat

SEQ ID NO: 3637848 - DNA, 11 bp, Homo sapiens
atatgttaaag

SEQ ID NO: 3637849 - DNA, 22 bp, Homo sapiens
atatgttgtgtttggttcaatt

SEQ ID NO: 3637850 - DNA, 13 bp, Homo sapiens
atatgttgttctt

SEQ ID NO: 3637851 - DNA, 12 bp, Homo sapiens
atattaaaattg

SEQ ID NO: 3637852 - DNA, 14 bp, Homo sapiens
atattaaattctca

SEQ ID NO: 3637853 - DNA, 21 bp, Homo sapiens
atattaaattctcaaagtttt

SEQ ID NO: 3637854 - DNA, 14 bp, Homo sapiens
atattaattttcca

SEQ ID NO: 3637855 - DNA, 16 bp, Homo sapiens
atattacaatgatcac

SEQ ID NO: 3637856 - DNA, 23 bp, Homo sapiens
atattacagataaaatgtaaact

SEQ ID NO: 3637857 - DNA, 19 bp, Homo sapiens
atattataaaggataaaga

SEQ ID NO: 3637858 - DNA, 15 bp, Homo sapiens
atattataagttgac

SEQ ID NO: 3637859 - DNA, 16 bp, Homo sapiens
atattataagttgacc

SEQ ID NO: 3637860 - DNA, 20 bp, Homo sapiens
atattataagttgaccttta

SEQ ID NO: 3637861 - DNA, 14 bp, Homo sapiens
atattataattgga

SEQ ID NO: 3637862 - DNA, 23 bp, Homo sapiens
atattattgtctgttttccttct

SEQ ID NO: 3637863 - DNA, 13 bp, Homo sapiens
atattatttgtct

SEQ ID NO: 3637864 - DNA, 17 bp, Homo sapiens
atattatttgtcttaaa

SEQ ID NO: 3637865 - DNA, 12 bp, Homo sapiens
atattcctccag

SEQ ID NO: 3637866 - DNA, 13 bp, Homo sapiens
atattcctccagc

SEQ ID NO: 3637867 - DNA, 16 bp, Homo sapiens
atattcctccagctgg

SEQ ID NO: 3637868 - DNA, 19 bp, Homo sapiens
atattctctagtcatttgt

SEQ ID NO: 3637869 - DNA, 22 bp, Homo sapiens
atattctttagcttacctgggc

SEQ ID NO: 3637870 - DNA, 21 bp, Homo sapiens
atattgaggagcactgaaagt

SEQ ID NO: 3637871 - DNA, 20 bp, Homo sapiens
atattgccctaattaaaaac

SEQ ID NO: 3637872 - DNA, 23 bp, Homo sapiens
atattgccctaattaaaaactgt

SEQ ID NO: 3637873 - DNA, 16 bp, Homo sapiens
atattgttataaataa

SEQ ID NO: 3637874 - DNA, 16 bp, Homo sapiens
atattgtttttatata

SEQ ID NO: 3637875 - DNA, 17 bp, Homo sapiens
atattgtttttatatat

SEQ ID NO: 3637876 - DNA, 19 bp, Homo sapiens
atattgtttttatatatta

SEQ ID NO: 3637877 - DNA, 16 bp, Homo sapiens
atattgtttttgtatt

SEQ ID NO: 3637878 - DNA, 14 bp, Homo sapiens
atatttaagcctta

SEQ ID NO: 3637879 - DNA, 19 bp, Homo sapiens
atatttacttcttatacat

SEQ ID NO: 3637880 - DNA, 11 bp, Homo sapiens
atatttattgt

SEQ ID NO: 3637881 - DNA, 13 bp, Homo sapiens
atatttattgtta

SEQ ID NO: 3637882 - DNA, 17 bp, Homo sapiens
atatttcaaacattttg

SEQ ID NO: 3637883 - DNA, 11 bp, Homo sapiens
atatttcaatc

SEQ ID NO: 3637884 - DNA, 15 bp, Homo sapiens
atatttcaatctttt

SEQ ID NO: 3637885 - DNA, 11 bp, Homo sapiens
atatttcatca

SEQ ID NO: 3637886 - DNA, 17 bp, Homo sapiens
atatttctcatttagca

SEQ ID NO: 3637887 - DNA, 23 bp, Homo sapiens
atatttctgaggagcctgcaaca

SEQ ID NO: 3637888 - DNA, 23 bp, Homo sapiens
atatttctgtaattatatctaaa

SEQ ID NO: 3637889 - DNA, 19 bp, Homo sapiens
atatttcttgctgcttcta

SEQ ID NO: 3637890 - DNA, 17 bp, Homo sapiens
atatttgcaaagtgtat

SEQ ID NO: 3637891 - DNA, 15 bp, Homo sapiens
atatttgccaataaa

SEQ ID NO: 3637892 - DNA, 18 bp, Homo sapiens
atatttgccaataaagct

SEQ ID NO: 3637893 - DNA, 18 bp, Homo sapiens
atatttgcctgtctgttt

SEQ ID NO: 3637894 - DNA, 20 bp, Homo sapiens
atatttgtaaatttatgtga

SEQ ID NO: 3637895 - DNA, 15 bp, Homo sapiens
atatttgttttaata

SEQ ID NO: 3637896 - DNA, 12 bp, Homo sapiens
atattttaactt

SEQ ID NO: 3637897 - DNA, 17 bp, Homo sapiens
atattttattgtatttt

SEQ ID NO: 3637898 - DNA, 20 bp, Homo sapiens
atattttcaacgcagccctg

SEQ ID NO: 3637899 - DNA, 19 bp, Homo sapiens
atattttcacactggtaaa

SEQ ID NO: 3637900 - DNA, 16 bp, Homo sapiens
atattttgctaactgg

SEQ ID NO: 3637901 - DNA, 21 bp, Homo sapiens
atattttgttgctttcttacc

SEQ ID NO: 3637902 - DNA, 11 bp, Homo sapiens
atatttttaaa

SEQ ID NO: 3637903 - DNA, 20 bp, Homo sapiens
atatttttaaagaatgttag

SEQ ID NO: 3637904 - DNA, 17 bp, Homo sapiens
atatttttataataaac

SEQ ID NO: 3637905 - DNA, 16 bp, Homo sapiens
atattttttatttcta

SEQ ID NO: 3637906 - DNA, 16 bp, Homo sapiens
atcaaaacaagtgaaa

SEQ ID NO: 3637907 - DNA, 19 bp, Homo sapiens
atcaaaactcacaagtgct

SEQ ID NO: 3637908 - DNA, 14 bp, Homo sapiens
atcaaagccacact

SEQ ID NO: 3637909 - DNA, 16 bp, Homo sapiens
atcaaagccacactct

SEQ ID NO: 3637910 - DNA, 14 bp, Homo sapiens
atcaaatacattta

SEQ ID NO: 3637911 - DNA, 17 bp, Homo sapiens
atcaaatatattattta

SEQ ID NO: 3637912 - DNA, 14 bp, Homo sapiens
atcaaatatgcaaa

SEQ ID NO: 3637913 - DNA, 15 bp, Homo sapiens
atcaaatatgcaaag

SEQ ID NO: 3637914 - DNA, 13 bp, Homo sapiens
atcaaatgtaaag

SEQ ID NO: 3637915 - DNA, 16 bp, Homo sapiens
atcaaattctgtctgg

SEQ ID NO: 3637916 - DNA, 19 bp, Homo sapiens
atcaaattctgtctgggga

SEQ ID NO: 3637917 - DNA, 14 bp, Homo sapiens
atcaactcccaact

SEQ ID NO: 3637918 - DNA, 20 bp, Homo sapiens
atcaactcccaacttcttcc

SEQ ID NO: 3637919 - DNA, 12 bp, Homo sapiens
atcaacttaaca

SEQ ID NO: 3637920 - DNA, 14 bp, Homo sapiens
atcaagagaaactt

SEQ ID NO: 3637921 - DNA, 13 bp, Homo sapiens
atcaagatttttt

SEQ ID NO: 3637922 - DNA, 23 bp, Homo sapiens
atggctataggtgctacaaaaac

SEQ ID NO: 3637923 - DNA, 15 bp, Homo sapiens
atggctatgaacaga

SEQ ID NO: 3637924 - DNA, 14 bp, Homo sapiens
atggctcatcagat

SEQ ID NO: 3637925 - DNA, 16 bp, Homo sapiens
atggctgcccaggaga

SEQ ID NO: 3637926 - DNA, 14 bp, Homo sapiens
atggcttttcctgg

SEQ ID NO: 3637927 - DNA, 17 bp, Homo sapiens
atgggagacccttgaca

SEQ ID NO: 3637928 - DNA, 12 bp, Homo sapiens
atgggagccggg

SEQ ID NO: 3637929 - DNA, 20 bp, Homo sapiens
atgggagctggttagaaatg

SEQ ID NO: 3637930 - DNA, 21 bp, Homo sapiens
atgggagctggttagaaatgc

SEQ ID NO: 3637931 - DNA, 22 bp, Homo sapiens
atgggagctggttagaaatgca

SEQ ID NO: 3637932 - DNA, 15 bp, Homo sapiens
atgggaggctggagt

SEQ ID NO: 3637933 - DNA, 15 bp, Homo sapiens
atgggcaaagcttgt

SEQ ID NO: 3637934 - DNA, 14 bp, Homo sapiens
atgggcatttctaa

SEQ ID NO: 3637935 - DNA, 16 bp, Homo sapiens
atgggcatttctaaaa

SEQ ID NO: 3637936 - DNA, 23 bp, Homo sapiens
atgggcatttctaaaatgttaaa

SEQ ID NO: 3637937 - DNA, 20 bp, Homo sapiens
atgggcctttaagaacctta

SEQ ID NO: 3637938 - DNA, 21 bp, Homo sapiens
atgggcctttaagaaccttaa

SEQ ID NO: 3637939 - DNA, 15 bp, Homo sapiens
atggggccagatcca

SEQ ID NO: 3637940 - DNA, 15 bp, Homo sapiens
atgggggatttcaaa

SEQ ID NO: 3637941 - DNA, 13 bp, Homo sapiens
atgggtacagagg

SEQ ID NO: 3637942 - DNA, 19 bp, Homo sapiens
atgggtcttagctctttct

SEQ ID NO: 3637943 - DNA, 21 bp, Homo sapiens
atggtagttttacagtgtttc

SEQ ID NO: 3637944 - DNA, 22 bp, Homo sapiens
atggtagttttacagtgtttct

SEQ ID NO: 3637945 - DNA, 16 bp, Homo sapiens
atggtcggatctcaca

SEQ ID NO: 3637946 - DNA, 18 bp, Homo sapiens
atggtgagtgatttttat

SEQ ID NO: 3637947 - DNA, 18 bp, Homo sapiens
atggtgccccaggaccag

SEQ ID NO: 3637948 - DNA, 13 bp, Homo sapiens
atggttaaatttt

SEQ ID NO: 3637949 - DNA, 12 bp, Homo sapiens
atggttcaagta

SEQ ID NO: 3637950 - DNA, 16 bp, Homo sapiens
atggttctcaggcctg

SEQ ID NO: 3637951 - DNA, 13 bp, Homo sapiens
atggttgatggaa

SEQ ID NO: 3637952 - DNA, 15 bp, Homo sapiens
atggttgatggaaaa

SEQ ID NO: 3637953 - DNA, 22 bp, Homo sapiens
atggtttaggccttgccagttt

SEQ ID NO: 3637954 - DNA, 19 bp, Homo sapiens
atggtttattctttgcaaa

SEQ ID NO: 3637955 - DNA, 18 bp, Homo sapiens
atgtaaaaatgaaggaat

SEQ ID NO: 3637956 - DNA, 12 bp, Homo sapiens
atgtaaaatgat

SEQ ID NO: 3637957 - DNA, 17 bp, Homo sapiens
atgtaaagaaatgtctt

SEQ ID NO: 3637958 - DNA, 19 bp, Homo sapiens
atgtaaatactttccatgt

SEQ ID NO: 3637959 - DNA, 16 bp, Homo sapiens
atgtaacttttgtaag

SEQ ID NO: 3637960 - DNA, 19 bp, Homo sapiens
atgtaagggaaactgccag

SEQ ID NO: 3637961 - DNA, 22 bp, Homo sapiens
atgtaagggaaactgccagcaa

SEQ ID NO: 3637962 - DNA, 19 bp, Homo sapiens
atgtaataaaaagcctctt

SEQ ID NO: 3637963 - DNA, 16 bp, Homo sapiens
atgtaattttgtgtaa

SEQ ID NO: 3637964 - DNA, 23 bp, Homo sapiens
atgtaattttgtgtaagaaatac

SEQ ID NO: 3637965 - DNA, 14 bp, Homo sapiens
atgtacatttaata

SEQ ID NO: 3637966 - DNA, 15 bp, Homo sapiens
atgtacatttaataa

SEQ ID NO: 3637967 - DNA, 18 bp, Homo sapiens
atgtacttaagagtggca

SEQ ID NO: 3637968 - DNA, 19 bp, Homo sapiens
atgtacttaagagtggcat

SEQ ID NO: 3637969 - DNA, 17 bp, Homo sapiens
atgtagaaactgaggcc

SEQ ID NO: 3637970 - DNA, 20 bp, Homo sapiens
atgtagaaactgaggcccag

SEQ ID NO: 3637971 - DNA, 22 bp, Homo sapiens
atgtagaaactgaggcccagag

SEQ ID NO: 3637972 - DNA, 16 bp, Homo sapiens
atgtagatgatatgtt

SEQ ID NO: 3637973 - DNA, 14 bp, Homo sapiens
atgtagcatataaa

SEQ ID NO: 3637974 - DNA, 16 bp, Homo sapiens
atgtagtatggtatat

SEQ ID NO: 3637975 - DNA, 18 bp, Homo sapiens
atgtagtatggtatatgc

SEQ ID NO: 3637976 - DNA, 22 bp, Homo sapiens
atgtagtattttttgtataatt

SEQ ID NO: 3637977 - DNA, 23 bp, Homo sapiens
atgtagtattttttgtataattg

SEQ ID NO: 3637978 - DNA, 20 bp, Homo sapiens
atgtataactttaacttctg

SEQ ID NO: 3637979 - DNA, 17 bp, Homo sapiens
atgtatataaacatgct

SEQ ID NO: 3637980 - DNA, 20 bp, Homo sapiens
atgtatatccatataacaat

SEQ ID NO: 3637981 - DNA, 20 bp, Homo sapiens
atgtatatcttctacatgca

SEQ ID NO: 3637982 - DNA, 22 bp, Homo sapiens
atgtatatttttaaagaatgtt

SEQ ID NO: 3637983 - DNA, 21 bp, Homo sapiens
atgtatcagtgtcctttccag

SEQ ID NO: 3637984 - DNA, 15 bp, Homo sapiens
atgtatctgagcagg

SEQ ID NO: 3637985 - DNA, 13 bp, Homo sapiens
atgtatggtatct

SEQ ID NO: 3637986 - DNA, 13 bp, Homo sapiens
atgtattcaagca

SEQ ID NO: 3637987 - DNA, 13 bp, Homo sapiens
atgtattcctatg

SEQ ID NO: 3637988 - DNA, 16 bp, Homo sapiens
atgtattgcacattgt

SEQ ID NO: 3637989 - DNA, 23 bp, Homo sapiens
atgtatttaagatgtacatttaa

SEQ ID NO: 3637990 - DNA, 16 bp, Homo sapiens
atgtattttccaagta

SEQ ID NO: 3637991 - DNA, 19 bp, Homo sapiens
atgtcaaatatttagatgt

SEQ ID NO: 3637992 - DNA, 23 bp, Homo sapiens
atgtcaaatatttagatgtaatt

SEQ ID NO: 3637993 - DNA, 20 bp, Homo sapiens
atgtcactttttgaggcaaa

SEQ ID NO: 3637994 - DNA, 13 bp, Homo sapiens
atgtcagccactg

SEQ ID NO: 3637995 - DNA, 16 bp, Homo sapiens
atgtcagggccaggtg

SEQ ID NO: 3637996 - DNA, 16 bp, Homo sapiens
atgtcagtatgtggaa

SEQ ID NO: 3637997 - DNA, 17 bp, Homo sapiens
atgtcatggatcgtgtt

SEQ ID NO: 3637998 - DNA, 19 bp, Homo sapiens
atgtccacttaaaatacat

SEQ ID NO: 3637999 - DNA, 11 bp, Homo sapiens
atgtccagtga

SEQ ID NO: 3638000 - DNA, 20 bp, Homo sapiens
atgtcccaacttgtaaaaat

SEQ ID NO: 3638001 - DNA, 15 bp, Homo sapiens
atgtcctgcctttta

SEQ ID NO: 3638002 - DNA, 15 bp, Homo sapiens
atgtcgcctctgcat

SEQ ID NO: 3638003 - DNA, 18 bp, Homo sapiens
atgtctcttctaacatct

SEQ ID NO: 3638004 - DNA, 13 bp, Homo sapiens
atgtctgcactga

SEQ ID NO: 3638005 - DNA, 17 bp, Homo sapiens
atgtctgcactgaggat

SEQ ID NO: 3638006 - DNA, 15 bp, Homo sapiens
atgtctgcagctcaa

SEQ ID NO: 3638007 - DNA, 23 bp, Homo sapiens
atgtctgcagctcaagggctggc

SEQ ID NO: 3638008 - DNA, 21 bp, Homo sapiens
atgtctgctgagttggcctgg

SEQ ID NO: 3638009 - DNA, 18 bp, Homo sapiens
atgtctggtgtttgtcat

SEQ ID NO: 3638010 - DNA, 20 bp, Homo sapiens
atgtctggtgtttgtcatgg

SEQ ID NO: 3638011 - DNA, 23 bp, Homo sapiens
atgtctggtgtttgtcatggtga

SEQ ID NO: 3638012 - DNA, 23 bp, Homo sapiens
atgtcttaaaacctgcttttcaa

SEQ ID NO: 3638013 - DNA, 14 bp, Homo sapiens
atgtctttcttgta

SEQ ID NO: 3638014 - DNA, 15 bp, Homo sapiens
atgtctttttattaa

SEQ ID NO: 3638015 - DNA, 12 bp, Homo sapiens
atgtgaaacatt

SEQ ID NO: 3638016 - DNA, 17 bp, Homo sapiens
atgtgaaatgctttctg

SEQ ID NO: 3638017 - DNA, 15 bp, Homo sapiens
atgtgaacacatcag

SEQ ID NO: 3638018 - DNA, 22 bp, Homo sapiens
atgtgaagaggtctgattggct

SEQ ID NO: 3638019 - DNA, 18 bp, Homo sapiens
atgtgaagttcatcttgc

SEQ ID NO: 3638020 - DNA, 16 bp, Homo sapiens
atgtgacaggtaaact

SEQ ID NO: 3638021 - DNA, 14 bp, Homo sapiens
atgtgacatttctc

SEQ ID NO: 3638022 - DNA, 18 bp, Homo sapiens
atgtgacattttacatta

SEQ ID NO: 3638023 - DNA, 21 bp, Homo sapiens
atgtgatatataagtgtacat

SEQ ID NO: 3638024 - DNA, 16 bp, Homo sapiens
atgtgcacacacacgc

SEQ ID NO: 3638025 - DNA, 18 bp, Homo sapiens
atgtgcctttctttgcct

SEQ ID NO: 3638026 - DNA, 16 bp, Homo sapiens
atgtgctctgtaacat

SEQ ID NO: 3638027 - DNA, 13 bp, Homo sapiens
atgtgctgtgtga

SEQ ID NO: 3638028 - DNA, 19 bp, Homo sapiens
atgtgctgtgtgagtgagc

SEQ ID NO: 3638029 - DNA, 22 bp, Homo sapiens
atgtggcccctgaacaagaatt

SEQ ID NO: 3638030 - DNA, 18 bp, Homo sapiens
atgtgggcagtgatgtca

SEQ ID NO: 3638031 - DNA, 16 bp, Homo sapiens
atgtgggggtctgtgt

SEQ ID NO: 3638032 - DNA, 18 bp, Homo sapiens
atgtgggggtctgtgtgt

SEQ ID NO: 3638033 - DNA, 18 bp, Homo sapiens
atgtggtgacacctcccc

SEQ ID NO: 3638034 - DNA, 12 bp, Homo sapiens
atgtgtaacagg

SEQ ID NO: 3638035 - DNA, 22 bp, Homo sapiens
atgtgtaacaggatacaggtga

SEQ ID NO: 3638036 - DNA, 20 bp, Homo sapiens
atgtgtagttataaaccaat

SEQ ID NO: 3638037 - DNA, 14 bp, Homo sapiens
atgtgtataagaat

SEQ ID NO: 3638038 - DNA, 14 bp, Homo sapiens
atgtgtcccttcca

SEQ ID NO: 3638039 - DNA, 22 bp, Homo sapiens
atgtgtcccttccaagctgtgt

SEQ ID NO: 3638040 - DNA, 14 bp, Homo sapiens
atgtgtctcccaga

SEQ ID NO: 3638041 - DNA, 14 bp, Homo sapiens
atgtgtctggccct

SEQ ID NO: 3638042 - DNA, 18 bp, Homo sapiens
atgtgtgcctggccgcag

SEQ ID NO: 3638043 - DNA, 18 bp, Homo sapiens
atgtgtgtgtgttgtgtg

SEQ ID NO: 3638044 - DNA, 23 bp, Homo sapiens
atgtgtgtgtgttgtgtgtggga

SEQ ID NO: 3638045 - DNA, 17 bp, Homo sapiens
atgtgtttccttttcag

SEQ ID NO: 3638046 - DNA, 21 bp, Homo sapiens
atgtgttttcatcatttcagc

SEQ ID NO: 3638047 - DNA, 20 bp, Homo sapiens
atgttaaaacataaacacat

SEQ ID NO: 3638048 - DNA, 13 bp, Homo sapiens
atgttaatatttt

SEQ ID NO: 3638049 - DNA, 17 bp, Homo sapiens
atgttaatattttatgt

SEQ ID NO: 3638050 - DNA, 19 bp, Homo sapiens
atgttaatattttatgtgt

SEQ ID NO: 3638051 - DNA, 16 bp, Homo sapiens
atgttaattatgcagt

SEQ ID NO: 3638052 - DNA, 21 bp, Homo sapiens
atgttaattatgcagtgtttc

SEQ ID NO: 3638053 - DNA, 21 bp, Homo sapiens
atgttacgtgaagaaataaat

SEQ ID NO: 3638054 - DNA, 13 bp, Homo sapiens
atttcaatctttt

SEQ ID NO: 3638055 - DNA, 17 bp, Homo sapiens
atttcaattgtttatat

SEQ ID NO: 3638056 - DNA, 23 bp, Homo sapiens
atttcacatgagtcaaaacaaag

SEQ ID NO: 3638057 - DNA, 22 bp, Homo sapiens
atttcacctactaatgtctctt

SEQ ID NO: 3638058 - DNA, 19 bp, Homo sapiens
atttcactgtagctctaaa

SEQ ID NO: 3638059 - DNA, 12 bp, Homo sapiens
atttcagactcc

SEQ ID NO: 3638060 - DNA, 18 bp, Homo sapiens
atttcagactcccattcc

SEQ ID NO: 3638061 - DNA, 22 bp, Homo sapiens
atttcagagaggccttttggaa

SEQ ID NO: 3638062 - DNA, 22 bp, Homo sapiens
atttcaggactctctccaggag

SEQ ID NO: 3638063 - DNA, 15 bp, Homo sapiens
atttcaggattaact

SEQ ID NO: 3638064 - DNA, 22 bp, Homo sapiens
atttcaggttaaattaaaccaa

SEQ ID NO: 3638065 - DNA, 15 bp, Homo sapiens
atttcataattctga

SEQ ID NO: 3638066 - DNA, 16 bp, Homo sapiens
atttcataattctgaa

SEQ ID NO: 3638067 - DNA, 17 bp, Homo sapiens
atttcataattctgaaa

SEQ ID NO: 3638068 - DNA, 14 bp, Homo sapiens
atttcatgaaaaag

SEQ ID NO: 3638069 - DNA, 19 bp, Homo sapiens
atttcattggtcttctttt

SEQ ID NO: 3638070 - DNA, 22 bp, Homo sapiens
atttcattggtcttctttttta

SEQ ID NO: 3638071 - DNA, 12 bp, Homo sapiens
atttcatttagc

SEQ ID NO: 3638072 - DNA, 19 bp, Homo sapiens
atttccattcatggatatt

SEQ ID NO: 3638073 - DNA, 14 bp, Homo sapiens
atttccatttctga

SEQ ID NO: 3638074 - DNA, 22 bp, Homo sapiens
atttcccccttcatccatcctg

SEQ ID NO: 3638075 - DNA, 14 bp, Homo sapiens
atttcccgcacatg

SEQ ID NO: 3638076 - DNA, 13 bp, Homo sapiens
atttcctagtgga

SEQ ID NO: 3638077 - DNA, 23 bp, Homo sapiens
atttcctagtggagttttataaa

SEQ ID NO: 3638078 - DNA, 11 bp, Homo sapiens
atttcctcctt

SEQ ID NO: 3638079 - DNA, 14 bp, Homo sapiens
atttccttcaggca

SEQ ID NO: 3638080 - DNA, 19 bp, Homo sapiens
atttcgggagccttgtcag

SEQ ID NO: 3638081 - DNA, 15 bp, Homo sapiens
atttctaaaatgtta

SEQ ID NO: 3638082 - DNA, 16 bp, Homo sapiens
atttctaagtatttaa

SEQ ID NO: 3638083 - DNA, 19 bp, Homo sapiens
atttctaagtatttaaatg

SEQ ID NO: 3638084 - DNA, 20 bp, Homo sapiens
atttctaatccttttcctta

SEQ ID NO: 3638085 - DNA, 18 bp, Homo sapiens
atttctaccatttcagag

SEQ ID NO: 3638086 - DNA, 20 bp, Homo sapiens
atttctagtacctgtgactc

SEQ ID NO: 3638087 - DNA, 14 bp, Homo sapiens
atttctatacagta

SEQ ID NO: 3638088 - DNA, 20 bp, Homo sapiens
atttctcataattttgcaaa

SEQ ID NO: 3638089 - DNA, 14 bp, Homo sapiens
atttctcatcacag

SEQ ID NO: 3638090 - DNA, 16 bp, Homo sapiens
atttctccatcccctc

SEQ ID NO: 3638091 - DNA, 20 bp, Homo sapiens
atttctccatcccctccctg

SEQ ID NO: 3638092 - DNA, 18 bp, Homo sapiens
atttctccatcctgcaga

SEQ ID NO: 3638093 - DNA, 20 bp, Homo sapiens
atttctccatcctgcagata

SEQ ID NO: 3638094 - DNA, 22 bp, Homo sapiens
atttctcttgtattatctcctt

SEQ ID NO: 3638095 - DNA, 15 bp, Homo sapiens
atttctgactcttat

SEQ ID NO: 3638096 - DNA, 19 bp, Homo sapiens
atttctgatgtctccagat

SEQ ID NO: 3638097 - DNA, 17 bp, Homo sapiens
atttctgccaataaatt

SEQ ID NO: 3638098 - DNA, 21 bp, Homo sapiens
atttctgccaataaattctaa

SEQ ID NO: 3638099 - DNA, 14 bp, Homo sapiens
atttctgctctgga

SEQ ID NO: 3638100 - DNA, 15 bp, Homo sapiens
atttctgctctggaa

SEQ ID NO: 3638101 - DNA, 16 bp, Homo sapiens
atttctgtctttaaga

SEQ ID NO: 3638102 - DNA, 13 bp, Homo sapiens
atttcttcttttc

SEQ ID NO: 3638103 - DNA, 14 bp, Homo sapiens
atttcttgaagaat

SEQ ID NO: 3638104 - DNA, 20 bp, Homo sapiens
atttcttgaagaataaattc

SEQ ID NO: 3638105 - DNA, 14 bp, Homo sapiens
atttcttgcgagcc

SEQ ID NO: 3638106 - DNA, 23 bp, Homo sapiens
atttgaaaaccatattttattgt

SEQ ID NO: 3638107 - DNA, 12 bp, Homo sapiens
atttgaaaatta

SEQ ID NO: 3638108 - DNA, 18 bp, Homo sapiens
atttgaaaccaggacatt

SEQ ID NO: 3638109 - DNA, 16 bp, Homo sapiens
atttgaagatagaagg

SEQ ID NO: 3638110 - DNA, 18 bp, Homo sapiens
atttgaaggtagaatgtt

SEQ ID NO: 3638111 - DNA, 23 bp, Homo sapiens
atttgaccagaactttttcctct

SEQ ID NO: 3638112 - DNA, 14 bp, Homo sapiens
atttgaggtcagtg

SEQ ID NO: 3638113 - DNA, 17 bp, Homo sapiens
atttgaggtctagagag

SEQ ID NO: 3638114 - DNA, 23 bp, Homo sapiens
atttgagtttagggttctggtgt

SEQ ID NO: 3638115 - DNA, 16 bp, Homo sapiens
atttgatatttgcatt

SEQ ID NO: 3638116 - DNA, 19 bp, Homo sapiens
atttgatatttgcattgag

SEQ ID NO: 3638117 - DNA, 20 bp, Homo sapiens
atttgcatattttgagaaac

SEQ ID NO: 3638118 - DNA, 22 bp, Homo sapiens
atttgcatattttgagaaactg

SEQ ID NO: 3638119 - DNA, 16 bp, Homo sapiens
atttgccagaggacca

SEQ ID NO: 3638120 - DNA, 22 bp, Homo sapiens
atttgccagaggaccaatgctt

SEQ ID NO: 3638121 - DNA, 23 bp, Homo sapiens
atttgcgcctcggtatctggctt

SEQ ID NO: 3638122 - DNA, 23 bp, Homo sapiens
atttgcttgcaatctaatctgaa

SEQ ID NO: 3638123 - DNA, 18 bp, Homo sapiens
atttgcttgtactgggac

SEQ ID NO: 3638124 - DNA, 14 bp, Homo sapiens
atttgctttggaag

SEQ ID NO: 3638125 - DNA, 15 bp, Homo sapiens
atttggaaataaagt

SEQ ID NO: 3638126 - DNA, 21 bp, Homo sapiens
atttgggcctgctccagacct

SEQ ID NO: 3638127 - DNA, 13 bp, Homo sapiens
atttgtaaaaatg

SEQ ID NO: 3638128 - DNA, 18 bp, Homo sapiens
atttgtaaaacttctgct

SEQ ID NO: 3638129 - DNA, 21 bp, Homo sapiens
atttgtaaaacttctgctcgt

SEQ ID NO: 3638130 - DNA, 18 bp, Homo sapiens
atttgtaaatttatgtga

SEQ ID NO: 3638131 - DNA, 23 bp, Homo sapiens
atttgtactgaaaaatggtaatt

SEQ ID NO: 3638132 - DNA, 13 bp, Homo sapiens
atttgtacttgct

SEQ ID NO: 3638133 - DNA, 22 bp, Homo sapiens
atttgtagtggaaacatttata

SEQ ID NO: 3638134 - DNA, 15 bp, Homo sapiens
atttgtataaagaaa

SEQ ID NO: 3638135 - DNA, 15 bp, Homo sapiens
atttgtatcacaaat

SEQ ID NO: 3638136 - DNA, 14 bp, Homo sapiens
atttgtattactag

SEQ ID NO: 3638137 - DNA, 19 bp, Homo sapiens
atttgtcaacagatttaaa

SEQ ID NO: 3638138 - DNA, 16 bp, Homo sapiens
atttgtcttaaaaatt

SEQ ID NO: 3638139 - DNA, 20 bp, Homo sapiens
atttgtcttaaaaatttata

SEQ ID NO: 3638140 - DNA, 23 bp, Homo sapiens
atttgtgaaatgatggtgaaagt

SEQ ID NO: 3638141 - DNA, 12 bp, Homo sapiens
atttgtgagact

SEQ ID NO: 3638142 - DNA, 22 bp, Homo sapiens
atttgttaaaatacagttctgt

SEQ ID NO: 3638143 - DNA, 16 bp, Homo sapiens
atttgttaatatttct

SEQ ID NO: 3638144 - DNA, 14 bp, Homo sapiens
attttaaattccac

SEQ ID NO: 3638145 - DNA, 19 bp, Homo sapiens
attttaaattccactgaaa

SEQ ID NO: 3638146 - DNA, 16 bp, Homo sapiens
attttaacgctgccta

SEQ ID NO: 3638147 - DNA, 13 bp, Homo sapiens
attttaatacaag

SEQ ID NO: 3638148 - DNA, 17 bp, Homo sapiens
attttaatacaagtaat

SEQ ID NO: 3638149 - DNA, 13 bp, Homo sapiens
attttaatcctgt

SEQ ID NO: 3638150 - DNA, 21 bp, Homo sapiens
attttaatcctgtaccaaatc

SEQ ID NO: 3638151 - DNA, 14 bp, Homo sapiens
attttaattaaaat

SEQ ID NO: 3638152 - DNA, 21 bp, Homo sapiens
attttacaagtataacagttt

SEQ ID NO: 3638153 - DNA, 15 bp, Homo sapiens
attttacattaaatt

SEQ ID NO: 3638154 - DNA, 13 bp, Homo sapiens
attttaccaaagc

SEQ ID NO: 3638155 - DNA, 17 bp, Homo sapiens
attttaccaaagcatca

SEQ ID NO: 3638156 - DNA, 22 bp, Homo sapiens
attttaccaaagcatcaataca

SEQ ID NO: 3638157 - DNA, 19 bp, Homo sapiens
attttacctagctaattat

SEQ ID NO: 3638158 - DNA, 19 bp, Homo sapiens
attttacctattctgaaaa

SEQ ID NO: 3638159 - DNA, 22 bp, Homo sapiens
attttacctattctgaaaaaga

SEQ ID NO: 3638160 - DNA, 18 bp, Homo sapiens
attttactgtcttgaatt

SEQ ID NO: 3638161 - DNA, 16 bp, Homo sapiens
attttagaataaattc

SEQ ID NO: 3638162 - DNA, 15 bp, Homo sapiens
attttagaatgtcaa

SEQ ID NO: 3638163 - DNA, 19 bp, Homo sapiens
attttagaatgtcaataaa

SEQ ID NO: 3638164 - DNA, 19 bp, Homo sapiens
attttatgccagttgttaa

SEQ ID NO: 3638165 - DNA, 21 bp, Homo sapiens
attttatgtctttcttgtaag

SEQ ID NO: 3638166 - DNA, 22 bp, Homo sapiens
attttattttgaaatggaaatt

SEQ ID NO: 3638167 - DNA, 15 bp, Homo sapiens
attttatttttagaa

SEQ ID NO: 3638168 - DNA, 18 bp, Homo sapiens
attttcaacgcagccctg

SEQ ID NO: 3638169 - DNA, 20 bp, Homo sapiens
attttcaacgcagccctgct

SEQ ID NO: 3638170 - DNA, 23 bp, Homo sapiens
attttcaagaaactgaggaattt

SEQ ID NO: 3638171 - DNA, 16 bp, Homo sapiens
attttccaagtaaaat

SEQ ID NO: 3638172 - DNA, 17 bp, Homo sapiens
attttcccctatcattt

SEQ ID NO: 3638173 - DNA, 22 bp, Homo sapiens
attttccttctgaagtctgagc

SEQ ID NO: 3638174 - DNA, 23 bp, Homo sapiens
attttcctttaatatgaaatttt

SEQ ID NO: 3638175 - DNA, 15 bp, Homo sapiens
attttctaaagactt

SEQ ID NO: 3638176 - DNA, 18 bp, Homo sapiens
attttctcactgaactcc

SEQ ID NO: 3638177 - DNA, 19 bp, Homo sapiens
attttctctttttgatctt

SEQ ID NO: 3638178 - DNA, 21 bp, Homo sapiens
attttctggtactctgtgaaa

SEQ ID NO: 3638179 - DNA, 13 bp, Homo sapiens
attttgaagtgct

SEQ ID NO: 3638180 - DNA, 15 bp, Homo sapiens
attttgacataagta

SEQ ID NO: 3638181 - DNA, 22 bp, Homo sapiens
attttgatgagatattaaattc

SEQ ID NO: 3638182 - DNA, 20 bp, Homo sapiens
attttgattaaccttttcaa

SEQ ID NO: 3638183 - DNA, 21 bp, Homo sapiens
attttgattaaccttttcaaa

SEQ ID NO: 3638184 - DNA, 11 bp, Homo sapiens
attttgctaac

SEQ ID NO: 3638185 - DNA, 14 bp, Homo sapiens
cacaccttgcagaa

SEQ ID NO: 3638186 - DNA, 13 bp, Homo sapiens
cacaccttggaga

SEQ ID NO: 3638187 - DNA, 14 bp, Homo sapiens
cacacgcctgtagt

SEQ ID NO: 3638188 - DNA, 14 bp, Homo sapiens
cacacgctgccttc

SEQ ID NO: 3638189 - DNA, 16 bp, Homo sapiens
cacacgctgctctgcc

SEQ ID NO: 3638190 - DNA, 22 bp, Homo sapiens
cacacggaccatctttagcagt

SEQ ID NO: 3638191 - DNA, 19 bp, Homo sapiens
cacactcaaatcaagaaac

SEQ ID NO: 3638192 - DNA, 20 bp, Homo sapiens
cacactcagaaaattccctg

SEQ ID NO: 3638193 - DNA, 14 bp, Homo sapiens
cacactcatcccct

SEQ ID NO: 3638194 - DNA, 22 bp, Homo sapiens
cacactcttcagtgactcctgc

SEQ ID NO: 3638195 - DNA, 23 bp, Homo sapiens
cacactcttcagtgactcctgct

SEQ ID NO: 3638196 - DNA, 12 bp, Homo sapiens
cacactgcttgg

SEQ ID NO: 3638197 - DNA, 16 bp, Homo sapiens
cacactgcttggccct

SEQ ID NO: 3638198 - DNA, 18 bp, Homo sapiens
cacactggcgtctggact

SEQ ID NO: 3638199 - DNA, 16 bp, Homo sapiens
cacactggtacttaga

SEQ ID NO: 3638200 - DNA, 18 bp, Homo sapiens
cacactgtggccaggcct

SEQ ID NO: 3638201 - DNA, 14 bp, Homo sapiens
cacacttcaggctc

SEQ ID NO: 3638202 - DNA, 18 bp, Homo sapiens
cacacttcaggctcttct

SEQ ID NO: 3638203 - DNA, 22 bp, Homo sapiens
cacagaaccttcaacccagtgg

SEQ ID NO: 3638204 - DNA, 14 bp, Homo sapiens
cacagacaagcagc

SEQ ID NO: 3638205 - DNA, 22 bp, Homo sapiens
cacagacaagcagcccttgctt

SEQ ID NO: 3638206 - DNA, 22 bp, Homo sapiens
cacagacactaacgaaatatca

SEQ ID NO: 3638207 - DNA, 20 bp, Homo sapiens
cacagaccgccgtctaactc

SEQ ID NO: 3638208 - DNA, 18 bp, Homo sapiens
cacagactcaaatgctca

SEQ ID NO: 3638209 - DNA, 21 bp, Homo sapiens
cacagactcaatgtgctctgt

SEQ ID NO: 3638210 - DNA, 20 bp, Homo sapiens
cacagactttagctttctga

SEQ ID NO: 3638211 - DNA, 20 bp, Homo sapiens
cacagagaagtttgtagcca

SEQ ID NO: 3638212 - DNA, 21 bp, Homo sapiens
cacagagaagtttgtagccag

SEQ ID NO: 3638213 - DNA, 16 bp, Homo sapiens
cacagagaggagggga

SEQ ID NO: 3638214 - DNA, 19 bp, Homo sapiens
cacagagaggaggggacca

SEQ ID NO: 3638215 - DNA, 18 bp, Homo sapiens
cacagatgcatatagaca

SEQ ID NO: 3638216 - DNA, 20 bp, Homo sapiens
cacagatgcatatagacaca

SEQ ID NO: 3638217 - DNA, 21 bp, Homo sapiens
cacagatgcatatagacacac

SEQ ID NO: 3638218 - DNA, 15 bp, Homo sapiens
cacagcaactgacct

SEQ ID NO: 3638219 - DNA, 23 bp, Homo sapiens
cacagcagctgcaggggcctctg

SEQ ID NO: 3638220 - DNA, 18 bp, Homo sapiens
cacagccagactggcaca

SEQ ID NO: 3638221 - DNA, 19 bp, Homo sapiens
cacagccttgcagcggctc

SEQ ID NO: 3638222 - DNA, 22 bp, Homo sapiens
cacagctacaaccctaccctgg

SEQ ID NO: 3638223 - DNA, 20 bp, Homo sapiens
cacagctctccggtctctct

SEQ ID NO: 3638224 - DNA, 13 bp, Homo sapiens
cacagctcttcat

SEQ ID NO: 3638225 - DNA, 16 bp, Homo sapiens
cacagctcttcattcc

SEQ ID NO: 3638226 - DNA, 20 bp, Homo sapiens
cacagctcttcattccattg

SEQ ID NO: 3638227 - DNA, 17 bp, Homo sapiens
cacagctcttccagggc

SEQ ID NO: 3638228 - DNA, 19 bp, Homo sapiens
cacagctcttccagggcag

SEQ ID NO: 3638229 - DNA, 20 bp, Homo sapiens
cacagctcttccagggcagc

SEQ ID NO: 3638230 - DNA, 21 bp, Homo sapiens
cacagctcttccagggcagcg

SEQ ID NO: 3638231 - DNA, 14 bp, Homo sapiens
cacagctgagaggc

SEQ ID NO: 3638232 - DNA, 18 bp, Homo sapiens
cacagctgagcacttagc

SEQ ID NO: 3638233 - DNA, 15 bp, Homo sapiens
cacagctgccctagc

SEQ ID NO: 3638234 - DNA, 14 bp, Homo sapiens
cacagctgggctgt

SEQ ID NO: 3638235 - DNA, 12 bp, Homo sapiens
cacaggagggcc

SEQ ID NO: 3638236 - DNA, 13 bp, Homo sapiens
cacaggagggcca

SEQ ID NO: 3638237 - DNA, 14 bp, Homo sapiens
cacaggagggccag

SEQ ID NO: 3638238 - DNA, 18 bp, Homo sapiens
cacaggcccttcctctcc

SEQ ID NO: 3638239 - DNA, 21 bp, Homo sapiens
cacaggcccttcctctccact

SEQ ID NO: 3638240 - DNA, 21 bp, Homo sapiens
cacaggctgaaatatccaccc

SEQ ID NO: 3638241 - DNA, 23 bp, Homo sapiens
cacaggggccaccacctttggct

SEQ ID NO: 3638242 - DNA, 14 bp, Homo sapiens
cacaggtctttcct

SEQ ID NO: 3638243 - DNA, 20 bp, Homo sapiens
cacaggtctttcctaaggct

SEQ ID NO: 3638244 - DNA, 20 bp, Homo sapiens
cacaggttttcagagaatta

SEQ ID NO: 3638245 - DNA, 18 bp, Homo sapiens
cacagtaccggattctct

SEQ ID NO: 3638246 - DNA, 20 bp, Homo sapiens
cacagtagctccaacacttt

SEQ ID NO: 3638247 - DNA, 24 bp, Homo sapiens
cacagtaggtcccggccagctctg

SEQ ID NO: 3638248 - DNA, 14 bp, Homo sapiens
cacagtatctgctg

SEQ ID NO: 3638249 - DNA, 22 bp, Homo sapiens
cacagtattatttctccatccc

SEQ ID NO: 3638250 - DNA, 14 bp, Homo sapiens
cacagtgcatctca

SEQ ID NO: 3638251 - DNA, 18 bp, Homo sapiens
cacagtgcatctcagccc

SEQ ID NO: 3638252 - DNA, 21 bp, Homo sapiens
cacagtggggctgcaggcagg

SEQ ID NO: 3638253 - DNA, 19 bp, Homo sapiens
cacagttattaattaaaga

SEQ ID NO: 3638254 - DNA, 20 bp, Homo sapiens
cacagttctttgggccagac

SEQ ID NO: 3638255 - DNA, 14 bp, Homo sapiens
cacagttttctgag

SEQ ID NO: 3638256 - DNA, 19 bp, Homo sapiens
cacagttttctgagaaaga

SEQ ID NO: 3638257 - DNA, 20 bp, Homo sapiens
cacagttttctgagaaagac

SEQ ID NO: 3638258 - DNA, 19 bp, Homo sapiens
cacataccctcttcatgga

SEQ ID NO: 3638259 - DNA, 22 bp, Homo sapiens
cacataccctcttcatggatgg

SEQ ID NO: 3638260 - DNA, 21 bp, Homo sapiens
cacatagtgatggttcccctg

SEQ ID NO: 3638261 - DNA, 16 bp, Homo sapiens
cacatcaaatatttct

SEQ ID NO: 3638262 - DNA, 13 bp, Homo sapiens
cacatcagcccca

SEQ ID NO: 3638263 - DNA, 17 bp, Homo sapiens
cacatcagccccacagg

SEQ ID NO: 3638264 - DNA, 18 bp, Homo sapiens
cacatcagccccacagga

SEQ ID NO: 3638265 - DNA, 20 bp, Homo sapiens
cacatcagccccacaggact

SEQ ID NO: 3638266 - DNA, 13 bp, Homo sapiens
cacatcagcttgc

SEQ ID NO: 3638267 - DNA, 14 bp, Homo sapiens
cacatctcagggaa

SEQ ID NO: 3638268 - DNA, 21 bp, Homo sapiens
cacatctcagggaactgaccc

SEQ ID NO: 3638269 - DNA, 19 bp, Homo sapiens
cacatctggctgcacaggc

SEQ ID NO: 3638270 - DNA, 15 bp, Homo sapiens
cacatctgttttgta

SEQ ID NO: 3638271 - DNA, 12 bp, Homo sapiens
cacatcttgctc

SEQ ID NO: 3638272 - DNA, 14 bp, Homo sapiens
cacatgccaggggc

SEQ ID NO: 3638273 - DNA, 14 bp, Homo sapiens
cacatgctgcctgg

SEQ ID NO: 3638274 - DNA, 16 bp, Homo sapiens
cacatgctgcctggca

SEQ ID NO: 3638275 - DNA, 18 bp, Homo sapiens
cacatggaagcccaactg

SEQ ID NO: 3638276 - DNA, 19 bp, Homo sapiens
cacatgtcagccactgtga

SEQ ID NO: 3638277 - DNA, 13 bp, Homo sapiens
cacattaaattga

SEQ ID NO: 3638278 - DNA, 15 bp, Homo sapiens
cacattaggctgttg

SEQ ID NO: 3638279 - DNA, 23 bp, Homo sapiens
cacattgaagaatgttagagtaa

SEQ ID NO: 3638280 - DNA, 15 bp, Homo sapiens
cacatttggaattga

SEQ ID NO: 3638281 - DNA, 23 bp, Homo sapiens
cacatttgtcttctttctgtctt

SEQ ID NO: 3638282 - DNA, 16 bp, Homo sapiens
caccaacccctgacct

SEQ ID NO: 3638283 - DNA, 22 bp, Homo sapiens
caccaacctccagactcagcag

SEQ ID NO: 3638284 - DNA, 23 bp, Homo sapiens
caccaacctccagactcagcaga

SEQ ID NO: 3638285 - DNA, 14 bp, Homo sapiens
caccaacctccagt

SEQ ID NO: 3638286 - DNA, 16 bp, Homo sapiens
caccaagcaagtccct

SEQ ID NO: 3638287 - DNA, 15 bp, Homo sapiens
caccaagctcaccct

SEQ ID NO: 3638288 - DNA, 18 bp, Homo sapiens
caccacacttgttttctt

SEQ ID NO: 3638289 - DNA, 12 bp, Homo sapiens
caccacagcctt

SEQ ID NO: 3638290 - DNA, 12 bp, Homo sapiens
caccaccctgcc

SEQ ID NO: 3638291 - DNA, 16 bp, Homo sapiens
caccacctctgtgggc

SEQ ID NO: 3638292 - DNA, 16 bp, Homo sapiens
caccactaccagccag

SEQ ID NO: 3638293 - DNA, 18 bp, Homo sapiens
caccactaccagccagcc

SEQ ID NO: 3638294 - DNA, 14 bp, Homo sapiens
caccactcaggcca

SEQ ID NO: 3638295 - DNA, 15 bp, Homo sapiens
caccactcaggccac

SEQ ID NO: 3638296 - DNA, 21 bp, Homo sapiens
caccagaacgcaccccactgg

SEQ ID NO: 3638297 - DNA, 12 bp, Homo sapiens
caccagaataaa

SEQ ID NO: 3638298 - DNA, 14 bp, Homo sapiens
caccagacacccag

SEQ ID NO: 3638299 - DNA, 15 bp, Homo sapiens
caccagacacccagg

SEQ ID NO: 3638300 - DNA, 17 bp, Homo sapiens
caccagacacccaggac

SEQ ID NO: 3638301 - DNA, 19 bp, Homo sapiens
caccagacacccaggactt

SEQ ID NO: 3638302 - DNA, 16 bp, Homo sapiens
caccagacggggctgg

SEQ ID NO: 3638303 - DNA, 20 bp, Homo sapiens
caccagcaaggggaccccga

SEQ ID NO: 3638304 - DNA, 10 bp, Homo sapiens
caccagcagc

SEQ ID NO: 3638305 - DNA, 15 bp, Homo sapiens
caccagcagcatggc

SEQ ID NO: 3638306 - DNA, 14 bp, Homo sapiens
caccaggggaggag

SEQ ID NO: 3638307 - DNA, 21 bp, Homo sapiens
caccaggggccaacctcaggc

SEQ ID NO: 3638308 - DNA, 19 bp, Homo sapiens
caccagtgttcctgaagct

SEQ ID NO: 3638309 - DNA, 21 bp, Homo sapiens
caccagtgttcctgaagctgc

SEQ ID NO: 3638310 - DNA, 20 bp, Homo sapiens
caccagttctcatgggtggc

SEQ ID NO: 3638311 - DNA, 15 bp, Homo sapiens
caccatctgctgtct

SEQ ID NO: 3638312 - DNA, 19 bp, Homo sapiens
caccatgctgctggggaag

SEQ ID NO: 3638313 - DNA, 20 bp, Homo sapiens
caccatgcttgcctgaagct

SEQ ID NO: 3638314 - DNA, 12 bp, Homo sapiens
cacccacaaact

SEQ ID NO: 3638315 - DNA, 17 bp, Homo sapiens
cacccacaaactccagg

SEQ ID NO: 3638316 - DNA, 14 bp, Homo sapiens
cacccacacagctg

SEQ ID NO: 3638317 - DNA, 21 bp, Homo sapiens
cagaggcgtactacccagctc

SEQ ID NO: 3638318 - DNA, 22 bp, Homo sapiens
cagaggcgtactacccagctct

SEQ ID NO: 3638319 - DNA, 24 bp, Homo sapiens
cagaggcgtactacccagctctgt

SEQ ID NO: 3638320 - DNA, 13 bp, Homo sapiens
cagagggaagcca

SEQ ID NO: 3638321 - DNA, 14 bp, Homo sapiens
cagagggaagccat

SEQ ID NO: 3638322 - DNA, 18 bp, Homo sapiens
cagagggaagccatgtgg

SEQ ID NO: 3638323 - DNA, 20 bp, Homo sapiens
cagagggaagccatgtgggg

SEQ ID NO: 3638324 - DNA, 19 bp, Homo sapiens
cagagggggagtagccaag

SEQ ID NO: 3638325 - DNA, 20 bp, Homo sapiens
cagagggggagtagccaagc

SEQ ID NO: 3638326 - DNA, 17 bp, Homo sapiens
cagagtccaatttaagg

SEQ ID NO: 3638327 - DNA, 15 bp, Homo sapiens
cagagtccccccact

SEQ ID NO: 3638328 - DNA, 23 bp, Homo sapiens
cagagtctcgctctgttgcccag

SEQ ID NO: 3638329 - DNA, 20 bp, Homo sapiens
cagagtgagggggtaaagca

SEQ ID NO: 3638330 - DNA, 17 bp, Homo sapiens
cagagtggcctccctgc

SEQ ID NO: 3638331 - DNA, 19 bp, Homo sapiens
cagagtggcgtggcctccc

SEQ ID NO: 3638332 - DNA, 21 bp, Homo sapiens
cagagtgggccccgggctgga

SEQ ID NO: 3638333 - DNA, 14 bp, Homo sapiens
cagagttacagttc

SEQ ID NO: 3638334 - DNA, 16 bp, Homo sapiens
cagataacataccttt

SEQ ID NO: 3638335 - DNA, 15 bp, Homo sapiens
cagataatccctgta

SEQ ID NO: 3638336 - DNA, 15 bp, Homo sapiens
cagatactttgaagt

SEQ ID NO: 3638337 - DNA, 21 bp, Homo sapiens
cagatactttgaagtgcagct

SEQ ID NO: 3638338 - DNA, 23 bp, Homo sapiens
cagatactttgaagtgcagctca

SEQ ID NO: 3638339 - DNA, 20 bp, Homo sapiens
cagatattctctagtcattt

SEQ ID NO: 3638340 - DNA, 18 bp, Homo sapiens
cagatattgttataaata

SEQ ID NO: 3638341 - DNA, 15 bp, Homo sapiens
cagatcacagggtga

SEQ ID NO: 3638342 - DNA, 15 bp, Homo sapiens
cagatcactcctgga

SEQ ID NO: 3638343 - DNA, 20 bp, Homo sapiens
cagatcagaacatgaaatgc

SEQ ID NO: 3638344 - DNA, 23 bp, Homo sapiens
cagatccagggacagaggcccca

SEQ ID NO: 3638345 - DNA, 23 bp, Homo sapiens
cagatctattgtttgttgcacta

SEQ ID NO: 3638346 - DNA, 21 bp, Homo sapiens
cagatctgcaccaccatgccc

SEQ ID NO: 3638347 - DNA, 15 bp, Homo sapiens
cagatctggaacctc

SEQ ID NO: 3638348 - DNA, 17 bp, Homo sapiens
cagatgaaaagaaaact

SEQ ID NO: 3638349 - DNA, 16 bp, Homo sapiens
cagatgaactgactga

SEQ ID NO: 3638350 - DNA, 21 bp, Homo sapiens
cagatgacagaggtttgaagg

SEQ ID NO: 3638351 - DNA, 16 bp, Homo sapiens
cagatgcatatagaca

SEQ ID NO: 3638352 - DNA, 14 bp, Homo sapiens
cagatgctgagcca

SEQ ID NO: 3638353 - DNA, 15 bp, Homo sapiens
cagatgctgagccat

SEQ ID NO: 3638354 - DNA, 17 bp, Homo sapiens
cagatgcttttgctaat

SEQ ID NO: 3638355 - DNA, 20 bp, Homo sapiens
cagatggaaagaggtgaaaa

SEQ ID NO: 3638356 - DNA, 18 bp, Homo sapiens
cagattagttctttttgc

SEQ ID NO: 3638357 - DNA, 19 bp, Homo sapiens
cagattcaggccagcccag

SEQ ID NO: 3638358 - DNA, 20 bp, Homo sapiens
cagattcaggccagcccagc

SEQ ID NO: 3638359 - DNA, 17 bp, Homo sapiens
cagattcccagagcaaa

SEQ ID NO: 3638360 - DNA, 19 bp, Homo sapiens
cagattcccagagcaaaat

SEQ ID NO: 3638361 - DNA, 15 bp, Homo sapiens
cagatttaagcctta

SEQ ID NO: 3638362 - DNA, 21 bp, Homo sapiens
cagatttaagccttacaaagg

SEQ ID NO: 3638363 - DNA, 16 bp, Homo sapiens
cagatttattcctttg

SEQ ID NO: 3638364 - DNA, 14 bp, Homo sapiens
cagatttgatattt

SEQ ID NO: 3638365 - DNA, 13 bp, Homo sapiens
cagatttggaaag

SEQ ID NO: 3638366 - DNA, 23 bp, Homo sapiens
cagattttgttggcatagctctg

SEQ ID NO: 3638367 - DNA, 23 bp, Homo sapiens
cagattttttgaaccatccactt

SEQ ID NO: 3638368 - DNA, 11 bp, Homo sapiens
cagcaaaagat

SEQ ID NO: 3638369 - DNA, 16 bp, Homo sapiens
cagcaaccctacagta

SEQ ID NO: 3638370 - DNA, 15 bp, Homo sapiens
cagcaacgcccctcc

SEQ ID NO: 3638371 - DNA, 19 bp, Homo sapiens
cagcaacgcccctccaaac

SEQ ID NO: 3638372 - DNA, 12 bp, Homo sapiens
cagcaactgacc

SEQ ID NO: 3638373 - DNA, 23 bp, Homo sapiens
cagcaagggtgatgggaaagcat

SEQ ID NO: 3638374 - DNA, 18 bp, Homo sapiens
cagcaatgccccaaactt

SEQ ID NO: 3638375 - DNA, 21 bp, Homo sapiens
cagcacatccatcagcacccc

SEQ ID NO: 3638376 - DNA, 15 bp, Homo sapiens
cagcaccaaccacag

SEQ ID NO: 3638377 - DNA, 16 bp, Homo sapiens
cagcaccaaccacagc

SEQ ID NO: 3638378 - DNA, 13 bp, Homo sapiens
cagcaccccttcc

SEQ ID NO: 3638379 - DNA, 15 bp, Homo sapiens
cagcaccgcctcttc

SEQ ID NO: 3638380 - DNA, 21 bp, Homo sapiens
cagcactccccagagctgtgc

SEQ ID NO: 3638381 - DNA, 15 bp, Homo sapiens
cagcactttgggagg

SEQ ID NO: 3638382 - DNA, 17 bp, Homo sapiens
cagcagacaaaatgaaa

SEQ ID NO: 3638383 - DNA, 21 bp, Homo sapiens
cagcagactggtttgcagtga

SEQ ID NO: 3638384 - DNA, 14 bp, Homo sapiens
cagcagatgctgtt

SEQ ID NO: 3638385 - DNA, 19 bp, Homo sapiens
cagcagcaccaaccacagc

SEQ ID NO: 3638386 - DNA, 15 bp, Homo sapiens
cagcagccccaggag

SEQ ID NO: 3638387 - DNA, 12 bp, Homo sapiens
cagcagcccccc

SEQ ID NO: 3638388 - DNA, 16 bp, Homo sapiens
cagcagccccccttgc

SEQ ID NO: 3638389 - DNA, 16 bp, Homo sapiens
cagcagcccctgcaca

SEQ ID NO: 3638390 - DNA, 14 bp, Homo sapiens
cagcagctgatgct

SEQ ID NO: 3638391 - DNA, 20 bp, Homo sapiens
cagcaggagagactgagcag

SEQ ID NO: 3638392 - DNA, 23 bp, Homo sapiens
cagcaggagagactgagcagccg

SEQ ID NO: 3638393 - DNA, 12 bp, Homo sapiens
cagcaggccaga

SEQ ID NO: 3638394 - DNA, 14 bp, Homo sapiens
cagcaggccagaga

SEQ ID NO: 3638395 - DNA, 15 bp, Homo sapiens
cagcaggccagagaa

SEQ ID NO: 3638396 - DNA, 16 bp, Homo sapiens
cagcaggccagagaaa

SEQ ID NO: 3638397 - DNA, 17 bp, Homo sapiens
cagcaggccagagaaag

SEQ ID NO: 3638398 - DNA, 14 bp, Homo sapiens
cagcaggcccatgg

SEQ ID NO: 3638399 - DNA, 16 bp, Homo sapiens
cagcaggcctctggga

SEQ ID NO: 3638400 - DNA, 18 bp, Homo sapiens
cagcaggcctctgggacc

SEQ ID NO: 3638401 - DNA, 14 bp, Homo sapiens
cagcaggctcaggc

SEQ ID NO: 3638402 - DNA, 15 bp, Homo sapiens
cagcaggctcaggca

SEQ ID NO: 3638403 - DNA, 16 bp, Homo sapiens
cagcaggctcaggcac

SEQ ID NO: 3638404 - DNA, 24 bp, Homo sapiens
cagcagggaaaatgcagcagggat

SEQ ID NO: 3638405 - DNA, 21 bp, Homo sapiens
cagcagggaccgggcgcagcc

SEQ ID NO: 3638406 - DNA, 18 bp, Homo sapiens
cagcagggatgccctgga

SEQ ID NO: 3638407 - DNA, 21 bp, Homo sapiens
cagcagggatgccctggaggt

SEQ ID NO: 3638408 - DNA, 17 bp, Homo sapiens
cagcaggggggctgtgc

SEQ ID NO: 3638409 - DNA, 18 bp, Homo sapiens
cagcaggggggctgtgcc

SEQ ID NO: 3638410 - DNA, 22 bp, Homo sapiens
cagcagtcgcccaagcagacag

SEQ ID NO: 3638411 - DNA, 22 bp, Homo sapiens
cagcagtctaaattttctaaat

SEQ ID NO: 3638412 - DNA, 16 bp, Homo sapiens
cagcagtgcagccggg

SEQ ID NO: 3638413 - DNA, 20 bp, Homo sapiens
cagcatcatggaggtttgaa

SEQ ID NO: 3638414 - DNA, 19 bp, Homo sapiens
cagcatccagtgtgagata

SEQ ID NO: 3638415 - DNA, 12 bp, Homo sapiens
cagcatccctgg

SEQ ID NO: 3638416 - DNA, 18 bp, Homo sapiens
cagcatcgggagcaccca

SEQ ID NO: 3638417 - DNA, 20 bp, Homo sapiens
cagcatgaataaaacactca

SEQ ID NO: 3638418 - DNA, 24 bp, Homo sapiens
cagcatgaataaaacactcatccc

SEQ ID NO: 3638419 - DNA, 15 bp, Homo sapiens
cagcatgcttgggct

SEQ ID NO: 3638420 - DNA, 15 bp, Homo sapiens
cagcatggcatagcc

SEQ ID NO: 3638421 - DNA, 15 bp, Homo sapiens
cagcattctcactcc

SEQ ID NO: 3638422 - DNA, 12 bp, Homo sapiens
cagcattgtgtg

SEQ ID NO: 3638423 - DNA, 16 bp, Homo sapiens
cagcattgtgtggaat

SEQ ID NO: 3638424 - DNA, 13 bp, Homo sapiens
cagcatttactat

SEQ ID NO: 3638425 - DNA, 19 bp, Homo sapiens
cagcatttactatgcacaa

SEQ ID NO: 3638426 - DNA, 12 bp, Homo sapiens
cagcatttcact

SEQ ID NO: 3638427 - DNA, 20 bp, Homo sapiens
cagccaagtgccaaatgctc

SEQ ID NO: 3638428 - DNA, 20 bp, Homo sapiens
cagccacagacccctgggag

SEQ ID NO: 3638429 - DNA, 22 bp, Homo sapiens
cagccacagacccctgggagct

SEQ ID NO: 3638430 - DNA, 22 bp, Homo sapiens
cagccacctgggaacacagttc

SEQ ID NO: 3638431 - DNA, 17 bp, Homo sapiens
cagccactccccagcca

SEQ ID NO: 3638432 - DNA, 19 bp, Homo sapiens
cagccagaggcatctgagg

SEQ ID NO: 3638433 - DNA, 14 bp, Homo sapiens
cagccagcagaggg

SEQ ID NO: 3638434 - DNA, 22 bp, Homo sapiens
cagccagcccttccctggcccc

SEQ ID NO: 3638435 - DNA, 12 bp, Homo sapiens
cagccagcctca

SEQ ID NO: 3638436 - DNA, 14 bp, Homo sapiens
cagccagcctcaga

SEQ ID NO: 3638437 - DNA, 21 bp, Homo sapiens
cagccagcgtcccttggtgag

SEQ ID NO: 3638438 - DNA, 21 bp, Homo sapiens
cagccaggctcctacctgtct

SEQ ID NO: 3638439 - DNA, 17 bp, Homo sapiens
cagccaggtctgactcc

SEQ ID NO: 3638440 - DNA, 18 bp, Homo sapiens
cagccaggtctgactcca

SEQ ID NO: 3638441 - DNA, 21 bp, Homo sapiens
cagccaggtctgactccaaag

SEQ ID NO: 3638442 - DNA, 22 bp, Homo sapiens
cagccagtcccgtttcatttag

SEQ ID NO: 3638443 - DNA, 17 bp, Homo sapiens
cagccatgtctgcattt

SEQ ID NO: 3638444 - DNA, 22 bp, Homo sapiens
cagcccaaacctgggaaggcca

SEQ ID NO: 3638445 - DNA, 11 bp, Homo sapiens
cagcccagaga

SEQ ID NO: 3638446 - DNA, 12 bp, Homo sapiens
cagcccagagac

SEQ ID NO: 3638447 - DNA, 22 bp, Homo sapiens
cagcccagagacatacttgaag

SEQ ID NO: 3638448 - DNA, 19 bp, Homo sapiens
cagcccagagccacctgga

SEQ ID NO: 3638449 - DNA, 22 bp, Homo sapiens
caggcaccgccacgtcccagca

SEQ ID NO: 3638450 - DNA, 23 bp, Homo sapiens
caggcaccgccacgtcccagcat

SEQ ID NO: 3638451 - DNA, 12 bp, Homo sapiens
caggcactccaa

SEQ ID NO: 3638452 - DNA, 23 bp, Homo sapiens
caggcactgctgcccagcctcca

SEQ ID NO: 3638453 - DNA, 23 bp, Homo sapiens
caggcagagtggcgtggcctccc

SEQ ID NO: 3638454 - DNA, 13 bp, Homo sapiens
caggcagatccag

SEQ ID NO: 3638455 - DNA, 14 bp, Homo sapiens
caggcagatccagg

SEQ ID NO: 3638456 - DNA, 21 bp, Homo sapiens
caggcagctatttcagcctcc

SEQ ID NO: 3638457 - DNA, 23 bp, Homo sapiens
caggcagctatttcagcctcctg

SEQ ID NO: 3638458 - DNA, 15 bp, Homo sapiens
caggcagctgaaatt

SEQ ID NO: 3638459 - DNA, 16 bp, Homo sapiens
caggcaggcggctcct

SEQ ID NO: 3638460 - DNA, 14 bp, Homo sapiens
caggcagggagaga

SEQ ID NO: 3638461 - DNA, 13 bp, Homo sapiens
caggcagggaggg

SEQ ID NO: 3638462 - DNA, 14 bp, Homo sapiens
caggcagggagggc

SEQ ID NO: 3638463 - DNA, 20 bp, Homo sapiens
caggcatggtagctcatgcc

SEQ ID NO: 3638464 - DNA, 14 bp, Homo sapiens
caggccacagtggg

SEQ ID NO: 3638465 - DNA, 23 bp, Homo sapiens
caggccacagtggggctgcaggc

SEQ ID NO: 3638466 - DNA, 24 bp, Homo sapiens
caggccacagtggggctgcaggca

SEQ ID NO: 3638467 - DNA, 14 bp, Homo sapiens
caggccaccctcca

SEQ ID NO: 3638468 - DNA, 15 bp, Homo sapiens
caggccacttgatga

SEQ ID NO: 3638469 - DNA, 12 bp, Homo sapiens
caggccagccca

SEQ ID NO: 3638470 - DNA, 13 bp, Homo sapiens
caggccagcccag

SEQ ID NO: 3638471 - DNA, 14 bp, Homo sapiens
caggccagcccagc

SEQ ID NO: 3638472 - DNA, 18 bp, Homo sapiens
caggcccactccccagcc

SEQ ID NO: 3638473 - DNA, 23 bp, Homo sapiens
caggcccactccccagccccagc

SEQ ID NO: 3638474 - DNA, 19 bp, Homo sapiens
caggccccaccggccaggc

SEQ ID NO: 3638475 - DNA, 15 bp, Homo sapiens
caggccccaggaaag

SEQ ID NO: 3638476 - DNA, 14 bp, Homo sapiens
caggcccccaggtg

SEQ ID NO: 3638477 - DNA, 14 bp, Homo sapiens
caggcccgcttgct

SEQ ID NO: 3638478 - DNA, 23 bp, Homo sapiens
caggccctccctgtctccagggc

SEQ ID NO: 3638479 - DNA, 16 bp, Homo sapiens
caggcccttcctctcc

SEQ ID NO: 3638480 - DNA, 23 bp, Homo sapiens
caggcccttcctctccactgcct

SEQ ID NO: 3638481 - DNA, 13 bp, Homo sapiens
caggccgcgccca

SEQ ID NO: 3638482 - DNA, 17 bp, Homo sapiens
caggccgcgcccagcag

SEQ ID NO: 3638483 - DNA, 22 bp, Homo sapiens
caggcctaggtgcagctcctca

SEQ ID NO: 3638484 - DNA, 20 bp, Homo sapiens
caggcctccaacgcccctgt

SEQ ID NO: 3638485 - DNA, 21 bp, Homo sapiens
caggcctccaacgcccctgtg

SEQ ID NO: 3638486 - DNA, 24 bp, Homo sapiens
caggcctccaacgcccctgtggcc

SEQ ID NO: 3638487 - DNA, 14 bp, Homo sapiens
caggcctctgggac

SEQ ID NO: 3638488 - DNA, 15 bp, Homo sapiens
caggcctctgggacc

SEQ ID NO: 3638489 - DNA, 22 bp, Homo sapiens
caggcctctgggacccacagaa

SEQ ID NO: 3638490 - DNA, 19 bp, Homo sapiens
caggcctgaagtcttctcc

SEQ ID NO: 3638491 - DNA, 15 bp, Homo sapiens
caggcctgactctca

SEQ ID NO: 3638492 - DNA, 16 bp, Homo sapiens
caggccttatctccaa

SEQ ID NO: 3638493 - DNA, 22 bp, Homo sapiens
caggccttatctccaagaccag

SEQ ID NO: 3638494 - DNA, 18 bp, Homo sapiens
caggccttatctgaaagg

SEQ ID NO: 3638495 - DNA, 22 bp, Homo sapiens
caggccttatctgaaaggccag

SEQ ID NO: 3638496 - DNA, 15 bp, Homo sapiens
caggcgctaattcaa

SEQ ID NO: 3638497 - DNA, 12 bp, Homo sapiens
caggcggctcct

SEQ ID NO: 3638498 - DNA, 21 bp, Homo sapiens
caggctaagaccctgtgtcct

SEQ ID NO: 3638499 - DNA, 24 bp, Homo sapiens
caggctaagaccctgtgtcctcca

SEQ ID NO: 3638500 - DNA, 14 bp, Homo sapiens
caggctactgtcag

SEQ ID NO: 3638501 - DNA, 15 bp, Homo sapiens
caggctagctgtgct

SEQ ID NO: 3638502 - DNA, 19 bp, Homo sapiens
caggctatatgcagtcctt

SEQ ID NO: 3638503 - DNA, 13 bp, Homo sapiens
caggctcaggaga

SEQ ID NO: 3638504 - DNA, 15 bp, Homo sapiens
caggctcaggagaag

SEQ ID NO: 3638505 - DNA, 22 bp, Homo sapiens
caggctcaggagaagccagtgt

SEQ ID NO: 3638506 - DNA, 18 bp, Homo sapiens
caggctcctaaagagaca

SEQ ID NO: 3638507 - DNA, 17 bp, Homo sapiens
caggctcgtcagccacc

SEQ ID NO: 3638508 - DNA, 20 bp, Homo sapiens
caggctcgtcagccacctgg

SEQ ID NO: 3638509 - DNA, 11 bp, Homo sapiens
caggctctgca

SEQ ID NO: 3638510 - DNA, 17 bp, Homo sapiens
caggctctgcacagaca

SEQ ID NO: 3638511 - DNA, 12 bp, Homo sapiens
caggctcttctc

SEQ ID NO: 3638512 - DNA, 14 bp, Homo sapiens
caggctcttctcct

SEQ ID NO: 3638513 - DNA, 22 bp, Homo sapiens
caggctcttctcctttcacaac

SEQ ID NO: 3638514 - DNA, 19 bp, Homo sapiens
caggctgaaatatccaccc

SEQ ID NO: 3638515 - DNA, 17 bp, Homo sapiens
caggctgaagagaggga

SEQ ID NO: 3638516 - DNA, 22 bp, Homo sapiens
caggctgagggtcgtgggaaag

SEQ ID NO: 3638517 - DNA, 19 bp, Homo sapiens
caggctgcctcctgccctt

SEQ ID NO: 3638518 - DNA, 18 bp, Homo sapiens
caggctggaagtacttgg

SEQ ID NO: 3638519 - DNA, 23 bp, Homo sapiens
caggctggtctcaaactcctgac

SEQ ID NO: 3638520 - DNA, 20 bp, Homo sapiens
caggctggtctcgaactcct

SEQ ID NO: 3638521 - DNA, 24 bp, Homo sapiens
caggctggtcttgaactgggctca

SEQ ID NO: 3638522 - DNA, 13 bp, Homo sapiens
caggctttctaga

SEQ ID NO: 3638523 - DNA, 17 bp, Homo sapiens
cagggaaaagcagctct

SEQ ID NO: 3638524 - DNA, 20 bp, Homo sapiens
cagggaaaagcagctctccc

SEQ ID NO: 3638525 - DNA, 15 bp, Homo sapiens
cagggaaatgtatgt

SEQ ID NO: 3638526 - DNA, 16 bp, Homo sapiens
cagggaaccccagggg

SEQ ID NO: 3638527 - DNA, 14 bp, Homo sapiens
cagggaactgaccc

SEQ ID NO: 3638528 - DNA, 21 bp, Homo sapiens
cagggaaggacaggaccctca

SEQ ID NO: 3638529 - DNA, 16 bp, Homo sapiens
cagggaatgcagcagg

SEQ ID NO: 3638530 - DNA, 18 bp, Homo sapiens
cagggaatggccacaaac

SEQ ID NO: 3638531 - DNA, 16 bp, Homo sapiens
cagggacagaggcccc

SEQ ID NO: 3638532 - DNA, 18 bp, Homo sapiens
cagggacagaggccccag

SEQ ID NO: 3638533 - DNA, 19 bp, Homo sapiens
cagggacagaggccccagc

SEQ ID NO: 3638534 - DNA, 18 bp, Homo sapiens
cagggaccactgggtgag

SEQ ID NO: 3638535 - DNA, 24 bp, Homo sapiens
cagggaccactgggtgagagagga

SEQ ID NO: 3638536 - DNA, 20 bp, Homo sapiens
cagggaccgggcgcagccct

SEQ ID NO: 3638537 - DNA, 15 bp, Homo sapiens
cagggaccggtgctg

SEQ ID NO: 3638538 - DNA, 19 bp, Homo sapiens
cagggaccggtgctgcagg

SEQ ID NO: 3638539 - DNA, 20 bp, Homo sapiens
cagggaccggtgctgcagga

SEQ ID NO: 3638540 - DNA, 21 bp, Homo sapiens
cagggacctaaagggactacc

SEQ ID NO: 3638541 - DNA, 23 bp, Homo sapiens
cagggacctgagagcatctcagg

SEQ ID NO: 3638542 - DNA, 21 bp, Homo sapiens
cagggactgaaaacctctcct

SEQ ID NO: 3638543 - DNA, 23 bp, Homo sapiens
cagggactgaaaacctctcctca

SEQ ID NO: 3638544 - DNA, 13 bp, Homo sapiens
cagggagaagctc

SEQ ID NO: 3638545 - DNA, 19 bp, Homo sapiens
cagggagcattttcctcca

SEQ ID NO: 3638546 - DNA, 15 bp, Homo sapiens
cagggagctctgggg

SEQ ID NO: 3638547 - DNA, 23 bp, Homo sapiens
cagggagctctggggacagcttc

SEQ ID NO: 3638548 - DNA, 12 bp, Homo sapiens
cagggagggctt

SEQ ID NO: 3638549 - DNA, 21 bp, Homo sapiens
cagggatccccaggaggcctg

SEQ ID NO: 3638550 - DNA, 15 bp, Homo sapiens
cagggatgctgggct

SEQ ID NO: 3638551 - DNA, 21 bp, Homo sapiens
cagggatgctgggctgggccc

SEQ ID NO: 3638552 - DNA, 14 bp, Homo sapiens
cagggatggaggga

SEQ ID NO: 3638553 - DNA, 15 bp, Homo sapiens
cagggcaaggccatt

SEQ ID NO: 3638554 - DNA, 19 bp, Homo sapiens
cagggcagcaggccagaga

SEQ ID NO: 3638555 - DNA, 12 bp, Homo sapiens
cagggcagcggc

SEQ ID NO: 3638556 - DNA, 13 bp, Homo sapiens
cagggcagcggct

SEQ ID NO: 3638557 - DNA, 16 bp, Homo sapiens
cagggccacctgcagg

SEQ ID NO: 3638558 - DNA, 23 bp, Homo sapiens
cagggccaggtgcagaccttggg

SEQ ID NO: 3638559 - DNA, 23 bp, Homo sapiens
cagggccatctgactgccaagcc

SEQ ID NO: 3638560 - DNA, 13 bp, Homo sapiens
cagggcccagagc

SEQ ID NO: 3638561 - DNA, 14 bp, Homo sapiens
cagggcccaggttc

SEQ ID NO: 3638562 - DNA, 15 bp, Homo sapiens
cagggcccctggatc

SEQ ID NO: 3638563 - DNA, 15 bp, Homo sapiens
cagggccgggcaggg

SEQ ID NO: 3638564 - DNA, 14 bp, Homo sapiens
cagggcctgacacc

SEQ ID NO: 3638565 - DNA, 17 bp, Homo sapiens
cagggcctgacaccccc

SEQ ID NO: 3638566 - DNA, 17 bp, Homo sapiens
cagggctaaataaagag

SEQ ID NO: 3638567 - DNA, 18 bp, Homo sapiens
cagggctaaataaagagg

SEQ ID NO: 3638568 - DNA, 19 bp, Homo sapiens
cagggctcacgtgggaacc

SEQ ID NO: 3638569 - DNA, 18 bp, Homo sapiens
cagggctgaggcctctca

SEQ ID NO: 3638570 - DNA, 12 bp, Homo sapiens
cagggctggagc

SEQ ID NO: 3638571 - DNA, 14 bp, Homo sapiens
cagggctggagcct

SEQ ID NO: 3638572 - DNA, 21 bp, Homo sapiens
cagggctggcacgtgacaggc

SEQ ID NO: 3638573 - DNA, 15 bp, Homo sapiens
cagggcttctagttt

SEQ ID NO: 3638574 - DNA, 16 bp, Homo sapiens
caggggaactggcagc

SEQ ID NO: 3638575 - DNA, 21 bp, Homo sapiens
caggggaattccctccccctc

SEQ ID NO: 3638576 - DNA, 23 bp, Homo sapiens
caggggaattccctccccctcct

SEQ ID NO: 3638577 - DNA, 14 bp, Homo sapiens
caggggaccccact

SEQ ID NO: 3638578 - DNA, 16 bp, Homo sapiens
caggggagacaggagc

SEQ ID NO: 3638579 - DNA, 17 bp, Homo sapiens
caggggagacaggagcc

SEQ ID NO: 3638580 - DNA, 13 bp, Homo sapiens
caggggagccctc

SEQ ID NO: 3638581 - DNA, 14 bp, Homo sapiens
catgcaccacgggc

SEQ ID NO: 3638582 - DNA, 22 bp, Homo sapiens
catgcacccctgagccagcagg

SEQ ID NO: 3638583 - DNA, 23 bp, Homo sapiens
catgcacccctgagccagcaggg

SEQ ID NO: 3638584 - DNA, 17 bp, Homo sapiens
catgcactcacccctag

SEQ ID NO: 3638585 - DNA, 19 bp, Homo sapiens
catgcactcacccctagcc

SEQ ID NO: 3638586 - DNA, 13 bp, Homo sapiens
catgcactgtgaa

SEQ ID NO: 3638587 - DNA, 16 bp, Homo sapiens
catgcactgtgaagga

SEQ ID NO: 3638588 - DNA, 21 bp, Homo sapiens
catgcactttatgtggagact

SEQ ID NO: 3638589 - DNA, 13 bp, Homo sapiens
catgcaggaagga

SEQ ID NO: 3638590 - DNA, 21 bp, Homo sapiens
catgcaggacgttagactgtt

SEQ ID NO: 3638591 - DNA, 22 bp, Homo sapiens
catgcatataatgaataaatca

SEQ ID NO: 3638592 - DNA, 15 bp, Homo sapiens
catgcatcttccact

SEQ ID NO: 3638593 - DNA, 22 bp, Homo sapiens
catgcattttgctttggacaca

SEQ ID NO: 3638594 - DNA, 13 bp, Homo sapiens
catgccagagagg

SEQ ID NO: 3638595 - DNA, 12 bp, Homo sapiens
catgcgcacaga

SEQ ID NO: 3638596 - DNA, 18 bp, Homo sapiens
catgcgcacagagggaag

SEQ ID NO: 3638597 - DNA, 22 bp, Homo sapiens
catgcgcacagagggaagccat

SEQ ID NO: 3638598 - DNA, 17 bp, Homo sapiens
catgcgccaccatgccc

SEQ ID NO: 3638599 - DNA, 20 bp, Homo sapiens
catgctagtgttgtatttct

SEQ ID NO: 3638600 - DNA, 22 bp, Homo sapiens
catgctagtgttgtatttctat

SEQ ID NO: 3638601 - DNA, 23 bp, Homo sapiens
catgctatctctgtgtgcacaaa

SEQ ID NO: 3638602 - DNA, 14 bp, Homo sapiens
catgctcaaccccc

SEQ ID NO: 3638603 - DNA, 18 bp, Homo sapiens
catgctcaacccccctcc

SEQ ID NO: 3638604 - DNA, 14 bp, Homo sapiens
catgctcacacatt

SEQ ID NO: 3638605 - DNA, 14 bp, Homo sapiens
catgctgccttcag

SEQ ID NO: 3638606 - DNA, 14 bp, Homo sapiens
catgctgctgggga

SEQ ID NO: 3638607 - DNA, 21 bp, Homo sapiens
catgctgctggggaagacagt

SEQ ID NO: 3638608 - DNA, 18 bp, Homo sapiens
catgcttgcctgaagctt

SEQ ID NO: 3638609 - DNA, 20 bp, Homo sapiens
catgctttgtttacgtgtaa

SEQ ID NO: 3638610 - DNA, 15 bp, Homo sapiens
catggaaaaatggtt

SEQ ID NO: 3638611 - DNA, 18 bp, Homo sapiens
catggacatgatcttctt

SEQ ID NO: 3638612 - DNA, 21 bp, Homo sapiens
catggaccgaggttcccactc

SEQ ID NO: 3638613 - DNA, 15 bp, Homo sapiens
catggactgagctgg

SEQ ID NO: 3638614 - DNA, 13 bp, Homo sapiens
catggagacagca

SEQ ID NO: 3638615 - DNA, 14 bp, Homo sapiens
catggagacagcag

SEQ ID NO: 3638616 - DNA, 15 bp, Homo sapiens
catggagccccctct

SEQ ID NO: 3638617 - DNA, 14 bp, Homo sapiens
catggagcctacct

SEQ ID NO: 3638618 - DNA, 22 bp, Homo sapiens
catggagtagaggtactagaat

SEQ ID NO: 3638619 - DNA, 19 bp, Homo sapiens
catggatgggggaactcag

SEQ ID NO: 3638620 - DNA, 13 bp, Homo sapiens
catggcaggagtc

SEQ ID NO: 3638621 - DNA, 17 bp, Homo sapiens
catggcaggagtctctg

SEQ ID NO: 3638622 - DNA, 22 bp, Homo sapiens
catggcaggagtctctgccagt

SEQ ID NO: 3638623 - DNA, 14 bp, Homo sapiens
catggctaactggc

SEQ ID NO: 3638624 - DNA, 13 bp, Homo sapiens
catgggaggaaga

SEQ ID NO: 3638625 - DNA, 14 bp, Homo sapiens
catgggtcaagaga

SEQ ID NO: 3638626 - DNA, 15 bp, Homo sapiens
catgggtccagggcc

SEQ ID NO: 3638627 - DNA, 15 bp, Homo sapiens
catggtgaaattata

SEQ ID NO: 3638628 - DNA, 16 bp, Homo sapiens
catggtgccccaggac

SEQ ID NO: 3638629 - DNA, 17 bp, Homo sapiens
catggtgccccaggacc

SEQ ID NO: 3638630 - DNA, 18 bp, Homo sapiens
catggtggggtctcctca

SEQ ID NO: 3638631 - DNA, 20 bp, Homo sapiens
catggtggggtctcctcagg

SEQ ID NO: 3638632 - DNA, 15 bp, Homo sapiens
catggtgtggggggc

SEQ ID NO: 3638633 - DNA, 23 bp, Homo sapiens
catggtgtggggggctgggggag

SEQ ID NO: 3638634 - DNA, 22 bp, Homo sapiens
catggttacatatcaaaacatc

SEQ ID NO: 3638635 - DNA, 16 bp, Homo sapiens
catggttcaagtatta

SEQ ID NO: 3638636 - DNA, 20 bp, Homo sapiens
catggttcaagtattaagca

SEQ ID NO: 3638637 - DNA, 17 bp, Homo sapiens
catgtaaaaagtgcagt

SEQ ID NO: 3638638 - DNA, 21 bp, Homo sapiens
catgtaaaaagtgcagtaaat

SEQ ID NO: 3638639 - DNA, 15 bp, Homo sapiens
catgtaagaaataag

SEQ ID NO: 3638640 - DNA, 18 bp, Homo sapiens
catgtacttttaaattat

SEQ ID NO: 3638641 - DNA, 10 bp, Homo sapiens
catgtagcat

SEQ ID NO: 3638642 - DNA, 23 bp, Homo sapiens
catgtagcatataaatgtttata

SEQ ID NO: 3638643 - DNA, 14 bp, Homo sapiens
catgtataaatgtg

SEQ ID NO: 3638644 - DNA, 18 bp, Homo sapiens
catgtattgcacattgta

SEQ ID NO: 3638645 - DNA, 20 bp, Homo sapiens
catgtccagtgagcagtgtt

SEQ ID NO: 3638646 - DNA, 16 bp, Homo sapiens
catgtccctaccgagt

SEQ ID NO: 3638647 - DNA, 19 bp, Homo sapiens
catgtcgccaaaaatacag

SEQ ID NO: 3638648 - DNA, 14 bp, Homo sapiens
catgtcgcctctgc

SEQ ID NO: 3638649 - DNA, 16 bp, Homo sapiens
catgtgacatttatat

SEQ ID NO: 3638650 - DNA, 11 bp, Homo sapiens
catgtgccttt

SEQ ID NO: 3638651 - DNA, 14 bp, Homo sapiens
catgtgctgtgtga

SEQ ID NO: 3638652 - DNA, 15 bp, Homo sapiens
catgtgtctggccct

SEQ ID NO: 3638653 - DNA, 14 bp, Homo sapiens
catgttatgcagtg

SEQ ID NO: 3638654 - DNA, 24 bp, Homo sapiens
catgttctaccgtggatttgtact

SEQ ID NO: 3638655 - DNA, 14 bp, Homo sapiens
catgttctgctttc

SEQ ID NO: 3638656 - DNA, 17 bp, Homo sapiens
catgttggaaatgtgtt

SEQ ID NO: 3638657 - DNA, 18 bp, Homo sapiens
catgttggaaatgtgttt

SEQ ID NO: 3638658 - DNA, 16 bp, Homo sapiens
catgttttcaactgcc

SEQ ID NO: 3638659 - DNA, 13 bp, Homo sapiens
catgttttccagg

SEQ ID NO: 3638660 - DNA, 14 bp, Homo sapiens
catgtttttaactt

SEQ ID NO: 3638661 - DNA, 14 bp, Homo sapiens
catgttttttcatt

SEQ ID NO: 3638662 - DNA, 16 bp, Homo sapiens
catgttttttcatttg

SEQ ID NO: 3638663 - DNA, 22 bp, Homo sapiens
cattaaaaagttgttctttgtt

SEQ ID NO: 3638664 - DNA, 19 bp, Homo sapiens
cattaaaaatgttagtatt

SEQ ID NO: 3638665 - DNA, 13 bp, Homo sapiens
cattaaaataaac

SEQ ID NO: 3638666 - DNA, 14 bp, Homo sapiens
cattaaaataaacc

SEQ ID NO: 3638667 - DNA, 18 bp, Homo sapiens
cattaaaataaaccaaat

SEQ ID NO: 3638668 - DNA, 14 bp, Homo sapiens
cattaaaatataat

SEQ ID NO: 3638669 - DNA, 16 bp, Homo sapiens
cattaacggtgctaaa

SEQ ID NO: 3638670 - DNA, 12 bp, Homo sapiens
cattaatattta

SEQ ID NO: 3638671 - DNA, 14 bp, Homo sapiens
cattaatatttacc

SEQ ID NO: 3638672 - DNA, 18 bp, Homo sapiens
cattaatatttaccaaag

SEQ ID NO: 3638673 - DNA, 17 bp, Homo sapiens
cattacagccatatgta

SEQ ID NO: 3638674 - DNA, 15 bp, Homo sapiens
cattaccctacagac

SEQ ID NO: 3638675 - DNA, 21 bp, Homo sapiens
cattacctcagtgagaagcca

SEQ ID NO: 3638676 - DNA, 22 bp, Homo sapiens
cattacctcagtgagaagccag

SEQ ID NO: 3638677 - DNA, 15 bp, Homo sapiens
cattactgttccaga

SEQ ID NO: 3638678 - DNA, 20 bp, Homo sapiens
cattactgttccagattcct

SEQ ID NO: 3638679 - DNA, 13 bp, Homo sapiens
cattagagaaaac

SEQ ID NO: 3638680 - DNA, 15 bp, Homo sapiens
cattagcaaggcaga

SEQ ID NO: 3638681 - DNA, 14 bp, Homo sapiens
cattatcttatcat

SEQ ID NO: 3638682 - DNA, 23 bp, Homo sapiens
cattatgccacttccttttaact

SEQ ID NO: 3638683 - DNA, 22 bp, Homo sapiens
cattatggtagaatcattttta

SEQ ID NO: 3638684 - DNA, 17 bp, Homo sapiens
cattcacaagcctcctg

SEQ ID NO: 3638685 - DNA, 20 bp, Homo sapiens
cattcacaagcctcctgtac

SEQ ID NO: 3638686 - DNA, 22 bp, Homo sapiens
cattcacagttctttgggccag

SEQ ID NO: 3638687 - DNA, 15 bp, Homo sapiens
cattcagctctggag

SEQ ID NO: 3638688 - DNA, 16 bp, Homo sapiens
cattcagctctggaga

SEQ ID NO: 3638689 - DNA, 17 bp, Homo sapiens
cattcagctctggagaa

SEQ ID NO: 3638690 - DNA, 12 bp, Homo sapiens
cattcagttcta

SEQ ID NO: 3638691 - DNA, 19 bp, Homo sapiens
cattcagttctaggccttt

SEQ ID NO: 3638692 - DNA, 15 bp, Homo sapiens
cattcatggatattt

SEQ ID NO: 3638693 - DNA, 16 bp, Homo sapiens
cattcatggatatttg

SEQ ID NO: 3638694 - DNA, 22 bp, Homo sapiens
cattccaccttcccatgccctg

SEQ ID NO: 3638695 - DNA, 14 bp, Homo sapiens
cattccatcttaca

SEQ ID NO: 3638696 - DNA, 16 bp, Homo sapiens
cattcccctcccacct

SEQ ID NO: 3638697 - DNA, 21 bp, Homo sapiens
cattcctccagcctcccctcc

SEQ ID NO: 3638698 - DNA, 16 bp, Homo sapiens
cattcctgaagaacca

SEQ ID NO: 3638699 - DNA, 21 bp, Homo sapiens
cattcctgaagaaccagtccc

SEQ ID NO: 3638700 - DNA, 13 bp, Homo sapiens
cattcctgtgccc

SEQ ID NO: 3638701 - DNA, 17 bp, Homo sapiens
cattctaccaagctgtc

SEQ ID NO: 3638702 - DNA, 20 bp, Homo sapiens
cattctaccaagctgtcaca

SEQ ID NO: 3638703 - DNA, 15 bp, Homo sapiens
cattctattctccag

SEQ ID NO: 3638704 - DNA, 16 bp, Homo sapiens
cattctattctccaga

SEQ ID NO: 3638705 - DNA, 20 bp, Homo sapiens
cattctattctccagacatg

SEQ ID NO: 3638706 - DNA, 17 bp, Homo sapiens
cattctattttagaata

SEQ ID NO: 3638707 - DNA, 14 bp, Homo sapiens
cattctcactccta

SEQ ID NO: 3638708 - DNA, 21 bp, Homo sapiens
cattctctcccatcctggggc

SEQ ID NO: 3638709 - DNA, 19 bp, Homo sapiens
cattctgaaccctccaaag

SEQ ID NO: 3638710 - DNA, 19 bp, Homo sapiens
cattctgcctagagtgtag

SEQ ID NO: 3638711 - DNA, 22 bp, Homo sapiens
cattctggttccctgctgcgct

SEQ ID NO: 3638712 - DNA, 16 bp, Homo sapiens
cattctgttttccccc

SEQ ID NO: 3638713 - DNA, 17 bp, Homo sapiens
cattctgttttccccca

SEQ ID NO: 3638714 - DNA, 14 bp, Homo sapiens
ccagcattcctttt

SEQ ID NO: 3638715 - DNA, 14 bp, Homo sapiens
ccagccagacccca

SEQ ID NO: 3638716 - DNA, 14 bp, Homo sapiens
ccagccagcctcag

SEQ ID NO: 3638717 - DNA, 14 bp, Homo sapiens
ccagccagcctggc

SEQ ID NO: 3638718 - DNA, 16 bp, Homo sapiens
ccagccaggccaacag

SEQ ID NO: 3638719 - DNA, 17 bp, Homo sapiens
ccagccaggccaacagc

SEQ ID NO: 3638720 - DNA, 12 bp, Homo sapiens
ccagccaggctc

SEQ ID NO: 3638721 - DNA, 15 bp, Homo sapiens
ccagccagggctcaa

SEQ ID NO: 3638722 - DNA, 14 bp, Homo sapiens
ccagccatgtctgc

SEQ ID NO: 3638723 - DNA, 18 bp, Homo sapiens
ccagcccaaacctgggaa

SEQ ID NO: 3638724 - DNA, 17 bp, Homo sapiens
ccagcccaccccatggc

SEQ ID NO: 3638725 - DNA, 17 bp, Homo sapiens
ccagcccagagccacct

SEQ ID NO: 3638726 - DNA, 13 bp, Homo sapiens
ccagcccagcacc

SEQ ID NO: 3638727 - DNA, 14 bp, Homo sapiens
ccagcccagccagg

SEQ ID NO: 3638728 - DNA, 15 bp, Homo sapiens
ccagccccagccagg

SEQ ID NO: 3638729 - DNA, 16 bp, Homo sapiens
ccagccccagccaggg

SEQ ID NO: 3638730 - DNA, 17 bp, Homo sapiens
ccagccccagccccttc

SEQ ID NO: 3638731 - DNA, 17 bp, Homo sapiens
ccagcccgacagtgcca

SEQ ID NO: 3638732 - DNA, 22 bp, Homo sapiens
ccagcccgacagtgccatcccc

SEQ ID NO: 3638733 - DNA, 22 bp, Homo sapiens
ccagcccggggccagcttggca

SEQ ID NO: 3638734 - DNA, 15 bp, Homo sapiens
ccagccctgggaacc

SEQ ID NO: 3638735 - DNA, 12 bp, Homo sapiens
ccagcccttccc

SEQ ID NO: 3638736 - DNA, 16 bp, Homo sapiens
ccagcctagcctggct

SEQ ID NO: 3638737 - DNA, 20 bp, Homo sapiens
ccagcctagcctggctctgc

SEQ ID NO: 3638738 - DNA, 15 bp, Homo sapiens
ccagcctccatgctg

SEQ ID NO: 3638739 - DNA, 20 bp, Homo sapiens
ccagcctccctgtctccagc

SEQ ID NO: 3638740 - DNA, 24 bp, Homo sapiens
ccagcctccctgtctccagctgcc

SEQ ID NO: 3638741 - DNA, 14 bp, Homo sapiens
ccagcctgcttccc

SEQ ID NO: 3638742 - DNA, 15 bp, Homo sapiens
ccagcctgggagccc

SEQ ID NO: 3638743 - DNA, 19 bp, Homo sapiens
ccagcctgggagcccagag

SEQ ID NO: 3638744 - DNA, 23 bp, Homo sapiens
ccagccttgtacagtctgctcct

SEQ ID NO: 3638745 - DNA, 23 bp, Homo sapiens
ccagcgggaatggcagctgccac

SEQ ID NO: 3638746 - DNA, 18 bp, Homo sapiens
ccagctacacctttctcc

SEQ ID NO: 3638747 - DNA, 14 bp, Homo sapiens
ccagctcacccctg

SEQ ID NO: 3638748 - DNA, 12 bp, Homo sapiens
ccagctcagccc

SEQ ID NO: 3638749 - DNA, 21 bp, Homo sapiens
ccagctcagccctggcctggc

SEQ ID NO: 3638750 - DNA, 20 bp, Homo sapiens
ccagctcaggacagatgcca

SEQ ID NO: 3638751 - DNA, 19 bp, Homo sapiens
ccagctccgtgtttctcta

SEQ ID NO: 3638752 - DNA, 18 bp, Homo sapiens
ccagctctagcctctgga

SEQ ID NO: 3638753 - DNA, 12 bp, Homo sapiens
ccagctctggag

SEQ ID NO: 3638754 - DNA, 17 bp, Homo sapiens
ccagctctgtcctcttg

SEQ ID NO: 3638755 - DNA, 16 bp, Homo sapiens
ccagctgaaggcagtg

SEQ ID NO: 3638756 - DNA, 19 bp, Homo sapiens
ccagctgaaggcagtggca

SEQ ID NO: 3638757 - DNA, 22 bp, Homo sapiens
ccagctgaaggcagtggcaggg

SEQ ID NO: 3638758 - DNA, 14 bp, Homo sapiens
ccagctgactaaac

SEQ ID NO: 3638759 - DNA, 23 bp, Homo sapiens
ccagctgactaaactttttttct

SEQ ID NO: 3638760 - DNA, 14 bp, Homo sapiens
ccagctgcacccct

SEQ ID NO: 3638761 - DNA, 21 bp, Homo sapiens
ccagctgcaccccttcctggg

SEQ ID NO: 3638762 - DNA, 19 bp, Homo sapiens
ccagctgcactgatgctgc

SEQ ID NO: 3638763 - DNA, 19 bp, Homo sapiens
ccagctgcctgggcccgga

SEQ ID NO: 3638764 - DNA, 16 bp, Homo sapiens
ccagcttaaaacactt

SEQ ID NO: 3638765 - DNA, 14 bp, Homo sapiens
ccagcttctctctc

SEQ ID NO: 3638766 - DNA, 15 bp, Homo sapiens
ccagcttctctctcc

SEQ ID NO: 3638767 - DNA, 19 bp, Homo sapiens
ccagcttctctctccaggg

SEQ ID NO: 3638768 - DNA, 20 bp, Homo sapiens
ccagcttctctctccagggt

SEQ ID NO: 3638769 - DNA, 13 bp, Homo sapiens
ccagcttggctca

SEQ ID NO: 3638770 - DNA, 13 bp, Homo sapiens
ccagcttgggcag

SEQ ID NO: 3638771 - DNA, 14 bp, Homo sapiens
ccagcttgggcaga

SEQ ID NO: 3638772 - DNA, 22 bp, Homo sapiens
ccaggaaggccaaaatcaagag

SEQ ID NO: 3638773 - DNA, 14 bp, Homo sapiens
ccaggacgggccac

SEQ ID NO: 3638774 - DNA, 22 bp, Homo sapiens
ccaggacgggccacacgtggct

SEQ ID NO: 3638775 - DNA, 13 bp, Homo sapiens
ccaggactcccag

SEQ ID NO: 3638776 - DNA, 16 bp, Homo sapiens
ccaggactcccagaac

SEQ ID NO: 3638777 - DNA, 21 bp, Homo sapiens
ccaggacttatttaaactctg

SEQ ID NO: 3638778 - DNA, 15 bp, Homo sapiens
ccaggagagagccag

SEQ ID NO: 3638779 - DNA, 23 bp, Homo sapiens
ccaggagagagccaggatgccca

SEQ ID NO: 3638780 - DNA, 15 bp, Homo sapiens
ccaggagagcctggg

SEQ ID NO: 3638781 - DNA, 14 bp, Homo sapiens
ccaggaggcctggg

SEQ ID NO: 3638782 - DNA, 21 bp, Homo sapiens
ccaggagggaggcaggggagg

SEQ ID NO: 3638783 - DNA, 23 bp, Homo sapiens
ccaggatatattttatttttaga

SEQ ID NO: 3638784 - DNA, 15 bp, Homo sapiens
ccaggcaccacagcc

SEQ ID NO: 3638785 - DNA, 12 bp, Homo sapiens
ccaggcagcctc

SEQ ID NO: 3638786 - DNA, 22 bp, Homo sapiens
ccaggcagctatttcagcctcc

SEQ ID NO: 3638787 - DNA, 24 bp, Homo sapiens
ccaggcagctatttcagcctcctg

SEQ ID NO: 3638788 - DNA, 18 bp, Homo sapiens
ccaggcagggagagagta

SEQ ID NO: 3638789 - DNA, 22 bp, Homo sapiens
ccaggcagggagagagtagctg

SEQ ID NO: 3638790 - DNA, 13 bp, Homo sapiens
ccaggccaacagc

SEQ ID NO: 3638791 - DNA, 18 bp, Homo sapiens
ccaggccaacagcacctc

SEQ ID NO: 3638792 - DNA, 15 bp, Homo sapiens
ccaggccagctgcct

SEQ ID NO: 3638793 - DNA, 16 bp, Homo sapiens
ccaggcccctccctct

SEQ ID NO: 3638794 - DNA, 23 bp, Homo sapiens
ccaggccctcagtcttcctgccg

SEQ ID NO: 3638795 - DNA, 17 bp, Homo sapiens
ccaggccgcgcccagca

SEQ ID NO: 3638796 - DNA, 14 bp, Homo sapiens
ccaggcctgtcaag

SEQ ID NO: 3638797 - DNA, 21 bp, Homo sapiens
ccaggccttatctgaaaggcc

SEQ ID NO: 3638798 - DNA, 18 bp, Homo sapiens
ccaggcgccccttccccc

SEQ ID NO: 3638799 - DNA, 16 bp, Homo sapiens
ccaggcgctaattcaa

SEQ ID NO: 3638800 - DNA, 23 bp, Homo sapiens
ccaggctcctacctgtctgctgc

SEQ ID NO: 3638801 - DNA, 22 bp, Homo sapiens
ccaggctcctgaccccgccatg

SEQ ID NO: 3638802 - DNA, 17 bp, Homo sapiens
ccaggctggagtgcaat

SEQ ID NO: 3638803 - DNA, 19 bp, Homo sapiens
ccaggctttctagaaagaa

SEQ ID NO: 3638804 - DNA, 22 bp, Homo sapiens
ccagggaccactgggtgagaga

SEQ ID NO: 3638805 - DNA, 14 bp, Homo sapiens
ccagggaccggcgg

SEQ ID NO: 3638806 - DNA, 14 bp, Homo sapiens
ccagggagaagctc

SEQ ID NO: 3638807 - DNA, 21 bp, Homo sapiens
ccagggagcattttcctccat

SEQ ID NO: 3638808 - DNA, 17 bp, Homo sapiens
ccagggagctctgggga

SEQ ID NO: 3638809 - DNA, 23 bp, Homo sapiens
ccagggagctctggggacagctt

SEQ ID NO: 3638810 - DNA, 13 bp, Homo sapiens
ccagggatgctgg

SEQ ID NO: 3638811 - DNA, 15 bp, Homo sapiens
ccagggcagcaggcc

SEQ ID NO: 3638812 - DNA, 18 bp, Homo sapiens
ccagggcagcaggccaga

SEQ ID NO: 3638813 - DNA, 19 bp, Homo sapiens
ccagggcagcaggccagag

SEQ ID NO: 3638814 - DNA, 22 bp, Homo sapiens
ccagggcagcaggccagagaaa

SEQ ID NO: 3638815 - DNA, 18 bp, Homo sapiens
ccagggcagcggctccac

SEQ ID NO: 3638816 - DNA, 16 bp, Homo sapiens
ccagggcccagagccc

SEQ ID NO: 3638817 - DNA, 21 bp, Homo sapiens
ccagggcccagagcccagctc

SEQ ID NO: 3638818 - DNA, 23 bp, Homo sapiens
ccagggcccagagcccagctcca

SEQ ID NO: 3638819 - DNA, 21 bp, Homo sapiens
ccagggcccccaccgaggttc

SEQ ID NO: 3638820 - DNA, 17 bp, Homo sapiens
ccagggcccctggatct

SEQ ID NO: 3638821 - DNA, 18 bp, Homo sapiens
ccagggcccctggatctc

SEQ ID NO: 3638822 - DNA, 17 bp, Homo sapiens
ccagggcctccagggcc

SEQ ID NO: 3638823 - DNA, 12 bp, Homo sapiens
ccagggcctgac

SEQ ID NO: 3638824 - DNA, 15 bp, Homo sapiens
ccagggcctgcggag

SEQ ID NO: 3638825 - DNA, 18 bp, Homo sapiens
ccagggctggggacagag

SEQ ID NO: 3638826 - DNA, 18 bp, Homo sapiens
ccaggggagatggggagg

SEQ ID NO: 3638827 - DNA, 13 bp, Homo sapiens
ccaggggcctgca

SEQ ID NO: 3638828 - DNA, 14 bp, Homo sapiens
ccaggggcctgcag

SEQ ID NO: 3638829 - DNA, 20 bp, Homo sapiens
ccaggggcctgcagaaggaa

SEQ ID NO: 3638830 - DNA, 21 bp, Homo sapiens
ccaggggcctgcagaaggaaa

SEQ ID NO: 3638831 - DNA, 20 bp, Homo sapiens
ccaggggggtgaggagctgg

SEQ ID NO: 3638832 - DNA, 17 bp, Homo sapiens
ccagggtctctcaggga

SEQ ID NO: 3638833 - DNA, 16 bp, Homo sapiens
ccagggtgacaaggcc

SEQ ID NO: 3638834 - DNA, 18 bp, Homo sapiens
ccagggtgacaaggcctg

SEQ ID NO: 3638835 - DNA, 21 bp, Homo sapiens
ccagggttggcaccttccccc

SEQ ID NO: 3638836 - DNA, 18 bp, Homo sapiens
ccaggtacaggagaggca

SEQ ID NO: 3638837 - DNA, 19 bp, Homo sapiens
ccaggtacaggagaggcag

SEQ ID NO: 3638838 - DNA, 14 bp, Homo sapiens
ccaggtcagcctgg

SEQ ID NO: 3638839 - DNA, 15 bp, Homo sapiens
ccaggtcagcctgga

SEQ ID NO: 3638840 - DNA, 21 bp, Homo sapiens
ccaggtcggagtgcctggagt

SEQ ID NO: 3638841 - DNA, 21 bp, Homo sapiens
ccaggtctgactccaaagctg

SEQ ID NO: 3638842 - DNA, 14 bp, Homo sapiens
ccaggtgcagacct

SEQ ID NO: 3638843 - DNA, 16 bp, Homo sapiens
ccaggtgcagccccag

SEQ ID NO: 3638844 - DNA, 21 bp, Homo sapiens
ccaggtggccactccagaccc

SEQ ID NO: 3638845 - DNA, 14 bp, Homo sapiens
ccaggtttttcaat

SEQ ID NO: 3638846 - DNA, 18 bp, Homo sapiens
cccagcctccaagctcca

SEQ ID NO: 3638847 - DNA, 20 bp, Homo sapiens
cccagcctccaagctccatc

SEQ ID NO: 3638848 - DNA, 18 bp, Homo sapiens
cccagcctccctgaagcc

SEQ ID NO: 3638849 - DNA, 18 bp, Homo sapiens
cccagctgaaggcagtgg

SEQ ID NO: 3638850 - DNA, 12 bp, Homo sapiens
cccagctgcacc

SEQ ID NO: 3638851 - DNA, 14 bp, Homo sapiens
cccagcttgggcag

SEQ ID NO: 3638852 - DNA, 20 bp, Homo sapiens
cccagctttccctgccaggc

SEQ ID NO: 3638853 - DNA, 17 bp, Homo sapiens
cccaggaccagctcagg

SEQ ID NO: 3638854 - DNA, 23 bp, Homo sapiens
cccaggaccctgaaggggccatg

SEQ ID NO: 3638855 - DNA, 14 bp, Homo sapiens
cccaggaggcctgg

SEQ ID NO: 3638856 - DNA, 15 bp, Homo sapiens
cccaggatatatttt

SEQ ID NO: 3638857 - DNA, 17 bp, Homo sapiens
cccaggatatattttat

SEQ ID NO: 3638858 - DNA, 18 bp, Homo sapiens
cccaggccagtcagacgc

SEQ ID NO: 3638859 - DNA, 15 bp, Homo sapiens
cccaggcctgcctgt

SEQ ID NO: 3638860 - DNA, 15 bp, Homo sapiens
cccaggcgcctgcgc

SEQ ID NO: 3638861 - DNA, 18 bp, Homo sapiens
cccaggctagagtgcaat

SEQ ID NO: 3638862 - DNA, 19 bp, Homo sapiens
cccagggagctctggggac

SEQ ID NO: 3638863 - DNA, 19 bp, Homo sapiens
cccagggcccagagcccag

SEQ ID NO: 3638864 - DNA, 14 bp, Homo sapiens
cccagggcctagag

SEQ ID NO: 3638865 - DNA, 15 bp, Homo sapiens
cccagggcctccagg

SEQ ID NO: 3638866 - DNA, 19 bp, Homo sapiens
cccagggcctccagggccc

SEQ ID NO: 3638867 - DNA, 20 bp, Homo sapiens
cccaggggaactggcagcgc

SEQ ID NO: 3638868 - DNA, 16 bp, Homo sapiens
cccaggggagccctcc

SEQ ID NO: 3638869 - DNA, 12 bp, Homo sapiens
cccaggggccgg

SEQ ID NO: 3638870 - DNA, 14 bp, Homo sapiens
cccaggtgcagccc

SEQ ID NO: 3638871 - DNA, 21 bp, Homo sapiens
cccaggtgcagccccagggcc

SEQ ID NO: 3638872 - DNA, 22 bp, Homo sapiens
cccaggtgcagccccagggcct

SEQ ID NO: 3638873 - DNA, 17 bp, Homo sapiens
cccaggttcgagaccca

SEQ ID NO: 3638874 - DNA, 18 bp, Homo sapiens
cccaggttcgagacccaa

SEQ ID NO: 3638875 - DNA, 19 bp, Homo sapiens
cccagtagctgggattaca

SEQ ID NO: 3638876 - DNA, 18 bp, Homo sapiens
cccagtcgaccccaaagg

SEQ ID NO: 3638877 - DNA, 22 bp, Homo sapiens
cccagtctttcttcactctggc

SEQ ID NO: 3638878 - DNA, 20 bp, Homo sapiens
cccagtgccagcaagtcctt

SEQ ID NO: 3638879 - DNA, 14 bp, Homo sapiens
cccagtgcccccac

SEQ ID NO: 3638880 - DNA, 20 bp, Homo sapiens
cccagtgcccccactgacca

SEQ ID NO: 3638881 - DNA, 18 bp, Homo sapiens
cccagtgttatttattcc

SEQ ID NO: 3638882 - DNA, 15 bp, Homo sapiens
cccagttaagtgaag

SEQ ID NO: 3638883 - DNA, 14 bp, Homo sapiens
cccagttcaccctg

SEQ ID NO: 3638884 - DNA, 12 bp, Homo sapiens
cccatatataaa

SEQ ID NO: 3638885 - DNA, 13 bp, Homo sapiens
cccatatataaat

SEQ ID NO: 3638886 - DNA, 15 bp, Homo sapiens
cccatatataaatta

SEQ ID NO: 3638887 - DNA, 18 bp, Homo sapiens
cccatccagacctggctc

SEQ ID NO: 3638888 - DNA, 22 bp, Homo sapiens
cccatccagacctggctccact

SEQ ID NO: 3638889 - DNA, 21 bp, Homo sapiens
cccatccagttcatgagaatc

SEQ ID NO: 3638890 - DNA, 20 bp, Homo sapiens
cccatccctgcctggaggct

SEQ ID NO: 3638891 - DNA, 12 bp, Homo sapiens
cccatccctgct

SEQ ID NO: 3638892 - DNA, 21 bp, Homo sapiens
cccatcctaggaaccagccaa

SEQ ID NO: 3638893 - DNA, 16 bp, Homo sapiens
cccatcctcatccctg

SEQ ID NO: 3638894 - DNA, 17 bp, Homo sapiens
cccatcctcatccctga

SEQ ID NO: 3638895 - DNA, 18 bp, Homo sapiens
cccatcctcatccctgac

SEQ ID NO: 3638896 - DNA, 13 bp, Homo sapiens
cccatcggaagtt

SEQ ID NO: 3638897 - DNA, 21 bp, Homo sapiens
cccatctttgctgccagctct

SEQ ID NO: 3638898 - DNA, 12 bp, Homo sapiens
cccatgcactgt

SEQ ID NO: 3638899 - DNA, 19 bp, Homo sapiens
cccatgcactgtgaaggac

SEQ ID NO: 3638900 - DNA, 14 bp, Homo sapiens
cccatgcatcttcc

SEQ ID NO: 3638901 - DNA, 12 bp, Homo sapiens
cccatgctgcct

SEQ ID NO: 3638902 - DNA, 23 bp, Homo sapiens
cccatgggctgtgtcctaaggcc

SEQ ID NO: 3638903 - DNA, 21 bp, Homo sapiens
cccatggtgggtaggtggttc

SEQ ID NO: 3638904 - DNA, 14 bp, Homo sapiens
cccatgttgtaatg

SEQ ID NO: 3638905 - DNA, 18 bp, Homo sapiens
cccattcccagcctgact

SEQ ID NO: 3638906 - DNA, 12 bp, Homo sapiens
cccattcttcct

SEQ ID NO: 3638907 - DNA, 20 bp, Homo sapiens
cccattggttcacctgtgac

SEQ ID NO: 3638908 - DNA, 15 bp, Homo sapiens
cccattgtccctctg

SEQ ID NO: 3638909 - DNA, 18 bp, Homo sapiens
cccatttagtgtgaatat

SEQ ID NO: 3638910 - DNA, 21 bp, Homo sapiens
cccatttgagaagctgaggct

SEQ ID NO: 3638911 - DNA, 13 bp, Homo sapiens
cccatttgggcag

SEQ ID NO: 3638912 - DNA, 13 bp, Homo sapiens
cccatttttctct

SEQ ID NO: 3638913 - DNA, 15 bp, Homo sapiens
ccccaaaatccaaaa

SEQ ID NO: 3638914 - DNA, 16 bp, Homo sapiens
ccccaaaatccaaaac

SEQ ID NO: 3638915 - DNA, 19 bp, Homo sapiens
ccccaaagactctggaggt

SEQ ID NO: 3638916 - DNA, 15 bp, Homo sapiens
ccccaaaggaacact

SEQ ID NO: 3638917 - DNA, 17 bp, Homo sapiens
ccccaacccctctccag

SEQ ID NO: 3638918 - DNA, 19 bp, Homo sapiens
ccccaacccctctccaggc

SEQ ID NO: 3638919 - DNA, 23 bp, Homo sapiens
ccccaactccaggggcacctatg

SEQ ID NO: 3638920 - DNA, 13 bp, Homo sapiens
ccccaagggccct

SEQ ID NO: 3638921 - DNA, 17 bp, Homo sapiens
ccccaagggccctggca

SEQ ID NO: 3638922 - DNA, 19 bp, Homo sapiens
ccccaagggggctgctgct

SEQ ID NO: 3638923 - DNA, 18 bp, Homo sapiens
ccccacaagctgtccctg

SEQ ID NO: 3638924 - DNA, 22 bp, Homo sapiens
ccccacaagctgtccctgcagg

SEQ ID NO: 3638925 - DNA, 16 bp, Homo sapiens
ccccacatccttctca

SEQ ID NO: 3638926 - DNA, 18 bp, Homo sapiens
ccccaccatctgctgtct

SEQ ID NO: 3638927 - DNA, 19 bp, Homo sapiens
ccccaccatctgctgtctt

SEQ ID NO: 3638928 - DNA, 12 bp, Homo sapiens
ccccaccccatc

SEQ ID NO: 3638929 - DNA, 16 bp, Homo sapiens
ccccacgctgaccatg

SEQ ID NO: 3638930 - DNA, 11 bp, Homo sapiens
ccccactcagt

SEQ ID NO: 3638931 - DNA, 22 bp, Homo sapiens
ccccactcagtgcctccacatg

SEQ ID NO: 3638932 - DNA, 22 bp, Homo sapiens
ccccactcccccgtttctcctt

SEQ ID NO: 3638933 - DNA, 14 bp, Homo sapiens
ccccactcccctca

SEQ ID NO: 3638934 - DNA, 17 bp, Homo sapiens
ccccactcccctcacac

SEQ ID NO: 3638935 - DNA, 14 bp, Homo sapiens
ccccactgaccaga

SEQ ID NO: 3638936 - DNA, 14 bp, Homo sapiens
ccccactgctgagc

SEQ ID NO: 3638937 - DNA, 13 bp, Homo sapiens
ccccactgggaga

SEQ ID NO: 3638938 - DNA, 17 bp, Homo sapiens
ccccactgggagagctg

SEQ ID NO: 3638939 - DNA, 16 bp, Homo sapiens
ccccacttctggccac

SEQ ID NO: 3638940 - DNA, 19 bp, Homo sapiens
ccccagacttctctttctt

SEQ ID NO: 3638941 - DNA, 20 bp, Homo sapiens
ccccagacttctctttctta

SEQ ID NO: 3638942 - DNA, 12 bp, Homo sapiens
ccccagaggccc

SEQ ID NO: 3638943 - DNA, 19 bp, Homo sapiens
ccccagcaacgcccctcca

SEQ ID NO: 3638944 - DNA, 12 bp, Homo sapiens
ccccagccactc

SEQ ID NO: 3638945 - DNA, 21 bp, Homo sapiens
ccccagccactccccagccag

SEQ ID NO: 3638946 - DNA, 16 bp, Homo sapiens
ccccagccagcctggc

SEQ ID NO: 3638947 - DNA, 18 bp, Homo sapiens
ccccagccagcctggctg

SEQ ID NO: 3638948 - DNA, 14 bp, Homo sapiens
ccccagccccaact

SEQ ID NO: 3638949 - DNA, 15 bp, Homo sapiens
ccccagccctgggaa

SEQ ID NO: 3638950 - DNA, 13 bp, Homo sapiens
ccccagcctccct

SEQ ID NO: 3638951 - DNA, 13 bp, Homo sapiens
ccccaggaccagc

SEQ ID NO: 3638952 - DNA, 14 bp, Homo sapiens
ccccaggcagaggg

SEQ ID NO: 3638953 - DNA, 14 bp, Homo sapiens
ccccagggcctcca

SEQ ID NO: 3638954 - DNA, 17 bp, Homo sapiens
ccccagggcctccaggg

SEQ ID NO: 3638955 - DNA, 19 bp, Homo sapiens
ccccagggcctccagggcc

SEQ ID NO: 3638956 - DNA, 13 bp, Homo sapiens
ccccagtgactcc

SEQ ID NO: 3638957 - DNA, 14 bp, Homo sapiens
ccccagtgactcca

SEQ ID NO: 3638958 - DNA, 16 bp, Homo sapiens
ccccatatataaatta

SEQ ID NO: 3638959 - DNA, 13 bp, Homo sapiens
ccccatctctcat

SEQ ID NO: 3638960 - DNA, 15 bp, Homo sapiens
ccccatctctcatcc

SEQ ID NO: 3638961 - DNA, 14 bp, Homo sapiens
ccccatctgagctg

SEQ ID NO: 3638962 - DNA, 19 bp, Homo sapiens
ccccatgcactgtgaagga

SEQ ID NO: 3638963 - DNA, 23 bp, Homo sapiens
ccccatgcactgtgaaggaccct

SEQ ID NO: 3638964 - DNA, 19 bp, Homo sapiens
ccccatggagctgggctaa

SEQ ID NO: 3638965 - DNA, 14 bp, Homo sapiens
ccccatggcagctc

SEQ ID NO: 3638966 - DNA, 17 bp, Homo sapiens
ccccatgggctgtgtcc

SEQ ID NO: 3638967 - DNA, 23 bp, Homo sapiens
ccccatgggctgtgtcctaaggc

SEQ ID NO: 3638968 - DNA, 19 bp, Homo sapiens
ccccatgttgtaatgctgc

SEQ ID NO: 3638969 - DNA, 21 bp, Homo sapiens
ccccatgttgtaatgctgcac

SEQ ID NO: 3638970 - DNA, 22 bp, Homo sapiens
ccccatgttgtaatgctgcact

SEQ ID NO: 3638971 - DNA, 16 bp, Homo sapiens
ccccattcttcctagt

SEQ ID NO: 3638972 - DNA, 13 bp, Homo sapiens
ccccatttcctca

SEQ ID NO: 3638973 - DNA, 19 bp, Homo sapiens
cccccaagctgttttcttc

SEQ ID NO: 3638974 - DNA, 14 bp, Homo sapiens
cccccactccagct

SEQ ID NO: 3638975 - DNA, 12 bp, Homo sapiens
cccccagaaagc

SEQ ID NO: 3638976 - DNA, 19 bp, Homo sapiens
cccccagaaagcctcctgc

SEQ ID NO: 3638977 - DNA, 16 bp, Homo sapiens
cccccagccctgggaa

SEQ ID NO: 3638978 - DNA, 12 bp, Homo sapiens
cccccagggcct

SEQ ID NO: 3638979 - DNA, 19 bp, Homo sapiens
cccccatgctgccttcagg

SEQ ID NO: 3638980 - DNA, 17 bp, Homo sapiens
ccctgtggccctggcca

SEQ ID NO: 3638981 - DNA, 13 bp, Homo sapiens
ccctgttcactct

SEQ ID NO: 3638982 - DNA, 14 bp, Homo sapiens
ccctgttcactcta

SEQ ID NO: 3638983 - DNA, 22 bp, Homo sapiens
ccctgttcactctacttagcat

SEQ ID NO: 3638984 - DNA, 17 bp, Homo sapiens
ccctgttcagctactcc

SEQ ID NO: 3638985 - DNA, 20 bp, Homo sapiens
ccctgttctccctttctctc

SEQ ID NO: 3638986 - DNA, 21 bp, Homo sapiens
ccctgttctccctttctctct

SEQ ID NO: 3638987 - DNA, 22 bp, Homo sapiens
cccttaaacacaggctgtcctt

SEQ ID NO: 3638988 - DNA, 20 bp, Homo sapiens
cccttaccctcctctgctgg

SEQ ID NO: 3638989 - DNA, 22 bp, Homo sapiens
cccttagagggaatctagccca

SEQ ID NO: 3638990 - DNA, 20 bp, Homo sapiens
cccttcaagacgaggggcag

SEQ ID NO: 3638991 - DNA, 20 bp, Homo sapiens
cccttcaggagcctggccag

SEQ ID NO: 3638992 - DNA, 22 bp, Homo sapiens
cccttcaggagcctggccaggc

SEQ ID NO: 3638993 - DNA, 21 bp, Homo sapiens
cccttcatccatcctgagcca

SEQ ID NO: 3638994 - DNA, 18 bp, Homo sapiens
cccttcatccgcctgtgg

SEQ ID NO: 3638995 - DNA, 20 bp, Homo sapiens
cccttccatgtgcctttctt

SEQ ID NO: 3638996 - DNA, 16 bp, Homo sapiens
cccttcccgcctccct

SEQ ID NO: 3638997 - DNA, 13 bp, Homo sapiens
cccttccctggcc

SEQ ID NO: 3638998 - DNA, 15 bp, Homo sapiens
cccttccctggcccc

SEQ ID NO: 3638999 - DNA, 16 bp, Homo sapiens
cccttccctggccccg

SEQ ID NO: 3639000 - DNA, 13 bp, Homo sapiens
cccttccctggga

SEQ ID NO: 3639001 - DNA, 14 bp, Homo sapiens
cccttccctgggag

SEQ ID NO: 3639002 - DNA, 15 bp, Homo sapiens
cccttccctgggagg

SEQ ID NO: 3639003 - DNA, 16 bp, Homo sapiens
cccttccctgtccttg

SEQ ID NO: 3639004 - DNA, 15 bp, Homo sapiens
cccttccggtgcgtg

SEQ ID NO: 3639005 - DNA, 22 bp, Homo sapiens
cccttcctcgtgggtcccagag

SEQ ID NO: 3639006 - DNA, 21 bp, Homo sapiens
cccttcctctccactgccttc

SEQ ID NO: 3639007 - DNA, 17 bp, Homo sapiens
cccttcctggaaacagc

SEQ ID NO: 3639008 - DNA, 19 bp, Homo sapiens
cccttcctggaaacagcat

SEQ ID NO: 3639009 - DNA, 14 bp, Homo sapiens
cccttcctgggcac

SEQ ID NO: 3639010 - DNA, 18 bp, Homo sapiens
cccttcctgggcacacgc

SEQ ID NO: 3639011 - DNA, 13 bp, Homo sapiens
cccttctataccc

SEQ ID NO: 3639012 - DNA, 18 bp, Homo sapiens
cccttctatacccaccca

SEQ ID NO: 3639013 - DNA, 19 bp, Homo sapiens
cccttctatacccacccag

SEQ ID NO: 3639014 - DNA, 15 bp, Homo sapiens
cccttctctgcctca

SEQ ID NO: 3639015 - DNA, 20 bp, Homo sapiens
cccttctcttctaacatgaa

SEQ ID NO: 3639016 - DNA, 16 bp, Homo sapiens
cccttgattcattctg

SEQ ID NO: 3639017 - DNA, 13 bp, Homo sapiens
cccttgctttcct

SEQ ID NO: 3639018 - DNA, 17 bp, Homo sapiens
cccttgctttcctgggc

SEQ ID NO: 3639019 - DNA, 16 bp, Homo sapiens
cccttggacattttat

SEQ ID NO: 3639020 - DNA, 17 bp, Homo sapiens
cccttggaggagagaga

SEQ ID NO: 3639021 - DNA, 22 bp, Homo sapiens
cccttggaggagagagaccccg

SEQ ID NO: 3639022 - DNA, 18 bp, Homo sapiens
ccctttctctctcctctc

SEQ ID NO: 3639023 - DNA, 23 bp, Homo sapiens
ccctttctctctcctctctgctt

SEQ ID NO: 3639024 - DNA, 15 bp, Homo sapiens
cccttttcccccttc

SEQ ID NO: 3639025 - DNA, 23 bp, Homo sapiens
ccgaaagggttaatcatatttga

SEQ ID NO: 3639026 - DNA, 22 bp, Homo sapiens
ccgaagatggtggccacagact

SEQ ID NO: 3639027 - DNA, 23 bp, Homo sapiens
ccgaagatggtggccacagactg

SEQ ID NO: 3639028 - DNA, 18 bp, Homo sapiens
ccgaagccgcctgtggac

SEQ ID NO: 3639029 - DNA, 22 bp, Homo sapiens
ccgacagcctggcacagggcag

SEQ ID NO: 3639030 - DNA, 12 bp, Homo sapiens
ccgacagtgcca

SEQ ID NO: 3639031 - DNA, 15 bp, Homo sapiens
ccgaccaactgccct

SEQ ID NO: 3639032 - DNA, 14 bp, Homo sapiens
ccgaccgggccagg

SEQ ID NO: 3639033 - DNA, 10 bp, Homo sapiens
ccgactcagg

SEQ ID NO: 3639034 - DNA, 18 bp, Homo sapiens
ccgactgactggaggagg

SEQ ID NO: 3639035 - DNA, 22 bp, Homo sapiens
ccgactgactggaggaggcctg

SEQ ID NO: 3639036 - DNA, 13 bp, Homo sapiens
ccgagctctggtg

SEQ ID NO: 3639037 - DNA, 14 bp, Homo sapiens
ccgagctctggtgc

SEQ ID NO: 3639038 - DNA, 17 bp, Homo sapiens
ccgaggtcactctgggc

SEQ ID NO: 3639039 - DNA, 13 bp, Homo sapiens
ccgaggtgggcag

SEQ ID NO: 3639040 - DNA, 14 bp, Homo sapiens
ccgaggttcccagg

SEQ ID NO: 3639041 - DNA, 14 bp, Homo sapiens
ccgagtctccggga

SEQ ID NO: 3639042 - DNA, 14 bp, Homo sapiens
ccgagtctcttctc

SEQ ID NO: 3639043 - DNA, 19 bp, Homo sapiens
ccgagtctcttctccactg

SEQ ID NO: 3639044 - DNA, 15 bp, Homo sapiens
ccgatgtgtctccca

SEQ ID NO: 3639045 - DNA, 18 bp, Homo sapiens
ccgatgtgtctcccagaa

SEQ ID NO: 3639046 - DNA, 20 bp, Homo sapiens
ccgatgtgtctcccagaact

SEQ ID NO: 3639047 - DNA, 22 bp, Homo sapiens
ccgcagaagcctccccagctca

SEQ ID NO: 3639048 - DNA, 17 bp, Homo sapiens
ccgcagacctggagctt

SEQ ID NO: 3639049 - DNA, 19 bp, Homo sapiens
ccgcagacctggagcttca

SEQ ID NO: 3639050 - DNA, 17 bp, Homo sapiens
ccgcagacggtctgtgt

SEQ ID NO: 3639051 - DNA, 23 bp, Homo sapiens
ccgcagacggtctgtgtgctgtt

SEQ ID NO: 3639052 - DNA, 11 bp, Homo sapiens
ccgcagagaaa

SEQ ID NO: 3639053 - DNA, 12 bp, Homo sapiens
ccgcagagaaat

SEQ ID NO: 3639054 - DNA, 18 bp, Homo sapiens
ccgcagagaaatgcccca

SEQ ID NO: 3639055 - DNA, 19 bp, Homo sapiens
ccgcagagaaatgccccag

SEQ ID NO: 3639056 - DNA, 20 bp, Homo sapiens
ccgcaggtgctcatgctgct

SEQ ID NO: 3639057 - DNA, 15 bp, Homo sapiens
ccgcagtgtgcacta

SEQ ID NO: 3639058 - DNA, 22 bp, Homo sapiens
ccgcagtgtgcactaaggggcc

SEQ ID NO: 3639059 - DNA, 13 bp, Homo sapiens
ccgcatgtgcatt

SEQ ID NO: 3639060 - DNA, 17 bp, Homo sapiens
ccgccacggcctggctg

SEQ ID NO: 3639061 - DNA, 20 bp, Homo sapiens
ccgccacggcctggctggtg

SEQ ID NO: 3639062 - DNA, 14 bp, Homo sapiens
ccgccacgtcccag

SEQ ID NO: 3639063 - DNA, 16 bp, Homo sapiens
ccgccacgtcccagca

SEQ ID NO: 3639064 - DNA, 12 bp, Homo sapiens
ccgccagctggg

SEQ ID NO: 3639065 - DNA, 14 bp, Homo sapiens
ccgccagctgggag

SEQ ID NO: 3639066 - DNA, 11 bp, Homo sapiens
ccgccagggct

SEQ ID NO: 3639067 - DNA, 22 bp, Homo sapiens
ccgcccagagacccaagctgcc

SEQ ID NO: 3639068 - DNA, 15 bp, Homo sapiens
ccgccccgccccaga

SEQ ID NO: 3639069 - DNA, 20 bp, Homo sapiens
ccgccgcagaccagctggcg

SEQ ID NO: 3639070 - DNA, 14 bp, Homo sapiens
ccgccgccgccgct

SEQ ID NO: 3639071 - DNA, 21 bp, Homo sapiens
ccgcctccctctcagaggcct

SEQ ID NO: 3639072 - DNA, 20 bp, Homo sapiens
ccgcctcgacctccccaccc

SEQ ID NO: 3639073 - DNA, 23 bp, Homo sapiens
ccgcctcgacctccccacccgct

SEQ ID NO: 3639074 - DNA, 22 bp, Homo sapiens
ccgcctgcttcttctctccaca

SEQ ID NO: 3639075 - DNA, 13 bp, Homo sapiens
ccgccttaccagg

SEQ ID NO: 3639076 - DNA, 14 bp, Homo sapiens
ccgcgcagctgcct

SEQ ID NO: 3639077 - DNA, 17 bp, Homo sapiens
ccgcgcgcccaccctcc

SEQ ID NO: 3639078 - DNA, 16 bp, Homo sapiens
ccgcgcggccgctttg

SEQ ID NO: 3639079 - DNA, 17 bp, Homo sapiens
ccgcggcccgcgcagct

SEQ ID NO: 3639080 - DNA, 21 bp, Homo sapiens
ccgcggcccgcgcagctgcct

SEQ ID NO: 3639081 - DNA, 15 bp, Homo sapiens
ccgcgtcccggcaag

SEQ ID NO: 3639082 - DNA, 22 bp, Homo sapiens
ccgcgtgatcaaagccacactc

SEQ ID NO: 3639083 - DNA, 21 bp, Homo sapiens
ccgctcagccctccctgcccc

SEQ ID NO: 3639084 - DNA, 18 bp, Homo sapiens
ccgctcaggggcctggag

SEQ ID NO: 3639085 - DNA, 20 bp, Homo sapiens
ccgctcaggggcctggaggt

SEQ ID NO: 3639086 - DNA, 22 bp, Homo sapiens
ccgctcccacagcttcctgagg

SEQ ID NO: 3639087 - DNA, 23 bp, Homo sapiens
ccgctcccacagcttcctgaggg

SEQ ID NO: 3639088 - DNA, 18 bp, Homo sapiens
ccgctcccgctcccaggt

SEQ ID NO: 3639089 - DNA, 12 bp, Homo sapiens
ccgctctaaatt

SEQ ID NO: 3639090 - DNA, 12 bp, Homo sapiens
ccgctgccaccc

SEQ ID NO: 3639091 - DNA, 14 bp, Homo sapiens
ccgctgccacccac

SEQ ID NO: 3639092 - DNA, 16 bp, Homo sapiens
ccgctgccacccacct

SEQ ID NO: 3639093 - DNA, 20 bp, Homo sapiens
ccgctgccacccacctccct

SEQ ID NO: 3639094 - DNA, 23 bp, Homo sapiens
ccgctgccacccacctccctgcc

SEQ ID NO: 3639095 - DNA, 20 bp, Homo sapiens
ccgctgtataaagcatgtgg

SEQ ID NO: 3639096 - DNA, 15 bp, Homo sapiens
ccgctgtatgtctta

SEQ ID NO: 3639097 - DNA, 22 bp, Homo sapiens
ccgcttctgaagctgctgcagc

SEQ ID NO: 3639098 - DNA, 17 bp, Homo sapiens
ccgctttgaaagaagca

SEQ ID NO: 3639099 - DNA, 22 bp, Homo sapiens
ccgctttggttttttgtttggt

SEQ ID NO: 3639100 - DNA, 21 bp, Homo sapiens
ccggaaggaatgtcagggcca

SEQ ID NO: 3639101 - DNA, 15 bp, Homo sapiens
ccggagaggtggccg

SEQ ID NO: 3639102 - DNA, 17 bp, Homo sapiens
ccggagggcaggaccct

SEQ ID NO: 3639103 - DNA, 17 bp, Homo sapiens
ccggaggggcctggcag

SEQ ID NO: 3639104 - DNA, 15 bp, Homo sapiens
ccggcagcgggcgga

SEQ ID NO: 3639105 - DNA, 20 bp, Homo sapiens
ccggcagcgggcggagggga

SEQ ID NO: 3639106 - DNA, 14 bp, Homo sapiens
ccggccagctctgg

SEQ ID NO: 3639107 - DNA, 19 bp, Homo sapiens
ccggccaggccgcgcccag

SEQ ID NO: 3639108 - DNA, 21 bp, Homo sapiens
ccggccgccccgccccagagc

SEQ ID NO: 3639109 - DNA, 11 bp, Homo sapiens
ccggcctcctc

SEQ ID NO: 3639110 - DNA, 19 bp, Homo sapiens
ccggcgctgattcctcgtg

SEQ ID NO: 3639111 - DNA, 18 bp, Homo sapiens
ccggcgggtgacagctcc

SEQ ID NO: 3639112 - DNA, 23 bp, Homo sapiens
cctgccccaagtggtgagcaagc

SEQ ID NO: 3639113 - DNA, 17 bp, Homo sapiens
cctgccccagggctccc

SEQ ID NO: 3639114 - DNA, 19 bp, Homo sapiens
cctgccccccctaagagac

SEQ ID NO: 3639115 - DNA, 22 bp, Homo sapiens
cctgccccccctaagagacaca

SEQ ID NO: 3639116 - DNA, 22 bp, Homo sapiens
cctgccccctgggctggggcct

SEQ ID NO: 3639117 - DNA, 23 bp, Homo sapiens
cctgccccgtcggactgccccca

SEQ ID NO: 3639118 - DNA, 16 bp, Homo sapiens
cctgcccctcccttca

SEQ ID NO: 3639119 - DNA, 18 bp, Homo sapiens
cctgcccctgcctgacag

SEQ ID NO: 3639120 - DNA, 15 bp, Homo sapiens
cctgccctctattta

SEQ ID NO: 3639121 - DNA, 21 bp, Homo sapiens
cctgccggttccgcccgccct

SEQ ID NO: 3639122 - DNA, 20 bp, Homo sapiens
cctgcctcagcctccccagt

SEQ ID NO: 3639123 - DNA, 14 bp, Homo sapiens
cctgcctccaccag

SEQ ID NO: 3639124 - DNA, 15 bp, Homo sapiens
cctgcctccaccagc

SEQ ID NO: 3639125 - DNA, 17 bp, Homo sapiens
cctgcctccaccagcaa

SEQ ID NO: 3639126 - DNA, 18 bp, Homo sapiens
cctgcctccaccagcaag

SEQ ID NO: 3639127 - DNA, 13 bp, Homo sapiens
cctgcctggaggc

SEQ ID NO: 3639128 - DNA, 14 bp, Homo sapiens
cctgcctggaggct

SEQ ID NO: 3639129 - DNA, 15 bp, Homo sapiens
cctgcctggaggctc

SEQ ID NO: 3639130 - DNA, 19 bp, Homo sapiens
cctgcctggaggctcctct

SEQ ID NO: 3639131 - DNA, 20 bp, Homo sapiens
cctgcctggaggctcctcta

SEQ ID NO: 3639132 - DNA, 22 bp, Homo sapiens
cctgcctggaggctcctctagg

SEQ ID NO: 3639133 - DNA, 23 bp, Homo sapiens
cctgcctgtgcccgcatgtgtgc

SEQ ID NO: 3639134 - DNA, 20 bp, Homo sapiens
cctgcctgttggcaggccca

SEQ ID NO: 3639135 - DNA, 18 bp, Homo sapiens
cctgcctttaagccaaag

SEQ ID NO: 3639136 - DNA, 20 bp, Homo sapiens
cctgcctttaagccaaagaa

SEQ ID NO: 3639137 - DNA, 22 bp, Homo sapiens
cctgcctttaagccaaagaaac

SEQ ID NO: 3639138 - DNA, 11 bp, Homo sapiens
cctgcctttta

SEQ ID NO: 3639139 - DNA, 18 bp, Homo sapiens
cctgcgagacgcacacag

SEQ ID NO: 3639140 - DNA, 19 bp, Homo sapiens
cctgctcagccctgcacca

SEQ ID NO: 3639141 - DNA, 20 bp, Homo sapiens
cctgctcagccctgcaccat

SEQ ID NO: 3639142 - DNA, 16 bp, Homo sapiens
cctgctccaccagcag

SEQ ID NO: 3639143 - DNA, 18 bp, Homo sapiens
cctgctccaccagcagca

SEQ ID NO: 3639144 - DNA, 22 bp, Homo sapiens
cctgctccaccagcagcatggc

SEQ ID NO: 3639145 - DNA, 16 bp, Homo sapiens
cctgctccagaagatg

SEQ ID NO: 3639146 - DNA, 22 bp, Homo sapiens
cctgctccagaagatgccagct

SEQ ID NO: 3639147 - DNA, 12 bp, Homo sapiens
cctgctccagac

SEQ ID NO: 3639148 - DNA, 14 bp, Homo sapiens
cctgctccagacct

SEQ ID NO: 3639149 - DNA, 22 bp, Homo sapiens
cctgctccagacctgatcctgg

SEQ ID NO: 3639150 - DNA, 23 bp, Homo sapiens
cctgctccttggcacccccatgc

SEQ ID NO: 3639151 - DNA, 22 bp, Homo sapiens
cctgctctcctcttgccactgc

SEQ ID NO: 3639152 - DNA, 13 bp, Homo sapiens
cctgctgaatgcc

SEQ ID NO: 3639153 - DNA, 23 bp, Homo sapiens
cctgctgaatgcctcgctccctt

SEQ ID NO: 3639154 - DNA, 11 bp, Homo sapiens
cctgctgcacc

SEQ ID NO: 3639155 - DNA, 12 bp, Homo sapiens
cctgctgcaccc

SEQ ID NO: 3639156 - DNA, 15 bp, Homo sapiens
cctgctgcaccctgc

SEQ ID NO: 3639157 - DNA, 20 bp, Homo sapiens
cctgctgcaccctgcgcctc

SEQ ID NO: 3639158 - DNA, 22 bp, Homo sapiens
cctgctgcaccctgcgcctcca

SEQ ID NO: 3639159 - DNA, 16 bp, Homo sapiens
cctgctgccagtgcag

SEQ ID NO: 3639160 - DNA, 22 bp, Homo sapiens
cctgctgccagtgcagccactg

SEQ ID NO: 3639161 - DNA, 15 bp, Homo sapiens
cctgctgcgctgctt

SEQ ID NO: 3639162 - DNA, 18 bp, Homo sapiens
cctgctgcgctgcttggt

SEQ ID NO: 3639163 - DNA, 20 bp, Homo sapiens
cctgctgtgccatgctgggc

SEQ ID NO: 3639164 - DNA, 15 bp, Homo sapiens
cctgctgtgctgctc

SEQ ID NO: 3639165 - DNA, 17 bp, Homo sapiens
cctgctgtgctgctcaa

SEQ ID NO: 3639166 - DNA, 15 bp, Homo sapiens
cctgcttccaggcct

SEQ ID NO: 3639167 - DNA, 12 bp, Homo sapiens
cctgcttcccac

SEQ ID NO: 3639168 - DNA, 17 bp, Homo sapiens
cctgcttgactttccag

SEQ ID NO: 3639169 - DNA, 23 bp, Homo sapiens
cctgcttgactttccagaatgac

SEQ ID NO: 3639170 - DNA, 15 bp, Homo sapiens
cctgcttgcccgctc

SEQ ID NO: 3639171 - DNA, 12 bp, Homo sapiens
cctgcttttcaa

SEQ ID NO: 3639172 - DNA, 14 bp, Homo sapiens
cctgcttttctgtc

SEQ ID NO: 3639173 - DNA, 15 bp, Homo sapiens
cctgcttttctgtcc

SEQ ID NO: 3639174 - DNA, 16 bp, Homo sapiens
cctggaaacagcatga

SEQ ID NO: 3639175 - DNA, 17 bp, Homo sapiens
cctggaaacagcatgaa

SEQ ID NO: 3639176 - DNA, 21 bp, Homo sapiens
cctggaaacagcatgaataaa

SEQ ID NO: 3639177 - DNA, 14 bp, Homo sapiens
cctggaaaccttcc

SEQ ID NO: 3639178 - DNA, 18 bp, Homo sapiens
cctggaaaccttccaccc

SEQ ID NO: 3639179 - DNA, 15 bp, Homo sapiens
cctggaactcctggc

SEQ ID NO: 3639180 - DNA, 16 bp, Homo sapiens
cctggaacttggggag

SEQ ID NO: 3639181 - DNA, 22 bp, Homo sapiens
cctggaagctctccgagctctg

SEQ ID NO: 3639182 - DNA, 20 bp, Homo sapiens
cctggaaggacatccatgtt

SEQ ID NO: 3639183 - DNA, 11 bp, Homo sapiens
cctggacacag

SEQ ID NO: 3639184 - DNA, 18 bp, Homo sapiens
cctggacacagctcttca

SEQ ID NO: 3639185 - DNA, 15 bp, Homo sapiens
cctggactagaggga

SEQ ID NO: 3639186 - DNA, 16 bp, Homo sapiens
cctggagaactagaga

SEQ ID NO: 3639187 - DNA, 13 bp, Homo sapiens
cctggagaagtag

SEQ ID NO: 3639188 - DNA, 22 bp, Homo sapiens
cctggagagtacatttgcttta

SEQ ID NO: 3639189 - DNA, 17 bp, Homo sapiens
cctggagcaggagcccc

SEQ ID NO: 3639190 - DNA, 12 bp, Homo sapiens
cctggagcaggc

SEQ ID NO: 3639191 - DNA, 16 bp, Homo sapiens
cctggagcaggcccaa

SEQ ID NO: 3639192 - DNA, 23 bp, Homo sapiens
cctggagcaggcccaatgctgct

SEQ ID NO: 3639193 - DNA, 19 bp, Homo sapiens
cctggagcttcagccaggt

SEQ ID NO: 3639194 - DNA, 13 bp, Homo sapiens
cctggaggcaggg

SEQ ID NO: 3639195 - DNA, 20 bp, Homo sapiens
cctggaggcagggggtgagg

SEQ ID NO: 3639196 - DNA, 12 bp, Homo sapiens
cctggaggccca

SEQ ID NO: 3639197 - DNA, 14 bp, Homo sapiens
cctggaggtgggca

SEQ ID NO: 3639198 - DNA, 17 bp, Homo sapiens
cctggatccagcactgg

SEQ ID NO: 3639199 - DNA, 20 bp, Homo sapiens
cctggatctcctcccttacc

SEQ ID NO: 3639200 - DNA, 14 bp, Homo sapiens
cctggatgcccagg

SEQ ID NO: 3639201 - DNA, 15 bp, Homo sapiens
cctggatgctgttga

SEQ ID NO: 3639202 - DNA, 18 bp, Homo sapiens
cctggattaccagggact

SEQ ID NO: 3639203 - DNA, 23 bp, Homo sapiens
cctggattgcgcctaatgtgttt

SEQ ID NO: 3639204 - DNA, 18 bp, Homo sapiens
cctggattggttggcaaa

SEQ ID NO: 3639205 - DNA, 19 bp, Homo sapiens
cctggcaaatgcctgactc

SEQ ID NO: 3639206 - DNA, 17 bp, Homo sapiens
cctggcaacagagcgag

SEQ ID NO: 3639207 - DNA, 22 bp, Homo sapiens
cctggcacaatgttggagcagc

SEQ ID NO: 3639208 - DNA, 18 bp, Homo sapiens
cctggcacagggcagtgg

SEQ ID NO: 3639209 - DNA, 18 bp, Homo sapiens
cctggcacccccacaagc

SEQ ID NO: 3639210 - DNA, 21 bp, Homo sapiens
cctggcagccgtgccttcagc

SEQ ID NO: 3639211 - DNA, 12 bp, Homo sapiens
cctggcagctct

SEQ ID NO: 3639212 - DNA, 20 bp, Homo sapiens
cctggcagctctggacagcc

SEQ ID NO: 3639213 - DNA, 23 bp, Homo sapiens
cctggcagctctggacagcccca

SEQ ID NO: 3639214 - DNA, 12 bp, Homo sapiens
cctggcagctgc

SEQ ID NO: 3639215 - DNA, 13 bp, Homo sapiens
cctggcagctgct

SEQ ID NO: 3639216 - DNA, 17 bp, Homo sapiens
cctggcagctgctgtgg

SEQ ID NO: 3639217 - DNA, 19 bp, Homo sapiens
cctggcagggacctgagag

SEQ ID NO: 3639218 - DNA, 14 bp, Homo sapiens
cctggcagggccac

SEQ ID NO: 3639219 - DNA, 16 bp, Homo sapiens
cctggccactaaagct

SEQ ID NO: 3639220 - DNA, 21 bp, Homo sapiens
cctggccactaaagcttcaga

SEQ ID NO: 3639221 - DNA, 23 bp, Homo sapiens
cctggccagacacaggccctccc

SEQ ID NO: 3639222 - DNA, 15 bp, Homo sapiens
cctggccaggaccct

SEQ ID NO: 3639223 - DNA, 13 bp, Homo sapiens
cctggccaggcag

SEQ ID NO: 3639224 - DNA, 15 bp, Homo sapiens
cctggccaggcaggg

SEQ ID NO: 3639225 - DNA, 18 bp, Homo sapiens
cctggccaggcagggaga

SEQ ID NO: 3639226 - DNA, 15 bp, Homo sapiens
cctggccatcccaca

SEQ ID NO: 3639227 - DNA, 17 bp, Homo sapiens
cctggcctgaactgagg

SEQ ID NO: 3639228 - DNA, 13 bp, Homo sapiens
cctggcctggctg

SEQ ID NO: 3639229 - DNA, 22 bp, Homo sapiens
cctggccttgggatccaggccc

SEQ ID NO: 3639230 - DNA, 14 bp, Homo sapiens
cctggctcactggc

SEQ ID NO: 3639231 - DNA, 21 bp, Homo sapiens
cctggctccactcttgatctc

SEQ ID NO: 3639232 - DNA, 22 bp, Homo sapiens
cctggctccactcttgatctct

SEQ ID NO: 3639233 - DNA, 13 bp, Homo sapiens
cctggctctgccc

SEQ ID NO: 3639234 - DNA, 12 bp, Homo sapiens
cctggctgtaaa

SEQ ID NO: 3639235 - DNA, 13 bp, Homo sapiens
cctggctttgcct

SEQ ID NO: 3639236 - DNA, 15 bp, Homo sapiens
cctggctttgcctct

SEQ ID NO: 3639237 - DNA, 16 bp, Homo sapiens
cctggctttgcctctt

SEQ ID NO: 3639238 - DNA, 17 bp, Homo sapiens
cctggctttgcctcttc

SEQ ID NO: 3639239 - DNA, 18 bp, Homo sapiens
cctggctttgcctcttct

SEQ ID NO: 3639240 - DNA, 19 bp, Homo sapiens
cctggctttgcctcttctt

SEQ ID NO: 3639241 - DNA, 13 bp, Homo sapiens
cctgggaacacag

SEQ ID NO: 3639242 - DNA, 21 bp, Homo sapiens
cctgggaacacagttctgggc

SEQ ID NO: 3639243 - DNA, 19 bp, Homo sapiens
cctgggaacacatctggct

SEQ ID NO: 3639244 - DNA, 18 bp, Homo sapiens
cgagaagtgctcttggct

SEQ ID NO: 3639245 - DNA, 14 bp, Homo sapiens
cgagaccagcctgg

SEQ ID NO: 3639246 - DNA, 15 bp, Homo sapiens
cgagaccagcctggc

SEQ ID NO: 3639247 - DNA, 16 bp, Homo sapiens
cgagaccagcctggcc

SEQ ID NO: 3639248 - DNA, 23 bp, Homo sapiens
cgagatttgccaggggcatccaa

SEQ ID NO: 3639249 - DNA, 15 bp, Homo sapiens
cgagcagcccagggc

SEQ ID NO: 3639250 - DNA, 15 bp, Homo sapiens
cgagcccaggcagct

SEQ ID NO: 3639251 - DNA, 13 bp, Homo sapiens
cgaggaaaggatt

SEQ ID NO: 3639252 - DNA, 18 bp, Homo sapiens
cgaggccacattgctggc

SEQ ID NO: 3639253 - DNA, 19 bp, Homo sapiens
cgaggccacattgctggct

SEQ ID NO: 3639254 - DNA, 21 bp, Homo sapiens
cgaggccacattgctggctgc

SEQ ID NO: 3639255 - DNA, 16 bp, Homo sapiens
cgaggctccctcttcc

SEQ ID NO: 3639256 - DNA, 19 bp, Homo sapiens
cgagggatgatgagggaag

SEQ ID NO: 3639257 - DNA, 13 bp, Homo sapiens
cgaggggcaggga

SEQ ID NO: 3639258 - DNA, 20 bp, Homo sapiens
cgagggtctcccctcctgca

SEQ ID NO: 3639259 - DNA, 18 bp, Homo sapiens
cgagtaaagtctgggcca

SEQ ID NO: 3639260 - DNA, 16 bp, Homo sapiens
cgagtctcttctccac

SEQ ID NO: 3639261 - DNA, 17 bp, Homo sapiens
cgagtctcttctccact

SEQ ID NO: 3639262 - DNA, 13 bp, Homo sapiens
cgatatttattga

SEQ ID NO: 3639263 - DNA, 19 bp, Homo sapiens
cgatgcccgcccggggagt

SEQ ID NO: 3639264 - DNA, 16 bp, Homo sapiens
cgatgtgtctcccaga

SEQ ID NO: 3639265 - DNA, 15 bp, Homo sapiens
cgatgttgtattgat

SEQ ID NO: 3639266 - DNA, 17 bp, Homo sapiens
cgcaatagttttttact

SEQ ID NO: 3639267 - DNA, 16 bp, Homo sapiens
cgcacacagctgagca

SEQ ID NO: 3639268 - DNA, 16 bp, Homo sapiens
cgcacatggtgtgggg

SEQ ID NO: 3639269 - DNA, 19 bp, Homo sapiens
cgcaccattgcactccagc

SEQ ID NO: 3639270 - DNA, 16 bp, Homo sapiens
cgcaccattttgtcag

SEQ ID NO: 3639271 - DNA, 24 bp, Homo sapiens
cgcacgcggatgctactactgcag

SEQ ID NO: 3639272 - DNA, 20 bp, Homo sapiens
cgcactctccccgctcaggg

SEQ ID NO: 3639273 - DNA, 19 bp, Homo sapiens
cgcagaccagctggcgggt

SEQ ID NO: 3639274 - DNA, 18 bp, Homo sapiens
cgcagacggtctgtgtgc

SEQ ID NO: 3639275 - DNA, 23 bp, Homo sapiens
cgcagacggtctgtgtgctgttt

SEQ ID NO: 3639276 - DNA, 22 bp, Homo sapiens
cgcagatttttatgttttgaaa

SEQ ID NO: 3639277 - DNA, 15 bp, Homo sapiens
cgcagccctgctttg

SEQ ID NO: 3639278 - DNA, 17 bp, Homo sapiens
cgcaggcagcgcagggc

SEQ ID NO: 3639279 - DNA, 17 bp, Homo sapiens
cgcagttgtagcagaaa

SEQ ID NO: 3639280 - DNA, 19 bp, Homo sapiens
cgccaaggaggtgggccac

SEQ ID NO: 3639281 - DNA, 13 bp, Homo sapiens
cgccaccatgccc

SEQ ID NO: 3639282 - DNA, 14 bp, Homo sapiens
cgccacggcctggc

SEQ ID NO: 3639283 - DNA, 15 bp, Homo sapiens
cgccacgtcccagca

SEQ ID NO: 3639284 - DNA, 14 bp, Homo sapiens
cgccagctgggagc

SEQ ID NO: 3639285 - DNA, 19 bp, Homo sapiens
cgccagctgggagcactgg

SEQ ID NO: 3639286 - DNA, 17 bp, Homo sapiens
cgccaggcaccacagcc

SEQ ID NO: 3639287 - DNA, 11 bp, Homo sapiens
cgccagggctg

SEQ ID NO: 3639288 - DNA, 14 bp, Homo sapiens
cgccagggctgggg

SEQ ID NO: 3639289 - DNA, 14 bp, Homo sapiens
cgcccagcagaggc

SEQ ID NO: 3639290 - DNA, 16 bp, Homo sapiens
cgccccatccctgctt

SEQ ID NO: 3639291 - DNA, 18 bp, Homo sapiens
cgccccatccctgcttgc

SEQ ID NO: 3639292 - DNA, 18 bp, Homo sapiens
cgcccctccaaacctcca

SEQ ID NO: 3639293 - DNA, 14 bp, Homo sapiens
cgcccctgtggcca

SEQ ID NO: 3639294 - DNA, 13 bp, Homo sapiens
cgccccttccccc

SEQ ID NO: 3639295 - DNA, 17 bp, Homo sapiens
cgcccgtggcctcgtgc

SEQ ID NO: 3639296 - DNA, 14 bp, Homo sapiens
cgccctcccggaga

SEQ ID NO: 3639297 - DNA, 20 bp, Homo sapiens
cgccctggtaaggctggtga

SEQ ID NO: 3639298 - DNA, 15 bp, Homo sapiens
cgcccttccatgtgc

SEQ ID NO: 3639299 - DNA, 13 bp, Homo sapiens
cgccgcagaccag

SEQ ID NO: 3639300 - DNA, 16 bp, Homo sapiens
cgccgccgccgctgcc

SEQ ID NO: 3639301 - DNA, 15 bp, Homo sapiens
cgccgccgctgccct

SEQ ID NO: 3639302 - DNA, 20 bp, Homo sapiens
cgccgtccggcggccccgcc

SEQ ID NO: 3639303 - DNA, 16 bp, Homo sapiens
cgccgtgtctcagcct

SEQ ID NO: 3639304 - DNA, 22 bp, Homo sapiens
cgcctacccttcccgcctccct

SEQ ID NO: 3639305 - DNA, 13 bp, Homo sapiens
cgcctcaaaatgt

SEQ ID NO: 3639306 - DNA, 18 bp, Homo sapiens
cgcctcgacctccccacc

SEQ ID NO: 3639307 - DNA, 17 bp, Homo sapiens
cgcctcggtatctggct

SEQ ID NO: 3639308 - DNA, 13 bp, Homo sapiens
cgcctctgcattc

SEQ ID NO: 3639309 - DNA, 17 bp, Homo sapiens
cgcctgaggcaattaga

SEQ ID NO: 3639310 - DNA, 12 bp, Homo sapiens
cgcctgcctgca

SEQ ID NO: 3639311 - DNA, 18 bp, Homo sapiens
cgcctgcctgcagcaggc

SEQ ID NO: 3639312 - DNA, 20 bp, Homo sapiens
cgccttctcccacatgaggc

SEQ ID NO: 3639313 - DNA, 22 bp, Homo sapiens
cgcggacccttctgggtccagg

SEQ ID NO: 3639314 - DNA, 15 bp, Homo sapiens
cgcggccgcctttgc

SEQ ID NO: 3639315 - DNA, 20 bp, Homo sapiens
cgctactatgatttaatttg

SEQ ID NO: 3639316 - DNA, 22 bp, Homo sapiens
cgctagagtaaaagtcccagtt

SEQ ID NO: 3639317 - DNA, 14 bp, Homo sapiens
cgctcaggggcctg

SEQ ID NO: 3639318 - DNA, 17 bp, Homo sapiens
cgctcaggggcctggag

SEQ ID NO: 3639319 - DNA, 20 bp, Homo sapiens
cgctcccaggttcccccagc

SEQ ID NO: 3639320 - DNA, 15 bp, Homo sapiens
cgctcccgctcccag

SEQ ID NO: 3639321 - DNA, 14 bp, Homo sapiens
cgctcgcccagcag

SEQ ID NO: 3639322 - DNA, 18 bp, Homo sapiens
cgctcgcccagcaggaga

SEQ ID NO: 3639323 - DNA, 20 bp, Homo sapiens
cgctcgcccagcaggagaga

SEQ ID NO: 3639324 - DNA, 21 bp, Homo sapiens
cgctcttggcaggtactcagc

SEQ ID NO: 3639325 - DNA, 18 bp, Homo sapiens
cgctgaggggtctcggat

SEQ ID NO: 3639326 - DNA, 18 bp, Homo sapiens
cgctgcccttgggtcccc

SEQ ID NO: 3639327 - DNA, 20 bp, Homo sapiens
cgctggaatccagaaggaag

SEQ ID NO: 3639328 - DNA, 22 bp, Homo sapiens
cgctggaatccagaaggaagct

SEQ ID NO: 3639329 - DNA, 14 bp, Homo sapiens
cgctggccctgccg

SEQ ID NO: 3639330 - DNA, 12 bp, Homo sapiens
cgctgtctctga

SEQ ID NO: 3639331 - DNA, 20 bp, Homo sapiens
cgcttctgaagctgctgcag

SEQ ID NO: 3639332 - DNA, 15 bp, Homo sapiens
cgcttctgccttttc

SEQ ID NO: 3639333 - DNA, 14 bp, Homo sapiens
cgctttgaaagaag

SEQ ID NO: 3639334 - DNA, 12 bp, Homo sapiens
cggaaggaggcc

SEQ ID NO: 3639335 - DNA, 22 bp, Homo sapiens
cggacagtccgcagttgtagca

SEQ ID NO: 3639336 - DNA, 20 bp, Homo sapiens
cggacatgcttttctgccac

SEQ ID NO: 3639337 - DNA, 21 bp, Homo sapiens
cggacatgcttttctgccact

SEQ ID NO: 3639338 - DNA, 20 bp, Homo sapiens
cggaccatctttagcagttt

SEQ ID NO: 3639339 - DNA, 22 bp, Homo sapiens
cggacccttctgggtccaggga

SEQ ID NO: 3639340 - DNA, 23 bp, Homo sapiens
cggacccttctgggtccagggag

SEQ ID NO: 3639341 - DNA, 15 bp, Homo sapiens
cggagagcagcagca

SEQ ID NO: 3639342 - DNA, 16 bp, Homo sapiens
cggagagcagcagcac

SEQ ID NO: 3639343 - DNA, 21 bp, Homo sapiens
cggagaggtggccgccatgct

SEQ ID NO: 3639344 - DNA, 22 bp, Homo sapiens
cggagatagatgactttgcaga

SEQ ID NO: 3639345 - DNA, 16 bp, Homo sapiens
cggagcaaactctgct

SEQ ID NO: 3639346 - DNA, 17 bp, Homo sapiens
cggagcaaactctgctg

SEQ ID NO: 3639347 - DNA, 23 bp, Homo sapiens
cggagcagaagacgtctcccctt

SEQ ID NO: 3639348 - DNA, 13 bp, Homo sapiens
cggagcccagcct

SEQ ID NO: 3639349 - DNA, 15 bp, Homo sapiens
cggagcccagcctgg

SEQ ID NO: 3639350 - DNA, 22 bp, Homo sapiens
cggagcccagcctgggagccca

SEQ ID NO: 3639351 - DNA, 13 bp, Homo sapiens
cggaggctgctcg

SEQ ID NO: 3639352 - DNA, 22 bp, Homo sapiens
cggagggtgccgtgcgggcgag

SEQ ID NO: 3639353 - DNA, 16 bp, Homo sapiens
cggaggtctctgggag

SEQ ID NO: 3639354 - DNA, 13 bp, Homo sapiens
cggagtgcctgga

SEQ ID NO: 3639355 - DNA, 14 bp, Homo sapiens
cggatcctgctggg

SEQ ID NO: 3639356 - DNA, 19 bp, Homo sapiens
cggatgacaccctggcctg

SEQ ID NO: 3639357 - DNA, 20 bp, Homo sapiens
cggatgacaccctggcctga

SEQ ID NO: 3639358 - DNA, 16 bp, Homo sapiens
cggattattttttcag

SEQ ID NO: 3639359 - DNA, 20 bp, Homo sapiens
cggattattttttcagaccg

SEQ ID NO: 3639360 - DNA, 20 bp, Homo sapiens
cggcaacgtagcctgggctc

SEQ ID NO: 3639361 - DNA, 15 bp, Homo sapiens
cggcagcgggcggag

SEQ ID NO: 3639362 - DNA, 22 bp, Homo sapiens
cggccatctctttgtacaggaa

SEQ ID NO: 3639363 - DNA, 13 bp, Homo sapiens
cggccccatctct

SEQ ID NO: 3639364 - DNA, 22 bp, Homo sapiens
cggccccccgcgctcgcccagc

SEQ ID NO: 3639365 - DNA, 15 bp, Homo sapiens
cggccccgccgcaga

SEQ ID NO: 3639366 - DNA, 17 bp, Homo sapiens
cggccccgtctgtggct

SEQ ID NO: 3639367 - DNA, 15 bp, Homo sapiens
cggcccgcgcagctg

SEQ ID NO: 3639368 - DNA, 18 bp, Homo sapiens
cggccgccccgccccaga

SEQ ID NO: 3639369 - DNA, 15 bp, Homo sapiens
cggccgcccggcagt

SEQ ID NO: 3639370 - DNA, 16 bp, Homo sapiens
cggccgcccggcagtg

SEQ ID NO: 3639371 - DNA, 14 bp, Homo sapiens
cggcctcccaaagt

SEQ ID NO: 3639372 - DNA, 14 bp, Homo sapiens
cggcctcccagagt

SEQ ID NO: 3639373 - DNA, 23 bp, Homo sapiens
cggcctcctcggagagcagcagc

SEQ ID NO: 3639374 - DNA, 18 bp, Homo sapiens
cggcggcttcgcgctgga

SEQ ID NO: 3639375 - DNA, 17 bp, Homo sapiens
cggcgggatcctccaca

SEQ ID NO: 3639376 - DNA, 14 bp, Homo sapiens
cggcgggtgacagc

SEQ ID NO: 3639377 - DNA, 20 bp, Homo sapiens
ctattattttcactgtagaa

SEQ ID NO: 3639378 - DNA, 16 bp, Homo sapiens
ctattcaaacagtctc

SEQ ID NO: 3639379 - DNA, 18 bp, Homo sapiens
ctattcaaacagtctcag

SEQ ID NO: 3639380 - DNA, 21 bp, Homo sapiens
ctattctgatgaatctcaaag

SEQ ID NO: 3639381 - DNA, 18 bp, Homo sapiens
ctattgatactctttcta

SEQ ID NO: 3639382 - DNA, 18 bp, Homo sapiens
ctattgctgctgcccctt

SEQ ID NO: 3639383 - DNA, 15 bp, Homo sapiens
ctatttaaaaaatga

SEQ ID NO: 3639384 - DNA, 21 bp, Homo sapiens
ctatttaaagaaatatgtatt

SEQ ID NO: 3639385 - DNA, 16 bp, Homo sapiens
ctatttattagccaac

SEQ ID NO: 3639386 - DNA, 12 bp, Homo sapiens
ctatttatttat

SEQ ID NO: 3639387 - DNA, 15 bp, Homo sapiens
ctatttatttgaggt

SEQ ID NO: 3639388 - DNA, 20 bp, Homo sapiens
ctatttcaatacttacatat

SEQ ID NO: 3639389 - DNA, 16 bp, Homo sapiens
ctatttcagcctcctg

SEQ ID NO: 3639390 - DNA, 20 bp, Homo sapiens
ctatttcccccttcatccat

SEQ ID NO: 3639391 - DNA, 22 bp, Homo sapiens
ctatttgaccagaactttttcc

SEQ ID NO: 3639392 - DNA, 14 bp, Homo sapiens
ctattttaattact

SEQ ID NO: 3639393 - DNA, 22 bp, Homo sapiens
ctattttgaatgcagaaaacag

SEQ ID NO: 3639394 - DNA, 16 bp, Homo sapiens
ctattttgtaactgta

SEQ ID NO: 3639395 - DNA, 15 bp, Homo sapiens
ctatttttatacact

SEQ ID NO: 3639396 - DNA, 23 bp, Homo sapiens
ctatttttatacactgtaagctt

SEQ ID NO: 3639397 - DNA, 11 bp, Homo sapiens
ctatttttcct

SEQ ID NO: 3639398 - DNA, 14 bp, Homo sapiens
ctcaaaacaaaaca

SEQ ID NO: 3639399 - DNA, 17 bp, Homo sapiens
ctcaaaacgggtcagta

SEQ ID NO: 3639400 - DNA, 19 bp, Homo sapiens
ctcaaaacgggtcagtatt

SEQ ID NO: 3639401 - DNA, 17 bp, Homo sapiens
ctcaaaactgcactgtc

SEQ ID NO: 3639402 - DNA, 18 bp, Homo sapiens
ctcaaaatatttgtacat

SEQ ID NO: 3639403 - DNA, 13 bp, Homo sapiens
ctcaaactcctga

SEQ ID NO: 3639404 - DNA, 13 bp, Homo sapiens
ctcaaactgcaca

SEQ ID NO: 3639405 - DNA, 16 bp, Homo sapiens
ctcaaagaaagtgtat

SEQ ID NO: 3639406 - DNA, 19 bp, Homo sapiens
ctcaaatgctcagaccagc

SEQ ID NO: 3639407 - DNA, 22 bp, Homo sapiens
ctcaaatgctcagaccagctct

SEQ ID NO: 3639408 - DNA, 14 bp, Homo sapiens
ctcaacccccctcc

SEQ ID NO: 3639409 - DNA, 22 bp, Homo sapiens
ctcaacccccctcccagacagg

SEQ ID NO: 3639410 - DNA, 16 bp, Homo sapiens
ctcaacgcctccccct

SEQ ID NO: 3639411 - DNA, 12 bp, Homo sapiens
ctcaagccctga

SEQ ID NO: 3639412 - DNA, 22 bp, Homo sapiens
ctcaagctggtggcctctgcag

SEQ ID NO: 3639413 - DNA, 14 bp, Homo sapiens
ctcaaggctaattt

SEQ ID NO: 3639414 - DNA, 16 bp, Homo sapiens
ctcaagggctggcact

SEQ ID NO: 3639415 - DNA, 13 bp, Homo sapiens
ctcaagtaaaaca

SEQ ID NO: 3639416 - DNA, 16 bp, Homo sapiens
ctcaagtaaaagaaaa

SEQ ID NO: 3639417 - DNA, 22 bp, Homo sapiens
ctcaagtacccattctgttttc

SEQ ID NO: 3639418 - DNA, 16 bp, Homo sapiens
ctcaagtgatcctcac

SEQ ID NO: 3639419 - DNA, 14 bp, Homo sapiens
ctcaatgcccagta

SEQ ID NO: 3639420 - DNA, 16 bp, Homo sapiens
ctcaatgcccagtaaa

SEQ ID NO: 3639421 - DNA, 17 bp, Homo sapiens
ctcaatgcccagtaaaa

SEQ ID NO: 3639422 - DNA, 16 bp, Homo sapiens
ctcaatgcttaggaga

SEQ ID NO: 3639423 - DNA, 14 bp, Homo sapiens
ctcaatttcagcac

SEQ ID NO: 3639424 - DNA, 23 bp, Homo sapiens
ctcaattttatccctcacctgta

SEQ ID NO: 3639425 - DNA, 23 bp, Homo sapiens
ctcacaacttagtgtaatatacc

SEQ ID NO: 3639426 - DNA, 14 bp, Homo sapiens
ctcacaaggcccag

SEQ ID NO: 3639427 - DNA, 15 bp, Homo sapiens
ctcacaaggcccagg

SEQ ID NO: 3639428 - DNA, 16 bp, Homo sapiens
ctcacaaggcccagga

SEQ ID NO: 3639429 - DNA, 19 bp, Homo sapiens
ctcacaaggcccaggagac

SEQ ID NO: 3639430 - DNA, 12 bp, Homo sapiens
ctcacacccctg

SEQ ID NO: 3639431 - DNA, 16 bp, Homo sapiens
ctcacacccctgtccc

SEQ ID NO: 3639432 - DNA, 19 bp, Homo sapiens
ctcacactaagagggcaga

SEQ ID NO: 3639433 - DNA, 15 bp, Homo sapiens
ctcacactggcgtct

SEQ ID NO: 3639434 - DNA, 12 bp, Homo sapiens
ctcacaggctga

SEQ ID NO: 3639435 - DNA, 20 bp, Homo sapiens
ctcacatagcttacaagcca

SEQ ID NO: 3639436 - DNA, 19 bp, Homo sapiens
ctcacatggtttacatcct

SEQ ID NO: 3639437 - DNA, 12 bp, Homo sapiens
ctcacatttatg

SEQ ID NO: 3639438 - DNA, 18 bp, Homo sapiens
ctcaccactaccagccag

SEQ ID NO: 3639439 - DNA, 19 bp, Homo sapiens
ctcaccactaccagccagc

SEQ ID NO: 3639440 - DNA, 14 bp, Homo sapiens
ctcacccacctctg

SEQ ID NO: 3639441 - DNA, 15 bp, Homo sapiens
ctcacccatcctaga

SEQ ID NO: 3639442 - DNA, 19 bp, Homo sapiens
ctcacccccagctttgcta

SEQ ID NO: 3639443 - DNA, 14 bp, Homo sapiens
ctcacccctagccc

SEQ ID NO: 3639444 - DNA, 13 bp, Homo sapiens
ctcaccctgggag

SEQ ID NO: 3639445 - DNA, 15 bp, Homo sapiens
ctcaccctgggagcc

SEQ ID NO: 3639446 - DNA, 20 bp, Homo sapiens
ctcacctgggcagggatgat

SEQ ID NO: 3639447 - DNA, 19 bp, Homo sapiens
ctcaccttggcaccagaca

SEQ ID NO: 3639448 - DNA, 13 bp, Homo sapiens
ctcacgcagccag

SEQ ID NO: 3639449 - DNA, 20 bp, Homo sapiens
ctcacgtaatgcattgcctg

SEQ ID NO: 3639450 - DNA, 13 bp, Homo sapiens
ctcactcctacct

SEQ ID NO: 3639451 - DNA, 15 bp, Homo sapiens
ctcactcctacctgg

SEQ ID NO: 3639452 - DNA, 16 bp, Homo sapiens
ctcactcctacctggt

SEQ ID NO: 3639453 - DNA, 17 bp, Homo sapiens
ctcactcctacctggta

SEQ ID NO: 3639454 - DNA, 19 bp, Homo sapiens
ctcactcctacctggtaat

SEQ ID NO: 3639455 - DNA, 23 bp, Homo sapiens
ctcactctgtccctgtccttccc

SEQ ID NO: 3639456 - DNA, 17 bp, Homo sapiens
ctcactctgttgcccag

SEQ ID NO: 3639457 - DNA, 15 bp, Homo sapiens
ctcactctgtttcct

SEQ ID NO: 3639458 - DNA, 21 bp, Homo sapiens
ctcactgccatggaattccct

SEQ ID NO: 3639459 - DNA, 16 bp, Homo sapiens
ctcactggcaggtgtg

SEQ ID NO: 3639460 - DNA, 22 bp, Homo sapiens
ctcactgggaagctcccacccc

SEQ ID NO: 3639461 - DNA, 16 bp, Homo sapiens
ctcactgttccttctt

SEQ ID NO: 3639462 - DNA, 20 bp, Homo sapiens
ctcagaaaattccctggggt

SEQ ID NO: 3639463 - DNA, 20 bp, Homo sapiens
ctcagaaggccccagagaga

SEQ ID NO: 3639464 - DNA, 21 bp, Homo sapiens
ctcagaaggccccagagagac

SEQ ID NO: 3639465 - DNA, 21 bp, Homo sapiens
ctcagacccaacagcaaagga

SEQ ID NO: 3639466 - DNA, 13 bp, Homo sapiens
ctcagaccccctc

SEQ ID NO: 3639467 - DNA, 22 bp, Homo sapiens
ctcagagacactgttgataaaa

SEQ ID NO: 3639468 - DNA, 22 bp, Homo sapiens
ctcagagaggtagcactctcag

SEQ ID NO: 3639469 - DNA, 13 bp, Homo sapiens
ctcagaggcctgc

SEQ ID NO: 3639470 - DNA, 13 bp, Homo sapiens
ctcagagtgcaag

SEQ ID NO: 3639471 - DNA, 13 bp, Homo sapiens
ctcagatccaggg

SEQ ID NO: 3639472 - DNA, 15 bp, Homo sapiens
ctcagatccagggac

SEQ ID NO: 3639473 - DNA, 16 bp, Homo sapiens
ctcagatccagggaca

SEQ ID NO: 3639474 - DNA, 20 bp, Homo sapiens
ctcagatccagggacagagg

SEQ ID NO: 3639475 - DNA, 23 bp, Homo sapiens
ctcagattcttcattgaggattg

SEQ ID NO: 3639476 - DNA, 17 bp, Homo sapiens
ctcagatttaagcctta

SEQ ID NO: 3639477 - DNA, 21 bp, Homo sapiens
ctcagatttaagccttacaaa

SEQ ID NO: 3639478 - DNA, 22 bp, Homo sapiens
ctcagatttaagccttacaaag

SEQ ID NO: 3639479 - DNA, 17 bp, Homo sapiens
ctcagatttctgaggaa

SEQ ID NO: 3639480 - DNA, 12 bp, Homo sapiens
ctcagcacccct

SEQ ID NO: 3639481 - DNA, 13 bp, Homo sapiens
ctcagcagagtga

SEQ ID NO: 3639482 - DNA, 12 bp, Homo sapiens
ctcagccagaga

SEQ ID NO: 3639483 - DNA, 17 bp, Homo sapiens
ctcagccccaccccagg

SEQ ID NO: 3639484 - DNA, 21 bp, Homo sapiens
ctcagccctccctgcccctcc

SEQ ID NO: 3639485 - DNA, 20 bp, Homo sapiens
ctcagccctggcctggctgg

SEQ ID NO: 3639486 - DNA, 21 bp, Homo sapiens
ctcagccctggcctggctggg

SEQ ID NO: 3639487 - DNA, 19 bp, Homo sapiens
ctcagcctggccagacaca

SEQ ID NO: 3639488 - DNA, 20 bp, Homo sapiens
ctcagcctggccagacacag

SEQ ID NO: 3639489 - DNA, 18 bp, Homo sapiens
ctcagcctggtttctggg

SEQ ID NO: 3639490 - DNA, 19 bp, Homo sapiens
ctcagcctggtttctgggt

SEQ ID NO: 3639491 - DNA, 20 bp, Homo sapiens
ctcagcctggtttctgggtg

SEQ ID NO: 3639492 - DNA, 22 bp, Homo sapiens
ctcagcctggtttctgggtgct

SEQ ID NO: 3639493 - DNA, 15 bp, Homo sapiens
ctcagccttgccaga

SEQ ID NO: 3639494 - DNA, 16 bp, Homo sapiens
ctcagccttgccagag

SEQ ID NO: 3639495 - DNA, 17 bp, Homo sapiens
ctcagccttgccagaga

SEQ ID NO: 3639496 - DNA, 14 bp, Homo sapiens
ctcagcgaatgaat

SEQ ID NO: 3639497 - DNA, 13 bp, Homo sapiens
ctcagctccctgc

SEQ ID NO: 3639498 - DNA, 16 bp, Homo sapiens
ctcagctccctgcctg

SEQ ID NO: 3639499 - DNA, 22 bp, Homo sapiens
ctcagctccctgcctgtttccc

SEQ ID NO: 3639500 - DNA, 17 bp, Homo sapiens
ctcagctcttggctcca

SEQ ID NO: 3639501 - DNA, 21 bp, Homo sapiens
ctcagctgagcatggagacag

SEQ ID NO: 3639502 - DNA, 14 bp, Homo sapiens
ctcagctgcctcct

SEQ ID NO: 3639503 - DNA, 17 bp, Homo sapiens
ctcagctgcctcctgcg

SEQ ID NO: 3639504 - DNA, 18 bp, Homo sapiens
ctcagctgtcaaggctca

SEQ ID NO: 3639505 - DNA, 16 bp, Homo sapiens
ctcagcttctcctgtg

SEQ ID NO: 3639506 - DNA, 23 bp, Homo sapiens
ctcaggaagggggccgccaccct

SEQ ID NO: 3639507 - DNA, 14 bp, Homo sapiens
ctcaggacagatgc

SEQ ID NO: 3639508 - DNA, 16 bp, Homo sapiens
ctcaggacagatgcca

SEQ ID NO: 3639509 - DNA, 13 bp, Homo sapiens
ctcaggagaagcc

SEQ ID NO: 3639510 - DNA, 15 bp, Homo sapiens
ctctagagggcgagg

SEQ ID NO: 3639511 - DNA, 17 bp, Homo sapiens
ctctagcctctggactg

SEQ ID NO: 3639512 - DNA, 20 bp, Homo sapiens
ctctagctgggggtgggcca

SEQ ID NO: 3639513 - DNA, 18 bp, Homo sapiens
ctctaggccctgtgagca

SEQ ID NO: 3639514 - DNA, 12 bp, Homo sapiens
ctctagtagtgt

SEQ ID NO: 3639515 - DNA, 16 bp, Homo sapiens
ctctagtgccttctaa

SEQ ID NO: 3639516 - DNA, 21 bp, Homo sapiens
ctctagttttttcttcctttt

SEQ ID NO: 3639517 - DNA, 16 bp, Homo sapiens
ctctatttattagcca

SEQ ID NO: 3639518 - DNA, 19 bp, Homo sapiens
ctctcaccatgatgtgaag

SEQ ID NO: 3639519 - DNA, 22 bp, Homo sapiens
ctctcaccatgatgtgaagagt

SEQ ID NO: 3639520 - DNA, 20 bp, Homo sapiens
ctctcagaaataaatcacag

SEQ ID NO: 3639521 - DNA, 21 bp, Homo sapiens
ctctcagaaataaatcacaga

SEQ ID NO: 3639522 - DNA, 22 bp, Homo sapiens
ctctcagaggcctgctgccagt

SEQ ID NO: 3639523 - DNA, 23 bp, Homo sapiens
ctctcagcatttccttgtcccgt

SEQ ID NO: 3639524 - DNA, 19 bp, Homo sapiens
ctctcagtactttggaggc

SEQ ID NO: 3639525 - DNA, 23 bp, Homo sapiens
ctctcattttatttacagctgtg

SEQ ID NO: 3639526 - DNA, 12 bp, Homo sapiens
ctctccactgcc

SEQ ID NO: 3639527 - DNA, 20 bp, Homo sapiens
ctctccaggcctgtcaagag

SEQ ID NO: 3639528 - DNA, 14 bp, Homo sapiens
ctctccagggtgct

SEQ ID NO: 3639529 - DNA, 21 bp, Homo sapiens
ctctccaggtcagcctggaag

SEQ ID NO: 3639530 - DNA, 22 bp, Homo sapiens
ctctccatacctgcccctgcct

SEQ ID NO: 3639531 - DNA, 11 bp, Homo sapiens
ctctccatatc

SEQ ID NO: 3639532 - DNA, 20 bp, Homo sapiens
ctctccatatcccttcctct

SEQ ID NO: 3639533 - DNA, 11 bp, Homo sapiens
ctctcccaggg

SEQ ID NO: 3639534 - DNA, 21 bp, Homo sapiens
ctctcccatcctggggcagca

SEQ ID NO: 3639535 - DNA, 18 bp, Homo sapiens
ctctcccattgtccctct

SEQ ID NO: 3639536 - DNA, 11 bp, Homo sapiens
ctctccccagc

SEQ ID NO: 3639537 - DNA, 13 bp, Homo sapiens
ctctccccagccc

SEQ ID NO: 3639538 - DNA, 18 bp, Homo sapiens
ctctccccagcccagaga

SEQ ID NO: 3639539 - DNA, 20 bp, Homo sapiens
ctctccccagcccagagaca

SEQ ID NO: 3639540 - DNA, 20 bp, Homo sapiens
ctctcccccaaggccactgc

SEQ ID NO: 3639541 - DNA, 20 bp, Homo sapiens
ctctccgagctctggtgctt

SEQ ID NO: 3639542 - DNA, 15 bp, Homo sapiens
ctctccggtctctct

SEQ ID NO: 3639543 - DNA, 18 bp, Homo sapiens
ctctcctcccgccccgcc

SEQ ID NO: 3639544 - DNA, 16 bp, Homo sapiens
ctctcctcttgccact

SEQ ID NO: 3639545 - DNA, 17 bp, Homo sapiens
ctctcctcttgccactg

SEQ ID NO: 3639546 - DNA, 13 bp, Homo sapiens
ctctcctgccctg

SEQ ID NO: 3639547 - DNA, 15 bp, Homo sapiens
ctctcctgccctgtg

SEQ ID NO: 3639548 - DNA, 16 bp, Homo sapiens
ctctcctgccctgtga

SEQ ID NO: 3639549 - DNA, 14 bp, Homo sapiens
ctctcctgcctcag

SEQ ID NO: 3639550 - DNA, 18 bp, Homo sapiens
ctctcgccccatccctgc

SEQ ID NO: 3639551 - DNA, 21 bp, Homo sapiens
ctctcgccccatccctgcttg

SEQ ID NO: 3639552 - DNA, 13 bp, Homo sapiens
ctctcgggagccc

SEQ ID NO: 3639553 - DNA, 21 bp, Homo sapiens
ctctcgttttgggtactttct

SEQ ID NO: 3639554 - DNA, 22 bp, Homo sapiens
ctctcgttttgggtactttcta

SEQ ID NO: 3639555 - DNA, 16 bp, Homo sapiens
ctctctcctctctgct

SEQ ID NO: 3639556 - DNA, 16 bp, Homo sapiens
ctctctcgggagccct

SEQ ID NO: 3639557 - DNA, 19 bp, Homo sapiens
ctctctcgggagccctagc

SEQ ID NO: 3639558 - DNA, 16 bp, Homo sapiens
ctctctgaacccctcc

SEQ ID NO: 3639559 - DNA, 16 bp, Homo sapiens
ctctctgagtcaaatc

SEQ ID NO: 3639560 - DNA, 12 bp, Homo sapiens
ctctctggctgg

SEQ ID NO: 3639561 - DNA, 13 bp, Homo sapiens
ctctctggctggg

SEQ ID NO: 3639562 - DNA, 15 bp, Homo sapiens
ctctctggctggtct

SEQ ID NO: 3639563 - DNA, 14 bp, Homo sapiens
ctctcttcctccac

SEQ ID NO: 3639564 - DNA, 17 bp, Homo sapiens
ctctcttgttgtccagg

SEQ ID NO: 3639565 - DNA, 17 bp, Homo sapiens
ctctctttaaccctccc

SEQ ID NO: 3639566 - DNA, 13 bp, Homo sapiens
ctctgaaaacaag

SEQ ID NO: 3639567 - DNA, 19 bp, Homo sapiens
ctctgaaggagttacaggg

SEQ ID NO: 3639568 - DNA, 16 bp, Homo sapiens
ctctgacagtccacag

SEQ ID NO: 3639569 - DNA, 17 bp, Homo sapiens
ctctgacagtccacagg

SEQ ID NO: 3639570 - DNA, 20 bp, Homo sapiens
ctctgacatcccttcctgga

SEQ ID NO: 3639571 - DNA, 16 bp, Homo sapiens
ctctgagcaaatgtgg

SEQ ID NO: 3639572 - DNA, 22 bp, Homo sapiens
ctctgagtagggcaatggaaat

SEQ ID NO: 3639573 - DNA, 15 bp, Homo sapiens
ctctgagtcaaatcc

SEQ ID NO: 3639574 - DNA, 16 bp, Homo sapiens
ctctgagtcaaatcca

SEQ ID NO: 3639575 - DNA, 15 bp, Homo sapiens
ctctgatcaagtatt

SEQ ID NO: 3639576 - DNA, 20 bp, Homo sapiens
ctctgcacagacaagcagcc

SEQ ID NO: 3639577 - DNA, 21 bp, Homo sapiens
ctctgcacagacaagcagccc

SEQ ID NO: 3639578 - DNA, 16 bp, Homo sapiens
ctctgcacccagaaca

SEQ ID NO: 3639579 - DNA, 17 bp, Homo sapiens
ctctgcacccagaacag

SEQ ID NO: 3639580 - DNA, 23 bp, Homo sapiens
ctctgcacccgcctcgacctccc

SEQ ID NO: 3639581 - DNA, 23 bp, Homo sapiens
ctctgcactcccacctgacacac

SEQ ID NO: 3639582 - DNA, 19 bp, Homo sapiens
ctctgcagtaaaacacatt

SEQ ID NO: 3639583 - DNA, 14 bp, Homo sapiens
ctctgccaaaggat

SEQ ID NO: 3639584 - DNA, 21 bp, Homo sapiens
ctctgccaaaggatgtgatat

SEQ ID NO: 3639585 - DNA, 18 bp, Homo sapiens
ctctgccagttacttggg

SEQ ID NO: 3639586 - DNA, 20 bp, Homo sapiens
ctctgccagttacttgggct

SEQ ID NO: 3639587 - DNA, 14 bp, Homo sapiens
ctctgccccagcct

SEQ ID NO: 3639588 - DNA, 13 bp, Homo sapiens
ctctgccccagct

SEQ ID NO: 3639589 - DNA, 15 bp, Homo sapiens
ctctgccccagcttg

SEQ ID NO: 3639590 - DNA, 22 bp, Homo sapiens
ctctgccccatcctccagcagg

SEQ ID NO: 3639591 - DNA, 17 bp, Homo sapiens
ctctgccccctccccca

SEQ ID NO: 3639592 - DNA, 18 bp, Homo sapiens
ctctgccccctcccccat

SEQ ID NO: 3639593 - DNA, 19 bp, Homo sapiens
ctctgccccctcccccatg

SEQ ID NO: 3639594 - DNA, 16 bp, Homo sapiens
ctctgccctggattgg

SEQ ID NO: 3639595 - DNA, 20 bp, Homo sapiens
ctctgccctgggctcctctt

SEQ ID NO: 3639596 - DNA, 20 bp, Homo sapiens
ctctgccggtcgggcagcca

SEQ ID NO: 3639597 - DNA, 22 bp, Homo sapiens
ctctgccggtcgggcagccagc

SEQ ID NO: 3639598 - DNA, 15 bp, Homo sapiens
ctctgcctcacctgg

SEQ ID NO: 3639599 - DNA, 19 bp, Homo sapiens
ctctgcgtcggtcctggtg

SEQ ID NO: 3639600 - DNA, 22 bp, Homo sapiens
ctctgctccaaccgggatggga

SEQ ID NO: 3639601 - DNA, 21 bp, Homo sapiens
ctctggacaatctcacacctt

SEQ ID NO: 3639602 - DNA, 15 bp, Homo sapiens
ctctggacagcccca

SEQ ID NO: 3639603 - DNA, 21 bp, Homo sapiens
ctctggagaaggcctggaaga

SEQ ID NO: 3639604 - DNA, 17 bp, Homo sapiens
ctctggaggtcatctgg

SEQ ID NO: 3639605 - DNA, 20 bp, Homo sapiens
ctctggagtggccactaagc

SEQ ID NO: 3639606 - DNA, 22 bp, Homo sapiens
ctctggcaccatcagcctgttc

SEQ ID NO: 3639607 - DNA, 16 bp, Homo sapiens
ctctggcagcaccgcc

SEQ ID NO: 3639608 - DNA, 22 bp, Homo sapiens
ctctggcagcaccgcctcttcc

SEQ ID NO: 3639609 - DNA, 17 bp, Homo sapiens
ctctggctccccaaggc

SEQ ID NO: 3639610 - DNA, 15 bp, Homo sapiens
ctctggctgcttttt

SEQ ID NO: 3639611 - DNA, 13 bp, Homo sapiens
ctctggctgggga

SEQ ID NO: 3639612 - DNA, 18 bp, Homo sapiens
ctctggcttcaaaaagcc

SEQ ID NO: 3639613 - DNA, 19 bp, Homo sapiens
ctctggcttcaaaaagcca

SEQ ID NO: 3639614 - DNA, 20 bp, Homo sapiens
ctctggcttcaaaaagccac

SEQ ID NO: 3639615 - DNA, 16 bp, Homo sapiens
ctctgggacccacaga

SEQ ID NO: 3639616 - DNA, 17 bp, Homo sapiens
ctctgggacccacagaa

SEQ ID NO: 3639617 - DNA, 20 bp, Homo sapiens
ctctgggacccacagaactt

SEQ ID NO: 3639618 - DNA, 21 bp, Homo sapiens
ctctgggacccacagaacttg

SEQ ID NO: 3639619 - DNA, 16 bp, Homo sapiens
ctctgggagcccagaa

SEQ ID NO: 3639620 - DNA, 20 bp, Homo sapiens
ctctgggcaaagcccctcac

SEQ ID NO: 3639621 - DNA, 23 bp, Homo sapiens
ctctgggcaaagcccctcacact

SEQ ID NO: 3639622 - DNA, 14 bp, Homo sapiens
ctctgggcctgagg

SEQ ID NO: 3639623 - DNA, 15 bp, Homo sapiens
ctctgggcctgaggg

SEQ ID NO: 3639624 - DNA, 16 bp, Homo sapiens
ctctgggggtcctctc

SEQ ID NO: 3639625 - DNA, 19 bp, Homo sapiens
ctctgggggtcctctctga

SEQ ID NO: 3639626 - DNA, 15 bp, Homo sapiens
ctctggggtgggcag

SEQ ID NO: 3639627 - DNA, 19 bp, Homo sapiens
ctctgggtccttggctccc

SEQ ID NO: 3639628 - DNA, 22 bp, Homo sapiens
ctctgggtctgattttctcact

SEQ ID NO: 3639629 - DNA, 16 bp, Homo sapiens
ctctgggtgctgccct

SEQ ID NO: 3639630 - DNA, 20 bp, Homo sapiens
ctctggtaaacattcctcca

SEQ ID NO: 3639631 - DNA, 21 bp, Homo sapiens
ctctggtaaacattcctccag

SEQ ID NO: 3639632 - DNA, 16 bp, Homo sapiens
ctctggtgctcctgca

SEQ ID NO: 3639633 - DNA, 16 bp, Homo sapiens
ctctggtgtgtggtga

SEQ ID NO: 3639634 - DNA, 21 bp, Homo sapiens
ctctgtaacatcgcacagttt

SEQ ID NO: 3639635 - DNA, 16 bp, Homo sapiens
ctctgtctgagacagg

SEQ ID NO: 3639636 - DNA, 21 bp, Homo sapiens
ctctgtctgagacaggtgcct

SEQ ID NO: 3639637 - DNA, 21 bp, Homo sapiens
ctctgtcttttggagaaccag

SEQ ID NO: 3639638 - DNA, 22 bp, Homo sapiens
ctctgtgcttttaaatgcataa

SEQ ID NO: 3639639 - DNA, 14 bp, Homo sapiens
ctctgtggtcaccc

SEQ ID NO: 3639640 - DNA, 21 bp, Homo sapiens
ctctgttcctttctctgggct

SEQ ID NO: 3639641 - DNA, 23 bp, Homo sapiens
ctgcctggagacaaggtgctaac

SEQ ID NO: 3639642 - DNA, 12 bp, Homo sapiens
ctgcctggaggc

SEQ ID NO: 3639643 - DNA, 19 bp, Homo sapiens
ctgcctggaggcaaaggcc

SEQ ID NO: 3639644 - DNA, 21 bp, Homo sapiens
ctgcctggaggcaaaggcctg

SEQ ID NO: 3639645 - DNA, 18 bp, Homo sapiens
ctgcctggccccctgtcc

SEQ ID NO: 3639646 - DNA, 20 bp, Homo sapiens
ctgcctgggccgtggcacag

SEQ ID NO: 3639647 - DNA, 15 bp, Homo sapiens
ctgcctgtctgaagc

SEQ ID NO: 3639648 - DNA, 21 bp, Homo sapiens
ctgcctgtgcccgcatgtgtg

SEQ ID NO: 3639649 - DNA, 20 bp, Homo sapiens
ctgcctgttggcaggcccac

SEQ ID NO: 3639650 - DNA, 13 bp, Homo sapiens
ctgcctgtttccc

SEQ ID NO: 3639651 - DNA, 17 bp, Homo sapiens
ctgccttaaacacacat

SEQ ID NO: 3639652 - DNA, 12 bp, Homo sapiens
ctgccttagcct

SEQ ID NO: 3639653 - DNA, 18 bp, Homo sapiens
ctgccttagcctaccatg

SEQ ID NO: 3639654 - DNA, 13 bp, Homo sapiens
ctgccttcaggga

SEQ ID NO: 3639655 - DNA, 19 bp, Homo sapiens
ctgccttcggtacccacca

SEQ ID NO: 3639656 - DNA, 13 bp, Homo sapiens
ctgccttctgctg

SEQ ID NO: 3639657 - DNA, 18 bp, Homo sapiens
ctgccttctgctgaaaga

SEQ ID NO: 3639658 - DNA, 18 bp, Homo sapiens
ctgcgaatctagaggagg

SEQ ID NO: 3639659 - DNA, 20 bp, Homo sapiens
ctgcgaatgggatcctgatg

SEQ ID NO: 3639660 - DNA, 15 bp, Homo sapiens
ctgcgactaaactta

SEQ ID NO: 3639661 - DNA, 22 bp, Homo sapiens
ctgcgagacgcacacagctgag

SEQ ID NO: 3639662 - DNA, 22 bp, Homo sapiens
ctgcgcccttaactgcatccag

SEQ ID NO: 3639663 - DNA, 12 bp, Homo sapiens
ctgcgcctccag

SEQ ID NO: 3639664 - DNA, 13 bp, Homo sapiens
ctgcgcctccaga

SEQ ID NO: 3639665 - DNA, 23 bp, Homo sapiens
ctgcgctcttgggaccccagaga

SEQ ID NO: 3639666 - DNA, 14 bp, Homo sapiens
ctgcgctgcttggt

SEQ ID NO: 3639667 - DNA, 15 bp, Homo sapiens
ctgcgtgcacttccc

SEQ ID NO: 3639668 - DNA, 21 bp, Homo sapiens
ctgcgttttcctagctgtgtt

SEQ ID NO: 3639669 - DNA, 21 bp, Homo sapiens
ctgctacctgttcttgggcct

SEQ ID NO: 3639670 - DNA, 15 bp, Homo sapiens
ctgctcacaagttct

SEQ ID NO: 3639671 - DNA, 15 bp, Homo sapiens
ctgctcagccctgca

SEQ ID NO: 3639672 - DNA, 13 bp, Homo sapiens
ctgctcagcttct

SEQ ID NO: 3639673 - DNA, 15 bp, Homo sapiens
ctgctcagcttctcc

SEQ ID NO: 3639674 - DNA, 23 bp, Homo sapiens
ctgctcagggaaaagcagctctc

SEQ ID NO: 3639675 - DNA, 13 bp, Homo sapiens
ctgctccaccagc

SEQ ID NO: 3639676 - DNA, 15 bp, Homo sapiens
ctgctccaccagcag

SEQ ID NO: 3639677 - DNA, 17 bp, Homo sapiens
ctgctccaccagcagca

SEQ ID NO: 3639678 - DNA, 11 bp, Homo sapiens
ctgctccagaa

SEQ ID NO: 3639679 - DNA, 13 bp, Homo sapiens
ctgctccagaaga

SEQ ID NO: 3639680 - DNA, 15 bp, Homo sapiens
ctgctccagaagatg

SEQ ID NO: 3639681 - DNA, 20 bp, Homo sapiens
ctgctccagaagatgccagc

SEQ ID NO: 3639682 - DNA, 13 bp, Homo sapiens
ctgctccagacct

SEQ ID NO: 3639683 - DNA, 22 bp, Homo sapiens
ctgctccagacctgatcctgga

SEQ ID NO: 3639684 - DNA, 20 bp, Homo sapiens
ctgctccctgtggcactcag

SEQ ID NO: 3639685 - DNA, 15 bp, Homo sapiens
ctgctcctagaggga

SEQ ID NO: 3639686 - DNA, 22 bp, Homo sapiens
ctgctcctagagggaggggcct

SEQ ID NO: 3639687 - DNA, 11 bp, Homo sapiens
ctgctcctctc

SEQ ID NO: 3639688 - DNA, 15 bp, Homo sapiens
ctgctcctctcttgg

SEQ ID NO: 3639689 - DNA, 13 bp, Homo sapiens
ctgctcctcttgt

SEQ ID NO: 3639690 - DNA, 23 bp, Homo sapiens
ctgctcctgcttttctgtcctgg

SEQ ID NO: 3639691 - DNA, 16 bp, Homo sapiens
ctgctccttggcaccc

SEQ ID NO: 3639692 - DNA, 23 bp, Homo sapiens
ctgctccttggcacccccatgct

SEQ ID NO: 3639693 - DNA, 16 bp, Homo sapiens
ctgctcgtggactgtg

SEQ ID NO: 3639694 - DNA, 21 bp, Homo sapiens
ctgctcgtttacactgcacat

SEQ ID NO: 3639695 - DNA, 14 bp, Homo sapiens
ctgctctcctcttg

SEQ ID NO: 3639696 - DNA, 20 bp, Homo sapiens
ctgctctcctcttgccactg

SEQ ID NO: 3639697 - DNA, 21 bp, Homo sapiens
ctgctctcctcttgccactgc

SEQ ID NO: 3639698 - DNA, 18 bp, Homo sapiens
ctgctgaaacaacaaata

SEQ ID NO: 3639699 - DNA, 21 bp, Homo sapiens
ctgctgaaagactcgagaacc

SEQ ID NO: 3639700 - DNA, 17 bp, Homo sapiens
ctgctgaaggaataaat

SEQ ID NO: 3639701 - DNA, 12 bp, Homo sapiens
ctgctgagctgg

SEQ ID NO: 3639702 - DNA, 16 bp, Homo sapiens
ctgctgagctggccct

SEQ ID NO: 3639703 - DNA, 22 bp, Homo sapiens
ctgctgagctggcccttgggga

SEQ ID NO: 3639704 - DNA, 22 bp, Homo sapiens
ctgctgagttggcctggccatt

SEQ ID NO: 3639705 - DNA, 20 bp, Homo sapiens
ctgctgatatcaacagcttc

SEQ ID NO: 3639706 - DNA, 22 bp, Homo sapiens
ctgctgcaccctgcgcctccag

SEQ ID NO: 3639707 - DNA, 23 bp, Homo sapiens
ctgctgcaccctgcgcctccaga

SEQ ID NO: 3639708 - DNA, 20 bp, Homo sapiens
ctgctgcagattagttcttt

SEQ ID NO: 3639709 - DNA, 23 bp, Homo sapiens
ctgctgcagattagttctttttg

SEQ ID NO: 3639710 - DNA, 15 bp, Homo sapiens
ctgctgccagggctt

SEQ ID NO: 3639711 - DNA, 17 bp, Homo sapiens
ctgctgccagggcttcc

SEQ ID NO: 3639712 - DNA, 15 bp, Homo sapiens
ctgctgcccagcctc

SEQ ID NO: 3639713 - DNA, 22 bp, Homo sapiens
ctgctgcccagcctccaagctc

SEQ ID NO: 3639714 - DNA, 16 bp, Homo sapiens
ctgctgccggctctgg

SEQ ID NO: 3639715 - DNA, 19 bp, Homo sapiens
ctgctgccggctctgggcc

SEQ ID NO: 3639716 - DNA, 20 bp, Homo sapiens
ctgctgccggctctgggcct

SEQ ID NO: 3639717 - DNA, 15 bp, Homo sapiens
ctgctgccttcacat

SEQ ID NO: 3639718 - DNA, 13 bp, Homo sapiens
ctgctgcgctgct

SEQ ID NO: 3639719 - DNA, 14 bp, Homo sapiens
ctgctgctactgct

SEQ ID NO: 3639720 - DNA, 13 bp, Homo sapiens
ctgctgctcctct

SEQ ID NO: 3639721 - DNA, 16 bp, Homo sapiens
ctgctgctgccgccgc

SEQ ID NO: 3639722 - DNA, 23 bp, Homo sapiens
ctgctgggaacctagcacacctg

SEQ ID NO: 3639723 - DNA, 20 bp, Homo sapiens
ctgctggggaagacagtggc

SEQ ID NO: 3639724 - DNA, 22 bp, Homo sapiens
ctgctggggaagacagtggccc

SEQ ID NO: 3639725 - DNA, 17 bp, Homo sapiens
ctgctgggtggcagggg

SEQ ID NO: 3639726 - DNA, 14 bp, Homo sapiens
ctgctggtacctgc

SEQ ID NO: 3639727 - DNA, 16 bp, Homo sapiens
ctgctggtacctgccc

SEQ ID NO: 3639728 - DNA, 19 bp, Homo sapiens
ctgctggtacctgccctct

SEQ ID NO: 3639729 - DNA, 21 bp, Homo sapiens
ctgctgtgccatgctgggcca

SEQ ID NO: 3639730 - DNA, 23 bp, Homo sapiens
ctgctgtgccatgctgggccact

SEQ ID NO: 3639731 - DNA, 14 bp, Homo sapiens
ctgctgtgctggga

SEQ ID NO: 3639732 - DNA, 13 bp, Homo sapiens
ctgctgtggagtg

SEQ ID NO: 3639733 - DNA, 19 bp, Homo sapiens
ctgctgttcttcagtcctt

SEQ ID NO: 3639734 - DNA, 23 bp, Homo sapiens
ctgcttaaactggaaaggatctg

SEQ ID NO: 3639735 - DNA, 15 bp, Homo sapiens
ctgcttgactgtaac

SEQ ID NO: 3639736 - DNA, 19 bp, Homo sapiens
ctgcttgcccgctcccaca

SEQ ID NO: 3639737 - DNA, 17 bp, Homo sapiens
ctgctttcctgcagcag

SEQ ID NO: 3639738 - DNA, 17 bp, Homo sapiens
ctgctttgcatctttgt

SEQ ID NO: 3639739 - DNA, 20 bp, Homo sapiens
ctgctttggatagtctccta

SEQ ID NO: 3639740 - DNA, 17 bp, Homo sapiens
ctgctttgggctgccct

SEQ ID NO: 3639741 - DNA, 12 bp, Homo sapiens
ctgcttttctgt

SEQ ID NO: 3639742 - DNA, 13 bp, Homo sapiens
ctggaaacagcat

SEQ ID NO: 3639743 - DNA, 14 bp, Homo sapiens
ctggaaacagcatg

SEQ ID NO: 3639744 - DNA, 15 bp, Homo sapiens
ctggaaacagcatga

SEQ ID NO: 3639745 - DNA, 17 bp, Homo sapiens
ctggaaacagcatgaat

SEQ ID NO: 3639746 - DNA, 19 bp, Homo sapiens
ctggaaacagcatgaataa

SEQ ID NO: 3639747 - DNA, 17 bp, Homo sapiens
ctggaaagcacaagact

SEQ ID NO: 3639748 - DNA, 19 bp, Homo sapiens
ctggaaagcacaagactgg

SEQ ID NO: 3639749 - DNA, 19 bp, Homo sapiens
ctggaaagcagagcctcct

SEQ ID NO: 3639750 - DNA, 21 bp, Homo sapiens
ctggaaagcagagcctcctgg

SEQ ID NO: 3639751 - DNA, 17 bp, Homo sapiens
ctggaaaggatctgtga

SEQ ID NO: 3639752 - DNA, 19 bp, Homo sapiens
ctggaacccagactcagac

SEQ ID NO: 3639753 - DNA, 16 bp, Homo sapiens
ctggaacctcagcctg

SEQ ID NO: 3639754 - DNA, 22 bp, Homo sapiens
ctggaacctcagcctggccaga

SEQ ID NO: 3639755 - DNA, 19 bp, Homo sapiens
ctggaacgtttcactgcaa

SEQ ID NO: 3639756 - DNA, 20 bp, Homo sapiens
ctggaacgtttcactgcaaa

SEQ ID NO: 3639757 - DNA, 16 bp, Homo sapiens
ctggaactcctggcct

SEQ ID NO: 3639758 - DNA, 17 bp, Homo sapiens
ctggaactcctggcctt

SEQ ID NO: 3639759 - DNA, 21 bp, Homo sapiens
ctggaagacgtggctctgggt

SEQ ID NO: 3639760 - DNA, 19 bp, Homo sapiens
ctggaagagctgagacctt

SEQ ID NO: 3639761 - DNA, 18 bp, Homo sapiens
ctggaagctctccgagct

SEQ ID NO: 3639762 - DNA, 21 bp, Homo sapiens
ctggaagctctccgagctctg

SEQ ID NO: 3639763 - DNA, 22 bp, Homo sapiens
ctggaagctttgtagaaattaa

SEQ ID NO: 3639764 - DNA, 23 bp, Homo sapiens
ctggaagctttgtagaaattaaa

SEQ ID NO: 3639765 - DNA, 15 bp, Homo sapiens
ctggaagtacttggc

SEQ ID NO: 3639766 - DNA, 19 bp, Homo sapiens
ctggaagtacttggccccc

SEQ ID NO: 3639767 - DNA, 16 bp, Homo sapiens
ctggaataaagttgca

SEQ ID NO: 3639768 - DNA, 23 bp, Homo sapiens
ctggaataaagttgcagatgatt

SEQ ID NO: 3639769 - DNA, 18 bp, Homo sapiens
ctggaatacatgaaatat

SEQ ID NO: 3639770 - DNA, 14 bp, Homo sapiens
ctggacacagctct

SEQ ID NO: 3639771 - DNA, 15 bp, Homo sapiens
ctggacacagctctt

SEQ ID NO: 3639772 - DNA, 22 bp, Homo sapiens
ctggacacagctcttcattcca

SEQ ID NO: 3639773 - DNA, 23 bp, Homo sapiens
ctgtgagggccaccggtgggcag

SEQ ID NO: 3639774 - DNA, 19 bp, Homo sapiens
ctgtgaggggctctctcat

SEQ ID NO: 3639775 - DNA, 16 bp, Homo sapiens
ctgtgatttttatcac

SEQ ID NO: 3639776 - DNA, 18 bp, Homo sapiens
ctgtgcagacccagtccc

SEQ ID NO: 3639777 - DNA, 21 bp, Homo sapiens
ctgtgcatctagcctcaagct

SEQ ID NO: 3639778 - DNA, 13 bp, Homo sapiens
ctgtgccagaggc

SEQ ID NO: 3639779 - DNA, 17 bp, Homo sapiens
ctgtgccagaggccaga

SEQ ID NO: 3639780 - DNA, 15 bp, Homo sapiens
ctgtgccagcaccac

SEQ ID NO: 3639781 - DNA, 13 bp, Homo sapiens
ctgtgccagcagg

SEQ ID NO: 3639782 - DNA, 15 bp, Homo sapiens
ctgtgcccctggcct

SEQ ID NO: 3639783 - DNA, 18 bp, Homo sapiens
ctgtgcccctggccttgg

SEQ ID NO: 3639784 - DNA, 11 bp, Homo sapiens
ctgtgcctctg

SEQ ID NO: 3639785 - DNA, 13 bp, Homo sapiens
ctgtgcctctgcc

SEQ ID NO: 3639786 - DNA, 14 bp, Homo sapiens
ctgtgcctctgcct

SEQ ID NO: 3639787 - DNA, 16 bp, Homo sapiens
ctgtgcctctgcctgt

SEQ ID NO: 3639788 - DNA, 17 bp, Homo sapiens
ctgtgcctctgggactg

SEQ ID NO: 3639789 - DNA, 18 bp, Homo sapiens
ctgtgcctctgggactgg

SEQ ID NO: 3639790 - DNA, 16 bp, Homo sapiens
ctgtgcctttcctatc

SEQ ID NO: 3639791 - DNA, 23 bp, Homo sapiens
ctgtgcgtcccagctgaaggcag

SEQ ID NO: 3639792 - DNA, 14 bp, Homo sapiens
ctgtgctccacact

SEQ ID NO: 3639793 - DNA, 15 bp, Homo sapiens
ctgtgctccacactc

SEQ ID NO: 3639794 - DNA, 18 bp, Homo sapiens
ctgtgctccacactcaga

SEQ ID NO: 3639795 - DNA, 22 bp, Homo sapiens
ctgtgctccacactcagaaaat

SEQ ID NO: 3639796 - DNA, 12 bp, Homo sapiens
ctgtgctctggc

SEQ ID NO: 3639797 - DNA, 12 bp, Homo sapiens
ctgtgctgtact

SEQ ID NO: 3639798 - DNA, 18 bp, Homo sapiens
ctgtgctgtactgagcac

SEQ ID NO: 3639799 - DNA, 20 bp, Homo sapiens
ctgtgctgtactgagcactg

SEQ ID NO: 3639800 - DNA, 14 bp, Homo sapiens
ctgtgcttaattta

SEQ ID NO: 3639801 - DNA, 17 bp, Homo sapiens
ctgtgcttaatttaaat

SEQ ID NO: 3639802 - DNA, 13 bp, Homo sapiens
ctgtgcttggcca

SEQ ID NO: 3639803 - DNA, 14 bp, Homo sapiens
ctgtgctttggaac

SEQ ID NO: 3639804 - DNA, 11 bp, Homo sapiens
ctgtggagctg

SEQ ID NO: 3639805 - DNA, 18 bp, Homo sapiens
ctgtggagctgccacaga

SEQ ID NO: 3639806 - DNA, 21 bp, Homo sapiens
ctgtggagggagggcagctgg

SEQ ID NO: 3639807 - DNA, 13 bp, Homo sapiens
ctgtggcaaaaag

SEQ ID NO: 3639808 - DNA, 22 bp, Homo sapiens
ctgtggcaaaaagagtcagaca

SEQ ID NO: 3639809 - DNA, 22 bp, Homo sapiens
ctgtggcagagttacagttctg

SEQ ID NO: 3639810 - DNA, 13 bp, Homo sapiens
ctgtggccaggcc

SEQ ID NO: 3639811 - DNA, 15 bp, Homo sapiens
ctgtggccaggcctt

SEQ ID NO: 3639812 - DNA, 16 bp, Homo sapiens
ctgtggccctggccac

SEQ ID NO: 3639813 - DNA, 22 bp, Homo sapiens
ctgtggccctggccactaaagc

SEQ ID NO: 3639814 - DNA, 14 bp, Homo sapiens
ctgtgggcaaagtc

SEQ ID NO: 3639815 - DNA, 16 bp, Homo sapiens
ctgtgggcactggtgg

SEQ ID NO: 3639816 - DNA, 15 bp, Homo sapiens
ctgtgggcttcccca

SEQ ID NO: 3639817 - DNA, 15 bp, Homo sapiens
ctgtggtttcatgtt

SEQ ID NO: 3639818 - DNA, 16 bp, Homo sapiens
ctgtggtttcatgtta

SEQ ID NO: 3639819 - DNA, 17 bp, Homo sapiens
ctgtgtacaatgtgaga

SEQ ID NO: 3639820 - DNA, 19 bp, Homo sapiens
ctgtgtaccacttcctgag

SEQ ID NO: 3639821 - DNA, 21 bp, Homo sapiens
ctgtgtaccacttcctgaggc

SEQ ID NO: 3639822 - DNA, 18 bp, Homo sapiens
ctgtgtcctaaggcccat

SEQ ID NO: 3639823 - DNA, 17 bp, Homo sapiens
ctgtgtcctctgcctgg

SEQ ID NO: 3639824 - DNA, 18 bp, Homo sapiens
ctgtgtcctctgcctggg

SEQ ID NO: 3639825 - DNA, 20 bp, Homo sapiens
ctgtgtcctctgcctgggct

SEQ ID NO: 3639826 - DNA, 21 bp, Homo sapiens
ctgtgtgattgacagctttgc

SEQ ID NO: 3639827 - DNA, 22 bp, Homo sapiens
ctgtgtgattgacagctttgct

SEQ ID NO: 3639828 - DNA, 23 bp, Homo sapiens
ctgtgtgattgacagctttgctg

SEQ ID NO: 3639829 - DNA, 16 bp, Homo sapiens
ctgtgtgcacaaatat

SEQ ID NO: 3639830 - DNA, 16 bp, Homo sapiens
ctgtgtggctcctggg

SEQ ID NO: 3639831 - DNA, 15 bp, Homo sapiens
ctgtgtgtccaaaac

SEQ ID NO: 3639832 - DNA, 13 bp, Homo sapiens
ctgtgtgtctgtc

SEQ ID NO: 3639833 - DNA, 14 bp, Homo sapiens
ctgtgtgtgtgtat

SEQ ID NO: 3639834 - DNA, 18 bp, Homo sapiens
ctgtgtgtttatgtgtgt

SEQ ID NO: 3639835 - DNA, 15 bp, Homo sapiens
ctgtgttgtacagct

SEQ ID NO: 3639836 - DNA, 18 bp, Homo sapiens
ctgtgtttccctgcctct

SEQ ID NO: 3639837 - DNA, 21 bp, Homo sapiens
ctgtgttttagtgtaaaattg

SEQ ID NO: 3639838 - DNA, 15 bp, Homo sapiens
ctgttaatatttcta

SEQ ID NO: 3639839 - DNA, 18 bp, Homo sapiens
ctgttaatatttctaaaa

SEQ ID NO: 3639840 - DNA, 18 bp, Homo sapiens
ctgttaatctgatgtata

SEQ ID NO: 3639841 - DNA, 17 bp, Homo sapiens
ctgttaatttataatgt

SEQ ID NO: 3639842 - DNA, 22 bp, Homo sapiens
ctgttaatttataatgtatttg

SEQ ID NO: 3639843 - DNA, 12 bp, Homo sapiens
ctgttacaaaag

SEQ ID NO: 3639844 - DNA, 18 bp, Homo sapiens
ctgttatcaaactgctgt

SEQ ID NO: 3639845 - DNA, 18 bp, Homo sapiens
ctgttatgctgtttccta

SEQ ID NO: 3639846 - DNA, 19 bp, Homo sapiens
ctgttatgctgtttcctag

SEQ ID NO: 3639847 - DNA, 13 bp, Homo sapiens
ctgttatttcttc

SEQ ID NO: 3639848 - DNA, 14 bp, Homo sapiens
ctgttatttcttcc

SEQ ID NO: 3639849 - DNA, 12 bp, Homo sapiens
ctgttcacagcc

SEQ ID NO: 3639850 - DNA, 15 bp, Homo sapiens
ctgttcagttgcact

SEQ ID NO: 3639851 - DNA, 16 bp, Homo sapiens
ctgttccatgcaactg

SEQ ID NO: 3639852 - DNA, 17 bp, Homo sapiens
ctgttcccacctgctgg

SEQ ID NO: 3639853 - DNA, 13 bp, Homo sapiens
ctgttccccagag

SEQ ID NO: 3639854 - DNA, 17 bp, Homo sapiens
ctgttcccccttcacaa

SEQ ID NO: 3639855 - DNA, 15 bp, Homo sapiens
ctgttcctcccccat

SEQ ID NO: 3639856 - DNA, 17 bp, Homo sapiens
ctgttcctttctctggg

SEQ ID NO: 3639857 - DNA, 16 bp, Homo sapiens
ctgttctaacatgtaa

SEQ ID NO: 3639858 - DNA, 14 bp, Homo sapiens
ctgttctccctttc

SEQ ID NO: 3639859 - DNA, 15 bp, Homo sapiens
ctgttcttagagtgt

SEQ ID NO: 3639860 - DNA, 19 bp, Homo sapiens
ctgttcttagagtgtagct

SEQ ID NO: 3639861 - DNA, 23 bp, Homo sapiens
ctgttcttagagtgtagctgtaa

SEQ ID NO: 3639862 - DNA, 15 bp, Homo sapiens
ctgttcttcagtcct

SEQ ID NO: 3639863 - DNA, 17 bp, Homo sapiens
ctgttgaatttcccaca

SEQ ID NO: 3639864 - DNA, 16 bp, Homo sapiens
ctgttgaggcatcaaa

SEQ ID NO: 3639865 - DNA, 17 bp, Homo sapiens
ctgttgagggccaagag

SEQ ID NO: 3639866 - DNA, 13 bp, Homo sapiens
ctgttgccatgga

SEQ ID NO: 3639867 - DNA, 16 bp, Homo sapiens
ctgttggagaaagaaa

SEQ ID NO: 3639868 - DNA, 14 bp, Homo sapiens
ctgttggtctgcct

SEQ ID NO: 3639869 - DNA, 22 bp, Homo sapiens
ctgttggtctgccttctgctga

SEQ ID NO: 3639870 - DNA, 16 bp, Homo sapiens
ctgtttattaatctta

SEQ ID NO: 3639871 - DNA, 18 bp, Homo sapiens
ctgtttattaatcttagt

SEQ ID NO: 3639872 - DNA, 13 bp, Homo sapiens
ctgtttcagaccc

SEQ ID NO: 3639873 - DNA, 16 bp, Homo sapiens
ctgtttcagaggctca

SEQ ID NO: 3639874 - DNA, 14 bp, Homo sapiens
ctgtttccctgctg

SEQ ID NO: 3639875 - DNA, 13 bp, Homo sapiens
ctgtttgattctt

SEQ ID NO: 3639876 - DNA, 16 bp, Homo sapiens
ctgttttcccccagca

SEQ ID NO: 3639877 - DNA, 12 bp, Homo sapiens
ctgttttcctcc

SEQ ID NO: 3639878 - DNA, 14 bp, Homo sapiens
ctgttttcctccct

SEQ ID NO: 3639879 - DNA, 17 bp, Homo sapiens
ctgttttcctcccttct

SEQ ID NO: 3639880 - DNA, 14 bp, Homo sapiens
ctgttttccttctt

SEQ ID NO: 3639881 - DNA, 17 bp, Homo sapiens
ctgttttggatgttgct

SEQ ID NO: 3639882 - DNA, 18 bp, Homo sapiens
ctgtttttattagccaat

SEQ ID NO: 3639883 - DNA, 14 bp, Homo sapiens
ctgtttttttgtta

SEQ ID NO: 3639884 - DNA, 12 bp, Homo sapiens
cttaaaaaatgt

SEQ ID NO: 3639885 - DNA, 16 bp, Homo sapiens
cttaaaaaatgtgaaa

SEQ ID NO: 3639886 - DNA, 14 bp, Homo sapiens
cttaaaaatttata

SEQ ID NO: 3639887 - DNA, 12 bp, Homo sapiens
cttaaaacactt

SEQ ID NO: 3639888 - DNA, 20 bp, Homo sapiens
cttaaaaccttgaaggtctg

SEQ ID NO: 3639889 - DNA, 14 bp, Homo sapiens
cttaaaagtaataa

SEQ ID NO: 3639890 - DNA, 15 bp, Homo sapiens
cttaaaagtaataaa

SEQ ID NO: 3639891 - DNA, 16 bp, Homo sapiens
cttaaaagtaataaag

SEQ ID NO: 3639892 - DNA, 17 bp, Homo sapiens
cttaaaagtaataaaga

SEQ ID NO: 3639893 - DNA, 15 bp, Homo sapiens
cttaaaagtattcat

SEQ ID NO: 3639894 - DNA, 13 bp, Homo sapiens
cttaaaagtttct

SEQ ID NO: 3639895 - DNA, 12 bp, Homo sapiens
cttaaaatgcat

SEQ ID NO: 3639896 - DNA, 11 bp, Homo sapiens
cttaaaatgga

SEQ ID NO: 3639897 - DNA, 18 bp, Homo sapiens
cttaaaatggaattgaaa

SEQ ID NO: 3639898 - DNA, 12 bp, Homo sapiens
cttaaacaaaaa

SEQ ID NO: 3639899 - DNA, 18 bp, Homo sapiens
cttaaacacaggctgtcc

SEQ ID NO: 3639900 - DNA, 20 bp, Homo sapiens
cttaaacataataaatcaca

SEQ ID NO: 3639901 - DNA, 18 bp, Homo sapiens
cttaaagaaaacccaccc

SEQ ID NO: 3639902 - DNA, 23 bp, Homo sapiens
cttaaagaggaatggccctcatt

SEQ ID NO: 3639903 - DNA, 15 bp, Homo sapiens
cttaaatttgttctt

SEQ ID NO: 3639904 - DNA, 21 bp, Homo sapiens
cttaacttcttgcttctttct

SEQ ID NO: 3639905 - DNA, 13 bp, Homo sapiens
cttaagaattgaa

SEQ ID NO: 3639906 - DNA, 12 bp, Homo sapiens
cttaagcaaatt

SEQ ID NO: 3639907 - DNA, 20 bp, Homo sapiens
cttaagcaaattttgtatta

SEQ ID NO: 3639908 - DNA, 22 bp, Homo sapiens
ctttgtggccaaggagctgcta

SEQ ID NO: 3639909 - DNA, 16 bp, Homo sapiens
ctttgtgtagctttgc

SEQ ID NO: 3639910 - DNA, 14 bp, Homo sapiens
ctttgtgttcattt

SEQ ID NO: 3639911 - DNA, 17 bp, Homo sapiens
ctttgttgtgagaatgg

SEQ ID NO: 3639912 - DNA, 21 bp, Homo sapiens
ctttgtttctttgttttattt

SEQ ID NO: 3639913 - DNA, 23 bp, Homo sapiens
cttttaaaatttgtcttaaaaat

SEQ ID NO: 3639914 - DNA, 11 bp, Homo sapiens
cttttaattta

SEQ ID NO: 3639915 - DNA, 20 bp, Homo sapiens
cttttactgaagcctttctt

SEQ ID NO: 3639916 - DNA, 15 bp, Homo sapiens
cttttagagagggga

SEQ ID NO: 3639917 - DNA, 13 bp, Homo sapiens
cttttatattcta

SEQ ID NO: 3639918 - DNA, 14 bp, Homo sapiens
cttttatattctaa

SEQ ID NO: 3639919 - DNA, 13 bp, Homo sapiens
cttttatgtaaat

SEQ ID NO: 3639920 - DNA, 14 bp, Homo sapiens
cttttatgtatttt

SEQ ID NO: 3639921 - DNA, 21 bp, Homo sapiens
cttttattttcacagcccata

SEQ ID NO: 3639922 - DNA, 13 bp, Homo sapiens
cttttcaggagat

SEQ ID NO: 3639923 - DNA, 18 bp, Homo sapiens
cttttcatatctcttgcc

SEQ ID NO: 3639924 - DNA, 23 bp, Homo sapiens
cttttccaaatcaaggataaata

SEQ ID NO: 3639925 - DNA, 15 bp, Homo sapiens
cttttcccttgcttc

SEQ ID NO: 3639926 - DNA, 17 bp, Homo sapiens
cttttcctggcagctgc

SEQ ID NO: 3639927 - DNA, 19 bp, Homo sapiens
cttttcctggcagctgctg

SEQ ID NO: 3639928 - DNA, 18 bp, Homo sapiens
cttttctaatgccttttg

SEQ ID NO: 3639929 - DNA, 17 bp, Homo sapiens
cttttctcctcactgta

SEQ ID NO: 3639930 - DNA, 14 bp, Homo sapiens
cttttctgtcctgg

SEQ ID NO: 3639931 - DNA, 15 bp, Homo sapiens
cttttctgtcctggg

SEQ ID NO: 3639932 - DNA, 14 bp, Homo sapiens
cttttgaacccagg

SEQ ID NO: 3639933 - DNA, 19 bp, Homo sapiens
cttttgaatacatttgtat

SEQ ID NO: 3639934 - DNA, 20 bp, Homo sapiens
cttttgaatacatttgtatt

SEQ ID NO: 3639935 - DNA, 21 bp, Homo sapiens
cttttgaatacatttgtattt

SEQ ID NO: 3639936 - DNA, 22 bp, Homo sapiens
cttttgcaggagtttgtggtaa

SEQ ID NO: 3639937 - DNA, 17 bp, Homo sapiens
cttttgctaataccaaa

SEQ ID NO: 3639938 - DNA, 15 bp, Homo sapiens
cttttgctctttttg

SEQ ID NO: 3639939 - DNA, 21 bp, Homo sapiens
cttttgctgaacaggaaagag

SEQ ID NO: 3639940 - DNA, 23 bp, Homo sapiens
cttttggagaaccagggctcttc

SEQ ID NO: 3639941 - DNA, 17 bp, Homo sapiens
cttttggcagagaccat

SEQ ID NO: 3639942 - DNA, 22 bp, Homo sapiens
cttttgggggtcagcatccagt

SEQ ID NO: 3639943 - DNA, 13 bp, Homo sapiens
cttttgtaagaca

SEQ ID NO: 3639944 - DNA, 14 bp, Homo sapiens
cttttgtatctttt

SEQ ID NO: 3639945 - DNA, 15 bp, Homo sapiens
cttttgtggagggga

SEQ ID NO: 3639946 - DNA, 21 bp, Homo sapiens
ctttttaaaaattgttattta

SEQ ID NO: 3639947 - DNA, 16 bp, Homo sapiens
ctttttacctggccta

SEQ ID NO: 3639948 - DNA, 17 bp, Homo sapiens
ctttttattccctgccc

SEQ ID NO: 3639949 - DNA, 18 bp, Homo sapiens
ctttttcataaattattt

SEQ ID NO: 3639950 - DNA, 13 bp, Homo sapiens
ctttttcttcact

SEQ ID NO: 3639951 - DNA, 14 bp, Homo sapiens
ctttttgaaatgtc

SEQ ID NO: 3639952 - DNA, 15 bp, Homo sapiens
ctttttgaggcaaaa

SEQ ID NO: 3639953 - DNA, 16 bp, Homo sapiens
cttttttttaaaaaaa

SEQ ID NO: 3639954 - DNA, 20 bp, Homo sapiens
ctttttttttttaagaaaaa

SEQ ID NO: 3639955 - DNA, 23 bp, Homo sapiens
ctttttttttttttaaagacaga

SEQ ID NO: 3639956 - DNA, 14 bp, Homo sapiens
gaaaaaaaaagcaa

SEQ ID NO: 3639957 - DNA, 22 bp, Homo sapiens
gaaaaaaaaagcaaatcagaaa

SEQ ID NO: 3639958 - DNA, 19 bp, Homo sapiens
gaaaaaaatcgtccaggga

SEQ ID NO: 3639959 - DNA, 13 bp, Homo sapiens
gaaaaaagagttt

SEQ ID NO: 3639960 - DNA, 23 bp, Homo sapiens
gaaaaacaccgcttctgcctttt

SEQ ID NO: 3639961 - DNA, 17 bp, Homo sapiens
gaaaaacaggaaaggag

SEQ ID NO: 3639962 - DNA, 13 bp, Homo sapiens
gaaaaagaagaaa

SEQ ID NO: 3639963 - DNA, 14 bp, Homo sapiens
gaaaaagacataaa

SEQ ID NO: 3639964 - DNA, 17 bp, Homo sapiens
gaaaaagacataaaaca

SEQ ID NO: 3639965 - DNA, 18 bp, Homo sapiens
gaaaaagacataaaacag

SEQ ID NO: 3639966 - DNA, 17 bp, Homo sapiens
gaaaaataataaagtca

SEQ ID NO: 3639967 - DNA, 19 bp, Homo sapiens
gaaaaatatatactaaaca

SEQ ID NO: 3639968 - DNA, 20 bp, Homo sapiens
gaaaaatctaagtgatataa

SEQ ID NO: 3639969 - DNA, 17 bp, Homo sapiens
gaaaaatgtgtggttct

SEQ ID NO: 3639970 - DNA, 22 bp, Homo sapiens
gaaaacagcgaacagccttaga

SEQ ID NO: 3639971 - DNA, 12 bp, Homo sapiens
gaaaacttcaaa

SEQ ID NO: 3639972 - DNA, 13 bp, Homo sapiens
gaaaagaaagaaa

SEQ ID NO: 3639973 - DNA, 16 bp, Homo sapiens
gaaaagaaagaaacca

SEQ ID NO: 3639974 - DNA, 14 bp, Homo sapiens
gaaaagactccaaa

SEQ ID NO: 3639975 - DNA, 16 bp, Homo sapiens
gaaaagactccaaaga

SEQ ID NO: 3639976 - DNA, 17 bp, Homo sapiens
gaaaagactccaaagaa

SEQ ID NO: 3639977 - DNA, 20 bp, Homo sapiens
gaaaagatgtacctggtgga

SEQ ID NO: 3639978 - DNA, 19 bp, Homo sapiens
gaaaagattcttcttaaaa

SEQ ID NO: 3639979 - DNA, 23 bp, Homo sapiens
gaaaagattcttcttaaaagttt

SEQ ID NO: 3639980 - DNA, 15 bp, Homo sapiens
gaaaagcagacattt

SEQ ID NO: 3639981 - DNA, 23 bp, Homo sapiens
gaaaagccgaaagggttaatcat

SEQ ID NO: 3639982 - DNA, 13 bp, Homo sapiens
gaaaagctaagag

SEQ ID NO: 3639983 - DNA, 15 bp, Homo sapiens
gaaaaggcaggtgct

SEQ ID NO: 3639984 - DNA, 13 bp, Homo sapiens
gaaaagtcttcct

SEQ ID NO: 3639985 - DNA, 12 bp, Homo sapiens
gaaaagttattt

SEQ ID NO: 3639986 - DNA, 14 bp, Homo sapiens
gaaaagttatttat

SEQ ID NO: 3639987 - DNA, 16 bp, Homo sapiens
gaaaagttcagggacc

SEQ ID NO: 3639988 - DNA, 12 bp, Homo sapiens
gaaaataaacat

SEQ ID NO: 3639989 - DNA, 17 bp, Homo sapiens
gaaaataaacatcagtt

SEQ ID NO: 3639990 - DNA, 22 bp, Homo sapiens
gaaaatatagacattctcacat

SEQ ID NO: 3639991 - DNA, 11 bp, Homo sapiens
gaaaatatgtt

SEQ ID NO: 3639992 - DNA, 14 bp, Homo sapiens
gaaaatatttcatt

SEQ ID NO: 3639993 - DNA, 17 bp, Homo sapiens
gaaaatgaaatgcatat

SEQ ID NO: 3639994 - DNA, 18 bp, Homo sapiens
gaaaatgaaatgcatatt

SEQ ID NO: 3639995 - DNA, 18 bp, Homo sapiens
gaaaatgacctcaaggaa

SEQ ID NO: 3639996 - DNA, 12 bp, Homo sapiens
gaaaatgactta

SEQ ID NO: 3639997 - DNA, 16 bp, Homo sapiens
gaaaatgacttatttc

SEQ ID NO: 3639998 - DNA, 22 bp, Homo sapiens
gaaaatgcagcagggatgccct

SEQ ID NO: 3639999 - DNA, 18 bp, Homo sapiens
gaaaattaggatttcatg

SEQ ID NO: 3640000 - DNA, 21 bp, Homo sapiens
gaaaattctaacccaagacat

SEQ ID NO: 3640001 - DNA, 12 bp, Homo sapiens
gaaaattgtctg

SEQ ID NO: 3640002 - DNA, 13 bp, Homo sapiens
gaaaatttttgta

SEQ ID NO: 3640003 - DNA, 18 bp, Homo sapiens
gaaacaaaaaaaaaatga

SEQ ID NO: 3640004 - DNA, 14 bp, Homo sapiens
gaaacaaaaacact

SEQ ID NO: 3640005 - DNA, 15 bp, Homo sapiens
gaaacaacagcttta

SEQ ID NO: 3640006 - DNA, 22 bp, Homo sapiens
gaaacaagctgtgcaggcatgg

SEQ ID NO: 3640007 - DNA, 21 bp, Homo sapiens
gaaacacaatacctacaataa

SEQ ID NO: 3640008 - DNA, 22 bp, Homo sapiens
gaaacacaatacctacaataaa

SEQ ID NO: 3640009 - DNA, 22 bp, Homo sapiens
gaaacacagcttacaatcgcaa

SEQ ID NO: 3640010 - DNA, 15 bp, Homo sapiens
gaaacaccagtgtta

SEQ ID NO: 3640011 - DNA, 17 bp, Homo sapiens
gaaacagaaaaataagt

SEQ ID NO: 3640012 - DNA, 14 bp, Homo sapiens
gaaacagaaacaaa

SEQ ID NO: 3640013 - DNA, 22 bp, Homo sapiens
gaaacagaaacaaaaacactaa

SEQ ID NO: 3640014 - DNA, 16 bp, Homo sapiens
gaaacagagtccaatt

SEQ ID NO: 3640015 - DNA, 21 bp, Homo sapiens
gaaacagagtggcctccctgc

SEQ ID NO: 3640016 - DNA, 23 bp, Homo sapiens
gaaacagattcaggccagcccag

SEQ ID NO: 3640017 - DNA, 17 bp, Homo sapiens
gaaacagcatgaataaa

SEQ ID NO: 3640018 - DNA, 15 bp, Homo sapiens
gaaacagctcagcca

SEQ ID NO: 3640019 - DNA, 17 bp, Homo sapiens
gaaacagctcagccagt

SEQ ID NO: 3640020 - DNA, 20 bp, Homo sapiens
gaaacagttggtaacttttg

SEQ ID NO: 3640021 - DNA, 20 bp, Homo sapiens
gaaacatgactcgtatatgt

SEQ ID NO: 3640022 - DNA, 12 bp, Homo sapiens
gaaacatttata

SEQ ID NO: 3640023 - DNA, 14 bp, Homo sapiens
gaaacatttatatt

SEQ ID NO: 3640024 - DNA, 21 bp, Homo sapiens
gaaaccacagtcttcccagca

SEQ ID NO: 3640025 - DNA, 17 bp, Homo sapiens
gaaaccttgctctcctc

SEQ ID NO: 3640026 - DNA, 19 bp, Homo sapiens
gaaaccttgctctcctcat

SEQ ID NO: 3640027 - DNA, 14 bp, Homo sapiens
gaaaccttttattt

SEQ ID NO: 3640028 - DNA, 15 bp, Homo sapiens
gaaactccagatgcc

SEQ ID NO: 3640029 - DNA, 22 bp, Homo sapiens
gaaactccatctcaaaacaaaa

SEQ ID NO: 3640030 - DNA, 23 bp, Homo sapiens
gaaactccatctcaaaacaaaac

SEQ ID NO: 3640031 - DNA, 23 bp, Homo sapiens
gaaactgaggcccagagagggaa

SEQ ID NO: 3640032 - DNA, 13 bp, Homo sapiens
gaaactgccagca

SEQ ID NO: 3640033 - DNA, 15 bp, Homo sapiens
gaaactgccagcaac

SEQ ID NO: 3640034 - DNA, 17 bp, Homo sapiens
gaaactgctgcagatta

SEQ ID NO: 3640035 - DNA, 20 bp, Homo sapiens
gaaactggtttataataaac

SEQ ID NO: 3640036 - DNA, 14 bp, Homo sapiens
gaaacttttaactg

SEQ ID NO: 3640037 - DNA, 16 bp, Homo sapiens
gaaacttttttatttt

SEQ ID NO: 3640038 - DNA, 14 bp, Homo sapiens
gaaagaagagaagt

SEQ ID NO: 3640039 - DNA, 17 bp, Homo sapiens
gaaagactattcaaaca

SEQ ID NO: 3640040 - DNA, 21 bp, Homo sapiens
gaaagacttctcaaagagaat

SEQ ID NO: 3640041 - DNA, 19 bp, Homo sapiens
gacatggaacagtgtaaat

SEQ ID NO: 3640042 - DNA, 20 bp, Homo sapiens
gacatggaacagtgtaaatc

SEQ ID NO: 3640043 - DNA, 23 bp, Homo sapiens
gacatggggaggttgtggggcct

SEQ ID NO: 3640044 - DNA, 12 bp, Homo sapiens
gacatggtgggg

SEQ ID NO: 3640045 - DNA, 15 bp, Homo sapiens
gacattgacagcaat

SEQ ID NO: 3640046 - DNA, 17 bp, Homo sapiens
gacattgacagcaattc

SEQ ID NO: 3640047 - DNA, 18 bp, Homo sapiens
gacattgacagcaattca

SEQ ID NO: 3640048 - DNA, 22 bp, Homo sapiens
gacattgctccaagatgttctc

SEQ ID NO: 3640049 - DNA, 23 bp, Homo sapiens
gacattggcacctaatccaggca

SEQ ID NO: 3640050 - DNA, 14 bp, Homo sapiens
gacattttacatta

SEQ ID NO: 3640051 - DNA, 21 bp, Homo sapiens
gacattttacattaaattttt

SEQ ID NO: 3640052 - DNA, 20 bp, Homo sapiens
gaccaaagcaaagaaaataa

SEQ ID NO: 3640053 - DNA, 16 bp, Homo sapiens
gaccaacagaaacctt

SEQ ID NO: 3640054 - DNA, 17 bp, Homo sapiens
gaccaactgccctaagc

SEQ ID NO: 3640055 - DNA, 15 bp, Homo sapiens
gaccaatgcttgcat

SEQ ID NO: 3640056 - DNA, 15 bp, Homo sapiens
gaccaattgaagcat

SEQ ID NO: 3640057 - DNA, 17 bp, Homo sapiens
gaccaattgaagcatga

SEQ ID NO: 3640058 - DNA, 21 bp, Homo sapiens
gaccacagactcaatgtgctc

SEQ ID NO: 3640059 - DNA, 16 bp, Homo sapiens
gaccacgccccaggac

SEQ ID NO: 3640060 - DNA, 18 bp, Homo sapiens
gaccacgccccaggacct

SEQ ID NO: 3640061 - DNA, 19 bp, Homo sapiens
gaccacgccccaggacctc

SEQ ID NO: 3640062 - DNA, 16 bp, Homo sapiens
gaccacttgccacgct

SEQ ID NO: 3640063 - DNA, 13 bp, Homo sapiens
gaccagcagcgcc

SEQ ID NO: 3640064 - DNA, 20 bp, Homo sapiens
gaccagcctccatgctgcct

SEQ ID NO: 3640065 - DNA, 21 bp, Homo sapiens
gaccagcctccatgctgcctc

SEQ ID NO: 3640066 - DNA, 22 bp, Homo sapiens
gaccagcctggccaacatggta

SEQ ID NO: 3640067 - DNA, 22 bp, Homo sapiens
gaccagctcaggacagatgcca

SEQ ID NO: 3640068 - DNA, 16 bp, Homo sapiens
gaccagggatgctggg

SEQ ID NO: 3640069 - DNA, 19 bp, Homo sapiens
gaccagggatgctgggctg

SEQ ID NO: 3640070 - DNA, 20 bp, Homo sapiens
gaccagggttggcaccttcc

SEQ ID NO: 3640071 - DNA, 19 bp, Homo sapiens
gaccaggtttgcaggagcc

SEQ ID NO: 3640072 - DNA, 15 bp, Homo sapiens
gaccagtctgaccct

SEQ ID NO: 3640073 - DNA, 22 bp, Homo sapiens
gaccagtttaagccgcagacct

SEQ ID NO: 3640074 - DNA, 13 bp, Homo sapiens
gaccataagagaa

SEQ ID NO: 3640075 - DNA, 17 bp, Homo sapiens
gaccatattacctggat

SEQ ID NO: 3640076 - DNA, 17 bp, Homo sapiens
gaccatcatgccctctc

SEQ ID NO: 3640077 - DNA, 18 bp, Homo sapiens
gaccatctttagcagttt

SEQ ID NO: 3640078 - DNA, 19 bp, Homo sapiens
gaccatctttagcagtttc

SEQ ID NO: 3640079 - DNA, 18 bp, Homo sapiens
gaccatgcgtcaggggcc

SEQ ID NO: 3640080 - DNA, 18 bp, Homo sapiens
gacccaaaccccctgcag

SEQ ID NO: 3640081 - DNA, 21 bp, Homo sapiens
gacccaaaccccctgcagccc

SEQ ID NO: 3640082 - DNA, 15 bp, Homo sapiens
gacccacagaacttg

SEQ ID NO: 3640083 - DNA, 16 bp, Homo sapiens
gacccagaatggagcc

SEQ ID NO: 3640084 - DNA, 15 bp, Homo sapiens
gacccagcatctccc

SEQ ID NO: 3640085 - DNA, 17 bp, Homo sapiens
gacccagtcccacactg

SEQ ID NO: 3640086 - DNA, 22 bp, Homo sapiens
gacccagtcccacactgtggcc

SEQ ID NO: 3640087 - DNA, 17 bp, Homo sapiens
gacccagtgcccccact

SEQ ID NO: 3640088 - DNA, 17 bp, Homo sapiens
gacccatccctgcctgg

SEQ ID NO: 3640089 - DNA, 21 bp, Homo sapiens
gaccccaagggggctgctgct

SEQ ID NO: 3640090 - DNA, 16 bp, Homo sapiens
gaccccacatccttct

SEQ ID NO: 3640091 - DNA, 21 bp, Homo sapiens
gacccccaaccaagtggctcc

SEQ ID NO: 3640092 - DNA, 17 bp, Homo sapiens
gacccccatctgagctg

SEQ ID NO: 3640093 - DNA, 13 bp, Homo sapiens
gaccccctcagcc

SEQ ID NO: 3640094 - DNA, 20 bp, Homo sapiens
gaccccgagaaccctgagca

SEQ ID NO: 3640095 - DNA, 15 bp, Homo sapiens
gaccccggcctgtct

SEQ ID NO: 3640096 - DNA, 21 bp, Homo sapiens
gacccctggcttttcactgct

SEQ ID NO: 3640097 - DNA, 12 bp, Homo sapiens
gacccctgggag

SEQ ID NO: 3640098 - DNA, 15 bp, Homo sapiens
gacccctgggagctt

SEQ ID NO: 3640099 - DNA, 20 bp, Homo sapiens
gacccggaggggcctggcag

SEQ ID NO: 3640100 - DNA, 18 bp, Homo sapiens
gaccctcaggcacacctt

SEQ ID NO: 3640101 - DNA, 20 bp, Homo sapiens
gaccctcaggcacaccttgc

SEQ ID NO: 3640102 - DNA, 22 bp, Homo sapiens
gaccctgacctccgcccctgcc

SEQ ID NO: 3640103 - DNA, 18 bp, Homo sapiens
gaccctgcaagaccacgg

SEQ ID NO: 3640104 - DNA, 13 bp, Homo sapiens
gaccctgggcagt

SEQ ID NO: 3640105 - DNA, 16 bp, Homo sapiens
gaccctgtcctgcagt

SEQ ID NO: 3640106 - DNA, 17 bp, Homo sapiens
gacccttgacacctgct

SEQ ID NO: 3640107 - DNA, 13 bp, Homo sapiens
gaccgagccctgg

SEQ ID NO: 3640108 - DNA, 19 bp, Homo sapiens
gaccgatgtgtctcccaga

SEQ ID NO: 3640109 - DNA, 14 bp, Homo sapiens
gacctaccccagcc

SEQ ID NO: 3640110 - DNA, 15 bp, Homo sapiens
gacctaccccagcca

SEQ ID NO: 3640111 - DNA, 16 bp, Homo sapiens
gacctaccccagccag

SEQ ID NO: 3640112 - DNA, 21 bp, Homo sapiens
gacctaccccagccaggctcc

SEQ ID NO: 3640113 - DNA, 14 bp, Homo sapiens
gacctcactggcct

SEQ ID NO: 3640114 - DNA, 15 bp, Homo sapiens
gacctcactggcctg

SEQ ID NO: 3640115 - DNA, 16 bp, Homo sapiens
gacctcactggcctgc

SEQ ID NO: 3640116 - DNA, 18 bp, Homo sapiens
gacctcactggcctgcca

SEQ ID NO: 3640117 - DNA, 16 bp, Homo sapiens
gacctcatcagccttg

SEQ ID NO: 3640118 - DNA, 15 bp, Homo sapiens
gacctcatctgtgga

SEQ ID NO: 3640119 - DNA, 17 bp, Homo sapiens
gacctcatctgtggagc

SEQ ID NO: 3640120 - DNA, 15 bp, Homo sapiens
gacctccagaagtcc

SEQ ID NO: 3640121 - DNA, 21 bp, Homo sapiens
gacctccagaagtcccttcaa

SEQ ID NO: 3640122 - DNA, 18 bp, Homo sapiens
gacctcccaactctaaag

SEQ ID NO: 3640123 - DNA, 15 bp, Homo sapiens
gacctccccacccgc

SEQ ID NO: 3640124 - DNA, 15 bp, Homo sapiens
gacctctgacaactg

SEQ ID NO: 3640125 - DNA, 16 bp, Homo sapiens
gacctcttctggagat

SEQ ID NO: 3640126 - DNA, 13 bp, Homo sapiens
gacctgacaattt

SEQ ID NO: 3640127 - DNA, 13 bp, Homo sapiens
gacctgagcggca

SEQ ID NO: 3640128 - DNA, 14 bp, Homo sapiens
gacctggcgtgctc

SEQ ID NO: 3640129 - DNA, 16 bp, Homo sapiens
gacctggctccactct

SEQ ID NO: 3640130 - DNA, 14 bp, Homo sapiens
gaccttaaatgcaa

SEQ ID NO: 3640131 - DNA, 16 bp, Homo sapiens
gaccttcgggctgtgc

SEQ ID NO: 3640132 - DNA, 19 bp, Homo sapiens
gaccttcgggctgtgcccg

SEQ ID NO: 3640133 - DNA, 11 bp, Homo sapiens
gacctttattt

SEQ ID NO: 3640134 - DNA, 19 bp, Homo sapiens
gacctttatttattaaact

SEQ ID NO: 3640135 - DNA, 21 bp, Homo sapiens
gacctttatttattaaacttc

SEQ ID NO: 3640136 - DNA, 22 bp, Homo sapiens
gacctttatttattaaacttca

SEQ ID NO: 3640137 - DNA, 14 bp, Homo sapiens
gacgaggggcaggg

SEQ ID NO: 3640138 - DNA, 17 bp, Homo sapiens
gacgccaaggaggtggg

SEQ ID NO: 3640139 - DNA, 22 bp, Homo sapiens
gacgccaggcaccacagcctcc

SEQ ID NO: 3640140 - DNA, 17 bp, Homo sapiens
gacgctccctgctccac

SEQ ID NO: 3640141 - DNA, 21 bp, Homo sapiens
gacggaaacaacgttgctatt

SEQ ID NO: 3640142 - DNA, 15 bp, Homo sapiens
gacggtctgtgtgct

SEQ ID NO: 3640143 - DNA, 20 bp, Homo sapiens
gacggtgttaattttgctaa

SEQ ID NO: 3640144 - DNA, 22 bp, Homo sapiens
gacgtgaacgttttaataattt

SEQ ID NO: 3640145 - DNA, 14 bp, Homo sapiens
gacgttaggccagg

SEQ ID NO: 3640146 - DNA, 15 bp, Homo sapiens
gacgttaggccaggc

SEQ ID NO: 3640147 - DNA, 18 bp, Homo sapiens
gactaaactttttttctg

SEQ ID NO: 3640148 - DNA, 14 bp, Homo sapiens
gactacctctgtgc

SEQ ID NO: 3640149 - DNA, 19 bp, Homo sapiens
gactacctctgtgccttgc

SEQ ID NO: 3640150 - DNA, 21 bp, Homo sapiens
gactagaactcctgtcttctt

SEQ ID NO: 3640151 - DNA, 19 bp, Homo sapiens
gactagagggacctctccc

SEQ ID NO: 3640152 - DNA, 18 bp, Homo sapiens
gactagatgtagtatttt

SEQ ID NO: 3640153 - DNA, 22 bp, Homo sapiens
gactatatttgggcctgctcca

SEQ ID NO: 3640154 - DNA, 15 bp, Homo sapiens
gactatggagctgag

SEQ ID NO: 3640155 - DNA, 16 bp, Homo sapiens
gactattcaaacagtc

SEQ ID NO: 3640156 - DNA, 22 bp, Homo sapiens
gactcaaatgctcagaccagct

SEQ ID NO: 3640157 - DNA, 14 bp, Homo sapiens
gactcaagtaccca

SEQ ID NO: 3640158 - DNA, 13 bp, Homo sapiens
gactcagcagagt

SEQ ID NO: 3640159 - DNA, 15 bp, Homo sapiens
gactcagcagagtga

SEQ ID NO: 3640160 - DNA, 19 bp, Homo sapiens
gactcagggacctaagcca

SEQ ID NO: 3640161 - DNA, 15 bp, Homo sapiens
gactcaggttgtctg

SEQ ID NO: 3640162 - DNA, 15 bp, Homo sapiens
gactccaaagaaatg

SEQ ID NO: 3640163 - DNA, 15 bp, Homo sapiens
gactccaaagctgtt

SEQ ID NO: 3640164 - DNA, 17 bp, Homo sapiens
gactccaaagctgttcc

SEQ ID NO: 3640165 - DNA, 24 bp, Homo sapiens
gactccagggtgacaaggcctgct

SEQ ID NO: 3640166 - DNA, 15 bp, Homo sapiens
gactccatctcttct

SEQ ID NO: 3640167 - DNA, 18 bp, Homo sapiens
gactccatctcttctgca

SEQ ID NO: 3640168 - DNA, 12 bp, Homo sapiens
gactcccagaac

SEQ ID NO: 3640169 - DNA, 14 bp, Homo sapiens
gactcccagaacct

SEQ ID NO: 3640170 - DNA, 22 bp, Homo sapiens
gactcccattcctgaagaacca

SEQ ID NO: 3640171 - DNA, 14 bp, Homo sapiens
gactccccagccca

SEQ ID NO: 3640172 - DNA, 22 bp, Homo sapiens
gactccccagcccagcacccct

SEQ ID NO: 3640173 - DNA, 19 bp, Homo sapiens
gagtggttaggcagcaagc

SEQ ID NO: 3640174 - DNA, 17 bp, Homo sapiens
gagtgtaaaatgtatat

SEQ ID NO: 3640175 - DNA, 18 bp, Homo sapiens
gagtgtagctgtaagggc

SEQ ID NO: 3640176 - DNA, 20 bp, Homo sapiens
gagtgtagctgtaagggcag

SEQ ID NO: 3640177 - DNA, 20 bp, Homo sapiens
gagtgtgaagctttgcacac

SEQ ID NO: 3640178 - DNA, 18 bp, Homo sapiens
gagtgtgggggaggcgca

SEQ ID NO: 3640179 - DNA, 16 bp, Homo sapiens
gagtgtgtggtctctg

SEQ ID NO: 3640180 - DNA, 15 bp, Homo sapiens
gagttaacaggacag

SEQ ID NO: 3640181 - DNA, 13 bp, Homo sapiens
gagttaagacctg

SEQ ID NO: 3640182 - DNA, 17 bp, Homo sapiens
gagttaagacctggcag

SEQ ID NO: 3640183 - DNA, 13 bp, Homo sapiens
gagttacagttct

SEQ ID NO: 3640184 - DNA, 14 bp, Homo sapiens
gagttacagttctg

SEQ ID NO: 3640185 - DNA, 17 bp, Homo sapiens
gagttccggggagaaac

SEQ ID NO: 3640186 - DNA, 16 bp, Homo sapiens
gagttcctctgcagtt

SEQ ID NO: 3640187 - DNA, 17 bp, Homo sapiens
gagttcctctgcagttt

SEQ ID NO: 3640188 - DNA, 22 bp, Homo sapiens
gagttccttatccctctcttcc

SEQ ID NO: 3640189 - DNA, 21 bp, Homo sapiens
gagttctctcatcggaggccc

SEQ ID NO: 3640190 - DNA, 12 bp, Homo sapiens
gagttctttgct

SEQ ID NO: 3640191 - DNA, 19 bp, Homo sapiens
gagttctttgctgcccctg

SEQ ID NO: 3640192 - DNA, 14 bp, Homo sapiens
gagttgatctggaa

SEQ ID NO: 3640193 - DNA, 16 bp, Homo sapiens
gagttgatctggaacc

SEQ ID NO: 3640194 - DNA, 17 bp, Homo sapiens
gagttgatctggaaccc

SEQ ID NO: 3640195 - DNA, 21 bp, Homo sapiens
gagttggaacaacatgttcta

SEQ ID NO: 3640196 - DNA, 21 bp, Homo sapiens
gagttgggggtcgggtggggg

SEQ ID NO: 3640197 - DNA, 12 bp, Homo sapiens
gagtttctctct

SEQ ID NO: 3640198 - DNA, 13 bp, Homo sapiens
gagtttctgtttg

SEQ ID NO: 3640199 - DNA, 14 bp, Homo sapiens
gagtttctgtttga

SEQ ID NO: 3640200 - DNA, 14 bp, Homo sapiens
gagtttgtggtaac

SEQ ID NO: 3640201 - DNA, 17 bp, Homo sapiens
gagttttataaattaaa

SEQ ID NO: 3640202 - DNA, 18 bp, Homo sapiens
gataaaaatcatatagac

SEQ ID NO: 3640203 - DNA, 13 bp, Homo sapiens
gataaaagatggc

SEQ ID NO: 3640204 - DNA, 16 bp, Homo sapiens
gataaactgaattttt

SEQ ID NO: 3640205 - DNA, 14 bp, Homo sapiens
gataaatatcttac

SEQ ID NO: 3640206 - DNA, 11 bp, Homo sapiens
gataagaaaac

SEQ ID NO: 3640207 - DNA, 22 bp, Homo sapiens
gataagtttctattctgtcagt

SEQ ID NO: 3640208 - DNA, 17 bp, Homo sapiens
gataataggtcatatgt

SEQ ID NO: 3640209 - DNA, 13 bp, Homo sapiens
gataattatatca

SEQ ID NO: 3640210 - DNA, 15 bp, Homo sapiens
gataatttatttcaa

SEQ ID NO: 3640211 - DNA, 17 bp, Homo sapiens
gatacaaaagcttttta

SEQ ID NO: 3640212 - DNA, 23 bp, Homo sapiens
gatacaaaagctttttaaaattt

SEQ ID NO: 3640213 - DNA, 23 bp, Homo sapiens
gataccattctattctccagaca

SEQ ID NO: 3640214 - DNA, 12 bp, Homo sapiens
gatacctggagc

SEQ ID NO: 3640215 - DNA, 20 bp, Homo sapiens
gatactctttctaatgctga

SEQ ID NO: 3640216 - DNA, 22 bp, Homo sapiens
gatactgtctctccagtgaaat

SEQ ID NO: 3640217 - DNA, 14 bp, Homo sapiens
gatactgtgtatat

SEQ ID NO: 3640218 - DNA, 21 bp, Homo sapiens
gatagatgctggcccagggcc

SEQ ID NO: 3640219 - DNA, 13 bp, Homo sapiens
gatagatgtgtgg

SEQ ID NO: 3640220 - DNA, 13 bp, Homo sapiens
gatagcagggcat

SEQ ID NO: 3640221 - DNA, 16 bp, Homo sapiens
gatagctattaagata

SEQ ID NO: 3640222 - DNA, 19 bp, Homo sapiens
gatagctctctgactgctt

SEQ ID NO: 3640223 - DNA, 13 bp, Homo sapiens
gataggaaactga

SEQ ID NO: 3640224 - DNA, 15 bp, Homo sapiens
gataggaaactgaag

SEQ ID NO: 3640225 - DNA, 15 bp, Homo sapiens
gatagtgttctgctc

SEQ ID NO: 3640226 - DNA, 17 bp, Homo sapiens
gatagtgttctgctcct

SEQ ID NO: 3640227 - DNA, 15 bp, Homo sapiens
gatatataagtgtac

SEQ ID NO: 3640228 - DNA, 17 bp, Homo sapiens
gatatataagtgtacat

SEQ ID NO: 3640229 - DNA, 21 bp, Homo sapiens
gatatatcatgagtgaataaa

SEQ ID NO: 3640230 - DNA, 14 bp, Homo sapiens
gatatcaacagctt

SEQ ID NO: 3640231 - DNA, 20 bp, Homo sapiens
gatatgcatgtagcatataa

SEQ ID NO: 3640232 - DNA, 21 bp, Homo sapiens
gatatgcatgtagcatataaa

SEQ ID NO: 3640233 - DNA, 12 bp, Homo sapiens
gatatgcttgta

SEQ ID NO: 3640234 - DNA, 20 bp, Homo sapiens
gatatggcaggactcctggc

SEQ ID NO: 3640235 - DNA, 15 bp, Homo sapiens
gatatggctgcccag

SEQ ID NO: 3640236 - DNA, 12 bp, Homo sapiens
gatattaaattc

SEQ ID NO: 3640237 - DNA, 14 bp, Homo sapiens
gatattgttctcca

SEQ ID NO: 3640238 - DNA, 12 bp, Homo sapiens
gatatttattga

SEQ ID NO: 3640239 - DNA, 17 bp, Homo sapiens
gatatttcaatctttta

SEQ ID NO: 3640240 - DNA, 23 bp, Homo sapiens
gatattttatctattggcctgtt

SEQ ID NO: 3640241 - DNA, 20 bp, Homo sapiens
gatattttattttgaaatgg

SEQ ID NO: 3640242 - DNA, 23 bp, Homo sapiens
gatattttcaacgcagccctgct

SEQ ID NO: 3640243 - DNA, 13 bp, Homo sapiens
gatatttttaata

SEQ ID NO: 3640244 - DNA, 14 bp, Homo sapiens
gatcaccagaataa

SEQ ID NO: 3640245 - DNA, 23 bp, Homo sapiens
gatcaccgactgaaaatattgtt

SEQ ID NO: 3640246 - DNA, 21 bp, Homo sapiens
gatcagaacattcagctctgg

SEQ ID NO: 3640247 - DNA, 18 bp, Homo sapiens
gatcagttataagtagca

SEQ ID NO: 3640248 - DNA, 20 bp, Homo sapiens
gatcatatggtaggaccctc

SEQ ID NO: 3640249 - DNA, 14 bp, Homo sapiens
gatcattcttttat

SEQ ID NO: 3640250 - DNA, 18 bp, Homo sapiens
gatcatttgttggaatga

SEQ ID NO: 3640251 - DNA, 13 bp, Homo sapiens
gatccaaaagaag

SEQ ID NO: 3640252 - DNA, 16 bp, Homo sapiens
gatccaaaagaagccc

SEQ ID NO: 3640253 - DNA, 23 bp, Homo sapiens
gatccaaaagaagcccccagcta

SEQ ID NO: 3640254 - DNA, 20 bp, Homo sapiens
gatccaagcaaaactttact

SEQ ID NO: 3640255 - DNA, 15 bp, Homo sapiens
gatccactcccagga

SEQ ID NO: 3640256 - DNA, 12 bp, Homo sapiens
gatccagccact

SEQ ID NO: 3640257 - DNA, 13 bp, Homo sapiens
gatccagcctggg

SEQ ID NO: 3640258 - DNA, 21 bp, Homo sapiens
gatccagcctggggtctggag

SEQ ID NO: 3640259 - DNA, 21 bp, Homo sapiens
gatccaggcccctccctctcc

SEQ ID NO: 3640260 - DNA, 13 bp, Homo sapiens
gatccagggacag

SEQ ID NO: 3640261 - DNA, 14 bp, Homo sapiens
gatccagggacaga

SEQ ID NO: 3640262 - DNA, 22 bp, Homo sapiens
gatccagggacagaggccccag

SEQ ID NO: 3640263 - DNA, 18 bp, Homo sapiens
gatccagggcagcaggcc

SEQ ID NO: 3640264 - DNA, 21 bp, Homo sapiens
gatcccaccccctcctccccc

SEQ ID NO: 3640265 - DNA, 22 bp, Homo sapiens
gatcccaccccctcctccccca

SEQ ID NO: 3640266 - DNA, 23 bp, Homo sapiens
gatcccaccccctcctcccccag

SEQ ID NO: 3640267 - DNA, 17 bp, Homo sapiens
gatccccgtctctgccc

SEQ ID NO: 3640268 - DNA, 19 bp, Homo sapiens
gatccctcccccccatgca

SEQ ID NO: 3640269 - DNA, 21 bp, Homo sapiens
gatccctcccccccatgcact

SEQ ID NO: 3640270 - DNA, 13 bp, Homo sapiens
gatcctccacaga

SEQ ID NO: 3640271 - DNA, 12 bp, Homo sapiens
gatcctggaggc

SEQ ID NO: 3640272 - DNA, 17 bp, Homo sapiens
gatcctggaggcccagt

SEQ ID NO: 3640273 - DNA, 12 bp, Homo sapiens
gatcctgttctg

SEQ ID NO: 3640274 - DNA, 14 bp, Homo sapiens
gatctatgggaaga

SEQ ID NO: 3640275 - DNA, 18 bp, Homo sapiens
gatctattgtttgttgca

SEQ ID NO: 3640276 - DNA, 20 bp, Homo sapiens
gatctctcttgtcctcttct

SEQ ID NO: 3640277 - DNA, 23 bp, Homo sapiens
gatctctcttgtcctcttctgct

SEQ ID NO: 3640278 - DNA, 23 bp, Homo sapiens
gatctgccccctagttcaggtcc

SEQ ID NO: 3640279 - DNA, 16 bp, Homo sapiens
gatctggaacccagac

SEQ ID NO: 3640280 - DNA, 12 bp, Homo sapiens
gatctggaacct

SEQ ID NO: 3640281 - DNA, 21 bp, Homo sapiens
gatctggaacctcagcctggc

SEQ ID NO: 3640282 - DNA, 14 bp, Homo sapiens
gatctggggagagc

SEQ ID NO: 3640283 - DNA, 18 bp, Homo sapiens
gatctggggagagcggct

SEQ ID NO: 3640284 - DNA, 16 bp, Homo sapiens
gatctgggtctctaat

SEQ ID NO: 3640285 - DNA, 15 bp, Homo sapiens
gatctggtcctaccc

SEQ ID NO: 3640286 - DNA, 14 bp, Homo sapiens
gatctgtcctcagc

SEQ ID NO: 3640287 - DNA, 16 bp, Homo sapiens
gatctgtcctcagcct

SEQ ID NO: 3640288 - DNA, 19 bp, Homo sapiens
gatctgtgattggctggtt

SEQ ID NO: 3640289 - DNA, 14 bp, Homo sapiens
gatctgtgtggctc

SEQ ID NO: 3640290 - DNA, 15 bp, Homo sapiens
gatctgtgtggctcc

SEQ ID NO: 3640291 - DNA, 18 bp, Homo sapiens
gatctgtgtggctcctgg

SEQ ID NO: 3640292 - DNA, 14 bp, Homo sapiens
gatctgttttggat

SEQ ID NO: 3640293 - DNA, 23 bp, Homo sapiens
gatctgttttggatgttgctata

SEQ ID NO: 3640294 - DNA, 18 bp, Homo sapiens
gatcttcagaactgccct

SEQ ID NO: 3640295 - DNA, 17 bp, Homo sapiens
gatcttcccacaggagg

SEQ ID NO: 3640296 - DNA, 23 bp, Homo sapiens
gatcttcccacaggagggccagc

SEQ ID NO: 3640297 - DNA, 19 bp, Homo sapiens
gatcttctttataattcta

SEQ ID NO: 3640298 - DNA, 23 bp, Homo sapiens
gatcttgagtataagaaatgcat

SEQ ID NO: 3640299 - DNA, 15 bp, Homo sapiens
gatcttgtgctatga

SEQ ID NO: 3640300 - DNA, 19 bp, Homo sapiens
gatctttctttccaaaaca

SEQ ID NO: 3640301 - DNA, 15 bp, Homo sapiens
gatctttgtggccaa

SEQ ID NO: 3640302 - DNA, 16 bp, Homo sapiens
gatctttgtggccaag

SEQ ID NO: 3640303 - DNA, 22 bp, Homo sapiens
gatgaagtttgtagttgtttta

SEQ ID NO: 3640304 - DNA, 23 bp, Homo sapiens
gatgacagaggtttgaaggagaa

SEQ ID NO: 3640305 - DNA, 17 bp, Homo sapiens
gatgaccagggatgctg

SEQ ID NO: 3640306 - DNA, 15 bp, Homo sapiens
gcagctggcccccag

SEQ ID NO: 3640307 - DNA, 16 bp, Homo sapiens
gcagctggcccccagc

SEQ ID NO: 3640308 - DNA, 21 bp, Homo sapiens
gcagcttcaacttttctcttt

SEQ ID NO: 3640309 - DNA, 14 bp, Homo sapiens
gcagcttgctgggc

SEQ ID NO: 3640310 - DNA, 16 bp, Homo sapiens
gcagcttgctgggctt

SEQ ID NO: 3640311 - DNA, 20 bp, Homo sapiens
gcagcttgctgggctttggg

SEQ ID NO: 3640312 - DNA, 15 bp, Homo sapiens
gcaggaaagccacat

SEQ ID NO: 3640313 - DNA, 15 bp, Homo sapiens
gcaggaagaaacttt

SEQ ID NO: 3640314 - DNA, 12 bp, Homo sapiens
gcaggaaggaaa

SEQ ID NO: 3640315 - DNA, 18 bp, Homo sapiens
gcaggaaggaccccacat

SEQ ID NO: 3640316 - DNA, 20 bp, Homo sapiens
gcaggaccttcgggctgtgc

SEQ ID NO: 3640317 - DNA, 17 bp, Homo sapiens
gcaggacgttagactgt

SEQ ID NO: 3640318 - DNA, 20 bp, Homo sapiens
gcaggactcctggcagggcc

SEQ ID NO: 3640319 - DNA, 20 bp, Homo sapiens
gcaggagagactgagcagcc

SEQ ID NO: 3640320 - DNA, 15 bp, Homo sapiens
gcaggaggggggagg

SEQ ID NO: 3640321 - DNA, 13 bp, Homo sapiens
gcaggagtctctg

SEQ ID NO: 3640322 - DNA, 17 bp, Homo sapiens
gcaggagtgggctctga

SEQ ID NO: 3640323 - DNA, 19 bp, Homo sapiens
gcaggagtgggctctgagc

SEQ ID NO: 3640324 - DNA, 15 bp, Homo sapiens
gcaggattctctgca

SEQ ID NO: 3640325 - DNA, 17 bp, Homo sapiens
gcaggattctctgcagc

SEQ ID NO: 3640326 - DNA, 16 bp, Homo sapiens
gcaggcaccgccacgt

SEQ ID NO: 3640327 - DNA, 22 bp, Homo sapiens
gcaggcaccgccacgtcccagc

SEQ ID NO: 3640328 - DNA, 12 bp, Homo sapiens
gcaggcagagtg

SEQ ID NO: 3640329 - DNA, 13 bp, Homo sapiens
gcaggcagcgcag

SEQ ID NO: 3640330 - DNA, 18 bp, Homo sapiens
gcaggcagcgcagggctg

SEQ ID NO: 3640331 - DNA, 23 bp, Homo sapiens
gcaggcagcgcagggctggcacg

SEQ ID NO: 3640332 - DNA, 17 bp, Homo sapiens
gcaggcaggcggctcct

SEQ ID NO: 3640333 - DNA, 14 bp, Homo sapiens
gcaggcccaatgct

SEQ ID NO: 3640334 - DNA, 18 bp, Homo sapiens
gcaggcccaatgctgctt

SEQ ID NO: 3640335 - DNA, 23 bp, Homo sapiens
gcaggcccaatgctgcttttggg

SEQ ID NO: 3640336 - DNA, 20 bp, Homo sapiens
gcaggcccactccccagccc

SEQ ID NO: 3640337 - DNA, 17 bp, Homo sapiens
gcaggcccatgggaggc

SEQ ID NO: 3640338 - DNA, 15 bp, Homo sapiens
gcaggcctctgggac

SEQ ID NO: 3640339 - DNA, 21 bp, Homo sapiens
gcaggcctctgggacccacag

SEQ ID NO: 3640340 - DNA, 15 bp, Homo sapiens
gcaggcggctcctcc

SEQ ID NO: 3640341 - DNA, 16 bp, Homo sapiens
gcaggcggctcctcct

SEQ ID NO: 3640342 - DNA, 20 bp, Homo sapiens
gcaggctgtggggcagctga

SEQ ID NO: 3640343 - DNA, 13 bp, Homo sapiens
gcagggaaggaca

SEQ ID NO: 3640344 - DNA, 23 bp, Homo sapiens
gcagggaaggacaggaccctcag

SEQ ID NO: 3640345 - DNA, 15 bp, Homo sapiens
gcagggacctgagag

SEQ ID NO: 3640346 - DNA, 14 bp, Homo sapiens
gcagggagagagta

SEQ ID NO: 3640347 - DNA, 17 bp, Homo sapiens
gcagggagggcttgggg

SEQ ID NO: 3640348 - DNA, 19 bp, Homo sapiens
gcagggatgatggcagagc

SEQ ID NO: 3640349 - DNA, 21 bp, Homo sapiens
gcagggccacctgcaggaccc

SEQ ID NO: 3640350 - DNA, 20 bp, Homo sapiens
gcagggcccacgtgtatagt

SEQ ID NO: 3640351 - DNA, 16 bp, Homo sapiens
gcagggccgggcaggg

SEQ ID NO: 3640352 - DNA, 22 bp, Homo sapiens
gcagggctggcacgtgacaggc

SEQ ID NO: 3640353 - DNA, 20 bp, Homo sapiens
gcaggggaattccctccccc

SEQ ID NO: 3640354 - DNA, 20 bp, Homo sapiens
gcaggggagacaggagccta

SEQ ID NO: 3640355 - DNA, 19 bp, Homo sapiens
gcaggggaggccatctgga

SEQ ID NO: 3640356 - DNA, 22 bp, Homo sapiens
gcagggggccccgccagggctg

SEQ ID NO: 3640357 - DNA, 18 bp, Homo sapiens
gcagggggccctgcccca

SEQ ID NO: 3640358 - DNA, 18 bp, Homo sapiens
gcaggggggctgtgccaa

SEQ ID NO: 3640359 - DNA, 22 bp, Homo sapiens
gcaggggggctgtgccaacctg

SEQ ID NO: 3640360 - DNA, 15 bp, Homo sapiens
gcagggtccacagct

SEQ ID NO: 3640361 - DNA, 15 bp, Homo sapiens
gcaggtacatttctg

SEQ ID NO: 3640362 - DNA, 20 bp, Homo sapiens
gcaggtacatttctgattct

SEQ ID NO: 3640363 - DNA, 23 bp, Homo sapiens
gcaggtacatttctgattctgat

SEQ ID NO: 3640364 - DNA, 15 bp, Homo sapiens
gcaggtgctcatgct

SEQ ID NO: 3640365 - DNA, 17 bp, Homo sapiens
gcaggtgctcatgctgc

SEQ ID NO: 3640366 - DNA, 20 bp, Homo sapiens
gcaggtgcttttggcagaga

SEQ ID NO: 3640367 - DNA, 14 bp, Homo sapiens
gcaggttccccaag

SEQ ID NO: 3640368 - DNA, 15 bp, Homo sapiens
gcaggttccccaagg

SEQ ID NO: 3640369 - DNA, 19 bp, Homo sapiens
gcaggttccccaagggccc

SEQ ID NO: 3640370 - DNA, 20 bp, Homo sapiens
gcaggttccccaagggccct

SEQ ID NO: 3640371 - DNA, 19 bp, Homo sapiens
gcagtcagcagatgctgtt

SEQ ID NO: 3640372 - DNA, 23 bp, Homo sapiens
gcagtcagcagatgctgttgtga

SEQ ID NO: 3640373 - DNA, 20 bp, Homo sapiens
gcagtcccacactgtgcaga

SEQ ID NO: 3640374 - DNA, 22 bp, Homo sapiens
gcagtcctggaggcagggggtg

SEQ ID NO: 3640375 - DNA, 14 bp, Homo sapiens
gcagtccttactcc

SEQ ID NO: 3640376 - DNA, 17 bp, Homo sapiens
gcagtcgcctgcctgca

SEQ ID NO: 3640377 - DNA, 19 bp, Homo sapiens
gcagtcgcctgcctgcagc

SEQ ID NO: 3640378 - DNA, 23 bp, Homo sapiens
gcagtcgtggggaacggaggagg

SEQ ID NO: 3640379 - DNA, 20 bp, Homo sapiens
gcagtctaaattttctaaat

SEQ ID NO: 3640380 - DNA, 16 bp, Homo sapiens
gcagtctccttcagca

SEQ ID NO: 3640381 - DNA, 19 bp, Homo sapiens
gcagtctggctgagccctg

SEQ ID NO: 3640382 - DNA, 23 bp, Homo sapiens
gcagtctttatttttttcccatg

SEQ ID NO: 3640383 - DNA, 15 bp, Homo sapiens
gcagtgactccccag

SEQ ID NO: 3640384 - DNA, 15 bp, Homo sapiens
gcagtgcacgcggct

SEQ ID NO: 3640385 - DNA, 18 bp, Homo sapiens
gcagtgcccatgtgtaca

SEQ ID NO: 3640386 - DNA, 20 bp, Homo sapiens
gcagtgtgcactaaggggcc

SEQ ID NO: 3640387 - DNA, 19 bp, Homo sapiens
gcagtgttccttgtgcccg

SEQ ID NO: 3640388 - DNA, 20 bp, Homo sapiens
gcagttaccacagcaactga

SEQ ID NO: 3640389 - DNA, 20 bp, Homo sapiens
gcagttactccctacactga

SEQ ID NO: 3640390 - DNA, 18 bp, Homo sapiens
gcagttcctgtcccacat

SEQ ID NO: 3640391 - DNA, 19 bp, Homo sapiens
gcagttcctgtcccacatg

SEQ ID NO: 3640392 - DNA, 16 bp, Homo sapiens
gcagttgaaaagactc

SEQ ID NO: 3640393 - DNA, 13 bp, Homo sapiens
gcagtttacagta

SEQ ID NO: 3640394 - DNA, 18 bp, Homo sapiens
gcagtttacagtatttct

SEQ ID NO: 3640395 - DNA, 12 bp, Homo sapiens
gcagtttcctca

SEQ ID NO: 3640396 - DNA, 14 bp, Homo sapiens
gcagtttcctcagt

SEQ ID NO: 3640397 - DNA, 21 bp, Homo sapiens
gcagtttcctcagtgatggaa

SEQ ID NO: 3640398 - DNA, 20 bp, Homo sapiens
gcataaagaattaatgactt

SEQ ID NO: 3640399 - DNA, 19 bp, Homo sapiens
gcataacctgtctcacctg

SEQ ID NO: 3640400 - DNA, 16 bp, Homo sapiens
gcataatttaaaaata

SEQ ID NO: 3640401 - DNA, 19 bp, Homo sapiens
gcataatttaaaaatatat

SEQ ID NO: 3640402 - DNA, 22 bp, Homo sapiens
gcatactgccttgtttaatggt

SEQ ID NO: 3640403 - DNA, 14 bp, Homo sapiens
gcatacttttcaaa

SEQ ID NO: 3640404 - DNA, 15 bp, Homo sapiens
gcatagctctggggt

SEQ ID NO: 3640405 - DNA, 12 bp, Homo sapiens
gcatataaaatt

SEQ ID NO: 3640406 - DNA, 16 bp, Homo sapiens
gcatataaatgtttat

SEQ ID NO: 3640407 - DNA, 19 bp, Homo sapiens
gcatataatgaataaatca

SEQ ID NO: 3640408 - DNA, 21 bp, Homo sapiens
gcatataattttcacttctgt

SEQ ID NO: 3640409 - DNA, 22 bp, Homo sapiens
gcatatggagaacatgttttat

SEQ ID NO: 3640410 - DNA, 23 bp, Homo sapiens
gcatatgggtgggattttgcaaa

SEQ ID NO: 3640411 - DNA, 15 bp, Homo sapiens
gcatattttgagaaa

SEQ ID NO: 3640412 - DNA, 20 bp, Homo sapiens
gcatattttgagaaactgct

SEQ ID NO: 3640413 - DNA, 12 bp, Homo sapiens
gcatcagctgct

SEQ ID NO: 3640414 - DNA, 22 bp, Homo sapiens
gcatcagctgctgaaacaacaa

SEQ ID NO: 3640415 - DNA, 18 bp, Homo sapiens
gcatcaggctaagaccct

SEQ ID NO: 3640416 - DNA, 11 bp, Homo sapiens
gcatccagcct

SEQ ID NO: 3640417 - DNA, 16 bp, Homo sapiens
gcatccagtgtgagat

SEQ ID NO: 3640418 - DNA, 16 bp, Homo sapiens
gcatccctggagcagg

SEQ ID NO: 3640419 - DNA, 19 bp, Homo sapiens
gcatccctggagcaggagc

SEQ ID NO: 3640420 - DNA, 19 bp, Homo sapiens
gcatcgggagcacccagag

SEQ ID NO: 3640421 - DNA, 15 bp, Homo sapiens
gcatctcagcccaca

SEQ ID NO: 3640422 - DNA, 12 bp, Homo sapiens
gcatctccagtg

SEQ ID NO: 3640423 - DNA, 20 bp, Homo sapiens
gcatctcctcccgcccttcc

SEQ ID NO: 3640424 - DNA, 19 bp, Homo sapiens
gcatctctccccatatata

SEQ ID NO: 3640425 - DNA, 14 bp, Homo sapiens
gcatctgaccagca

SEQ ID NO: 3640426 - DNA, 15 bp, Homo sapiens
gcatgaaataaaata

SEQ ID NO: 3640427 - DNA, 23 bp, Homo sapiens
gcatgaacgtggattgtatttaa

SEQ ID NO: 3640428 - DNA, 15 bp, Homo sapiens
gcatgagctggcaac

SEQ ID NO: 3640429 - DNA, 23 bp, Homo sapiens
gcatgagctggcaaccagccagc

SEQ ID NO: 3640430 - DNA, 23 bp, Homo sapiens
gcatgatagacacatatgagggg

SEQ ID NO: 3640431 - DNA, 14 bp, Homo sapiens
gcatgcaccacggg

SEQ ID NO: 3640432 - DNA, 16 bp, Homo sapiens
gcatgcagcgccacct

SEQ ID NO: 3640433 - DNA, 20 bp, Homo sapiens
gcatgcatgggaggaattca

SEQ ID NO: 3640434 - DNA, 23 bp, Homo sapiens
gcatgccgggcccctccatccac

SEQ ID NO: 3640435 - DNA, 16 bp, Homo sapiens
gcatggaaaaatggtt

SEQ ID NO: 3640436 - DNA, 14 bp, Homo sapiens
gcatggagaatggg

SEQ ID NO: 3640437 - DNA, 22 bp, Homo sapiens
gccccacctcggcacacactgt

SEQ ID NO: 3640438 - DNA, 17 bp, Homo sapiens
gccccacttctggccac

SEQ ID NO: 3640439 - DNA, 19 bp, Homo sapiens
gccccagagagaccctgca

SEQ ID NO: 3640440 - DNA, 21 bp, Homo sapiens
gccccagagctccgatgcccg

SEQ ID NO: 3640441 - DNA, 13 bp, Homo sapiens
gccccagaggccc

SEQ ID NO: 3640442 - DNA, 12 bp, Homo sapiens
gccccagcctgt

SEQ ID NO: 3640443 - DNA, 11 bp, Homo sapiens
gccccaggacc

SEQ ID NO: 3640444 - DNA, 17 bp, Homo sapiens
gccccaggaccagctca

SEQ ID NO: 3640445 - DNA, 18 bp, Homo sapiens
gccccaggaccagctcag

SEQ ID NO: 3640446 - DNA, 11 bp, Homo sapiens
gccccaggaga

SEQ ID NO: 3640447 - DNA, 13 bp, Homo sapiens
gccccagggcctg

SEQ ID NO: 3640448 - DNA, 20 bp, Homo sapiens
gccccaggggaactggcagc

SEQ ID NO: 3640449 - DNA, 24 bp, Homo sapiens
gccccagtgttatttattccccag

SEQ ID NO: 3640450 - DNA, 22 bp, Homo sapiens
gccccatccaaccactgtacac

SEQ ID NO: 3640451 - DNA, 20 bp, Homo sapiens
gccccatccagacctggctc

SEQ ID NO: 3640452 - DNA, 15 bp, Homo sapiens
gccccatccctgctt

SEQ ID NO: 3640453 - DNA, 16 bp, Homo sapiens
gccccatcctccagca

SEQ ID NO: 3640454 - DNA, 17 bp, Homo sapiens
gccccatcctccagcag

SEQ ID NO: 3640455 - DNA, 17 bp, Homo sapiens
gcccccactgaccagaa

SEQ ID NO: 3640456 - DNA, 22 bp, Homo sapiens
gcccccagaaagcctcctgccc

SEQ ID NO: 3640457 - DNA, 21 bp, Homo sapiens
gcccccagccctgggaaccac

SEQ ID NO: 3640458 - DNA, 16 bp, Homo sapiens
gcccccagccctgggg

SEQ ID NO: 3640459 - DNA, 23 bp, Homo sapiens
gcccccagctaagaacctggaac

SEQ ID NO: 3640460 - DNA, 15 bp, Homo sapiens
gcccccagggcctcc

SEQ ID NO: 3640461 - DNA, 17 bp, Homo sapiens
gcccccagggcctccag

SEQ ID NO: 3640462 - DNA, 14 bp, Homo sapiens
gcccccattcccag

SEQ ID NO: 3640463 - DNA, 18 bp, Homo sapiens
gccccccgcgctcgccca

SEQ ID NO: 3640464 - DNA, 18 bp, Homo sapiens
gcccccgcgatgccctgg

SEQ ID NO: 3640465 - DNA, 20 bp, Homo sapiens
gcccccgggccgctggctgg

SEQ ID NO: 3640466 - DNA, 17 bp, Homo sapiens
gccccctccaggagaga

SEQ ID NO: 3640467 - DNA, 18 bp, Homo sapiens
gccccctcccccatgggc

SEQ ID NO: 3640468 - DNA, 20 bp, Homo sapiens
gccccctcccccatgggctg

SEQ ID NO: 3640469 - DNA, 21 bp, Homo sapiens
gccccctctttgtagctccta

SEQ ID NO: 3640470 - DNA, 11 bp, Homo sapiens
gccccctgcca

SEQ ID NO: 3640471 - DNA, 12 bp, Homo sapiens
gccccctgggct

SEQ ID NO: 3640472 - DNA, 15 bp, Homo sapiens
gcccccttcaggagc

SEQ ID NO: 3640473 - DNA, 22 bp, Homo sapiens
gccccgacgtttgcggcagtgt

SEQ ID NO: 3640474 - DNA, 18 bp, Homo sapiens
gccccgagcccaggcagc

SEQ ID NO: 3640475 - DNA, 14 bp, Homo sapiens
gccccgccagggct

SEQ ID NO: 3640476 - DNA, 17 bp, Homo sapiens
gccccgccagggctggg

SEQ ID NO: 3640477 - DNA, 12 bp, Homo sapiens
gccccgcccctc

SEQ ID NO: 3640478 - DNA, 13 bp, Homo sapiens
gccccgccctcag

SEQ ID NO: 3640479 - DNA, 15 bp, Homo sapiens
gccccgggctggaga

SEQ ID NO: 3640480 - DNA, 21 bp, Homo sapiens
gccccgtcggactgcccccag

SEQ ID NO: 3640481 - DNA, 20 bp, Homo sapiens
gcccctactgtgggcaaagt

SEQ ID NO: 3640482 - DNA, 20 bp, Homo sapiens
gcccctatgtagtccgtgct

SEQ ID NO: 3640483 - DNA, 15 bp, Homo sapiens
gcccctcacactgca

SEQ ID NO: 3640484 - DNA, 18 bp, Homo sapiens
gcccctccaaacctccag

SEQ ID NO: 3640485 - DNA, 21 bp, Homo sapiens
gcccctccaaacctccagcct

SEQ ID NO: 3640486 - DNA, 14 bp, Homo sapiens
gcccctccatccac

SEQ ID NO: 3640487 - DNA, 19 bp, Homo sapiens
gcccctcccacgcctcacc

SEQ ID NO: 3640488 - DNA, 15 bp, Homo sapiens
gcccctccccagcca

SEQ ID NO: 3640489 - DNA, 16 bp, Homo sapiens
gcccctccccagccag

SEQ ID NO: 3640490 - DNA, 15 bp, Homo sapiens
gcccctccctctcca

SEQ ID NO: 3640491 - DNA, 14 bp, Homo sapiens
gcccctcccttcaa

SEQ ID NO: 3640492 - DNA, 20 bp, Homo sapiens
gcccctgaggagctttgtgt

SEQ ID NO: 3640493 - DNA, 21 bp, Homo sapiens
gcccctgcctgacagccttcc

SEQ ID NO: 3640494 - DNA, 22 bp, Homo sapiens
gcccctgcctgacagccttccc

SEQ ID NO: 3640495 - DNA, 20 bp, Homo sapiens
gcccctgctgtgctgctcaa

SEQ ID NO: 3640496 - DNA, 19 bp, Homo sapiens
gcccctggctttgcctctt

SEQ ID NO: 3640497 - DNA, 18 bp, Homo sapiens
gcccctgtctagagaggg

SEQ ID NO: 3640498 - DNA, 15 bp, Homo sapiens
gcccctgtctggaag

SEQ ID NO: 3640499 - DNA, 16 bp, Homo sapiens
gcccctgtctggaaga

SEQ ID NO: 3640500 - DNA, 13 bp, Homo sapiens
gcccctgtggcca

SEQ ID NO: 3640501 - DNA, 20 bp, Homo sapiens
gcccctgtggccaactgcaa

SEQ ID NO: 3640502 - DNA, 18 bp, Homo sapiens
gcccctgtggccctggcc

SEQ ID NO: 3640503 - DNA, 20 bp, Homo sapiens
gcccctgtggccctggccac

SEQ ID NO: 3640504 - DNA, 17 bp, Homo sapiens
gccccttccccctccaa

SEQ ID NO: 3640505 - DNA, 13 bp, Homo sapiens
gccccttccctgg

SEQ ID NO: 3640506 - DNA, 14 bp, Homo sapiens
gcccgacagcctgg

SEQ ID NO: 3640507 - DNA, 19 bp, Homo sapiens
gcccgacagcctggcacag

SEQ ID NO: 3640508 - DNA, 15 bp, Homo sapiens
gcccgacaggtgggc

SEQ ID NO: 3640509 - DNA, 22 bp, Homo sapiens
gcccgacaggtgggcctgggag

SEQ ID NO: 3640510 - DNA, 14 bp, Homo sapiens
gcccgacagtgcca

SEQ ID NO: 3640511 - DNA, 12 bp, Homo sapiens
gcccgcatgtgt

SEQ ID NO: 3640512 - DNA, 21 bp, Homo sapiens
gcccgcatgtgtgcctggccg

SEQ ID NO: 3640513 - DNA, 17 bp, Homo sapiens
gcccgcctaagaccctg

SEQ ID NO: 3640514 - DNA, 18 bp, Homo sapiens
gcccgcctaagaccctga

SEQ ID NO: 3640515 - DNA, 16 bp, Homo sapiens
gcccgcgcagctgcct

SEQ ID NO: 3640516 - DNA, 17 bp, Homo sapiens
gcccgcgcagctgccta

SEQ ID NO: 3640517 - DNA, 12 bp, Homo sapiens
gcccgctcccac

SEQ ID NO: 3640518 - DNA, 18 bp, Homo sapiens
gcccggccagccatgtct

SEQ ID NO: 3640519 - DNA, 19 bp, Homo sapiens
gcccggccggagggcagga

SEQ ID NO: 3640520 - DNA, 14 bp, Homo sapiens
gcccgggagctgct

SEQ ID NO: 3640521 - DNA, 13 bp, Homo sapiens
gccctaactccta

SEQ ID NO: 3640522 - DNA, 16 bp, Homo sapiens
gccctaagcccccagg

SEQ ID NO: 3640523 - DNA, 18 bp, Homo sapiens
gccctaagtggctgcctt

SEQ ID NO: 3640524 - DNA, 19 bp, Homo sapiens
gccctaattaaaaactgtg

SEQ ID NO: 3640525 - DNA, 12 bp, Homo sapiens
gccctcattcag

SEQ ID NO: 3640526 - DNA, 19 bp, Homo sapiens
gccctccctgtctccaggg

SEQ ID NO: 3640527 - DNA, 11 bp, Homo sapiens
gccctcctcag

SEQ ID NO: 3640528 - DNA, 16 bp, Homo sapiens
gccctctatttattag

SEQ ID NO: 3640529 - DNA, 13 bp, Homo sapiens
gccctctctcggg

SEQ ID NO: 3640530 - DNA, 16 bp, Homo sapiens
gccctctggagtggcc

SEQ ID NO: 3640531 - DNA, 17 bp, Homo sapiens
gccctctggagtggcca

SEQ ID NO: 3640532 - DNA, 19 bp, Homo sapiens
gccctctggagtggccact

SEQ ID NO: 3640533 - DNA, 16 bp, Homo sapiens
gccctctttcatctgt

SEQ ID NO: 3640534 - DNA, 17 bp, Homo sapiens
gccctgaatttcttctt

SEQ ID NO: 3640535 - DNA, 21 bp, Homo sapiens
gccctgcaccatgctgctggg

SEQ ID NO: 3640536 - DNA, 11 bp, Homo sapiens
gccctgcccca

SEQ ID NO: 3640537 - DNA, 14 bp, Homo sapiens
gccctgccccaccc

SEQ ID NO: 3640538 - DNA, 17 bp, Homo sapiens
gccctgctacctgttct

SEQ ID NO: 3640539 - DNA, 16 bp, Homo sapiens
gccctgctttgggctg

SEQ ID NO: 3640540 - DNA, 18 bp, Homo sapiens
gccctgctttgggctgcc

SEQ ID NO: 3640541 - DNA, 19 bp, Homo sapiens
gccctgctttgggctgccc

SEQ ID NO: 3640542 - DNA, 23 bp, Homo sapiens
gccctgctttgggctgccctggt

SEQ ID NO: 3640543 - DNA, 13 bp, Homo sapiens
gccctggaggtgg

SEQ ID NO: 3640544 - DNA, 15 bp, Homo sapiens
gccctggaggtggct

SEQ ID NO: 3640545 - DNA, 18 bp, Homo sapiens
gccctggaggtggctgag

SEQ ID NO: 3640546 - DNA, 13 bp, Homo sapiens
gccctggccagga

SEQ ID NO: 3640547 - DNA, 15 bp, Homo sapiens
gccctgggaaccact

SEQ ID NO: 3640548 - DNA, 17 bp, Homo sapiens
gccctgggaaccactcc

SEQ ID NO: 3640549 - DNA, 18 bp, Homo sapiens
gccctgggaaccactccc

SEQ ID NO: 3640550 - DNA, 11 bp, Homo sapiens
gccctgggctc

SEQ ID NO: 3640551 - DNA, 19 bp, Homo sapiens
gccctggggatcttcccac

SEQ ID NO: 3640552 - DNA, 21 bp, Homo sapiens
gccctggggatcttcccacag

SEQ ID NO: 3640553 - DNA, 20 bp, Homo sapiens
gccctgggggattcctgagc

SEQ ID NO: 3640554 - DNA, 17 bp, Homo sapiens
gccctggttagctgaca

SEQ ID NO: 3640555 - DNA, 18 bp, Homo sapiens
gccctgtgagcacaaaga

SEQ ID NO: 3640556 - DNA, 14 bp, Homo sapiens
gccctgttaaaaga

SEQ ID NO: 3640557 - DNA, 19 bp, Homo sapiens
gccctgttgacacaggtct

SEQ ID NO: 3640558 - DNA, 21 bp, Homo sapiens
gccctgttgacacaggtcttt

SEQ ID NO: 3640559 - DNA, 18 bp, Homo sapiens
gcccttattttcaagaaa

SEQ ID NO: 3640560 - DNA, 22 bp, Homo sapiens
gcccttccatgtcgcctctgca

SEQ ID NO: 3640561 - DNA, 19 bp, Homo sapiens
gcccttccatgtgcctttc

SEQ ID NO: 3640562 - DNA, 20 bp, Homo sapiens
gcccttccatgtgcctttct

SEQ ID NO: 3640563 - DNA, 12 bp, Homo sapiens
gcccttcctctc

SEQ ID NO: 3640564 - DNA, 16 bp, Homo sapiens
gcccttcctctccact

SEQ ID NO: 3640565 - DNA, 18 bp, Homo sapiens
gcccttcctctccactgc

SEQ ID NO: 3640566 - DNA, 21 bp, Homo sapiens
gcccttcctctccactgcctt

SEQ ID NO: 3640567 - DNA, 22 bp, Homo sapiens
gcccttctatacccacccagaa

SEQ ID NO: 3640568 - DNA, 14 bp, Homo sapiens
gcccttgctgcccg

SEQ ID NO: 3640569 - DNA, 22 bp, Homo sapiens
gcccttgctttcggagctcctg

SEQ ID NO: 3640570 - DNA, 11 bp, Homo sapiens
gcggccgcctt

SEQ ID NO: 3640571 - DNA, 22 bp, Homo sapiens
gcggctgtgcagcctgtcctgg

SEQ ID NO: 3640572 - DNA, 14 bp, Homo sapiens
gcgggagacagctt

SEQ ID NO: 3640573 - DNA, 21 bp, Homo sapiens
gcgggagacagcttctctgca

SEQ ID NO: 3640574 - DNA, 20 bp, Homo sapiens
gcgggatcctccacagagag

SEQ ID NO: 3640575 - DNA, 17 bp, Homo sapiens
gcgggcacacctcctcc

SEQ ID NO: 3640576 - DNA, 20 bp, Homo sapiens
gcgggtgtggagaccaggct

SEQ ID NO: 3640577 - DNA, 21 bp, Homo sapiens
gcggtccctgtccctctagtg

SEQ ID NO: 3640578 - DNA, 19 bp, Homo sapiens
gcggttcctcatctgagag

SEQ ID NO: 3640579 - DNA, 16 bp, Homo sapiens
gcgtactacccagctc

SEQ ID NO: 3640580 - DNA, 24 bp, Homo sapiens
gcgtccagctcagccctggcctgg

SEQ ID NO: 3640581 - DNA, 18 bp, Homo sapiens
gcgtcccttggtgagaaa

SEQ ID NO: 3640582 - DNA, 14 bp, Homo sapiens
gcgtctgaggcctg

SEQ ID NO: 3640583 - DNA, 13 bp, Homo sapiens
gcgtctgcctggg

SEQ ID NO: 3640584 - DNA, 16 bp, Homo sapiens
gcgtgaggcctgggct

SEQ ID NO: 3640585 - DNA, 15 bp, Homo sapiens
gcgtgatcaaagcca

SEQ ID NO: 3640586 - DNA, 20 bp, Homo sapiens
gcgtggtgtgtccctggaca

SEQ ID NO: 3640587 - DNA, 16 bp, Homo sapiens
gcgttctcccaaagat

SEQ ID NO: 3640588 - DNA, 23 bp, Homo sapiens
gcgttgttgcatgtttgaaatga

SEQ ID NO: 3640589 - DNA, 12 bp, Homo sapiens
gcgtttttcctt

SEQ ID NO: 3640590 - DNA, 21 bp, Homo sapiens
gctaaagggaccatctgctgc

SEQ ID NO: 3640591 - DNA, 13 bp, Homo sapiens
gctaaattttctg

SEQ ID NO: 3640592 - DNA, 13 bp, Homo sapiens
gctaactgggtta

SEQ ID NO: 3640593 - DNA, 20 bp, Homo sapiens
gctaactgggttaaatattt

SEQ ID NO: 3640594 - DNA, 12 bp, Homo sapiens
gctaactggtta

SEQ ID NO: 3640595 - DNA, 19 bp, Homo sapiens
gctaagctaggaatgaaat

SEQ ID NO: 3640596 - DNA, 20 bp, Homo sapiens
gctaagtacacaataagcaa

SEQ ID NO: 3640597 - DNA, 20 bp, Homo sapiens
gctaataccaaaattgagct

SEQ ID NO: 3640598 - DNA, 22 bp, Homo sapiens
gctaattcaaggaatttcttaa

SEQ ID NO: 3640599 - DNA, 15 bp, Homo sapiens
gctaattctgggaag

SEQ ID NO: 3640600 - DNA, 22 bp, Homo sapiens
gctaattctttgacctgttggg

SEQ ID NO: 3640601 - DNA, 17 bp, Homo sapiens
gctacaaaaacacagca

SEQ ID NO: 3640602 - DNA, 22 bp, Homo sapiens
gctacaaccctaccctggcagg

SEQ ID NO: 3640603 - DNA, 20 bp, Homo sapiens
gctacacctttctcctttgt

SEQ ID NO: 3640604 - DNA, 19 bp, Homo sapiens
gctacctgctcagccctgc

SEQ ID NO: 3640605 - DNA, 22 bp, Homo sapiens
gctactatgatttaatttgaaa

SEQ ID NO: 3640606 - DNA, 17 bp, Homo sapiens
gctactcaggaggctga

SEQ ID NO: 3640607 - DNA, 14 bp, Homo sapiens
gctactcccacagc

SEQ ID NO: 3640608 - DNA, 21 bp, Homo sapiens
gctactgctgctgctgctgcc

SEQ ID NO: 3640609 - DNA, 12 bp, Homo sapiens
gctactgcttca

SEQ ID NO: 3640610 - DNA, 23 bp, Homo sapiens
gctactggcaaaaggatctttgt

SEQ ID NO: 3640611 - DNA, 16 bp, Homo sapiens
gctactgtaatgctgc

SEQ ID NO: 3640612 - DNA, 22 bp, Homo sapiens
gctactgtaatgctgcctcagg

SEQ ID NO: 3640613 - DNA, 12 bp, Homo sapiens
gctagagaaatc

SEQ ID NO: 3640614 - DNA, 20 bp, Homo sapiens
gctagatccagcccaaacct

SEQ ID NO: 3640615 - DNA, 15 bp, Homo sapiens
gctaggaaccctgga

SEQ ID NO: 3640616 - DNA, 16 bp, Homo sapiens
gctaggagcaggcttg

SEQ ID NO: 3640617 - DNA, 19 bp, Homo sapiens
gctaggccccagaggccct

SEQ ID NO: 3640618 - DNA, 21 bp, Homo sapiens
gctaggccccagaggccctgg

SEQ ID NO: 3640619 - DNA, 18 bp, Homo sapiens
gctagtcaagctcctcct

SEQ ID NO: 3640620 - DNA, 21 bp, Homo sapiens
gctagtcaagctcctcctccc

SEQ ID NO: 3640621 - DNA, 23 bp, Homo sapiens
gctagtcaagctcctcctccctg

SEQ ID NO: 3640622 - DNA, 13 bp, Homo sapiens
gctagtgccttta

SEQ ID NO: 3640623 - DNA, 21 bp, Homo sapiens
gctatagggtgtgatgaagtc

SEQ ID NO: 3640624 - DNA, 19 bp, Homo sapiens
gctatagtgacatgcagtt

SEQ ID NO: 3640625 - DNA, 13 bp, Homo sapiens
gctatccttggct

SEQ ID NO: 3640626 - DNA, 23 bp, Homo sapiens
gctatccttggctttcagagcca

SEQ ID NO: 3640627 - DNA, 16 bp, Homo sapiens
gctatctctgtgtgca

SEQ ID NO: 3640628 - DNA, 13 bp, Homo sapiens
gctatgaacagaa

SEQ ID NO: 3640629 - DNA, 18 bp, Homo sapiens
gctatgatgttagttttc

SEQ ID NO: 3640630 - DNA, 20 bp, Homo sapiens
gctatggggtaggagaaaag

SEQ ID NO: 3640631 - DNA, 14 bp, Homo sapiens
gctatttcagcctc

SEQ ID NO: 3640632 - DNA, 17 bp, Homo sapiens
gctatttttatacactg

SEQ ID NO: 3640633 - DNA, 19 bp, Homo sapiens
gctcaaaattgcttctaaa

SEQ ID NO: 3640634 - DNA, 20 bp, Homo sapiens
gctcaacccccctcccagac

SEQ ID NO: 3640635 - DNA, 22 bp, Homo sapiens
gctcaaggccacaggcacacag

SEQ ID NO: 3640636 - DNA, 14 bp, Homo sapiens
gctcaatgcccagt

SEQ ID NO: 3640637 - DNA, 15 bp, Homo sapiens
gctcacaaggcccag

SEQ ID NO: 3640638 - DNA, 18 bp, Homo sapiens
gctcacaaggcccaggag

SEQ ID NO: 3640639 - DNA, 19 bp, Homo sapiens
gctcaccccatcatccctt

SEQ ID NO: 3640640 - DNA, 15 bp, Homo sapiens
gctcacccctggagg

SEQ ID NO: 3640641 - DNA, 18 bp, Homo sapiens
gctcacgtcgcggccgcc

SEQ ID NO: 3640642 - DNA, 13 bp, Homo sapiens
gctcactggcagg

SEQ ID NO: 3640643 - DNA, 22 bp, Homo sapiens
gctcagagaggtagcactctca

SEQ ID NO: 3640644 - DNA, 18 bp, Homo sapiens
gctcagccctccctgccc

SEQ ID NO: 3640645 - DNA, 19 bp, Homo sapiens
gctcagccctccctgcccc

SEQ ID NO: 3640646 - DNA, 12 bp, Homo sapiens
gctcagccctgc

SEQ ID NO: 3640647 - DNA, 16 bp, Homo sapiens
gctcagccctgcacca

SEQ ID NO: 3640648 - DNA, 13 bp, Homo sapiens
gctcagccctggc

SEQ ID NO: 3640649 - DNA, 12 bp, Homo sapiens
gctcagcctggt

SEQ ID NO: 3640650 - DNA, 22 bp, Homo sapiens
gctcagcctggtttctgggtgc

SEQ ID NO: 3640651 - DNA, 23 bp, Homo sapiens
gctcagctgagcatggagacagc

SEQ ID NO: 3640652 - DNA, 19 bp, Homo sapiens
gctcagctgtcaaggctca

SEQ ID NO: 3640653 - DNA, 23 bp, Homo sapiens
gctcagggcagtggcttctttcc

SEQ ID NO: 3640654 - DNA, 21 bp, Homo sapiens
gctcagtaatttgaggacaac

SEQ ID NO: 3640655 - DNA, 19 bp, Homo sapiens
gctcatgcacccctgagcc

SEQ ID NO: 3640656 - DNA, 16 bp, Homo sapiens
gctcattatgccactt

SEQ ID NO: 3640657 - DNA, 16 bp, Homo sapiens
gctcatttcatgaagc

SEQ ID NO: 3640658 - DNA, 15 bp, Homo sapiens
gctccaacctgcaaa

SEQ ID NO: 3640659 - DNA, 19 bp, Homo sapiens
gctccaagatgttctcctg

SEQ ID NO: 3640660 - DNA, 21 bp, Homo sapiens
gctccaaggggaatcagaact

SEQ ID NO: 3640661 - DNA, 23 bp, Homo sapiens
gctccaaggggaatcagaactca

SEQ ID NO: 3640662 - DNA, 16 bp, Homo sapiens
gctccacactcagaaa

SEQ ID NO: 3640663 - DNA, 19 bp, Homo sapiens
gctccactcttgatctctc

SEQ ID NO: 3640664 - DNA, 21 bp, Homo sapiens
gctccactcttgatctctctt

SEQ ID NO: 3640665 - DNA, 22 bp, Homo sapiens
gctccactcttgatctctcttg

SEQ ID NO: 3640666 - DNA, 17 bp, Homo sapiens
gctccactttctcatcc

SEQ ID NO: 3640667 - DNA, 19 bp, Homo sapiens
gctccagaagatgccagct

SEQ ID NO: 3640668 - DNA, 21 bp, Homo sapiens
gctccagaagatgccagcttc

SEQ ID NO: 3640669 - DNA, 13 bp, Homo sapiens
gctccagacctga

SEQ ID NO: 3640670 - DNA, 20 bp, Homo sapiens
gctccagcaggaaggacccc

SEQ ID NO: 3640671 - DNA, 13 bp, Homo sapiens
gctcccacagaac

SEQ ID NO: 3640672 - DNA, 18 bp, Homo sapiens
gctcccacagcttcctga

SEQ ID NO: 3640673 - DNA, 20 bp, Homo sapiens
gctcccacagcttcctgagg

SEQ ID NO: 3640674 - DNA, 22 bp, Homo sapiens
gctcccacagcttcctgagggc

SEQ ID NO: 3640675 - DNA, 20 bp, Homo sapiens
gctcccctaaagccaggctc

SEQ ID NO: 3640676 - DNA, 19 bp, Homo sapiens
gctcccctaaagcctcaaa

SEQ ID NO: 3640677 - DNA, 13 bp, Homo sapiens
gctccctgactgg

SEQ ID NO: 3640678 - DNA, 23 bp, Homo sapiens
gctcccttcaagacgaggggcag

SEQ ID NO: 3640679 - DNA, 14 bp, Homo sapiens
gctccgtagctctg

SEQ ID NO: 3640680 - DNA, 18 bp, Homo sapiens
gctccgtagctctgctgc

SEQ ID NO: 3640681 - DNA, 19 bp, Homo sapiens
gctccgtagctctgctgct

SEQ ID NO: 3640682 - DNA, 22 bp, Homo sapiens
gctccgtggccccgccctcagg

SEQ ID NO: 3640683 - DNA, 13 bp, Homo sapiens
gctccgtgtttct

SEQ ID NO: 3640684 - DNA, 15 bp, Homo sapiens
gctccgtgtttctct

SEQ ID NO: 3640685 - DNA, 17 bp, Homo sapiens
gctcctacctgtctgct

SEQ ID NO: 3640686 - DNA, 23 bp, Homo sapiens
gctcctacctgtctgctgccagc

SEQ ID NO: 3640687 - DNA, 14 bp, Homo sapiens
gctcctagagggag

SEQ ID NO: 3640688 - DNA, 16 bp, Homo sapiens
gctcctagagggaggg

SEQ ID NO: 3640689 - DNA, 19 bp, Homo sapiens
gctcctataaagggcccac

SEQ ID NO: 3640690 - DNA, 19 bp, Homo sapiens
gctcctcccggtgcccaag

SEQ ID NO: 3640691 - DNA, 16 bp, Homo sapiens
gctcctcctcacccac

SEQ ID NO: 3640692 - DNA, 22 bp, Homo sapiens
gctcctcctcacccacctctgg

SEQ ID NO: 3640693 - DNA, 23 bp, Homo sapiens
gctcctcctcacccacctctggg

SEQ ID NO: 3640694 - DNA, 15 bp, Homo sapiens
gctcctcctccctgc

SEQ ID NO: 3640695 - DNA, 18 bp, Homo sapiens
gctcctcctccctgcatc

SEQ ID NO: 3640696 - DNA, 20 bp, Homo sapiens
gctcctcctccctgcatctg

SEQ ID NO: 3640697 - DNA, 20 bp, Homo sapiens
gctcctctaggccctgtgag

SEQ ID NO: 3640698 - DNA, 15 bp, Homo sapiens
gctcctctcttgggt

SEQ ID NO: 3640699 - DNA, 15 bp, Homo sapiens
gctcctgaccttggg

SEQ ID NO: 3640700 - DNA, 21 bp, Homo sapiens
gctcctgcaaaaggaggtgaa

SEQ ID NO: 3640701 - DNA, 21 bp, Homo sapiens
ggagagttctttgctgcccct

SEQ ID NO: 3640702 - DNA, 22 bp, Homo sapiens
ggagagttctttgctgcccctg

SEQ ID NO: 3640703 - DNA, 17 bp, Homo sapiens
ggagataaggtggcttc

SEQ ID NO: 3640704 - DNA, 19 bp, Homo sapiens
ggagataaggtggcttctc

SEQ ID NO: 3640705 - DNA, 19 bp, Homo sapiens
ggagatagatgactttgca

SEQ ID NO: 3640706 - DNA, 17 bp, Homo sapiens
ggagatgaccagggatg

SEQ ID NO: 3640707 - DNA, 18 bp, Homo sapiens
ggagatgaccagggatgc

SEQ ID NO: 3640708 - DNA, 24 bp, Homo sapiens
ggagatgctgtgcccctggccttg

SEQ ID NO: 3640709 - DNA, 14 bp, Homo sapiens
ggagcacccagagc

SEQ ID NO: 3640710 - DNA, 21 bp, Homo sapiens
ggagcagcaggaggggggagg

SEQ ID NO: 3640711 - DNA, 12 bp, Homo sapiens
ggagcagcaggc

SEQ ID NO: 3640712 - DNA, 14 bp, Homo sapiens
ggagcagcaggcct

SEQ ID NO: 3640713 - DNA, 15 bp, Homo sapiens
ggagcagcaggcctc

SEQ ID NO: 3640714 - DNA, 15 bp, Homo sapiens
ggagcaggcccaatg

SEQ ID NO: 3640715 - DNA, 14 bp, Homo sapiens
ggagcaggcttgtg

SEQ ID NO: 3640716 - DNA, 19 bp, Homo sapiens
ggagcaggcttgtggcagc

SEQ ID NO: 3640717 - DNA, 24 bp, Homo sapiens
ggagcaggttccccaagggccctg

SEQ ID NO: 3640718 - DNA, 15 bp, Homo sapiens
ggagcattgcagcct

SEQ ID NO: 3640719 - DNA, 21 bp, Homo sapiens
ggagcatttaatggcagctag

SEQ ID NO: 3640720 - DNA, 23 bp, Homo sapiens
ggagccaaatgaccgagccctgg

SEQ ID NO: 3640721 - DNA, 16 bp, Homo sapiens
ggagccaatggagact

SEQ ID NO: 3640722 - DNA, 15 bp, Homo sapiens
ggagccaccagttct

SEQ ID NO: 3640723 - DNA, 22 bp, Homo sapiens
ggagccaggactcccagaacct

SEQ ID NO: 3640724 - DNA, 23 bp, Homo sapiens
ggagccaggactcccagaacctc

SEQ ID NO: 3640725 - DNA, 15 bp, Homo sapiens
ggagccagtcctcca

SEQ ID NO: 3640726 - DNA, 18 bp, Homo sapiens
ggagcccactgtcctggg

SEQ ID NO: 3640727 - DNA, 22 bp, Homo sapiens
ggagcccactgtcctgggcctg

SEQ ID NO: 3640728 - DNA, 19 bp, Homo sapiens
ggagcccagcctgggagcc

SEQ ID NO: 3640729 - DNA, 12 bp, Homo sapiens
ggagcccagtga

SEQ ID NO: 3640730 - DNA, 19 bp, Homo sapiens
ggagcccagtgaagcctct

SEQ ID NO: 3640731 - DNA, 20 bp, Homo sapiens
ggagcccagtgaagcctctg

SEQ ID NO: 3640732 - DNA, 13 bp, Homo sapiens
ggagccctagccc

SEQ ID NO: 3640733 - DNA, 19 bp, Homo sapiens
ggagccctagccctgctcc

SEQ ID NO: 3640734 - DNA, 20 bp, Homo sapiens
ggagccggtaactgtcctgt

SEQ ID NO: 3640735 - DNA, 23 bp, Homo sapiens
ggagcctacctctgtctgagaca

SEQ ID NO: 3640736 - DNA, 16 bp, Homo sapiens
ggagcctagctcctgc

SEQ ID NO: 3640737 - DNA, 12 bp, Homo sapiens
ggagcctggcca

SEQ ID NO: 3640738 - DNA, 13 bp, Homo sapiens
ggagcctggccag

SEQ ID NO: 3640739 - DNA, 13 bp, Homo sapiens
ggagcgcaggcag

SEQ ID NO: 3640740 - DNA, 15 bp, Homo sapiens
ggagcgcaggcagcg

SEQ ID NO: 3640741 - DNA, 18 bp, Homo sapiens
ggagctgccacagagaag

SEQ ID NO: 3640742 - DNA, 19 bp, Homo sapiens
ggagctgccacagagaagt

SEQ ID NO: 3640743 - DNA, 18 bp, Homo sapiens
ggagctgctgggtggcag

SEQ ID NO: 3640744 - DNA, 18 bp, Homo sapiens
ggagctggttagaaatgc

SEQ ID NO: 3640745 - DNA, 14 bp, Homo sapiens
ggagcttcagccag

SEQ ID NO: 3640746 - DNA, 18 bp, Homo sapiens
ggagcttcagccaggtct

SEQ ID NO: 3640747 - DNA, 18 bp, Homo sapiens
ggaggaaaagtcttccta

SEQ ID NO: 3640748 - DNA, 11 bp, Homo sapiens
ggaggacaaat

SEQ ID NO: 3640749 - DNA, 13 bp, Homo sapiens
ggaggagaatgag

SEQ ID NO: 3640750 - DNA, 19 bp, Homo sapiens
ggaggagagagaccccgca

SEQ ID NO: 3640751 - DNA, 13 bp, Homo sapiens
ggaggagcctgtg

SEQ ID NO: 3640752 - DNA, 17 bp, Homo sapiens
ggaggaggcctgtccca

SEQ ID NO: 3640753 - DNA, 18 bp, Homo sapiens
ggaggattcgagcatcag

SEQ ID NO: 3640754 - DNA, 15 bp, Homo sapiens
ggaggcaaaggcctg

SEQ ID NO: 3640755 - DNA, 22 bp, Homo sapiens
ggaggcagggggtgaggggcag

SEQ ID NO: 3640756 - DNA, 23 bp, Homo sapiens
ggaggccaccccaaaccccagcc

SEQ ID NO: 3640757 - DNA, 12 bp, Homo sapiens
ggaggccatctg

SEQ ID NO: 3640758 - DNA, 13 bp, Homo sapiens
ggaggccatctgg

SEQ ID NO: 3640759 - DNA, 13 bp, Homo sapiens
ggaggcccagttc

SEQ ID NO: 3640760 - DNA, 17 bp, Homo sapiens
ggaggcccatgccctcc

SEQ ID NO: 3640761 - DNA, 15 bp, Homo sapiens
ggaggcggtggcaga

SEQ ID NO: 3640762 - DNA, 19 bp, Homo sapiens
ggaggctcctctaggccct

SEQ ID NO: 3640763 - DNA, 22 bp, Homo sapiens
ggaggctcctctaggccctgtg

SEQ ID NO: 3640764 - DNA, 13 bp, Homo sapiens
ggaggctgaggca

SEQ ID NO: 3640765 - DNA, 17 bp, Homo sapiens
ggagggaagggagccaa

SEQ ID NO: 3640766 - DNA, 18 bp, Homo sapiens
ggagggaagggagccaag

SEQ ID NO: 3640767 - DNA, 21 bp, Homo sapiens
ggagggaagggagccaaggga

SEQ ID NO: 3640768 - DNA, 15 bp, Homo sapiens
ggagggcagctggcc

SEQ ID NO: 3640769 - DNA, 18 bp, Homo sapiens
ggagggcttggggctgca

SEQ ID NO: 3640770 - DNA, 22 bp, Homo sapiens
ggaggggatgataaaggaaata

SEQ ID NO: 3640771 - DNA, 14 bp, Homo sapiens
ggaggggcagcgca

SEQ ID NO: 3640772 - DNA, 21 bp, Homo sapiens
ggaggggcagcgcatgtgtgc

SEQ ID NO: 3640773 - DNA, 21 bp, Homo sapiens
ggaggggcctaggcctcagcc

SEQ ID NO: 3640774 - DNA, 14 bp, Homo sapiens
ggaggggcctggca

SEQ ID NO: 3640775 - DNA, 15 bp, Homo sapiens
ggagggggcaggctg

SEQ ID NO: 3640776 - DNA, 21 bp, Homo sapiens
ggaggtcatctggcggaggtc

SEQ ID NO: 3640777 - DNA, 13 bp, Homo sapiens
ggaggtctccagg

SEQ ID NO: 3640778 - DNA, 20 bp, Homo sapiens
ggaggtctctgggagcccag

SEQ ID NO: 3640779 - DNA, 13 bp, Homo sapiens
ggaggtctggctg

SEQ ID NO: 3640780 - DNA, 20 bp, Homo sapiens
ggaggtggaggctgcggtga

SEQ ID NO: 3640781 - DNA, 18 bp, Homo sapiens
ggagtctgattgcaggaa

SEQ ID NO: 3640782 - DNA, 18 bp, Homo sapiens
ggagtgggctctgagcag

SEQ ID NO: 3640783 - DNA, 18 bp, Homo sapiens
ggagtggttaggcagcaa

SEQ ID NO: 3640784 - DNA, 23 bp, Homo sapiens
ggagtgtaaaatgtatattttta

SEQ ID NO: 3640785 - DNA, 20 bp, Homo sapiens
ggagtgtgagggtcctgcag

SEQ ID NO: 3640786 - DNA, 22 bp, Homo sapiens
ggagtgtgtaatttaaaattgt

SEQ ID NO: 3640787 - DNA, 22 bp, Homo sapiens
ggagttcatggaagagttccct

SEQ ID NO: 3640788 - DNA, 12 bp, Homo sapiens
ggagttccttat

SEQ ID NO: 3640789 - DNA, 21 bp, Homo sapiens
ggagtttgacaccttagagaa

SEQ ID NO: 3640790 - DNA, 16 bp, Homo sapiens
ggagtttttttataca

SEQ ID NO: 3640791 - DNA, 23 bp, Homo sapiens
ggagtttttttatacaatgttct

SEQ ID NO: 3640792 - DNA, 15 bp, Homo sapiens
ggatacagctgcttt

SEQ ID NO: 3640793 - DNA, 21 bp, Homo sapiens
ggatagatgctggcccagggc

SEQ ID NO: 3640794 - DNA, 16 bp, Homo sapiens
ggataggacagaggga

SEQ ID NO: 3640795 - DNA, 22 bp, Homo sapiens
ggataggactccatttctttct

SEQ ID NO: 3640796 - DNA, 22 bp, Homo sapiens
ggatagtgttctgctcctgctt

SEQ ID NO: 3640797 - DNA, 22 bp, Homo sapiens
ggatatggcaggactcctggca

SEQ ID NO: 3640798 - DNA, 13 bp, Homo sapiens
ggatcaatacaca

SEQ ID NO: 3640799 - DNA, 13 bp, Homo sapiens
ggatccaggcccc

SEQ ID NO: 3640800 - DNA, 19 bp, Homo sapiens
ggatccaggcccctccctc

SEQ ID NO: 3640801 - DNA, 22 bp, Homo sapiens
ggatccagggcagcaggccaga

SEQ ID NO: 3640802 - DNA, 12 bp, Homo sapiens
ggatccccttcc

SEQ ID NO: 3640803 - DNA, 13 bp, Homo sapiens
ggatccccttcct

SEQ ID NO: 3640804 - DNA, 23 bp, Homo sapiens
ggatccgtgctgtctcctttgga

SEQ ID NO: 3640805 - DNA, 13 bp, Homo sapiens
ggatcctccacag

SEQ ID NO: 3640806 - DNA, 11 bp, Homo sapiens
ggatctcacag

SEQ ID NO: 3640807 - DNA, 17 bp, Homo sapiens
ggatctcacaggctgag

SEQ ID NO: 3640808 - DNA, 15 bp, Homo sapiens
ggatctgtgattggc

SEQ ID NO: 3640809 - DNA, 17 bp, Homo sapiens
ggatctgtgattggctg

SEQ ID NO: 3640810 - DNA, 20 bp, Homo sapiens
ggatcttcagaactgccctt

SEQ ID NO: 3640811 - DNA, 15 bp, Homo sapiens
ggatctttgtggcca

SEQ ID NO: 3640812 - DNA, 17 bp, Homo sapiens
ggatctttgtggccaag

SEQ ID NO: 3640813 - DNA, 21 bp, Homo sapiens
ggatgaattccaaattctgct

SEQ ID NO: 3640814 - DNA, 16 bp, Homo sapiens
ggatgacaccctggcc

SEQ ID NO: 3640815 - DNA, 17 bp, Homo sapiens
ggatgacaccctggcct

SEQ ID NO: 3640816 - DNA, 15 bp, Homo sapiens
ggatgacctccagaa

SEQ ID NO: 3640817 - DNA, 18 bp, Homo sapiens
ggatgacctccagaagtc

SEQ ID NO: 3640818 - DNA, 19 bp, Homo sapiens
ggatgagaaacagctcagc

SEQ ID NO: 3640819 - DNA, 23 bp, Homo sapiens
ggatgagaaacagctcagccagt

SEQ ID NO: 3640820 - DNA, 15 bp, Homo sapiens
ggatgataaaggaaa

SEQ ID NO: 3640821 - DNA, 20 bp, Homo sapiens
ggatgatggcagagccaggc

SEQ ID NO: 3640822 - DNA, 21 bp, Homo sapiens
ggatgcaaatagattcagaga

SEQ ID NO: 3640823 - DNA, 23 bp, Homo sapiens
ggatgcaaatagattcagagaaa

SEQ ID NO: 3640824 - DNA, 21 bp, Homo sapiens
ggatgccttcccctgggccct

SEQ ID NO: 3640825 - DNA, 16 bp, Homo sapiens
ggatgctaacatctaa

SEQ ID NO: 3640826 - DNA, 17 bp, Homo sapiens
ggatggaatgatgggtc

SEQ ID NO: 3640827 - DNA, 14 bp, Homo sapiens
ggatggacatcttg

SEQ ID NO: 3640828 - DNA, 23 bp, Homo sapiens
ggatggacttgtgattggctgca

SEQ ID NO: 3640829 - DNA, 16 bp, Homo sapiens
ggatggagaaagaagt

SEQ ID NO: 3640830 - DNA, 12 bp, Homo sapiens
ggatggcagact

SEQ ID NO: 3640831 - DNA, 15 bp, Homo sapiens
ggatgggggaactca

SEQ ID NO: 3640832 - DNA, 13 bp, Homo sapiens
ggatgtctgggcc

SEQ ID NO: 3640833 - DNA, 16 bp, Homo sapiens
ggattaactaaagaag

SEQ ID NO: 3640834 - DNA, 18 bp, Homo sapiens
ggattaagaaaccttgct

SEQ ID NO: 3640835 - DNA, 13 bp, Homo sapiens
ggattacagaaac

SEQ ID NO: 3640836 - DNA, 14 bp, Homo sapiens
ggattacagaaact

SEQ ID NO: 3640837 - DNA, 19 bp, Homo sapiens
ggattacagaaactgatgc

SEQ ID NO: 3640838 - DNA, 22 bp, Homo sapiens
ggattcacccccctctgctgcc

SEQ ID NO: 3640839 - DNA, 16 bp, Homo sapiens
ggattcctgagctggc

SEQ ID NO: 3640840 - DNA, 20 bp, Homo sapiens
ggattgaacttctttgaatt

SEQ ID NO: 3640841 - DNA, 17 bp, Homo sapiens
ggattgaggggccctgg

SEQ ID NO: 3640842 - DNA, 14 bp, Homo sapiens
ggattgatcattct

SEQ ID NO: 3640843 - DNA, 15 bp, Homo sapiens
ggattgcccctggct

SEQ ID NO: 3640844 - DNA, 23 bp, Homo sapiens
ggattgtgtatctgtgcttctaa

SEQ ID NO: 3640845 - DNA, 13 bp, Homo sapiens
ggattttaccaaa

SEQ ID NO: 3640846 - DNA, 17 bp, Homo sapiens
ggattttaccaaagcat

SEQ ID NO: 3640847 - DNA, 18 bp, Homo sapiens
ggattttttactgccctt

SEQ ID NO: 3640848 - DNA, 16 bp, Homo sapiens
ggcaaagtttaaatgt

SEQ ID NO: 3640849 - DNA, 19 bp, Homo sapiens
ggcaaagtttaaatgtatt

SEQ ID NO: 3640850 - DNA, 23 bp, Homo sapiens
ggcaaagtttaaatgtattttac

SEQ ID NO: 3640851 - DNA, 17 bp, Homo sapiens
ggcaaatgcctgactca

SEQ ID NO: 3640852 - DNA, 14 bp, Homo sapiens
ggcaacagatctgg

SEQ ID NO: 3640853 - DNA, 14 bp, Homo sapiens
ggcaaccagccagc

SEQ ID NO: 3640854 - DNA, 17 bp, Homo sapiens
ggcaaccagccagcgtc

SEQ ID NO: 3640855 - DNA, 15 bp, Homo sapiens
ggcaacgtagcctgg

SEQ ID NO: 3640856 - DNA, 17 bp, Homo sapiens
ggcaagacagaaaagtg

SEQ ID NO: 3640857 - DNA, 16 bp, Homo sapiens
ggcaagcagactgttc

SEQ ID NO: 3640858 - DNA, 16 bp, Homo sapiens
ggcaagctaggcccca

SEQ ID NO: 3640859 - DNA, 23 bp, Homo sapiens
ggcaagctaggccccagaggccc

SEQ ID NO: 3640860 - DNA, 23 bp, Homo sapiens
ggcaaggggtgaggataggacag

SEQ ID NO: 3640861 - DNA, 21 bp, Homo sapiens
ggcaataaataaagcttggga

SEQ ID NO: 3640862 - DNA, 21 bp, Homo sapiens
ggcaatatagcaagatcccat

SEQ ID NO: 3640863 - DNA, 15 bp, Homo sapiens
ggcaatgatggcaat

SEQ ID NO: 3640864 - DNA, 14 bp, Homo sapiens
ggcaattttgtaac

SEQ ID NO: 3640865 - DNA, 21 bp, Homo sapiens
ggcacacctcctcccactgcc

SEQ ID NO: 3640866 - DNA, 21 bp, Homo sapiens
ggcacacgctgctctgcccca

SEQ ID NO: 3640867 - DNA, 13 bp, Homo sapiens
ggcacactttctg

SEQ ID NO: 3640868 - DNA, 14 bp, Homo sapiens
ggcacagaccaggc

SEQ ID NO: 3640869 - DNA, 19 bp, Homo sapiens
ggcacagctgggagcctgg

SEQ ID NO: 3640870 - DNA, 20 bp, Homo sapiens
ggcacagctgggagcctggt

SEQ ID NO: 3640871 - DNA, 19 bp, Homo sapiens
ggcacagtgggagctgagc

SEQ ID NO: 3640872 - DNA, 21 bp, Homo sapiens
ggcacagtgggagctgagctg

SEQ ID NO: 3640873 - DNA, 21 bp, Homo sapiens
ggcacagttttctgagaaaga

SEQ ID NO: 3640874 - DNA, 18 bp, Homo sapiens
ggcaccagacacccagga

SEQ ID NO: 3640875 - DNA, 13 bp, Homo sapiens
ggcacccccatgc

SEQ ID NO: 3640876 - DNA, 14 bp, Homo sapiens
ggcacccccatgct

SEQ ID NO: 3640877 - DNA, 16 bp, Homo sapiens
ggcacccccatgctgc

SEQ ID NO: 3640878 - DNA, 17 bp, Homo sapiens
ggcacccccatgctgcc

SEQ ID NO: 3640879 - DNA, 20 bp, Homo sapiens
ggcaccgccacgtcccagca

SEQ ID NO: 3640880 - DNA, 22 bp, Homo sapiens
ggcacctaatccaggcagatcc

SEQ ID NO: 3640881 - DNA, 13 bp, Homo sapiens
ggcacctgtttcc

SEQ ID NO: 3640882 - DNA, 21 bp, Homo sapiens
ggcacggcgggatcctccaca

SEQ ID NO: 3640883 - DNA, 14 bp, Homo sapiens
ggcactggtgggcc

SEQ ID NO: 3640884 - DNA, 20 bp, Homo sapiens
ggcactggtttgttccctgt

SEQ ID NO: 3640885 - DNA, 19 bp, Homo sapiens
ggcacttggaggacctggc

SEQ ID NO: 3640886 - DNA, 16 bp, Homo sapiens
ggcacttttttaaata

SEQ ID NO: 3640887 - DNA, 16 bp, Homo sapiens
ggcagacatggtgggg

SEQ ID NO: 3640888 - DNA, 11 bp, Homo sapiens
ggcagactctt

SEQ ID NO: 3640889 - DNA, 18 bp, Homo sapiens
ggcagactctttaataaa

SEQ ID NO: 3640890 - DNA, 21 bp, Homo sapiens
ggcagactctttaataaattg

SEQ ID NO: 3640891 - DNA, 23 bp, Homo sapiens
ggcagactctttaataaattgct

SEQ ID NO: 3640892 - DNA, 14 bp, Homo sapiens
ggcagactgtgaac

SEQ ID NO: 3640893 - DNA, 16 bp, Homo sapiens
ggcagagaggctgtgg

SEQ ID NO: 3640894 - DNA, 23 bp, Homo sapiens
ggcagagcctttttacctggcct

SEQ ID NO: 3640895 - DNA, 13 bp, Homo sapiens
ggcagatctccca

SEQ ID NO: 3640896 - DNA, 12 bp, Homo sapiens
ggcagcaccgcc

SEQ ID NO: 3640897 - DNA, 20 bp, Homo sapiens
ggcagcactccccagagctg

SEQ ID NO: 3640898 - DNA, 13 bp, Homo sapiens
ggcagcaggccag

SEQ ID NO: 3640899 - DNA, 19 bp, Homo sapiens
ggcagcaggccagagaaag

SEQ ID NO: 3640900 - DNA, 20 bp, Homo sapiens
ggcagcaggccagagaaagc

SEQ ID NO: 3640901 - DNA, 22 bp, Homo sapiens
ggcagccgtgccttcagctcta

SEQ ID NO: 3640902 - DNA, 20 bp, Homo sapiens
ggcagcgcagggctggcacg

SEQ ID NO: 3640903 - DNA, 17 bp, Homo sapiens
ggcagcgcatgtgtgca

SEQ ID NO: 3640904 - DNA, 13 bp, Homo sapiens
ggcagcgggcgga

SEQ ID NO: 3640905 - DNA, 21 bp, Homo sapiens
ggcagctatttcagcctcctg

SEQ ID NO: 3640906 - DNA, 20 bp, Homo sapiens
ggcagctctggacagcccca

SEQ ID NO: 3640907 - DNA, 12 bp, Homo sapiens
ggcagctgctgt

SEQ ID NO: 3640908 - DNA, 11 bp, Homo sapiens
ggcagctggcc

SEQ ID NO: 3640909 - DNA, 19 bp, Homo sapiens
ggcagcttctactcctgcc

SEQ ID NO: 3640910 - DNA, 17 bp, Homo sapiens
ggcaggactcctggcag

SEQ ID NO: 3640911 - DNA, 14 bp, Homo sapiens
ggcaggattctctg

SEQ ID NO: 3640912 - DNA, 12 bp, Homo sapiens
ggcaggcccact

SEQ ID NO: 3640913 - DNA, 13 bp, Homo sapiens
ggcaggcccactc

SEQ ID NO: 3640914 - DNA, 15 bp, Homo sapiens
ggcaggcggctcctc

SEQ ID NO: 3640915 - DNA, 16 bp, Homo sapiens
ggcaggcggctcctcc

SEQ ID NO: 3640916 - DNA, 15 bp, Homo sapiens
ggcaggctgagggtc

SEQ ID NO: 3640917 - DNA, 14 bp, Homo sapiens
ggcagggacctaaa

SEQ ID NO: 3640918 - DNA, 18 bp, Homo sapiens
ggcagggacctaaaggga

SEQ ID NO: 3640919 - DNA, 18 bp, Homo sapiens
ggcagggagggcttgggg

SEQ ID NO: 3640920 - DNA, 19 bp, Homo sapiens
ggcagggatccccaggagg

SEQ ID NO: 3640921 - DNA, 14 bp, Homo sapiens
ggcagggcccacgt

SEQ ID NO: 3640922 - DNA, 20 bp, Homo sapiens
ggcagggcccacgtgtatag

SEQ ID NO: 3640923 - DNA, 18 bp, Homo sapiens
ggcaggggagacaggagc

SEQ ID NO: 3640924 - DNA, 22 bp, Homo sapiens
ggcaggggagacaggagcctag

SEQ ID NO: 3640925 - DNA, 16 bp, Homo sapiens
ggcaggggaggccatc

SEQ ID NO: 3640926 - DNA, 19 bp, Homo sapiens
ggcaggggaggccatctgg

SEQ ID NO: 3640927 - DNA, 18 bp, Homo sapiens
ggcagggggacagcaggg

SEQ ID NO: 3640928 - DNA, 13 bp, Homo sapiens
ggcagggggccct

SEQ ID NO: 3640929 - DNA, 15 bp, Homo sapiens
ggcagggggccctgc

SEQ ID NO: 3640930 - DNA, 19 bp, Homo sapiens
ggcagggggccctgcccca

SEQ ID NO: 3640931 - DNA, 23 bp, Homo sapiens
ggcagggggccctgccccacccc

SEQ ID NO: 3640932 - DNA, 17 bp, Homo sapiens
ggcagggtaggtggggc

SEQ ID NO: 3640933 - DNA, 10 bp, Homo sapiens
ggcaggtgct

SEQ ID NO: 3640934 - DNA, 21 bp, Homo sapiens
ggcaggtgtgggatctgggga

SEQ ID NO: 3640935 - DNA, 12 bp, Homo sapiens
ggcagtcctgga

SEQ ID NO: 3640936 - DNA, 17 bp, Homo sapiens
ggcagtcctggaggcag

SEQ ID NO: 3640937 - DNA, 18 bp, Homo sapiens
ggcagtccttactccccc

SEQ ID NO: 3640938 - DNA, 19 bp, Homo sapiens
ggcagtgcccatgtgtaca

SEQ ID NO: 3640939 - DNA, 20 bp, Homo sapiens
ggcagtgcccatgtgtacat

SEQ ID NO: 3640940 - DNA, 14 bp, Homo sapiens
ggcagtgttccttg

SEQ ID NO: 3640941 - DNA, 15 bp, Homo sapiens
ggcatagctctgggg

SEQ ID NO: 3640942 - DNA, 15 bp, Homo sapiens
ggcatcttggaaaag

SEQ ID NO: 3640943 - DNA, 13 bp, Homo sapiens
ggcatgagccact

SEQ ID NO: 3640944 - DNA, 15 bp, Homo sapiens
ggcatggcaggagtc

SEQ ID NO: 3640945 - DNA, 23 bp, Homo sapiens
ggcatggtggcacacgcctgtag

SEQ ID NO: 3640946 - DNA, 22 bp, Homo sapiens
ggcattagcaaggcagagcctt

SEQ ID NO: 3640947 - DNA, 17 bp, Homo sapiens
ggcattctcccagctct

SEQ ID NO: 3640948 - DNA, 13 bp, Homo sapiens
ggcatttcaatcc

SEQ ID NO: 3640949 - DNA, 14 bp, Homo sapiens
ggcatttggtgaga

SEQ ID NO: 3640950 - DNA, 21 bp, Homo sapiens
ggcatttggtgagagtcaaag

SEQ ID NO: 3640951 - DNA, 20 bp, Homo sapiens
ggccaaacccttgctttcct

SEQ ID NO: 3640952 - DNA, 13 bp, Homo sapiens
ggccaacatggta

SEQ ID NO: 3640953 - DNA, 20 bp, Homo sapiens
ggccaaccagcccgacagtg

SEQ ID NO: 3640954 - DNA, 13 bp, Homo sapiens
ggccaagggacca

SEQ ID NO: 3640955 - DNA, 13 bp, Homo sapiens
ggccacacccagg

SEQ ID NO: 3640956 - DNA, 16 bp, Homo sapiens
ggccacacccaggaag

SEQ ID NO: 3640957 - DNA, 15 bp, Homo sapiens
ggccacagtggggct

SEQ ID NO: 3640958 - DNA, 20 bp, Homo sapiens
ggccacagtggggctgcagg

SEQ ID NO: 3640959 - DNA, 21 bp, Homo sapiens
ggccacagtggggctgcaggc

SEQ ID NO: 3640960 - DNA, 16 bp, Homo sapiens
ggccacctccacaccc

SEQ ID NO: 3640961 - DNA, 19 bp, Homo sapiens
ggccacctccacacccacc

SEQ ID NO: 3640962 - DNA, 14 bp, Homo sapiens
ggccacctgcagga

SEQ ID NO: 3640963 - DNA, 17 bp, Homo sapiens
ggccactccagacccct

SEQ ID NO: 3640964 - DNA, 19 bp, Homo sapiens
ggccactgcgctcttggga

SEQ ID NO: 3640965 - DNA, 19 bp, Homo sapiens
ggccactttcagagccccc

SEQ ID NO: 3640966 - DNA, 18 bp, Homo sapiens
gggccgccacggcctggc

SEQ ID NO: 3640967 - DNA, 19 bp, Homo sapiens
gggccgccacggcctggct

SEQ ID NO: 3640968 - DNA, 17 bp, Homo sapiens
gggccggccagtggcct

SEQ ID NO: 3640969 - DNA, 21 bp, Homo sapiens
gggccggctgagtggcagcag

SEQ ID NO: 3640970 - DNA, 12 bp, Homo sapiens
gggccgggcagg

SEQ ID NO: 3640971 - DNA, 20 bp, Homo sapiens
gggccgtaggggctcctgag

SEQ ID NO: 3640972 - DNA, 16 bp, Homo sapiens
gggccgtggcacagct

SEQ ID NO: 3640973 - DNA, 14 bp, Homo sapiens
gggcctcaggctct

SEQ ID NO: 3640974 - DNA, 15 bp, Homo sapiens
gggcctcaggctctg

SEQ ID NO: 3640975 - DNA, 17 bp, Homo sapiens
gggcctcaggctctgca

SEQ ID NO: 3640976 - DNA, 11 bp, Homo sapiens
gggcctccagg

SEQ ID NO: 3640977 - DNA, 19 bp, Homo sapiens
gggcctgagggtccacctg

SEQ ID NO: 3640978 - DNA, 21 bp, Homo sapiens
gggcctgagggtccacctgga

SEQ ID NO: 3640979 - DNA, 13 bp, Homo sapiens
gggcctgctccag

SEQ ID NO: 3640980 - DNA, 15 bp, Homo sapiens
gggcctgctccagac

SEQ ID NO: 3640981 - DNA, 15 bp, Homo sapiens
gggcctggagcccca

SEQ ID NO: 3640982 - DNA, 11 bp, Homo sapiens
gggcctggagg

SEQ ID NO: 3640983 - DNA, 10 bp, Homo sapiens
gggcctggca

SEQ ID NO: 3640984 - DNA, 13 bp, Homo sapiens
gggcgacaaaaac

SEQ ID NO: 3640985 - DNA, 14 bp, Homo sapiens
gggcggcacagcct

SEQ ID NO: 3640986 - DNA, 18 bp, Homo sapiens
gggcgttgggagcctagc

SEQ ID NO: 3640987 - DNA, 14 bp, Homo sapiens
gggctaaataaaga

SEQ ID NO: 3640988 - DNA, 21 bp, Homo sapiens
gggctaattctgggaagggag

SEQ ID NO: 3640989 - DNA, 20 bp, Homo sapiens
gggctcactgtgctggggca

SEQ ID NO: 3640990 - DNA, 13 bp, Homo sapiens
gggctcagcctgg

SEQ ID NO: 3640991 - DNA, 17 bp, Homo sapiens
gggctcagcctggtttc

SEQ ID NO: 3640992 - DNA, 15 bp, Homo sapiens
gggctctgggtgctg

SEQ ID NO: 3640993 - DNA, 18 bp, Homo sapiens
gggctctgggtgctgccc

SEQ ID NO: 3640994 - DNA, 15 bp, Homo sapiens
gggctctgtggcaaa

SEQ ID NO: 3640995 - DNA, 13 bp, Homo sapiens
gggctgcaggcag

SEQ ID NO: 3640996 - DNA, 21 bp, Homo sapiens
gggctgcaggcaggcggctcc

SEQ ID NO: 3640997 - DNA, 20 bp, Homo sapiens
gggctgcccacctggctgcc

SEQ ID NO: 3640998 - DNA, 13 bp, Homo sapiens
gggctgccctggt

SEQ ID NO: 3640999 - DNA, 18 bp, Homo sapiens
gggctgctgctcctctct

SEQ ID NO: 3641000 - DNA, 20 bp, Homo sapiens
gggctggagaaagagctgcc

SEQ ID NO: 3641001 - DNA, 21 bp, Homo sapiens
gggctggagaaagagctgcct

SEQ ID NO: 3641002 - DNA, 22 bp, Homo sapiens
gggctggagaaagagctgcctg

SEQ ID NO: 3641003 - DNA, 15 bp, Homo sapiens
gggctggagcctggg

SEQ ID NO: 3641004 - DNA, 18 bp, Homo sapiens
gggctgggggctgccgag

SEQ ID NO: 3641005 - DNA, 19 bp, Homo sapiens
gggctgggggctgccgagc

SEQ ID NO: 3641006 - DNA, 17 bp, Homo sapiens
gggctggttggagaagg

SEQ ID NO: 3641007 - DNA, 22 bp, Homo sapiens
gggctgtcctgccacccagccc

SEQ ID NO: 3641008 - DNA, 12 bp, Homo sapiens
gggctgtgccaa

SEQ ID NO: 3641009 - DNA, 21 bp, Homo sapiens
gggctgtgtcctaaggcccat

SEQ ID NO: 3641010 - DNA, 21 bp, Homo sapiens
gggcttatatgtacttttatt

SEQ ID NO: 3641011 - DNA, 21 bp, Homo sapiens
gggcttctcctcctctgtctt

SEQ ID NO: 3641012 - DNA, 15 bp, Homo sapiens
gggcttggcccagcg

SEQ ID NO: 3641013 - DNA, 19 bp, Homo sapiens
gggctttctcttccccttc

SEQ ID NO: 3641014 - DNA, 21 bp, Homo sapiens
gggctttctcttccccttcct

SEQ ID NO: 3641015 - DNA, 23 bp, Homo sapiens
gggctttctcttccccttcctgt

SEQ ID NO: 3641016 - DNA, 18 bp, Homo sapiens
gggctttggttccttctc

SEQ ID NO: 3641017 - DNA, 22 bp, Homo sapiens
gggctttgtgaccagaaagctt

SEQ ID NO: 3641018 - DNA, 21 bp, Homo sapiens
gggctttgttgtgagaatggc

SEQ ID NO: 3641019 - DNA, 15 bp, Homo sapiens
gggcttttgccactc

SEQ ID NO: 3641020 - DNA, 17 bp, Homo sapiens
ggggaacactgagaaag

SEQ ID NO: 3641021 - DNA, 18 bp, Homo sapiens
ggggaacactgagaaaga

SEQ ID NO: 3641022 - DNA, 18 bp, Homo sapiens
ggggaactcagatccagg

SEQ ID NO: 3641023 - DNA, 15 bp, Homo sapiens
ggggaattccctccc

SEQ ID NO: 3641024 - DNA, 23 bp, Homo sapiens
ggggacagcttcctcacacccct

SEQ ID NO: 3641025 - DNA, 13 bp, Homo sapiens
ggggacaggcccg

SEQ ID NO: 3641026 - DNA, 21 bp, Homo sapiens
ggggacccaaaccccctgcag

SEQ ID NO: 3641027 - DNA, 19 bp, Homo sapiens
ggggagcccactgtcctgg

SEQ ID NO: 3641028 - DNA, 13 bp, Homo sapiens
ggggaggcacact

SEQ ID NO: 3641029 - DNA, 22 bp, Homo sapiens
ggggagtttccgcggcggcttc

SEQ ID NO: 3641030 - DNA, 13 bp, Homo sapiens
ggggatagatgtg

SEQ ID NO: 3641031 - DNA, 23 bp, Homo sapiens
ggggattgcccctggctttgcct

SEQ ID NO: 3641032 - DNA, 22 bp, Homo sapiens
ggggcaagacagaaaagtgcct

SEQ ID NO: 3641033 - DNA, 13 bp, Homo sapiens
ggggcaagctagg

SEQ ID NO: 3641034 - DNA, 13 bp, Homo sapiens
ggggcagcactcc

SEQ ID NO: 3641035 - DNA, 20 bp, Homo sapiens
ggggcaggaaagccacatct

SEQ ID NO: 3641036 - DNA, 23 bp, Homo sapiens
ggggccactttcagagcccccag

SEQ ID NO: 3641037 - DNA, 22 bp, Homo sapiens
ggggccataaacggttcctggt

SEQ ID NO: 3641038 - DNA, 14 bp, Homo sapiens
ggggccatgcctcc

SEQ ID NO: 3641039 - DNA, 23 bp, Homo sapiens
ggggccatgcctcctcaggagcc

SEQ ID NO: 3641040 - DNA, 23 bp, Homo sapiens
ggggcccaagtggggtgctctgg

SEQ ID NO: 3641041 - DNA, 20 bp, Homo sapiens
ggggccccatggcagctcct

SEQ ID NO: 3641042 - DNA, 15 bp, Homo sapiens
ggggccccgccaggg

SEQ ID NO: 3641043 - DNA, 18 bp, Homo sapiens
ggggccccgccagggctg

SEQ ID NO: 3641044 - DNA, 22 bp, Homo sapiens
ggggcccgacaggtgggcctgg

SEQ ID NO: 3641045 - DNA, 19 bp, Homo sapiens
ggggccctgccccacccca

SEQ ID NO: 3641046 - DNA, 11 bp, Homo sapiens
ggggccctgct

SEQ ID NO: 3641047 - DNA, 14 bp, Homo sapiens
ggggccgctgccac

SEQ ID NO: 3641048 - DNA, 22 bp, Homo sapiens
ggggccgctgccacccacctcc

SEQ ID NO: 3641049 - DNA, 23 bp, Homo sapiens
ggggcctaggcctcagccagaga

SEQ ID NO: 3641050 - DNA, 20 bp, Homo sapiens
ggggcctgcagaaggaaaga

SEQ ID NO: 3641051 - DNA, 13 bp, Homo sapiens
ggggcctggaggt

SEQ ID NO: 3641052 - DNA, 18 bp, Homo sapiens
ggggcgtctgttccccct

SEQ ID NO: 3641053 - DNA, 20 bp, Homo sapiens
ggggctctgggtgctgccct

SEQ ID NO: 3641054 - DNA, 16 bp, Homo sapiens
ggggctcttctgagca

SEQ ID NO: 3641055 - DNA, 14 bp, Homo sapiens
ggggcttggggctc

SEQ ID NO: 3641056 - DNA, 17 bp, Homo sapiens
gggggaactcagatcca

SEQ ID NO: 3641057 - DNA, 14 bp, Homo sapiens
gggggacagcaggg

SEQ ID NO: 3641058 - DNA, 21 bp, Homo sapiens
gggggagcccagtgaagcctc

SEQ ID NO: 3641059 - DNA, 22 bp, Homo sapiens
gggggcacttggaggacctggc

SEQ ID NO: 3641060 - DNA, 19 bp, Homo sapiens
gggggccccacctcggcac

SEQ ID NO: 3641061 - DNA, 12 bp, Homo sapiens
gggggccctgct

SEQ ID NO: 3641062 - DNA, 16 bp, Homo sapiens
gggggctgaggagcag

SEQ ID NO: 3641063 - DNA, 23 bp, Homo sapiens
gggggtaaagcagttcctgtccc

SEQ ID NO: 3641064 - DNA, 22 bp, Homo sapiens
ggggtcctctctgagtcaaatc

SEQ ID NO: 3641065 - DNA, 23 bp, Homo sapiens
ggggtctcttctgaataaagcaa

SEQ ID NO: 3641066 - DNA, 21 bp, Homo sapiens
ggggtctggagttgatctgga

SEQ ID NO: 3641067 - DNA, 22 bp, Homo sapiens
ggggtctgggcgtccagctcag

SEQ ID NO: 3641068 - DNA, 18 bp, Homo sapiens
ggggtgaatacttatttt

SEQ ID NO: 3641069 - DNA, 17 bp, Homo sapiens
ggggtgatcctgttctg

SEQ ID NO: 3641070 - DNA, 20 bp, Homo sapiens
ggggtgcggcggtcccagct

SEQ ID NO: 3641071 - DNA, 20 bp, Homo sapiens
ggggttctttcttcctctgc

SEQ ID NO: 3641072 - DNA, 12 bp, Homo sapiens
gggtaaagcagt

SEQ ID NO: 3641073 - DNA, 17 bp, Homo sapiens
gggtaattgtacaataa

SEQ ID NO: 3641074 - DNA, 18 bp, Homo sapiens
gggtatttttataacaat

SEQ ID NO: 3641075 - DNA, 17 bp, Homo sapiens
gggtcacatgactctca

SEQ ID NO: 3641076 - DNA, 15 bp, Homo sapiens
gggtccacctggaga

SEQ ID NO: 3641077 - DNA, 18 bp, Homo sapiens
gggtccaggagagcctgg

SEQ ID NO: 3641078 - DNA, 13 bp, Homo sapiens
gggtccctccacc

SEQ ID NO: 3641079 - DNA, 18 bp, Homo sapiens
gggtcctgcagcctgcag

SEQ ID NO: 3641080 - DNA, 13 bp, Homo sapiens
gggtcgtgggaaa

SEQ ID NO: 3641081 - DNA, 19 bp, Homo sapiens
gggtcgtgggaaaggggag

SEQ ID NO: 3641082 - DNA, 14 bp, Homo sapiens
gggtctcactctgt

SEQ ID NO: 3641083 - DNA, 22 bp, Homo sapiens
gggtctcggatgacaccctggc

SEQ ID NO: 3641084 - DNA, 17 bp, Homo sapiens
gggtctgattttctcac

SEQ ID NO: 3641085 - DNA, 17 bp, Homo sapiens
gggtctgcgatgcagcg

SEQ ID NO: 3641086 - DNA, 15 bp, Homo sapiens
gggtctgggcgtcca

SEQ ID NO: 3641087 - DNA, 19 bp, Homo sapiens
gggtctggggacaggcccg

SEQ ID NO: 3641088 - DNA, 17 bp, Homo sapiens
gggtgacagctccggga

SEQ ID NO: 3641089 - DNA, 21 bp, Homo sapiens
gggtgccgctgtctctgaggg

SEQ ID NO: 3641090 - DNA, 18 bp, Homo sapiens
gggtgctctggtctgacc

SEQ ID NO: 3641091 - DNA, 22 bp, Homo sapiens
gggtggcacctgtttcccgggc

SEQ ID NO: 3641092 - DNA, 21 bp, Homo sapiens
gggtgggggacgatcaggagg

SEQ ID NO: 3641093 - DNA, 16 bp, Homo sapiens
gggtgggggagggaaa

SEQ ID NO: 3641094 - DNA, 20 bp, Homo sapiens
gggtgggggagggaaaggga

SEQ ID NO: 3641095 - DNA, 18 bp, Homo sapiens
gggtggtattctggtagg

SEQ ID NO: 3641096 - DNA, 15 bp, Homo sapiens
gggtgtaacttcctg

SEQ ID NO: 3641097 - DNA, 17 bp, Homo sapiens
gtcacgatcacaggcct

SEQ ID NO: 3641098 - DNA, 14 bp, Homo sapiens
gtcactacctggct

SEQ ID NO: 3641099 - DNA, 17 bp, Homo sapiens
gtcactttttgaggcaa

SEQ ID NO: 3641100 - DNA, 18 bp, Homo sapiens
gtcactttttgaggcaaa

SEQ ID NO: 3641101 - DNA, 20 bp, Homo sapiens
gtcagaagtcaataggccta

SEQ ID NO: 3641102 - DNA, 14 bp, Homo sapiens
gtcagacatttctt

SEQ ID NO: 3641103 - DNA, 13 bp, Homo sapiens
gtcagaggagcgc

SEQ ID NO: 3641104 - DNA, 17 bp, Homo sapiens
gtcagaggagcgcaggc

SEQ ID NO: 3641105 - DNA, 16 bp, Homo sapiens
gtcagcagatgctgtt

SEQ ID NO: 3641106 - DNA, 15 bp, Homo sapiens
gtcagccacctggga

SEQ ID NO: 3641107 - DNA, 16 bp, Homo sapiens
gtcagccacctgggaa

SEQ ID NO: 3641108 - DNA, 13 bp, Homo sapiens
gtcagcctggaag

SEQ ID NO: 3641109 - DNA, 14 bp, Homo sapiens
gtcagcctggaagg

SEQ ID NO: 3641110 - DNA, 22 bp, Homo sapiens
gtcagcctggaagggacagtat

SEQ ID NO: 3641111 - DNA, 21 bp, Homo sapiens
gtcaggcccttattttcaaga

SEQ ID NO: 3641112 - DNA, 14 bp, Homo sapiens
gtcaggctagctgt

SEQ ID NO: 3641113 - DNA, 20 bp, Homo sapiens
gtcagtgtgtcagtttttcc

SEQ ID NO: 3641114 - DNA, 19 bp, Homo sapiens
gtcagtgttaaagattttg

SEQ ID NO: 3641115 - DNA, 16 bp, Homo sapiens
gtcagttgttatttat

SEQ ID NO: 3641116 - DNA, 19 bp, Homo sapiens
gtcagttgttatttattga

SEQ ID NO: 3641117 - DNA, 14 bp, Homo sapiens
gtcagtttttcctc

SEQ ID NO: 3641118 - DNA, 16 bp, Homo sapiens
gtcataagtgaatatt

SEQ ID NO: 3641119 - DNA, 19 bp, Homo sapiens
gtcatacaaatttataaag

SEQ ID NO: 3641120 - DNA, 13 bp, Homo sapiens
gtcatacatagga

SEQ ID NO: 3641121 - DNA, 13 bp, Homo sapiens
gtcatagaaatta

SEQ ID NO: 3641122 - DNA, 22 bp, Homo sapiens
gtcatagaaattacacccaaag

SEQ ID NO: 3641123 - DNA, 15 bp, Homo sapiens
gtcataggttaatat

SEQ ID NO: 3641124 - DNA, 21 bp, Homo sapiens
gtcatataagattcatattta

SEQ ID NO: 3641125 - DNA, 16 bp, Homo sapiens
gtcatatgttaagcag

SEQ ID NO: 3641126 - DNA, 13 bp, Homo sapiens
gtcatctggcgga

SEQ ID NO: 3641127 - DNA, 22 bp, Homo sapiens
gtcatcttgctaccagtattta

SEQ ID NO: 3641128 - DNA, 18 bp, Homo sapiens
gtcatgccctcctctccc

SEQ ID NO: 3641129 - DNA, 23 bp, Homo sapiens
gtcatgggagagtacaccctttc

SEQ ID NO: 3641130 - DNA, 16 bp, Homo sapiens
gtcatgtgagtctggg

SEQ ID NO: 3641131 - DNA, 19 bp, Homo sapiens
gtcatgtgagtctgggata

SEQ ID NO: 3641132 - DNA, 16 bp, Homo sapiens
gtcatgttatgcagtg

SEQ ID NO: 3641133 - DNA, 17 bp, Homo sapiens
gtcatgttatgcagtga

SEQ ID NO: 3641134 - DNA, 22 bp, Homo sapiens
gtcattacaaaaaaacacgtgg

SEQ ID NO: 3641135 - DNA, 17 bp, Homo sapiens
gtcattatttttgttag

SEQ ID NO: 3641136 - DNA, 23 bp, Homo sapiens
gtcattatttttgttagcaaaga

SEQ ID NO: 3641137 - DNA, 12 bp, Homo sapiens
gtcattcagttc

SEQ ID NO: 3641138 - DNA, 18 bp, Homo sapiens
gtcattcagttctaggcc

SEQ ID NO: 3641139 - DNA, 19 bp, Homo sapiens
gtcattcagttctaggcct

SEQ ID NO: 3641140 - DNA, 23 bp, Homo sapiens
gtcattgcacctatctcagccat

SEQ ID NO: 3641141 - DNA, 12 bp, Homo sapiens
gtcattgccatg

SEQ ID NO: 3641142 - DNA, 13 bp, Homo sapiens
gtcattggcaaag

SEQ ID NO: 3641143 - DNA, 14 bp, Homo sapiens
gtcattggcaaagt

SEQ ID NO: 3641144 - DNA, 15 bp, Homo sapiens
gtcatttaaatgtgt

SEQ ID NO: 3641145 - DNA, 23 bp, Homo sapiens
gtcatttctatattcctccagct

SEQ ID NO: 3641146 - DNA, 17 bp, Homo sapiens
gtcatttgaacctggat

SEQ ID NO: 3641147 - DNA, 12 bp, Homo sapiens
gtccaagcagag

SEQ ID NO: 3641148 - DNA, 24 bp, Homo sapiens
gtccaagcataccaacacgagcag

SEQ ID NO: 3641149 - DNA, 15 bp, Homo sapiens
gtccaatttaaggaa

SEQ ID NO: 3641150 - DNA, 15 bp, Homo sapiens
gtccacaggggccac

SEQ ID NO: 3641151 - DNA, 17 bp, Homo sapiens
gtccacttaaaatacat

SEQ ID NO: 3641152 - DNA, 19 bp, Homo sapiens
gtccagagataaaaatcat

SEQ ID NO: 3641153 - DNA, 12 bp, Homo sapiens
gtccagctcagc

SEQ ID NO: 3641154 - DNA, 18 bp, Homo sapiens
gtccagctcagccctggc

SEQ ID NO: 3641155 - DNA, 15 bp, Homo sapiens
gtccagctctgacat

SEQ ID NO: 3641156 - DNA, 19 bp, Homo sapiens
gtccagctctgacatccct

SEQ ID NO: 3641157 - DNA, 22 bp, Homo sapiens
gtccagctgggaagcccttttt

SEQ ID NO: 3641158 - DNA, 22 bp, Homo sapiens
gtccaggacaggagatgctgtg

SEQ ID NO: 3641159 - DNA, 17 bp, Homo sapiens
gtccaggccccaccggc

SEQ ID NO: 3641160 - DNA, 14 bp, Homo sapiens
gtccagggcctgac

SEQ ID NO: 3641161 - DNA, 16 bp, Homo sapiens
gtccagggcctgacac

SEQ ID NO: 3641162 - DNA, 16 bp, Homo sapiens
gtccatgtaaatactt

SEQ ID NO: 3641163 - DNA, 13 bp, Homo sapiens
gtccatttcctaa

SEQ ID NO: 3641164 - DNA, 22 bp, Homo sapiens
gtcccacactgtggccaggcct

SEQ ID NO: 3641165 - DNA, 17 bp, Homo sapiens
gtcccacccacacagct

SEQ ID NO: 3641166 - DNA, 19 bp, Homo sapiens
gtcccacccacacagctgc

SEQ ID NO: 3641167 - DNA, 15 bp, Homo sapiens
gtcccagagacctca

SEQ ID NO: 3641168 - DNA, 14 bp, Homo sapiens
gtcccagcatccct

SEQ ID NO: 3641169 - DNA, 16 bp, Homo sapiens
gtcccagcatccctgg

SEQ ID NO: 3641170 - DNA, 17 bp, Homo sapiens
gtcccagcatccctgga

SEQ ID NO: 3641171 - DNA, 12 bp, Homo sapiens
gtcccagctgaa

SEQ ID NO: 3641172 - DNA, 16 bp, Homo sapiens
gtcccagctgaaggca

SEQ ID NO: 3641173 - DNA, 22 bp, Homo sapiens
gtcccagctgaaggcagtggca

SEQ ID NO: 3641174 - DNA, 16 bp, Homo sapiens
gtcccatttttctctt

SEQ ID NO: 3641175 - DNA, 13 bp, Homo sapiens
gtccccaccatct

SEQ ID NO: 3641176 - DNA, 15 bp, Homo sapiens
gtccccaccatctgc

SEQ ID NO: 3641177 - DNA, 16 bp, Homo sapiens
gtccccaccatctgct

SEQ ID NO: 3641178 - DNA, 17 bp, Homo sapiens
gtccccccactcccagc

SEQ ID NO: 3641179 - DNA, 16 bp, Homo sapiens
gtcccggccagctctg

SEQ ID NO: 3641180 - DNA, 23 bp, Homo sapiens
gtcccggtgtatcctggccctgg

SEQ ID NO: 3641181 - DNA, 22 bp, Homo sapiens
gtccctaccgagtctcttctcc

SEQ ID NO: 3641182 - DNA, 17 bp, Homo sapiens
gtccctgaacgccctgg

SEQ ID NO: 3641183 - DNA, 18 bp, Homo sapiens
gtccctgaacgccctggt

SEQ ID NO: 3641184 - DNA, 15 bp, Homo sapiens
gtccctgcagggcca

SEQ ID NO: 3641185 - DNA, 23 bp, Homo sapiens
gtccctgctgctgccagggcttc

SEQ ID NO: 3641186 - DNA, 11 bp, Homo sapiens
gtccctggaca

SEQ ID NO: 3641187 - DNA, 13 bp, Homo sapiens
gtccctggacaca

SEQ ID NO: 3641188 - DNA, 18 bp, Homo sapiens
gtccctgtcatttgaacc

SEQ ID NO: 3641189 - DNA, 20 bp, Homo sapiens
gtccctgtccctctagtgcc

SEQ ID NO: 3641190 - DNA, 16 bp, Homo sapiens
gtccctgtccttccct

SEQ ID NO: 3641191 - DNA, 17 bp, Homo sapiens
gtcccttccaagctgtg

SEQ ID NO: 3641192 - DNA, 14 bp, Homo sapiens
gtcccttgcctctg

SEQ ID NO: 3641193 - DNA, 21 bp, Homo sapiens
gtcccttgcctctgccctgga

SEQ ID NO: 3641194 - DNA, 20 bp, Homo sapiens
gtccgtgccccttccctggg

SEQ ID NO: 3641195 - DNA, 14 bp, Homo sapiens
gtcctacccatccc

SEQ ID NO: 3641196 - DNA, 18 bp, Homo sapiens
gtcctacccatccccgca

SEQ ID NO: 3641197 - DNA, 19 bp, Homo sapiens
gtcctccaccatgcactca

SEQ ID NO: 3641198 - DNA, 19 bp, Homo sapiens
gtcctcctatctccctggc

SEQ ID NO: 3641199 - DNA, 20 bp, Homo sapiens
gtcctcctatctccctggct

SEQ ID NO: 3641200 - DNA, 23 bp, Homo sapiens
gtcctcctatctccctggctcac

SEQ ID NO: 3641201 - DNA, 21 bp, Homo sapiens
gtcctctcggctgccaggggc

SEQ ID NO: 3641202 - DNA, 14 bp, Homo sapiens
gtcctctgcctggg

SEQ ID NO: 3641203 - DNA, 15 bp, Homo sapiens
gtcctctgcctgggc

SEQ ID NO: 3641204 - DNA, 18 bp, Homo sapiens
gtcctcttttcctggcag

SEQ ID NO: 3641205 - DNA, 22 bp, Homo sapiens
gtcctcttttcctggcagctgc

SEQ ID NO: 3641206 - DNA, 15 bp, Homo sapiens
gtcctgcacatgagt

SEQ ID NO: 3641207 - DNA, 17 bp, Homo sapiens
gtcctgccacccagccc

SEQ ID NO: 3641208 - DNA, 20 bp, Homo sapiens
gtcctgggcatgggtccagg

SEQ ID NO: 3641209 - DNA, 12 bp, Homo sapiens
gtcctggtgccc

SEQ ID NO: 3641210 - DNA, 22 bp, Homo sapiens
gtcctggtgcctatctgcctgg

SEQ ID NO: 3641211 - DNA, 13 bp, Homo sapiens
gtcctgtactgta

SEQ ID NO: 3641212 - DNA, 14 bp, Homo sapiens
gtcctgtcctgctc

SEQ ID NO: 3641213 - DNA, 22 bp, Homo sapiens
gtcctgtcgaaggggaggcaca

SEQ ID NO: 3641214 - DNA, 15 bp, Homo sapiens
gtccttatgtcctgt

SEQ ID NO: 3641215 - DNA, 15 bp, Homo sapiens
gtccttctttcctct

SEQ ID NO: 3641216 - DNA, 14 bp, Homo sapiens
gtcctttcccacca

SEQ ID NO: 3641217 - DNA, 18 bp, Homo sapiens
gtcctttcccaccattcc

SEQ ID NO: 3641218 - DNA, 17 bp, Homo sapiens
gtccttttatctccttg

SEQ ID NO: 3641219 - DNA, 15 bp, Homo sapiens
gtccttttgacactg

SEQ ID NO: 3641220 - DNA, 21 bp, Homo sapiens
gtcgaggccacattgctggct

SEQ ID NO: 3641221 - DNA, 15 bp, Homo sapiens
gtcgccctcccaggc

SEQ ID NO: 3641222 - DNA, 12 bp, Homo sapiens
gtcgcctctgca

SEQ ID NO: 3641223 - DNA, 18 bp, Homo sapiens
gtcgcctgcctgcagcag

SEQ ID NO: 3641224 - DNA, 16 bp, Homo sapiens
gtcggactgcccccag

SEQ ID NO: 3641225 - DNA, 17 bp, Homo sapiens
gtcggagtgcctggagt

SEQ ID NO: 3641226 - DNA, 15 bp, Homo sapiens
gtcgggcagccagca

SEQ ID NO: 3641227 - DNA, 15 bp, Homo sapiens
gtcggtcctggtgcc

SEQ ID NO: 3641228 - DNA, 15 bp, Homo sapiens
gtcgtacattgagca

SEQ ID NO: 3641229 - DNA, 19 bp, Homo sapiens
gtcgtcttgaacgagcagc

SEQ ID NO: 3641230 - DNA, 12 bp, Homo sapiens
gttaccacagca

SEQ ID NO: 3641231 - DNA, 20 bp, Homo sapiens
gttaccacagcaactgacct

SEQ ID NO: 3641232 - DNA, 21 bp, Homo sapiens
gttaccattttaacgctgcct

SEQ ID NO: 3641233 - DNA, 23 bp, Homo sapiens
gttacctctattttaattactgc

SEQ ID NO: 3641234 - DNA, 23 bp, Homo sapiens
gttacgtgaagaaataaatgaaa

SEQ ID NO: 3641235 - DNA, 14 bp, Homo sapiens
gttacttctctaat

SEQ ID NO: 3641236 - DNA, 16 bp, Homo sapiens
gttagaaaatgactta

SEQ ID NO: 3641237 - DNA, 22 bp, Homo sapiens
gttagaaaatgacttatttctg

SEQ ID NO: 3641238 - DNA, 16 bp, Homo sapiens
gttagctgacagtcag

SEQ ID NO: 3641239 - DNA, 23 bp, Homo sapiens
gttagcttaatcttaatgtctgg

SEQ ID NO: 3641240 - DNA, 23 bp, Homo sapiens
gttagttcaatcctgattcatat

SEQ ID NO: 3641241 - DNA, 24 bp, Homo sapiens
gttagttcaatctggattcatatt

SEQ ID NO: 3641242 - DNA, 13 bp, Homo sapiens
gttatacttcaaa

SEQ ID NO: 3641243 - DNA, 18 bp, Homo sapiens
gttatatattttgttttt

SEQ ID NO: 3641244 - DNA, 17 bp, Homo sapiens
gttatatgtacagttta

SEQ ID NO: 3641245 - DNA, 13 bp, Homo sapiens
gttatcatcctcc

SEQ ID NO: 3641246 - DNA, 13 bp, Homo sapiens
gttatgcagtgaa

SEQ ID NO: 3641247 - DNA, 19 bp, Homo sapiens
gttatgcctctgacagtcc

SEQ ID NO: 3641248 - DNA, 16 bp, Homo sapiens
gttatgctgtttccta

SEQ ID NO: 3641249 - DNA, 15 bp, Homo sapiens
gttatgtattcctat

SEQ ID NO: 3641250 - DNA, 16 bp, Homo sapiens
gttatgtattcctatg

SEQ ID NO: 3641251 - DNA, 23 bp, Homo sapiens
gttattaattaaagaaaattaat

SEQ ID NO: 3641252 - DNA, 23 bp, Homo sapiens
gttatttattccccagtgactcc

SEQ ID NO: 3641253 - DNA, 13 bp, Homo sapiens
gttatttttacag

SEQ ID NO: 3641254 - DNA, 13 bp, Homo sapiens
gttcaactacatg

SEQ ID NO: 3641255 - DNA, 20 bp, Homo sapiens
gttcaatcctgattcatatt

SEQ ID NO: 3641256 - DNA, 12 bp, Homo sapiens
gttcagaagaat

SEQ ID NO: 3641257 - DNA, 16 bp, Homo sapiens
gttcagaatggcagtc

SEQ ID NO: 3641258 - DNA, 17 bp, Homo sapiens
gttcagacacagctctt

SEQ ID NO: 3641259 - DNA, 13 bp, Homo sapiens
gttcagctactcc

SEQ ID NO: 3641260 - DNA, 22 bp, Homo sapiens
gttcatacactaaccaaatctc

SEQ ID NO: 3641261 - DNA, 20 bp, Homo sapiens
gttcatcaccatttcctcct

SEQ ID NO: 3641262 - DNA, 12 bp, Homo sapiens
gttcatgagaat

SEQ ID NO: 3641263 - DNA, 10 bp, Homo sapiens
gttcatgttg

SEQ ID NO: 3641264 - DNA, 20 bp, Homo sapiens
gttcattctaccaagctgtc

SEQ ID NO: 3641265 - DNA, 12 bp, Homo sapiens
gttcatttcatt

SEQ ID NO: 3641266 - DNA, 18 bp, Homo sapiens
gttccaacatgcaatact

SEQ ID NO: 3641267 - DNA, 19 bp, Homo sapiens
gttccaagtccaataagac

SEQ ID NO: 3641268 - DNA, 14 bp, Homo sapiens
gttccactgagacc

SEQ ID NO: 3641269 - DNA, 19 bp, Homo sapiens
gttccagattcctatgatg

SEQ ID NO: 3641270 - DNA, 16 bp, Homo sapiens
gttccagtgtctgtct

SEQ ID NO: 3641271 - DNA, 11 bp, Homo sapiens
gttcccactct

SEQ ID NO: 3641272 - DNA, 20 bp, Homo sapiens
gttccccaagggccctggca

SEQ ID NO: 3641273 - DNA, 13 bp, Homo sapiens
gttccctgctgcg

SEQ ID NO: 3641274 - DNA, 14 bp, Homo sapiens
gttccctgctgcgc

SEQ ID NO: 3641275 - DNA, 14 bp, Homo sapiens
gttccggggagaaa

SEQ ID NO: 3641276 - DNA, 21 bp, Homo sapiens
gttccggggagaaacccagag

SEQ ID NO: 3641277 - DNA, 12 bp, Homo sapiens
gttcctgaaatg

SEQ ID NO: 3641278 - DNA, 15 bp, Homo sapiens
gttcctgaagctgct

SEQ ID NO: 3641279 - DNA, 16 bp, Homo sapiens
gttcctgaagctgctg

SEQ ID NO: 3641280 - DNA, 16 bp, Homo sapiens
gttcctggtgactcct

SEQ ID NO: 3641281 - DNA, 17 bp, Homo sapiens
gttcctggtgactcctg

SEQ ID NO: 3641282 - DNA, 18 bp, Homo sapiens
gttccttggccatgcaga

SEQ ID NO: 3641283 - DNA, 15 bp, Homo sapiens
gttcctttctctggg

SEQ ID NO: 3641284 - DNA, 17 bp, Homo sapiens
gttcctttctctgggct

SEQ ID NO: 3641285 - DNA, 14 bp, Homo sapiens
gttctaaaatataa

SEQ ID NO: 3641286 - DNA, 23 bp, Homo sapiens
gttctaaagatggaaaaaccacc

SEQ ID NO: 3641287 - DNA, 13 bp, Homo sapiens
gttctaaggctca

SEQ ID NO: 3641288 - DNA, 19 bp, Homo sapiens
gttctaggcatacttttca

SEQ ID NO: 3641289 - DNA, 21 bp, Homo sapiens
gttctaggcatacttttcaaa

SEQ ID NO: 3641290 - DNA, 20 bp, Homo sapiens
gttctatatgaatgctattt

SEQ ID NO: 3641291 - DNA, 18 bp, Homo sapiens
gttctccctttctctctc

SEQ ID NO: 3641292 - DNA, 22 bp, Homo sapiens
gttctccctttctctctcctct

SEQ ID NO: 3641293 - DNA, 13 bp, Homo sapiens
gttctgcctgcca

SEQ ID NO: 3641294 - DNA, 14 bp, Homo sapiens
gttctgctccatac

SEQ ID NO: 3641295 - DNA, 18 bp, Homo sapiens
gttctgctcctgcttttc

SEQ ID NO: 3641296 - DNA, 21 bp, Homo sapiens
gttctgctgatatcaacagct

SEQ ID NO: 3641297 - DNA, 19 bp, Homo sapiens
gttctgtggttccagtaag

SEQ ID NO: 3641298 - DNA, 16 bp, Homo sapiens
gttctgtggtttcatg

SEQ ID NO: 3641299 - DNA, 19 bp, Homo sapiens
gttctgtggtttcatgtta

SEQ ID NO: 3641300 - DNA, 21 bp, Homo sapiens
gttctgtggtttcatgttagt

SEQ ID NO: 3641301 - DNA, 16 bp, Homo sapiens
gttcttagcaataaat

SEQ ID NO: 3641302 - DNA, 14 bp, Homo sapiens
gttcttatgcaaaa

SEQ ID NO: 3641303 - DNA, 19 bp, Homo sapiens
gttcttatgcaaaatggaa

SEQ ID NO: 3641304 - DNA, 18 bp, Homo sapiens
gttcttcctgtctccttt

SEQ ID NO: 3641305 - DNA, 22 bp, Homo sapiens
gttcttgggcctcaggctctgc

SEQ ID NO: 3641306 - DNA, 15 bp, Homo sapiens
gttcttgggggaggc

SEQ ID NO: 3641307 - DNA, 17 bp, Homo sapiens
gttctttcacccatcct

SEQ ID NO: 3641308 - DNA, 15 bp, Homo sapiens
gttctttcatctccc

SEQ ID NO: 3641309 - DNA, 15 bp, Homo sapiens
gttctttccggccaa

SEQ ID NO: 3641310 - DNA, 15 bp, Homo sapiens
gttctttcttcctct

SEQ ID NO: 3641311 - DNA, 14 bp, Homo sapiens
gttctttgctgccc

SEQ ID NO: 3641312 - DNA, 22 bp, Homo sapiens
gttctttgctgcccctgtctgg

SEQ ID NO: 3641313 - DNA, 17 bp, Homo sapiens
gttgaaaatgcaactct

SEQ ID NO: 3641314 - DNA, 21 bp, Homo sapiens
gttgacctttatttattaaac

SEQ ID NO: 3641315 - DNA, 24 bp, Homo sapiens
gttgacttatagtacatgataaat

SEQ ID NO: 3641316 - DNA, 16 bp, Homo sapiens
gttgaggtttttaaat

SEQ ID NO: 3641317 - DNA, 22 bp, Homo sapiens
gttgagttacattaaaataaac

SEQ ID NO: 3641318 - DNA, 20 bp, Homo sapiens
gttgatataaaactctgggt

SEQ ID NO: 3641319 - DNA, 19 bp, Homo sapiens
gttgatctggaacccagac

SEQ ID NO: 3641320 - DNA, 14 bp, Homo sapiens
gttgatggaaaata

SEQ ID NO: 3641321 - DNA, 17 bp, Homo sapiens
gttgatggagccccagg

SEQ ID NO: 3641322 - DNA, 22 bp, Homo sapiens
gttgcactaaaatgaggatcca

SEQ ID NO: 3641323 - DNA, 15 bp, Homo sapiens
gttgcactgaacagg

SEQ ID NO: 3641324 - DNA, 18 bp, Homo sapiens
gttgcagccgcagagaaa

SEQ ID NO: 3641325 - DNA, 23 bp, Homo sapiens
gttgcattttaaccctattttac

SEQ ID NO: 3641326 - DNA, 20 bp, Homo sapiens
gttgcctttatttgctgtta

SEQ ID NO: 3641327 - DNA, 15 bp, Homo sapiens
gttgcgtctgaggcc

SEQ ID NO: 3641328 - DNA, 18 bp, Homo sapiens
gttgcgtctgaggcctgc

SEQ ID NO: 3641329 - DNA, 15 bp, Homo sapiens
gttgctatacatgtt

SEQ ID NO: 3641330 - DNA, 19 bp, Homo sapiens
gttgctgaaacttgctgag

SEQ ID NO: 3641331 - DNA, 15 bp, Homo sapiens
gttgctgaagatgcc

SEQ ID NO: 3641332 - DNA, 16 bp, Homo sapiens
gttgctggtcctgcac

SEQ ID NO: 3641333 - DNA, 18 bp, Homo sapiens
gttgctggtcctgcacat

SEQ ID NO: 3641334 - DNA, 12 bp, Homo sapiens
gttgctgtggct

SEQ ID NO: 3641335 - DNA, 16 bp, Homo sapiens
gttgctgttaatctga

SEQ ID NO: 3641336 - DNA, 17 bp, Homo sapiens
gttgctgttttcctccc

SEQ ID NO: 3641337 - DNA, 10 bp, Homo sapiens
gttggagaaa

SEQ ID NO: 3641338 - DNA, 21 bp, Homo sapiens
gttggagcagcaggcctctgg

SEQ ID NO: 3641339 - DNA, 15 bp, Homo sapiens
gttggcaggcccact

SEQ ID NO: 3641340 - DNA, 16 bp, Homo sapiens
gttggcaggcccactc

SEQ ID NO: 3641341 - DNA, 18 bp, Homo sapiens
gttggcatagctctgggg

SEQ ID NO: 3641342 - DNA, 16 bp, Homo sapiens
gttggctttcataaat

SEQ ID NO: 3641343 - DNA, 12 bp, Homo sapiens
gttggctttgcc

SEQ ID NO: 3641344 - DNA, 14 bp, Homo sapiens
gttgggagaatgtc

SEQ ID NO: 3641345 - DNA, 21 bp, Homo sapiens
gttgggagaatgtcagtatgt

SEQ ID NO: 3641346 - DNA, 16 bp, Homo sapiens
gttgggcccctgagga

SEQ ID NO: 3641347 - DNA, 18 bp, Homo sapiens
gttgggctgaacatgtgt

SEQ ID NO: 3641348 - DNA, 14 bp, Homo sapiens
gttgggtcaccaga

SEQ ID NO: 3641349 - DNA, 17 bp, Homo sapiens
gttggtagcaattggca

SEQ ID NO: 3641350 - DNA, 14 bp, Homo sapiens
gttgtaatgctgca

SEQ ID NO: 3641351 - DNA, 23 bp, Homo sapiens
gttgtattgatttttaagaaagt

SEQ ID NO: 3641352 - DNA, 14 bp, Homo sapiens
gttgtatttctata

SEQ ID NO: 3641353 - DNA, 13 bp, Homo sapiens
gttgtcaataaat

SEQ ID NO: 3641354 - DNA, 17 bp, Homo sapiens
gttgtcacatctcaggg

SEQ ID NO: 3641355 - DNA, 22 bp, Homo sapiens
gttgtctgaagtcactgcacag

SEQ ID NO: 3641356 - DNA, 12 bp, Homo sapiens
gttgtgagaatg

SEQ ID NO: 3641357 - DNA, 14 bp, Homo sapiens
gttgtgagaatggc

SEQ ID NO: 3641358 - DNA, 19 bp, Homo sapiens
gttgtgtgtatatgtattt

SEQ ID NO: 3641359 - DNA, 21 bp, Homo sapiens
gttgttctaaaggctgttaaa

SEQ ID NO: 3641360 - DNA, 14 bp, Homo sapiens
gttgttgtggaagc

SEQ ID NO: 3641361 - DNA, 18 bp, Homo sapiens
gttgttgtgtgtatatgt

SEQ ID NO: 3641362 - DNA, 16 bp, Homo sapiens
gtttaaaatcatttct

SEQ ID NO: 3641363 - DNA, 20 bp, Homo sapiens
taagtattttcctgttgtca

SEQ ID NO: 3641364 - DNA, 21 bp, Homo sapiens
taagtattttcctgttgtcaa

SEQ ID NO: 3641365 - DNA, 15 bp, Homo sapiens
taagtcaaaaggaac

SEQ ID NO: 3641366 - DNA, 16 bp, Homo sapiens
taagtcaaaaggaaca

SEQ ID NO: 3641367 - DNA, 18 bp, Homo sapiens
taagtccttccacctgcc

SEQ ID NO: 3641368 - DNA, 15 bp, Homo sapiens
taagtgaaaaacatg

SEQ ID NO: 3641369 - DNA, 22 bp, Homo sapiens
taagtgccaggatggaatgatg

SEQ ID NO: 3641370 - DNA, 14 bp, Homo sapiens
taagtgtacatatg

SEQ ID NO: 3641371 - DNA, 22 bp, Homo sapiens
taagtgtgcagccatagtttgg

SEQ ID NO: 3641372 - DNA, 17 bp, Homo sapiens
taagttgacctttattt

SEQ ID NO: 3641373 - DNA, 18 bp, Homo sapiens
taagttgacctttattta

SEQ ID NO: 3641374 - DNA, 18 bp, Homo sapiens
taagtttatccaaatctt

SEQ ID NO: 3641375 - DNA, 12 bp, Homo sapiens
taataaacactg

SEQ ID NO: 3641376 - DNA, 14 bp, Homo sapiens
taataaactctcta

SEQ ID NO: 3641377 - DNA, 13 bp, Homo sapiens
taataaagacagg

SEQ ID NO: 3641378 - DNA, 15 bp, Homo sapiens
taataaagagaaata

SEQ ID NO: 3641379 - DNA, 12 bp, Homo sapiens
taataaaggact

SEQ ID NO: 3641380 - DNA, 13 bp, Homo sapiens
taataaaggactg

SEQ ID NO: 3641381 - DNA, 15 bp, Homo sapiens
taataaatcacacat

SEQ ID NO: 3641382 - DNA, 23 bp, Homo sapiens
taataaatgtgactcagcatcac

SEQ ID NO: 3641383 - DNA, 12 bp, Homo sapiens
taataaattgct

SEQ ID NO: 3641384 - DNA, 21 bp, Homo sapiens
taataaattgcttactgatat

SEQ ID NO: 3641385 - DNA, 21 bp, Homo sapiens
taataatatcaaagagaagat

SEQ ID NO: 3641386 - DNA, 13 bp, Homo sapiens
taataatgggttt

SEQ ID NO: 3641387 - DNA, 15 bp, Homo sapiens
taataatttttgctg

SEQ ID NO: 3641388 - DNA, 18 bp, Homo sapiens
taataatttttgctgaat

SEQ ID NO: 3641389 - DNA, 14 bp, Homo sapiens
taatacaagcatat

SEQ ID NO: 3641390 - DNA, 22 bp, Homo sapiens
taataccacagctatttagaag

SEQ ID NO: 3641391 - DNA, 15 bp, Homo sapiens
taataggcattttaa

SEQ ID NO: 3641392 - DNA, 16 bp, Homo sapiens
taataggcattttaag

SEQ ID NO: 3641393 - DNA, 18 bp, Homo sapiens
taataggcattttaagta

SEQ ID NO: 3641394 - DNA, 18 bp, Homo sapiens
taataggtcatatgttgt

SEQ ID NO: 3641395 - DNA, 21 bp, Homo sapiens
taatagtttttcactttgtgt

SEQ ID NO: 3641396 - DNA, 17 bp, Homo sapiens
taatatccctacatgta

SEQ ID NO: 3641397 - DNA, 14 bp, Homo sapiens
taatatgaaatttt

SEQ ID NO: 3641398 - DNA, 19 bp, Homo sapiens
taatatgcagccatatatg

SEQ ID NO: 3641399 - DNA, 18 bp, Homo sapiens
taatattgacttgtatat

SEQ ID NO: 3641400 - DNA, 14 bp, Homo sapiens
taatatttaccaaa

SEQ ID NO: 3641401 - DNA, 14 bp, Homo sapiens
taatatttctaaaa

SEQ ID NO: 3641402 - DNA, 17 bp, Homo sapiens
taatattttatgtgtaa

SEQ ID NO: 3641403 - DNA, 17 bp, Homo sapiens
taatcaaattctgtctg

SEQ ID NO: 3641404 - DNA, 18 bp, Homo sapiens
taatcaagagaaacttca

SEQ ID NO: 3641405 - DNA, 19 bp, Homo sapiens
taatcaagatttttttcct

SEQ ID NO: 3641406 - DNA, 21 bp, Homo sapiens
taatcagtgattatttttcca

SEQ ID NO: 3641407 - DNA, 22 bp, Homo sapiens
taatcatatttgaaaaccatat

SEQ ID NO: 3641408 - DNA, 17 bp, Homo sapiens
taatccaggcagatcca

SEQ ID NO: 3641409 - DNA, 22 bp, Homo sapiens
taatccaggcagatccaggact

SEQ ID NO: 3641410 - DNA, 14 bp, Homo sapiens
taatcctgtaccaa

SEQ ID NO: 3641411 - DNA, 14 bp, Homo sapiens
taatccttttcctt

SEQ ID NO: 3641412 - DNA, 15 bp, Homo sapiens
taatccttttcctta

SEQ ID NO: 3641413 - DNA, 17 bp, Homo sapiens
taatccttttccttatt

SEQ ID NO: 3641414 - DNA, 14 bp, Homo sapiens
taatctgagcaggt

SEQ ID NO: 3641415 - DNA, 19 bp, Homo sapiens
taatctggactcctctgtc

SEQ ID NO: 3641416 - DNA, 20 bp, Homo sapiens
taatctggactcctctgtcc

SEQ ID NO: 3641417 - DNA, 17 bp, Homo sapiens
taatgaatgaaacattt

SEQ ID NO: 3641418 - DNA, 13 bp, Homo sapiens
taatgacaaaaga

SEQ ID NO: 3641419 - DNA, 17 bp, Homo sapiens
taatgacagccttgcaa

SEQ ID NO: 3641420 - DNA, 15 bp, Homo sapiens
taatgacaggcctgt

SEQ ID NO: 3641421 - DNA, 20 bp, Homo sapiens
taatgacaggcctgtccaac

SEQ ID NO: 3641422 - DNA, 17 bp, Homo sapiens
taatgacttagaaactg

SEQ ID NO: 3641423 - DNA, 15 bp, Homo sapiens
taatgatatgcttgt

SEQ ID NO: 3641424 - DNA, 14 bp, Homo sapiens
taatgcattgcctg

SEQ ID NO: 3641425 - DNA, 16 bp, Homo sapiens
taatgcattgcctgta

SEQ ID NO: 3641426 - DNA, 15 bp, Homo sapiens
taatgcttgatttag

SEQ ID NO: 3641427 - DNA, 14 bp, Homo sapiens
taatggattaaatt

SEQ ID NO: 3641428 - DNA, 22 bp, Homo sapiens
taatggattaaatttaattctt

SEQ ID NO: 3641429 - DNA, 18 bp, Homo sapiens
taatggggtcctggccat

SEQ ID NO: 3641430 - DNA, 17 bp, Homo sapiens
taatggtttattctttg

SEQ ID NO: 3641431 - DNA, 14 bp, Homo sapiens
taatgtaaaatgat

SEQ ID NO: 3641432 - DNA, 21 bp, Homo sapiens
taatgtaatgtttttatttca

SEQ ID NO: 3641433 - DNA, 13 bp, Homo sapiens
taatgtactgcat

SEQ ID NO: 3641434 - DNA, 16 bp, Homo sapiens
taatgtatgttaccaa

SEQ ID NO: 3641435 - DNA, 23 bp, Homo sapiens
taatgtatttgaaaattacatgt

SEQ ID NO: 3641436 - DNA, 16 bp, Homo sapiens
taatgtctcttctaac

SEQ ID NO: 3641437 - DNA, 17 bp, Homo sapiens
taatgtctcttctaaca

SEQ ID NO: 3641438 - DNA, 19 bp, Homo sapiens
taatgtttttatttcaatt

SEQ ID NO: 3641439 - DNA, 23 bp, Homo sapiens
taatgtttttatttcaattgttt

SEQ ID NO: 3641440 - DNA, 15 bp, Homo sapiens
taattaaaaactgtg

SEQ ID NO: 3641441 - DNA, 17 bp, Homo sapiens
taattaaagactcaaga

SEQ ID NO: 3641442 - DNA, 19 bp, Homo sapiens
taattagtgccacttaatg

SEQ ID NO: 3641443 - DNA, 15 bp, Homo sapiens
taattatcagttggt

SEQ ID NO: 3641444 - DNA, 18 bp, Homo sapiens
taattcaagcctctaaac

SEQ ID NO: 3641445 - DNA, 18 bp, Homo sapiens
taattcaaggaatttctt

SEQ ID NO: 3641446 - DNA, 20 bp, Homo sapiens
taattcaaggaatttcttaa

SEQ ID NO: 3641447 - DNA, 23 bp, Homo sapiens
taattcagggtggtaaagtatgt

SEQ ID NO: 3641448 - DNA, 15 bp, Homo sapiens
taattctatgcctgt

SEQ ID NO: 3641449 - DNA, 13 bp, Homo sapiens
taattctgaaaca

SEQ ID NO: 3641450 - DNA, 14 bp, Homo sapiens
taattctgaaacaa

SEQ ID NO: 3641451 - DNA, 15 bp, Homo sapiens
taattgaaagaatgt

SEQ ID NO: 3641452 - DNA, 22 bp, Homo sapiens
taattgacaggattattggaaa

SEQ ID NO: 3641453 - DNA, 22 bp, Homo sapiens
taattgcagataactttgactt

SEQ ID NO: 3641454 - DNA, 12 bp, Homo sapiens
taattgctttga

SEQ ID NO: 3641455 - DNA, 20 bp, Homo sapiens
taattgtaattccaaaatcc

SEQ ID NO: 3641456 - DNA, 16 bp, Homo sapiens
taattgtacaataaat

SEQ ID NO: 3641457 - DNA, 16 bp, Homo sapiens
taattgttgctaatct

SEQ ID NO: 3641458 - DNA, 20 bp, Homo sapiens
taatttaatttgtaaaactt

SEQ ID NO: 3641459 - DNA, 23 bp, Homo sapiens
taatttaatttgtaaaacttctg

SEQ ID NO: 3641460 - DNA, 21 bp, Homo sapiens
taatttagagataggaaactg

SEQ ID NO: 3641461 - DNA, 16 bp, Homo sapiens
taatttataatgtatt

SEQ ID NO: 3641462 - DNA, 20 bp, Homo sapiens
taatttataatgtatttgaa

SEQ ID NO: 3641463 - DNA, 21 bp, Homo sapiens
taatttataatgtatttgaaa

SEQ ID NO: 3641464 - DNA, 19 bp, Homo sapiens
taatttccttcaggcagct

SEQ ID NO: 3641465 - DNA, 20 bp, Homo sapiens
taatttggctttcacattta

SEQ ID NO: 3641466 - DNA, 21 bp, Homo sapiens
taatttgtaaaacttctgctc

SEQ ID NO: 3641467 - DNA, 14 bp, Homo sapiens
taattttaaacaaa

SEQ ID NO: 3641468 - DNA, 15 bp, Homo sapiens
taattttcagttcta

SEQ ID NO: 3641469 - DNA, 12 bp, Homo sapiens
taattttgcaaa

SEQ ID NO: 3641470 - DNA, 13 bp, Homo sapiens
taattttgcaaat

SEQ ID NO: 3641471 - DNA, 14 bp, Homo sapiens
taattttgctaact

SEQ ID NO: 3641472 - DNA, 20 bp, Homo sapiens
taattttgctaactgggtta

SEQ ID NO: 3641473 - DNA, 19 bp, Homo sapiens
taattttgtgtaagaaata

SEQ ID NO: 3641474 - DNA, 14 bp, Homo sapiens
taatttttccaact

SEQ ID NO: 3641475 - DNA, 22 bp, Homo sapiens
taattttttttttccttttaaa

SEQ ID NO: 3641476 - DNA, 13 bp, Homo sapiens
tacaaaaaattag

SEQ ID NO: 3641477 - DNA, 15 bp, Homo sapiens
tacaaaaacacagca

SEQ ID NO: 3641478 - DNA, 17 bp, Homo sapiens
tacaaaaacacagcaag

SEQ ID NO: 3641479 - DNA, 19 bp, Homo sapiens
tacaaactcccacttgtca

SEQ ID NO: 3641480 - DNA, 12 bp, Homo sapiens
tacaaactctca

SEQ ID NO: 3641481 - DNA, 13 bp, Homo sapiens
tacaaactctcac

SEQ ID NO: 3641482 - DNA, 21 bp, Homo sapiens
tacaaagaaccatgcaggaag

SEQ ID NO: 3641483 - DNA, 16 bp, Homo sapiens
tacaaagattctctat

SEQ ID NO: 3641484 - DNA, 16 bp, Homo sapiens
tacaaatcagaagtca

SEQ ID NO: 3641485 - DNA, 17 bp, Homo sapiens
tacaaatcagaagtcat

SEQ ID NO: 3641486 - DNA, 19 bp, Homo sapiens
tacaaatcagaagtcatct

SEQ ID NO: 3641487 - DNA, 20 bp, Homo sapiens
tacaaatcagaagtcatctt

SEQ ID NO: 3641488 - DNA, 21 bp, Homo sapiens
tacaaatcagaagtcatcttg

SEQ ID NO: 3641489 - DNA, 22 bp, Homo sapiens
tacaaatgccttaaaatggaat

SEQ ID NO: 3641490 - DNA, 17 bp, Homo sapiens
tacaaatttataaaggt

SEQ ID NO: 3641491 - DNA, 15 bp, Homo sapiens
tacaacaaaaatcac

SEQ ID NO: 3641492 - DNA, 17 bp, Homo sapiens
tacaaccccctccaccc

SEQ ID NO: 3641493 - DNA, 21 bp, Homo sapiens
tacaaccctaccctggcaggg

SEQ ID NO: 3641494 - DNA, 15 bp, Homo sapiens
tacaactaaataaca

SEQ ID NO: 3641495 - DNA, 20 bp, Homo sapiens
tacaactaaataacacagat

SEQ ID NO: 3641496 - DNA, 20 bp, Homo sapiens
tagttctttcctccccctgc

SEQ ID NO: 3641497 - DNA, 14 bp, Homo sapiens
tagttgacagtatt

SEQ ID NO: 3641498 - DNA, 18 bp, Homo sapiens
tagttgacagtattaaca

SEQ ID NO: 3641499 - DNA, 21 bp, Homo sapiens
tagttgacagtattaacacta

SEQ ID NO: 3641500 - DNA, 23 bp, Homo sapiens
tagttgagttggaacaacatgtt

SEQ ID NO: 3641501 - DNA, 16 bp, Homo sapiens
tagttgccaatctaaa

SEQ ID NO: 3641502 - DNA, 23 bp, Homo sapiens
tagttgtccagagataaaaatca

SEQ ID NO: 3641503 - DNA, 16 bp, Homo sapiens
tagttgttttaagtac

SEQ ID NO: 3641504 - DNA, 14 bp, Homo sapiens
tagttttatttgta

SEQ ID NO: 3641505 - DNA, 17 bp, Homo sapiens
tagttttatttgtatta

SEQ ID NO: 3641506 - DNA, 18 bp, Homo sapiens
tagttttttcttcctttt

SEQ ID NO: 3641507 - DNA, 20 bp, Homo sapiens
tagttttttcttccttttca

SEQ ID NO: 3641508 - DNA, 23 bp, Homo sapiens
tagttttttcttccttttcactg

SEQ ID NO: 3641509 - DNA, 23 bp, Homo sapiens
tataaaacagccctatttcttga

SEQ ID NO: 3641510 - DNA, 15 bp, Homo sapiens
tataaaatgtattca

SEQ ID NO: 3641511 - DNA, 20 bp, Homo sapiens
tataaaatgtattcaagcaa

SEQ ID NO: 3641512 - DNA, 15 bp, Homo sapiens
tataaaccaatctta

SEQ ID NO: 3641513 - DNA, 15 bp, Homo sapiens
tataaaccaatgaaa

SEQ ID NO: 3641514 - DNA, 15 bp, Homo sapiens
tataaaccataaaat

SEQ ID NO: 3641515 - DNA, 20 bp, Homo sapiens
tataaaccataaaataaata

SEQ ID NO: 3641516 - DNA, 16 bp, Homo sapiens
tataaactgggatgta

SEQ ID NO: 3641517 - DNA, 15 bp, Homo sapiens
tataaagaaactggt

SEQ ID NO: 3641518 - DNA, 15 bp, Homo sapiens
tataaatgggaagaa

SEQ ID NO: 3641519 - DNA, 15 bp, Homo sapiens
tataaatgtgatatg

SEQ ID NO: 3641520 - DNA, 12 bp, Homo sapiens
tataaattaaaa

SEQ ID NO: 3641521 - DNA, 20 bp, Homo sapiens
tataaattcctctttgcttt

SEQ ID NO: 3641522 - DNA, 17 bp, Homo sapiens
tataaattgtgtattta

SEQ ID NO: 3641523 - DNA, 16 bp, Homo sapiens
tataaattttttgaaa

SEQ ID NO: 3641524 - DNA, 22 bp, Homo sapiens
tataacacttaggactagaaga

SEQ ID NO: 3641525 - DNA, 18 bp, Homo sapiens
tataactattacagtgtt

SEQ ID NO: 3641526 - DNA, 19 bp, Homo sapiens
tataactattacagtgttg

SEQ ID NO: 3641527 - DNA, 16 bp, Homo sapiens
tataactttaacttct

SEQ ID NO: 3641528 - DNA, 17 bp, Homo sapiens
tataagaaatgcatatg

SEQ ID NO: 3641529 - DNA, 19 bp, Homo sapiens
tataagcaaaatcagaagt

SEQ ID NO: 3641530 - DNA, 13 bp, Homo sapiens
tataagtgtacat

SEQ ID NO: 3641531 - DNA, 12 bp, Homo sapiens
tataataaacat

SEQ ID NO: 3641532 - DNA, 20 bp, Homo sapiens
tataataaactcttaagaga

SEQ ID NO: 3641533 - DNA, 19 bp, Homo sapiens
tataataaaggactgtaat

SEQ ID NO: 3641534 - DNA, 18 bp, Homo sapiens
tataatgaatgaaacatt

SEQ ID NO: 3641535 - DNA, 12 bp, Homo sapiens
tataatgtattt

SEQ ID NO: 3641536 - DNA, 19 bp, Homo sapiens
tataatgtatttgaaaatt

SEQ ID NO: 3641537 - DNA, 22 bp, Homo sapiens
tataatgtatttgaaaattaca

SEQ ID NO: 3641538 - DNA, 19 bp, Homo sapiens
tataattggatttcctaat

SEQ ID NO: 3641539 - DNA, 17 bp, Homo sapiens
tataatttacctaagat

SEQ ID NO: 3641540 - DNA, 13 bp, Homo sapiens
tatacaatgttct

SEQ ID NO: 3641541 - DNA, 14 bp, Homo sapiens
tatacaccagcaat

SEQ ID NO: 3641542 - DNA, 13 bp, Homo sapiens
tatacagaggaaa

SEQ ID NO: 3641543 - DNA, 14 bp, Homo sapiens
tatacatgttggaa

SEQ ID NO: 3641544 - DNA, 20 bp, Homo sapiens
tatacatgttggaaatgtgt

SEQ ID NO: 3641545 - DNA, 14 bp, Homo sapiens
tatacatttgataa

SEQ ID NO: 3641546 - DNA, 15 bp, Homo sapiens
tatacccacccagaa

SEQ ID NO: 3641547 - DNA, 22 bp, Homo sapiens
tatacccacccagaatgagaca

SEQ ID NO: 3641548 - DNA, 22 bp, Homo sapiens
tatactgcaaactatttaaaga

SEQ ID NO: 3641549 - DNA, 18 bp, Homo sapiens
tatactgctatttacact

SEQ ID NO: 3641550 - DNA, 20 bp, Homo sapiens
tatactgctatttacactat

SEQ ID NO: 3641551 - DNA, 17 bp, Homo sapiens
tatactgctctataaat

SEQ ID NO: 3641552 - DNA, 22 bp, Homo sapiens
tatactgctctataaatagtat

SEQ ID NO: 3641553 - DNA, 20 bp, Homo sapiens
tatactgtaggtgttatgta

SEQ ID NO: 3641554 - DNA, 13 bp, Homo sapiens
tatactgttcttc

SEQ ID NO: 3641555 - DNA, 17 bp, Homo sapiens
tatagaaaacctgactt

SEQ ID NO: 3641556 - DNA, 15 bp, Homo sapiens
tatagaccaattgaa

SEQ ID NO: 3641557 - DNA, 20 bp, Homo sapiens
tatagaccaattgaagcatg

SEQ ID NO: 3641558 - DNA, 14 bp, Homo sapiens
tatagatataaata

SEQ ID NO: 3641559 - DNA, 16 bp, Homo sapiens
tataggcatgagccac

SEQ ID NO: 3641560 - DNA, 23 bp, Homo sapiens
tataggcctgtcccttgcctctg

SEQ ID NO: 3641561 - DNA, 21 bp, Homo sapiens
tataggggtcctgggggcagg

SEQ ID NO: 3641562 - DNA, 21 bp, Homo sapiens
tataggtgctacaaaaacaca

SEQ ID NO: 3641563 - DNA, 18 bp, Homo sapiens
tataggtttgattcaaca

SEQ ID NO: 3641564 - DNA, 13 bp, Homo sapiens
tatagtatctgta

SEQ ID NO: 3641565 - DNA, 16 bp, Homo sapiens
tatagtgacatgcagt

SEQ ID NO: 3641566 - DNA, 18 bp, Homo sapiens
tatagttactgtgtaatt

SEQ ID NO: 3641567 - DNA, 19 bp, Homo sapiens
tatagttatatgtacagtt

SEQ ID NO: 3641568 - DNA, 13 bp, Homo sapiens
tatataaagtcag

SEQ ID NO: 3641569 - DNA, 16 bp, Homo sapiens
tatataaagtcagtga

SEQ ID NO: 3641570 - DNA, 14 bp, Homo sapiens
tatataaattatta

SEQ ID NO: 3641571 - DNA, 22 bp, Homo sapiens
tatataaattattactttaaat

SEQ ID NO: 3641572 - DNA, 20 bp, Homo sapiens
tatataagagcatgaaattt

SEQ ID NO: 3641573 - DNA, 15 bp, Homo sapiens
tatataatgtatata

SEQ ID NO: 3641574 - DNA, 16 bp, Homo sapiens
tatatacagaggaaat

SEQ ID NO: 3641575 - DNA, 23 bp, Homo sapiens
tatataggctattttctaaagac

SEQ ID NO: 3641576 - DNA, 13 bp, Homo sapiens
tatatatatgtgt

SEQ ID NO: 3641577 - DNA, 17 bp, Homo sapiens
tatatattcttataaaa

SEQ ID NO: 3641578 - DNA, 17 bp, Homo sapiens
tatatcaggtgtataaa

SEQ ID NO: 3641579 - DNA, 15 bp, Homo sapiens
tatatgatatgcatg

SEQ ID NO: 3641580 - DNA, 21 bp, Homo sapiens
tatatgatatgcatgtagcat

SEQ ID NO: 3641581 - DNA, 15 bp, Homo sapiens
tatatgcacacatat

SEQ ID NO: 3641582 - DNA, 18 bp, Homo sapiens
tatatggaaggttcctgt

SEQ ID NO: 3641583 - DNA, 18 bp, Homo sapiens
tatatgtatttaagatgt

SEQ ID NO: 3641584 - DNA, 18 bp, Homo sapiens
tatatgtgaaacattttt

SEQ ID NO: 3641585 - DNA, 23 bp, Homo sapiens
tatattacttgcctatctgactt

SEQ ID NO: 3641586 - DNA, 14 bp, Homo sapiens
tatattataagttg

SEQ ID NO: 3641587 - DNA, 13 bp, Homo sapiens
tatattcattctt

SEQ ID NO: 3641588 - DNA, 17 bp, Homo sapiens
tatattcctccagctgg

SEQ ID NO: 3641589 - DNA, 16 bp, Homo sapiens
tatattctaatagttt

SEQ ID NO: 3641590 - DNA, 16 bp, Homo sapiens
tatattctattttaca

SEQ ID NO: 3641591 - DNA, 20 bp, Homo sapiens
tatattgtttttgtatttat

SEQ ID NO: 3641592 - DNA, 13 bp, Homo sapiens
tatatttaagcct

SEQ ID NO: 3641593 - DNA, 15 bp, Homo sapiens
tatatttaattttga

SEQ ID NO: 3641594 - DNA, 12 bp, Homo sapiens
tatatttattgt

SEQ ID NO: 3641595 - DNA, 13 bp, Homo sapiens
tatatttattgtt

SEQ ID NO: 3641596 - DNA, 20 bp, Homo sapiens
tatatttgtaaatttatgtg

SEQ ID NO: 3641597 - DNA, 13 bp, Homo sapiens
tatatttgtatta

SEQ ID NO: 3641598 - DNA, 15 bp, Homo sapiens
tatatttttaaagaa

SEQ ID NO: 3641599 - DNA, 21 bp, Homo sapiens
tatatttttataataaacata

SEQ ID NO: 3641600 - DNA, 14 bp, Homo sapiens
tatcaaaatagtct

SEQ ID NO: 3641601 - DNA, 16 bp, Homo sapiens
tatcaaagagaagatg

SEQ ID NO: 3641602 - DNA, 20 bp, Homo sapiens
tatcaaagagaagatgcctg

SEQ ID NO: 3641603 - DNA, 23 bp, Homo sapiens
tatcaaatacatttaaaacatta

SEQ ID NO: 3641604 - DNA, 23 bp, Homo sapiens
tatcaccaaaaacctattccact

SEQ ID NO: 3641605 - DNA, 17 bp, Homo sapiens
tatcagcaatgccccaa

SEQ ID NO: 3641606 - DNA, 20 bp, Homo sapiens
tatcagcaatgccccaaact

SEQ ID NO: 3641607 - DNA, 18 bp, Homo sapiens
tatcaggtgtataaatgt

SEQ ID NO: 3641608 - DNA, 21 bp, Homo sapiens
tatcaggtgtataaatgtaca

SEQ ID NO: 3641609 - DNA, 16 bp, Homo sapiens
tatcataaaatcaaaa

SEQ ID NO: 3641610 - DNA, 23 bp, Homo sapiens
tatcataagttatgcctctgaca

SEQ ID NO: 3641611 - DNA, 15 bp, Homo sapiens
tatcatagaaatgta

SEQ ID NO: 3641612 - DNA, 13 bp, Homo sapiens
tatcatgaatgtg

SEQ ID NO: 3641613 - DNA, 14 bp, Homo sapiens
tatccaatctgtga

SEQ ID NO: 3641614 - DNA, 14 bp, Homo sapiens
tatccaatgaaata

SEQ ID NO: 3641615 - DNA, 15 bp, Homo sapiens
tatccacccagcagg

SEQ ID NO: 3641616 - DNA, 12 bp, Homo sapiens
tatccagagctg

SEQ ID NO: 3641617 - DNA, 23 bp, Homo sapiens
tatccaggttggttttgctgttg

SEQ ID NO: 3641618 - DNA, 16 bp, Homo sapiens
tatcccaatcattgtt

SEQ ID NO: 3641619 - DNA, 16 bp, Homo sapiens
tatccctctcttcccc

SEQ ID NO: 3641620 - DNA, 23 bp, Homo sapiens
tatccctctcttccccttccctt

SEQ ID NO: 3641621 - DNA, 17 bp, Homo sapiens
tatcctccaggtttttc

SEQ ID NO: 3641622 - DNA, 16 bp, Homo sapiens
tatcctgaaatttcag

SEQ ID NO: 3641623 - DNA, 15 bp, Homo sapiens
tatcctggccctggg

SEQ ID NO: 3641624 - DNA, 16 bp, Homo sapiens
tatcctggccctgggg

SEQ ID NO: 3641625 - DNA, 20 bp, Homo sapiens
tatcctgggagcactgcgtt

SEQ ID NO: 3641626 - DNA, 19 bp, Homo sapiens
tatccttaaccattctgtc

SEQ ID NO: 3641627 - DNA, 16 bp, Homo sapiens
tatctatgttttacca

SEQ ID NO: 3641628 - DNA, 18 bp, Homo sapiens
tcacccccctctgctgcc

SEQ ID NO: 3641629 - DNA, 19 bp, Homo sapiens
tcacccccctctgctgccg

SEQ ID NO: 3641630 - DNA, 16 bp, Homo sapiens
tcacccctagccctgg

SEQ ID NO: 3641631 - DNA, 23 bp, Homo sapiens
tcaccctgatttaggagaagcca

SEQ ID NO: 3641632 - DNA, 17 bp, Homo sapiens
tcaccctgggagccagt

SEQ ID NO: 3641633 - DNA, 13 bp, Homo sapiens
tcaccctggggat

SEQ ID NO: 3641634 - DNA, 23 bp, Homo sapiens
tcaccctggggatagtccttcct

SEQ ID NO: 3641635 - DNA, 22 bp, Homo sapiens
tcaccgactgaaaatattgttt

SEQ ID NO: 3641636 - DNA, 19 bp, Homo sapiens
tcacctactaatgtctctt

SEQ ID NO: 3641637 - DNA, 16 bp, Homo sapiens
tcacctagcagcctca

SEQ ID NO: 3641638 - DNA, 24 bp, Homo sapiens
tcacctcgagaagtaattatcagt

SEQ ID NO: 3641639 - DNA, 19 bp, Homo sapiens
tcaccttggcaccagacac

SEQ ID NO: 3641640 - DNA, 23 bp, Homo sapiens
tcaccttggcaccagacacccag

SEQ ID NO: 3641641 - DNA, 14 bp, Homo sapiens
tcacgccttggcct

SEQ ID NO: 3641642 - DNA, 15 bp, Homo sapiens
tcacgtgctttgtgt

SEQ ID NO: 3641643 - DNA, 12 bp, Homo sapiens
tcactaaggact

SEQ ID NO: 3641644 - DNA, 20 bp, Homo sapiens
tcactagtgaccccttccct

SEQ ID NO: 3641645 - DNA, 14 bp, Homo sapiens
tcactccccaggga

SEQ ID NO: 3641646 - DNA, 15 bp, Homo sapiens
tcactcctacctggt

SEQ ID NO: 3641647 - DNA, 13 bp, Homo sapiens
tcactcctggagg

SEQ ID NO: 3641648 - DNA, 19 bp, Homo sapiens
tcactctacttagcatgtc

SEQ ID NO: 3641649 - DNA, 17 bp, Homo sapiens
tcactctaggttttaca

SEQ ID NO: 3641650 - DNA, 16 bp, Homo sapiens
tcactctgggcctggg

SEQ ID NO: 3641651 - DNA, 21 bp, Homo sapiens
tcactctgtccctgtccttcc

SEQ ID NO: 3641652 - DNA, 24 bp, Homo sapiens
tcactctgtccctgtccttccctg

SEQ ID NO: 3641653 - DNA, 13 bp, Homo sapiens
tcactcttttgat

SEQ ID NO: 3641654 - DNA, 16 bp, Homo sapiens
tcactgaactccaccg

SEQ ID NO: 3641655 - DNA, 21 bp, Homo sapiens
tcactgcaaacacaccttgga

SEQ ID NO: 3641656 - DNA, 22 bp, Homo sapiens
tcactgcacagtgcatctcagc

SEQ ID NO: 3641657 - DNA, 17 bp, Homo sapiens
tcactgctagagacgct

SEQ ID NO: 3641658 - DNA, 12 bp, Homo sapiens
tcactgctggct

SEQ ID NO: 3641659 - DNA, 16 bp, Homo sapiens
tcactgctggctgcct

SEQ ID NO: 3641660 - DNA, 18 bp, Homo sapiens
tcactgctggctgcctta

SEQ ID NO: 3641661 - DNA, 18 bp, Homo sapiens
tcactggcctgccatgcc

SEQ ID NO: 3641662 - DNA, 21 bp, Homo sapiens
tcactgtagaatgatttcatg

SEQ ID NO: 3641663 - DNA, 19 bp, Homo sapiens
tcactgtcctccaagccag

SEQ ID NO: 3641664 - DNA, 20 bp, Homo sapiens
tcactgtgcttaatttaaat

SEQ ID NO: 3641665 - DNA, 18 bp, Homo sapiens
tcacttaaatttgttctt

SEQ ID NO: 3641666 - DNA, 13 bp, Homo sapiens
tcacttacaagaa

SEQ ID NO: 3641667 - DNA, 13 bp, Homo sapiens
tcacttactattg

SEQ ID NO: 3641668 - DNA, 12 bp, Homo sapiens
tcacttagtcct

SEQ ID NO: 3641669 - DNA, 13 bp, Homo sapiens
tcacttgtacaaa

SEQ ID NO: 3641670 - DNA, 16 bp, Homo sapiens
tcacttgtacaaaata

SEQ ID NO: 3641671 - DNA, 18 bp, Homo sapiens
tcacttgtcgggggccca

SEQ ID NO: 3641672 - DNA, 13 bp, Homo sapiens
tcactttcctcag

SEQ ID NO: 3641673 - DNA, 16 bp, Homo sapiens
tcactttcttaagcaa

SEQ ID NO: 3641674 - DNA, 23 bp, Homo sapiens
tcactttgtgtattaaatggttt

SEQ ID NO: 3641675 - DNA, 16 bp, Homo sapiens
tcactttttctgataa

SEQ ID NO: 3641676 - DNA, 20 bp, Homo sapiens
tcactttttgaggcaaaaga

SEQ ID NO: 3641677 - DNA, 22 bp, Homo sapiens
tcactttttgaggcaaaagaag

SEQ ID NO: 3641678 - DNA, 15 bp, Homo sapiens
tcacttttttataaa

SEQ ID NO: 3641679 - DNA, 16 bp, Homo sapiens
tcagaaataaatcaca

SEQ ID NO: 3641680 - DNA, 14 bp, Homo sapiens
tcagaacaaaactt

SEQ ID NO: 3641681 - DNA, 18 bp, Homo sapiens
tcagaacattcagctctg

SEQ ID NO: 3641682 - DNA, 21 bp, Homo sapiens
tcagaaccaaatctttcccct

SEQ ID NO: 3641683 - DNA, 21 bp, Homo sapiens
tcagaactcaaatggggccag

SEQ ID NO: 3641684 - DNA, 12 bp, Homo sapiens
tcagaactgccc

SEQ ID NO: 3641685 - DNA, 19 bp, Homo sapiens
tcagaactgcccttgctgc

SEQ ID NO: 3641686 - DNA, 15 bp, Homo sapiens
tcagaactgtttttg

SEQ ID NO: 3641687 - DNA, 17 bp, Homo sapiens
tcagaagaatcttcctg

SEQ ID NO: 3641688 - DNA, 18 bp, Homo sapiens
tcagaagaatcttcctgg

SEQ ID NO: 3641689 - DNA, 14 bp, Homo sapiens
tcagaaggccccag

SEQ ID NO: 3641690 - DNA, 15 bp, Homo sapiens
tcagaagtcatcttg

SEQ ID NO: 3641691 - DNA, 17 bp, Homo sapiens
tcagaatcttttcaatg

SEQ ID NO: 3641692 - DNA, 18 bp, Homo sapiens
tcagaatggcagtcctgg

SEQ ID NO: 3641693 - DNA, 20 bp, Homo sapiens
tcagaatggcagtcctggag

SEQ ID NO: 3641694 - DNA, 22 bp, Homo sapiens
tcagaatggcagtcctggaggc

SEQ ID NO: 3641695 - DNA, 21 bp, Homo sapiens
tcagacacagctcttccaggg

SEQ ID NO: 3641696 - DNA, 16 bp, Homo sapiens
tcagacatccacataa

SEQ ID NO: 3641697 - DNA, 12 bp, Homo sapiens
tcagacatttct

SEQ ID NO: 3641698 - DNA, 12 bp, Homo sapiens
tcagaccccccc

SEQ ID NO: 3641699 - DNA, 21 bp, Homo sapiens
tcagactcccattcctgaaga

SEQ ID NO: 3641700 - DNA, 23 bp, Homo sapiens
tcagactttgtgttcatttcatt

SEQ ID NO: 3641701 - DNA, 12 bp, Homo sapiens
tcagagaattat

SEQ ID NO: 3641702 - DNA, 21 bp, Homo sapiens
tcagagaattatctcaagtaa

SEQ ID NO: 3641703 - DNA, 22 bp, Homo sapiens
tcagagaggccttttggaatgt

SEQ ID NO: 3641704 - DNA, 16 bp, Homo sapiens
tcagagccagcctggc

SEQ ID NO: 3641705 - DNA, 23 bp, Homo sapiens
tcagagccagcctggctctgccc

SEQ ID NO: 3641706 - DNA, 19 bp, Homo sapiens
tcagagtgttttgaccagt

SEQ ID NO: 3641707 - DNA, 15 bp, Homo sapiens
tcagatccagggaca

SEQ ID NO: 3641708 - DNA, 16 bp, Homo sapiens
tcagatgcagtttgga

SEQ ID NO: 3641709 - DNA, 19 bp, Homo sapiens
tcagattcccagagcaaaa

SEQ ID NO: 3641710 - DNA, 21 bp, Homo sapiens
tcagattcccagagcaaaata

SEQ ID NO: 3641711 - DNA, 18 bp, Homo sapiens
tcagatttaagccttaca

SEQ ID NO: 3641712 - DNA, 20 bp, Homo sapiens
tcagatttaagccttacaaa

SEQ ID NO: 3641713 - DNA, 22 bp, Homo sapiens
tcagatttaagccttacaaagg

SEQ ID NO: 3641714 - DNA, 15 bp, Homo sapiens
tcagatttctgagga

SEQ ID NO: 3641715 - DNA, 21 bp, Homo sapiens
tcagatttgaactcttcaatc

SEQ ID NO: 3641716 - DNA, 15 bp, Homo sapiens
tcagcaaacaggatc

SEQ ID NO: 3641717 - DNA, 20 bp, Homo sapiens
tcagcaaacttgttgaattt

SEQ ID NO: 3641718 - DNA, 23 bp, Homo sapiens
tcagcaacccttcctgctgctgc

SEQ ID NO: 3641719 - DNA, 17 bp, Homo sapiens
tcagcagctagaaaaca

SEQ ID NO: 3641720 - DNA, 10 bp, Homo sapiens
tcagcatcca

SEQ ID NO: 3641721 - DNA, 20 bp, Homo sapiens
tcagcattctcactcctacc

SEQ ID NO: 3641722 - DNA, 21 bp, Homo sapiens
tcagcattttagaaactacaa

SEQ ID NO: 3641723 - DNA, 16 bp, Homo sapiens
tcagccacctgggaac

SEQ ID NO: 3641724 - DNA, 13 bp, Homo sapiens
tcagccactgtga

SEQ ID NO: 3641725 - DNA, 22 bp, Homo sapiens
tcagccaggtctgactccaaag

SEQ ID NO: 3641726 - DNA, 16 bp, Homo sapiens
tcagccagtggggatg

SEQ ID NO: 3641727 - DNA, 18 bp, Homo sapiens
tcagccagtggggatgag

SEQ ID NO: 3641728 - DNA, 15 bp, Homo sapiens
tcagccctgcaccat

SEQ ID NO: 3641729 - DNA, 15 bp, Homo sapiens
tcagccctggcctgg

SEQ ID NO: 3641730 - DNA, 20 bp, Homo sapiens
tcagcctaccgctggccctg

SEQ ID NO: 3641731 - DNA, 20 bp, Homo sapiens
tcagcctccccagtagctgg

SEQ ID NO: 3641732 - DNA, 13 bp, Homo sapiens
tcagcctcctcat

SEQ ID NO: 3641733 - DNA, 21 bp, Homo sapiens
tcagcctcctgagtagctgga

SEQ ID NO: 3641734 - DNA, 13 bp, Homo sapiens
tcagcctcctggg

SEQ ID NO: 3641735 - DNA, 17 bp, Homo sapiens
tcagcctgctttcctgc

SEQ ID NO: 3641736 - DNA, 14 bp, Homo sapiens
tcagcctggccaga

SEQ ID NO: 3641737 - DNA, 16 bp, Homo sapiens
tcagcctggccagaca

SEQ ID NO: 3641738 - DNA, 20 bp, Homo sapiens
tcagcctggccagacacagg

SEQ ID NO: 3641739 - DNA, 17 bp, Homo sapiens
tcagcctggtttctggg

SEQ ID NO: 3641740 - DNA, 19 bp, Homo sapiens
tcagcctgttccagaagga

SEQ ID NO: 3641741 - DNA, 20 bp, Homo sapiens
tcagcctgttccagaaggag

SEQ ID NO: 3641742 - DNA, 22 bp, Homo sapiens
tcagcctgttccagaaggagga

SEQ ID NO: 3641743 - DNA, 15 bp, Homo sapiens
tcagccttgccagag

SEQ ID NO: 3641744 - DNA, 17 bp, Homo sapiens
tcagccttgccagagat

SEQ ID NO: 3641745 - DNA, 17 bp, Homo sapiens
tcagctcccctcggaga

SEQ ID NO: 3641746 - DNA, 22 bp, Homo sapiens
tcagctcccctcggagaagagc

SEQ ID NO: 3641747 - DNA, 12 bp, Homo sapiens
tcagctccctgc

SEQ ID NO: 3641748 - DNA, 17 bp, Homo sapiens
tcagctccctgcctgtt

SEQ ID NO: 3641749 - DNA, 19 bp, Homo sapiens
tcagctccctgcctgtttc

SEQ ID NO: 3641750 - DNA, 21 bp, Homo sapiens
tcagctccctgcctgtttccc

SEQ ID NO: 3641751 - DNA, 17 bp, Homo sapiens
tcagctctggagaacag

SEQ ID NO: 3641752 - DNA, 20 bp, Homo sapiens
tcagctgagcatggagacag

SEQ ID NO: 3641753 - DNA, 22 bp, Homo sapiens
tcagctgcaaggtactctggtg

SEQ ID NO: 3641754 - DNA, 16 bp, Homo sapiens
tcagctgccccacagg

SEQ ID NO: 3641755 - DNA, 12 bp, Homo sapiens
tcagctgtgcct

SEQ ID NO: 3641756 - DNA, 21 bp, Homo sapiens
tcagctgtggggaacacagct

SEQ ID NO: 3641757 - DNA, 21 bp, Homo sapiens
tcagcttcttcacaggcactc

SEQ ID NO: 3641758 - DNA, 18 bp, Homo sapiens
tcagctttggctctggct

SEQ ID NO: 3641759 - DNA, 21 bp, Homo sapiens
tcaggaaatcaaatatgcaaa

SEQ ID NO: 3641760 - DNA, 15 bp, Homo sapiens
tccctaaactgcagc

SEQ ID NO: 3641761 - DNA, 20 bp, Homo sapiens
tccctaaactgcagcctctc

SEQ ID NO: 3641762 - DNA, 14 bp, Homo sapiens
tccctacactgatg

SEQ ID NO: 3641763 - DNA, 24 bp, Homo sapiens
tccctacatgtattgcacattgta

SEQ ID NO: 3641764 - DNA, 19 bp, Homo sapiens
tccctaccctaaccaagtt

SEQ ID NO: 3641765 - DNA, 23 bp, Homo sapiens
tccctaccgagtctcttctccac

SEQ ID NO: 3641766 - DNA, 15 bp, Homo sapiens
tccctacttcctgtg

SEQ ID NO: 3641767 - DNA, 12 bp, Homo sapiens
tccctcacccat

SEQ ID NO: 3641768 - DNA, 14 bp, Homo sapiens
tccctcacccatcc

SEQ ID NO: 3641769 - DNA, 15 bp, Homo sapiens
tccctcaccttggca

SEQ ID NO: 3641770 - DNA, 15 bp, Homo sapiens
tccctcagtttctta

SEQ ID NO: 3641771 - DNA, 21 bp, Homo sapiens
tccctccaccccacagaacct

SEQ ID NO: 3641772 - DNA, 21 bp, Homo sapiens
tccctcccccccatgcactgt

SEQ ID NO: 3641773 - DNA, 16 bp, Homo sapiens
tccctccccctccttg

SEQ ID NO: 3641774 - DNA, 22 bp, Homo sapiens
tccctccgccttctcccacatg

SEQ ID NO: 3641775 - DNA, 15 bp, Homo sapiens
tccctcctgagtgcc

SEQ ID NO: 3641776 - DNA, 20 bp, Homo sapiens
tccctcctgagtgccccact

SEQ ID NO: 3641777 - DNA, 16 bp, Homo sapiens
tccctctcagaggcct

SEQ ID NO: 3641778 - DNA, 15 bp, Homo sapiens
tccctctccagcagg

SEQ ID NO: 3641779 - DNA, 15 bp, Homo sapiens
tccctctcttcccct

SEQ ID NO: 3641780 - DNA, 13 bp, Homo sapiens
tccctctgcccca

SEQ ID NO: 3641781 - DNA, 12 bp, Homo sapiens
tccctgactggg

SEQ ID NO: 3641782 - DNA, 23 bp, Homo sapiens
tccctgactgggggcagacatgg

SEQ ID NO: 3641783 - DNA, 17 bp, Homo sapiens
tccctgatcccaccccc

SEQ ID NO: 3641784 - DNA, 21 bp, Homo sapiens
tccctgcatctgaccagcagc

SEQ ID NO: 3641785 - DNA, 18 bp, Homo sapiens
tccctgcccaaaccctta

SEQ ID NO: 3641786 - DNA, 14 bp, Homo sapiens
tccctgcccctccc

SEQ ID NO: 3641787 - DNA, 18 bp, Homo sapiens
tccctgcccctcccttca

SEQ ID NO: 3641788 - DNA, 19 bp, Homo sapiens
tccctgcccctcccttcaa

SEQ ID NO: 3641789 - DNA, 13 bp, Homo sapiens
tccctgcctggag

SEQ ID NO: 3641790 - DNA, 19 bp, Homo sapiens
tccctgcgagacgcacaca

SEQ ID NO: 3641791 - DNA, 17 bp, Homo sapiens
tccctgctccacgtctg

SEQ ID NO: 3641792 - DNA, 11 bp, Homo sapiens
tccctgctgaa

SEQ ID NO: 3641793 - DNA, 17 bp, Homo sapiens
tccctgctgcgctgctt

SEQ ID NO: 3641794 - DNA, 18 bp, Homo sapiens
tccctgctgcgctgcttg

SEQ ID NO: 3641795 - DNA, 22 bp, Homo sapiens
tccctgcttgcccgctcccaca

SEQ ID NO: 3641796 - DNA, 16 bp, Homo sapiens
tccctgctttgcatct

SEQ ID NO: 3641797 - DNA, 22 bp, Homo sapiens
tccctggaaaccttccacccag

SEQ ID NO: 3641798 - DNA, 20 bp, Homo sapiens
tccctggaagctctccgagc

SEQ ID NO: 3641799 - DNA, 18 bp, Homo sapiens
tccctggaaggacatcca

SEQ ID NO: 3641800 - DNA, 15 bp, Homo sapiens
tccctggacacagct

SEQ ID NO: 3641801 - DNA, 17 bp, Homo sapiens
tccctggacacagctct

SEQ ID NO: 3641802 - DNA, 20 bp, Homo sapiens
tccctggacacagctcttca

SEQ ID NO: 3641803 - DNA, 21 bp, Homo sapiens
tccctggacacagctcttcat

SEQ ID NO: 3641804 - DNA, 16 bp, Homo sapiens
tccctggagcaggagc

SEQ ID NO: 3641805 - DNA, 19 bp, Homo sapiens
tccctggagcaggagcccc

SEQ ID NO: 3641806 - DNA, 23 bp, Homo sapiens
tccctggagcaggagccccgcca

SEQ ID NO: 3641807 - DNA, 18 bp, Homo sapiens
tccctggctcactggcag

SEQ ID NO: 3641808 - DNA, 19 bp, Homo sapiens
tccctggctcactggcagg

SEQ ID NO: 3641809 - DNA, 21 bp, Homo sapiens
tccctggggccaacggcaaca

SEQ ID NO: 3641810 - DNA, 21 bp, Homo sapiens
tccctgggtttgggagccagg

SEQ ID NO: 3641811 - DNA, 14 bp, Homo sapiens
tccctgtctccagg

SEQ ID NO: 3641812 - DNA, 16 bp, Homo sapiens
tccctgtctccagggc

SEQ ID NO: 3641813 - DNA, 16 bp, Homo sapiens
tccctgtgtcatttca

SEQ ID NO: 3641814 - DNA, 18 bp, Homo sapiens
tccctgttccccagagaa

SEQ ID NO: 3641815 - DNA, 16 bp, Homo sapiens
tccctgttctcccttt

SEQ ID NO: 3641816 - DNA, 18 bp, Homo sapiens
tcccttaccctcctctgc

SEQ ID NO: 3641817 - DNA, 21 bp, Homo sapiens
tcccttcaaccattccccatg

SEQ ID NO: 3641818 - DNA, 23 bp, Homo sapiens
tcccttgaggaaacaacagcttt

SEQ ID NO: 3641819 - DNA, 15 bp, Homo sapiens
tcccttgcctctgcc

SEQ ID NO: 3641820 - DNA, 16 bp, Homo sapiens
tcccttgcctctgccc

SEQ ID NO: 3641821 - DNA, 19 bp, Homo sapiens
tcccttggacattttatgt

SEQ ID NO: 3641822 - DNA, 22 bp, Homo sapiens
tcccttggacattttatgtctt

SEQ ID NO: 3641823 - DNA, 22 bp, Homo sapiens
tcccttggtttagaggaaccca

SEQ ID NO: 3641824 - DNA, 13 bp, Homo sapiens
tccctttccctac

SEQ ID NO: 3641825 - DNA, 15 bp, Homo sapiens
tccctttcccttggt

SEQ ID NO: 3641826 - DNA, 18 bp, Homo sapiens
tccctttctctctcctct

SEQ ID NO: 3641827 - DNA, 19 bp, Homo sapiens
tccctttctctctcctctc

SEQ ID NO: 3641828 - DNA, 21 bp, Homo sapiens
tccctttctctctcctctctg

SEQ ID NO: 3641829 - DNA, 20 bp, Homo sapiens
tccctttttcataaattatt

SEQ ID NO: 3641830 - DNA, 19 bp, Homo sapiens
tccgactgcccctgctgtg

SEQ ID NO: 3641831 - DNA, 14 bp, Homo sapiens
tccgagctctggtg

SEQ ID NO: 3641832 - DNA, 22 bp, Homo sapiens
tccgaggggtggaatgccgctg

SEQ ID NO: 3641833 - DNA, 23 bp, Homo sapiens
tccgagtgtgatttgaattctgt

SEQ ID NO: 3641834 - DNA, 11 bp, Homo sapiens
tccgcagggcg

SEQ ID NO: 3641835 - DNA, 17 bp, Homo sapiens
tccgcagggcgcccagc

SEQ ID NO: 3641836 - DNA, 16 bp, Homo sapiens
tccgcagttgtagcag

SEQ ID NO: 3641837 - DNA, 19 bp, Homo sapiens
tccgccttaccaggagaag

SEQ ID NO: 3641838 - DNA, 14 bp, Homo sapiens
tccggagcgccctg

SEQ ID NO: 3641839 - DNA, 19 bp, Homo sapiens
tccggagcgccctgcaggg

SEQ ID NO: 3641840 - DNA, 22 bp, Homo sapiens
tccggagcgccctgcagggccg

SEQ ID NO: 3641841 - DNA, 21 bp, Homo sapiens
tccggccaaggtgccaccacc

SEQ ID NO: 3641842 - DNA, 20 bp, Homo sapiens
tccggcggccccgccgcaga

SEQ ID NO: 3641843 - DNA, 23 bp, Homo sapiens
tccgggagggtgcggctgtgcag

SEQ ID NO: 3641844 - DNA, 19 bp, Homo sapiens
tccgggcaccaggggccaa

SEQ ID NO: 3641845 - DNA, 18 bp, Homo sapiens
tccgggcgtgtgaagaac

SEQ ID NO: 3641846 - DNA, 15 bp, Homo sapiens
tccggggagaaaccc

SEQ ID NO: 3641847 - DNA, 14 bp, Homo sapiens
tccggtttgccatg

SEQ ID NO: 3641848 - DNA, 15 bp, Homo sapiens
tccgtagctctgctg

SEQ ID NO: 3641849 - DNA, 17 bp, Homo sapiens
tccgtagctctgctgct

SEQ ID NO: 3641850 - DNA, 17 bp, Homo sapiens
tccgtagggtctttctt

SEQ ID NO: 3641851 - DNA, 14 bp, Homo sapiens
tccgtcactacctg

SEQ ID NO: 3641852 - DNA, 20 bp, Homo sapiens
tccgtccatccgactgcccc

SEQ ID NO: 3641853 - DNA, 22 bp, Homo sapiens
tccgtgaaaatatgtttggaat

SEQ ID NO: 3641854 - DNA, 21 bp, Homo sapiens
tccgtgcttaaccaaagaagc

SEQ ID NO: 3641855 - DNA, 20 bp, Homo sapiens
tccgtggccccgccctcagg

SEQ ID NO: 3641856 - DNA, 22 bp, Homo sapiens
tccgtgtttctctaaggaatta

SEQ ID NO: 3641857 - DNA, 23 bp, Homo sapiens
tccgtgtttctctaaggaattat

SEQ ID NO: 3641858 - DNA, 17 bp, Homo sapiens
tcctaaatgtcagctgt

SEQ ID NO: 3641859 - DNA, 14 bp, Homo sapiens
tcctaattgtgccc

SEQ ID NO: 3641860 - DNA, 15 bp, Homo sapiens
tcctacccatccccg

SEQ ID NO: 3641861 - DNA, 21 bp, Homo sapiens
tcctacctcagcctcctgggt

SEQ ID NO: 3641862 - DNA, 16 bp, Homo sapiens
tcctacctgtctgctg

SEQ ID NO: 3641863 - DNA, 17 bp, Homo sapiens
tcctactcctcatagca

SEQ ID NO: 3641864 - DNA, 16 bp, Homo sapiens
tcctagacttgaaagt

SEQ ID NO: 3641865 - DNA, 18 bp, Homo sapiens
tcctagacttgaaagttt

SEQ ID NO: 3641866 - DNA, 21 bp, Homo sapiens
tcctagagggaggggcctagg

SEQ ID NO: 3641867 - DNA, 20 bp, Homo sapiens
tcctaggctccaccccatcc

SEQ ID NO: 3641868 - DNA, 23 bp, Homo sapiens
tcctagtgaaagaggcagcttga

SEQ ID NO: 3641869 - DNA, 13 bp, Homo sapiens
tcctagttttctc

SEQ ID NO: 3641870 - DNA, 22 bp, Homo sapiens
tcctataaagggcccacacctg

SEQ ID NO: 3641871 - DNA, 14 bp, Homo sapiens
tcctataaagtgcc

SEQ ID NO: 3641872 - DNA, 19 bp, Homo sapiens
tcctataaagtgcctcgga

SEQ ID NO: 3641873 - DNA, 22 bp, Homo sapiens
tcctataaagtgcctcggacag

SEQ ID NO: 3641874 - DNA, 14 bp, Homo sapiens
tcctatctccctgg

SEQ ID NO: 3641875 - DNA, 15 bp, Homo sapiens
tcctatctccctggc

SEQ ID NO: 3641876 - DNA, 13 bp, Homo sapiens
tcctatgatggat

SEQ ID NO: 3641877 - DNA, 20 bp, Homo sapiens
tcctatgatggatggcagac

SEQ ID NO: 3641878 - DNA, 17 bp, Homo sapiens
tcctatgtatatcttct

SEQ ID NO: 3641879 - DNA, 20 bp, Homo sapiens
tcctattctgatgaatctca

SEQ ID NO: 3641880 - DNA, 16 bp, Homo sapiens
tcctatttatttgagg

SEQ ID NO: 3641881 - DNA, 14 bp, Homo sapiens
tcctcacacccctg

SEQ ID NO: 3641882 - DNA, 17 bp, Homo sapiens
tcctcacacccctgtcc

SEQ ID NO: 3641883 - DNA, 13 bp, Homo sapiens
tcctcacccacct

SEQ ID NO: 3641884 - DNA, 16 bp, Homo sapiens
tcctcacccacctctg

SEQ ID NO: 3641885 - DNA, 17 bp, Homo sapiens
tcctcacccacctctgg

SEQ ID NO: 3641886 - DNA, 14 bp, Homo sapiens
tcctcactctgtcc

SEQ ID NO: 3641887 - DNA, 21 bp, Homo sapiens
tcctcactctgtccctgtcct

SEQ ID NO: 3641888 - DNA, 15 bp, Homo sapiens
tcctcagctgcctcc

SEQ ID NO: 3641889 - DNA, 12 bp, Homo sapiens
tcctcaggacca

SEQ ID NO: 3641890 - DNA, 12 bp, Homo sapiens
tcctcagtgatg

SEQ ID NO: 3641891 - DNA, 15 bp, Homo sapiens
tcctcagtgatggaa

SEQ ID NO: 3641892 - DNA, 20 bp, Homo sapiens
tctagcctctggactggaaa

SEQ ID NO: 3641893 - DNA, 23 bp, Homo sapiens
tctaggaggagctagtaggaatg

SEQ ID NO: 3641894 - DNA, 18 bp, Homo sapiens
tctaggcactgagcaggg

SEQ ID NO: 3641895 - DNA, 18 bp, Homo sapiens
tctaggcatacttttcaa

SEQ ID NO: 3641896 - DNA, 19 bp, Homo sapiens
tctaggccctgtgagcaca

SEQ ID NO: 3641897 - DNA, 18 bp, Homo sapiens
tctagggttattgcattt

SEQ ID NO: 3641898 - DNA, 23 bp, Homo sapiens
tctagtcatttgttaatatttct

SEQ ID NO: 3641899 - DNA, 14 bp, Homo sapiens
tctagttcaatgcc

SEQ ID NO: 3641900 - DNA, 16 bp, Homo sapiens
tctagttctttcctcc

SEQ ID NO: 3641901 - DNA, 20 bp, Homo sapiens
tctagttgcccccattccca

SEQ ID NO: 3641902 - DNA, 13 bp, Homo sapiens
tctagtttctctt

SEQ ID NO: 3641903 - DNA, 19 bp, Homo sapiens
tctagtttctcttagaaaa

SEQ ID NO: 3641904 - DNA, 20 bp, Homo sapiens
tctagttttttcttcctttt

SEQ ID NO: 3641905 - DNA, 22 bp, Homo sapiens
tctagttttttcttccttttca

SEQ ID NO: 3641906 - DNA, 19 bp, Homo sapiens
tctataacagatcctttca

SEQ ID NO: 3641907 - DNA, 17 bp, Homo sapiens
tctatactgtggcctgc

SEQ ID NO: 3641908 - DNA, 17 bp, Homo sapiens
tctatataaaatgtatt

SEQ ID NO: 3641909 - DNA, 14 bp, Homo sapiens
tctatattcctcca

SEQ ID NO: 3641910 - DNA, 16 bp, Homo sapiens
tctatattcctccagc

SEQ ID NO: 3641911 - DNA, 18 bp, Homo sapiens
tctatattcctccagctg

SEQ ID NO: 3641912 - DNA, 13 bp, Homo sapiens
tctatgcctgtct

SEQ ID NO: 3641913 - DNA, 13 bp, Homo sapiens
tctatgtatcaaa

SEQ ID NO: 3641914 - DNA, 14 bp, Homo sapiens
tctatgttaatatt

SEQ ID NO: 3641915 - DNA, 23 bp, Homo sapiens
tctattaatcaagagaaacttca

SEQ ID NO: 3641916 - DNA, 21 bp, Homo sapiens
tctattctccagacatggagg

SEQ ID NO: 3641917 - DNA, 13 bp, Homo sapiens
tctattctgtcag

SEQ ID NO: 3641918 - DNA, 17 bp, Homo sapiens
tctattgtttgttgcac

SEQ ID NO: 3641919 - DNA, 13 bp, Homo sapiens
tctatttatttat

SEQ ID NO: 3641920 - DNA, 13 bp, Homo sapiens
tctatttcactta

SEQ ID NO: 3641921 - DNA, 17 bp, Homo sapiens
tctattttaattactgc

SEQ ID NO: 3641922 - DNA, 13 bp, Homo sapiens
tctattttacaac

SEQ ID NO: 3641923 - DNA, 16 bp, Homo sapiens
tctatttttctcttca

SEQ ID NO: 3641924 - DNA, 20 bp, Homo sapiens
tctattttttgaaaagcaga

SEQ ID NO: 3641925 - DNA, 20 bp, Homo sapiens
tctcaaaaaaaagaaaatgt

SEQ ID NO: 3641926 - DNA, 22 bp, Homo sapiens
tctcaaaaaaaagaaaatgtct

SEQ ID NO: 3641927 - DNA, 14 bp, Homo sapiens
tctcaaagttttat

SEQ ID NO: 3641928 - DNA, 17 bp, Homo sapiens
tctcaagagggcactgg

SEQ ID NO: 3641929 - DNA, 19 bp, Homo sapiens
tctcaagagggcactggtg

SEQ ID NO: 3641930 - DNA, 14 bp, Homo sapiens
tctcaagtaaaaca

SEQ ID NO: 3641931 - DNA, 18 bp, Homo sapiens
tctcaagtaaaacaaatg

SEQ ID NO: 3641932 - DNA, 20 bp, Homo sapiens
tctcaagtaaaacaaatgaa

SEQ ID NO: 3641933 - DNA, 19 bp, Homo sapiens
tctcacaggctgagaactc

SEQ ID NO: 3641934 - DNA, 13 bp, Homo sapiens
tctcacctggact

SEQ ID NO: 3641935 - DNA, 16 bp, Homo sapiens
tctcactcctacctgg

SEQ ID NO: 3641936 - DNA, 17 bp, Homo sapiens
tctcactcctacctggt

SEQ ID NO: 3641937 - DNA, 18 bp, Homo sapiens
tctcactcctacctggta

SEQ ID NO: 3641938 - DNA, 15 bp, Homo sapiens
tctcacttagtcctt

SEQ ID NO: 3641939 - DNA, 15 bp, Homo sapiens
tctcagatgcagttt

SEQ ID NO: 3641940 - DNA, 19 bp, Homo sapiens
tctcagccataggtgcagt

SEQ ID NO: 3641941 - DNA, 20 bp, Homo sapiens
tctcagccataggtgcagtt

SEQ ID NO: 3641942 - DNA, 19 bp, Homo sapiens
tctcagcctctgccagcgc

SEQ ID NO: 3641943 - DNA, 16 bp, Homo sapiens
tctcagctgtgccttc

SEQ ID NO: 3641944 - DNA, 14 bp, Homo sapiens
tctcaggaaatcaa

SEQ ID NO: 3641945 - DNA, 15 bp, Homo sapiens
tctcaggagatggag

SEQ ID NO: 3641946 - DNA, 19 bp, Homo sapiens
tctcaggaggggcagcgca

SEQ ID NO: 3641947 - DNA, 11 bp, Homo sapiens
tctcagggctg

SEQ ID NO: 3641948 - DNA, 20 bp, Homo sapiens
tctcagggctggagcctggg

SEQ ID NO: 3641949 - DNA, 22 bp, Homo sapiens
tctcagggctggagcctggggt

SEQ ID NO: 3641950 - DNA, 15 bp, Homo sapiens
tctcaggtccctgca

SEQ ID NO: 3641951 - DNA, 20 bp, Homo sapiens
tctcagtaccccatggagct

SEQ ID NO: 3641952 - DNA, 12 bp, Homo sapiens
tctcataagcac

SEQ ID NO: 3641953 - DNA, 15 bp, Homo sapiens
tctcataattttgca

SEQ ID NO: 3641954 - DNA, 17 bp, Homo sapiens
tctcataattttgcaaa

SEQ ID NO: 3641955 - DNA, 18 bp, Homo sapiens
tctcatccccaaactgta

SEQ ID NO: 3641956 - DNA, 17 bp, Homo sapiens
tctcatgggtggcactc

SEQ ID NO: 3641957 - DNA, 16 bp, Homo sapiens
tctcattcatccttat

SEQ ID NO: 3641958 - DNA, 16 bp, Homo sapiens
tctcattccagaggaa

SEQ ID NO: 3641959 - DNA, 22 bp, Homo sapiens
tctccacacacagctgggctgt

SEQ ID NO: 3641960 - DNA, 13 bp, Homo sapiens
tctccactccaga

SEQ ID NO: 3641961 - DNA, 13 bp, Homo sapiens
tctccactggacc

SEQ ID NO: 3641962 - DNA, 15 bp, Homo sapiens
tctccactggaccct

SEQ ID NO: 3641963 - DNA, 11 bp, Homo sapiens
tctccagcagg

SEQ ID NO: 3641964 - DNA, 14 bp, Homo sapiens
tctccagctgacta

SEQ ID NO: 3641965 - DNA, 17 bp, Homo sapiens
tctccagctgcctgggc

SEQ ID NO: 3641966 - DNA, 19 bp, Homo sapiens
tctccagctgcctgggccc

SEQ ID NO: 3641967 - DNA, 13 bp, Homo sapiens
tctccaggcctgt

SEQ ID NO: 3641968 - DNA, 15 bp, Homo sapiens
tctccaggcctgtca

SEQ ID NO: 3641969 - DNA, 18 bp, Homo sapiens
tctccagggcccccaccg

SEQ ID NO: 3641970 - DNA, 15 bp, Homo sapiens
tctccaggtcagcct

SEQ ID NO: 3641971 - DNA, 16 bp, Homo sapiens
tctccaggtcagcctg

SEQ ID NO: 3641972 - DNA, 17 bp, Homo sapiens
tctccaggtcagcctgg

SEQ ID NO: 3641973 - DNA, 14 bp, Homo sapiens
tctccagtgaaatg

SEQ ID NO: 3641974 - DNA, 19 bp, Homo sapiens
tctccatacctgcccctgc

SEQ ID NO: 3641975 - DNA, 12 bp, Homo sapiens
tctccatcccct

SEQ ID NO: 3641976 - DNA, 13 bp, Homo sapiens
tctccatcccctc

SEQ ID NO: 3641977 - DNA, 23 bp, Homo sapiens
tctccatcccctccctgcctgct

SEQ ID NO: 3641978 - DNA, 16 bp, Homo sapiens
tctccatggagcctac

SEQ ID NO: 3641979 - DNA, 14 bp, Homo sapiens
tctcccaagaaacc

SEQ ID NO: 3641980 - DNA, 14 bp, Homo sapiens
tctcccacatgagg

SEQ ID NO: 3641981 - DNA, 17 bp, Homo sapiens
tctcccattgtccctct

SEQ ID NO: 3641982 - DNA, 19 bp, Homo sapiens
tctcccattgtccctctgc

SEQ ID NO: 3641983 - DNA, 18 bp, Homo sapiens
tctccccatatataaatt

SEQ ID NO: 3641984 - DNA, 13 bp, Homo sapiens
tctcccccactcc

SEQ ID NO: 3641985 - DNA, 16 bp, Homo sapiens
tctcccccactccact

SEQ ID NO: 3641986 - DNA, 15 bp, Homo sapiens
tctccccgctcaggg

SEQ ID NO: 3641987 - DNA, 22 bp, Homo sapiens
tctccccgctcaggggcctgga

SEQ ID NO: 3641988 - DNA, 18 bp, Homo sapiens
tctcccctcagagtgcaa

SEQ ID NO: 3641989 - DNA, 14 bp, Homo sapiens
tctcccctctcgcc

SEQ ID NO: 3641990 - DNA, 17 bp, Homo sapiens
tctccccttctctgcct

SEQ ID NO: 3641991 - DNA, 17 bp, Homo sapiens
tctccgaaatgctgtct

SEQ ID NO: 3641992 - DNA, 20 bp, Homo sapiens
tctccgaaatgctgtctttc

SEQ ID NO: 3641993 - DNA, 14 bp, Homo sapiens
tctccgagctctgg

SEQ ID NO: 3641994 - DNA, 13 bp, Homo sapiens
tctccgcgcctac

SEQ ID NO: 3641995 - DNA, 14 bp, Homo sapiens
tctcctaaagcttt

SEQ ID NO: 3641996 - DNA, 17 bp, Homo sapiens
tctcctcactctgtccc

SEQ ID NO: 3641997 - DNA, 15 bp, Homo sapiens
tctcctcactgtatc

SEQ ID NO: 3641998 - DNA, 13 bp, Homo sapiens
tctcctcagcctc

SEQ ID NO: 3641999 - DNA, 14 bp, Homo sapiens
tctcctcccctact

SEQ ID NO: 3642000 - DNA, 19 bp, Homo sapiens
tctcctcccgccccgcccc

SEQ ID NO: 3642001 - DNA, 22 bp, Homo sapiens
tctcctcccgcccttccatgtg

SEQ ID NO: 3642002 - DNA, 17 bp, Homo sapiens
tctcctcctctgtcttt

SEQ ID NO: 3642003 - DNA, 18 bp, Homo sapiens
tctcctctctgcttcata

SEQ ID NO: 3642004 - DNA, 17 bp, Homo sapiens
tctcctcttgccactgc

SEQ ID NO: 3642005 - DNA, 17 bp, Homo sapiens
tctcctgacccctgcct

SEQ ID NO: 3642006 - DNA, 12 bp, Homo sapiens
tctcctgccctg

SEQ ID NO: 3642007 - DNA, 19 bp, Homo sapiens
tctccttaagagacaattt

SEQ ID NO: 3642008 - DNA, 13 bp, Homo sapiens
tctccttcagcac

SEQ ID NO: 3642009 - DNA, 14 bp, Homo sapiens
tctccttcagcacg

SEQ ID NO: 3642010 - DNA, 17 bp, Homo sapiens
tctccttttcctatcct

SEQ ID NO: 3642011 - DNA, 14 bp, Homo sapiens
tctcgaactcctga

SEQ ID NO: 3642012 - DNA, 15 bp, Homo sapiens
tctcgaactcctgac

SEQ ID NO: 3642013 - DNA, 17 bp, Homo sapiens
tctcgctctgttgccca

SEQ ID NO: 3642014 - DNA, 18 bp, Homo sapiens
tctcggatgacaccctgg

SEQ ID NO: 3642015 - DNA, 22 bp, Homo sapiens
tctcggatgacaccctggcctg

SEQ ID NO: 3642016 - DNA, 15 bp, Homo sapiens
tctcggctctgcatg

SEQ ID NO: 3642017 - DNA, 20 bp, Homo sapiens
tctcggctctgcatgttttc

SEQ ID NO: 3642018 - DNA, 15 bp, Homo sapiens
tctcggctgccaggg

SEQ ID NO: 3642019 - DNA, 18 bp, Homo sapiens
tctcggctgccaggggct

SEQ ID NO: 3642020 - DNA, 16 bp, Homo sapiens
tctctaatgtctgcag

SEQ ID NO: 3642021 - DNA, 18 bp, Homo sapiens
tctctagtagtgtggcct

SEQ ID NO: 3642022 - DNA, 17 bp, Homo sapiens
tctctagtcatttgtta

SEQ ID NO: 3642023 - DNA, 21 bp, Homo sapiens
tctctatcagaaatacaaaaa

SEQ ID NO: 3642024 - DNA, 15 bp, Homo sapiens
tctctccagctgact

SEQ ID NO: 3642025 - DNA, 18 bp, Homo sapiens
tctctccagctgactaaa

SEQ ID NO: 3642026 - DNA, 16 bp, Homo sapiens
tgaaaagactccaaag

SEQ ID NO: 3642027 - DNA, 13 bp, Homo sapiens
tgaaaagatgtac

SEQ ID NO: 3642028 - DNA, 18 bp, Homo sapiens
tgaaaagtaattgaaaaa

SEQ ID NO: 3642029 - DNA, 21 bp, Homo sapiens
tgaaaagttatttatgctata

SEQ ID NO: 3642030 - DNA, 15 bp, Homo sapiens
tgaaaataactgaac

SEQ ID NO: 3642031 - DNA, 19 bp, Homo sapiens
tgaaaataactgaaccaaa

SEQ ID NO: 3642032 - DNA, 21 bp, Homo sapiens
tgaaaatatttgtatcacaaa

SEQ ID NO: 3642033 - DNA, 22 bp, Homo sapiens
tgaaaatatttgtatcacaaat

SEQ ID NO: 3642034 - DNA, 11 bp, Homo sapiens
tgaaaatgaag

SEQ ID NO: 3642035 - DNA, 17 bp, Homo sapiens
tgaaaattacatgtttt

SEQ ID NO: 3642036 - DNA, 23 bp, Homo sapiens
tgaaaattacatgttttttcatt

SEQ ID NO: 3642037 - DNA, 16 bp, Homo sapiens
tgaaaattcaggtgct

SEQ ID NO: 3642038 - DNA, 13 bp, Homo sapiens
tgaaaatttaaca

SEQ ID NO: 3642039 - DNA, 16 bp, Homo sapiens
tgaaacaacttggaaa

SEQ ID NO: 3642040 - DNA, 14 bp, Homo sapiens
tgaaacaatcttcc

SEQ ID NO: 3642041 - DNA, 22 bp, Homo sapiens
tgaaacagaaaaataagtcaaa

SEQ ID NO: 3642042 - DNA, 14 bp, Homo sapiens
tgaaacagacttgt

SEQ ID NO: 3642043 - DNA, 21 bp, Homo sapiens
tgaaacatcctatgaaatact

SEQ ID NO: 3642044 - DNA, 20 bp, Homo sapiens
tgaaacccctgtaggcctca

SEQ ID NO: 3642045 - DNA, 17 bp, Homo sapiens
tgaaactccagatgcca

SEQ ID NO: 3642046 - DNA, 16 bp, Homo sapiens
tgaaactggcttcccc

SEQ ID NO: 3642047 - DNA, 13 bp, Homo sapiens
tgaaagaagcaag

SEQ ID NO: 3642048 - DNA, 15 bp, Homo sapiens
tgaaagaagcaagac

SEQ ID NO: 3642049 - DNA, 16 bp, Homo sapiens
tgaaagaagcaagaca

SEQ ID NO: 3642050 - DNA, 19 bp, Homo sapiens
tgaaagactcgagaaccaa

SEQ ID NO: 3642051 - DNA, 18 bp, Homo sapiens
tgaaagatggctgtgcct

SEQ ID NO: 3642052 - DNA, 19 bp, Homo sapiens
tgaaagatggctgtgcctc

SEQ ID NO: 3642053 - DNA, 19 bp, Homo sapiens
tgaaagcgacttcaggtca

SEQ ID NO: 3642054 - DNA, 16 bp, Homo sapiens
tgaaaggccagcagct

SEQ ID NO: 3642055 - DNA, 21 bp, Homo sapiens
tgaaagggtttgatatggaga

SEQ ID NO: 3642056 - DNA, 17 bp, Homo sapiens
tgaaagtatgttttact

SEQ ID NO: 3642057 - DNA, 16 bp, Homo sapiens
tgaaagtccagaaact

SEQ ID NO: 3642058 - DNA, 14 bp, Homo sapiens
tgaaagttttccag

SEQ ID NO: 3642059 - DNA, 15 bp, Homo sapiens
tgaaagttttccagt

SEQ ID NO: 3642060 - DNA, 17 bp, Homo sapiens
tgaaagttttccagtat

SEQ ID NO: 3642061 - DNA, 18 bp, Homo sapiens
tgaaagttttccagtatt

SEQ ID NO: 3642062 - DNA, 19 bp, Homo sapiens
tgaaagttttccagtattg

SEQ ID NO: 3642063 - DNA, 17 bp, Homo sapiens
tgaaataaaactggctt

SEQ ID NO: 3642064 - DNA, 19 bp, Homo sapiens
tgaaataaaactggctttg

SEQ ID NO: 3642065 - DNA, 14 bp, Homo sapiens
tgaaataaaatata

SEQ ID NO: 3642066 - DNA, 11 bp, Homo sapiens
tgaaatacctt

SEQ ID NO: 3642067 - DNA, 18 bp, Homo sapiens
tgaaatacctttgtagtt

SEQ ID NO: 3642068 - DNA, 18 bp, Homo sapiens
tgaaatatattttctctt

SEQ ID NO: 3642069 - DNA, 14 bp, Homo sapiens
tgaaatatccagga

SEQ ID NO: 3642070 - DNA, 12 bp, Homo sapiens
tgaaatccctgc

SEQ ID NO: 3642071 - DNA, 18 bp, Homo sapiens
tgaaatgaggtctgttta

SEQ ID NO: 3642072 - DNA, 13 bp, Homo sapiens
tgaaatgcatatt

SEQ ID NO: 3642073 - DNA, 20 bp, Homo sapiens
tgaaatgccctcctaaatgt

SEQ ID NO: 3642074 - DNA, 22 bp, Homo sapiens
tgaaatgccctcctaaatgtca

SEQ ID NO: 3642075 - DNA, 17 bp, Homo sapiens
tgaaatgctgttagtaa

SEQ ID NO: 3642076 - DNA, 21 bp, Homo sapiens
tgaaattataactattacagt

SEQ ID NO: 3642077 - DNA, 15 bp, Homo sapiens
tgaaatttaattaca

SEQ ID NO: 3642078 - DNA, 19 bp, Homo sapiens
tgaaatttaattacaaaca

SEQ ID NO: 3642079 - DNA, 23 bp, Homo sapiens
tgaaatttacctttttttagtta

SEQ ID NO: 3642080 - DNA, 12 bp, Homo sapiens
tgaaatttcaga

SEQ ID NO: 3642081 - DNA, 18 bp, Homo sapiens
tgaaatttgataaactga

SEQ ID NO: 3642082 - DNA, 20 bp, Homo sapiens
tgaaatttgttatacttcaa

SEQ ID NO: 3642083 - DNA, 23 bp, Homo sapiens
tgaaattttgattaaccttttca

SEQ ID NO: 3642084 - DNA, 23 bp, Homo sapiens
tgaaattttttttcatgctttat

SEQ ID NO: 3642085 - DNA, 11 bp, Homo sapiens
tgaacaagaat

SEQ ID NO: 3642086 - DNA, 23 bp, Homo sapiens
tgaacaagatgtgggccttgcaa

SEQ ID NO: 3642087 - DNA, 19 bp, Homo sapiens
tgaacccaggaggtggagg

SEQ ID NO: 3642088 - DNA, 14 bp, Homo sapiens
tgaaccctccaaag

SEQ ID NO: 3642089 - DNA, 17 bp, Homo sapiens
tgaacctgggaggcaga

SEQ ID NO: 3642090 - DNA, 13 bp, Homo sapiens
tgaacgagcagcc

SEQ ID NO: 3642091 - DNA, 15 bp, Homo sapiens
tgaacgagcagccca

SEQ ID NO: 3642092 - DNA, 17 bp, Homo sapiens
tgaacgagcagcccagg

SEQ ID NO: 3642093 - DNA, 17 bp, Homo sapiens
tgaacgccctggtaagg

SEQ ID NO: 3642094 - DNA, 14 bp, Homo sapiens
tgaacgtggattgt

SEQ ID NO: 3642095 - DNA, 16 bp, Homo sapiens
tgaacgttttaataat

SEQ ID NO: 3642096 - DNA, 17 bp, Homo sapiens
tgaacgttttaataatt

SEQ ID NO: 3642097 - DNA, 15 bp, Homo sapiens
tgaactcaccctggg

SEQ ID NO: 3642098 - DNA, 13 bp, Homo sapiens
tgaactccaggca

SEQ ID NO: 3642099 - DNA, 15 bp, Homo sapiens
tgaactccaggcatg

SEQ ID NO: 3642100 - DNA, 13 bp, Homo sapiens
tgaactctggtgc

SEQ ID NO: 3642101 - DNA, 20 bp, Homo sapiens
tgaactctggtgctcctgca

SEQ ID NO: 3642102 - DNA, 23 bp, Homo sapiens
tgaactgaggagatgaccaggga

SEQ ID NO: 3642103 - DNA, 16 bp, Homo sapiens
tgaacttccaggaaag

SEQ ID NO: 3642104 - DNA, 19 bp, Homo sapiens
tgaactttcagcagtctaa

SEQ ID NO: 3642105 - DNA, 21 bp, Homo sapiens
tgaagaaacagagtggcctcc

SEQ ID NO: 3642106 - DNA, 21 bp, Homo sapiens
tgaagaacaggcttggcaaag

SEQ ID NO: 3642107 - DNA, 23 bp, Homo sapiens
tgaagaaggaagctgtgttgaaa

SEQ ID NO: 3642108 - DNA, 13 bp, Homo sapiens
tgaagaaggcaag

SEQ ID NO: 3642109 - DNA, 18 bp, Homo sapiens
tgaagaatgcattcaaaa

SEQ ID NO: 3642110 - DNA, 23 bp, Homo sapiens
tgaagaatgttagagtaatgaaa

SEQ ID NO: 3642111 - DNA, 19 bp, Homo sapiens
tgaagacagaggcagagat

SEQ ID NO: 3642112 - DNA, 16 bp, Homo sapiens
tgaagacccaaaacag

SEQ ID NO: 3642113 - DNA, 20 bp, Homo sapiens
tgaagacccaaaacagcttt

SEQ ID NO: 3642114 - DNA, 20 bp, Homo sapiens
tgaagagaagggcagggctg

SEQ ID NO: 3642115 - DNA, 12 bp, Homo sapiens
tgaagagaggga

SEQ ID NO: 3642116 - DNA, 22 bp, Homo sapiens
tgaagagagggacaggcactcc

SEQ ID NO: 3642117 - DNA, 21 bp, Homo sapiens
tgaagattctatgttaatatt

SEQ ID NO: 3642118 - DNA, 11 bp, Homo sapiens
tgaagattctt

SEQ ID NO: 3642119 - DNA, 22 bp, Homo sapiens
tgaagattcttaaaaattgaat

SEQ ID NO: 3642120 - DNA, 11 bp, Homo sapiens
tgaagcaactg

SEQ ID NO: 3642121 - DNA, 16 bp, Homo sapiens
tgaagcaactgtgaat

SEQ ID NO: 3642122 - DNA, 14 bp, Homo sapiens
tgaagcatgaacgt

SEQ ID NO: 3642123 - DNA, 15 bp, Homo sapiens
tgaagcctctctcct

SEQ ID NO: 3642124 - DNA, 13 bp, Homo sapiens
tgaagcctttctt

SEQ ID NO: 3642125 - DNA, 18 bp, Homo sapiens
tgaagcctttcttttgga

SEQ ID NO: 3642126 - DNA, 16 bp, Homo sapiens
tgaagctgctgcagct

SEQ ID NO: 3642127 - DNA, 14 bp, Homo sapiens
tgaagctgctgtgt

SEQ ID NO: 3642128 - DNA, 17 bp, Homo sapiens
tgaaggagaatggcatg

SEQ ID NO: 3642129 - DNA, 18 bp, Homo sapiens
tgaagggccagagccagg

SEQ ID NO: 3642130 - DNA, 18 bp, Homo sapiens
tgaaggtagaatgttttc

SEQ ID NO: 3642131 - DNA, 22 bp, Homo sapiens
tgaaggtctgtcataggactct

SEQ ID NO: 3642132 - DNA, 19 bp, Homo sapiens
tgaaggtgctgacggccag

SEQ ID NO: 3642133 - DNA, 15 bp, Homo sapiens
tgaagtcactgcaca

SEQ ID NO: 3642134 - DNA, 16 bp, Homo sapiens
tgaagtcactgcacag

SEQ ID NO: 3642135 - DNA, 21 bp, Homo sapiens
tgaagtcactgcacagtgcat

SEQ ID NO: 3642136 - DNA, 22 bp, Homo sapiens
tgaagtccttcagtgagcccct

SEQ ID NO: 3642137 - DNA, 21 bp, Homo sapiens
tgaagtctgagcccatttctg

SEQ ID NO: 3642138 - DNA, 13 bp, Homo sapiens
tgaagtgcagctc

SEQ ID NO: 3642139 - DNA, 18 bp, Homo sapiens
tgaagtgcagctcatgtt

SEQ ID NO: 3642140 - DNA, 22 bp, Homo sapiens
tgaagtgctgtttattaatctt

SEQ ID NO: 3642141 - DNA, 19 bp, Homo sapiens
tgaagtttttgaaatacct

SEQ ID NO: 3642142 - DNA, 19 bp, Homo sapiens
tgaataaaacactcatccc

SEQ ID NO: 3642143 - DNA, 14 bp, Homo sapiens
tgaataaagacacc

SEQ ID NO: 3642144 - DNA, 15 bp, Homo sapiens
tgaataaagacacct

SEQ ID NO: 3642145 - DNA, 13 bp, Homo sapiens
tgaataaatgtca

SEQ ID NO: 3642146 - DNA, 15 bp, Homo sapiens
tgaataaatgtcact

SEQ ID NO: 3642147 - DNA, 13 bp, Homo sapiens
tgaataacttgaa

SEQ ID NO: 3642148 - DNA, 18 bp, Homo sapiens
tgaatattgccattatgc

SEQ ID NO: 3642149 - DNA, 18 bp, Homo sapiens
tgaatatttgttttaata

SEQ ID NO: 3642150 - DNA, 19 bp, Homo sapiens
tgaatatttgttttaatac

SEQ ID NO: 3642151 - DNA, 20 bp, Homo sapiens
tgaatattttatctttcctt

SEQ ID NO: 3642152 - DNA, 18 bp, Homo sapiens
tgaatatttttgtatttt

SEQ ID NO: 3642153 - DNA, 22 bp, Homo sapiens
tgaatatttttgtattttacat

SEQ ID NO: 3642154 - DNA, 21 bp, Homo sapiens
tgaatcagaacagatgctgag

SEQ ID NO: 3642155 - DNA, 17 bp, Homo sapiens
tgaatcagctggacata

SEQ ID NO: 3642156 - DNA, 17 bp, Homo sapiens
tgaatccgtacttgggt

SEQ ID NO: 3642157 - DNA, 14 bp, Homo sapiens
tgaatctgtctatc

SEQ ID NO: 3642158 - DNA, 20 bp, Homo sapiens
tgcccaacccttccctcacc

SEQ ID NO: 3642159 - DNA, 23 bp, Homo sapiens
tgcccaacctgctctcctcttgc

SEQ ID NO: 3642160 - DNA, 24 bp, Homo sapiens
tgcccaacctgctctcctcttgcc

SEQ ID NO: 3642161 - DNA, 12 bp, Homo sapiens
tgcccacccctc

SEQ ID NO: 3642162 - DNA, 13 bp, Homo sapiens
tgcccacccctca

SEQ ID NO: 3642163 - DNA, 14 bp, Homo sapiens
tgcccacctggctg

SEQ ID NO: 3642164 - DNA, 16 bp, Homo sapiens
tgcccacctggctgcc

SEQ ID NO: 3642165 - DNA, 15 bp, Homo sapiens
tgcccaggcctgcct

SEQ ID NO: 3642166 - DNA, 15 bp, Homo sapiens
tgcccaggggagccc

SEQ ID NO: 3642167 - DNA, 18 bp, Homo sapiens
tgcccagtaaaatttcag

SEQ ID NO: 3642168 - DNA, 22 bp, Homo sapiens
tgcccagtaaaatttcaggatt

SEQ ID NO: 3642169 - DNA, 23 bp, Homo sapiens
tgcccagtaaaatttcaggatta

SEQ ID NO: 3642170 - DNA, 19 bp, Homo sapiens
tgcccatgtgtacattctg

SEQ ID NO: 3642171 - DNA, 21 bp, Homo sapiens
tgcccatgtgtacattctgcc

SEQ ID NO: 3642172 - DNA, 16 bp, Homo sapiens
tgccccaaactttctc

SEQ ID NO: 3642173 - DNA, 14 bp, Homo sapiens
tgccccaagtggtg

SEQ ID NO: 3642174 - DNA, 13 bp, Homo sapiens
tgccccaccactc

SEQ ID NO: 3642175 - DNA, 17 bp, Homo sapiens
tgccccaccactcccca

SEQ ID NO: 3642176 - DNA, 19 bp, Homo sapiens
tgccccaccactccccaac

SEQ ID NO: 3642177 - DNA, 12 bp, Homo sapiens
tgccccacccca

SEQ ID NO: 3642178 - DNA, 16 bp, Homo sapiens
tgccccaccccacctc

SEQ ID NO: 3642179 - DNA, 13 bp, Homo sapiens
tgccccaccccat

SEQ ID NO: 3642180 - DNA, 21 bp, Homo sapiens
tgccccaccccatccagccag

SEQ ID NO: 3642181 - DNA, 15 bp, Homo sapiens
tgccccacctccccc

SEQ ID NO: 3642182 - DNA, 16 bp, Homo sapiens
tgccccacttctggcc

SEQ ID NO: 3642183 - DNA, 15 bp, Homo sapiens
tgccccagcttgggc

SEQ ID NO: 3642184 - DNA, 13 bp, Homo sapiens
tgccccaggacca

SEQ ID NO: 3642185 - DNA, 14 bp, Homo sapiens
tgccccaggaccag

SEQ ID NO: 3642186 - DNA, 19 bp, Homo sapiens
tgccccaggaccagctcag

SEQ ID NO: 3642187 - DNA, 20 bp, Homo sapiens
tgccccaggaccagctcagg

SEQ ID NO: 3642188 - DNA, 17 bp, Homo sapiens
tgccccatcctccagca

SEQ ID NO: 3642189 - DNA, 21 bp, Homo sapiens
tgccccatcctccagcaggga

SEQ ID NO: 3642190 - DNA, 18 bp, Homo sapiens
tgcccccagaaagcctcc

SEQ ID NO: 3642191 - DNA, 20 bp, Homo sapiens
tgcccccagaaagcctcctg

SEQ ID NO: 3642192 - DNA, 13 bp, Homo sapiens
tgcccccattccc

SEQ ID NO: 3642193 - DNA, 17 bp, Homo sapiens
tgcccccattcccagcc

SEQ ID NO: 3642194 - DNA, 20 bp, Homo sapiens
tgcccccattcccagcctga

SEQ ID NO: 3642195 - DNA, 23 bp, Homo sapiens
tgccccctccaggagagagccag

SEQ ID NO: 3642196 - DNA, 14 bp, Homo sapiens
tgccccctccccca

SEQ ID NO: 3642197 - DNA, 21 bp, Homo sapiens
tgccccctcccccatgggctg

SEQ ID NO: 3642198 - DNA, 14 bp, Homo sapiens
tgccccctgccagt

SEQ ID NO: 3642199 - DNA, 23 bp, Homo sapiens
tgcccctaaagagcatcctgata

SEQ ID NO: 3642200 - DNA, 23 bp, Homo sapiens
tgcccctaagctggctgtacctg

SEQ ID NO: 3642201 - DNA, 16 bp, Homo sapiens
tgcccctcccttcaac

SEQ ID NO: 3642202 - DNA, 21 bp, Homo sapiens
tgcccctgctgtgctgctcaa

SEQ ID NO: 3642203 - DNA, 15 bp, Homo sapiens
tgcccctggctttgc

SEQ ID NO: 3642204 - DNA, 18 bp, Homo sapiens
tgcccctggctttgcctc

SEQ ID NO: 3642205 - DNA, 20 bp, Homo sapiens
tgcccctggctttgcctctt

SEQ ID NO: 3642206 - DNA, 17 bp, Homo sapiens
tgcccctgtctggaaga

SEQ ID NO: 3642207 - DNA, 21 bp, Homo sapiens
tgccccttaaacacaggctgt

SEQ ID NO: 3642208 - DNA, 15 bp, Homo sapiens
tgcccgactgactgg

SEQ ID NO: 3642209 - DNA, 16 bp, Homo sapiens
tgcccgcatgtgtgcc

SEQ ID NO: 3642210 - DNA, 21 bp, Homo sapiens
tgcccgcatgtgtgcctggcc

SEQ ID NO: 3642211 - DNA, 16 bp, Homo sapiens
tgcccgcccggggagt

SEQ ID NO: 3642212 - DNA, 15 bp, Homo sapiens
tgcccgcgccaggcc

SEQ ID NO: 3642213 - DNA, 21 bp, Homo sapiens
tgcccgcgggagacagcttct

SEQ ID NO: 3642214 - DNA, 23 bp, Homo sapiens
tgcccgctcccacagcttcctga

SEQ ID NO: 3642215 - DNA, 18 bp, Homo sapiens
tgccctaagcccccaggg

SEQ ID NO: 3642216 - DNA, 21 bp, Homo sapiens
tgccctaagcccccagggcct

SEQ ID NO: 3642217 - DNA, 21 bp, Homo sapiens
tgccctcaagtaaaagaaaag

SEQ ID NO: 3642218 - DNA, 14 bp, Homo sapiens
tgccctcctctccc

SEQ ID NO: 3642219 - DNA, 14 bp, Homo sapiens
tgccctctctcggg

SEQ ID NO: 3642220 - DNA, 16 bp, Homo sapiens
tgccctgcccaacctc

SEQ ID NO: 3642221 - DNA, 19 bp, Homo sapiens
tgccctgcggccccgtctg

SEQ ID NO: 3642222 - DNA, 16 bp, Homo sapiens
tgccctggatgcccag

SEQ ID NO: 3642223 - DNA, 18 bp, Homo sapiens
tgccctggatgcccagga

SEQ ID NO: 3642224 - DNA, 12 bp, Homo sapiens
tgccctgggctc

SEQ ID NO: 3642225 - DNA, 17 bp, Homo sapiens
tgccctgggggccgtgc

SEQ ID NO: 3642226 - DNA, 17 bp, Homo sapiens
tgccgaccacgccccag

SEQ ID NO: 3642227 - DNA, 15 bp, Homo sapiens
tgccgctgtctctga

SEQ ID NO: 3642228 - DNA, 16 bp, Homo sapiens
tgccgctttctctgag

SEQ ID NO: 3642229 - DNA, 17 bp, Homo sapiens
tgccgctttctctgagg

SEQ ID NO: 3642230 - DNA, 19 bp, Homo sapiens
tgccgcttttgtgcctctc

SEQ ID NO: 3642231 - DNA, 23 bp, Homo sapiens
tgccgcttttgtgcctctcacag

SEQ ID NO: 3642232 - DNA, 16 bp, Homo sapiens
tgccggctctgggcct

SEQ ID NO: 3642233 - DNA, 20 bp, Homo sapiens
tgccggctctgggcctgagg

SEQ ID NO: 3642234 - DNA, 19 bp, Homo sapiens
tgccggtcgggcagccagc

SEQ ID NO: 3642235 - DNA, 21 bp, Homo sapiens
tgccgtgtcccctgacagggc

SEQ ID NO: 3642236 - DNA, 15 bp, Homo sapiens
tgcctaacctgggac

SEQ ID NO: 3642237 - DNA, 19 bp, Homo sapiens
tgcctaagaataaacattt

SEQ ID NO: 3642238 - DNA, 13 bp, Homo sapiens
tgcctagagtgta

SEQ ID NO: 3642239 - DNA, 22 bp, Homo sapiens
tgcctagagtgtagcctaaagg

SEQ ID NO: 3642240 - DNA, 15 bp, Homo sapiens
tgcctatctgcctgg

SEQ ID NO: 3642241 - DNA, 22 bp, Homo sapiens
tgcctcacctggtcgccaatcc

SEQ ID NO: 3642242 - DNA, 23 bp, Homo sapiens
tgcctcacctggtcgccaatcca

SEQ ID NO: 3642243 - DNA, 15 bp, Homo sapiens
tgcctccacatgctg

SEQ ID NO: 3642244 - DNA, 16 bp, Homo sapiens
tgcctccacatgctgc

SEQ ID NO: 3642245 - DNA, 17 bp, Homo sapiens
tgcctccaggaaccaca

SEQ ID NO: 3642246 - DNA, 20 bp, Homo sapiens
tgcctccaggaaccacacca

SEQ ID NO: 3642247 - DNA, 17 bp, Homo sapiens
tgcctcccctctccttc

SEQ ID NO: 3642248 - DNA, 12 bp, Homo sapiens
tgcctcctcagg

SEQ ID NO: 3642249 - DNA, 14 bp, Homo sapiens
tgcctcctcttcaa

SEQ ID NO: 3642250 - DNA, 14 bp, Homo sapiens
tgcctcctgccctt

SEQ ID NO: 3642251 - DNA, 14 bp, Homo sapiens
tgcctcctgcgccc

SEQ ID NO: 3642252 - DNA, 18 bp, Homo sapiens
tgcctctccctgggtctg

SEQ ID NO: 3642253 - DNA, 15 bp, Homo sapiens
tgcctctgcagtctc

SEQ ID NO: 3642254 - DNA, 14 bp, Homo sapiens
tgcctctgccctgg

SEQ ID NO: 3642255 - DNA, 13 bp, Homo sapiens
tgcctctgcctgt

SEQ ID NO: 3642256 - DNA, 11 bp, Homo sapiens
tgcctcttctt

SEQ ID NO: 3642257 - DNA, 14 bp, Homo sapiens
tgcctcttctttgt

SEQ ID NO: 3642258 - DNA, 15 bp, Homo sapiens
tgcctgacagccttc

SEQ ID NO: 3642259 - DNA, 16 bp, Homo sapiens
tgcctgagctggggaa

SEQ ID NO: 3642260 - DNA, 14 bp, Homo sapiens
tgcctgaggctgta

SEQ ID NO: 3642261 - DNA, 20 bp, Homo sapiens
tgcctgatttcattcctcga

SEQ ID NO: 3642262 - DNA, 17 bp, Homo sapiens
tgcctgcagcaggcagc

SEQ ID NO: 3642263 - DNA, 16 bp, Homo sapiens
tgcctgcatgagctgg

SEQ ID NO: 3642264 - DNA, 18 bp, Homo sapiens
tgcctgcatgagctggca

SEQ ID NO: 3642265 - DNA, 21 bp, Homo sapiens
tgcctgcatgagctggcaacc

SEQ ID NO: 3642266 - DNA, 19 bp, Homo sapiens
tgcctgccagctgcactga

SEQ ID NO: 3642267 - DNA, 10 bp, Homo sapiens
tgcctggagg

SEQ ID NO: 3642268 - DNA, 15 bp, Homo sapiens
tgcctggaggcaaag

SEQ ID NO: 3642269 - DNA, 15 bp, Homo sapiens
tgcctggaggctcct

SEQ ID NO: 3642270 - DNA, 17 bp, Homo sapiens
tgcctggaggctcctct

SEQ ID NO: 3642271 - DNA, 18 bp, Homo sapiens
tgcctggagtcaggtgtc

SEQ ID NO: 3642272 - DNA, 21 bp, Homo sapiens
tgcctggccgcagggcggggc

SEQ ID NO: 3642273 - DNA, 14 bp, Homo sapiens
tgcctgggcccgga

SEQ ID NO: 3642274 - DNA, 21 bp, Homo sapiens
tgcctgggcccggaagggctt

SEQ ID NO: 3642275 - DNA, 22 bp, Homo sapiens
tgcctgggccgtggcacagctg

SEQ ID NO: 3642276 - DNA, 18 bp, Homo sapiens
tgcctgggctcagcctgg

SEQ ID NO: 3642277 - DNA, 17 bp, Homo sapiens
tgcctgggctctggaag

SEQ ID NO: 3642278 - DNA, 23 bp, Homo sapiens
tgcctgggggcttttgccactcc

SEQ ID NO: 3642279 - DNA, 19 bp, Homo sapiens
tgcctgtgagcatggggcc

SEQ ID NO: 3642280 - DNA, 21 bp, Homo sapiens
tgcctgtgagcatggggccag

SEQ ID NO: 3642281 - DNA, 22 bp, Homo sapiens
tgcctgtgcccgcatgtgtgcc

SEQ ID NO: 3642282 - DNA, 17 bp, Homo sapiens
tgcctgttaatttataa

SEQ ID NO: 3642283 - DNA, 21 bp, Homo sapiens
tgcctgttaatttataatgta

SEQ ID NO: 3642284 - DNA, 23 bp, Homo sapiens
tgcctgttggcaggcccactccc

SEQ ID NO: 3642285 - DNA, 12 bp, Homo sapiens
tgcctgtttccc

SEQ ID NO: 3642286 - DNA, 23 bp, Homo sapiens
tgccttcaacaacgtgagagaaa

SEQ ID NO: 3642287 - DNA, 15 bp, Homo sapiens
tgccttcacatttgg

SEQ ID NO: 3642288 - DNA, 20 bp, Homo sapiens
tgccttcagtcttggtaaaa

SEQ ID NO: 3642289 - DNA, 16 bp, Homo sapiens
tgccttctactcccct

SEQ ID NO: 3642290 - DNA, 20 bp, Homo sapiens
tggccctcctcagctccctg

SEQ ID NO: 3642291 - DNA, 19 bp, Homo sapiens
tggccctggggatcttccc

SEQ ID NO: 3642292 - DNA, 19 bp, Homo sapiens
tggcccttcaagggtcagg

SEQ ID NO: 3642293 - DNA, 23 bp, Homo sapiens
tggcccttggtggggagcacaga

SEQ ID NO: 3642294 - DNA, 14 bp, Homo sapiens
tggccgcctgcagc

SEQ ID NO: 3642295 - DNA, 11 bp, Homo sapiens
tggcctatgaa

SEQ ID NO: 3642296 - DNA, 18 bp, Homo sapiens
tggcctcccaaagtgctg

SEQ ID NO: 3642297 - DNA, 12 bp, Homo sapiens
tggcctccctgc

SEQ ID NO: 3642298 - DNA, 21 bp, Homo sapiens
tggcctcgtgaggggcaagct

SEQ ID NO: 3642299 - DNA, 19 bp, Homo sapiens
tggcctcgtgctccgcagg

SEQ ID NO: 3642300 - DNA, 16 bp, Homo sapiens
tggcctgaactgagga

SEQ ID NO: 3642301 - DNA, 12 bp, Homo sapiens
tggcctggagca

SEQ ID NO: 3642302 - DNA, 16 bp, Homo sapiens
tggcctggagcaggcc

SEQ ID NO: 3642303 - DNA, 17 bp, Homo sapiens
tggcctggagcaggccc

SEQ ID NO: 3642304 - DNA, 18 bp, Homo sapiens
tggcctggggtgcatctc

SEQ ID NO: 3642305 - DNA, 16 bp, Homo sapiens
tggcctgtgccagcac

SEQ ID NO: 3642306 - DNA, 21 bp, Homo sapiens
tggcctgtgccagcaccacag

SEQ ID NO: 3642307 - DNA, 21 bp, Homo sapiens
tggcctgttcttctatgggtt

SEQ ID NO: 3642308 - DNA, 15 bp, Homo sapiens
tggccttccccagca

SEQ ID NO: 3642309 - DNA, 18 bp, Homo sapiens
tggccttgggatccaggc

SEQ ID NO: 3642310 - DNA, 15 bp, Homo sapiens
tggcctttacagaaa

SEQ ID NO: 3642311 - DNA, 17 bp, Homo sapiens
tggcctttacagaaaat

SEQ ID NO: 3642312 - DNA, 18 bp, Homo sapiens
tggcctttatgttctttc

SEQ ID NO: 3642313 - DNA, 20 bp, Homo sapiens
tggcctttttcatttatcta

SEQ ID NO: 3642314 - DNA, 14 bp, Homo sapiens
tggcggaggctgct

SEQ ID NO: 3642315 - DNA, 16 bp, Homo sapiens
tggcggaggctgctcg

SEQ ID NO: 3642316 - DNA, 13 bp, Homo sapiens
tggcggaggtctc

SEQ ID NO: 3642317 - DNA, 19 bp, Homo sapiens
tggcggaggtctctgggag

SEQ ID NO: 3642318 - DNA, 21 bp, Homo sapiens
tggcggcacgtccttgggcgt

SEQ ID NO: 3642319 - DNA, 17 bp, Homo sapiens
tggcggctgcacaacag

SEQ ID NO: 3642320 - DNA, 14 bp, Homo sapiens
tggcggtggctgcc

SEQ ID NO: 3642321 - DNA, 21 bp, Homo sapiens
tggcgtgctcagacccaacag

SEQ ID NO: 3642322 - DNA, 14 bp, Homo sapiens
tggcgttgttgcat

SEQ ID NO: 3642323 - DNA, 20 bp, Homo sapiens
tggctaacttacaaagattc

SEQ ID NO: 3642324 - DNA, 23 bp, Homo sapiens
tggctagtcaagctcctcctccc

SEQ ID NO: 3642325 - DNA, 15 bp, Homo sapiens
tggctagtccttgtt

SEQ ID NO: 3642326 - DNA, 19 bp, Homo sapiens
tggctataggtgctacaaa

SEQ ID NO: 3642327 - DNA, 15 bp, Homo sapiens
tggctatgaacagaa

SEQ ID NO: 3642328 - DNA, 15 bp, Homo sapiens
tggctatttttgaag

SEQ ID NO: 3642329 - DNA, 13 bp, Homo sapiens
tggctcacaaggc

SEQ ID NO: 3642330 - DNA, 19 bp, Homo sapiens
tggctcacaaggcccagga

SEQ ID NO: 3642331 - DNA, 22 bp, Homo sapiens
tggctcacaaggcccaggagac

SEQ ID NO: 3642332 - DNA, 15 bp, Homo sapiens
tggctcactggcagg

SEQ ID NO: 3642333 - DNA, 18 bp, Homo sapiens
tggctccactcttgatct

SEQ ID NO: 3642334 - DNA, 22 bp, Homo sapiens
tggctccactcttgatctctct

SEQ ID NO: 3642335 - DNA, 18 bp, Homo sapiens
tggctcctcccggtgccc

SEQ ID NO: 3642336 - DNA, 19 bp, Homo sapiens
tggctcctcccggtgccca

SEQ ID NO: 3642337 - DNA, 13 bp, Homo sapiens
tggctcctctcag

SEQ ID NO: 3642338 - DNA, 13 bp, Homo sapiens
tggctcctgggcc

SEQ ID NO: 3642339 - DNA, 14 bp, Homo sapiens
tggctcctgggccg

SEQ ID NO: 3642340 - DNA, 20 bp, Homo sapiens
tggctcctgggccggctgag

SEQ ID NO: 3642341 - DNA, 19 bp, Homo sapiens
tggctctgccccctccccc

SEQ ID NO: 3642342 - DNA, 15 bp, Homo sapiens
tggctctgccccgca

SEQ ID NO: 3642343 - DNA, 11 bp, Homo sapiens
tggctctgctg

SEQ ID NO: 3642344 - DNA, 13 bp, Homo sapiens
tggctgacccctc

SEQ ID NO: 3642345 - DNA, 17 bp, Homo sapiens
tggctgagcccctgggg

SEQ ID NO: 3642346 - DNA, 20 bp, Homo sapiens
tggctgagcccctggggaaa

SEQ ID NO: 3642347 - DNA, 10 bp, Homo sapiens
tggctgcagg

SEQ ID NO: 3642348 - DNA, 20 bp, Homo sapiens
tggctgcaggaagaaacttt

SEQ ID NO: 3642349 - DNA, 22 bp, Homo sapiens
tggctgcaggaagaaacttttt

SEQ ID NO: 3642350 - DNA, 14 bp, Homo sapiens
tggctgcaggtgtt

SEQ ID NO: 3642351 - DNA, 22 bp, Homo sapiens
tggctgcaggtgttctgctgat

SEQ ID NO: 3642352 - DNA, 13 bp, Homo sapiens
tggctgccccggc

SEQ ID NO: 3642353 - DNA, 17 bp, Homo sapiens
tggctggaaagcagagc

SEQ ID NO: 3642354 - DNA, 18 bp, Homo sapiens
tggctggaaagcagagcc

SEQ ID NO: 3642355 - DNA, 17 bp, Homo sapiens
tggctggtagcagcagg

SEQ ID NO: 3642356 - DNA, 21 bp, Homo sapiens
tggctggtgggaaggccggca

SEQ ID NO: 3642357 - DNA, 20 bp, Homo sapiens
tggctgtaatgacaaaagat

SEQ ID NO: 3642358 - DNA, 20 bp, Homo sapiens
tggctgtacctgttcctccc

SEQ ID NO: 3642359 - DNA, 19 bp, Homo sapiens
tggctgtgcctctgcctgt

SEQ ID NO: 3642360 - DNA, 18 bp, Homo sapiens
tggcttccccactccccc

SEQ ID NO: 3642361 - DNA, 13 bp, Homo sapiens
tggcttccctgga

SEQ ID NO: 3642362 - DNA, 14 bp, Homo sapiens
tggcttccctggaa

SEQ ID NO: 3642363 - DNA, 13 bp, Homo sapiens
tggcttctttcca

SEQ ID NO: 3642364 - DNA, 18 bp, Homo sapiens
tggcttggggattgtaca

SEQ ID NO: 3642365 - DNA, 20 bp, Homo sapiens
tggcttggggattgtacacg

SEQ ID NO: 3642366 - DNA, 18 bp, Homo sapiens
tggctttcacatttaaat

SEQ ID NO: 3642367 - DNA, 22 bp, Homo sapiens
tggctttcacatttaaatggtt

SEQ ID NO: 3642368 - DNA, 15 bp, Homo sapiens
tggctttgcccaccc

SEQ ID NO: 3642369 - DNA, 20 bp, Homo sapiens
tggctttgcccacccctcac

SEQ ID NO: 3642370 - DNA, 12 bp, Homo sapiens
tggctttgcctc

SEQ ID NO: 3642371 - DNA, 17 bp, Homo sapiens
tggctttggcttcttgg

SEQ ID NO: 3642372 - DNA, 16 bp, Homo sapiens
tggcttttcactgctg

SEQ ID NO: 3642373 - DNA, 22 bp, Homo sapiens
tggcttttcactgctggctgcc

SEQ ID NO: 3642374 - DNA, 15 bp, Homo sapiens
tgggaaacagaggct

SEQ ID NO: 3642375 - DNA, 19 bp, Homo sapiens
tgggaaacagagtccaatt

SEQ ID NO: 3642376 - DNA, 14 bp, Homo sapiens
tgggaaagcattgt

SEQ ID NO: 3642377 - DNA, 17 bp, Homo sapiens
tgggaaagcattgtaaa

SEQ ID NO: 3642378 - DNA, 18 bp, Homo sapiens
tgggaaagcattgtaaat

SEQ ID NO: 3642379 - DNA, 21 bp, Homo sapiens
tgggaaagcattgtaaatgtg

SEQ ID NO: 3642380 - DNA, 21 bp, Homo sapiens
tgggaacccccctcccaccca

SEQ ID NO: 3642381 - DNA, 14 bp, Homo sapiens
tgggaactgaaatc

SEQ ID NO: 3642382 - DNA, 16 bp, Homo sapiens
tgggaagaattggaag

SEQ ID NO: 3642383 - DNA, 15 bp, Homo sapiens
tgggaaggccagcct

SEQ ID NO: 3642384 - DNA, 16 bp, Homo sapiens
tgggaaggccagcctt

SEQ ID NO: 3642385 - DNA, 17 bp, Homo sapiens
tgggaaggccggcagcg

SEQ ID NO: 3642386 - DNA, 14 bp, Homo sapiens
tgggaagggagcat

SEQ ID NO: 3642387 - DNA, 16 bp, Homo sapiens
tgggaagtttgctgtg

SEQ ID NO: 3642388 - DNA, 22 bp, Homo sapiens
tgggaagtttgctgtgctttgg

SEQ ID NO: 3642389 - DNA, 16 bp, Homo sapiens
tgggaatatgtagagg

SEQ ID NO: 3642390 - DNA, 12 bp, Homo sapiens
tgggaatgggag

SEQ ID NO: 3642391 - DNA, 15 bp, Homo sapiens
tgggaatgggagagg

SEQ ID NO: 3642392 - DNA, 14 bp, Homo sapiens
tgggacagctggct

SEQ ID NO: 3642393 - DNA, 19 bp, Homo sapiens
tgggacagctggctgggcc

SEQ ID NO: 3642394 - DNA, 14 bp, Homo sapiens
tgggacccacagaa

SEQ ID NO: 3642395 - DNA, 20 bp, Homo sapiens
tgggacctgtggtcatgtga

SEQ ID NO: 3642396 - DNA, 20 bp, Homo sapiens
tgggactgggaacagaactc

SEQ ID NO: 3642397 - DNA, 22 bp, Homo sapiens
tgggagaatgtcagtatgtgga

SEQ ID NO: 3642398 - DNA, 15 bp, Homo sapiens
tgggagacatgtgac

SEQ ID NO: 3642399 - DNA, 16 bp, Homo sapiens
tgggagagccatacat

SEQ ID NO: 3642400 - DNA, 11 bp, Homo sapiens
tgggagccagg

SEQ ID NO: 3642401 - DNA, 14 bp, Homo sapiens
tgggagccaggact

SEQ ID NO: 3642402 - DNA, 20 bp, Homo sapiens
tgggagccaggactcccaga

SEQ ID NO: 3642403 - DNA, 14 bp, Homo sapiens
tgggagcccagagg

SEQ ID NO: 3642404 - DNA, 23 bp, Homo sapiens
tgggagccgggcaaactggccgc

SEQ ID NO: 3642405 - DNA, 22 bp, Homo sapiens
tgggagcctagctcctgccaca

SEQ ID NO: 3642406 - DNA, 22 bp, Homo sapiens
tgggagcctggttcagacacag

SEQ ID NO: 3642407 - DNA, 18 bp, Homo sapiens
tgggagctgagctggaag

SEQ ID NO: 3642408 - DNA, 18 bp, Homo sapiens
tgggagctgctgggtggc

SEQ ID NO: 3642409 - DNA, 19 bp, Homo sapiens
tgggagctggttagaaatg

SEQ ID NO: 3642410 - DNA, 16 bp, Homo sapiens
tgggagcttgggaatg

SEQ ID NO: 3642411 - DNA, 18 bp, Homo sapiens
tgggaggaggaaaagaaa

SEQ ID NO: 3642412 - DNA, 18 bp, Homo sapiens
tgggaggatacagaggag

SEQ ID NO: 3642413 - DNA, 20 bp, Homo sapiens
tgggaggcagaggttgcagt

SEQ ID NO: 3642414 - DNA, 15 bp, Homo sapiens
tgggaggctggagtt

SEQ ID NO: 3642415 - DNA, 16 bp, Homo sapiens
tgggaggtcaggaaac

SEQ ID NO: 3642416 - DNA, 23 bp, Homo sapiens
tgggaggtcttggccgactcagg

SEQ ID NO: 3642417 - DNA, 11 bp, Homo sapiens
tgggagtgtgt

SEQ ID NO: 3642418 - DNA, 13 bp, Homo sapiens
tgggagtgtgtaa

SEQ ID NO: 3642419 - DNA, 17 bp, Homo sapiens
tgggagttgctgttaat

SEQ ID NO: 3642420 - DNA, 20 bp, Homo sapiens
tgggatagtgttctgctcct

SEQ ID NO: 3642421 - DNA, 23 bp, Homo sapiens
tgggatagtgttctgctcctgct

SEQ ID NO: 3642422 - DNA, 19 bp, Homo sapiens
tgggatatggctgcccagg

SEQ ID NO: 3642423 - DNA, 19 bp, Homo sapiens
tgtcctgcttatacttttc

SEQ ID NO: 3642424 - DNA, 22 bp, Homo sapiens
tgtcctgcttatacttttctca

SEQ ID NO: 3642425 - DNA, 15 bp, Homo sapiens
tgtcctgtctttgat

SEQ ID NO: 3642426 - DNA, 16 bp, Homo sapiens
tgtccttaacccacct

SEQ ID NO: 3642427 - DNA, 19 bp, Homo sapiens
tgtccttaacccacctctc

SEQ ID NO: 3642428 - DNA, 21 bp, Homo sapiens
tgtccttaacccacctctcct

SEQ ID NO: 3642429 - DNA, 19 bp, Homo sapiens
tgtccttccctgttctccc

SEQ ID NO: 3642430 - DNA, 13 bp, Homo sapiens
tgtccttggactc

SEQ ID NO: 3642431 - DNA, 20 bp, Homo sapiens
tgtccttgtcacgatcacag

SEQ ID NO: 3642432 - DNA, 18 bp, Homo sapiens
tgtcctttctctctaatt

SEQ ID NO: 3642433 - DNA, 19 bp, Homo sapiens
tgtcctttctctctaattc

SEQ ID NO: 3642434 - DNA, 22 bp, Homo sapiens
tgtcgaaggggaggcacacttt

SEQ ID NO: 3642435 - DNA, 13 bp, Homo sapiens
tgtctaattaaaa

SEQ ID NO: 3642436 - DNA, 14 bp, Homo sapiens
tgtctagagaggga

SEQ ID NO: 3642437 - DNA, 14 bp, Homo sapiens
tgtctatctgtgaa

SEQ ID NO: 3642438 - DNA, 22 bp, Homo sapiens
tgtctattttgtaactgtaaag

SEQ ID NO: 3642439 - DNA, 18 bp, Homo sapiens
tgtctcaacgcctccccc

SEQ ID NO: 3642440 - DNA, 18 bp, Homo sapiens
tgtctcaagagggcactg

SEQ ID NO: 3642441 - DNA, 23 bp, Homo sapiens
tgtctcaagagggcactggtggc

SEQ ID NO: 3642442 - DNA, 15 bp, Homo sapiens
tgtctcacgcagcca

SEQ ID NO: 3642443 - DNA, 17 bp, Homo sapiens
tgtctcagcctctgcca

SEQ ID NO: 3642444 - DNA, 16 bp, Homo sapiens
tgtctcaggtccctgc

SEQ ID NO: 3642445 - DNA, 21 bp, Homo sapiens
tgtctcattgaccttcagatt

SEQ ID NO: 3642446 - DNA, 13 bp, Homo sapiens
tgtctccagctgc

SEQ ID NO: 3642447 - DNA, 14 bp, Homo sapiens
tgtctcccagaact

SEQ ID NO: 3642448 - DNA, 14 bp, Homo sapiens
tgtctctccagtga

SEQ ID NO: 3642449 - DNA, 19 bp, Homo sapiens
tgtctgaagtcactgcaca

SEQ ID NO: 3642450 - DNA, 14 bp, Homo sapiens
tgtctgagacaggt

SEQ ID NO: 3642451 - DNA, 17 bp, Homo sapiens
tgtctgagacaggtgcc

SEQ ID NO: 3642452 - DNA, 23 bp, Homo sapiens
tgtctgagacaggtgcctaacct

SEQ ID NO: 3642453 - DNA, 16 bp, Homo sapiens
tgtctgcactgaggat

SEQ ID NO: 3642454 - DNA, 12 bp, Homo sapiens
tgtctgcagctg

SEQ ID NO: 3642455 - DNA, 13 bp, Homo sapiens
tgtctgccagggc

SEQ ID NO: 3642456 - DNA, 18 bp, Homo sapiens
tgtctgctgagttggcct

SEQ ID NO: 3642457 - DNA, 17 bp, Homo sapiens
tgtctgctgccagcaca

SEQ ID NO: 3642458 - DNA, 22 bp, Homo sapiens
tgtctgggctcagacatccaca

SEQ ID NO: 3642459 - DNA, 16 bp, Homo sapiens
tgtctggtgtttgtca

SEQ ID NO: 3642460 - DNA, 18 bp, Homo sapiens
tgtctggtgtttgtcatg

SEQ ID NO: 3642461 - DNA, 16 bp, Homo sapiens
tgtctgttgtattcat

SEQ ID NO: 3642462 - DNA, 22 bp, Homo sapiens
tgtctgtttgctcaaaattgct

SEQ ID NO: 3642463 - DNA, 17 bp, Homo sapiens
tgtcttaaaaatttata

SEQ ID NO: 3642464 - DNA, 18 bp, Homo sapiens
tgtcttaaaaatttatac

SEQ ID NO: 3642465 - DNA, 19 bp, Homo sapiens
tgtcttaatttttgaaaaa

SEQ ID NO: 3642466 - DNA, 16 bp, Homo sapiens
tgtcttattaagactg

SEQ ID NO: 3642467 - DNA, 17 bp, Homo sapiens
tgtcttattaagactgg

SEQ ID NO: 3642468 - DNA, 15 bp, Homo sapiens
tgtcttctttctcca

SEQ ID NO: 3642469 - DNA, 15 bp, Homo sapiens
tgtctttaagaacta

SEQ ID NO: 3642470 - DNA, 17 bp, Homo sapiens
tgtctttcttgctccct

SEQ ID NO: 3642471 - DNA, 21 bp, Homo sapiens
tgtctttctttgtcattcagt

SEQ ID NO: 3642472 - DNA, 18 bp, Homo sapiens
tgtctttgatcgcctctt

SEQ ID NO: 3642473 - DNA, 20 bp, Homo sapiens
tgtcttttctttgccatctc

SEQ ID NO: 3642474 - DNA, 21 bp, Homo sapiens
tgtgaaataaaactggctttg

SEQ ID NO: 3642475 - DNA, 18 bp, Homo sapiens
tgtgaacctacctgcctt

SEQ ID NO: 3642476 - DNA, 14 bp, Homo sapiens
tgtgaactcaccct

SEQ ID NO: 3642477 - DNA, 22 bp, Homo sapiens
tgtgaagaggtctgattggctg

SEQ ID NO: 3642478 - DNA, 13 bp, Homo sapiens
tgtgaaggaccct

SEQ ID NO: 3642479 - DNA, 22 bp, Homo sapiens
tgtgaattaggctgtaactact

SEQ ID NO: 3642480 - DNA, 23 bp, Homo sapiens
tgtgaattaggctgtaactactt

SEQ ID NO: 3642481 - DNA, 24 bp, Homo sapiens
tgtgaattaggctgtaactacttt

SEQ ID NO: 3642482 - DNA, 17 bp, Homo sapiens
tgtgacatttatatatt

SEQ ID NO: 3642483 - DNA, 18 bp, Homo sapiens
tgtgacatttatatattg

SEQ ID NO: 3642484 - DNA, 18 bp, Homo sapiens
tgtgacattttacattaa

SEQ ID NO: 3642485 - DNA, 15 bp, Homo sapiens
tgtgacctctgacaa

SEQ ID NO: 3642486 - DNA, 23 bp, Homo sapiens
tgtgacggcagggaaatgtatgt

SEQ ID NO: 3642487 - DNA, 21 bp, Homo sapiens
tgtgacgtttttccagttcac

SEQ ID NO: 3642488 - DNA, 16 bp, Homo sapiens
tgtgactccaagaggg

SEQ ID NO: 3642489 - DNA, 22 bp, Homo sapiens
tgtgactccttatctctttcca

SEQ ID NO: 3642490 - DNA, 19 bp, Homo sapiens
tgtgactcttactccttag

SEQ ID NO: 3642491 - DNA, 11 bp, Homo sapiens
tgtgagaatgg

SEQ ID NO: 3642492 - DNA, 12 bp, Homo sapiens
tgtgagaatggc

SEQ ID NO: 3642493 - DNA, 18 bp, Homo sapiens
tgtgagaatggcctggag

SEQ ID NO: 3642494 - DNA, 22 bp, Homo sapiens
tgtgagaatggcctggagcagg

SEQ ID NO: 3642495 - DNA, 13 bp, Homo sapiens
tgtgagaccccaa

SEQ ID NO: 3642496 - DNA, 19 bp, Homo sapiens
tgtgagcacaaagaagaaa

SEQ ID NO: 3642497 - DNA, 20 bp, Homo sapiens
tgtgagcacaaagaagaaag

SEQ ID NO: 3642498 - DNA, 17 bp, Homo sapiens
tgtgagcatggggccag

SEQ ID NO: 3642499 - DNA, 16 bp, Homo sapiens
tgtgagctcttccctt

SEQ ID NO: 3642500 - DNA, 17 bp, Homo sapiens
tgtgagctcttccctta

SEQ ID NO: 3642501 - DNA, 16 bp, Homo sapiens
tgtgagtcattatgta

SEQ ID NO: 3642502 - DNA, 17 bp, Homo sapiens
tgtgagtcattatgtag

SEQ ID NO: 3642503 - DNA, 16 bp, Homo sapiens
tgtgagtctgggatat

SEQ ID NO: 3642504 - DNA, 22 bp, Homo sapiens
tgtgagtttaccttgtatactg

SEQ ID NO: 3642505 - DNA, 16 bp, Homo sapiens
tgtgatatataagtgt

SEQ ID NO: 3642506 - DNA, 17 bp, Homo sapiens
tgtgatatgtctgctga

SEQ ID NO: 3642507 - DNA, 18 bp, Homo sapiens
tgtgatctgggtctctaa

SEQ ID NO: 3642508 - DNA, 18 bp, Homo sapiens
tgtgatgacattccctgc

SEQ ID NO: 3642509 - DNA, 22 bp, Homo sapiens
tgtgattgacagctttgctgct

SEQ ID NO: 3642510 - DNA, 13 bp, Homo sapiens
tgtgattggctgc

SEQ ID NO: 3642511 - DNA, 16 bp, Homo sapiens
tgtgattggctgcagg

SEQ ID NO: 3642512 - DNA, 17 bp, Homo sapiens
tgtgattggctgcagga

SEQ ID NO: 3642513 - DNA, 16 bp, Homo sapiens
tgtgattggctggtta

SEQ ID NO: 3642514 - DNA, 14 bp, Homo sapiens
tgtgattgtgccta

SEQ ID NO: 3642515 - DNA, 17 bp, Homo sapiens
tgtgatttgaattctgt

SEQ ID NO: 3642516 - DNA, 15 bp, Homo sapiens
tgtgatttttatcac

SEQ ID NO: 3642517 - DNA, 17 bp, Homo sapiens
tgtgatttttatcacaa

SEQ ID NO: 3642518 - DNA, 16 bp, Homo sapiens
tgtgcaaacagtaacg

SEQ ID NO: 3642519 - DNA, 18 bp, Homo sapiens
tgtgcattctttttttta

SEQ ID NO: 3642520 - DNA, 14 bp, Homo sapiens
tgtgccaagagcta

SEQ ID NO: 3642521 - DNA, 14 bp, Homo sapiens
tgtgccatgctggg

SEQ ID NO: 3642522 - DNA, 14 bp, Homo sapiens
tgtgcctctgcctg

SEQ ID NO: 3642523 - DNA, 15 bp, Homo sapiens
tgtgcctctgcctgt

SEQ ID NO: 3642524 - DNA, 10 bp, Homo sapiens
tgtgcctttc

SEQ ID NO: 3642525 - DNA, 12 bp, Homo sapiens
tgtgcctttctt

SEQ ID NO: 3642526 - DNA, 13 bp, Homo sapiens
tgtgcctttcttt

SEQ ID NO: 3642527 - DNA, 14 bp, Homo sapiens
tgtgcctttctttg

SEQ ID NO: 3642528 - DNA, 18 bp, Homo sapiens
tgtgcctttctttgcctc

SEQ ID NO: 3642529 - DNA, 21 bp, Homo sapiens
tgtgcctttctttgcctctgc

SEQ ID NO: 3642530 - DNA, 13 bp, Homo sapiens
tgtgcctttggcc

SEQ ID NO: 3642531 - DNA, 16 bp, Homo sapiens
tgtgccttttgccatc

SEQ ID NO: 3642532 - DNA, 16 bp, Homo sapiens
tgtgcgtcccagctga

SEQ ID NO: 3642533 - DNA, 17 bp, Homo sapiens
tgtgcgtcccagctgaa

SEQ ID NO: 3642534 - DNA, 18 bp, Homo sapiens
tgtgctaatcaaaacttt

SEQ ID NO: 3642535 - DNA, 22 bp, Homo sapiens
tgtgctatgaaacaatcttcca

SEQ ID NO: 3642536 - DNA, 15 bp, Homo sapiens
tgtgctcagagacac

SEQ ID NO: 3642537 - DNA, 18 bp, Homo sapiens
tgtgctccacactcagaa

SEQ ID NO: 3642538 - DNA, 20 bp, Homo sapiens
tgtgctccacactcagaaaa

SEQ ID NO: 3642539 - DNA, 21 bp, Homo sapiens
tgtgctctggcaccatcagcc

SEQ ID NO: 3642540 - DNA, 14 bp, Homo sapiens
tgtgctgtttcaaa

SEQ ID NO: 3642541 - DNA, 16 bp, Homo sapiens
tgtgctgtttgaaaat

SEQ ID NO: 3642542 - DNA, 14 bp, Homo sapiens
tgtgctttttgtca

SEQ ID NO: 3642543 - DNA, 17 bp, Homo sapiens
tgtgctttttgtcatgt

SEQ ID NO: 3642544 - DNA, 18 bp, Homo sapiens
tgtgctttttgtcatgtt

SEQ ID NO: 3642545 - DNA, 17 bp, Homo sapiens
tgtggaaaatgaaaatt

SEQ ID NO: 3642546 - DNA, 21 bp, Homo sapiens
tgtggaacataaaaaggacat

SEQ ID NO: 3642547 - DNA, 14 bp, Homo sapiens
tgtggagaccaggc

SEQ ID NO: 3642548 - DNA, 15 bp, Homo sapiens
tgtggcaaaaagagt

SEQ ID NO: 3642549 - DNA, 19 bp, Homo sapiens
tgtggcagagttacagttc

SEQ ID NO: 3642550 - DNA, 20 bp, Homo sapiens
tgtggcagagttacagttct

SEQ ID NO: 3642551 - DNA, 13 bp, Homo sapiens
tgtggcagcctga

SEQ ID NO: 3642552 - DNA, 13 bp, Homo sapiens
tgtggcagggggc

SEQ ID NO: 3642553 - DNA, 15 bp, Homo sapiens
tgtggccaaggagct

SEQ ID NO: 3642554 - DNA, 18 bp, Homo sapiens
tgtggccaaggagctgct

SEQ ID NO: 3642555 - DNA, 19 bp, Homo sapiens
tgtggccaaggagctgcta

SEQ ID NO: 3642556 - DNA, 17 bp, Homo sapiens
ttactaaaaagtataaa

SEQ ID NO: 3642557 - DNA, 24 bp, Homo sapiens
ttactaaatatataaagtatatgt

SEQ ID NO: 3642558 - DNA, 16 bp, Homo sapiens
ttactaatgtaaaatg

SEQ ID NO: 3642559 - DNA, 13 bp, Homo sapiens
ttactaccttatc

SEQ ID NO: 3642560 - DNA, 12 bp, Homo sapiens
ttactcctggct

SEQ ID NO: 3642561 - DNA, 14 bp, Homo sapiens
ttactctattgata

SEQ ID NO: 3642562 - DNA, 13 bp, Homo sapiens
ttactctttgaaa

SEQ ID NO: 3642563 - DNA, 12 bp, Homo sapiens
ttactgatgaga

SEQ ID NO: 3642564 - DNA, 15 bp, Homo sapiens
ttactgatgagagaa

SEQ ID NO: 3642565 - DNA, 18 bp, Homo sapiens
ttactgcactcagattta

SEQ ID NO: 3642566 - DNA, 21 bp, Homo sapiens
ttactgccctttcaaagcact

SEQ ID NO: 3642567 - DNA, 22 bp, Homo sapiens
ttactgccctttcaaagcactt

SEQ ID NO: 3642568 - DNA, 13 bp, Homo sapiens
ttactgtgtaatt

SEQ ID NO: 3642569 - DNA, 16 bp, Homo sapiens
ttactgtgtaattagt

SEQ ID NO: 3642570 - DNA, 20 bp, Homo sapiens
ttactgtgtaattagtgcca

SEQ ID NO: 3642571 - DNA, 21 bp, Homo sapiens
ttacttcaaagtgcctgggct

SEQ ID NO: 3642572 - DNA, 17 bp, Homo sapiens
ttacttttaaacagtga

SEQ ID NO: 3642573 - DNA, 19 bp, Homo sapiens
ttagaaaatgacttatttc

SEQ ID NO: 3642574 - DNA, 20 bp, Homo sapiens
ttagaaaatgacttatttct

SEQ ID NO: 3642575 - DNA, 22 bp, Homo sapiens
ttagaaaatgacttatttctgc

SEQ ID NO: 3642576 - DNA, 10 bp, Homo sapiens
ttagaaacta

SEQ ID NO: 3642577 - DNA, 19 bp, Homo sapiens
ttagaaactacaaatatag

SEQ ID NO: 3642578 - DNA, 12 bp, Homo sapiens
ttagaaatataa

SEQ ID NO: 3642579 - DNA, 15 bp, Homo sapiens
ttagaaatgtgaaga

SEQ ID NO: 3642580 - DNA, 22 bp, Homo sapiens
ttagaaatgtgaagaggtctga

SEQ ID NO: 3642581 - DNA, 13 bp, Homo sapiens
ttagaacctttct

SEQ ID NO: 3642582 - DNA, 15 bp, Homo sapiens
ttagaagaagtgtgt

SEQ ID NO: 3642583 - DNA, 16 bp, Homo sapiens
ttagaagattctatgt

SEQ ID NO: 3642584 - DNA, 18 bp, Homo sapiens
ttagaatgtcaataaatt

SEQ ID NO: 3642585 - DNA, 13 bp, Homo sapiens
ttagaatgtcagt

SEQ ID NO: 3642586 - DNA, 13 bp, Homo sapiens
ttagaatgttgaa

SEQ ID NO: 3642587 - DNA, 22 bp, Homo sapiens
ttagacaaagccttaagcaaat

SEQ ID NO: 3642588 - DNA, 15 bp, Homo sapiens
ttagacttactatta

SEQ ID NO: 3642589 - DNA, 15 bp, Homo sapiens
ttagagaaaacctta

SEQ ID NO: 3642590 - DNA, 21 bp, Homo sapiens
ttagagcttccgagaatagct

SEQ ID NO: 3642591 - DNA, 15 bp, Homo sapiens
ttagagtgtagctgt

SEQ ID NO: 3642592 - DNA, 13 bp, Homo sapiens
ttagagtttctgt

SEQ ID NO: 3642593 - DNA, 16 bp, Homo sapiens
ttagagtttctgtttg

SEQ ID NO: 3642594 - DNA, 13 bp, Homo sapiens
ttagatatttgcc

SEQ ID NO: 3642595 - DNA, 14 bp, Homo sapiens
ttagatatttgcct

SEQ ID NO: 3642596 - DNA, 22 bp, Homo sapiens
ttagcaggttgggctagagaaa

SEQ ID NO: 3642597 - DNA, 15 bp, Homo sapiens
ttagcagtttcctca

SEQ ID NO: 3642598 - DNA, 16 bp, Homo sapiens
ttagcagtttcctcag

SEQ ID NO: 3642599 - DNA, 16 bp, Homo sapiens
ttagcattaaagttct

SEQ ID NO: 3642600 - DNA, 14 bp, Homo sapiens
ttagcatttgtata

SEQ ID NO: 3642601 - DNA, 22 bp, Homo sapiens
ttagccaactgtttccctgctg

SEQ ID NO: 3642602 - DNA, 23 bp, Homo sapiens
ttagccaactgtttccctgctga

SEQ ID NO: 3642603 - DNA, 16 bp, Homo sapiens
ttagccctcaccacag

SEQ ID NO: 3642604 - DNA, 16 bp, Homo sapiens
ttagcctttgtcccag

SEQ ID NO: 3642605 - DNA, 23 bp, Homo sapiens
ttagctcagctgagcatggagac

SEQ ID NO: 3642606 - DNA, 13 bp, Homo sapiens
ttagctctttctc

SEQ ID NO: 3642607 - DNA, 16 bp, Homo sapiens
ttagctggcattacag

SEQ ID NO: 3642608 - DNA, 17 bp, Homo sapiens
ttagctgtctgctcaga

SEQ ID NO: 3642609 - DNA, 15 bp, Homo sapiens
ttagcttacctgggc

SEQ ID NO: 3642610 - DNA, 13 bp, Homo sapiens
ttagcttccttaa

SEQ ID NO: 3642611 - DNA, 20 bp, Homo sapiens
ttaggaagtgtttatgttgt

SEQ ID NO: 3642612 - DNA, 23 bp, Homo sapiens
ttaggaagttgacttatagtaca

SEQ ID NO: 3642613 - DNA, 16 bp, Homo sapiens
ttaggagaagccagga

SEQ ID NO: 3642614 - DNA, 12 bp, Homo sapiens
ttaggccaggcc

SEQ ID NO: 3642615 - DNA, 15 bp, Homo sapiens
ttaggggaactgggt

SEQ ID NO: 3642616 - DNA, 21 bp, Homo sapiens
ttagggtcctgtcgaagggga

SEQ ID NO: 3642617 - DNA, 13 bp, Homo sapiens
ttaggtactattc

SEQ ID NO: 3642618 - DNA, 14 bp, Homo sapiens
ttagtacaaagttt

SEQ ID NO: 3642619 - DNA, 18 bp, Homo sapiens
ttagtattttaatcctgt

SEQ ID NO: 3642620 - DNA, 22 bp, Homo sapiens
ttagtattttaatcctgtacca

SEQ ID NO: 3642621 - DNA, 15 bp, Homo sapiens
ttagtctgaaactgg

SEQ ID NO: 3642622 - DNA, 18 bp, Homo sapiens
ttagtgccacttaatgta

SEQ ID NO: 3642623 - DNA, 19 bp, Homo sapiens
ttagtgccacttaatgtat

SEQ ID NO: 3642624 - DNA, 13 bp, Homo sapiens
ttagttaccttat

SEQ ID NO: 3642625 - DNA, 20 bp, Homo sapiens
ttagttaccttatagttact

SEQ ID NO: 3642626 - DNA, 22 bp, Homo sapiens
ttagttaccttatagttactgt

SEQ ID NO: 3642627 - DNA, 12 bp, Homo sapiens
ttagttgacagt

SEQ ID NO: 3642628 - DNA, 16 bp, Homo sapiens
ttagttgacagtatta

SEQ ID NO: 3642629 - DNA, 19 bp, Homo sapiens
ttagttggctttcataaat

SEQ ID NO: 3642630 - DNA, 15 bp, Homo sapiens
ttagttggctttgcc

SEQ ID NO: 3642631 - DNA, 16 bp, Homo sapiens
ttataactattacagt

SEQ ID NO: 3642632 - DNA, 18 bp, Homo sapiens
ttataactattacagtgt

SEQ ID NO: 3642633 - DNA, 18 bp, Homo sapiens
ttataagtagcaggccaa

SEQ ID NO: 3642634 - DNA, 18 bp, Homo sapiens
ttataataatgttaacat

SEQ ID NO: 3642635 - DNA, 13 bp, Homo sapiens
ttataatgtattt

SEQ ID NO: 3642636 - DNA, 20 bp, Homo sapiens
ttataatgtatttgaaaatt

SEQ ID NO: 3642637 - DNA, 19 bp, Homo sapiens
ttatacctcaaactatctg

SEQ ID NO: 3642638 - DNA, 23 bp, Homo sapiens
ttataggcctgtcccttgcctct

SEQ ID NO: 3642639 - DNA, 14 bp, Homo sapiens
ttatagttactgtg

SEQ ID NO: 3642640 - DNA, 14 bp, Homo sapiens
ttatatacagagga

SEQ ID NO: 3642641 - DNA, 23 bp, Homo sapiens
ttatatactgctatttacactat

SEQ ID NO: 3642642 - DNA, 13 bp, Homo sapiens
ttatatatatgtg

SEQ ID NO: 3642643 - DNA, 16 bp, Homo sapiens
ttatatgaagtttaaa

SEQ ID NO: 3642644 - DNA, 16 bp, Homo sapiens
ttatatgatatgcatg

SEQ ID NO: 3642645 - DNA, 18 bp, Homo sapiens
ttatatgatatgcatgta

SEQ ID NO: 3642646 - DNA, 20 bp, Homo sapiens
ttatatggataatctgagca

SEQ ID NO: 3642647 - DNA, 23 bp, Homo sapiens
ttatattacttgcctatctgact

SEQ ID NO: 3642648 - DNA, 13 bp, Homo sapiens
ttatatttattgt

SEQ ID NO: 3642649 - DNA, 21 bp, Homo sapiens
ttatatttgacttgaaaagaa

SEQ ID NO: 3642650 - DNA, 16 bp, Homo sapiens
ttatcacctgttcatt

SEQ ID NO: 3642651 - DNA, 21 bp, Homo sapiens
ttatcccatttagtgtgaata

SEQ ID NO: 3642652 - DNA, 17 bp, Homo sapiens
ttatccctctcttcccc

SEQ ID NO: 3642653 - DNA, 18 bp, Homo sapiens
ttatccctctcttcccct

SEQ ID NO: 3642654 - DNA, 23 bp, Homo sapiens
ttatccctctcttccccttccct

SEQ ID NO: 3642655 - DNA, 16 bp, Homo sapiens
ttatcctgaaatttca

SEQ ID NO: 3642656 - DNA, 14 bp, Homo sapiens
ttatcgctttatgt

SEQ ID NO: 3642657 - DNA, 14 bp, Homo sapiens
ttatctataattta

SEQ ID NO: 3642658 - DNA, 11 bp, Homo sapiens
ttatctcaaaa

SEQ ID NO: 3642659 - DNA, 21 bp, Homo sapiens
ttatctcaagtaaaacaaatg

SEQ ID NO: 3642660 - DNA, 22 bp, Homo sapiens
ttatctcaagtaaaacaaatga

SEQ ID NO: 3642661 - DNA, 17 bp, Homo sapiens
ttatctggttctatatg

SEQ ID NO: 3642662 - DNA, 14 bp, Homo sapiens
ttatctgtaattgt

SEQ ID NO: 3642663 - DNA, 16 bp, Homo sapiens
ttatctgtcagctgca

SEQ ID NO: 3642664 - DNA, 19 bp, Homo sapiens
ttatctgtttaaagcatat

SEQ ID NO: 3642665 - DNA, 18 bp, Homo sapiens
ttatgacatcacttgtac

SEQ ID NO: 3642666 - DNA, 13 bp, Homo sapiens
ttatgagccaggc

SEQ ID NO: 3642667 - DNA, 14 bp, Homo sapiens
ttatgcaaatacaa

SEQ ID NO: 3642668 - DNA, 18 bp, Homo sapiens
ttatgcagtgaactattt

SEQ ID NO: 3642669 - DNA, 22 bp, Homo sapiens
ttatgccacttccttttaactg

SEQ ID NO: 3642670 - DNA, 19 bp, Homo sapiens
ttatgcggttaattttgaa

SEQ ID NO: 3642671 - DNA, 17 bp, Homo sapiens
ttatgctgtttcctagc

SEQ ID NO: 3642672 - DNA, 17 bp, Homo sapiens
ttatggctataggtgct

SEQ ID NO: 3642673 - DNA, 19 bp, Homo sapiens
ttatgtagctgtcgtacat

SEQ ID NO: 3642674 - DNA, 12 bp, Homo sapiens
ttatgtgtgtgt

SEQ ID NO: 3642675 - DNA, 19 bp, Homo sapiens
ttatgttgtttataataaa

SEQ ID NO: 3642676 - DNA, 16 bp, Homo sapiens
ttattaaacaaataat

SEQ ID NO: 3642677 - DNA, 15 bp, Homo sapiens
ttattaaacttcagc

SEQ ID NO: 3642678 - DNA, 20 bp, Homo sapiens
ttattaagactggctttaga

SEQ ID NO: 3642679 - DNA, 14 bp, Homo sapiens
ttattaattgcttt

SEQ ID NO: 3642680 - DNA, 21 bp, Homo sapiens
ttattacacaaagaacttgct

SEQ ID NO: 3642681 - DNA, 19 bp, Homo sapiens
ttattaccttctttctaat

SEQ ID NO: 3642682 - DNA, 16 bp, Homo sapiens
ttattactttaaatta

SEQ ID NO: 3642683 - DNA, 21 bp, Homo sapiens
ttattactttaaattatatga

SEQ ID NO: 3642684 - DNA, 14 bp, Homo sapiens
ttattataaattct

SEQ ID NO: 3642685 - DNA, 14 bp, Homo sapiens
ttattatgttctta

SEQ ID NO: 3642686 - DNA, 18 bp, Homo sapiens
ttattcattagttttgaa

SEQ ID NO: 3642687 - DNA, 16 bp, Homo sapiens
ttattgaatatatgat

SEQ ID NO: 3642688 - DNA, 12 bp, Homo sapiens
ttattgcatttg

SEQ ID NO: 3642689 - DNA, 15 bp, Homo sapiens
ttccaaattctgctt

SEQ ID NO: 3642690 - DNA, 13 bp, Homo sapiens
ttccaacatgcaa

SEQ ID NO: 3642691 - DNA, 22 bp, Homo sapiens
ttccaactgggcatttcaatcc

SEQ ID NO: 3642692 - DNA, 13 bp, Homo sapiens
ttccacagaggac

SEQ ID NO: 3642693 - DNA, 14 bp, Homo sapiens
ttccacagaggaca

SEQ ID NO: 3642694 - DNA, 22 bp, Homo sapiens
ttccacagaggacacagagaag

SEQ ID NO: 3642695 - DNA, 22 bp, Homo sapiens
ttccacccacaaactccaggct

SEQ ID NO: 3642696 - DNA, 23 bp, Homo sapiens
ttccacccagtgctgaatttccc

SEQ ID NO: 3642697 - DNA, 15 bp, Homo sapiens
ttccacctcacctct

SEQ ID NO: 3642698 - DNA, 15 bp, Homo sapiens
ttccaccttcccatg

SEQ ID NO: 3642699 - DNA, 17 bp, Homo sapiens
ttccagagagtggagag

SEQ ID NO: 3642700 - DNA, 21 bp, Homo sapiens
ttccagagagtggagagagca

SEQ ID NO: 3642701 - DNA, 23 bp, Homo sapiens
ttccagagagtggagagagcagg

SEQ ID NO: 3642702 - DNA, 17 bp, Homo sapiens
ttccagagagtggctcc

SEQ ID NO: 3642703 - DNA, 20 bp, Homo sapiens
ttccagagagtggctcctcc

SEQ ID NO: 3642704 - DNA, 20 bp, Homo sapiens
ttccagaggctattattttc

SEQ ID NO: 3642705 - DNA, 18 bp, Homo sapiens
ttccagctccgtgtttct

SEQ ID NO: 3642706 - DNA, 20 bp, Homo sapiens
ttccaggactgtttcaaaca

SEQ ID NO: 3642707 - DNA, 21 bp, Homo sapiens
ttccaggactgtttcaaacat

SEQ ID NO: 3642708 - DNA, 22 bp, Homo sapiens
ttccaggcctgaagtcttctcc

SEQ ID NO: 3642709 - DNA, 21 bp, Homo sapiens
ttccagtaaggatttttatgt

SEQ ID NO: 3642710 - DNA, 19 bp, Homo sapiens
ttccataatctggactcct

SEQ ID NO: 3642711 - DNA, 22 bp, Homo sapiens
ttccataatctggactcctctg

SEQ ID NO: 3642712 - DNA, 14 bp, Homo sapiens
ttccatcaaagaga

SEQ ID NO: 3642713 - DNA, 23 bp, Homo sapiens
ttccatgcaactggagttcctta

SEQ ID NO: 3642714 - DNA, 20 bp, Homo sapiens
ttccatgtcgcctctgcatt

SEQ ID NO: 3642715 - DNA, 14 bp, Homo sapiens
ttccatgtgccttt

SEQ ID NO: 3642716 - DNA, 19 bp, Homo sapiens
ttccatgtgcctttctttg

SEQ ID NO: 3642717 - DNA, 13 bp, Homo sapiens
ttcccaacacaaa

SEQ ID NO: 3642718 - DNA, 19 bp, Homo sapiens
ttcccaacgtgcaaagcca

SEQ ID NO: 3642719 - DNA, 19 bp, Homo sapiens
ttcccaccattcctgcctt

SEQ ID NO: 3642720 - DNA, 12 bp, Homo sapiens
ttcccactccag

SEQ ID NO: 3642721 - DNA, 13 bp, Homo sapiens
ttcccactccagc

SEQ ID NO: 3642722 - DNA, 16 bp, Homo sapiens
ttcccactccagctga

SEQ ID NO: 3642723 - DNA, 12 bp, Homo sapiens
ttcccaggaccc

SEQ ID NO: 3642724 - DNA, 20 bp, Homo sapiens
ttcccaggaccctgaagggg

SEQ ID NO: 3642725 - DNA, 16 bp, Homo sapiens
ttcccagggctggaga

SEQ ID NO: 3642726 - DNA, 14 bp, Homo sapiens
ttcccatggccatt

SEQ ID NO: 3642727 - DNA, 13 bp, Homo sapiens
ttcccatttcttc

SEQ ID NO: 3642728 - DNA, 16 bp, Homo sapiens
ttccccagctccagca

SEQ ID NO: 3642729 - DNA, 18 bp, Homo sapiens
ttccccagtgactccagg

SEQ ID NO: 3642730 - DNA, 20 bp, Homo sapiens
ttccccagtgactccagggt

SEQ ID NO: 3642731 - DNA, 19 bp, Homo sapiens
ttcccccaggcgcctgcgc

SEQ ID NO: 3642732 - DNA, 19 bp, Homo sapiens
ttccccctccaatcccacc

SEQ ID NO: 3642733 - DNA, 13 bp, Homo sapiens
ttcccccttccca

SEQ ID NO: 3642734 - DNA, 14 bp, Homo sapiens
ttcccctcccacct

SEQ ID NO: 3642735 - DNA, 19 bp, Homo sapiens
ttcccctcccacctctcct

SEQ ID NO: 3642736 - DNA, 14 bp, Homo sapiens
ttcccctgttcact

SEQ ID NO: 3642737 - DNA, 17 bp, Homo sapiens
ttcccctgttcactcta

SEQ ID NO: 3642738 - DNA, 14 bp, Homo sapiens
ttccccttccctta

SEQ ID NO: 3642739 - DNA, 16 bp, Homo sapiens
ttccccttttgccaat

SEQ ID NO: 3642740 - DNA, 12 bp, Homo sapiens
ttcccgcctccc

SEQ ID NO: 3642741 - DNA, 15 bp, Homo sapiens
ttcccgctcagccct

SEQ ID NO: 3642742 - DNA, 18 bp, Homo sapiens
ttcccgctcagccctccc

SEQ ID NO: 3642743 - DNA, 12 bp, Homo sapiens
ttccctccattt

SEQ ID NO: 3642744 - DNA, 22 bp, Homo sapiens
ttccctcctgagtgccccactt

SEQ ID NO: 3642745 - DNA, 21 bp, Homo sapiens
ttccctcttgtccctttccct

SEQ ID NO: 3642746 - DNA, 19 bp, Homo sapiens
ttccctgccaggccctttg

SEQ ID NO: 3642747 - DNA, 18 bp, Homo sapiens
ttccctgctttgcatctt

SEQ ID NO: 3642748 - DNA, 20 bp, Homo sapiens
ttccctggaaaccttccacc

SEQ ID NO: 3642749 - DNA, 19 bp, Homo sapiens
ttccctggaactcctggcc

SEQ ID NO: 3642750 - DNA, 21 bp, Homo sapiens
ttccctggaactcctggcctt

SEQ ID NO: 3642751 - DNA, 11 bp, Homo sapiens
ttccctgggag

SEQ ID NO: 3642752 - DNA, 17 bp, Homo sapiens
ttcccttccggtgcgtg

SEQ ID NO: 3642753 - DNA, 16 bp, Homo sapiens
ttccgaagtctctgat

SEQ ID NO: 3642754 - DNA, 12 bp, Homo sapiens
ttccgctgaggg

SEQ ID NO: 3642755 - DNA, 22 bp, Homo sapiens
ttccgctttgaaagaagcaaga

SEQ ID NO: 3642756 - DNA, 13 bp, Homo sapiens
ttccgtaaatgtc

SEQ ID NO: 3642757 - DNA, 16 bp, Homo sapiens
ttccgtaaatgtctgc

SEQ ID NO: 3642758 - DNA, 15 bp, Homo sapiens
ttccgtcacttaaat

SEQ ID NO: 3642759 - DNA, 21 bp, Homo sapiens
ttccgtcacttaaatttgttc

SEQ ID NO: 3642760 - DNA, 18 bp, Homo sapiens
ttccgtgacgtcactgga

SEQ ID NO: 3642761 - DNA, 23 bp, Homo sapiens
ttcctaatcaaattctgtctggg

SEQ ID NO: 3642762 - DNA, 17 bp, Homo sapiens
ttcctaattgtgcccct

SEQ ID NO: 3642763 - DNA, 21 bp, Homo sapiens
ttcctaccacccggtccccac

SEQ ID NO: 3642764 - DNA, 14 bp, Homo sapiens
ttcctactcctcat

SEQ ID NO: 3642765 - DNA, 21 bp, Homo sapiens
ttcctactgcgcctcgtgctg

SEQ ID NO: 3642766 - DNA, 14 bp, Homo sapiens
ttcctagccctctc

SEQ ID NO: 3642767 - DNA, 16 bp, Homo sapiens
ttcctagctaggagca

SEQ ID NO: 3642768 - DNA, 21 bp, Homo sapiens
ttcctagctaggagcaggctt

SEQ ID NO: 3642769 - DNA, 12 bp, Homo sapiens
ttcctagtgaaa

SEQ ID NO: 3642770 - DNA, 15 bp, Homo sapiens
ttcctcagctgcctc

SEQ ID NO: 3642771 - DNA, 16 bp, Homo sapiens
ttcctccagcctcccc

SEQ ID NO: 3642772 - DNA, 20 bp, Homo sapiens
ttcctccagcctcccctccc

SEQ ID NO: 3642773 - DNA, 14 bp, Homo sapiens
ttcctccccctgca

SEQ ID NO: 3642774 - DNA, 17 bp, Homo sapiens
ttcctccccctgcaact

SEQ ID NO: 3642775 - DNA, 12 bp, Homo sapiens
ttcctcccttct

SEQ ID NO: 3642776 - DNA, 15 bp, Homo sapiens
ttcctcccttctgct

SEQ ID NO: 3642777 - DNA, 18 bp, Homo sapiens
ttcctcccttctgctact

SEQ ID NO: 3642778 - DNA, 16 bp, Homo sapiens
ttcctctccactgcct

SEQ ID NO: 3642779 - DNA, 14 bp, Homo sapiens
ttcctctccatacc

SEQ ID NO: 3642780 - DNA, 20 bp, Homo sapiens
ttcctctggctccccaaggc

SEQ ID NO: 3642781 - DNA, 15 bp, Homo sapiens
ttcctctttgctttg

SEQ ID NO: 3642782 - DNA, 16 bp, Homo sapiens
ttcctgaagaaccagt

SEQ ID NO: 3642783 - DNA, 16 bp, Homo sapiens
ttcctgaagctgctgt

SEQ ID NO: 3642784 - DNA, 17 bp, Homo sapiens
ttcctgcctttaagcca

SEQ ID NO: 3642785 - DNA, 19 bp, Homo sapiens
ttcctgcctttaagccaaa

SEQ ID NO: 3642786 - DNA, 11 bp, Homo sapiens
ttcctgctgca

SEQ ID NO: 3642787 - DNA, 22 bp, Homo sapiens
ttcctgctgcaccctgcgcctc

SEQ ID NO: 3642788 - DNA, 15 bp, Homo sapiens
ttcctgctgctgcta

SEQ ID NO: 3642789 - DNA, 11 bp, Homo sapiens
ttcctgctgta

SEQ ID NO: 3642790 - DNA, 19 bp, Homo sapiens
ttcctggcagctgctgtgg

SEQ ID NO: 3642791 - DNA, 19 bp, Homo sapiens
ttcctgggcacacgctgct

SEQ ID NO: 3642792 - DNA, 15 bp, Homo sapiens
ttcctgtccagctcc

SEQ ID NO: 3642793 - DNA, 18 bp, Homo sapiens
ttcctgtgcctttcctat

SEQ ID NO: 3642794 - DNA, 21 bp, Homo sapiens
ttcctgtttcagaccccccca

SEQ ID NO: 3642795 - DNA, 14 bp, Homo sapiens
ttccttatccctct

SEQ ID NO: 3642796 - DNA, 15 bp, Homo sapiens
ttccttatttgcctt

SEQ ID NO: 3642797 - DNA, 15 bp, Homo sapiens
ttccttcagatattt

SEQ ID NO: 3642798 - DNA, 21 bp, Homo sapiens
ttccttcaggcagctgaaatt

SEQ ID NO: 3642799 - DNA, 13 bp, Homo sapiens
ttccttctctggg

SEQ ID NO: 3642800 - DNA, 12 bp, Homo sapiens
ttccttcttccc

SEQ ID NO: 3642801 - DNA, 20 bp, Homo sapiens
ttccttggactcattttaaa

SEQ ID NO: 3642802 - DNA, 16 bp, Homo sapiens
ttccttgtcactggta

SEQ ID NO: 3642803 - DNA, 16 bp, Homo sapiens
ttcctttacaactaaa

SEQ ID NO: 3642804 - DNA, 19 bp, Homo sapiens
ttcctttattttgctgctt

SEQ ID NO: 3642805 - DNA, 12 bp, Homo sapiens
ttcctttcttga

SEQ ID NO: 3642806 - DNA, 14 bp, Homo sapiens
ttcctttgcatatt

SEQ ID NO: 3642807 - DNA, 12 bp, Homo sapiens
ttcctttgctag

SEQ ID NO: 3642808 - DNA, 21 bp, Homo sapiens
ttccttttagagttaagaact

SEQ ID NO: 3642809 - DNA, 12 bp, Homo sapiens
ttccttttcact

SEQ ID NO: 3642810 - DNA, 16 bp, Homo sapiens
ttccttttcactgctg

SEQ ID NO: 3642811 - DNA, 21 bp, Homo sapiens
ttccttttcaggagatgggga

SEQ ID NO: 3642812 - DNA, 16 bp, Homo sapiens
ttcgactggtccagct

SEQ ID NO: 3642813 - DNA, 21 bp, Homo sapiens
ttcgactggtccagctctgac

SEQ ID NO: 3642814 - DNA, 15 bp, Homo sapiens
ttcgagaccagcctg

SEQ ID NO: 3642815 - DNA, 20 bp, Homo sapiens
ttcgatacaccgggcctgga

SEQ ID NO: 3642816 - DNA, 23 bp, Homo sapiens
ttcggacatgcttttctgccact

SEQ ID NO: 3642817 - DNA, 12 bp, Homo sapiens
ttcgtctactgc

SEQ ID NO: 3642818 - DNA, 13 bp, Homo sapiens
ttctaaagatgga

SEQ ID NO: 3642819 - DNA, 15 bp, Homo sapiens
ttctaaattacaaag

SEQ ID NO: 3642820 - DNA, 16 bp, Homo sapiens
ttctaaattacaaagg

SEQ ID NO: 3642821 - DNA, 17 bp, Homo sapiens
ttctaaattacaaaggt

SEQ ID NO: 3642822 - DNA, 13 bp, Homo sapiens
tttaatgctgcct

SEQ ID NO: 3642823 - DNA, 14 bp, Homo sapiens
tttaatggcagcta

SEQ ID NO: 3642824 - DNA, 18 bp, Homo sapiens
tttaatgtactaatattt

SEQ ID NO: 3642825 - DNA, 21 bp, Homo sapiens
tttaattacaaacaataagaa

SEQ ID NO: 3642826 - DNA, 23 bp, Homo sapiens
tttaattacaaacaataagaaca

SEQ ID NO: 3642827 - DNA, 16 bp, Homo sapiens
tttaattactgctata

SEQ ID NO: 3642828 - DNA, 17 bp, Homo sapiens
tttaattgaaagaatgt

SEQ ID NO: 3642829 - DNA, 20 bp, Homo sapiens
tttaattgtccagtttgtct

SEQ ID NO: 3642830 - DNA, 22 bp, Homo sapiens
tttaatttatatcaggtgtata

SEQ ID NO: 3642831 - DNA, 23 bp, Homo sapiens
tttaatttgtaaaacttctgctc

SEQ ID NO: 3642832 - DNA, 16 bp, Homo sapiens
tttaatttttcctttt

SEQ ID NO: 3642833 - DNA, 14 bp, Homo sapiens
tttacagcaaaaga

SEQ ID NO: 3642834 - DNA, 15 bp, Homo sapiens
tttacagctgcctgc

SEQ ID NO: 3642835 - DNA, 16 bp, Homo sapiens
tttacagctgcctgca

SEQ ID NO: 3642836 - DNA, 15 bp, Homo sapiens
tttacagctgtgctc

SEQ ID NO: 3642837 - DNA, 20 bp, Homo sapiens
tttacagctgtgctccacac

SEQ ID NO: 3642838 - DNA, 17 bp, Homo sapiens
tttacagtgtttctggc

SEQ ID NO: 3642839 - DNA, 21 bp, Homo sapiens
tttacatgacagatattttat

SEQ ID NO: 3642840 - DNA, 10 bp, Homo sapiens
tttacatttc

SEQ ID NO: 3642841 - DNA, 13 bp, Homo sapiens
tttaccaaagcat

SEQ ID NO: 3642842 - DNA, 19 bp, Homo sapiens
tttacccacacacagataa

SEQ ID NO: 3642843 - DNA, 13 bp, Homo sapiens
tttacccttttcc

SEQ ID NO: 3642844 - DNA, 18 bp, Homo sapiens
tttacctattctgaaaaa

SEQ ID NO: 3642845 - DNA, 12 bp, Homo sapiens
tttacctggcct

SEQ ID NO: 3642846 - DNA, 14 bp, Homo sapiens
tttacgtagctatt

SEQ ID NO: 3642847 - DNA, 21 bp, Homo sapiens
tttacgtagctatttttatac

SEQ ID NO: 3642848 - DNA, 22 bp, Homo sapiens
tttactatttcaatacttacat

SEQ ID NO: 3642849 - DNA, 24 bp, Homo sapiens
tttactatttcaatacttacatat

SEQ ID NO: 3642850 - DNA, 17 bp, Homo sapiens
tttactccgtaacagat

SEQ ID NO: 3642851 - DNA, 11 bp, Homo sapiens
tttactcctgg

SEQ ID NO: 3642852 - DNA, 14 bp, Homo sapiens
tttactctttgaaa

SEQ ID NO: 3642853 - DNA, 14 bp, Homo sapiens
tttactgaagcctt

SEQ ID NO: 3642854 - DNA, 18 bp, Homo sapiens
tttactgatgagagaatg

SEQ ID NO: 3642855 - DNA, 16 bp, Homo sapiens
tttactttaaacttgt

SEQ ID NO: 3642856 - DNA, 18 bp, Homo sapiens
tttactttaaacttgtct

SEQ ID NO: 3642857 - DNA, 18 bp, Homo sapiens
tttacttttaaacagtga

SEQ ID NO: 3642858 - DNA, 22 bp, Homo sapiens
tttactttttttttattttatt

SEQ ID NO: 3642859 - DNA, 13 bp, Homo sapiens
tttagaaaaaaca

SEQ ID NO: 3642860 - DNA, 13 bp, Homo sapiens
tttagaaccagcc

SEQ ID NO: 3642861 - DNA, 17 bp, Homo sapiens
tttagaagattctatgt

SEQ ID NO: 3642862 - DNA, 22 bp, Homo sapiens
tttagaagccaactatgattat

SEQ ID NO: 3642863 - DNA, 23 bp, Homo sapiens
tttagacaaagccttaagcaaat

SEQ ID NO: 3642864 - DNA, 21 bp, Homo sapiens
tttagagaaaataaatttaac

SEQ ID NO: 3642865 - DNA, 17 bp, Homo sapiens
tttagagataattgctt

SEQ ID NO: 3642866 - DNA, 18 bp, Homo sapiens
tttagagataggaaactg

SEQ ID NO: 3642867 - DNA, 18 bp, Homo sapiens
tttagaggaacccaagat

SEQ ID NO: 3642868 - DNA, 14 bp, Homo sapiens
tttagatatttgcc

SEQ ID NO: 3642869 - DNA, 22 bp, Homo sapiens
tttagcttacctgggcacaaac

SEQ ID NO: 3642870 - DNA, 22 bp, Homo sapiens
tttaggaagttgacttatagta

SEQ ID NO: 3642871 - DNA, 17 bp, Homo sapiens
tttaggataaaataatg

SEQ ID NO: 3642872 - DNA, 22 bp, Homo sapiens
tttaggtgaattaattaaacat

SEQ ID NO: 3642873 - DNA, 13 bp, Homo sapiens
tttaggtgcttta

SEQ ID NO: 3642874 - DNA, 18 bp, Homo sapiens
tttagtcttgatgtggaa

SEQ ID NO: 3642875 - DNA, 13 bp, Homo sapiens
tttagtctttata

SEQ ID NO: 3642876 - DNA, 20 bp, Homo sapiens
tttagtggaagcttctaaat

SEQ ID NO: 3642877 - DNA, 18 bp, Homo sapiens
tttagtgtaaaattgtta

SEQ ID NO: 3642878 - DNA, 17 bp, Homo sapiens
tttagttatatatatgt

SEQ ID NO: 3642879 - DNA, 19 bp, Homo sapiens
tttataataaaaatatatt

SEQ ID NO: 3642880 - DNA, 14 bp, Homo sapiens
tttataatgaataa

SEQ ID NO: 3642881 - DNA, 19 bp, Homo sapiens
tttatacactgtaagcttt

SEQ ID NO: 3642882 - DNA, 14 bp, Homo sapiens
tttatagctttatt

SEQ ID NO: 3642883 - DNA, 18 bp, Homo sapiens
tttatatcaggtgtataa

SEQ ID NO: 3642884 - DNA, 18 bp, Homo sapiens
tttatatgccctcaagta

SEQ ID NO: 3642885 - DNA, 21 bp, Homo sapiens
tttatatggataatctgagca

SEQ ID NO: 3642886 - DNA, 16 bp, Homo sapiens
tttatatttattgtta

SEQ ID NO: 3642887 - DNA, 20 bp, Homo sapiens
tttatatttattgttagaaa

SEQ ID NO: 3642888 - DNA, 19 bp, Homo sapiens
tttatatttggggtccttt

SEQ ID NO: 3642889 - DNA, 15 bp, Homo sapiens
tttatcccatttagt

SEQ ID NO: 3642890 - DNA, 18 bp, Homo sapiens
tttatcctgaaatttcag

SEQ ID NO: 3642891 - DNA, 19 bp, Homo sapiens
tttatcctgaaatttcaga

SEQ ID NO: 3642892 - DNA, 20 bp, Homo sapiens
tttatctataatttacctaa

SEQ ID NO: 3642893 - DNA, 12 bp, Homo sapiens
tttatctccttg

SEQ ID NO: 3642894 - DNA, 13 bp, Homo sapiens
tttatctccttgt

SEQ ID NO: 3642895 - DNA, 23 bp, Homo sapiens
tttatctccttgtggcctatgaa

SEQ ID NO: 3642896 - DNA, 16 bp, Homo sapiens
tttatcttaatccatt

SEQ ID NO: 3642897 - DNA, 16 bp, Homo sapiens
tttatgcaaatacaat

SEQ ID NO: 3642898 - DNA, 18 bp, Homo sapiens
tttatgcaaggtcttgca

SEQ ID NO: 3642899 - DNA, 19 bp, Homo sapiens
tttatgctacctagtctcc

SEQ ID NO: 3642900 - DNA, 23 bp, Homo sapiens
tttatgctataaattttttgaaa

SEQ ID NO: 3642901 - DNA, 15 bp, Homo sapiens
tttatggttttcatt

SEQ ID NO: 3642902 - DNA, 12 bp, Homo sapiens
tttatgtacata

SEQ ID NO: 3642903 - DNA, 12 bp, Homo sapiens
tttatgtctttc

SEQ ID NO: 3642904 - DNA, 13 bp, Homo sapiens
tttatgtgaaatg

SEQ ID NO: 3642905 - DNA, 20 bp, Homo sapiens
tttatgtgaaatgctttctg

SEQ ID NO: 3642906 - DNA, 21 bp, Homo sapiens
tttatgtgaaatgctttctgt

SEQ ID NO: 3642907 - DNA, 12 bp, Homo sapiens
tttatgtgatgg

SEQ ID NO: 3642908 - DNA, 14 bp, Homo sapiens
tttatgtttttggt

SEQ ID NO: 3642909 - DNA, 19 bp, Homo sapiens
tttattaaaatatttcagg

SEQ ID NO: 3642910 - DNA, 20 bp, Homo sapiens
tttattaagcagtacaaatg

SEQ ID NO: 3642911 - DNA, 13 bp, Homo sapiens
tttattaatctta

SEQ ID NO: 3642912 - DNA, 14 bp, Homo sapiens
tttattataaactg

SEQ ID NO: 3642913 - DNA, 22 bp, Homo sapiens
tttattataaattctactaagt

SEQ ID NO: 3642914 - DNA, 22 bp, Homo sapiens
tttattccctgcccaaaccctt

SEQ ID NO: 3642915 - DNA, 22 bp, Homo sapiens
tttattgccaaaacccagctgc

SEQ ID NO: 3642916 - DNA, 12 bp, Homo sapiens
tttattgtaaaa

SEQ ID NO: 3642917 - DNA, 18 bp, Homo sapiens
tttattgtattttgatga

SEQ ID NO: 3642918 - DNA, 19 bp, Homo sapiens
tttattgtattttgatgag

SEQ ID NO: 3642919 - DNA, 22 bp, Homo sapiens
tttatttattaaacttcagcaa

SEQ ID NO: 3642920 - DNA, 13 bp, Homo sapiens
tttatttgaggtc

SEQ ID NO: 3642921 - DNA, 14 bp, Homo sapiens
tttatttgtaaagt

SEQ ID NO: 3642922 - DNA, 13 bp, Homo sapiens
tttatttgtatta

SEQ ID NO: 3642923 - DNA, 10 bp, Homo sapiens
tttattttct

SEQ ID NO: 3642924 - DNA, 16 bp, Homo sapiens
tttattttcttttgaa

SEQ ID NO: 3642925 - DNA, 18 bp, Homo sapiens
tttatttttttcccatga

SEQ ID NO: 3642926 - DNA, 21 bp, Homo sapiens
tttcaaaagccttaccttgaa

SEQ ID NO: 3642927 - DNA, 12 bp, Homo sapiens
tttcaaagcact

SEQ ID NO: 3642928 - DNA, 19 bp, Homo sapiens
tttcaaagcacttaagtgt

SEQ ID NO: 3642929 - DNA, 20 bp, Homo sapiens
tttcaaagcacttaagtgtt

SEQ ID NO: 3642930 - DNA, 18 bp, Homo sapiens
tttcaaattaatgttcca

SEQ ID NO: 3642931 - DNA, 19 bp, Homo sapiens
tttcaagaaactgaggaat

SEQ ID NO: 3642932 - DNA, 14 bp, Homo sapiens
tttcaatacttaca

SEQ ID NO: 3642933 - DNA, 21 bp, Homo sapiens
tttcaatacttacatatctga

SEQ ID NO: 3642934 - DNA, 12 bp, Homo sapiens
tttcaatatgca

SEQ ID NO: 3642935 - DNA, 13 bp, Homo sapiens
tttcaatatgcaa

SEQ ID NO: 3642936 - DNA, 13 bp, Homo sapiens
tttcaatctttta

SEQ ID NO: 3642937 - DNA, 21 bp, Homo sapiens
tttcaatcttttaaattgcaa

SEQ ID NO: 3642938 - DNA, 17 bp, Homo sapiens
tttcaattaaacggatt

SEQ ID NO: 3642939 - DNA, 19 bp, Homo sapiens
tttcaattaaacggattat

SEQ ID NO: 3642940 - DNA, 21 bp, Homo sapiens
tttcaattaaacggattattt

SEQ ID NO: 3642941 - DNA, 13 bp, Homo sapiens
tttcacactggat

SEQ ID NO: 3642942 - DNA, 21 bp, Homo sapiens
tttcacactggtaaatgttac

SEQ ID NO: 3642943 - DNA, 17 bp, Homo sapiens
tttcaccagatttgcta

SEQ ID NO: 3642944 - DNA, 19 bp, Homo sapiens
tttcacccatcctaggaac

SEQ ID NO: 3642945 - DNA, 23 bp, Homo sapiens
tttcacccatcctaggaaccagc

SEQ ID NO: 3642946 - DNA, 20 bp, Homo sapiens
tttcacctactaatgtctct

SEQ ID NO: 3642947 - DNA, 16 bp, Homo sapiens
tttcactagagacaaa

SEQ ID NO: 3642948 - DNA, 21 bp, Homo sapiens
tttcactagagacaaatcttt

SEQ ID NO: 3642949 - DNA, 14 bp, Homo sapiens
tttcactgctggct

SEQ ID NO: 3642950 - DNA, 24 bp, Homo sapiens
tttcactgctggctgccttagaac

SEQ ID NO: 3642951 - DNA, 12 bp, Homo sapiens
tttcacttctgt

SEQ ID NO: 3642952 - DNA, 11 bp, Homo sapiens
tttcagactcc

SEQ ID NO: 3642953 - DNA, 21 bp, Homo sapiens
tttcagactcccattcctgaa

SEQ ID NO: 3642954 - DNA, 16 bp, Homo sapiens
tttgagaccagcctgg

SEQ ID NO: 3642955 - DNA, 22 bp, Homo sapiens
tttgagctcagccccaactctt

SEQ ID NO: 3642956 - DNA, 20 bp, Homo sapiens
tttgaggaagtggctgtccc

SEQ ID NO: 3642957 - DNA, 21 bp, Homo sapiens
tttgaggaagtggctgtccct

SEQ ID NO: 3642958 - DNA, 20 bp, Homo sapiens
tttgatcgcctctttgacat

SEQ ID NO: 3642959 - DNA, 15 bp, Homo sapiens
tttgatgagttgtga

SEQ ID NO: 3642960 - DNA, 17 bp, Homo sapiens
tttgattatttaagact

SEQ ID NO: 3642961 - DNA, 11 bp, Homo sapiens
tttgattggct

SEQ ID NO: 3642962 - DNA, 13 bp, Homo sapiens
tttgattggcttt

SEQ ID NO: 3642963 - DNA, 18 bp, Homo sapiens
tttgcaaagtgtattagg

SEQ ID NO: 3642964 - DNA, 12 bp, Homo sapiens
tttgcacagctc

SEQ ID NO: 3642965 - DNA, 16 bp, Homo sapiens
tttgcacagctctccg

SEQ ID NO: 3642966 - DNA, 18 bp, Homo sapiens
tttgcactgaggatattc

SEQ ID NO: 3642967 - DNA, 12 bp, Homo sapiens
tttgcagaggct

SEQ ID NO: 3642968 - DNA, 21 bp, Homo sapiens
tttgcaggagtttgtggtaac

SEQ ID NO: 3642969 - DNA, 20 bp, Homo sapiens
tttgcatattttgagaaact

SEQ ID NO: 3642970 - DNA, 19 bp, Homo sapiens
tttgcattgaggaaatatt

SEQ ID NO: 3642971 - DNA, 23 bp, Homo sapiens
tttgcattgaggaaatattaatt

SEQ ID NO: 3642972 - DNA, 12 bp, Homo sapiens
tttgccaataaa

SEQ ID NO: 3642973 - DNA, 23 bp, Homo sapiens
tttgccaataaagcttttggaag

SEQ ID NO: 3642974 - DNA, 17 bp, Homo sapiens
tttgccagcccatttgg

SEQ ID NO: 3642975 - DNA, 19 bp, Homo sapiens
tttgccagttttccctgga

SEQ ID NO: 3642976 - DNA, 14 bp, Homo sapiens
tttgcccacccctc

SEQ ID NO: 3642977 - DNA, 11 bp, Homo sapiens
tttgcctctgt

SEQ ID NO: 3642978 - DNA, 15 bp, Homo sapiens
tttgcctcttctttg

SEQ ID NO: 3642979 - DNA, 15 bp, Homo sapiens
tttgccttctactcc

SEQ ID NO: 3642980 - DNA, 22 bp, Homo sapiens
tttgccttctactccccttaat

SEQ ID NO: 3642981 - DNA, 15 bp, Homo sapiens
tttgcgcctcggtat

SEQ ID NO: 3642982 - DNA, 15 bp, Homo sapiens
tttgctaactgggtt

SEQ ID NO: 3642983 - DNA, 16 bp, Homo sapiens
tttgctaactgggtta

SEQ ID NO: 3642984 - DNA, 21 bp, Homo sapiens
tttgctaactgggttaaatat

SEQ ID NO: 3642985 - DNA, 13 bp, Homo sapiens
tttgctaactggt

SEQ ID NO: 3642986 - DNA, 17 bp, Homo sapiens
tttgctaactggttaaa

SEQ ID NO: 3642987 - DNA, 21 bp, Homo sapiens
tttgctctaccaaatagtgat

SEQ ID NO: 3642988 - DNA, 15 bp, Homo sapiens
tttgctgaattcctt

SEQ ID NO: 3642989 - DNA, 19 bp, Homo sapiens
tttgctgaattcctttaca

SEQ ID NO: 3642990 - DNA, 13 bp, Homo sapiens
tttgctgcccctg

SEQ ID NO: 3642991 - DNA, 18 bp, Homo sapiens
tttgctgtgctttggaac

SEQ ID NO: 3642992 - DNA, 15 bp, Homo sapiens
tttgcttcaaaaaca

SEQ ID NO: 3642993 - DNA, 22 bp, Homo sapiens
tttgcttgcaatctaatctgaa

SEQ ID NO: 3642994 - DNA, 15 bp, Homo sapiens
tttgctttctgctca

SEQ ID NO: 3642995 - DNA, 23 bp, Homo sapiens
tttggaatattccactatttgca

SEQ ID NO: 3642996 - DNA, 11 bp, Homo sapiens
tttggaatgtg

SEQ ID NO: 3642997 - DNA, 13 bp, Homo sapiens
tttggacagctga

SEQ ID NO: 3642998 - DNA, 12 bp, Homo sapiens
tttggacagtgg

SEQ ID NO: 3642999 - DNA, 13 bp, Homo sapiens
tttggacagtggc

SEQ ID NO: 3643000 - DNA, 20 bp, Homo sapiens
tttggatagtctcctacgca

SEQ ID NO: 3643001 - DNA, 22 bp, Homo sapiens
tttggcctggggtgcatctcct

SEQ ID NO: 3643002 - DNA, 16 bp, Homo sapiens
tttggctagtccttgt

SEQ ID NO: 3643003 - DNA, 19 bp, Homo sapiens
tttggctggtagcagcagg

SEQ ID NO: 3643004 - DNA, 12 bp, Homo sapiens
tttgggaagaat

SEQ ID NO: 3643005 - DNA, 21 bp, Homo sapiens
tttgggaagaatccagtatta

SEQ ID NO: 3643006 - DNA, 18 bp, Homo sapiens
tttgggaagtttgctgtg

SEQ ID NO: 3643007 - DNA, 16 bp, Homo sapiens
tttgggagccaggact

SEQ ID NO: 3643008 - DNA, 18 bp, Homo sapiens
tttgggggtaaagtttgc

SEQ ID NO: 3643009 - DNA, 19 bp, Homo sapiens
tttgggggtcagcatccag

SEQ ID NO: 3643010 - DNA, 16 bp, Homo sapiens
tttgggttctgcctgc

SEQ ID NO: 3643011 - DNA, 11 bp, Homo sapiens
tttggtcaaat

SEQ ID NO: 3643012 - DNA, 16 bp, Homo sapiens
tttggttattggtttt

SEQ ID NO: 3643013 - DNA, 19 bp, Homo sapiens
tttggtttgccttttatgt

SEQ ID NO: 3643014 - DNA, 14 bp, Homo sapiens
tttgtaaaaatgag

SEQ ID NO: 3643015 - DNA, 17 bp, Homo sapiens
tttgtaaatgaaactta

SEQ ID NO: 3643016 - DNA, 17 bp, Homo sapiens
tttgtaaatttatgtga

SEQ ID NO: 3643017 - DNA, 23 bp, Homo sapiens
tttgtaactgtttagatgaatgt

SEQ ID NO: 3643018 - DNA, 13 bp, Homo sapiens
tttgtaattgctt

SEQ ID NO: 3643019 - DNA, 19 bp, Homo sapiens
tttgtacatagttatttat

SEQ ID NO: 3643020 - DNA, 15 bp, Homo sapiens
tttgtagaaattaaa

SEQ ID NO: 3643021 - DNA, 15 bp, Homo sapiens
tttgtagtagcgttt

SEQ ID NO: 3643022 - DNA, 19 bp, Homo sapiens
tttgtagttactcaagcag

SEQ ID NO: 3643023 - DNA, 19 bp, Homo sapiens
tttgtagttttatttgtat

SEQ ID NO: 3643024 - DNA, 17 bp, Homo sapiens
tttgtatcttaaatttg

SEQ ID NO: 3643025 - DNA, 22 bp, Homo sapiens
tttgtatcttttatcctgggag

SEQ ID NO: 3643026 - DNA, 16 bp, Homo sapiens
tttgtatgcactttgt

SEQ ID NO: 3643027 - DNA, 18 bp, Homo sapiens
tttgtatttattaatttg

SEQ ID NO: 3643028 - DNA, 22 bp, Homo sapiens
tttgtattttacatgggccagt

SEQ ID NO: 3643029 - DNA, 14 bp, Homo sapiens
tttgtcactttttc

SEQ ID NO: 3643030 - DNA, 17 bp, Homo sapiens
tttgtcattcagttcta

SEQ ID NO: 3643031 - DNA, 21 bp, Homo sapiens
tttgtcttttaatccatttca

SEQ ID NO: 3643032 - DNA, 16 bp, Homo sapiens
tttgtgcctttggcct

SEQ ID NO: 3643033 - DNA, 12 bp, Homo sapiens
tttgtgcttttt

SEQ ID NO: 3643034 - DNA, 11 bp, Homo sapiens
tttgtggccaa

SEQ ID NO: 3643035 - DNA, 14 bp, Homo sapiens
tttgtgtattaaat

SEQ ID NO: 3643036 - DNA, 15 bp, Homo sapiens
tttgtgtattaaatg

SEQ ID NO: 3643037 - DNA, 14 bp, Homo sapiens
tttgttagcaaaga

SEQ ID NO: 3643038 - DNA, 15 bp, Homo sapiens
tttgttgctttctta

SEQ ID NO: 3643039 - DNA, 15 bp, Homo sapiens
tttgttttaaccaat

SEQ ID NO: 3643040 - DNA, 15 bp, Homo sapiens
tttgttttagaacca

SEQ ID NO: 3643041 - DNA, 21 bp, Homo sapiens
tttgttttagaagattctatg

SEQ ID NO: 3643042 - DNA, 18 bp, Homo sapiens
tttgttttcggcagcctt

SEQ ID NO: 3643043 - DNA, 17 bp, Homo sapiens
ttttaaaaaggtaaatg

SEQ ID NO: 3643044 - DNA, 23 bp, Homo sapiens
ttttaaaaatgtcctgcctttta

SEQ ID NO: 3643045 - DNA, 22 bp, Homo sapiens
ttttaaaacacttccataatct

SEQ ID NO: 3643046 - DNA, 16 bp, Homo sapiens
ttttaaaatcaactta

SEQ ID NO: 3643047 - DNA, 17 bp, Homo sapiens
ttttaaaatttgtctta

SEQ ID NO: 3643048 - DNA, 15 bp, Homo sapiens
ttttaaagaatgtta

SEQ ID NO: 3643049 - DNA, 21 bp, Homo sapiens
ttttaaagacctgacaccttt

SEQ ID NO: 3643050 - DNA, 15 bp, Homo sapiens
ttttaaataaaagca

SEQ ID NO: 3643051 - DNA, 16 bp, Homo sapiens
ttttaaataaaagcac

SEQ ID NO: 3643052 - DNA, 17 bp, Homo sapiens
ttttaaataaaagcaca

SEQ ID NO: 3643053 - DNA, 19 bp, Homo sapiens
ttttaaatgcataaatgca

SEQ ID NO: 3643054 - DNA, 16 bp, Homo sapiens
ttttaaccaataacta

SEQ ID NO: 3643055 - DNA, 18 bp, Homo sapiens
ttttaagaaaaaataaaa

SEQ ID NO: 3643056 - DNA, 18 bp, Homo sapiens
ttttaagaaagaaatact

SEQ ID NO: 3643057 - DNA, 23 bp, Homo sapiens
ttttaagaaagtaatttaatttg

SEQ ID NO: 3643058 - DNA, 13 bp, Homo sapiens
ttttaataaacta

SEQ ID NO: 3643059 - DNA, 19 bp, Homo sapiens
ttttaataaactgcagggt

SEQ ID NO: 3643060 - DNA, 22 bp, Homo sapiens
ttttaatccatttcaggactct

SEQ ID NO: 3643061 - DNA, 21 bp, Homo sapiens
ttttaatcctgtaccaaatct

SEQ ID NO: 3643062 - DNA, 21 bp, Homo sapiens
ttttaatctctaacagtggac

SEQ ID NO: 3643063 - DNA, 20 bp, Homo sapiens
ttttaatgtcatttgttaaa

SEQ ID NO: 3643064 - DNA, 12 bp, Homo sapiens
ttttaattaaaa

SEQ ID NO: 3643065 - DNA, 23 bp, Homo sapiens
ttttaattaaaattggtaaaaat

SEQ ID NO: 3643066 - DNA, 19 bp, Homo sapiens
ttttaattcacgtgctttg

SEQ ID NO: 3643067 - DNA, 18 bp, Homo sapiens
ttttaattttcagttcta

SEQ ID NO: 3643068 - DNA, 18 bp, Homo sapiens
ttttacaagtataacagt

SEQ ID NO: 3643069 - DNA, 20 bp, Homo sapiens
ttttacaagtataacagttt

SEQ ID NO: 3643070 - DNA, 17 bp, Homo sapiens
ttttacatgtttccatc

SEQ ID NO: 3643071 - DNA, 16 bp, Homo sapiens
ttttaccaaagcatca

SEQ ID NO: 3643072 - DNA, 19 bp, Homo sapiens
ttttacctagctaattatt

SEQ ID NO: 3643073 - DNA, 15 bp, Homo sapiens
ttttacctattctga

SEQ ID NO: 3643074 - DNA, 13 bp, Homo sapiens
ttttactgccctt

SEQ ID NO: 3643075 - DNA, 19 bp, Homo sapiens
ttttagaaactacaaatat

SEQ ID NO: 3643076 - DNA, 17 bp, Homo sapiens
ttttagaatgtcaataa

SEQ ID NO: 3643077 - DNA, 20 bp, Homo sapiens
ttttagaatgttgaaaagta

SEQ ID NO: 3643078 - DNA, 12 bp, Homo sapiens
ttttagagaaaa

SEQ ID NO: 3643079 - DNA, 15 bp, Homo sapiens
ttttagcatttgtat

SEQ ID NO: 3643080 - DNA, 16 bp, Homo sapiens
ttttagcatttgtata

SEQ ID NO: 3643081 - DNA, 23 bp, Homo sapiens
ttttaggtcaaacccaagttagt

SEQ ID NO: 3643082 - DNA, 19 bp, Homo sapiens
ttttagtgtaaaattgtta

SEQ ID NO: 3643083 - DNA, 20 bp, Homo sapiens
ttttagtgtaaaattgttaa

SEQ ID NO: 3643084 - DNA, 15 bp, Homo sapiens
ttttagttatatata

SEQ ID NO: 3643085 - DNA, 14 bp, Homo sapiens
ttttatagaaaacc

SEQ ID NO: 3643086 - DNA, 20 bp, Homo sapiens
ttttatatatataaagtcag

SEQ ID NO: 3643087 - DNA, 12 bp, Homo sapiens
aaaaaaaacaaa

SEQ ID NO: 3643088 - DNA, 14 bp, Homo sapiens
aaaaacatggcctt

SEQ ID NO: 3643089 - DNA, 16 bp, Homo sapiens
aaacatggcctttgct

SEQ ID NO: 3643090 - DNA, 22 bp, Homo sapiens
aaacattagttctatttctatc

SEQ ID NO: 3643091 - DNA, 15 bp, Homo sapiens
aaacttgttagaaat

SEQ ID NO: 3643092 - DNA, 21 bp, Homo sapiens
aaatacgccagaactgcttta

SEQ ID NO: 3643093 - DNA, 19 bp, Homo sapiens
aaatcctaccaacctctga

SEQ ID NO: 3643094 - DNA, 19 bp, Homo sapiens
aaatgctgtaactttctga

SEQ ID NO: 3643095 - DNA, 17 bp, Homo sapiens
aaatgtaagaatcattg

SEQ ID NO: 3643096 - DNA, 21 bp, Homo sapiens
aactgtcaaagaatcaatcca

SEQ ID NO: 3643097 - DNA, 13 bp, Homo sapiens
aagaagaaaacac

SEQ ID NO: 3643098 - DNA, 22 bp, Homo sapiens
aagaatcattgtaaacattagt

SEQ ID NO: 3643099 - DNA, 23 bp, Homo sapiens
aagacagatactcctccaaggtt

SEQ ID NO: 3643100 - DNA, 20 bp, Homo sapiens
aagcctgagtttgctttcaa

SEQ ID NO: 3643101 - DNA, 23 bp, Homo sapiens
aagtttataagaggatgaagtga

SEQ ID NO: 3643102 - DNA, 20 bp, Homo sapiens
aatacgccagaactgcttta

SEQ ID NO: 3643103 - DNA, 19 bp, Homo sapiens
aatatttgtcgatatttcc

SEQ ID NO: 3643104 - DNA, 20 bp, Homo sapiens
aatcattgtaaacattagtt

SEQ ID NO: 3643105 - DNA, 18 bp, Homo sapiens
aatccagcggttctcaaa

SEQ ID NO: 3643106 - DNA, 21 bp, Homo sapiens
aatctcttctaaaaaaaaaca

SEQ ID NO: 3643107 - DNA, 23 bp, Homo sapiens
aatgtaagaatcattgtaaacat

SEQ ID NO: 3643108 - DNA, 19 bp, Homo sapiens
acagactattgacatcagc

SEQ ID NO: 3643109 - DNA, 16 bp, Homo sapiens
acatagtgaaagttta

SEQ ID NO: 3643110 - DNA, 20 bp, Homo sapiens
acatgcttcatgaaaatcct

SEQ ID NO: 3643111 - DNA, 14 bp, Homo sapiens
acatggcctttgct

SEQ ID NO: 3643112 - DNA, 17 bp, Homo sapiens
accttcagatcctaccc

SEQ ID NO: 3643113 - DNA, 23 bp, Homo sapiens
actagtaccttcagatcctaccc

SEQ ID NO: 3643114 - DNA, 12 bp, Homo sapiens
actattgacatc

SEQ ID NO: 3643115 - DNA, 20 bp, Homo sapiens
actgtcaaagaatcaatcca

SEQ ID NO: 3643116 - DNA, 21 bp, Homo sapiens
acttcaaaaactgtcaaagaa

SEQ ID NO: 3643117 - DNA, 16 bp, Homo sapiens
agactattgacatcag

SEQ ID NO: 3643118 - DNA, 20 bp, Homo sapiens
agacttgctgaatcggaatc

SEQ ID NO: 3643119 - DNA, 15 bp, Homo sapiens
agcagcggacttcaa

SEQ ID NO: 3643120 - DNA, 20 bp, Homo sapiens
agctccagtggaagaagaaa

SEQ ID NO: 3643121 - DNA, 18 bp, Homo sapiens
agctgcatacagtttgca

SEQ ID NO: 3643122 - DNA, 14 bp, Homo sapiens
aggcaatcacatag

SEQ ID NO: 3643123 - DNA, 16 bp, Homo sapiens
agtaccttcagatcct

SEQ ID NO: 3643124 - DNA, 16 bp, Homo sapiens
agtggaagaagaaaac

SEQ ID NO: 3643125 - DNA, 15 bp, Homo sapiens
atagcaacatgcttc

SEQ ID NO: 3643126 - DNA, 20 bp, Homo sapiens
atatttgtcgatatttccat

SEQ ID NO: 3643127 - DNA, 16 bp, Homo sapiens
atcattgtaaacatta

SEQ ID NO: 3643128 - DNA, 20 bp, Homo sapiens
atcccacggaaaatgccaat

SEQ ID NO: 3643129 - DNA, 15 bp, Homo sapiens
atcctaccaacctct

SEQ ID NO: 3643130 - DNA, 17 bp, Homo sapiens
atgaaaatcctaccaac

SEQ ID NO: 3643131 - DNA, 17 bp, Homo sapiens
atgatgttgaatatttg

SEQ ID NO: 3643132 - DNA, 18 bp, Homo sapiens
atgatgttgaatatttgt

SEQ ID NO: 3643133 - DNA, 22 bp, Homo sapiens
atgctgtaactttctgaaataa

SEQ ID NO: 3643134 - DNA, 18 bp, Homo sapiens
atgcttcatgaaaatcct

SEQ ID NO: 3643135 - DNA, 13 bp, Homo sapiens
atgtaagaatcat

SEQ ID NO: 3643136 - DNA, 16 bp, Homo sapiens
attaaatttttcctta

SEQ ID NO: 3643137 - DNA, 23 bp, Homo sapiens
attctcaagccgcatcccagact

SEQ ID NO: 3643138 - DNA, 11 bp, Homo sapiens
atttttcttcc

SEQ ID NO: 3643139 - DNA, 23 bp, Homo sapiens
cacagactattgacatcagcatc

SEQ ID NO: 3643140 - DNA, 12 bp, Homo sapiens
cagatcctaccc

SEQ ID NO: 3643141 - DNA, 16 bp, Homo sapiens
catacagtttgcactt

SEQ ID NO: 3643142 - DNA, 16 bp, Homo sapiens
catgaaaatcctacca

SEQ ID NO: 3643143 - DNA, 12 bp, Homo sapiens
catgaagacaga

SEQ ID NO: 3643144 - DNA, 17 bp, Homo sapiens
ccaagtaaatagcaaca

SEQ ID NO: 3643145 - DNA, 20 bp, Homo sapiens
ccacggaaaatgccaatctc

SEQ ID NO: 3643146 - DNA, 22 bp, Homo sapiens
cccacggaaaatgccaatctct

SEQ ID NO: 3643147 - DNA, 23 bp, Homo sapiens
cccagacttgctgaatcggaatc

SEQ ID NO: 3643148 - DNA, 14 bp, Homo sapiens
ccttcagatcctac

SEQ ID NO: 3643149 - DNA, 12 bp, Homo sapiens
cgaaagaacagt

SEQ ID NO: 3643150 - DNA, 21 bp, Homo sapiens
cgaaagaacagtccattgaaa

SEQ ID NO: 3643151 - DNA, 17 bp, Homo sapiens
ctaaatgtaagaatcat

SEQ ID NO: 3643152 - DNA, 22 bp, Homo sapiens
ctattgacatcagcatcaccta

SEQ ID NO: 3643153 - DNA, 17 bp, Homo sapiens
ctgaagttcagctgcat

SEQ ID NO: 3643154 - DNA, 16 bp, Homo sapiens
ctggggccgaaagaac

SEQ ID NO: 3643155 - DNA, 23 bp, Homo sapiens
cttaacaaaccctcgtttctgat

SEQ ID NO: 3643156 - DNA, 17 bp, Homo sapiens
cttagctgccaagtaaa

SEQ ID NO: 3643157 - DNA, 21 bp, Homo sapiens
cttcaaaaactgtcaaagaat

SEQ ID NO: 3643158 - DNA, 20 bp, Homo sapiens
gaaacttgttagaaatgcaa

SEQ ID NO: 3643159 - DNA, 21 bp, Homo sapiens
gaactgctttatcccacggaa

SEQ ID NO: 3643160 - DNA, 20 bp, Homo sapiens
gaatcattgtaaacattagt

SEQ ID NO: 3643161 - DNA, 18 bp, Homo sapiens
gataatcttagctgccaa

SEQ ID NO: 3643162 - DNA, 16 bp, Homo sapiens
gatatttccatcatta

SEQ ID NO: 3643163 - DNA, 17 bp, Homo sapiens
gatatttccatcattaa

SEQ ID NO: 3643164 - DNA, 12 bp, Homo sapiens
gcaaattctcaa

SEQ ID NO: 3643165 - DNA, 18 bp, Homo sapiens
gttctatttctatcccaa

SEQ ID NO: 3643166 - DNA, 22 bp, Homo sapiens
gttctcaaacggtacacagact

SEQ ID NO: 3643167 - DNA, 20 bp, Homo sapiens
taaagcctgagtttgctttc

SEQ ID NO: 3643168 - DNA, 14 bp, Homo sapiens
taaatttttcctta

SEQ ID NO: 3643169 - DNA, 23 bp, Homo sapiens
taacaaaccctcgtttctgatta

SEQ ID NO: 3643170 - DNA, 18 bp, Homo sapiens
taagagaagctactttgt

SEQ ID NO: 3643171 - DNA, 15 bp, Homo sapiens
taagaggatgaagtg

SEQ ID NO: 3643172 - DNA, 21 bp, Homo sapiens
tacacagactattgacatcag

SEQ ID NO: 3643173 - DNA, 22 bp, Homo sapiens
tagctggtcttatttgtaaagc

SEQ ID NO: 3643174 - DNA, 16 bp, Homo sapiens
tatcccacggaaaatg

SEQ ID NO: 3643175 - DNA, 19 bp, Homo sapiens
tcaatccagcggttctcaa

SEQ ID NO: 3643176 - DNA, 16 bp, Homo sapiens
tcacatagtgaaagtt

SEQ ID NO: 3643177 - DNA, 12 bp, Homo sapiens
tcagatcctacc

SEQ ID NO: 3643178 - DNA, 20 bp, Homo sapiens
tcccacggaaaatgccaatc

SEQ ID NO: 3643179 - DNA, 23 bp, Homo sapiens
tcccacggaaaatgccaatctct

SEQ ID NO: 3643180 - DNA, 19 bp, Homo sapiens
tcgatatttccatcattaa

SEQ ID NO: 3643181 - DNA, 20 bp, Homo sapiens
tctcaaacggtacacagact

SEQ ID NO: 3643182 - DNA, 19 bp, Homo sapiens
tcttaggcaatcacatagt

SEQ ID NO: 3643183 - DNA, 13 bp, Homo sapiens
tgaaaatcctacc

SEQ ID NO: 3643184 - DNA, 23 bp, Homo sapiens
tgaaagggagtattacaaaaaca

SEQ ID NO: 3643185 - DNA, 17 bp, Homo sapiens
tgaaataacatggcctt

SEQ ID NO: 3643186 - DNA, 20 bp, Homo sapiens
tgaagtgatatggtgagcag

SEQ ID NO: 3643187 - DNA, 14 bp, Homo sapiens
tgacatcagcatca

SEQ ID NO: 3643188 - DNA, 19 bp, Homo sapiens
tgctgaatcggaatctctg

SEQ ID NO: 3643189 - DNA, 18 bp, Homo sapiens
tgcttcatgaaaatccta

SEQ ID NO: 3643190 - DNA, 15 bp, Homo sapiens
tgtaagaatcattgt

SEQ ID NO: 3643191 - DNA, 16 bp, Homo sapiens
ttcatgaaaatcctac

SEQ ID NO: 3643192 - DNA, 17 bp, Homo sapiens
ttcatgaaaatcctacc

SEQ ID NO: 3643193 - DNA, 22 bp, Homo sapiens
tttgctggggccgaaagaacag

SEQ ID NO: 3643194 - DNA, 20 bp, Homo sapiens
tttttaaatgatgttgaata

SEQ ID NO: 3643195 - DNA, 10 bp, Homo sapiens
aaaacaaaat

SEQ ID NO: 3643196 - DNA, 15 bp, Homo sapiens
aaaatgccaatctct

SEQ ID NO: 3643197 - DNA, 17 bp, Homo sapiens
aaacatggcctttgctt

SEQ ID NO: 3643198 - DNA, 23 bp, Homo sapiens
aaaccctcgtttctgattaatgc

SEQ ID NO: 3643199 - DNA, 17 bp, Homo sapiens
aaactgtcaaagaatca

SEQ ID NO: 3643200 - DNA, 18 bp, Homo sapiens
aaatagcaacatgcttca

SEQ ID NO: 3643201 - DNA, 14 bp, Homo sapiens
aaatgccaatctct

SEQ ID NO: 3643202 - DNA, 21 bp, Homo sapiens
aacaaaccctcgtttctgatt

SEQ ID NO: 3643203 - DNA, 18 bp, Homo sapiens
aacagtccattgaaaggg

SEQ ID NO: 3643204 - DNA, 16 bp, Homo sapiens
aacatgcttcatgaaa

SEQ ID NO: 3643205 - DNA, 22 bp, Homo sapiens
aacggtacacagactattgaca

SEQ ID NO: 3643206 - DNA, 22 bp, Homo sapiens
aatatttgtcgatatttccatc

SEQ ID NO: 3643207 - DNA, 22 bp, Homo sapiens
aatcaatccagcggttctcaaa

SEQ ID NO: 3643208 - DNA, 16 bp, Homo sapiens
aatcttagctgccaag

SEQ ID NO: 3643209 - DNA, 14 bp, Homo sapiens
aatgatgttgaata

SEQ ID NO: 3643210 - DNA, 14 bp, Homo sapiens
aatgcaaattctca

SEQ ID NO: 3643211 - DNA, 16 bp, Homo sapiens
acacagactattgaca

SEQ ID NO: 3643212 - DNA, 20 bp, Homo sapiens
acacagactattgacatcag

SEQ ID NO: 3643213 - DNA, 21 bp, Homo sapiens
acatgcttcatgaaaatccta

SEQ ID NO: 3643214 - DNA, 15 bp, Homo sapiens
accttcagatcctac

SEQ ID NO: 3643215 - DNA, 17 bp, Homo sapiens
actattgacatcagcat

SEQ ID NO: 3643216 - DNA, 16 bp, Homo sapiens
acttcaaaaactgtca

SEQ ID NO: 3643217 - DNA, 15 bp, Homo sapiens
agaaaataccaagga

SEQ ID NO: 3643218 - DNA, 18 bp, Homo sapiens
agaaatgcaaattctcaa

SEQ ID NO: 3643219 - DNA, 19 bp, Homo sapiens
agaattagtggcacttgct

SEQ ID NO: 3643220 - DNA, 15 bp, Homo sapiens
agacagatactcctc

SEQ ID NO: 3643221 - DNA, 21 bp, Homo sapiens
agacagatactcctccaaggt

SEQ ID NO: 3643222 - DNA, 22 bp, Homo sapiens
agacagatactcctccaaggtt

SEQ ID NO: 3643223 - DNA, 15 bp, Homo sapiens
agatcctacccctga

SEQ ID NO: 3643224 - DNA, 18 bp, Homo sapiens
agcatcacctagaaactt

SEQ ID NO: 3643225 - DNA, 14 bp, Homo sapiens
agctccagtggaag

SEQ ID NO: 3643226 - DNA, 22 bp, Homo sapiens
agttctatttctatcccaaact

SEQ ID NO: 3643227 - DNA, 22 bp, Homo sapiens
atagctggtcttatttgtaaag

SEQ ID NO: 3643228 - DNA, 20 bp, Homo sapiens
atcaatccagcggttctcaa

SEQ ID NO: 3643229 - DNA, 17 bp, Homo sapiens
atcacatagtgaaagtt

SEQ ID NO: 3643230 - DNA, 15 bp, Homo sapiens
atcacctagaaactt

SEQ ID NO: 3643231 - DNA, 23 bp, Homo sapiens
atcattaaatttttccttagcat

SEQ ID NO: 3643232 - DNA, 16 bp, Homo sapiens
atcttagctgccaagt

SEQ ID NO: 3643233 - DNA, 21 bp, Homo sapiens
atgctaaatgtaagaatcatt

SEQ ID NO: 3643234 - DNA, 15 bp, Homo sapiens
atgcttcatgaaaat

SEQ ID NO: 3643235 - DNA, 21 bp, Homo sapiens
atgcttcatgaaaatcctacc

SEQ ID NO: 3643236 - DNA, 22 bp, Homo sapiens
atgcttcatgaaaatcctacca

SEQ ID NO: 3643237 - DNA, 15 bp, Homo sapiens
atggtgagcagcgga

SEQ ID NO: 3643238 - DNA, 15 bp, Homo sapiens
atgtaagaatcattg

SEQ ID NO: 3643239 - DNA, 12 bp, Homo sapiens
atgttgaatatt

SEQ ID NO: 3643240 - DNA, 13 bp, Homo sapiens
attaaatttttcc

SEQ ID NO: 3643241 - DNA, 17 bp, Homo sapiens
attagttctatttctat

SEQ ID NO: 3643242 - DNA, 20 bp, Homo sapiens
attctcaagccgcatcccag

SEQ ID NO: 3643243 - DNA, 17 bp, Homo sapiens
attgacatcagcatcac

SEQ ID NO: 3643244 - DNA, 22 bp, Homo sapiens
attgacatcagcatcacctaga

SEQ ID NO: 3643245 - DNA, 18 bp, Homo sapiens
atttgtcgatatttccat

SEQ ID NO: 3643246 - DNA, 17 bp, Homo sapiens
caatccagcggttctca

SEQ ID NO: 3643247 - DNA, 13 bp, Homo sapiens
cagaactgcttta

SEQ ID NO: 3643248 - DNA, 15 bp, Homo sapiens
catcattaaattttt

SEQ ID NO: 3643249 - DNA, 23 bp, Homo sapiens
catgcttcatgaaaatcctacca

SEQ ID NO: 3643250 - DNA, 21 bp, Homo sapiens
cattaaagcctgagtttgctt

SEQ ID NO: 3643251 - DNA, 13 bp, Homo sapiens
cctaccaacctct

SEQ ID NO: 3643252 - DNA, 14 bp, Homo sapiens
cctaccaacctctg

SEQ ID NO: 3643253 - DNA, 20 bp, Homo sapiens
ccttcagatcctacccctga

SEQ ID NO: 3643254 - DNA, 23 bp, Homo sapiens
cgccagaactgctttatcccacg

SEQ ID NO: 3643255 - DNA, 22 bp, Homo sapiens
ctaaatgtaagaatcattgtaa

SEQ ID NO: 3643256 - DNA, 16 bp, Homo sapiens
ctaatgagaagtcaac

SEQ ID NO: 3643257 - DNA, 15 bp, Homo sapiens
ctgtcaaagaatcaa

SEQ ID NO: 3643258 - DNA, 14 bp, Homo sapiens
cttcagatcctacc

SEQ ID NO: 3643259 - DNA, 15 bp, Homo sapiens
cttcagatcctaccc

SEQ ID NO: 3643260 - DNA, 16 bp, Homo sapiens
cttcagatcctacccc

SEQ ID NO: 3643261 - DNA, 17 bp, Homo sapiens
cttcatgaaaatcctac

SEQ ID NO: 3643262 - DNA, 18 bp, Homo sapiens
cttcatgaaaatcctacc

SEQ ID NO: 3643263 - DNA, 20 bp, Homo sapiens
cttgctgaatcggaatctct

SEQ ID NO: 3643264 - DNA, 23 bp, Homo sapiens
cttggagggcatgaagacagata

SEQ ID NO: 3643265 - DNA, 13 bp, Homo sapiens
gaaaatcctacca

SEQ ID NO: 3643266 - DNA, 21 bp, Homo sapiens
gaaagaaaataccaaggaaca

SEQ ID NO: 3643267 - DNA, 19 bp, Homo sapiens
gaaatacgccagaactgct

SEQ ID NO: 3643268 - DNA, 20 bp, Homo sapiens
gaaatacgccagaactgctt

SEQ ID NO: 3643269 - DNA, 13 bp, Homo sapiens
gaagaagaaaaca

SEQ ID NO: 3643270 - DNA, 15 bp, Homo sapiens
gaagctactttgttt

SEQ ID NO: 3643271 - DNA, 20 bp, Homo sapiens
gaatatttgtcgatatttcc

SEQ ID NO: 3643272 - DNA, 18 bp, Homo sapiens
gacatcagcatcacctag

SEQ ID NO: 3643273 - DNA, 16 bp, Homo sapiens
gactattgacatcagc

SEQ ID NO: 3643274 - DNA, 18 bp, Homo sapiens
gagcagcggacttcaaaa

SEQ ID NO: 3643275 - DNA, 14 bp, Homo sapiens
gatcctacccctga

SEQ ID NO: 3643276 - DNA, 15 bp, Homo sapiens
ggcatgaagacagat

SEQ ID NO: 3643277 - DNA, 21 bp, Homo sapiens
gtaaacattagttctatttct

SEQ ID NO: 3643278 - DNA, 13 bp, Homo sapiens
taaacattagttc

SEQ ID NO: 3643279 - DNA, 22 bp, Homo sapiens
taatgctaaatgtaagaatcat

SEQ ID NO: 3643280 - DNA, 17 bp, Homo sapiens
tacacagactattgaca

SEQ ID NO: 3643281 - DNA, 18 bp, Homo sapiens
taccttcagatcctaccc

SEQ ID NO: 3643282 - DNA, 19 bp, Homo sapiens
tactttgtttttaaatgat

SEQ ID NO: 3643283 - DNA, 23 bp, Homo sapiens
tagaattagtggcacttgctttt

SEQ ID NO: 3643284 - DNA, 18 bp, Homo sapiens
tattgacatcagcatcac

SEQ ID NO: 3643285 - DNA, 17 bp, Homo sapiens
tcaagccgcatcccaga

SEQ ID NO: 3643286 - DNA, 22 bp, Homo sapiens
tccagtggaagaagaaaacact

SEQ ID NO: 3643287 - DNA, 13 bp, Homo sapiens
tcgatatttccat

SEQ ID NO: 3643288 - DNA, 23 bp, Homo sapiens
tctctgagctccagtggaagaag

SEQ ID NO: 3643289 - DNA, 16 bp, Homo sapiens
tcttaggcaatcacat

SEQ ID NO: 3643290 - DNA, 15 bp, Homo sapiens
tcttccttaaactcc

SEQ ID NO: 3643291 - DNA, 15 bp, Homo sapiens
tgaaaatcctaccaa

SEQ ID NO: 3643292 - DNA, 22 bp, Homo sapiens
tgaaagaaaataccaaggaaca

SEQ ID NO: 3643293 - DNA, 13 bp, Homo sapiens
tgaaataagagaa

SEQ ID NO: 3643294 - DNA, 23 bp, Homo sapiens
tgaatatttgtcgatatttccat

SEQ ID NO: 3643295 - DNA, 17 bp, Homo sapiens
tgcttcatgaaaatcct

SEQ ID NO: 3643296 - DNA, 15 bp, Homo sapiens
tggacaccggaaaca

SEQ ID NO: 3643297 - DNA, 19 bp, Homo sapiens
tgtcgatatttccatcatt

SEQ ID NO: 3643298 - DNA, 12 bp, Homo sapiens
ttaaatttttcc

SEQ ID NO: 3643299 - DNA, 12 bp, Homo sapiens
ttagttctattt

SEQ ID NO: 3643300 - DNA, 12 bp, Homo sapiens
ttcagatcctac

SEQ ID NO: 3643301 - DNA, 13 bp, Homo sapiens
ttcagatcctacc

SEQ ID NO: 3643302 - DNA, 15 bp, Homo sapiens
ttcagatcctacccc

SEQ ID NO: 3643303 - DNA, 20 bp, Homo sapiens
ttgctggggccgaaagaaca

SEQ ID NO: 3643304 - DNA, 20 bp, Homo sapiens
ttgtaaacattagttctatt

SEQ ID NO: 3643305 - DNA, 23 bp, Homo sapiens
tttccatcattaaatttttcctt

SEQ ID NO: 3643306 - DNA, 14 bp, Homo sapiens
tttctgaaataaca

SEQ ID NO: 3643307 - DNA, 14 bp, Homo sapiens
aaaataccaaggaa

SEQ ID NO: 3643308 - DNA, 12 bp, Homo sapiens
aaaatcctacca

SEQ ID NO: 3643309 - DNA, 18 bp, Homo sapiens
aaaatcctaccaacctct

SEQ ID NO: 3643310 - DNA, 23 bp, Homo sapiens
aaacactagtaccttcagatcct

SEQ ID NO: 3643311 - DNA, 13 bp, Homo sapiens
aaaataccaagga

SEQ ID NO: 3643312 - DNA, 15 bp, Homo sapiens
aaagctcactttact

SEQ ID NO: 3643313 - DNA, 15 bp, Homo sapiens
aaatagcaacatgct

SEQ ID NO: 3643314 - DNA, 20 bp, Homo sapiens
aaatgtaagaatcattgtaa

SEQ ID NO: 3643315 - DNA, 17 bp, Homo sapiens
aaatttttccttagcat

SEQ ID NO: 3643316 - DNA, 22 bp, Homo sapiens
aacatggcctttgcttgaaaga

SEQ ID NO: 3643317 - DNA, 15 bp, Homo sapiens
aaccctcgtttctga

SEQ ID NO: 3643318 - DNA, 20 bp, Homo sapiens
aactgctttatcccacggaa

SEQ ID NO: 3643319 - DNA, 16 bp, Homo sapiens
aagaaaataccaagga

SEQ ID NO: 3643320 - DNA, 18 bp, Homo sapiens
aagagaagctactttgtt

SEQ ID NO: 3643321 - DNA, 21 bp, Homo sapiens
aagataatcttagctgccaag

SEQ ID NO: 3643322 - DNA, 21 bp, Homo sapiens
aataagagaagctactttgtt

SEQ ID NO: 3643323 - DNA, 12 bp, Homo sapiens
aataccaaggaa

SEQ ID NO: 3643324 - DNA, 16 bp, Homo sapiens
aatccagcggttctca

SEQ ID NO: 3643325 - DNA, 16 bp, Homo sapiens
aatcctaccaacctct

SEQ ID NO: 3643326 - DNA, 16 bp, Homo sapiens
aatgcaaattctcaag

SEQ ID NO: 3643327 - DNA, 21 bp, Homo sapiens
aatgctaaatgtaagaatcat

SEQ ID NO: 3643328 - DNA, 18 bp, Homo sapiens
aattagtggcacttgctt

SEQ ID NO: 3643329 - DNA, 22 bp, Homo sapiens
acactagtaccttcagatccta

SEQ ID NO: 3643330 - DNA, 20 bp, Homo sapiens
acagatactcctccaaggtt

SEQ ID NO: 3643331 - DNA, 19 bp, Homo sapiens
acggaaaatgccaatctct

SEQ ID NO: 3643332 - DNA, 20 bp, Homo sapiens
actttctgaaataacatggc

SEQ ID NO: 3643333 - DNA, 19 bp, Homo sapiens
agataatcttagctgccaa

SEQ ID NO: 3643334 - DNA, 20 bp, Homo sapiens
agcaacatgcttcatgaaaa

SEQ ID NO: 3643335 - DNA, 19 bp, Homo sapiens
agctccagtggaagaagaa

SEQ ID NO: 3643336 - DNA, 15 bp, Homo sapiens
agctgccaagtaaat

SEQ ID NO: 3643337 - DNA, 22 bp, Homo sapiens
agctgccaagtaaatagcaaca

SEQ ID NO: 3643338 - DNA, 20 bp, Homo sapiens
agtaccttcagatcctaccc

SEQ ID NO: 3643339 - DNA, 14 bp, Homo sapiens
agttctatttctat

SEQ ID NO: 3643340 - DNA, 20 bp, Homo sapiens
atacgccagaactgctttat

SEQ ID NO: 3643341 - DNA, 17 bp, Homo sapiens
atactcctccaaggtta

SEQ ID NO: 3643342 - DNA, 23 bp, Homo sapiens
atagctggtcttatttgtaaagc

SEQ ID NO: 3643343 - DNA, 17 bp, Homo sapiens
atcattaaatttttcct

SEQ ID NO: 3643344 - DNA, 15 bp, Homo sapiens
atgaaaatcctacca

SEQ ID NO: 3643345 - DNA, 21 bp, Homo sapiens
atgaaaatcctaccaacctct

SEQ ID NO: 3643346 - DNA, 14 bp, Homo sapiens
atgcaaattctcaa

SEQ ID NO: 3643347 - DNA, 14 bp, Homo sapiens
attaaatttttcct

SEQ ID NO: 3643348 - DNA, 19 bp, Homo sapiens
attctcaagccgcatccca

SEQ ID NO: 3643349 - DNA, 21 bp, Homo sapiens
attctcaagccgcatcccaga

SEQ ID NO: 3643350 - DNA, 18 bp, Homo sapiens
attgacatcagcatcacc

SEQ ID NO: 3643351 - DNA, 23 bp, Homo sapiens
caagtaaatagcaacatgcttca

SEQ ID NO: 3643352 - DNA, 17 bp, Homo sapiens
cacctagaaacttgtta

SEQ ID NO: 3643353 - DNA, 14 bp, Homo sapiens
cagtccattgaaag

SEQ ID NO: 3643354 - DNA, 21 bp, Homo sapiens
catgaaaatcctaccaacctc

SEQ ID NO: 3643355 - DNA, 19 bp, Homo sapiens
catgcttcatgaaaatcct

SEQ ID NO: 3643356 - DNA, 22 bp, Homo sapiens
catggcctttgcttgaaagaaa

SEQ ID NO: 3643357 - DNA, 14 bp, Homo sapiens
ccagacttgctgaa

SEQ ID NO: 3643358 - DNA, 15 bp, Homo sapiens
cctaccaacctctga

SEQ ID NO: 3643359 - DNA, 16 bp, Homo sapiens
ccttcagatcctaccc

SEQ ID NO: 3643360 - DNA, 16 bp, Homo sapiens
cctttgcttgaaagaa

SEQ ID NO: 3643361 - DNA, 18 bp, Homo sapiens
cggaaaatgccaatctct

SEQ ID NO: 3643362 - DNA, 19 bp, Homo sapiens
ctccagtggaagaagaaaa

SEQ ID NO: 3643363 - DNA, 19 bp, Homo sapiens
cttaacaaaccctcgtttc

SEQ ID NO: 3643364 - DNA, 19 bp, Homo sapiens
cttagaattagtggcactt

SEQ ID NO: 3643365 - DNA, 14 bp, Homo sapiens
cttagctgccaagt

SEQ ID NO: 3643366 - DNA, 16 bp, Homo sapiens
cttcatgaaaatccta

SEQ ID NO: 3643367 - DNA, 19 bp, Homo sapiens
cttcatgaaaatcctacca

SEQ ID NO: 3643368 - DNA, 14 bp, Homo sapiens
ctttgcttgaaaga

SEQ ID NO: 3643369 - DNA, 16 bp, Homo sapiens
ctttgtttttaaatga

SEQ ID NO: 3643370 - DNA, 17 bp, Homo sapiens
gaaacttgttagaaatg

SEQ ID NO: 3643371 - DNA, 19 bp, Homo sapiens
gaagctactttgtttttaa

SEQ ID NO: 3643372 - DNA, 15 bp, Homo sapiens
gaatcggaatctctg

SEQ ID NO: 3643373 - DNA, 13 bp, Homo sapiens
gacatcagcatca

SEQ ID NO: 3643374 - DNA, 14 bp, Homo sapiens
gagctccagtggaa

SEQ ID NO: 3643375 - DNA, 12 bp, Homo sapiens
gctactttgttt

SEQ ID NO: 3643376 - DNA, 18 bp, Homo sapiens
gcttcatgaaaatcctac

SEQ ID NO: 3643377 - DNA, 20 bp, Homo sapiens
gcttcatgaaaatcctacca

SEQ ID NO: 3643378 - DNA, 15 bp, Homo sapiens
ggaaaatgccaatct

SEQ ID NO: 3643379 - DNA, 16 bp, Homo sapiens
ggaacaggaaactgat

SEQ ID NO: 3643380 - DNA, 14 bp, Homo sapiens
gtcgatatttccat

SEQ ID NO: 3643381 - DNA, 23 bp, Homo sapiens
gtggagcagccaacaagcagggg

SEQ ID NO: 3643382 - DNA, 17 bp, Homo sapiens
gttctatttctatccca

SEQ ID NO: 3643383 - DNA, 18 bp, Homo sapiens
taaacattagttctattt

SEQ ID NO: 3643384 - DNA, 23 bp, Homo sapiens
taaacattagttctatttctatc

SEQ ID NO: 3643385 - DNA, 14 bp, Homo sapiens
taaatgatgttgaa

SEQ ID NO: 3643386 - DNA, 16 bp, Homo sapiens
taaatgtaagaatcat

SEQ ID NO: 3643387 - DNA, 21 bp, Homo sapiens
taacaaaccctcgtttctgat

SEQ ID NO: 3643388 - DNA, 21 bp, Homo sapiens
taagaatcattgtaaacatta

SEQ ID NO: 3643389 - DNA, 13 bp, Homo sapiens
taagctatgtgaa

SEQ ID NO: 3643390 - DNA, 14 bp, Homo sapiens
taatgctaaatgta

SEQ ID NO: 3643391 - DNA, 21 bp, Homo sapiens
taatgctaaatgtaagaatca

SEQ ID NO: 3643392 - DNA, 16 bp, Homo sapiens
tacaaaaacatggcct

SEQ ID NO: 3643393 - DNA, 22 bp, Homo sapiens
tacacagactattgacatcagc

SEQ ID NO: 3643394 - DNA, 12 bp, Homo sapiens
tagctgccaagt

SEQ ID NO: 3643395 - DNA, 20 bp, Homo sapiens
tagtaccttcagatcctacc

SEQ ID NO: 3643396 - DNA, 15 bp, Homo sapiens
tagttctatttctat

SEQ ID NO: 3643397 - DNA, 20 bp, Homo sapiens
tagttctatttctatcccaa

SEQ ID NO: 3643398 - DNA, 21 bp, Homo sapiens
tatcccacggaaaatgccaat

SEQ ID NO: 3643399 - DNA, 17 bp, Homo sapiens
tattgacatcagcatca

SEQ ID NO: 3643400 - DNA, 16 bp, Homo sapiens
tatttctatcccaaac

SEQ ID NO: 3643401 - DNA, 22 bp, Homo sapiens
tcaaaaactgtcaaagaatcaa

SEQ ID NO: 3643402 - DNA, 14 bp, Homo sapiens
tcacatagtgaaag

SEQ ID NO: 3643403 - DNA, 14 bp, Homo sapiens
tcacctagaaactt

SEQ ID NO: 3643404 - DNA, 18 bp, Homo sapiens
tcacctagaaacttgtta

SEQ ID NO: 3643405 - DNA, 16 bp, Homo sapiens
tcatgaaaatcctacc

SEQ ID NO: 3643406 - DNA, 19 bp, Homo sapiens
tccagtggaagaagaaaac

SEQ ID NO: 3643407 - DNA, 14 bp, Homo sapiens
tcctaccaacctct

SEQ ID NO: 3643408 - DNA, 14 bp, Homo sapiens
tcgatatttccatc

SEQ ID NO: 3643409 - DNA, 22 bp, Homo sapiens
tctcaaacggtacacagactat

SEQ ID NO: 3643410 - DNA, 22 bp, Homo sapiens
tctcaagccgcatcccagactt

SEQ ID NO: 3643411 - DNA, 19 bp, Homo sapiens
tctctgagctccagtggaa

SEQ ID NO: 3643412 - DNA, 14 bp, Homo sapiens
tcttagctgccaag

SEQ ID NO: 3643413 - DNA, 16 bp, Homo sapiens
tgaaataacatggcct

SEQ ID NO: 3643414 - DNA, 14 bp, Homo sapiens
tgattaatgctaaa

SEQ ID NO: 3643415 - DNA, 24 bp, Homo sapiens
tgctaaatgtaagaatcattgtaa

SEQ ID NO: 3643416 - DNA, 18 bp, Homo sapiens
tgctgtaactttctgaaa

SEQ ID NO: 3643417 - DNA, 16 bp, Homo sapiens
tgcttcatgaaaatcc

SEQ ID NO: 3643418 - DNA, 20 bp, Homo sapiens
tgcttcatgaaaatcctacc

SEQ ID NO: 3643419 - DNA, 14 bp, Homo sapiens
tgtcaaagaatcaa

SEQ ID NO: 3643420 - DNA, 23 bp, Homo sapiens
ttaacaaaccctcgtttctgatt

SEQ ID NO: 3643421 - DNA, 13 bp, Homo sapiens
ttagaaatgcaaa

SEQ ID NO: 3643422 - DNA, 18 bp, Homo sapiens
ttcagctgcatacagttt

SEQ ID NO: 3643423 - DNA, 18 bp, Homo sapiens
ttcatgaaaatcctacca

SEQ ID NO: 3643424 - DNA, 14 bp, Homo sapiens
ttccttagcattgt

SEQ ID NO: 3643425 - DNA, 23 bp, Homo sapiens
ttctcaagccgcatcccagactt

SEQ ID NO: 3643426 - DNA, 18 bp, Homo sapiens
ttcttccttaaactcctg

SEQ ID NO: 3643427 - DNA, 22 bp, Homo sapiens
ttgaatatttgtcgatatttcc

SEQ ID NO: 3643428 - DNA, 22 bp, Homo sapiens
ttgctgaatcggaatctctggg

SEQ ID NO: 3643429 - DNA, 14 bp, Homo sapiens
ttgcttgaaagaaa

SEQ ID NO: 3643430 - DNA, 22 bp, Homo sapiens
ttgtaaacattagttctatttc

SEQ ID NO: 3643431 - DNA, 14 bp, Homo sapiens
tttgcttgaaagaa

SEQ ID NO: 3643432 - DNA, 16 bp, Homo sapiens
tttgcttgaaagaaaa

SEQ ID NO: 3643433 - DNA, 17 bp, Homo sapiens
aaatcctaccaacctct

SEQ ID NO: 3643434 - DNA, 23 bp, Homo sapiens
aaatttttcttccttaaactcct

SEQ ID NO: 3643435 - DNA, 23 bp, Homo sapiens
aacatggcctttgcttgaaagaa

SEQ ID NO: 3643436 - DNA, 11 bp, Homo sapiens
aagaaaacact

SEQ ID NO: 3643437 - DNA, 23 bp, Homo sapiens
aagaatcattgtaaacattagtt

SEQ ID NO: 3643438 - DNA, 15 bp, Homo sapiens
aagtaaatagcaaca

SEQ ID NO: 3643439 - DNA, 17 bp, Homo sapiens
aatagcaacatgcttca

SEQ ID NO: 3643440 - DNA, 18 bp, Homo sapiens
aatcctaccaacctctga

SEQ ID NO: 3643441 - DNA, 13 bp, Homo sapiens
aatgccaatctct

SEQ ID NO: 3643442 - DNA, 17 bp, Homo sapiens
aatgtaagaatcattgt

SEQ ID NO: 3643443 - DNA, 13 bp, Homo sapiens
acaaaaacatggc

SEQ ID NO: 3643444 - DNA, 16 bp, Homo sapiens
acagactattgacatc

SEQ ID NO: 3643445 - DNA, 23 bp, Homo sapiens
acatgcttcatgaaaatcctacc

SEQ ID NO: 3643446 - DNA, 19 bp, Homo sapiens
acattagttctatttctat

SEQ ID NO: 3643447 - DNA, 15 bp, Homo sapiens
acctctgaagtctct

SEQ ID NO: 3643448 - DNA, 16 bp, Homo sapiens
accttcagatcctacc

SEQ ID NO: 3643449 - DNA, 18 bp, Homo sapiens
accttcagatcctacccc

SEQ ID NO: 3643450 - DNA, 15 bp, Homo sapiens
acggaaaatgccaat

SEQ ID NO: 3643451 - DNA, 18 bp, Homo sapiens
acggaaaatgccaatctc

SEQ ID NO: 3643452 - DNA, 16 bp, Homo sapiens
actgtcaaagaatcaa

SEQ ID NO: 3643453 - DNA, 21 bp, Homo sapiens
acttgctgaatcggaatctct

SEQ ID NO: 3643454 - DNA, 16 bp, Homo sapiens
acttgttagaaatgca

SEQ ID NO: 3643455 - DNA, 14 bp, Homo sapiens
actttctgaaataa

SEQ ID NO: 3643456 - DNA, 16 bp, Homo sapiens
agaaatgcaaattctc

SEQ ID NO: 3643457 - DNA, 17 bp, Homo sapiens
agaagtcaacagtgaaa

SEQ ID NO: 3643458 - DNA, 13 bp, Homo sapiens
agaatcattgtaa

SEQ ID NO: 3643459 - DNA, 20 bp, Homo sapiens
agactattgacatcagcatc

SEQ ID NO: 3643460 - DNA, 12 bp, Homo sapiens
agacttgctgaa

SEQ ID NO: 3643461 - DNA, 15 bp, Homo sapiens
agcaacatgcttcat

SEQ ID NO: 3643462 - DNA, 16 bp, Homo sapiens
agccgcatcccagact

SEQ ID NO: 3643463 - DNA, 13 bp, Homo sapiens
agctactttgttt

SEQ ID NO: 3643464 - DNA, 23 bp, Homo sapiens
agctccagtggaagaagaaaaca

SEQ ID NO: 3643465 - DNA, 14 bp, Homo sapiens
agtcaacagtgaaa

SEQ ID NO: 3643466 - DNA, 22 bp, Homo sapiens
atcattaaagcctgagtttgct

SEQ ID NO: 3643467 - DNA, 23 bp, Homo sapiens
atcccacggaaaatgccaatctc

SEQ ID NO: 3643468 - DNA, 14 bp, Homo sapiens
atcctaccaacctc

SEQ ID NO: 3643469 - DNA, 15 bp, Homo sapiens
atcttagctgccaag

SEQ ID NO: 3643470 - DNA, 19 bp, Homo sapiens
atgaaaatcctaccaacct

SEQ ID NO: 3643471 - DNA, 20 bp, Homo sapiens
atgaaaatcctaccaacctc

SEQ ID NO: 3643472 - DNA, 20 bp, Homo sapiens
atggcctttgcttgaaagaa

SEQ ID NO: 3643473 - DNA, 13 bp, Homo sapiens
atttctatcccaa

SEQ ID NO: 3643474 - DNA, 20 bp, Homo sapiens
caaaaacatggcctttgctt

SEQ ID NO: 3643475 - DNA, 14 bp, Homo sapiens
caaacggtacacag

SEQ ID NO: 3643476 - DNA, 23 bp, Homo sapiens
caaatgctgtaactttctgaaat

SEQ ID NO: 3643477 - DNA, 22 bp, Homo sapiens
caacatgcttcatgaaaatcct

SEQ ID NO: 3643478 - DNA, 20 bp, Homo sapiens
cacggaaaatgccaatctct

SEQ ID NO: 3643479 - DNA, 11 bp, Homo sapiens
cagatcctacc

SEQ ID NO: 3643480 - DNA, 22 bp, Homo sapiens
catgaaaatcctaccaacctct

SEQ ID NO: 3643481 - DNA, 19 bp, Homo sapiens
catggcctttgcttgaaag

SEQ ID NO: 3643482 - DNA, 18 bp, Homo sapiens
ccagtggaagaagaaaac

SEQ ID NO: 3643483 - DNA, 18 bp, Homo sapiens
cctaatgagaagtcaaca

SEQ ID NO: 3643484 - DNA, 13 bp, Homo sapiens
ccttcagatccta

SEQ ID NO: 3643485 - DNA, 18 bp, Homo sapiens
ctaaatgtaagaatcatt

SEQ ID NO: 3643486 - DNA, 18 bp, Homo sapiens
ctggtcttatttgtaaag

SEQ ID NO: 3643487 - DNA, 19 bp, Homo sapiens
cttctaaaaaaaaacaaaa

SEQ ID NO: 3643488 - DNA, 12 bp, Homo sapiens
cttggagggcat

SEQ ID NO: 3643489 - DNA, 13 bp, Homo sapiens
ctttctgaaataa

SEQ ID NO: 3643490 - DNA, 14 bp, Homo sapiens
gaaaatcctaccaa

SEQ ID NO: 3643491 - DNA, 23 bp, Homo sapiens
gcaacatgcttcatgaaaatcct

SEQ ID NO: 3643492 - DNA, 21 bp, Homo sapiens
gcatcacctagaaacttgtta

SEQ ID NO: 3643493 - DNA, 23 bp, Homo sapiens
gccaatctcttctaaaaaaaaac

SEQ ID NO: 3643494 - DNA, 18 bp, Homo sapiens
gctaaatgtaagaatcat

SEQ ID NO: 3643495 - DNA, 12 bp, Homo sapiens
gctccagtggaa

SEQ ID NO: 3643496 - DNA, 21 bp, Homo sapiens
gctccagtggaagaagaaaac

SEQ ID NO: 3643497 - DNA, 17 bp, Homo sapiens
ggaaaatgccaatctct

SEQ ID NO: 3643498 - DNA, 13 bp, Homo sapiens
ggaacacctcctc

SEQ ID NO: 3643499 - DNA, 18 bp, Homo sapiens
gtaaatagcaacatgctt

SEQ ID NO: 3643500 - DNA, 13 bp, Homo sapiens
gtaagaatcattg

SEQ ID NO: 3643501 - DNA, 15 bp, Homo sapiens
gtacacagactattg

SEQ ID NO: 3643502 - DNA, 19 bp, Homo sapiens
gtaccttcagatcctaccc

SEQ ID NO: 3643503 - DNA, 12 bp, Homo sapiens
gtcaacagtgaa

SEQ ID NO: 3643504 - DNA, 15 bp, Homo sapiens
gttagaaatgcaaat

SEQ ID NO: 3643505 - DNA, 18 bp, Homo sapiens
gtttccattttttgttcc

SEQ ID NO: 3643506 - DNA, 19 bp, Homo sapiens
gtttctgattaatgctaaa

SEQ ID NO: 3643507 - DNA, 20 bp, Homo sapiens
taacaaaccctcgtttctga

SEQ ID NO: 3643508 - DNA, 16 bp, Homo sapiens
taactttctgaaataa

SEQ ID NO: 3643509 - DNA, 15 bp, Homo sapiens
taccttcagatccta

SEQ ID NO: 3643510 - DNA, 17 bp, Homo sapiens
taccttcagatcctacc

SEQ ID NO: 3643511 - DNA, 19 bp, Homo sapiens
tatcccacggaaaatgcca

SEQ ID NO: 3643512 - DNA, 14 bp, Homo sapiens
tcagatcctacccc

SEQ ID NO: 3643513 - DNA, 22 bp, Homo sapiens
tcatgaaaatcctaccaacctc

SEQ ID NO: 3643514 - DNA, 21 bp, Homo sapiens
tcccaaactaagctatgtgaa

SEQ ID NO: 3643515 - DNA, 13 bp, Homo sapiens
tcccagacttgct

SEQ ID NO: 3643516 - DNA, 20 bp, Homo sapiens
tctcaagccgcatcccagac

SEQ ID NO: 3643517 - DNA, 21 bp, Homo sapiens
tctcaagccgcatcccagact

SEQ ID NO: 3643518 - DNA, 16 bp, Homo sapiens
tcttctaaaaaaaaac

SEQ ID NO: 3643519 - DNA, 18 bp, Homo sapiens
tgctaaatgtaagaatca

SEQ ID NO: 3643520 - DNA, 21 bp, Homo sapiens
tgcttcatgaaaatcctacca

SEQ ID NO: 3643521 - DNA, 16 bp, Homo sapiens
tggtcttatttgtaaa

SEQ ID NO: 3643522 - DNA, 17 bp, Homo sapiens
tgtaactttctgaaata

SEQ ID NO: 3643523 - DNA, 19 bp, Homo sapiens
ttaacaaaccctcgtttct

SEQ ID NO: 3643524 - DNA, 22 bp, Homo sapiens
ttatcccacggaaaatgccaat

SEQ ID NO: 3643525 - DNA, 18 bp, Homo sapiens
ttcaaatgctgtaacttt

SEQ ID NO: 3643526 - DNA, 14 bp, Homo sapiens
ttcagatcctaccc

SEQ ID NO: 3643527 - DNA, 14 bp, Homo sapiens
ttctatcccaaact

SEQ ID NO: 3643528 - DNA, 23 bp, Homo sapiens
ttctatcccaaactaagctatgt

SEQ ID NO: 3643529 - DNA, 18 bp, Homo sapiens
ttctcaagccgcatccca

SEQ ID NO: 3643530 - DNA, 17 bp, Homo sapiens
tttatcccacggaaaat

SEQ ID NO: 3643531 - DNA, 19 bp, Homo sapiens
tttgctggggccgaaagaa

SEQ ID NO: 3643532 - DNA, 22 bp, Homo sapiens
tttgtcgatatttccatcatta

SEQ ID NO: 3643533 - DNA, 13 bp, Homo sapiens
aaaaaaaaatatg

SEQ ID NO: 3643534 - DNA, 12 bp, Homo sapiens
aaaaaaatatga

SEQ ID NO: 3643535 - DNA, 14 bp, Homo sapiens
aaaaaaatatgaga

SEQ ID NO: 3643536 - DNA, 15 bp, Homo sapiens
aaaaactggaaacat

SEQ ID NO: 3643537 - DNA, 18 bp, Homo sapiens
aaaaactggaaacatctg

SEQ ID NO: 3643538 - DNA, 18 bp, Homo sapiens
aaaaatagctataaatag

SEQ ID NO: 3643539 - DNA, 14 bp, Homo sapiens
aaaaatctgaattt

SEQ ID NO: 3643540 - DNA, 15 bp, Homo sapiens
aaaaattatctttaa

SEQ ID NO: 3643541 - DNA, 24 bp, Homo sapiens
aaaaatttgacattgtcagaatgt

SEQ ID NO: 3643542 - DNA, 14 bp, Homo sapiens
aaaacaaaatcctt

SEQ ID NO: 3643543 - DNA, 20 bp, Homo sapiens
aaaactggaaacatctgatt

SEQ ID NO: 3643544 - DNA, 16 bp, Homo sapiens
aaaagacacttttacc

SEQ ID NO: 3643545 - DNA, 16 bp, Homo sapiens
aaaagaccatgcattc

SEQ ID NO: 3643546 - DNA, 12 bp, Homo sapiens
aaaagcaggaac

SEQ ID NO: 3643547 - DNA, 17 bp, Homo sapiens
aaaagtgtttttacata

SEQ ID NO: 3643548 - DNA, 20 bp, Homo sapiens
aaaagtgtttttacatatag

SEQ ID NO: 3643549 - DNA, 14 bp, Homo sapiens
aaaagtttatcttt

SEQ ID NO: 3643550 - DNA, 22 bp, Homo sapiens
aaaagttttcaagcattgctaa

SEQ ID NO: 3643551 - DNA, 20 bp, Homo sapiens
aaaataataaagtggcattt

SEQ ID NO: 3643552 - DNA, 22 bp, Homo sapiens
aaaatactaagagatttgcttt

SEQ ID NO: 3643553 - DNA, 15 bp, Homo sapiens
aaaatagctataaat

SEQ ID NO: 3643554 - DNA, 13 bp, Homo sapiens
aaaatctgaattt

SEQ ID NO: 3643555 - DNA, 15 bp, Homo sapiens
aaaatgatttgcttt

SEQ ID NO: 3643556 - DNA, 13 bp, Homo sapiens
aaaatggaagacc

SEQ ID NO: 3643557 - DNA, 16 bp, Homo sapiens
aaaatggctgaagaaa

SEQ ID NO: 3643558 - DNA, 18 bp, Homo sapiens
aaaatgtgtgcttggaaa

SEQ ID NO: 3643559 - DNA, 19 bp, Homo sapiens
aaaatgtgtgcttggaaaa

SEQ ID NO: 3643560 - DNA, 14 bp, Homo sapiens
aaaatgttctgaca

SEQ ID NO: 3643561 - DNA, 18 bp, Homo sapiens
aaaatgtttatttttgct

SEQ ID NO: 3643562 - DNA, 20 bp, Homo sapiens
aaaatttatgtcattttcag

SEQ ID NO: 3643563 - DNA, 14 bp, Homo sapiens
aaaatttgacattg

SEQ ID NO: 3643564 - DNA, 15 bp, Homo sapiens
aaacaaaatataaat

SEQ ID NO: 3643565 - DNA, 13 bp, Homo sapiens
aaacaaaatttat

SEQ ID NO: 3643566 - DNA, 15 bp, Homo sapiens
aaacaaatatactca

SEQ ID NO: 3643567 - DNA, 14 bp, Homo sapiens
aaacaacaaaggaa

SEQ ID NO: 3643568 - DNA, 17 bp, Homo sapiens
aaacaatacttttcagg

SEQ ID NO: 3643569 - DNA, 19 bp, Homo sapiens
aaacatagtggtattttaa

SEQ ID NO: 3643570 - DNA, 20 bp, Homo sapiens
aaacatagtggtattttaac

SEQ ID NO: 3643571 - DNA, 14 bp, Homo sapiens
aaacatctgatttc

SEQ ID NO: 3643572 - DNA, 17 bp, Homo sapiens
aaacatctgatttctga

SEQ ID NO: 3643573 - DNA, 18 bp, Homo sapiens
aaacatctgatttctgaa

SEQ ID NO: 3643574 - DNA, 15 bp, Homo sapiens
aaaccagaaggaagc

SEQ ID NO: 3643575 - DNA, 12 bp, Homo sapiens
aaaccatgaaaa

SEQ ID NO: 3643576 - DNA, 17 bp, Homo sapiens
aaaccatgaaaagtttt

SEQ ID NO: 3643577 - DNA, 19 bp, Homo sapiens
aaaccttgctgctatgctg

SEQ ID NO: 3643578 - DNA, 15 bp, Homo sapiens
aaactcatacagtct

SEQ ID NO: 3643579 - DNA, 21 bp, Homo sapiens
aaactcatacagtctctattt

SEQ ID NO: 3643580 - DNA, 16 bp, Homo sapiens
aaactttggaagtttt

SEQ ID NO: 3643581 - DNA, 14 bp, Homo sapiens
aaacttttataaat

SEQ ID NO: 3643582 - DNA, 23 bp, Homo sapiens
aaagaacagcacagtcttttcct

SEQ ID NO: 3643583 - DNA, 17 bp, Homo sapiens
aaagaagtccatgtgat

SEQ ID NO: 3643584 - DNA, 15 bp, Homo sapiens
aaagacatctgagga

SEQ ID NO: 3643585 - DNA, 18 bp, Homo sapiens
aaagaccatgcattcaga

SEQ ID NO: 3643586 - DNA, 18 bp, Homo sapiens
aaagacttcaaatgttat

SEQ ID NO: 3643587 - DNA, 21 bp, Homo sapiens
aaagagaatttggagccagga

SEQ ID NO: 3643588 - DNA, 22 bp, Homo sapiens
aaaggaagtgaggtagtgccaa

SEQ ID NO: 3643589 - DNA, 21 bp, Homo sapiens
aaaggctgcagctaatttgtg

SEQ ID NO: 3643590 - DNA, 18 bp, Homo sapiens
aaaggctgtcatttcatt

SEQ ID NO: 3643591 - DNA, 14 bp, Homo sapiens
aaagtactagcaat

SEQ ID NO: 3643592 - DNA, 17 bp, Homo sapiens
aaagtcaggccattcag

SEQ ID NO: 3643593 - DNA, 12 bp, Homo sapiens
aaagtgaaatta

SEQ ID NO: 3643594 - DNA, 20 bp, Homo sapiens
aaagtggcatttctttatga

SEQ ID NO: 3643595 - DNA, 15 bp, Homo sapiens
aaagtgtttttacat

SEQ ID NO: 3643596 - DNA, 15 bp, Homo sapiens
aaagttttcaagcat

SEQ ID NO: 3643597 - DNA, 15 bp, Homo sapiens
aaataattaaaacaa

SEQ ID NO: 3643598 - DNA, 15 bp, Homo sapiens
aaatagcttttcact

SEQ ID NO: 3643599 - DNA, 20 bp, Homo sapiens
aaatagcttttcacttctta

SEQ ID NO: 3643600 - DNA, 12 bp, Homo sapiens
aaatataaaaat

SEQ ID NO: 3643601 - DNA, 19 bp, Homo sapiens
aaatataaatcacagattt

SEQ ID NO: 3643602 - DNA, 16 bp, Homo sapiens
aaatatagtgttgtgt

SEQ ID NO: 3643603 - DNA, 22 bp, Homo sapiens
aaatatagtgttgtgttacaat

SEQ ID NO: 3643604 - DNA, 13 bp, Homo sapiens
aaatattgctgtc

SEQ ID NO: 3643605 - DNA, 20 bp, Homo sapiens
aaatattgctgtctgaaaaa

SEQ ID NO: 3643606 - DNA, 14 bp, Homo sapiens
aaatattttcttaa

SEQ ID NO: 3643607 - DNA, 18 bp, Homo sapiens
aaatcacagatttccaaa

SEQ ID NO: 3643608 - DNA, 12 bp, Homo sapiens
aaatcattttga

SEQ ID NO: 3643609 - DNA, 16 bp, Homo sapiens
aaatcattttgatgta

SEQ ID NO: 3643610 - DNA, 17 bp, Homo sapiens
aaatcattttgatgtat

SEQ ID NO: 3643611 - DNA, 19 bp, Homo sapiens
aaatcattttgatgtatta

SEQ ID NO: 3643612 - DNA, 17 bp, Homo sapiens
aaatccttgccttcaaa

SEQ ID NO: 3643613 - DNA, 15 bp, Homo sapiens
aaatctacaaacttt

SEQ ID NO: 3643614 - DNA, 21 bp, Homo sapiens
aaatctacaaacttttataaa

SEQ ID NO: 3643615 - DNA, 16 bp, Homo sapiens
aaatctcaattcttcc

SEQ ID NO: 3643616 - DNA, 13 bp, Homo sapiens
aaatctgaatttc

SEQ ID NO: 3643617 - DNA, 20 bp, Homo sapiens
aaatcttacccttcaatgtt

SEQ ID NO: 3643618 - DNA, 18 bp, Homo sapiens
aaatctttgttaaaatat

SEQ ID NO: 3643619 - DNA, 14 bp, Homo sapiens
aaatgaaaatggct

SEQ ID NO: 3643620 - DNA, 17 bp, Homo sapiens
aaatgaaatacttgaca

SEQ ID NO: 3643621 - DNA, 18 bp, Homo sapiens
aaatgatatgtctttaaa

SEQ ID NO: 3643622 - DNA, 24 bp, Homo sapiens
aaatgccacacttgtgtgccacag

SEQ ID NO: 3643623 - DNA, 20 bp, Homo sapiens
aaatggctgaagaaacacag

SEQ ID NO: 3643624 - DNA, 22 bp, Homo sapiens
aaatggctgaagaaacacagca

SEQ ID NO: 3643625 - DNA, 17 bp, Homo sapiens
aaatgttttaaagaagt

SEQ ID NO: 3643626 - DNA, 23 bp, Homo sapiens
aaattaacaaattcagtggacat

SEQ ID NO: 3643627 - DNA, 20 bp, Homo sapiens
aaattaagagcataaacaat

SEQ ID NO: 3643628 - DNA, 12 bp, Homo sapiens
aaattagtgttt

SEQ ID NO: 3643629 - DNA, 19 bp, Homo sapiens
aaattagtgttttcattct

SEQ ID NO: 3643630 - DNA, 15 bp, Homo sapiens
aaattatctttaaaa

SEQ ID NO: 3643631 - DNA, 17 bp, Homo sapiens
aaattcagtggacattt

SEQ ID NO: 3643632 - DNA, 20 bp, Homo sapiens
aaattcagtggacatttgtt

SEQ ID NO: 3643633 - DNA, 22 bp, Homo sapiens
aaattcagtggacatttgttct

SEQ ID NO: 3643634 - DNA, 14 bp, Homo sapiens
aaattcctaattct

SEQ ID NO: 3643635 - DNA, 14 bp, Homo sapiens
aaattctgattatt

SEQ ID NO: 3643636 - DNA, 22 bp, Homo sapiens
aaatttatgtcattttcagatc

SEQ ID NO: 3643637 - DNA, 15 bp, Homo sapiens
aaatttgacattgtc

SEQ ID NO: 3643638 - DNA, 12 bp, Homo sapiens
aaattttattga

SEQ ID NO: 3643639 - DNA, 18 bp, Homo sapiens
aaattttggaagaattca

SEQ ID NO: 3643640 - DNA, 12 bp, Homo sapiens
aacaaaatttat

SEQ ID NO: 3643641 - DNA, 21 bp, Homo sapiens
aacaaaatttatgtcattttc

SEQ ID NO: 3643642 - DNA, 17 bp, Homo sapiens
aacaaatatactcattt

SEQ ID NO: 3643643 - DNA, 12 bp, Homo sapiens
aacaaatcattt

SEQ ID NO: 3643644 - DNA, 14 bp, Homo sapiens
aacaaatcattttg

SEQ ID NO: 3643645 - DNA, 12 bp, Homo sapiens
aacaaattcagt

SEQ ID NO: 3643646 - DNA, 17 bp, Homo sapiens
aacaagcaaactgaaat

SEQ ID NO: 3643647 - DNA, 21 bp, Homo sapiens
aacaatacttttcaggcactt

SEQ ID NO: 3643648 - DNA, 12 bp, Homo sapiens
aacacacagtat

SEQ ID NO: 3643649 - DNA, 19 bp, Homo sapiens
aacacacagtatagataaa

SEQ ID NO: 3643650 - DNA, 15 bp, Homo sapiens
aacacagcatgcatt

SEQ ID NO: 3643651 - DNA, 17 bp, Homo sapiens
aacaccctcacactggg

SEQ ID NO: 3643652 - DNA, 14 bp, Homo sapiens
aacagaattgttct

SEQ ID NO: 3643653 - DNA, 13 bp, Homo sapiens
aacagtaaatata

SEQ ID NO: 3643654 - DNA, 14 bp, Homo sapiens
aacagtaaatatac

SEQ ID NO: 3643655 - DNA, 22 bp, Homo sapiens
aacatagtggtattttaacata

SEQ ID NO: 3643656 - DNA, 14 bp, Homo sapiens
aacatctctttctc

SEQ ID NO: 3643657 - DNA, 23 bp, Homo sapiens
aacattccatccttgagtcaaaa

SEQ ID NO: 3643658 - DNA, 16 bp, Homo sapiens
aaccagaaggaagccc

SEQ ID NO: 3643659 - DNA, 16 bp, Homo sapiens
aaccatgaaaagtttt

SEQ ID NO: 3643660 - DNA, 19 bp, Homo sapiens
aaccatgaaaagttttcaa

SEQ ID NO: 3643661 - DNA, 14 bp, Homo sapiens
aaccctggaaaagg

SEQ ID NO: 3643662 - DNA, 15 bp, Homo sapiens
aaccgggactacaga

SEQ ID NO: 3643663 - DNA, 13 bp, Homo sapiens
aaccttcctgtct

SEQ ID NO: 3643664 - DNA, 18 bp, Homo sapiens
aaccttgtactttacaat

SEQ ID NO: 3643665 - DNA, 15 bp, Homo sapiens
aacctttggacaaga

SEQ ID NO: 3643666 - DNA, 17 bp, Homo sapiens
aacgttcatgttcatct

SEQ ID NO: 3643667 - DNA, 20 bp, Homo sapiens
aacgttcatgttcatctcag

SEQ ID NO: 3643668 - DNA, 13 bp, Homo sapiens
aactaatgtaaat

SEQ ID NO: 3643669 - DNA, 16 bp, Homo sapiens
aactaatgtaaatatt

SEQ ID NO: 3643670 - DNA, 17 bp, Homo sapiens
aactatcagggcaagct

SEQ ID NO: 3643671 - DNA, 20 bp, Homo sapiens
aactatcagggcaagctcat

SEQ ID NO: 3643672 - DNA, 19 bp, Homo sapiens
aactggaaacatctgattt

SEQ ID NO: 3643673 - DNA, 23 bp, Homo sapiens
aactggaaacatctgatttctga

SEQ ID NO: 3643674 - DNA, 13 bp, Homo sapiens
aactgggaaatga

SEQ ID NO: 3643675 - DNA, 20 bp, Homo sapiens
aactgtggataaattttgga

SEQ ID NO: 3643676 - DNA, 13 bp, Homo sapiens
aacttattttgat

SEQ ID NO: 3643677 - DNA, 14 bp, Homo sapiens
aacttattttgatt

SEQ ID NO: 3643678 - DNA, 18 bp, Homo sapiens
aacttattttgattgttt

SEQ ID NO: 3643679 - DNA, 15 bp, Homo sapiens
aacttgctgtgaaat

SEQ ID NO: 3643680 - DNA, 21 bp, Homo sapiens
aactttggaagttttacttga

SEQ ID NO: 3643681 - DNA, 21 bp, Homo sapiens
aagaaacacagcatgcattta

SEQ ID NO: 3643682 - DNA, 16 bp, Homo sapiens
aagaaggactgaagaa

SEQ ID NO: 3643683 - DNA, 11 bp, Homo sapiens
aagaattcagt

SEQ ID NO: 3643684 - DNA, 16 bp, Homo sapiens
aagaattcatgatgct

SEQ ID NO: 3643685 - DNA, 15 bp, Homo sapiens
aagacatctgaggaa

SEQ ID NO: 3643686 - DNA, 17 bp, Homo sapiens
aagacatctgaggaaaa

SEQ ID NO: 3643687 - DNA, 17 bp, Homo sapiens
aagaccatgcattcaga

SEQ ID NO: 3643688 - DNA, 13 bp, Homo sapiens
aagagcctgagac

SEQ ID NO: 3643689 - DNA, 12 bp, Homo sapiens
aagagcttccag

SEQ ID NO: 3643690 - DNA, 17 bp, Homo sapiens
aagagcttccagaaatg

SEQ ID NO: 3643691 - DNA, 22 bp, Homo sapiens
aagagcttccagaaatgccaca

SEQ ID NO: 3643692 - DNA, 17 bp, Homo sapiens
aagatggggagctctgg

SEQ ID NO: 3643693 - DNA, 15 bp, Homo sapiens
aagatgtaagaagct

SEQ ID NO: 3643694 - DNA, 16 bp, Homo sapiens
aagcaaactgaaatta

SEQ ID NO: 3643695 - DNA, 20 bp, Homo sapiens
aagcaaactgaaattagtgt

SEQ ID NO: 3643696 - DNA, 12 bp, Homo sapiens
aagcaaggaagt

SEQ ID NO: 3643697 - DNA, 14 bp, Homo sapiens
aagcaaggaagtaa

SEQ ID NO: 3643698 - DNA, 22 bp, Homo sapiens
aagcaaggaagtaagggagtca

SEQ ID NO: 3643699 - DNA, 16 bp, Homo sapiens
aagcagaatgagatga

SEQ ID NO: 3643700 - DNA, 19 bp, Homo sapiens
aagcagaatgagatgattt

SEQ ID NO: 3643701 - DNA, 14 bp, Homo sapiens
aagcattgctaaag

SEQ ID NO: 3643702 - DNA, 22 bp, Homo sapiens
aagctacatatgtaggaaaatt

SEQ ID NO: 3643703 - DNA, 16 bp, Homo sapiens
aagctcatagcacatg

SEQ ID NO: 3643704 - DNA, 20 bp, Homo sapiens
aagctcatagcacatgtttt

SEQ ID NO: 3643705 - DNA, 22 bp, Homo sapiens
aagcttaggtcatgaacatggt

SEQ ID NO: 3643706 - DNA, 18 bp, Homo sapiens
aaggaagccctctcagat

SEQ ID NO: 3643707 - DNA, 14 bp, Homo sapiens
aaggaagtgaggta

SEQ ID NO: 3643708 - DNA, 12 bp, Homo sapiens
aaggacagtgtt

SEQ ID NO: 3643709 - DNA, 16 bp, Homo sapiens
aaggacagtgttcaaa

SEQ ID NO: 3643710 - DNA, 23 bp, Homo sapiens
aaggactgaagaaaatccttcag

SEQ ID NO: 3643711 - DNA, 12 bp, Homo sapiens
aaggcagacagg

SEQ ID NO: 3643712 - DNA, 20 bp, Homo sapiens
aaggcagacaggaaggaagc

SEQ ID NO: 3643713 - DNA, 20 bp, Homo sapiens
aaggctgcagctaatttgtg

SEQ ID NO: 3643714 - DNA, 13 bp, Homo sapiens
aaggcttctccac

SEQ ID NO: 3643715 - DNA, 16 bp, Homo sapiens
aagggaagcccagcct

SEQ ID NO: 3643716 - DNA, 18 bp, Homo sapiens
aagggaagcccagcctgc

SEQ ID NO: 3643717 - DNA, 18 bp, Homo sapiens
aagggaccttcagggaga

SEQ ID NO: 3643718 - DNA, 17 bp, Homo sapiens
aaggtccggatgtcact

SEQ ID NO: 3643719 - DNA, 22 bp, Homo sapiens
aagtacaaaaaattagccagtc

SEQ ID NO: 3643720 - DNA, 22 bp, Homo sapiens
aagtactagcaataagttgaat

SEQ ID NO: 3643721 - DNA, 14 bp, Homo sapiens
aagtccatgtgata

SEQ ID NO: 3643722 - DNA, 15 bp, Homo sapiens
aagtcctcagagctc

SEQ ID NO: 3643723 - DNA, 23 bp, Homo sapiens
aagtctacctgccttgcctgtta

SEQ ID NO: 3643724 - DNA, 12 bp, Homo sapiens
aagtgaaaaaga

SEQ ID NO: 3643725 - DNA, 17 bp, Homo sapiens
aagtgaaattagtattt

SEQ ID NO: 3643726 - DNA, 21 bp, Homo sapiens
aagtgaaattagtattttgag

SEQ ID NO: 3643727 - DNA, 12 bp, Homo sapiens
aagtggcaagct

SEQ ID NO: 3643728 - DNA, 15 bp, Homo sapiens
aagtggcaagctctt

SEQ ID NO: 3643729 - DNA, 22 bp, Homo sapiens
aagtggcaagctcttcattgca

SEQ ID NO: 3643730 - DNA, 18 bp, Homo sapiens
aagtttaaatctttgtta

SEQ ID NO: 3643731 - DNA, 12 bp, Homo sapiens
aagtttgacaca

SEQ ID NO: 3643732 - DNA, 11 bp, Homo sapiens
aataaaaatag

SEQ ID NO: 3643733 - DNA, 13 bp, Homo sapiens
aataaaaatagct

SEQ ID NO: 3643734 - DNA, 24 bp, Homo sapiens
aataaaaatagctataaatagtga

SEQ ID NO: 3643735 - DNA, 20 bp, Homo sapiens
aataaaatgtttatttttgc

SEQ ID NO: 3643736 - DNA, 13 bp, Homo sapiens
aataaagtcaaat

SEQ ID NO: 3643737 - DNA, 23 bp, Homo sapiens
aataaagtggcatttctttatga

SEQ ID NO: 3643738 - DNA, 12 bp, Homo sapiens
aataattaaaac

SEQ ID NO: 3643739 - DNA, 14 bp, Homo sapiens
aataattatatgaa

SEQ ID NO: 3643740 - DNA, 23 bp, Homo sapiens
aatacttttcaggcactttagaa

SEQ ID NO: 3643741 - DNA, 16 bp, Homo sapiens
aatagctgatagaaga

SEQ ID NO: 3643742 - DNA, 19 bp, Homo sapiens
aatagtgaaaattttattg

SEQ ID NO: 3643743 - DNA, 21 bp, Homo sapiens
aatagtgaaaattttattgaa

SEQ ID NO: 3643744 - DNA, 14 bp, Homo sapiens
aatataacatgaaa

SEQ ID NO: 3643745 - DNA, 15 bp, Homo sapiens
aatataacatgaaag

SEQ ID NO: 3643746 - DNA, 17 bp, Homo sapiens
aatatactcatttggat

SEQ ID NO: 3643747 - DNA, 17 bp, Homo sapiens
aatatagtgttgtgtta

SEQ ID NO: 3643748 - DNA, 18 bp, Homo sapiens
aatatccttttagaagca

SEQ ID NO: 3643749 - DNA, 18 bp, Homo sapiens
aatcaagtctgtgaaagt

SEQ ID NO: 3643750 - DNA, 16 bp, Homo sapiens
aatcacagatttccaa

SEQ ID NO: 3643751 - DNA, 12 bp, Homo sapiens
aatcatctattg

SEQ ID NO: 3643752 - DNA, 13 bp, Homo sapiens
aatccatcgattt

SEQ ID NO: 3643753 - DNA, 15 bp, Homo sapiens
aatccttcagcaatc

SEQ ID NO: 3643754 - DNA, 20 bp, Homo sapiens
aatccttcagcaatccttaa

SEQ ID NO: 3643755 - DNA, 14 bp, Homo sapiens
aatctaaattaact

SEQ ID NO: 3643756 - DNA, 13 bp, Homo sapiens
aatctacaaactt

SEQ ID NO: 3643757 - DNA, 15 bp, Homo sapiens
aatctactagaacct

SEQ ID NO: 3643758 - DNA, 23 bp, Homo sapiens
aatcttacccttcaatgttaaat

SEQ ID NO: 3643759 - DNA, 19 bp, Homo sapiens
aatctttgttaaaatatag

SEQ ID NO: 3643760 - DNA, 22 bp, Homo sapiens
aatgaaatacttgacaacattt

SEQ ID NO: 3643761 - DNA, 20 bp, Homo sapiens
aatgagtttccagctaagcc

SEQ ID NO: 3643762 - DNA, 19 bp, Homo sapiens
aatgattcacttttattgt

SEQ ID NO: 3643763 - DNA, 23 bp, Homo sapiens
aatggcatttttttagtaaatta

SEQ ID NO: 3643764 - DNA, 13 bp, Homo sapiens
aatggcctcttaa

SEQ ID NO: 3643765 - DNA, 19 bp, Homo sapiens
aatggcctcttaaaaatta

SEQ ID NO: 3643766 - DNA, 18 bp, Homo sapiens
aatggctgaagaaacaca

SEQ ID NO: 3643767 - DNA, 23 bp, Homo sapiens
aatgtagggcagaatagctgata

SEQ ID NO: 3643768 - DNA, 14 bp, Homo sapiens
aatgtcctgtagag

SEQ ID NO: 3643769 - DNA, 20 bp, Homo sapiens
aatgtctgtccctaaacata

SEQ ID NO: 3643770 - DNA, 23 bp, Homo sapiens
aatgtctgtccctaaacatagtg

SEQ ID NO: 3643771 - DNA, 21 bp, Homo sapiens
gtcagaacctttggacaagag

SEQ ID NO: 3643772 - DNA, 14 bp, Homo sapiens
gtcagaatgttgtg

SEQ ID NO: 3643773 - DNA, 18 bp, Homo sapiens
gtcatgaacatggtcaga

SEQ ID NO: 3643774 - DNA, 20 bp, Homo sapiens
gtcattttcagatccttcca

SEQ ID NO: 3643775 - DNA, 20 bp, Homo sapiens
gtccatgtgataattgtaaa

SEQ ID NO: 3643776 - DNA, 19 bp, Homo sapiens
gtccatttttgagtaaaac

SEQ ID NO: 3643777 - DNA, 18 bp, Homo sapiens
gtccgtgaagagaaagac

SEQ ID NO: 3643778 - DNA, 15 bp, Homo sapiens
gtcctgcatgtatgc

SEQ ID NO: 3643779 - DNA, 18 bp, Homo sapiens
gtcctgtagagagagacc

SEQ ID NO: 3643780 - DNA, 21 bp, Homo sapiens
gtcgaggctggtaagggacct

SEQ ID NO: 3643781 - DNA, 16 bp, Homo sapiens
gtcgtggactccagct

SEQ ID NO: 3643782 - DNA, 15 bp, Homo sapiens
gtctcctgtatcatt

SEQ ID NO: 3643783 - DNA, 21 bp, Homo sapiens
gtctgtgaaagtctcctgtat

SEQ ID NO: 3643784 - DNA, 17 bp, Homo sapiens
gtcttaggtggcagggc

SEQ ID NO: 3643785 - DNA, 19 bp, Homo sapiens
gtcttaggtggcagggctg

SEQ ID NO: 3643786 - DNA, 14 bp, Homo sapiens
gtcttgttgttcat

SEQ ID NO: 3643787 - DNA, 17 bp, Homo sapiens
gtgaaagtggcaagctc

SEQ ID NO: 3643788 - DNA, 13 bp, Homo sapiens
gtgaccagaatga

SEQ ID NO: 3643789 - DNA, 18 bp, Homo sapiens
gtgactttggctgcatgc

SEQ ID NO: 3643790 - DNA, 16 bp, Homo sapiens
gtgagactccatctca

SEQ ID NO: 3643791 - DNA, 19 bp, Homo sapiens
gtgagtgcaagagcctgag

SEQ ID NO: 3643792 - DNA, 17 bp, Homo sapiens
gtgataattgtaaaggt

SEQ ID NO: 3643793 - DNA, 16 bp, Homo sapiens
gtgatggagagggatg

SEQ ID NO: 3643794 - DNA, 17 bp, Homo sapiens
gtgatggagagggatgg

SEQ ID NO: 3643795 - DNA, 15 bp, Homo sapiens
gtgcaagagcctgag

SEQ ID NO: 3643796 - DNA, 21 bp, Homo sapiens
gtgcaagagcctgagactgga

SEQ ID NO: 3643797 - DNA, 19 bp, Homo sapiens
gtgcagcccccactgcctt

SEQ ID NO: 3643798 - DNA, 22 bp, Homo sapiens
gtgcaggaaaaggctgcagcta

SEQ ID NO: 3643799 - DNA, 16 bp, Homo sapiens
gtgcatgttaaaataa

SEQ ID NO: 3643800 - DNA, 20 bp, Homo sapiens
gtgcatgttaaaataattat

SEQ ID NO: 3643801 - DNA, 18 bp, Homo sapiens
gtgcccacttaccctggg

SEQ ID NO: 3643802 - DNA, 14 bp, Homo sapiens
gtgcttcacacaaa

SEQ ID NO: 3643803 - DNA, 21 bp, Homo sapiens
gtgcttcacacaaagtgaaat

SEQ ID NO: 3643804 - DNA, 23 bp, Homo sapiens
gtgcttcacacaaagtgaaatta

SEQ ID NO: 3643805 - DNA, 16 bp, Homo sapiens
gtggactccagctcta

SEQ ID NO: 3643806 - DNA, 18 bp, Homo sapiens
gtggataaattttggaag

SEQ ID NO: 3643807 - DNA, 19 bp, Homo sapiens
gtggcaacatttggggaga

SEQ ID NO: 3643808 - DNA, 18 bp, Homo sapiens
gtggcaagctcttcattg

SEQ ID NO: 3643809 - DNA, 13 bp, Homo sapiens
gtgtcctgcatgt

SEQ ID NO: 3643810 - DNA, 22 bp, Homo sapiens
gtgtgacctacaagattcctgg

SEQ ID NO: 3643811 - DNA, 14 bp, Homo sapiens
gtgtgcttcacaca

SEQ ID NO: 3643812 - DNA, 13 bp, Homo sapiens
gtgttcaaattct

SEQ ID NO: 3643813 - DNA, 16 bp, Homo sapiens
gtgttctcaacacaca

SEQ ID NO: 3643814 - DNA, 17 bp, Homo sapiens
gtgttctcaacacacag

SEQ ID NO: 3643815 - DNA, 12 bp, Homo sapiens
gttaaaatatag

SEQ ID NO: 3643816 - DNA, 22 bp, Homo sapiens
gttaaaatatagtgttgtgtta

SEQ ID NO: 3643817 - DNA, 12 bp, Homo sapiens
gttaacagtaaa

SEQ ID NO: 3643818 - DNA, 20 bp, Homo sapiens
gttaaccgggactacagaag

SEQ ID NO: 3643819 - DNA, 16 bp, Homo sapiens
gttaatgattcttgtg

SEQ ID NO: 3643820 - DNA, 22 bp, Homo sapiens
gttaccccaccctgcccactcc

SEQ ID NO: 3643821 - DNA, 17 bp, Homo sapiens
gttagcttcctgcagga

SEQ ID NO: 3643822 - DNA, 15 bp, Homo sapiens
gttagggaaaacatt

SEQ ID NO: 3643823 - DNA, 20 bp, Homo sapiens
gttagggaaaacattccatc

SEQ ID NO: 3643824 - DNA, 13 bp, Homo sapiens
gttataaaatctg

SEQ ID NO: 3643825 - DNA, 19 bp, Homo sapiens
gttatcttttgtgtcctgt

SEQ ID NO: 3643826 - DNA, 17 bp, Homo sapiens
gttatttaccagaagtt

SEQ ID NO: 3643827 - DNA, 21 bp, Homo sapiens
gttcaatgctacaaaatgtgt

SEQ ID NO: 3643828 - DNA, 12 bp, Homo sapiens
gttcatgaatac

SEQ ID NO: 3643829 - DNA, 23 bp, Homo sapiens
gttctcaacacacagtatagata

SEQ ID NO: 3643830 - DNA, 19 bp, Homo sapiens
gttctgtgcagtttggtat

SEQ ID NO: 3643831 - DNA, 14 bp, Homo sapiens
gttgaagtgcatgt

SEQ ID NO: 3643832 - DNA, 14 bp, Homo sapiens
gttggtatttactg

SEQ ID NO: 3643833 - DNA, 12 bp, Homo sapiens
gttgtgttacaa

SEQ ID NO: 3643834 - DNA, 15 bp, Homo sapiens
gtttcactgttcatg

SEQ ID NO: 3643835 - DNA, 19 bp, Homo sapiens
gtttccagctaagcctgat

SEQ ID NO: 3643836 - DNA, 21 bp, Homo sapiens
gtttgatgaataaaatgttta

SEQ ID NO: 3643837 - DNA, 14 bp, Homo sapiens
gttttacaaagaaa

SEQ ID NO: 3643838 - DNA, 17 bp, Homo sapiens
taaaaattatctttaaa

SEQ ID NO: 3643839 - DNA, 20 bp, Homo sapiens
taaaataattatatgaagca

SEQ ID NO: 3643840 - DNA, 19 bp, Homo sapiens
taaacaaaatttatgtcat

SEQ ID NO: 3643841 - DNA, 22 bp, Homo sapiens
taaacaaaatttatgtcatttt

SEQ ID NO: 3643842 - DNA, 13 bp, Homo sapiens
taaaccagaagga

SEQ ID NO: 3643843 - DNA, 18 bp, Homo sapiens
taaagaagtccatgtgat

SEQ ID NO: 3643844 - DNA, 16 bp, Homo sapiens
taaaggtgatgaattt

SEQ ID NO: 3643845 - DNA, 17 bp, Homo sapiens
taaaggtgatgaattta

SEQ ID NO: 3643846 - DNA, 20 bp, Homo sapiens
taaaggtgatgaatttacca

SEQ ID NO: 3643847 - DNA, 19 bp, Homo sapiens
taaagtcaggccattcagt

SEQ ID NO: 3643848 - DNA, 17 bp, Homo sapiens
taaataaaaatagctat

SEQ ID NO: 3643849 - DNA, 14 bp, Homo sapiens
taaatagtgaaaat

SEQ ID NO: 3643850 - DNA, 22 bp, Homo sapiens
taaatatacactttacattctt

SEQ ID NO: 3643851 - DNA, 14 bp, Homo sapiens
taaatattgctgtc

SEQ ID NO: 3643852 - DNA, 15 bp, Homo sapiens
taaatattgctgtct

SEQ ID NO: 3643853 - DNA, 20 bp, Homo sapiens
taaatattgctgtctgaaaa

SEQ ID NO: 3643854 - DNA, 21 bp, Homo sapiens
taaatctaaattaacttctat

SEQ ID NO: 3643855 - DNA, 17 bp, Homo sapiens
taaatctacaaactttt

SEQ ID NO: 3643856 - DNA, 22 bp, Homo sapiens
taaatcttacccttcaatgtta

SEQ ID NO: 3643857 - DNA, 15 bp, Homo sapiens
taaatctttgttaaa

SEQ ID NO: 3643858 - DNA, 16 bp, Homo sapiens
taaatctttgttaaaa

SEQ ID NO: 3643859 - DNA, 18 bp, Homo sapiens
taaatctttgttaaaata

SEQ ID NO: 3643860 - DNA, 24 bp, Homo sapiens
taaatctttgttaaaatatagtgt

SEQ ID NO: 3643861 - DNA, 17 bp, Homo sapiens
taaattaacaaattcag

SEQ ID NO: 3643862 - DNA, 18 bp, Homo sapiens
taaatttattaaatgttg

SEQ ID NO: 3643863 - DNA, 13 bp, Homo sapiens
taaattttggaag

SEQ ID NO: 3643864 - DNA, 19 bp, Homo sapiens
taaattttggaagaattca

SEQ ID NO: 3643865 - DNA, 20 bp, Homo sapiens
taaattttggaagaattcat

SEQ ID NO: 3643866 - DNA, 24 bp, Homo sapiens
taaattttggaagaattcatgatg

SEQ ID NO: 3643867 - DNA, 13 bp, Homo sapiens
taacaaagtgaga

SEQ ID NO: 3643868 - DNA, 14 bp, Homo sapiens
taacagtaaatata

SEQ ID NO: 3643869 - DNA, 16 bp, Homo sapiens
taacagtatttccata

SEQ ID NO: 3643870 - DNA, 14 bp, Homo sapiens
taacttattttgat

SEQ ID NO: 3643871 - DNA, 14 bp, Homo sapiens
taacttgctgtgaa

SEQ ID NO: 3643872 - DNA, 12 bp, Homo sapiens
taagaattcagt

SEQ ID NO: 3643873 - DNA, 18 bp, Homo sapiens
taagataattaaatgaaa

SEQ ID NO: 3643874 - DNA, 19 bp, Homo sapiens
taaggacagtgttcaaatt

SEQ ID NO: 3643875 - DNA, 23 bp, Homo sapiens
taaggacagtgttcaaattctga

SEQ ID NO: 3643876 - DNA, 14 bp, Homo sapiens
taaggcagacagga

SEQ ID NO: 3643877 - DNA, 19 bp, Homo sapiens
taaggcagacaggaaggaa

SEQ ID NO: 3643878 - DNA, 15 bp, Homo sapiens
taagggaccttcagg

SEQ ID NO: 3643879 - DNA, 21 bp, Homo sapiens
taagggaccttcagggagagc

SEQ ID NO: 3643880 - DNA, 22 bp, Homo sapiens
taagttctgtgcagtttggtat

SEQ ID NO: 3643881 - DNA, 15 bp, Homo sapiens
taagttgaatgataa

SEQ ID NO: 3643882 - DNA, 18 bp, Homo sapiens
taatactaagtcctcaga

SEQ ID NO: 3643883 - DNA, 15 bp, Homo sapiens
taatagctcacagca

SEQ ID NO: 3643884 - DNA, 18 bp, Homo sapiens
taatagctcacagcacat

SEQ ID NO: 3643885 - DNA, 14 bp, Homo sapiens
taatagtttctaaa

SEQ ID NO: 3643886 - DNA, 22 bp, Homo sapiens
taatgaaaaatctgaatttcta

SEQ ID NO: 3643887 - DNA, 15 bp, Homo sapiens
taatgacctgaattg

SEQ ID NO: 3643888 - DNA, 17 bp, Homo sapiens
taatgaggcaactcagc

SEQ ID NO: 3643889 - DNA, 18 bp, Homo sapiens
taatgaggcaactcagca

SEQ ID NO: 3643890 - DNA, 23 bp, Homo sapiens
taattatcctcaagttgtgtgct

SEQ ID NO: 3643891 - DNA, 12 bp, Homo sapiens
taattatggtac

SEQ ID NO: 3643892 - DNA, 20 bp, Homo sapiens
taattatggtacctctgtct

SEQ ID NO: 3643893 - DNA, 22 bp, Homo sapiens
taattcttaccgaaatgaaaat

SEQ ID NO: 3643894 - DNA, 18 bp, Homo sapiens
taattcttctcctttgtc

SEQ ID NO: 3643895 - DNA, 17 bp, Homo sapiens
taattggagattactaa

SEQ ID NO: 3643896 - DNA, 18 bp, Homo sapiens
taatttagcagtccattt

SEQ ID NO: 3643897 - DNA, 14 bp, Homo sapiens
taatttattaaatt

SEQ ID NO: 3643898 - DNA, 14 bp, Homo sapiens
tacaaaatgtgtgc

SEQ ID NO: 3643899 - DNA, 13 bp, Homo sapiens
tacaaagaaacaa

SEQ ID NO: 3643900 - DNA, 21 bp, Homo sapiens
tacaacaagcaaactgaaatt

SEQ ID NO: 3643901 - DNA, 24 bp, Homo sapiens
tacaagtgtttctagtaacagtat

SEQ ID NO: 3643902 - DNA, 23 bp, Homo sapiens
tacaatcatgcctacattagtga

SEQ ID NO: 3643903 - DNA, 14 bp, Homo sapiens
tacacatataaaca

SEQ ID NO: 3643904 - DNA, 19 bp, Homo sapiens
tacacatataaacacagta

SEQ ID NO: 3643905 - DNA, 20 bp, Homo sapiens
tacacatataaacacagtaa

SEQ ID NO: 3643906 - DNA, 14 bp, Homo sapiens
tacactccagcctg

SEQ ID NO: 3643907 - DNA, 16 bp, Homo sapiens
tggtaacttgctgtga

SEQ ID NO: 3643908 - DNA, 21 bp, Homo sapiens
tggtaagggaccttcagggag

SEQ ID NO: 3643909 - DNA, 13 bp, Homo sapiens
tggtatgaaacaa

SEQ ID NO: 3643910 - DNA, 22 bp, Homo sapiens
tggtatgaaacaaatatactca

SEQ ID NO: 3643911 - DNA, 18 bp, Homo sapiens
tggtatttactgcaatgt

SEQ ID NO: 3643912 - DNA, 22 bp, Homo sapiens
tggtatttactgcaatgtctgt

SEQ ID NO: 3643913 - DNA, 17 bp, Homo sapiens
tggtattttaacatagc

SEQ ID NO: 3643914 - DNA, 21 bp, Homo sapiens
tggtattttaacatagcagct

SEQ ID NO: 3643915 - DNA, 19 bp, Homo sapiens
tggtcttgtttaatatttg

SEQ ID NO: 3643916 - DNA, 15 bp, Homo sapiens
tggtgtcctgcatgt

SEQ ID NO: 3643917 - DNA, 14 bp, Homo sapiens
tggttaatgaaaaa

SEQ ID NO: 3643918 - DNA, 20 bp, Homo sapiens
tggttaatgaaaaatctgaa

SEQ ID NO: 3643919 - DNA, 13 bp, Homo sapiens
tggttatatttca

SEQ ID NO: 3643920 - DNA, 15 bp, Homo sapiens
tgtaaataaaaatag

SEQ ID NO: 3643921 - DNA, 17 bp, Homo sapiens
tgtaaataaaaatagct

SEQ ID NO: 3643922 - DNA, 19 bp, Homo sapiens
tgtaaatattgctgtctga

SEQ ID NO: 3643923 - DNA, 16 bp, Homo sapiens
tgtaaatgatatgtct

SEQ ID NO: 3643924 - DNA, 22 bp, Homo sapiens
tgtaagaagctaaaatgaaaaa

SEQ ID NO: 3643925 - DNA, 23 bp, Homo sapiens
tgtaagacacgtgcaacagactg

SEQ ID NO: 3643926 - DNA, 18 bp, Homo sapiens
tgtaatacaccaaatagc

SEQ ID NO: 3643927 - DNA, 18 bp, Homo sapiens
tgtacatttatgtgtgaa

SEQ ID NO: 3643928 - DNA, 20 bp, Homo sapiens
tgtacatttatgtgtgaagc

SEQ ID NO: 3643929 - DNA, 22 bp, Homo sapiens
tgtaggaaaattttcttcttta

SEQ ID NO: 3643930 - DNA, 14 bp, Homo sapiens
tgtatatctgtgta

SEQ ID NO: 3643931 - DNA, 21 bp, Homo sapiens
tgtatatctgtgtaagacacg

SEQ ID NO: 3643932 - DNA, 13 bp, Homo sapiens
tgtatgcttccag

SEQ ID NO: 3643933 - DNA, 18 bp, Homo sapiens
tgtattggaagtatagat

SEQ ID NO: 3643934 - DNA, 14 bp, Homo sapiens
tgtatttgaggaaa

SEQ ID NO: 3643935 - DNA, 15 bp, Homo sapiens
tgtcaaatggtattt

SEQ ID NO: 3643936 - DNA, 23 bp, Homo sapiens
tgtcaaatggtattttttgtgaa

SEQ ID NO: 3643937 - DNA, 14 bp, Homo sapiens
tgtcagaatgttgt

SEQ ID NO: 3643938 - DNA, 14 bp, Homo sapiens
tgtcattttcagat

SEQ ID NO: 3643939 - DNA, 20 bp, Homo sapiens
tgtcattttcagatccttcc

SEQ ID NO: 3643940 - DNA, 15 bp, Homo sapiens
tgtccctaaacatag

SEQ ID NO: 3643941 - DNA, 21 bp, Homo sapiens
tgtctctacaaaaaaaatcaa

SEQ ID NO: 3643942 - DNA, 17 bp, Homo sapiens
tgtctgtccctaaacat

SEQ ID NO: 3643943 - DNA, 20 bp, Homo sapiens
tgtctgtccctaaacatagt

SEQ ID NO: 3643944 - DNA, 21 bp, Homo sapiens
tgtctgtccctaaacatagtg

SEQ ID NO: 3643945 - DNA, 12 bp, Homo sapiens
tgtcttattcct

SEQ ID NO: 3643946 - DNA, 17 bp, Homo sapiens
tgtcttattcctaattc

SEQ ID NO: 3643947 - DNA, 22 bp, Homo sapiens
tgtcttattcctaattcctgta

SEQ ID NO: 3643948 - DNA, 15 bp, Homo sapiens
tgtctttaaaatgat

SEQ ID NO: 3643949 - DNA, 18 bp, Homo sapiens
tgtgaacaatcagattag

SEQ ID NO: 3643950 - DNA, 15 bp, Homo sapiens
tgtgataattgtaaa

SEQ ID NO: 3643951 - DNA, 14 bp, Homo sapiens
tgtgcagtttggta

SEQ ID NO: 3643952 - DNA, 21 bp, Homo sapiens
tgtgctattcgtaagttctgt

SEQ ID NO: 3643953 - DNA, 15 bp, Homo sapiens
tgtgctgctgtggca

SEQ ID NO: 3643954 - DNA, 22 bp, Homo sapiens
tgtggaaggcacactgagcaag

SEQ ID NO: 3643955 - DNA, 18 bp, Homo sapiens
tgtggataaattttggaa

SEQ ID NO: 3643956 - DNA, 23 bp, Homo sapiens
tgtggatggaggtgatgaaaacc

SEQ ID NO: 3643957 - DNA, 19 bp, Homo sapiens
tgtggcaccttgattggaa

SEQ ID NO: 3643958 - DNA, 15 bp, Homo sapiens
tgtggggatggtgat

SEQ ID NO: 3643959 - DNA, 17 bp, Homo sapiens
tgtgttacaataagtgt

SEQ ID NO: 3643960 - DNA, 15 bp, Homo sapiens
tgtgttctcaacaca

SEQ ID NO: 3643961 - DNA, 16 bp, Homo sapiens
tgtgttctcaacacac

SEQ ID NO: 3643962 - DNA, 17 bp, Homo sapiens
tgtgttctcaacacaca

SEQ ID NO: 3643963 - DNA, 18 bp, Homo sapiens
tgtgttctcaacacacag

SEQ ID NO: 3643964 - DNA, 16 bp, Homo sapiens
tgtgttggtatttact

SEQ ID NO: 3643965 - DNA, 16 bp, Homo sapiens
tgttaaaataattata

SEQ ID NO: 3643966 - DNA, 16 bp, Homo sapiens
tgttaatgattcttgt

SEQ ID NO: 3643967 - DNA, 14 bp, Homo sapiens
tgttagaaaaaact

SEQ ID NO: 3643968 - DNA, 17 bp, Homo sapiens
tgttataaaatctgtat

SEQ ID NO: 3643969 - DNA, 21 bp, Homo sapiens
tgttattcaataactattgct

SEQ ID NO: 3643970 - DNA, 14 bp, Homo sapiens
tgttcaaattctga

SEQ ID NO: 3643971 - DNA, 22 bp, Homo sapiens
tgttcatataggggcaaaaatt

SEQ ID NO: 3643972 - DNA, 23 bp, Homo sapiens
tgttctcaacacacagtatagat

SEQ ID NO: 3643973 - DNA, 16 bp, Homo sapiens
tgttgaagtgcatgtt

SEQ ID NO: 3643974 - DNA, 19 bp, Homo sapiens
tgttgaagtgcatgttaaa

SEQ ID NO: 3643975 - DNA, 21 bp, Homo sapiens
tgttgaagtgcatgttaaaat

SEQ ID NO: 3643976 - DNA, 17 bp, Homo sapiens
tgttggccatcatttca

SEQ ID NO: 3643977 - DNA, 13 bp, Homo sapiens
tgttgtggggatg

SEQ ID NO: 3643978 - DNA, 12 bp, Homo sapiens
tgttttcattct

SEQ ID NO: 3643979 - DNA, 15 bp, Homo sapiens
tgttttcattctggt

SEQ ID NO: 3643980 - DNA, 21 bp, Homo sapiens
ttaaaaagacacttttaccga

SEQ ID NO: 3643981 - DNA, 22 bp, Homo sapiens
ttaaaataattatatgaagcag

SEQ ID NO: 3643982 - DNA, 14 bp, Homo sapiens
ttaaaatatagtgt

SEQ ID NO: 3643983 - DNA, 23 bp, Homo sapiens
ttaaaatgattcacttttattgt

SEQ ID NO: 3643984 - DNA, 22 bp, Homo sapiens
ttaaaattggttaatgaaaaat

SEQ ID NO: 3643985 - DNA, 17 bp, Homo sapiens
ttaaacaaaatttatgt

SEQ ID NO: 3643986 - DNA, 16 bp, Homo sapiens
ttaaactgggaaatga

SEQ ID NO: 3643987 - DNA, 24 bp, Homo sapiens
ttaaagaagtccatgtgataattg

SEQ ID NO: 3643988 - DNA, 16 bp, Homo sapiens
ttaaatctttgttaaa

SEQ ID NO: 3643989 - DNA, 15 bp, Homo sapiens
ttaaatgaaatactt

SEQ ID NO: 3643990 - DNA, 23 bp, Homo sapiens
tttaaatctttgttaaaatatag

SEQ ID NO: 3643991 - DNA, 22 bp, Homo sapiens
tttaacatagcagctggttaac

SEQ ID NO: 3643992 - DNA, 20 bp, Homo sapiens
tttaattcttaccgaaatga

SEQ ID NO: 3643993 - DNA, 18 bp, Homo sapiens
tttacatatagctttgca

SEQ ID NO: 3643994 - DNA, 19 bp, Homo sapiens
tttacatatagctttgcaa

SEQ ID NO: 3643995 - DNA, 20 bp, Homo sapiens
tttaccatcaaacaaatcat

SEQ ID NO: 3643996 - DNA, 18 bp, Homo sapiens
tttacttgattaaggact

SEQ ID NO: 3643997 - DNA, 17 bp, Homo sapiens
tttagcatgagttctgc

SEQ ID NO: 3643998 - DNA, 15 bp, Homo sapiens
tttataacattgtaa

SEQ ID NO: 3643999 - DNA, 16 bp, Homo sapiens
tttatttttgctctcc

SEQ ID NO: 3644000 - DNA, 14 bp, Homo sapiens
tttcaaccacacct

SEQ ID NO: 3644001 - DNA, 16 bp, Homo sapiens
tttcactacttagcat

SEQ ID NO: 3644002 - DNA, 18 bp, Homo sapiens
tttcacttcttaaggaca

SEQ ID NO: 3644003 - DNA, 24 bp, Homo sapiens
tttcattcgtgggcctgctgctct

SEQ ID NO: 3644004 - DNA, 16 bp, Homo sapiens
tttcattctggtcctt

SEQ ID NO: 3644005 - DNA, 20 bp, Homo sapiens
tttccagctaagcctgatga

SEQ ID NO: 3644006 - DNA, 21 bp, Homo sapiens
tttccatacgtgcccatttca

SEQ ID NO: 3644007 - DNA, 22 bp, Homo sapiens
tttccatacgtgcccatttcac

SEQ ID NO: 3644008 - DNA, 16 bp, Homo sapiens
tttccatttggatttt

SEQ ID NO: 3644009 - DNA, 17 bp, Homo sapiens
tttcccagcctcttcca

SEQ ID NO: 3644010 - DNA, 19 bp, Homo sapiens
tttcctttcttccttcctt

SEQ ID NO: 3644011 - DNA, 15 bp, Homo sapiens
tttctagcaattgct

SEQ ID NO: 3644012 - DNA, 15 bp, Homo sapiens
tttctagtaacagta

SEQ ID NO: 3644013 - DNA, 21 bp, Homo sapiens
tttctagtaacagtatttcca

SEQ ID NO: 3644014 - DNA, 22 bp, Homo sapiens
tttctgaatttttttttaacat

SEQ ID NO: 3644015 - DNA, 21 bp, Homo sapiens
tttctgagtagcatatataat

SEQ ID NO: 3644016 - DNA, 22 bp, Homo sapiens
tttctgagtagcatatataatt

SEQ ID NO: 3644017 - DNA, 20 bp, Homo sapiens
tttctgatacatctgtcagt

SEQ ID NO: 3644018 - DNA, 11 bp, Homo sapiens
tttcttccttc

SEQ ID NO: 3644019 - DNA, 17 bp, Homo sapiens
tttcttggtatgatcat

SEQ ID NO: 3644020 - DNA, 15 bp, Homo sapiens
tttcttttgtgcata

SEQ ID NO: 3644021 - DNA, 23 bp, Homo sapiens
tttctttttttttttttttgaga

SEQ ID NO: 3644022 - DNA, 19 bp, Homo sapiens
tttgacatgagtctccaga

SEQ ID NO: 3644023 - DNA, 20 bp, Homo sapiens
tttgacatgagtctccagat

SEQ ID NO: 3644024 - DNA, 19 bp, Homo sapiens
tttgacattgtcagaatgt

SEQ ID NO: 3644025 - DNA, 14 bp, Homo sapiens
tttgaggaaactca

SEQ ID NO: 3644026 - DNA, 15 bp, Homo sapiens
tttgaggaaactcat

SEQ ID NO: 3644027 - DNA, 14 bp, Homo sapiens
tttgagtaaaactt

SEQ ID NO: 3644028 - DNA, 17 bp, Homo sapiens
tttgatgaataaaatgt

SEQ ID NO: 3644029 - DNA, 18 bp, Homo sapiens
tttgatgaataaaatgtt

SEQ ID NO: 3644030 - DNA, 16 bp, Homo sapiens
tttgatttgcaacact

SEQ ID NO: 3644031 - DNA, 20 bp, Homo sapiens
tttgatttgcaacactgcca

SEQ ID NO: 3644032 - DNA, 22 bp, Homo sapiens
tttgcaaccttgtactttacaa

SEQ ID NO: 3644033 - DNA, 16 bp, Homo sapiens
tttggattttaaacaa

SEQ ID NO: 3644034 - DNA, 20 bp, Homo sapiens
tttggtatgaaacaaatata

SEQ ID NO: 3644035 - DNA, 17 bp, Homo sapiens
tttgtgaaagtggcaag

SEQ ID NO: 3644036 - DNA, 18 bp, Homo sapiens
tttgttaaaatatagtgt

SEQ ID NO: 3644037 - DNA, 17 bp, Homo sapiens
ttttaaagaagtccatg

SEQ ID NO: 3644038 - DNA, 20 bp, Homo sapiens
ttttaaagaagtccatgtga

SEQ ID NO: 3644039 - DNA, 21 bp, Homo sapiens
ttttacaaagaaacaaaatat

SEQ ID NO: 3644040 - DNA, 22 bp, Homo sapiens
ttttagaagcagcgagtgcatg

SEQ ID NO: 3644041 - DNA, 17 bp, Homo sapiens
ttttataaatgttttaa

SEQ ID NO: 3644042 - DNA, 18 bp, Homo sapiens
ttttatgagacttcctat

SEQ ID NO: 3644043 - DNA, 20 bp, Homo sapiens
ttttatgagacttcctatta

SEQ ID NO: 3644044 - DNA, 13 bp, Homo sapiens
ttttcacttctta

SEQ ID NO: 3644045 - DNA, 22 bp, Homo sapiens
ttttcattctggtccttagtaa

SEQ ID NO: 3644046 - DNA, 9 bp, Homo sapiens
ttttgagac

SEQ ID NO: 3644047 - DNA, 16 bp, Homo sapiens
ttttgagccttattaa

SEQ ID NO: 3644048 - DNA, 13 bp, Homo sapiens
ttttgatgtatta

SEQ ID NO: 3644049 - DNA, 11 bp, Homo sapiens
tttttgtgaat

SEQ ID NO: 3644050 - DNA, 19 bp, Homo sapiens
tgaattatcttggatgaga

SEQ ID NO: 3644051 - DNA, 16 bp, Homo sapiens
tgaattttttttctga

SEQ ID NO: 3644052 - DNA, 20 bp, Homo sapiens
tgaattttttttctgaattt

SEQ ID NO: 3644053 - DNA, 12 bp, Homo sapiens
tgacaacatttt

SEQ ID NO: 3644054 - DNA, 16 bp, Homo sapiens
tgacacaacatctgag

SEQ ID NO: 3644055 - DNA, 17 bp, Homo sapiens
tgacacaacatctgaga

SEQ ID NO: 3644056 - DNA, 21 bp, Homo sapiens
tgacagcatttcagctgtgag

SEQ ID NO: 3644057 - DNA, 20 bp, Homo sapiens
tgacagtggttatatttcaa

SEQ ID NO: 3644058 - DNA, 15 bp, Homo sapiens
tgacagttacttaca

SEQ ID NO: 3644059 - DNA, 18 bp, Homo sapiens
tgacagttacttacacac

SEQ ID NO: 3644060 - DNA, 17 bp, Homo sapiens
tgacatgagtctccaga

SEQ ID NO: 3644061 - DNA, 20 bp, Homo sapiens
tgacattgtcagaatgttgt

SEQ ID NO: 3644062 - DNA, 11 bp, Homo sapiens
tgacctgaatt

SEQ ID NO: 3644063 - DNA, 12 bp, Homo sapiens
tgacctgaattg

SEQ ID NO: 3644064 - DNA, 19 bp, Homo sapiens
tgacctgaattgaaagaga

SEQ ID NO: 3644065 - DNA, 16 bp, Homo sapiens
tgacctgcctcccttc

SEQ ID NO: 3644066 - DNA, 17 bp, Homo sapiens
tgacctgcctcccttca

SEQ ID NO: 3644067 - DNA, 21 bp, Homo sapiens
tgacctgcctcccttcatgca

SEQ ID NO: 3644068 - DNA, 23 bp, Homo sapiens
tgacctgcctcccttcatgcatg

SEQ ID NO: 3644069 - DNA, 18 bp, Homo sapiens
tgacgtcttaggtggcag

SEQ ID NO: 3644070 - DNA, 15 bp, Homo sapiens
tgacttggagagaga

SEQ ID NO: 3644071 - DNA, 16 bp, Homo sapiens
tgactttcctatgaca

SEQ ID NO: 3644072 - DNA, 20 bp, Homo sapiens
tgagaaagacatctgaggaa

SEQ ID NO: 3644073 - DNA, 13 bp, Homo sapiens
tgagactccatct

SEQ ID NO: 3644074 - DNA, 14 bp, Homo sapiens
tgagactggaaaag

SEQ ID NO: 3644075 - DNA, 19 bp, Homo sapiens
tgagacttcctattaattt

SEQ ID NO: 3644076 - DNA, 22 bp, Homo sapiens
tgagacttcctattaatttatt

SEQ ID NO: 3644077 - DNA, 19 bp, Homo sapiens
tgagatttagggttctata

SEQ ID NO: 3644078 - DNA, 22 bp, Homo sapiens
tgagcatgcccaaatataacat

SEQ ID NO: 3644079 - DNA, 14 bp, Homo sapiens
tgaggaagaggttg

SEQ ID NO: 3644080 - DNA, 15 bp, Homo sapiens
tgagtagcatatata

SEQ ID NO: 3644081 - DNA, 19 bp, Homo sapiens
tgagtgcaagagcctgaga

SEQ ID NO: 3644082 - DNA, 14 bp, Homo sapiens
tgagtgttagaaaa

SEQ ID NO: 3644083 - DNA, 20 bp, Homo sapiens
tgagttctgcacatacagat

SEQ ID NO: 3644084 - DNA, 19 bp, Homo sapiens
tgataatagctcacagcac

SEQ ID NO: 3644085 - DNA, 24 bp, Homo sapiens
tgatagaagaaggactgaagaaaa

SEQ ID NO: 3644086 - DNA, 16 bp, Homo sapiens
tgatatgtctttaaaa

SEQ ID NO: 3644087 - DNA, 20 bp, Homo sapiens
tgatatgtctttaaaatgat

SEQ ID NO: 3644088 - DNA, 18 bp, Homo sapiens
tgatctcagcatcctgga

SEQ ID NO: 3644089 - DNA, 15 bp, Homo sapiens
tgatggaagggcctt

SEQ ID NO: 3644090 - DNA, 20 bp, Homo sapiens
tgatgtattattatatatgt

SEQ ID NO: 3644091 - DNA, 11 bp, Homo sapiens
tgattaaggac

SEQ ID NO: 3644092 - DNA, 18 bp, Homo sapiens
tgattaaggactacagaa

SEQ ID NO: 3644093 - DNA, 14 bp, Homo sapiens
tgattcttgtgtca

SEQ ID NO: 3644094 - DNA, 12 bp, Homo sapiens
tgatttaacatt

SEQ ID NO: 3644095 - DNA, 14 bp, Homo sapiens
tgatttctgaacta

SEQ ID NO: 3644096 - DNA, 18 bp, Homo sapiens
tgatttgcaacactgcca

SEQ ID NO: 3644097 - DNA, 18 bp, Homo sapiens
tgcaaagtgttgtcttat

SEQ ID NO: 3644098 - DNA, 16 bp, Homo sapiens
tgcaagtgagaaagac

SEQ ID NO: 3644099 - DNA, 17 bp, Homo sapiens
tgcaagtgagaaagaca

SEQ ID NO: 3644100 - DNA, 13 bp, Homo sapiens
tgcacatacagat

SEQ ID NO: 3644101 - DNA, 18 bp, Homo sapiens
tgcagagtatacaagtgt

SEQ ID NO: 3644102 - DNA, 17 bp, Homo sapiens
tgcagcccccactgcct

SEQ ID NO: 3644103 - DNA, 22 bp, Homo sapiens
tgcaggactctatccctggctt

SEQ ID NO: 3644104 - DNA, 23 bp, Homo sapiens
tgcaggcagccttgcccattctc

SEQ ID NO: 3644105 - DNA, 20 bp, Homo sapiens
tgcagttatttaccagaagt

SEQ ID NO: 3644106 - DNA, 20 bp, Homo sapiens
tgcatctagctggagccccg

SEQ ID NO: 3644107 - DNA, 11 bp, Homo sapiens
tgcatggaaat

SEQ ID NO: 3644108 - DNA, 19 bp, Homo sapiens
tgcatggaaattcccttca

SEQ ID NO: 3644109 - DNA, 17 bp, Homo sapiens
tgcatgttaaaataatt

SEQ ID NO: 3644110 - DNA, 16 bp, Homo sapiens
tgccaccctcatgctg

SEQ ID NO: 3644111 - DNA, 16 bp, Homo sapiens
tgccattacactccag

SEQ ID NO: 3644112 - DNA, 21 bp, Homo sapiens
tgccattacactccagcctgg

SEQ ID NO: 3644113 - DNA, 23 bp, Homo sapiens
tgccatttcctcctgggcaacag

SEQ ID NO: 3644114 - DNA, 15 bp, Homo sapiens
tgcccactcccatcc

SEQ ID NO: 3644115 - DNA, 22 bp, Homo sapiens
tgcccacttaccctgggctgga

SEQ ID NO: 3644116 - DNA, 17 bp, Homo sapiens
tgcccatttcacacaac

SEQ ID NO: 3644117 - DNA, 14 bp, Homo sapiens
tgccgtggcaactg

SEQ ID NO: 3644118 - DNA, 13 bp, Homo sapiens
tgcctacattagt

SEQ ID NO: 3644119 - DNA, 17 bp, Homo sapiens
tgcctggccaacataat

SEQ ID NO: 3644120 - DNA, 17 bp, Homo sapiens
tgcctgtaatcccagca

SEQ ID NO: 3644121 - DNA, 18 bp, Homo sapiens
tgccttatattattttct

SEQ ID NO: 3644122 - DNA, 22 bp, Homo sapiens
tgctaaagtcaggccattcagt

SEQ ID NO: 3644123 - DNA, 19 bp, Homo sapiens
tgctattcgtaagttctgt

SEQ ID NO: 3644124 - DNA, 16 bp, Homo sapiens
tgctcatctacacata

SEQ ID NO: 3644125 - DNA, 23 bp, Homo sapiens
tgctctgcaggcagccttgccca

SEQ ID NO: 3644126 - DNA, 20 bp, Homo sapiens
tgctgctctctaagaattca

SEQ ID NO: 3644127 - DNA, 13 bp, Homo sapiens
tgctgctgtggca

SEQ ID NO: 3644128 - DNA, 18 bp, Homo sapiens
tgctgtaaataaaaatag

SEQ ID NO: 3644129 - DNA, 19 bp, Homo sapiens
tgctgtatttgaggaaact

SEQ ID NO: 3644130 - DNA, 18 bp, Homo sapiens
tgcttcacacaaagtgaa

SEQ ID NO: 3644131 - DNA, 16 bp, Homo sapiens
tgcttctctaaaacag

SEQ ID NO: 3644132 - DNA, 19 bp, Homo sapiens
tgcttgaacctgtgaggaa

SEQ ID NO: 3644133 - DNA, 20 bp, Homo sapiens
tgcttgaacctgtgaggaag

SEQ ID NO: 3644134 - DNA, 22 bp, Homo sapiens
tgcttgagcatgcccaaatata

SEQ ID NO: 3644135 - DNA, 21 bp, Homo sapiens
tggaaaatgttctgacagcat

SEQ ID NO: 3644136 - DNA, 15 bp, Homo sapiens
tggaaagatggggag

SEQ ID NO: 3644137 - DNA, 17 bp, Homo sapiens
tggaaattcccttcatc

SEQ ID NO: 3644138 - DNA, 18 bp, Homo sapiens
tggaaattcccttcatct

SEQ ID NO: 3644139 - DNA, 19 bp, Homo sapiens
tggaaatttgtgtgcttca

SEQ ID NO: 3644140 - DNA, 15 bp, Homo sapiens
tggaagaagaaccag

SEQ ID NO: 3644141 - DNA, 16 bp, Homo sapiens
tggaagaattcatgat

SEQ ID NO: 3644142 - DNA, 19 bp, Homo sapiens
tggaagagctgctgtattt

SEQ ID NO: 3644143 - DNA, 17 bp, Homo sapiens
tggaagtgactttggct

SEQ ID NO: 3644144 - DNA, 12 bp, Homo sapiens
tggactccagct

SEQ ID NO: 3644145 - DNA, 13 bp, Homo sapiens
tggactccagctc

SEQ ID NO: 3644146 - DNA, 16 bp, Homo sapiens
tggacttgtctcccag

SEQ ID NO: 3644147 - DNA, 15 bp, Homo sapiens
tggagactaacttat

SEQ ID NO: 3644148 - DNA, 13 bp, Homo sapiens
tggagagggatgg

SEQ ID NO: 3644149 - DNA, 12 bp, Homo sapiens
tggaggaaggaa

SEQ ID NO: 3644150 - DNA, 13 bp, Homo sapiens
tggaggaaggaaa

SEQ ID NO: 3644151 - DNA, 15 bp, Homo sapiens
tggaggaaggaaaca

SEQ ID NO: 3644152 - DNA, 16 bp, Homo sapiens
tggaggtagggctggc

SEQ ID NO: 3644153 - DNA, 18 bp, Homo sapiens
tggaggtagggctggctg

SEQ ID NO: 3644154 - DNA, 19 bp, Homo sapiens
tggaggtgttgtggggatg

SEQ ID NO: 3644155 - DNA, 20 bp, Homo sapiens
tggaggtgttgtggggatgg

SEQ ID NO: 3644156 - DNA, 15 bp, Homo sapiens
tggatataaatctta

SEQ ID NO: 3644157 - DNA, 17 bp, Homo sapiens
tggatggaggtgatgaa

SEQ ID NO: 3644158 - DNA, 16 bp, Homo sapiens
tggattttaaacaaaa

SEQ ID NO: 3644159 - DNA, 22 bp, Homo sapiens
tggattttaaacaaaatttatg

SEQ ID NO: 3644160 - DNA, 23 bp, Homo sapiens
tggattttaaacaaaatttatgt

SEQ ID NO: 3644161 - DNA, 15 bp, Homo sapiens
tggcaacatttgggg

SEQ ID NO: 3644162 - DNA, 20 bp, Homo sapiens
tggcaacgttcatgttcatc

SEQ ID NO: 3644163 - DNA, 21 bp, Homo sapiens
tggcagggctgttccctccag

SEQ ID NO: 3644164 - DNA, 20 bp, Homo sapiens
tggcatttctttatgaaaaa

SEQ ID NO: 3644165 - DNA, 12 bp, Homo sapiens
tggcatttgcag

SEQ ID NO: 3644166 - DNA, 20 bp, Homo sapiens
tggccattggctagaatcag

SEQ ID NO: 3644167 - DNA, 20 bp, Homo sapiens
tggctagaatcagggtggag

SEQ ID NO: 3644168 - DNA, 21 bp, Homo sapiens
tggctagaatcagggtggaga

SEQ ID NO: 3644169 - DNA, 17 bp, Homo sapiens
tggctgaagaaacacag

SEQ ID NO: 3644170 - DNA, 19 bp, Homo sapiens
tggctgaagaaacacagca

SEQ ID NO: 3644171 - DNA, 20 bp, Homo sapiens
tggctgaagaaacacagcat

SEQ ID NO: 3644172 - DNA, 12 bp, Homo sapiens
tggctgcatgcg

SEQ ID NO: 3644173 - DNA, 15 bp, Homo sapiens
tggctggaggaagga

SEQ ID NO: 3644174 - DNA, 16 bp, Homo sapiens
tggcttccccttcaga

SEQ ID NO: 3644175 - DNA, 19 bp, Homo sapiens
tgggaatctaagtgggaga

SEQ ID NO: 3644176 - DNA, 16 bp, Homo sapiens
tgggaggccgaggcag

SEQ ID NO: 3644177 - DNA, 17 bp, Homo sapiens
tgggaggccgaggcagg

SEQ ID NO: 3644178 - DNA, 21 bp, Homo sapiens
tgggaggccgaggcaggtgga

SEQ ID NO: 3644179 - DNA, 19 bp, Homo sapiens
tgggcagacaggtgggaga

SEQ ID NO: 3644180 - DNA, 22 bp, Homo sapiens
tgggcagacaggtgggagatgg

SEQ ID NO: 3644181 - DNA, 22 bp, Homo sapiens
tgggctgaagggaagcccagcc

SEQ ID NO: 3644182 - DNA, 18 bp, Homo sapiens
tggggagctctggaggtg

SEQ ID NO: 3644183 - DNA, 17 bp, Homo sapiens
tggggatggtgatggag

SEQ ID NO: 3644184 - DNA, 21 bp, Homo sapiens
tgggtggcaacatttggggag

SEQ ID NO: 3644185 - DNA, 13 bp, Homo sapiens
tgggttaacagta

SEQ ID NO: 3644186 - DNA, 23 bp, Homo sapiens
tcagggtagcagcagaggcagga

SEQ ID NO: 3644187 - DNA, 16 bp, Homo sapiens
tcaggtggcatttgca

SEQ ID NO: 3644188 - DNA, 17 bp, Homo sapiens
tcaggtggcatttgcag

SEQ ID NO: 3644189 - DNA, 16 bp, Homo sapiens
tcaggttcctacagga

SEQ ID NO: 3644190 - DNA, 18 bp, Homo sapiens
tcaggttcctacaggaga

SEQ ID NO: 3644191 - DNA, 21 bp, Homo sapiens
tcaggtttccggctactgaca

SEQ ID NO: 3644192 - DNA, 14 bp, Homo sapiens
tcagtagcatttta

SEQ ID NO: 3644193 - DNA, 21 bp, Homo sapiens
tcagtctatgctgtgtgcaga

SEQ ID NO: 3644194 - DNA, 16 bp, Homo sapiens
tcagtggacatttgtt

SEQ ID NO: 3644195 - DNA, 18 bp, Homo sapiens
tcagtgttataaaatctg

SEQ ID NO: 3644196 - DNA, 22 bp, Homo sapiens
tcagttaggattaggtttagaa

SEQ ID NO: 3644197 - DNA, 14 bp, Homo sapiens
tcatagcacatgtt

SEQ ID NO: 3644198 - DNA, 15 bp, Homo sapiens
tcatagcacatgttt

SEQ ID NO: 3644199 - DNA, 23 bp, Homo sapiens
tcatcaagtagtagtacttaata

SEQ ID NO: 3644200 - DNA, 12 bp, Homo sapiens
tcatctggaacc

SEQ ID NO: 3644201 - DNA, 18 bp, Homo sapiens
tcatctggaaccatcaga

SEQ ID NO: 3644202 - DNA, 22 bp, Homo sapiens
tcatgaacatggtcagaacctt

SEQ ID NO: 3644203 - DNA, 17 bp, Homo sapiens
tcatgcaagtgagaaag

SEQ ID NO: 3644204 - DNA, 20 bp, Homo sapiens
tcatgcaagtgagaaagaca

SEQ ID NO: 3644205 - DNA, 20 bp, Homo sapiens
tcatgcctgtaatcccagca

SEQ ID NO: 3644206 - DNA, 12 bp, Homo sapiens
tcatgtacttaa

SEQ ID NO: 3644207 - DNA, 16 bp, Homo sapiens
tcattccattctggaa

SEQ ID NO: 3644208 - DNA, 14 bp, Homo sapiens
tcattgcactgcag

SEQ ID NO: 3644209 - DNA, 11 bp, Homo sapiens
tcattgccttg

SEQ ID NO: 3644210 - DNA, 18 bp, Homo sapiens
tcatttggatataaatct

SEQ ID NO: 3644211 - DNA, 22 bp, Homo sapiens
tccaaaagcaggaacccatcta

SEQ ID NO: 3644212 - DNA, 17 bp, Homo sapiens
tccacaacctcctcctc

SEQ ID NO: 3644213 - DNA, 18 bp, Homo sapiens
tccacaatcatctattga

SEQ ID NO: 3644214 - DNA, 21 bp, Homo sapiens
tccacccccgttagcttcctg

SEQ ID NO: 3644215 - DNA, 22 bp, Homo sapiens
tccagctaagcctgatgatgga

SEQ ID NO: 3644216 - DNA, 14 bp, Homo sapiens
tccagggacaagct

SEQ ID NO: 3644217 - DNA, 22 bp, Homo sapiens
tccagtgtggtcttgtttaata

SEQ ID NO: 3644218 - DNA, 15 bp, Homo sapiens
tccagttctgatgag

SEQ ID NO: 3644219 - DNA, 22 bp, Homo sapiens
tccatcgatttgtattaatgta

SEQ ID NO: 3644220 - DNA, 13 bp, Homo sapiens
tccattctggaag

SEQ ID NO: 3644221 - DNA, 13 bp, Homo sapiens
tccatttcccact

SEQ ID NO: 3644222 - DNA, 20 bp, Homo sapiens
tccatttggattttaaacaa

SEQ ID NO: 3644223 - DNA, 21 bp, Homo sapiens
tcccaacccaggattcaacat

SEQ ID NO: 3644224 - DNA, 16 bp, Homo sapiens
tcccacattttagaat

SEQ ID NO: 3644225 - DNA, 18 bp, Homo sapiens
tcccacattttagaatac

SEQ ID NO: 3644226 - DNA, 14 bp, Homo sapiens
tcccagttgtccgt

SEQ ID NO: 3644227 - DNA, 17 bp, Homo sapiens
tcccatggtagactgtg

SEQ ID NO: 3644228 - DNA, 20 bp, Homo sapiens
tcccatggtagactgtgaca

SEQ ID NO: 3644229 - DNA, 15 bp, Homo sapiens
tccctaaacatagtg

SEQ ID NO: 3644230 - DNA, 19 bp, Homo sapiens
tccctatctttgccaccct

SEQ ID NO: 3644231 - DNA, 19 bp, Homo sapiens
tcctaggacatctctgtaa

SEQ ID NO: 3644232 - DNA, 15 bp, Homo sapiens
tcctattaatttatt

SEQ ID NO: 3644233 - DNA, 15 bp, Homo sapiens
tcctgcatgtatgcc

SEQ ID NO: 3644234 - DNA, 19 bp, Homo sapiens
tcctggaaatttgtgtgct

SEQ ID NO: 3644235 - DNA, 21 bp, Homo sapiens
tcctgtaacctcatcgggatt

SEQ ID NO: 3644236 - DNA, 19 bp, Homo sapiens
tcctgtagagagagaccta

SEQ ID NO: 3644237 - DNA, 13 bp, Homo sapiens
tcctgtctcccag

SEQ ID NO: 3644238 - DNA, 15 bp, Homo sapiens
tcctgttgttttctt

SEQ ID NO: 3644239 - DNA, 19 bp, Homo sapiens
tccttaaaaagaccatgca

SEQ ID NO: 3644240 - DNA, 15 bp, Homo sapiens
tccttagtaaattcc

SEQ ID NO: 3644241 - DNA, 22 bp, Homo sapiens
tccttcttccccaatatgcctg

SEQ ID NO: 3644242 - DNA, 14 bp, Homo sapiens
tcctttctctcttt

SEQ ID NO: 3644243 - DNA, 15 bp, Homo sapiens
tcctttcttccttcc

SEQ ID NO: 3644244 - DNA, 16 bp, Homo sapiens
tcctttcttccttcct

SEQ ID NO: 3644245 - DNA, 17 bp, Homo sapiens
tcctttcttccttcctt

SEQ ID NO: 3644246 - DNA, 18 bp, Homo sapiens
tccttttccatcccactc

SEQ ID NO: 3644247 - DNA, 20 bp, Homo sapiens
tccttttccatcccactcca

SEQ ID NO: 3644248 - DNA, 14 bp, Homo sapiens
tctaaaccagaagg

SEQ ID NO: 3644249 - DNA, 18 bp, Homo sapiens
tctaaaccagaaggaagc

SEQ ID NO: 3644250 - DNA, 14 bp, Homo sapiens
tctaaaccatgaaa

SEQ ID NO: 3644251 - DNA, 22 bp, Homo sapiens
tctaaaccatgaaaagttttca

SEQ ID NO: 3644252 - DNA, 22 bp, Homo sapiens
tctaaaggtttcactgttcatg

SEQ ID NO: 3644253 - DNA, 15 bp, Homo sapiens
tctacaaacttttat

SEQ ID NO: 3644254 - DNA, 19 bp, Homo sapiens
tctacacatataaacacag

SEQ ID NO: 3644255 - DNA, 23 bp, Homo sapiens
tctataggacttaatttagcagt

SEQ ID NO: 3644256 - DNA, 15 bp, Homo sapiens
tctatgattaaactg

SEQ ID NO: 3644257 - DNA, 23 bp, Homo sapiens
tctatgctgtgtgcagagtatac

SEQ ID NO: 3644258 - DNA, 20 bp, Homo sapiens
tctcagaagtgaaaaagact

SEQ ID NO: 3644259 - DNA, 19 bp, Homo sapiens
tctcagcatcctggaaatt

SEQ ID NO: 3644260 - DNA, 20 bp, Homo sapiens
tctcagctactcaggaggct

SEQ ID NO: 3644261 - DNA, 19 bp, Homo sapiens
tctcaggtggcatttgcag

SEQ ID NO: 3644262 - DNA, 19 bp, Homo sapiens
tctccctcccttctttcct

SEQ ID NO: 3644263 - DNA, 20 bp, Homo sapiens
tctccctcccttctttcctt

SEQ ID NO: 3644264 - DNA, 23 bp, Homo sapiens
tctcctttgtcaaatggtatttt

SEQ ID NO: 3644265 - DNA, 20 bp, Homo sapiens
tctcgccaggctggagtgta

SEQ ID NO: 3644266 - DNA, 23 bp, Homo sapiens
tctctagtgcaggaaaaggctgc

SEQ ID NO: 3644267 - DNA, 19 bp, Homo sapiens
tctctctttcttttgtgca

SEQ ID NO: 3644268 - DNA, 20 bp, Homo sapiens
tctctgtaaaaagcaggtga

SEQ ID NO: 3644269 - DNA, 9 bp, Homo sapiens
tctcttcca

SEQ ID NO: 3644270 - DNA, 22 bp, Homo sapiens
tctgaggaaaatggaagaccta

SEQ ID NO: 3644271 - DNA, 14 bp, Homo sapiens
tctgattattacaa

SEQ ID NO: 3644272 - DNA, 13 bp, Homo sapiens
tctgcaggcagcc

SEQ ID NO: 3644273 - DNA, 17 bp, Homo sapiens
tctgcaggcagccttgc

SEQ ID NO: 3644274 - DNA, 18 bp, Homo sapiens
tctggaagtgactttggc

SEQ ID NO: 3644275 - DNA, 18 bp, Homo sapiens
tctggaggtgttgtgggg

SEQ ID NO: 3644276 - DNA, 18 bp, Homo sapiens
tctgtaaaaagcaggtga

SEQ ID NO: 3644277 - DNA, 23 bp, Homo sapiens
tctgtaattcttctcctttgtca

SEQ ID NO: 3644278 - DNA, 14 bp, Homo sapiens
tctgtcaatgaaaa

SEQ ID NO: 3644279 - DNA, 18 bp, Homo sapiens
tctgtcagtgagtcagag

SEQ ID NO: 3644280 - DNA, 16 bp, Homo sapiens
tctgtccctaaacata

SEQ ID NO: 3644281 - DNA, 17 bp, Homo sapiens
tctgtccctaaacatag

SEQ ID NO: 3644282 - DNA, 18 bp, Homo sapiens
tctgtccctaaacatagt

SEQ ID NO: 3644283 - DNA, 19 bp, Homo sapiens
tctgtccctaaacatagtg

SEQ ID NO: 3644284 - DNA, 22 bp, Homo sapiens
tctgtctataggacttaattta

SEQ ID NO: 3644285 - DNA, 20 bp, Homo sapiens
tctgtgcagtttggtatgaa

SEQ ID NO: 3644286 - DNA, 19 bp, Homo sapiens
tctgtgtaagacacgtgca

SEQ ID NO: 3644287 - DNA, 13 bp, Homo sapiens
tcttaaaaattat

SEQ ID NO: 3644288 - DNA, 16 bp, Homo sapiens
tcttaaaattggttaa

SEQ ID NO: 3644289 - DNA, 18 bp, Homo sapiens
tcttaactaatgtaaata

SEQ ID NO: 3644290 - DNA, 20 bp, Homo sapiens
tcttaactaatgtaaatatt

SEQ ID NO: 3644291 - DNA, 16 bp, Homo sapiens
tcttaaggacagtgtt

SEQ ID NO: 3644292 - DNA, 18 bp, Homo sapiens
tcttaaggacagtgttca

SEQ ID NO: 3644293 - DNA, 13 bp, Homo sapiens
tcttaattatggt

SEQ ID NO: 3644294 - DNA, 14 bp, Homo sapiens
tcttaccgaaatga

SEQ ID NO: 3644295 - DNA, 14 bp, Homo sapiens
tcttccactgagtc

SEQ ID NO: 3644296 - DNA, 19 bp, Homo sapiens
tcttctggtgagtgcaaga

SEQ ID NO: 3644297 - DNA, 23 bp, Homo sapiens
tctttatgaaaaaaaaagaaatc

SEQ ID NO: 3644298 - DNA, 17 bp, Homo sapiens
tctttcttttgtgcata

SEQ ID NO: 3644299 - DNA, 14 bp, Homo sapiens
tctttgccaccctc

SEQ ID NO: 3644300 - DNA, 17 bp, Homo sapiens
tctttgccaccctcatg

SEQ ID NO: 3644301 - DNA, 15 bp, Homo sapiens
tcttttgtgtcctgt

SEQ ID NO: 3644302 - DNA, 15 bp, Homo sapiens
tgaaaaatctgaatt

SEQ ID NO: 3644303 - DNA, 16 bp, Homo sapiens
tgaaaaatctgaattt

SEQ ID NO: 3644304 - DNA, 19 bp, Homo sapiens
tgaaaaatctgaatttcta

SEQ ID NO: 3644305 - DNA, 23 bp, Homo sapiens
tgaaaccctgtctctactaaaag

SEQ ID NO: 3644306 - DNA, 21 bp, Homo sapiens
tgaaagtcaagtctacctgcc

SEQ ID NO: 3644307 - DNA, 17 bp, Homo sapiens
tgaaattagtattttga

SEQ ID NO: 3644308 - DNA, 18 bp, Homo sapiens
tgaaattagtattttgag

SEQ ID NO: 3644309 - DNA, 21 bp, Homo sapiens
tgaactatcagggcaagctca

SEQ ID NO: 3644310 - DNA, 16 bp, Homo sapiens
tgaactttgctgagcc

SEQ ID NO: 3644311 - DNA, 19 bp, Homo sapiens
tgaagaaaatccttcagca

SEQ ID NO: 3644312 - DNA, 13 bp, Homo sapiens
tgaagaaacacag

SEQ ID NO: 3644313 - DNA, 16 bp, Homo sapiens
tgaagaaacacagcat

SEQ ID NO: 3644314 - DNA, 20 bp, Homo sapiens
tgaagaaacacagcatgcat

SEQ ID NO: 3644315 - DNA, 13 bp, Homo sapiens
tgaagcagaatga

SEQ ID NO: 3644316 - DNA, 15 bp, Homo sapiens
tgaagccctaagtaa

SEQ ID NO: 3644317 - DNA, 22 bp, Homo sapiens
tgaagtagtgtgagtgttagaa

SEQ ID NO: 3644318 - DNA, 13 bp, Homo sapiens
tgaagtgcatgtt

SEQ ID NO: 3644319 - DNA, 14 bp, Homo sapiens
tgaataagattaat

SEQ ID NO: 3644320 - DNA, 17 bp, Homo sapiens
tgaattatcttggatga

SEQ ID NO: 3644321 - DNA, 18 bp, Homo sapiens
tgaattatcttggatgag

SEQ ID NO: 3644322 - DNA, 16 bp, Homo sapiens
tacattagtgagattt

SEQ ID NO: 3644323 - DNA, 17 bp, Homo sapiens
tacattcttgctctgct

SEQ ID NO: 3644324 - DNA, 14 bp, Homo sapiens
taccccaccagcag

SEQ ID NO: 3644325 - DNA, 21 bp, Homo sapiens
tacggtacaagctacatatgt

SEQ ID NO: 3644326 - DNA, 22 bp, Homo sapiens
tacggtacaagctacatatgta

SEQ ID NO: 3644327 - DNA, 22 bp, Homo sapiens
tactagaaccttctaatccatg

SEQ ID NO: 3644328 - DNA, 15 bp, Homo sapiens
tactagcaataagtt

SEQ ID NO: 3644329 - DNA, 20 bp, Homo sapiens
tactatggtatatattttga

SEQ ID NO: 3644330 - DNA, 14 bp, Homo sapiens
tactcaggaggctg

SEQ ID NO: 3644331 - DNA, 22 bp, Homo sapiens
tactcatttggatataaatctt

SEQ ID NO: 3644332 - DNA, 21 bp, Homo sapiens
tactgcaatgtctgtccctaa

SEQ ID NO: 3644333 - DNA, 24 bp, Homo sapiens
tacttaataacacttcaccttctg

SEQ ID NO: 3644334 - DNA, 14 bp, Homo sapiens
tacttaatagtacc

SEQ ID NO: 3644335 - DNA, 12 bp, Homo sapiens
tacttgattaag

SEQ ID NO: 3644336 - DNA, 14 bp, Homo sapiens
tacttgattaagga

SEQ ID NO: 3644337 - DNA, 23 bp, Homo sapiens
tagaaactttggaagttttactt

SEQ ID NO: 3644338 - DNA, 23 bp, Homo sapiens
tagaaatatccttttagaagcag

SEQ ID NO: 3644339 - DNA, 20 bp, Homo sapiens
tagaagaaggactgaagaaa

SEQ ID NO: 3644340 - DNA, 15 bp, Homo sapiens
tagaatcaagtctgt

SEQ ID NO: 3644341 - DNA, 21 bp, Homo sapiens
tagaatcagggtggagaagtt

SEQ ID NO: 3644342 - DNA, 16 bp, Homo sapiens
tagacctaactgtgaa

SEQ ID NO: 3644343 - DNA, 18 bp, Homo sapiens
tagagatgttgagtctta

SEQ ID NO: 3644344 - DNA, 20 bp, Homo sapiens
tagataccattttgaaatat

SEQ ID NO: 3644345 - DNA, 22 bp, Homo sapiens
tagcaataagttgaatgataat

SEQ ID NO: 3644346 - DNA, 21 bp, Homo sapiens
tagcaattgcttctctaaaac

SEQ ID NO: 3644347 - DNA, 13 bp, Homo sapiens
tagcacatgtttt

SEQ ID NO: 3644348 - DNA, 16 bp, Homo sapiens
tagcacatgttttaca

SEQ ID NO: 3644349 - DNA, 19 bp, Homo sapiens
tagcactttgggaggctga

SEQ ID NO: 3644350 - DNA, 14 bp, Homo sapiens
tagcagcagaggca

SEQ ID NO: 3644351 - DNA, 15 bp, Homo sapiens
tagcagcagaggcag

SEQ ID NO: 3644352 - DNA, 16 bp, Homo sapiens
tagcataatattttct

SEQ ID NO: 3644353 - DNA, 15 bp, Homo sapiens
tagcatgagttctgc

SEQ ID NO: 3644354 - DNA, 20 bp, Homo sapiens
tagcatgagttctgcacata

SEQ ID NO: 3644355 - DNA, 14 bp, Homo sapiens
tagccagtcatggt

SEQ ID NO: 3644356 - DNA, 16 bp, Homo sapiens
tagctacaaatgaaaa

SEQ ID NO: 3644357 - DNA, 15 bp, Homo sapiens
tagctgatagaagaa

SEQ ID NO: 3644358 - DNA, 18 bp, Homo sapiens
tagggctggctggaggaa

SEQ ID NO: 3644359 - DNA, 19 bp, Homo sapiens
tagggctggctggaggaag

SEQ ID NO: 3644360 - DNA, 22 bp, Homo sapiens
taggggtcctcttagtccacaa

SEQ ID NO: 3644361 - DNA, 21 bp, Homo sapiens
taggtttagaatcaagtctgt

SEQ ID NO: 3644362 - DNA, 23 bp, Homo sapiens
taggtttagaatcaagtctgtga

SEQ ID NO: 3644363 - DNA, 18 bp, Homo sapiens
tagtagtacttaatagta

SEQ ID NO: 3644364 - DNA, 22 bp, Homo sapiens
tagtattttgagccttattaaa

SEQ ID NO: 3644365 - DNA, 13 bp, Homo sapiens
tagtggtatttta

SEQ ID NO: 3644366 - DNA, 19 bp, Homo sapiens
tagtgttttcattctggtc

SEQ ID NO: 3644367 - DNA, 11 bp, Homo sapiens
tataaaaataa

SEQ ID NO: 3644368 - DNA, 15 bp, Homo sapiens
tataaatgttttaaa

SEQ ID NO: 3644369 - DNA, 23 bp, Homo sapiens
tataagtttgacacaacatctga

SEQ ID NO: 3644370 - DNA, 18 bp, Homo sapiens
tataattttattgctgga

SEQ ID NO: 3644371 - DNA, 13 bp, Homo sapiens
tatacaagtgttt

SEQ ID NO: 3644372 - DNA, 15 bp, Homo sapiens
tatacactttacatt

SEQ ID NO: 3644373 - DNA, 17 bp, Homo sapiens
tatagatggtagaaact

SEQ ID NO: 3644374 - DNA, 19 bp, Homo sapiens
tataggacttaatttagca

SEQ ID NO: 3644375 - DNA, 20 bp, Homo sapiens
tataggacttaatttagcag

SEQ ID NO: 3644376 - DNA, 17 bp, Homo sapiens
tatagtgttgtgttaca

SEQ ID NO: 3644377 - DNA, 14 bp, Homo sapiens
tatatattttgaaa

SEQ ID NO: 3644378 - DNA, 17 bp, Homo sapiens
tatatgaagcagaatga

SEQ ID NO: 3644379 - DNA, 14 bp, Homo sapiens
tatatttactgttt

SEQ ID NO: 3644380 - DNA, 19 bp, Homo sapiens
tatatttactgtttataat

SEQ ID NO: 3644381 - DNA, 15 bp, Homo sapiens
tatattttgaaagga

SEQ ID NO: 3644382 - DNA, 13 bp, Homo sapiens
tatcagaagcaag

SEQ ID NO: 3644383 - DNA, 17 bp, Homo sapiens
tatcagggcaagctcat

SEQ ID NO: 3644384 - DNA, 24 bp, Homo sapiens
tatcagggcaagctcatagcacat

SEQ ID NO: 3644385 - DNA, 15 bp, Homo sapiens
tatccctggcttccc

SEQ ID NO: 3644386 - DNA, 20 bp, Homo sapiens
tatcctcaagttgtgtgcta

SEQ ID NO: 3644387 - DNA, 22 bp, Homo sapiens
tatctggaaaaaaaaaaatatg

SEQ ID NO: 3644388 - DNA, 21 bp, Homo sapiens
tatctgtgtaagacacgtgca

SEQ ID NO: 3644389 - DNA, 13 bp, Homo sapiens
tatcttggatgag

SEQ ID NO: 3644390 - DNA, 11 bp, Homo sapiens
tatctttgcca

SEQ ID NO: 3644391 - DNA, 14 bp, Homo sapiens
tatctttgccaccc

SEQ ID NO: 3644392 - DNA, 15 bp, Homo sapiens
tatgaagcagaatga

SEQ ID NO: 3644393 - DNA, 18 bp, Homo sapiens
tatgagaaatataaaaat

SEQ ID NO: 3644394 - DNA, 16 bp, Homo sapiens
tatgagacttcctatt

SEQ ID NO: 3644395 - DNA, 20 bp, Homo sapiens
tatgagattggaaaaaatta

SEQ ID NO: 3644396 - DNA, 15 bp, Homo sapiens
tatgccatgtatgtt

SEQ ID NO: 3644397 - DNA, 23 bp, Homo sapiens
tatgcctgcgccatcttcacatt

SEQ ID NO: 3644398 - DNA, 13 bp, Homo sapiens
tatgctgtgtgca

SEQ ID NO: 3644399 - DNA, 22 bp, Homo sapiens
tatgctgtgtgcagagtataca

SEQ ID NO: 3644400 - DNA, 15 bp, Homo sapiens
tatgctgttcattga

SEQ ID NO: 3644401 - DNA, 20 bp, Homo sapiens
tatgcttccagggacaagct

SEQ ID NO: 3644402 - DNA, 17 bp, Homo sapiens
tatggtacctctgtcta

SEQ ID NO: 3644403 - DNA, 17 bp, Homo sapiens
tatgtcattttcagatc

SEQ ID NO: 3644404 - DNA, 15 bp, Homo sapiens
tattaatttattaaa

SEQ ID NO: 3644405 - DNA, 21 bp, Homo sapiens
tattacaacaagcaaactgaa

SEQ ID NO: 3644406 - DNA, 16 bp, Homo sapiens
tattcgtaagttctgt

SEQ ID NO: 3644407 - DNA, 14 bp, Homo sapiens
tatttactgcaatg

SEQ ID NO: 3644408 - DNA, 15 bp, Homo sapiens
tatttactgcaatgt

SEQ ID NO: 3644409 - DNA, 19 bp, Homo sapiens
tatttactgcaatgtctgt

SEQ ID NO: 3644410 - DNA, 16 bp, Homo sapiens
tatttactgtttataa

SEQ ID NO: 3644411 - DNA, 21 bp, Homo sapiens
tatttataacattgtaaatga

SEQ ID NO: 3644412 - DNA, 11 bp, Homo sapiens
tatttccatgg

SEQ ID NO: 3644413 - DNA, 22 bp, Homo sapiens
tatttgaggaaactcatacagt

SEQ ID NO: 3644414 - DNA, 22 bp, Homo sapiens
tatttggtaacttgctgtgaaa

SEQ ID NO: 3644415 - DNA, 16 bp, Homo sapiens
tattttaacatagcag

SEQ ID NO: 3644416 - DNA, 18 bp, Homo sapiens
tatttttgctctccctcc

SEQ ID NO: 3644417 - DNA, 12 bp, Homo sapiens
tattttttgtga

SEQ ID NO: 3644418 - DNA, 15 bp, Homo sapiens
tcaaacgaaatggct

SEQ ID NO: 3644419 - DNA, 21 bp, Homo sapiens
tcaaatggtattttttgtgaa

SEQ ID NO: 3644420 - DNA, 23 bp, Homo sapiens
tcaaattctgattattacaacaa

SEQ ID NO: 3644421 - DNA, 18 bp, Homo sapiens
tcaacacacagtatagat

SEQ ID NO: 3644422 - DNA, 21 bp, Homo sapiens
tcaacacacagtatagataaa

SEQ ID NO: 3644423 - DNA, 16 bp, Homo sapiens
tcaacagaattgttct

SEQ ID NO: 3644424 - DNA, 17 bp, Homo sapiens
tcaagagattctgcctc

SEQ ID NO: 3644425 - DNA, 11 bp, Homo sapiens
tcaagtctgtg

SEQ ID NO: 3644426 - DNA, 15 bp, Homo sapiens
tcaatgctacaaaat

SEQ ID NO: 3644427 - DNA, 16 bp, Homo sapiens
tcaatgttaaatctac

SEQ ID NO: 3644428 - DNA, 20 bp, Homo sapiens
tcacacaactgtggataaat

SEQ ID NO: 3644429 - DNA, 11 bp, Homo sapiens
tcacactggga

SEQ ID NO: 3644430 - DNA, 21 bp, Homo sapiens
tcacagatttccaaaagtact

SEQ ID NO: 3644431 - DNA, 16 bp, Homo sapiens
tcacagcacatttgtt

SEQ ID NO: 3644432 - DNA, 15 bp, Homo sapiens
tcacattctgaagtt

SEQ ID NO: 3644433 - DNA, 13 bp, Homo sapiens
tcaccccagcctc

SEQ ID NO: 3644434 - DNA, 23 bp, Homo sapiens
tcaccgagaggaaaaaggcttct

SEQ ID NO: 3644435 - DNA, 12 bp, Homo sapiens
tcacttcttaag

SEQ ID NO: 3644436 - DNA, 15 bp, Homo sapiens
tcacttcttaaggac

SEQ ID NO: 3644437 - DNA, 16 bp, Homo sapiens
tcacttttattgtata

SEQ ID NO: 3644438 - DNA, 19 bp, Homo sapiens
tcagaacctttggacaaga

SEQ ID NO: 3644439 - DNA, 13 bp, Homo sapiens
tcagaagcaagga

SEQ ID NO: 3644440 - DNA, 15 bp, Homo sapiens
tcagaagcaaggaag

SEQ ID NO: 3644441 - DNA, 16 bp, Homo sapiens
tcagaagcaaggaagt

SEQ ID NO: 3644442 - DNA, 18 bp, Homo sapiens
tcagaagtgaaaaagact

SEQ ID NO: 3644443 - DNA, 21 bp, Homo sapiens
tcagaatgttgtgttggtatt

SEQ ID NO: 3644444 - DNA, 17 bp, Homo sapiens
tcagatcaccccagcct

SEQ ID NO: 3644445 - DNA, 21 bp, Homo sapiens
tcagatcaccccagcctcact

SEQ ID NO: 3644446 - DNA, 16 bp, Homo sapiens
tcagatccttccaaac

SEQ ID NO: 3644447 - DNA, 22 bp, Homo sapiens
tcagatctgaagtagtgtgagt

SEQ ID NO: 3644448 - DNA, 15 bp, Homo sapiens
tcagattagacacta

SEQ ID NO: 3644449 - DNA, 19 bp, Homo sapiens
tcagcatccaaaagcagga

SEQ ID NO: 3644450 - DNA, 20 bp, Homo sapiens
tcagcatcctggaaatttgt

SEQ ID NO: 3644451 - DNA, 22 bp, Homo sapiens
tcagcatcctggaaatttgtgt

SEQ ID NO: 3644452 - DNA, 23 bp, Homo sapiens
tcagctcactgcaacctccgcat

SEQ ID NO: 3644453 - DNA, 18 bp, Homo sapiens
tcaggaggctgaggcagg

SEQ ID NO: 3644454 - DNA, 19 bp, Homo sapiens
tcaggaggctgaggcagga

SEQ ID NO: 3644455 - DNA, 23 bp, Homo sapiens
tcaggattgaggatgaactcagg

SEQ ID NO: 3644456 - DNA, 18 bp, Homo sapiens
tcagggagagctgggcag

SEQ ID NO: 3644457 - DNA, 22 bp, Homo sapiens
tcagggagagctgggcagacag

SEQ ID NO: 3644458 - DNA, 18 bp, Homo sapiens
gctctgctcatctacaca

SEQ ID NO: 3644459 - DNA, 19 bp, Homo sapiens
gctcttcattgcactgcag

SEQ ID NO: 3644460 - DNA, 20 bp, Homo sapiens
gctgaagaaacacagcatgc

SEQ ID NO: 3644461 - DNA, 23 bp, Homo sapiens
gctgagatgggaggatcacttga

SEQ ID NO: 3644462 - DNA, 17 bp, Homo sapiens
gctgcagctaatttgtg

SEQ ID NO: 3644463 - DNA, 14 bp, Homo sapiens
gctgctatgctgtt

SEQ ID NO: 3644464 - DNA, 16 bp, Homo sapiens
gctgctctctaagaat

SEQ ID NO: 3644465 - DNA, 13 bp, Homo sapiens
gctggaggaagga

SEQ ID NO: 3644466 - DNA, 14 bp, Homo sapiens
gctggctggaggaa

SEQ ID NO: 3644467 - DNA, 14 bp, Homo sapiens
gctgggcagacagg

SEQ ID NO: 3644468 - DNA, 15 bp, Homo sapiens
gctggtaagggacct

SEQ ID NO: 3644469 - DNA, 17 bp, Homo sapiens
gctgtaaataaaaatag

SEQ ID NO: 3644470 - DNA, 15 bp, Homo sapiens
gctgtatttgaggaa

SEQ ID NO: 3644471 - DNA, 19 bp, Homo sapiens
gctgtcatttcattgcact

SEQ ID NO: 3644472 - DNA, 19 bp, Homo sapiens
gctgtggcatcaggaaagg

SEQ ID NO: 3644473 - DNA, 16 bp, Homo sapiens
gctgtgtgcagagtat

SEQ ID NO: 3644474 - DNA, 16 bp, Homo sapiens
gctgttcattgatgac

SEQ ID NO: 3644475 - DNA, 13 bp, Homo sapiens
gcttagaaggcac

SEQ ID NO: 3644476 - DNA, 18 bp, Homo sapiens
gcttccagaaatgccaca

SEQ ID NO: 3644477 - DNA, 20 bp, Homo sapiens
gcttccagaaatgccacact

SEQ ID NO: 3644478 - DNA, 22 bp, Homo sapiens
gcttccagaaatgccacacttg

SEQ ID NO: 3644479 - DNA, 14 bp, Homo sapiens
gcttccccttcaga

SEQ ID NO: 3644480 - DNA, 15 bp, Homo sapiens
gcttccccttcagac

SEQ ID NO: 3644481 - DNA, 14 bp, Homo sapiens
gctttatcagaagc

SEQ ID NO: 3644482 - DNA, 22 bp, Homo sapiens
gctttatcagaagcaaggaagt

SEQ ID NO: 3644483 - DNA, 15 bp, Homo sapiens
ggaaaacattccatc

SEQ ID NO: 3644484 - DNA, 18 bp, Homo sapiens
ggaaacaacaaaggaagt

SEQ ID NO: 3644485 - DNA, 21 bp, Homo sapiens
ggaaataacgggtggcattgg

SEQ ID NO: 3644486 - DNA, 15 bp, Homo sapiens
ggaaatttgtgtgct

SEQ ID NO: 3644487 - DNA, 19 bp, Homo sapiens
ggaagacctaaggcagaca

SEQ ID NO: 3644488 - DNA, 17 bp, Homo sapiens
ggaagagctgctgtatt

SEQ ID NO: 3644489 - DNA, 13 bp, Homo sapiens
ggaagcccagcct

SEQ ID NO: 3644490 - DNA, 14 bp, Homo sapiens
ggaagcccagcctg

SEQ ID NO: 3644491 - DNA, 15 bp, Homo sapiens
ggaagcccagcctgc

SEQ ID NO: 3644492 - DNA, 17 bp, Homo sapiens
ggaagccctctcagatc

SEQ ID NO: 3644493 - DNA, 19 bp, Homo sapiens
ggaaggaaacaacaaagga

SEQ ID NO: 3644494 - DNA, 12 bp, Homo sapiens
ggaaggaagcac

SEQ ID NO: 3644495 - DNA, 13 bp, Homo sapiens
ggaagtaagggag

SEQ ID NO: 3644496 - DNA, 17 bp, Homo sapiens
ggaccagcttttcccaa

SEQ ID NO: 3644497 - DNA, 22 bp, Homo sapiens
ggaccagcttttcccaaaagcc

SEQ ID NO: 3644498 - DNA, 13 bp, Homo sapiens
ggactacagaagt

SEQ ID NO: 3644499 - DNA, 11 bp, Homo sapiens
ggactccagct

SEQ ID NO: 3644500 - DNA, 13 bp, Homo sapiens
ggacttaatttag

SEQ ID NO: 3644501 - DNA, 15 bp, Homo sapiens
ggagactaacttatt

SEQ ID NO: 3644502 - DNA, 20 bp, Homo sapiens
ggagactaacttattttgat

SEQ ID NO: 3644503 - DNA, 15 bp, Homo sapiens
ggagatagctttctt

SEQ ID NO: 3644504 - DNA, 15 bp, Homo sapiens
ggaggccgaggcagg

SEQ ID NO: 3644505 - DNA, 21 bp, Homo sapiens
ggaggctgagacgcaaggatc

SEQ ID NO: 3644506 - DNA, 16 bp, Homo sapiens
ggagttcgaggcgagc

SEQ ID NO: 3644507 - DNA, 14 bp, Homo sapiens
ggataatgagatgt

SEQ ID NO: 3644508 - DNA, 21 bp, Homo sapiens
ggatcatgaggtcaggagttc

SEQ ID NO: 3644509 - DNA, 22 bp, Homo sapiens
ggatggaaataacgggtggcat

SEQ ID NO: 3644510 - DNA, 14 bp, Homo sapiens
ggatggtgatggag

SEQ ID NO: 3644511 - DNA, 14 bp, Homo sapiens
ggcacaatctcagc

SEQ ID NO: 3644512 - DNA, 14 bp, Homo sapiens
ggcacactgagcaa

SEQ ID NO: 3644513 - DNA, 18 bp, Homo sapiens
ggcacatgacagtggtta

SEQ ID NO: 3644514 - DNA, 17 bp, Homo sapiens
ggcagacaggaaggaag

SEQ ID NO: 3644515 - DNA, 18 bp, Homo sapiens
ggcagacaggaaggaagc

SEQ ID NO: 3644516 - DNA, 19 bp, Homo sapiens
ggcagacaggaaggaagca

SEQ ID NO: 3644517 - DNA, 16 bp, Homo sapiens
ggcaggaccagaaggc

SEQ ID NO: 3644518 - DNA, 17 bp, Homo sapiens
ggcaggaccagaaggca

SEQ ID NO: 3644519 - DNA, 20 bp, Homo sapiens
ggcagggctgttccctccag

SEQ ID NO: 3644520 - DNA, 20 bp, Homo sapiens
ggcaggtggatcatgaggtc

SEQ ID NO: 3644521 - DNA, 14 bp, Homo sapiens
ggcatggaaagatg

SEQ ID NO: 3644522 - DNA, 20 bp, Homo sapiens
ggcatttttttagtaaatta

SEQ ID NO: 3644523 - DNA, 22 bp, Homo sapiens
ggccaacatggtgaaaccctgt

SEQ ID NO: 3644524 - DNA, 13 bp, Homo sapiens
ggctgaggcagga

SEQ ID NO: 3644525 - DNA, 16 bp, Homo sapiens
ggctgaggcaggagaa

SEQ ID NO: 3644526 - DNA, 20 bp, Homo sapiens
ggctggagtgtagtggcaca

SEQ ID NO: 3644527 - DNA, 12 bp, Homo sapiens
ggctggctggag

SEQ ID NO: 3644528 - DNA, 14 bp, Homo sapiens
ggctggctggagga

SEQ ID NO: 3644529 - DNA, 15 bp, Homo sapiens
ggctggctggaggaa

SEQ ID NO: 3644530 - DNA, 13 bp, Homo sapiens
ggctggtaaggga

SEQ ID NO: 3644531 - DNA, 21 bp, Homo sapiens
ggctggtaagggaccttcagg

SEQ ID NO: 3644532 - DNA, 18 bp, Homo sapiens
gggaatctaagtgggaga

SEQ ID NO: 3644533 - DNA, 19 bp, Homo sapiens
gggagagataatgaggcaa

SEQ ID NO: 3644534 - DNA, 15 bp, Homo sapiens
gggagatggaggtag

SEQ ID NO: 3644535 - DNA, 11 bp, Homo sapiens
gggattacaga

SEQ ID NO: 3644536 - DNA, 16 bp, Homo sapiens
gggcagacaggtggga

SEQ ID NO: 3644537 - DNA, 21 bp, Homo sapiens
gggctgttccctccaggcaaa

SEQ ID NO: 3644538 - DNA, 12 bp, Homo sapiens
ggggaggctgag

SEQ ID NO: 3644539 - DNA, 22 bp, Homo sapiens
ggggtatataaattggggtgat

SEQ ID NO: 3644540 - DNA, 23 bp, Homo sapiens
ggggtcctcttagtccacaaggt

SEQ ID NO: 3644541 - DNA, 18 bp, Homo sapiens
gggtatataaattggggt

SEQ ID NO: 3644542 - DNA, 20 bp, Homo sapiens
gggtatataaattggggtga

SEQ ID NO: 3644543 - DNA, 23 bp, Homo sapiens
gggtcctcttagtccacaaggtc

SEQ ID NO: 3644544 - DNA, 18 bp, Homo sapiens
gggtggcaacatttgggg

SEQ ID NO: 3644545 - DNA, 20 bp, Homo sapiens
gggtgttgtgagagctggga

SEQ ID NO: 3644546 - DNA, 21 bp, Homo sapiens
gggttcaagagattctgcctc

SEQ ID NO: 3644547 - DNA, 14 bp, Homo sapiens
gggttctatattta

SEQ ID NO: 3644548 - DNA, 23 bp, Homo sapiens
ggtagggctggctggaggaagga

SEQ ID NO: 3644549 - DNA, 19 bp, Homo sapiens
ggtagtgccaatgacagga

SEQ ID NO: 3644550 - DNA, 12 bp, Homo sapiens
ggtatgatcatt

SEQ ID NO: 3644551 - DNA, 19 bp, Homo sapiens
ggtatttactgcaatgtct

SEQ ID NO: 3644552 - DNA, 15 bp, Homo sapiens
ggtattttaacatag

SEQ ID NO: 3644553 - DNA, 21 bp, Homo sapiens
ggtcagaacctttggacaaga

SEQ ID NO: 3644554 - DNA, 15 bp, Homo sapiens
ggtccttagtaaatt

SEQ ID NO: 3644555 - DNA, 13 bp, Homo sapiens
ggtcggaccagct

SEQ ID NO: 3644556 - DNA, 23 bp, Homo sapiens
ggtctgtgttctcaacacacagt

SEQ ID NO: 3644557 - DNA, 19 bp, Homo sapiens
ggtctgttgaagtgcatgt

SEQ ID NO: 3644558 - DNA, 18 bp, Homo sapiens
ggtgatggagagggatgg

SEQ ID NO: 3644559 - DNA, 17 bp, Homo sapiens
ggtggcagggctgttcc

SEQ ID NO: 3644560 - DNA, 15 bp, Homo sapiens
ggtggcatttgcagg

SEQ ID NO: 3644561 - DNA, 22 bp, Homo sapiens
ggttaatgaaaaatctgaattt

SEQ ID NO: 3644562 - DNA, 19 bp, Homo sapiens
ggttcaatcaacagaattg

SEQ ID NO: 3644563 - DNA, 17 bp, Homo sapiens
ggttcctacaggagata

SEQ ID NO: 3644564 - DNA, 16 bp, Homo sapiens
ggttctgctttctgat

SEQ ID NO: 3644565 - DNA, 15 bp, Homo sapiens
gtaaataaaaatagc

SEQ ID NO: 3644566 - DNA, 19 bp, Homo sapiens
gtaaatatacactttacat

SEQ ID NO: 3644567 - DNA, 22 bp, Homo sapiens
gtaaatattgctgtctgaaaaa

SEQ ID NO: 3644568 - DNA, 18 bp, Homo sapiens
gtaaattcctaattctat

SEQ ID NO: 3644569 - DNA, 16 bp, Homo sapiens
gtaacagtatttccat

SEQ ID NO: 3644570 - DNA, 21 bp, Homo sapiens
gtaacttgctgtgaaatgact

SEQ ID NO: 3644571 - DNA, 20 bp, Homo sapiens
gtaagacattagtttgaggt

SEQ ID NO: 3644572 - DNA, 14 bp, Homo sapiens
gtaagttctgtgca

SEQ ID NO: 3644573 - DNA, 22 bp, Homo sapiens
gtaatagatcagcatccaaaag

SEQ ID NO: 3644574 - DNA, 20 bp, Homo sapiens
gtaatcccagcactttggga

SEQ ID NO: 3644575 - DNA, 20 bp, Homo sapiens
gtaattcttctcctttgtca

SEQ ID NO: 3644576 - DNA, 22 bp, Homo sapiens
gtaattcttctcctttgtcaaa

SEQ ID NO: 3644577 - DNA, 14 bp, Homo sapiens
gtacatttatgtgt

SEQ ID NO: 3644578 - DNA, 21 bp, Homo sapiens
gtacatttatgtgtgaagcaa

SEQ ID NO: 3644579 - DNA, 21 bp, Homo sapiens
ctgtgtggcaccttgattgga

SEQ ID NO: 3644580 - DNA, 13 bp, Homo sapiens
ctgtgttctcaac

SEQ ID NO: 3644581 - DNA, 16 bp, Homo sapiens
ctgttgaagtgcatgt

SEQ ID NO: 3644582 - DNA, 19 bp, Homo sapiens
ctgttgaagtgcatgttaa

SEQ ID NO: 3644583 - DNA, 22 bp, Homo sapiens
ctgttgaagtgcatgttaaaat

SEQ ID NO: 3644584 - DNA, 18 bp, Homo sapiens
ctgttggtcttaactaat

SEQ ID NO: 3644585 - DNA, 19 bp, Homo sapiens
cttaaaaagaccatgcatt

SEQ ID NO: 3644586 - DNA, 20 bp, Homo sapiens
cttaaaattggttaatgaaa

SEQ ID NO: 3644587 - DNA, 23 bp, Homo sapiens
cttaaaattggttaatgaaaaat

SEQ ID NO: 3644588 - DNA, 18 bp, Homo sapiens
cttaaggacagtgttcaa

SEQ ID NO: 3644589 - DNA, 21 bp, Homo sapiens
cttaaggacagtgttcaaatt

SEQ ID NO: 3644590 - DNA, 13 bp, Homo sapiens
cttaataacactt

SEQ ID NO: 3644591 - DNA, 20 bp, Homo sapiens
cttacacacctgagaatgtg

SEQ ID NO: 3644592 - DNA, 17 bp, Homo sapiens
cttaccgaaatgaaaat

SEQ ID NO: 3644593 - DNA, 15 bp, Homo sapiens
cttagaatgtgaaaa

SEQ ID NO: 3644594 - DNA, 16 bp, Homo sapiens
cttagaatgtgaaaaa

SEQ ID NO: 3644595 - DNA, 14 bp, Homo sapiens
cttagtaaattcct

SEQ ID NO: 3644596 - DNA, 16 bp, Homo sapiens
cttatattattttctg

SEQ ID NO: 3644597 - DNA, 15 bp, Homo sapiens
cttattcctaattcc

SEQ ID NO: 3644598 - DNA, 16 bp, Homo sapiens
cttattcctaattcct

SEQ ID NO: 3644599 - DNA, 18 bp, Homo sapiens
cttattcctaattcctgt

SEQ ID NO: 3644600 - DNA, 22 bp, Homo sapiens
cttattttgattgtttgatgaa

SEQ ID NO: 3644601 - DNA, 14 bp, Homo sapiens
cttcaaccccactt

SEQ ID NO: 3644602 - DNA, 23 bp, Homo sapiens
cttcaaccccacttcctactgta

SEQ ID NO: 3644603 - DNA, 13 bp, Homo sapiens
cttcaatgttaaa

SEQ ID NO: 3644604 - DNA, 14 bp, Homo sapiens
cttcacacaaagtg

SEQ ID NO: 3644605 - DNA, 17 bp, Homo sapiens
cttcacacaaagtgaaa

SEQ ID NO: 3644606 - DNA, 18 bp, Homo sapiens
cttcacacaaagtgaaat

SEQ ID NO: 3644607 - DNA, 19 bp, Homo sapiens
cttcacacaaagtgaaatt

SEQ ID NO: 3644608 - DNA, 20 bp, Homo sapiens
cttcacacaaagtgaaatta

SEQ ID NO: 3644609 - DNA, 16 bp, Homo sapiens
cttcaccttctgtaat

SEQ ID NO: 3644610 - DNA, 17 bp, Homo sapiens
cttcagggagagctggg

SEQ ID NO: 3644611 - DNA, 12 bp, Homo sapiens
cttcatctggaa

SEQ ID NO: 3644612 - DNA, 13 bp, Homo sapiens
cttcatgcatgga

SEQ ID NO: 3644613 - DNA, 17 bp, Homo sapiens
cttccagaaatgccaca

SEQ ID NO: 3644614 - DNA, 18 bp, Homo sapiens
cttccagaaatgccacac

SEQ ID NO: 3644615 - DNA, 14 bp, Homo sapiens
cttccattcccttt

SEQ ID NO: 3644616 - DNA, 15 bp, Homo sapiens
cttccattccctttc

SEQ ID NO: 3644617 - DNA, 22 bp, Homo sapiens
cttccctatctttgccaccctc

SEQ ID NO: 3644618 - DNA, 18 bp, Homo sapiens
cttcctgcaggactctat

SEQ ID NO: 3644619 - DNA, 19 bp, Homo sapiens
cttcttaaggacagtgttc

SEQ ID NO: 3644620 - DNA, 21 bp, Homo sapiens
cttgaaaataataaagtggca

SEQ ID NO: 3644621 - DNA, 15 bp, Homo sapiens
cttgaacctgtgagg

SEQ ID NO: 3644622 - DNA, 16 bp, Homo sapiens
cttgagcatgcccaaa

SEQ ID NO: 3644623 - DNA, 14 bp, Homo sapiens
cttggagagagatt

SEQ ID NO: 3644624 - DNA, 21 bp, Homo sapiens
cttggattaattcatggtatc

SEQ ID NO: 3644625 - DNA, 15 bp, Homo sapiens
cttgtattggaagta

SEQ ID NO: 3644626 - DNA, 15 bp, Homo sapiens
ctttatcagaagcaa

SEQ ID NO: 3644627 - DNA, 17 bp, Homo sapiens
ctttatcagaagcaagg

SEQ ID NO: 3644628 - DNA, 16 bp, Homo sapiens
ctttctttcccttact

SEQ ID NO: 3644629 - DNA, 18 bp, Homo sapiens
ctttcttttgtgcatatg

SEQ ID NO: 3644630 - DNA, 15 bp, Homo sapiens
ctttgacctgcctcc

SEQ ID NO: 3644631 - DNA, 23 bp, Homo sapiens
ctttgacctgcctcccttcatgc

SEQ ID NO: 3644632 - DNA, 21 bp, Homo sapiens
ctttgcacaatcaataaaaat

SEQ ID NO: 3644633 - DNA, 16 bp, Homo sapiens
ctttggacaagaggaa

SEQ ID NO: 3644634 - DNA, 16 bp, Homo sapiens
ctttggctgcatgcga

SEQ ID NO: 3644635 - DNA, 15 bp, Homo sapiens
ctttgtcaaatggta

SEQ ID NO: 3644636 - DNA, 14 bp, Homo sapiens
ctttgttaaaatat

SEQ ID NO: 3644637 - DNA, 16 bp, Homo sapiens
ctttgttaaaatatag

SEQ ID NO: 3644638 - DNA, 22 bp, Homo sapiens
ctttgttaaaatatagtgttgt

SEQ ID NO: 3644639 - DNA, 13 bp, Homo sapiens
cttttagaagcag

SEQ ID NO: 3644640 - DNA, 19 bp, Homo sapiens
cttttccatcccactccac

SEQ ID NO: 3644641 - DNA, 20 bp, Homo sapiens
cttttcctacggtacaagct

SEQ ID NO: 3644642 - DNA, 15 bp, Homo sapiens
cttttgagcagtaaa

SEQ ID NO: 3644643 - DNA, 19 bp, Homo sapiens
ctttttttttttttttgag

SEQ ID NO: 3644644 - DNA, 17 bp, Homo sapiens
gaaaaaaaaaagtaatt

SEQ ID NO: 3644645 - DNA, 15 bp, Homo sapiens
gaaaaagtgttttta

SEQ ID NO: 3644646 - DNA, 17 bp, Homo sapiens
gaaaatggctgaagaaa

SEQ ID NO: 3644647 - DNA, 22 bp, Homo sapiens
gaaaatggctgaagaaacacag

SEQ ID NO: 3644648 - DNA, 23 bp, Homo sapiens
gaaacaaaatataaatcacagat

SEQ ID NO: 3644649 - DNA, 13 bp, Homo sapiens
gaaacaaatatac

SEQ ID NO: 3644650 - DNA, 23 bp, Homo sapiens
gaaacaaatatactcatttggat

SEQ ID NO: 3644651 - DNA, 15 bp, Homo sapiens
gaaacaacaaaggaa

SEQ ID NO: 3644652 - DNA, 19 bp, Homo sapiens
gaaacaccctcacactggg

SEQ ID NO: 3644653 - DNA, 15 bp, Homo sapiens
gaaacacggagtttc

SEQ ID NO: 3644654 - DNA, 12 bp, Homo sapiens
gaaacatctgat

SEQ ID NO: 3644655 - DNA, 14 bp, Homo sapiens
gaaacatctgattt

SEQ ID NO: 3644656 - DNA, 15 bp, Homo sapiens
gaaactgtttgatta

SEQ ID NO: 3644657 - DNA, 20 bp, Homo sapiens
gaaagagaatttggagccag

SEQ ID NO: 3644658 - DNA, 13 bp, Homo sapiens
gaaagatggggag

SEQ ID NO: 3644659 - DNA, 20 bp, Homo sapiens
gaaatacttgacaacatttt

SEQ ID NO: 3644660 - DNA, 22 bp, Homo sapiens
gaaattagtgttttcattctgg

SEQ ID NO: 3644661 - DNA, 21 bp, Homo sapiens
gaaattcccttcatctggaac

SEQ ID NO: 3644662 - DNA, 14 bp, Homo sapiens
gaaatttgtgtgct

SEQ ID NO: 3644663 - DNA, 17 bp, Homo sapiens
gaacaaactcagatctc

SEQ ID NO: 3644664 - DNA, 17 bp, Homo sapiens
gaactcgggattacaga

SEQ ID NO: 3644665 - DNA, 20 bp, Homo sapiens
gaagaaacacagcatgcatt

SEQ ID NO: 3644666 - DNA, 21 bp, Homo sapiens
gaagaaacacagcatgcattt

SEQ ID NO: 3644667 - DNA, 13 bp, Homo sapiens
gaagaaccaggca

SEQ ID NO: 3644668 - DNA, 13 bp, Homo sapiens
gaagaagaaccag

SEQ ID NO: 3644669 - DNA, 18 bp, Homo sapiens
gaagaaggactgaagaaa

SEQ ID NO: 3644670 - DNA, 16 bp, Homo sapiens
gaagacctaaggcaga

SEQ ID NO: 3644671 - DNA, 18 bp, Homo sapiens
gaagacctaaggcagaca

SEQ ID NO: 3644672 - DNA, 13 bp, Homo sapiens
gaagcaaggaagt

SEQ ID NO: 3644673 - DNA, 22 bp, Homo sapiens
gaagcagaatgagatgatttaa

SEQ ID NO: 3644674 - DNA, 14 bp, Homo sapiens
gaagcccagcctgc

SEQ ID NO: 3644675 - DNA, 17 bp, Homo sapiens
gaagccctctcagatca

SEQ ID NO: 3644676 - DNA, 14 bp, Homo sapiens
gaaggaaacaacaa

SEQ ID NO: 3644677 - DNA, 18 bp, Homo sapiens
gaaggaagccctctcaga

SEQ ID NO: 3644678 - DNA, 14 bp, Homo sapiens
gaaggactgaagaa

SEQ ID NO: 3644679 - DNA, 16 bp, Homo sapiens
gaaggcacactgagca

SEQ ID NO: 3644680 - DNA, 21 bp, Homo sapiens
gaaggctctctggtctacctg

SEQ ID NO: 3644681 - DNA, 21 bp, Homo sapiens
gaagtaagggagtcattgcct

SEQ ID NO: 3644682 - DNA, 15 bp, Homo sapiens
gaagtagtgtgagtg

SEQ ID NO: 3644683 - DNA, 20 bp, Homo sapiens
gaagtatagatggtagaaac

SEQ ID NO: 3644684 - DNA, 21 bp, Homo sapiens
gaagtatagatggtagaaact

SEQ ID NO: 3644685 - DNA, 21 bp, Homo sapiens
gaagtttaaatctttgttaaa

SEQ ID NO: 3644686 - DNA, 23 bp, Homo sapiens
gaagttttacttgattaaggact

SEQ ID NO: 3644687 - DNA, 21 bp, Homo sapiens
gaatcatgggcagaggatgag

SEQ ID NO: 3644688 - DNA, 16 bp, Homo sapiens
gaatgagatgatttaa

SEQ ID NO: 3644689 - DNA, 17 bp, Homo sapiens
gaatgtcctgtagagag

SEQ ID NO: 3644690 - DNA, 20 bp, Homo sapiens
gaatgtcctgtagagagaga

SEQ ID NO: 3644691 - DNA, 16 bp, Homo sapiens
gaattatcttggatga

SEQ ID NO: 3644692 - DNA, 21 bp, Homo sapiens
gaattcatgatgctagttctt

SEQ ID NO: 3644693 - DNA, 15 bp, Homo sapiens
gaattgaaagagaat

SEQ ID NO: 3644694 - DNA, 23 bp, Homo sapiens
gaatttggagccaggatgggtct

SEQ ID NO: 3644695 - DNA, 17 bp, Homo sapiens
gacaagcattgggtcag

SEQ ID NO: 3644696 - DNA, 13 bp, Homo sapiens
gacaggaaggaag

SEQ ID NO: 3644697 - DNA, 18 bp, Homo sapiens
gacaggaaggaagcacaa

SEQ ID NO: 3644698 - DNA, 18 bp, Homo sapiens
gacagtggttatatttca

SEQ ID NO: 3644699 - DNA, 13 bp, Homo sapiens
gacatctctgtaa

SEQ ID NO: 3644700 - DNA, 13 bp, Homo sapiens
gacattagtttga

SEQ ID NO: 3644701 - DNA, 13 bp, Homo sapiens
gacattgtcagaa

SEQ ID NO: 3644702 - DNA, 17 bp, Homo sapiens
gacattgtcagaatgtt

SEQ ID NO: 3644703 - DNA, 18 bp, Homo sapiens
gacattgtcagaatgttg

SEQ ID NO: 3644704 - DNA, 12 bp, Homo sapiens
gaccagaaggca

SEQ ID NO: 3644705 - DNA, 15 bp, Homo sapiens
gacctaactgtgaac

SEQ ID NO: 3644706 - DNA, 17 bp, Homo sapiens
gacctaaggcagacagg

SEQ ID NO: 3644707 - DNA, 20 bp, Homo sapiens
gaccttcagggagagctggg

SEQ ID NO: 3644708 - DNA, 22 bp, Homo sapiens
gacgtcttaggtggcagggctg

SEQ ID NO: 3644709 - DNA, 13 bp, Homo sapiens
gactacagaagtg

SEQ ID NO: 3644710 - DNA, 14 bp, Homo sapiens
gactcaaaccaaat

SEQ ID NO: 3644711 - DNA, 22 bp, Homo sapiens
gactccagctctacgtcccaca

SEQ ID NO: 3644712 - DNA, 19 bp, Homo sapiens
cctttggcaggtgcagccc

SEQ ID NO: 3644713 - DNA, 16 bp, Homo sapiens
cggagtttccatttgg

SEQ ID NO: 3644714 - DNA, 19 bp, Homo sapiens
cggccaggcacggaggctc

SEQ ID NO: 3644715 - DNA, 16 bp, Homo sapiens
cgggactacagaagtg

SEQ ID NO: 3644716 - DNA, 14 bp, Homo sapiens
cgggattacagaaa

SEQ ID NO: 3644717 - DNA, 17 bp, Homo sapiens
cgggattacagaaacac

SEQ ID NO: 3644718 - DNA, 14 bp, Homo sapiens
cgtgaagagaaaga

SEQ ID NO: 3644719 - DNA, 22 bp, Homo sapiens
cgtgaagagaaagacagtattt

SEQ ID NO: 3644720 - DNA, 17 bp, Homo sapiens
cgtggcaactgtggaag

SEQ ID NO: 3644721 - DNA, 18 bp, Homo sapiens
cgttagcttcctgcagga

SEQ ID NO: 3644722 - DNA, 21 bp, Homo sapiens
ctaaacatagtggtattttaa

SEQ ID NO: 3644723 - DNA, 16 bp, Homo sapiens
ctaaaccagaaggaag

SEQ ID NO: 3644724 - DNA, 13 bp, Homo sapiens
ctaaaccatgaaa

SEQ ID NO: 3644725 - DNA, 15 bp, Homo sapiens
ctaaaccatgaaaag

SEQ ID NO: 3644726 - DNA, 21 bp, Homo sapiens
ctaaaccatgaaaagttttca

SEQ ID NO: 3644727 - DNA, 17 bp, Homo sapiens
ctaaattaacaaattca

SEQ ID NO: 3644728 - DNA, 11 bp, Homo sapiens
ctaagcctggc

SEQ ID NO: 3644729 - DNA, 12 bp, Homo sapiens
ctaagcctggct

SEQ ID NO: 3644730 - DNA, 22 bp, Homo sapiens
ctaagcctggcttagaaggcac

SEQ ID NO: 3644731 - DNA, 15 bp, Homo sapiens
ctaaggcagacagga

SEQ ID NO: 3644732 - DNA, 23 bp, Homo sapiens
ctaaggcagacaggaaggaagca

SEQ ID NO: 3644733 - DNA, 18 bp, Homo sapiens
ctaagtaaatctaaatta

SEQ ID NO: 3644734 - DNA, 14 bp, Homo sapiens
ctaagtgggagaca

SEQ ID NO: 3644735 - DNA, 17 bp, Homo sapiens
ctaattcctgtatgtta

SEQ ID NO: 3644736 - DNA, 11 bp, Homo sapiens
ctacatatgta

SEQ ID NO: 3644737 - DNA, 23 bp, Homo sapiens
ctactgtaatagatcagcatcca

SEQ ID NO: 3644738 - DNA, 13 bp, Homo sapiens
ctagaggtggcat

SEQ ID NO: 3644739 - DNA, 15 bp, Homo sapiens
ctagatatgagaaat

SEQ ID NO: 3644740 - DNA, 16 bp, Homo sapiens
ctagatatgagaaata

SEQ ID NO: 3644741 - DNA, 13 bp, Homo sapiens
ctagcaaaaggat

SEQ ID NO: 3644742 - DNA, 19 bp, Homo sapiens
ctagcaataagttgaatga

SEQ ID NO: 3644743 - DNA, 13 bp, Homo sapiens
ctagccatatatt

SEQ ID NO: 3644744 - DNA, 23 bp, Homo sapiens
ctaggatgaattatcttggatga

SEQ ID NO: 3644745 - DNA, 17 bp, Homo sapiens
ctataaatagtgaaaat

SEQ ID NO: 3644746 - DNA, 19 bp, Homo sapiens
ctataaatagtgaaaattt

SEQ ID NO: 3644747 - DNA, 21 bp, Homo sapiens
ctataggacttaatttagcag

SEQ ID NO: 3644748 - DNA, 11 bp, Homo sapiens
ctatatttact

SEQ ID NO: 3644749 - DNA, 12 bp, Homo sapiens
ctatatttactg

SEQ ID NO: 3644750 - DNA, 12 bp, Homo sapiens
ctatctggaaaa

SEQ ID NO: 3644751 - DNA, 20 bp, Homo sapiens
ctatctggaaaaaaaaaaat

SEQ ID NO: 3644752 - DNA, 22 bp, Homo sapiens
ctatctggaaaaaaaaaaatat

SEQ ID NO: 3644753 - DNA, 19 bp, Homo sapiens
ctatctttgccaccctcat

SEQ ID NO: 3644754 - DNA, 21 bp, Homo sapiens
ctatctttgccaccctcatgc

SEQ ID NO: 3644755 - DNA, 18 bp, Homo sapiens
ctatgacactcatcaggt

SEQ ID NO: 3644756 - DNA, 16 bp, Homo sapiens
ctatgctgtgtgcaga

SEQ ID NO: 3644757 - DNA, 20 bp, Homo sapiens
ctattgctgtaaataaaaat

SEQ ID NO: 3644758 - DNA, 12 bp, Homo sapiens
ctatttgatttg

SEQ ID NO: 3644759 - DNA, 14 bp, Homo sapiens
ctcaattcttccct

SEQ ID NO: 3644760 - DNA, 19 bp, Homo sapiens
ctcaattcttccctatctt

SEQ ID NO: 3644761 - DNA, 16 bp, Homo sapiens
ctcacagcacatttgt

SEQ ID NO: 3644762 - DNA, 16 bp, Homo sapiens
ctcactccatttccca

SEQ ID NO: 3644763 - DNA, 15 bp, Homo sapiens
ctcagaagtgaaaaa

SEQ ID NO: 3644764 - DNA, 16 bp, Homo sapiens
ctcagatcaccccagc

SEQ ID NO: 3644765 - DNA, 17 bp, Homo sapiens
ctcagcatcctggaaat

SEQ ID NO: 3644766 - DNA, 23 bp, Homo sapiens
ctcagcatcctggaaatttgtgt

SEQ ID NO: 3644767 - DNA, 18 bp, Homo sapiens
ctcagctactcaggaggc

SEQ ID NO: 3644768 - DNA, 20 bp, Homo sapiens
ctcagctactcaggaggctg

SEQ ID NO: 3644769 - DNA, 13 bp, Homo sapiens
ctcaggaggctga

SEQ ID NO: 3644770 - DNA, 15 bp, Homo sapiens
ctcaggaggctgagg

SEQ ID NO: 3644771 - DNA, 18 bp, Homo sapiens
ctcaggtggcatttgcag

SEQ ID NO: 3644772 - DNA, 23 bp, Homo sapiens
ctcatagcacatgttttacaaag

SEQ ID NO: 3644773 - DNA, 21 bp, Homo sapiens
ctcatgcctgtaatcccagca

SEQ ID NO: 3644774 - DNA, 21 bp, Homo sapiens
ctcatgtacttaataacactt

SEQ ID NO: 3644775 - DNA, 18 bp, Homo sapiens
ctcattagagatgttgag

SEQ ID NO: 3644776 - DNA, 20 bp, Homo sapiens
ctccagctctacgtcccaca

SEQ ID NO: 3644777 - DNA, 14 bp, Homo sapiens
ctccatttcccact

SEQ ID NO: 3644778 - DNA, 17 bp, Homo sapiens
ctcccagtcgaggctgg

SEQ ID NO: 3644779 - DNA, 18 bp, Homo sapiens
ctcccagtcgaggctggt

SEQ ID NO: 3644780 - DNA, 18 bp, Homo sapiens
ctcccttctttccttcct

SEQ ID NO: 3644781 - DNA, 18 bp, Homo sapiens
ctctaagaattcagtagc

SEQ ID NO: 3644782 - DNA, 23 bp, Homo sapiens
ctctaagcctggcttagaaggca

SEQ ID NO: 3644783 - DNA, 10 bp, Homo sapiens
ctctcagatc

SEQ ID NO: 3644784 - DNA, 12 bp, Homo sapiens
ctctcagatcac

SEQ ID NO: 3644785 - DNA, 18 bp, Homo sapiens
ctctctaagaattcagta

SEQ ID NO: 3644786 - DNA, 12 bp, Homo sapiens
ctctctttcttt

SEQ ID NO: 3644787 - DNA, 21 bp, Homo sapiens
ctctgcaggcagccttgccca

SEQ ID NO: 3644788 - DNA, 13 bp, Homo sapiens
ctcttccattccc

SEQ ID NO: 3644789 - DNA, 16 bp, Homo sapiens
ctcttccattcccttt

SEQ ID NO: 3644790 - DNA, 22 bp, Homo sapiens
ctctttcttttgtgcatatggc

SEQ ID NO: 3644791 - DNA, 21 bp, Homo sapiens
ctgaaaactcattagagatgt

SEQ ID NO: 3644792 - DNA, 20 bp, Homo sapiens
ctgaaagggatggccacaag

SEQ ID NO: 3644793 - DNA, 23 bp, Homo sapiens
ctgaaattagtgttttcattctg

SEQ ID NO: 3644794 - DNA, 12 bp, Homo sapiens
ctgaagaaacac

SEQ ID NO: 3644795 - DNA, 16 bp, Homo sapiens
ctgaagggaagcccag

SEQ ID NO: 3644796 - DNA, 11 bp, Homo sapiens
ctgagaatgtg

SEQ ID NO: 3644797 - DNA, 12 bp, Homo sapiens
ctgagaatgtgc

SEQ ID NO: 3644798 - DNA, 17 bp, Homo sapiens
ctgagacgcaaggatca

SEQ ID NO: 3644799 - DNA, 20 bp, Homo sapiens
ctgagactggaaaaggtgga

SEQ ID NO: 3644800 - DNA, 19 bp, Homo sapiens
ctgagatcgtgccattaca

SEQ ID NO: 3644801 - DNA, 13 bp, Homo sapiens
ctgagctggccta

SEQ ID NO: 3644802 - DNA, 19 bp, Homo sapiens
ctgaggaaaatggaagacc

SEQ ID NO: 3644803 - DNA, 13 bp, Homo sapiens
ctgatacatctgt

SEQ ID NO: 3644804 - DNA, 13 bp, Homo sapiens
ctgcacatacaga

SEQ ID NO: 3644805 - DNA, 19 bp, Homo sapiens
ctgcacatacagatggtgt

SEQ ID NO: 3644806 - DNA, 18 bp, Homo sapiens
ctgcagctaatttgtgaa

SEQ ID NO: 3644807 - DNA, 20 bp, Homo sapiens
ctgcagctaatttgtgaaag

SEQ ID NO: 3644808 - DNA, 13 bp, Homo sapiens
ctgcaggcagcct

SEQ ID NO: 3644809 - DNA, 21 bp, Homo sapiens
ctgcagttatttaccagaagt

SEQ ID NO: 3644810 - DNA, 23 bp, Homo sapiens
ctgcatgcgagtgctcatttcag

SEQ ID NO: 3644811 - DNA, 20 bp, Homo sapiens
ctgcatgtatgccatgtatg

SEQ ID NO: 3644812 - DNA, 17 bp, Homo sapiens
ctgcctcagcctccaga

SEQ ID NO: 3644813 - DNA, 15 bp, Homo sapiens
ctgcctcccttcatg

SEQ ID NO: 3644814 - DNA, 18 bp, Homo sapiens
ctgcctcccttcatgcat

SEQ ID NO: 3644815 - DNA, 19 bp, Homo sapiens
ctgcctcccttcatgcatg

SEQ ID NO: 3644816 - DNA, 21 bp, Homo sapiens
ctgcctcccttcatgcatgga

SEQ ID NO: 3644817 - DNA, 21 bp, Homo sapiens
ctgctgtatttgaggaaactc

SEQ ID NO: 3644818 - DNA, 17 bp, Homo sapiens
ctggaaatttgtgtgct

SEQ ID NO: 3644819 - DNA, 16 bp, Homo sapiens
ctggaaccatcagaaa

SEQ ID NO: 3644820 - DNA, 16 bp, Homo sapiens
ctggaatctactagaa

SEQ ID NO: 3644821 - DNA, 19 bp, Homo sapiens
ctggagccccgcagggagg

SEQ ID NO: 3644822 - DNA, 18 bp, Homo sapiens
ctggaggtgttgtgggga

SEQ ID NO: 3644823 - DNA, 21 bp, Homo sapiens
ctggaggtgttgtggggatgg

SEQ ID NO: 3644824 - DNA, 22 bp, Homo sapiens
ctggaggtgttgtggggatggt

SEQ ID NO: 3644825 - DNA, 22 bp, Homo sapiens
ctggccattggctagaatcagg

SEQ ID NO: 3644826 - DNA, 13 bp, Homo sapiens
ctggcttcccctt

SEQ ID NO: 3644827 - DNA, 23 bp, Homo sapiens
ctggcttccccttcagaccttgc

SEQ ID NO: 3644828 - DNA, 22 bp, Homo sapiens
ctgggaatgtcctgtagagaga

SEQ ID NO: 3644829 - DNA, 14 bp, Homo sapiens
ctgggcagacaggt

SEQ ID NO: 3644830 - DNA, 18 bp, Homo sapiens
ctgggcagacaggtggga

SEQ ID NO: 3644831 - DNA, 14 bp, Homo sapiens
ctgggctggagagt

SEQ ID NO: 3644832 - DNA, 15 bp, Homo sapiens
ctgggctggcttgag

SEQ ID NO: 3644833 - DNA, 20 bp, Homo sapiens
ctgggttaacagtaaatata

SEQ ID NO: 3644834 - DNA, 20 bp, Homo sapiens
ctggtaagggaccttcaggg

SEQ ID NO: 3644835 - DNA, 23 bp, Homo sapiens
ctggtaattatcctcaagttgtg

SEQ ID NO: 3644836 - DNA, 16 bp, Homo sapiens
ctggtccttagtaaat

SEQ ID NO: 3644837 - DNA, 23 bp, Homo sapiens
ctggttaaccgggactacagaag

SEQ ID NO: 3644838 - DNA, 17 bp, Homo sapiens
ctgtaaataaaaatagc

SEQ ID NO: 3644839 - DNA, 20 bp, Homo sapiens
ctgtaatagatcagcatcca

SEQ ID NO: 3644840 - DNA, 16 bp, Homo sapiens
ctgtagagagagacct

SEQ ID NO: 3644841 - DNA, 17 bp, Homo sapiens
ctgtagagagagaccta

SEQ ID NO: 3644842 - DNA, 14 bp, Homo sapiens
ctgtccctaaacat

SEQ ID NO: 3644843 - DNA, 17 bp, Homo sapiens
ctgtccctaaacatagt

SEQ ID NO: 3644844 - DNA, 13 bp, Homo sapiens
ctgtctgaaaaag

SEQ ID NO: 3644845 - DNA, 14 bp, Homo sapiens
ctgtgaacaatcag

SEQ ID NO: 3644846 - DNA, 16 bp, Homo sapiens
ctgtgacacagctgag

SEQ ID NO: 3644847 - DNA, 12 bp, Homo sapiens
ctgtgaggaaga

SEQ ID NO: 3644848 - DNA, 24 bp, Homo sapiens
ctgtgaggaagaggttgcagtgag

SEQ ID NO: 3644849 - DNA, 19 bp, Homo sapiens
aatgtgcctctcagtatct

SEQ ID NO: 3644850 - DNA, 22 bp, Homo sapiens
aatgttgtgttggtatttactg

SEQ ID NO: 3644851 - DNA, 23 bp, Homo sapiens
aatgttgtgttggtatttactgc

SEQ ID NO: 3644852 - DNA, 17 bp, Homo sapiens
aatgtttatttttgctc

SEQ ID NO: 3644853 - DNA, 17 bp, Homo sapiens
aattaaatgaaatactt

SEQ ID NO: 3644854 - DNA, 18 bp, Homo sapiens
aattaacttctattttca

SEQ ID NO: 3644855 - DNA, 15 bp, Homo sapiens
aattagtgttttcat

SEQ ID NO: 3644856 - DNA, 18 bp, Homo sapiens
aattatatgaagcagaat

SEQ ID NO: 3644857 - DNA, 19 bp, Homo sapiens
aattatatgaagcagaatg

SEQ ID NO: 3644858 - DNA, 12 bp, Homo sapiens
aattatctttaa

SEQ ID NO: 3644859 - DNA, 15 bp, Homo sapiens
aattatctttaaaac

SEQ ID NO: 3644860 - DNA, 15 bp, Homo sapiens
aattattttctgaga

SEQ ID NO: 3644861 - DNA, 19 bp, Homo sapiens
aattcagtggacatttgtt

SEQ ID NO: 3644862 - DNA, 13 bp, Homo sapiens
aattcatgatgct

SEQ ID NO: 3644863 - DNA, 14 bp, Homo sapiens
aattcctaattcta

SEQ ID NO: 3644864 - DNA, 15 bp, Homo sapiens
aattcctaattctat

SEQ ID NO: 3644865 - DNA, 14 bp, Homo sapiens
aattctgattatta

SEQ ID NO: 3644866 - DNA, 19 bp, Homo sapiens
aattcttaccgaaatgaaa

SEQ ID NO: 3644867 - DNA, 11 bp, Homo sapiens
aattcttccct

SEQ ID NO: 3644868 - DNA, 21 bp, Homo sapiens
aattcttccctatctttgcca

SEQ ID NO: 3644869 - DNA, 15 bp, Homo sapiens
aattgcttctctaaa

SEQ ID NO: 3644870 - DNA, 20 bp, Homo sapiens
aattgcttctctaaaacagc

SEQ ID NO: 3644871 - DNA, 16 bp, Homo sapiens
aattgcttgaacctgt

SEQ ID NO: 3644872 - DNA, 14 bp, Homo sapiens
aattgcttgagcat

SEQ ID NO: 3644873 - DNA, 21 bp, Homo sapiens
aattgcttgagcatgcccaaa

SEQ ID NO: 3644874 - DNA, 14 bp, Homo sapiens
aattgggttttgat

SEQ ID NO: 3644875 - DNA, 16 bp, Homo sapiens
aattggttaatgaaaa

SEQ ID NO: 3644876 - DNA, 17 bp, Homo sapiens
aattggttaatgaaaaa

SEQ ID NO: 3644877 - DNA, 19 bp, Homo sapiens
aattgtaaaggtgatgaat

SEQ ID NO: 3644878 - DNA, 21 bp, Homo sapiens
aattgtaaaggtgatgaattt

SEQ ID NO: 3644879 - DNA, 15 bp, Homo sapiens
aatttatgtcatttt

SEQ ID NO: 3644880 - DNA, 20 bp, Homo sapiens
aatttctagatatgagaaat

SEQ ID NO: 3644881 - DNA, 15 bp, Homo sapiens
aatttgacattgtca

SEQ ID NO: 3644882 - DNA, 17 bp, Homo sapiens
aatttgacattgtcaga

SEQ ID NO: 3644883 - DNA, 19 bp, Homo sapiens
aatttgacattgtcagaat

SEQ ID NO: 3644884 - DNA, 21 bp, Homo sapiens
aatttgacattgtcagaatgt

SEQ ID NO: 3644885 - DNA, 22 bp, Homo sapiens
aatttgacattgtcagaatgtt

SEQ ID NO: 3644886 - DNA, 14 bp, Homo sapiens
aatttgtgaaagtg

SEQ ID NO: 3644887 - DNA, 12 bp, Homo sapiens
aatttgtgtgct

SEQ ID NO: 3644888 - DNA, 22 bp, Homo sapiens
aattttatgtcatatatcaaat

SEQ ID NO: 3644889 - DNA, 14 bp, Homo sapiens
aattttcttcttta

SEQ ID NO: 3644890 - DNA, 14 bp, Homo sapiens
acaaaatataaatc

SEQ ID NO: 3644891 - DNA, 15 bp, Homo sapiens
acaaacttttataaa

SEQ ID NO: 3644892 - DNA, 16 bp, Homo sapiens
acaaacttttataaat

SEQ ID NO: 3644893 - DNA, 22 bp, Homo sapiens
acaaagtgaaattagtattttg

SEQ ID NO: 3644894 - DNA, 14 bp, Homo sapiens
acaaatatactcat

SEQ ID NO: 3644895 - DNA, 14 bp, Homo sapiens
acaaatcattttga

SEQ ID NO: 3644896 - DNA, 17 bp, Homo sapiens
acaaatcattttgatgt

SEQ ID NO: 3644897 - DNA, 21 bp, Homo sapiens
acaaatcattttgatgtatta

SEQ ID NO: 3644898 - DNA, 14 bp, Homo sapiens
acaaattcagtgga

SEQ ID NO: 3644899 - DNA, 18 bp, Homo sapiens
acaaattcagtggacatt

SEQ ID NO: 3644900 - DNA, 21 bp, Homo sapiens
acaaattcagtggacatttgt

SEQ ID NO: 3644901 - DNA, 18 bp, Homo sapiens
acaactgtggataaattt

SEQ ID NO: 3644902 - DNA, 17 bp, Homo sapiens
acaagcaaactgaaatt

SEQ ID NO: 3644903 - DNA, 14 bp, Homo sapiens
acaagctacatatg

SEQ ID NO: 3644904 - DNA, 20 bp, Homo sapiens
acaatacttttcaggcactt

SEQ ID NO: 3644905 - DNA, 15 bp, Homo sapiens
acaatcatctattga

SEQ ID NO: 3644906 - DNA, 22 bp, Homo sapiens
acaatcatgcctacattagtga

SEQ ID NO: 3644907 - DNA, 14 bp, Homo sapiens
acacaaagtgaaat

SEQ ID NO: 3644908 - DNA, 16 bp, Homo sapiens
acacaaagtgaaatta

SEQ ID NO: 3644909 - DNA, 18 bp, Homo sapiens
acacaaagtgaaattagt

SEQ ID NO: 3644910 - DNA, 16 bp, Homo sapiens
acacacctgagaatgt

SEQ ID NO: 3644911 - DNA, 13 bp, Homo sapiens
acacagcatgcat

SEQ ID NO: 3644912 - DNA, 21 bp, Homo sapiens
acacagctgagctggcctatt

SEQ ID NO: 3644913 - DNA, 20 bp, Homo sapiens
acacagtatagataaatcca

SEQ ID NO: 3644914 - DNA, 21 bp, Homo sapiens
acacatataaacacagtaaga

SEQ ID NO: 3644915 - DNA, 16 bp, Homo sapiens
acaccctcacactggg

SEQ ID NO: 3644916 - DNA, 15 bp, Homo sapiens
acacctaaattaaca

SEQ ID NO: 3644917 - DNA, 20 bp, Homo sapiens
cattggctagaatcagggtg

SEQ ID NO: 3644918 - DNA, 13 bp, Homo sapiens
cattgtcagaatg

SEQ ID NO: 3644919 - DNA, 14 bp, Homo sapiens
cattgtcagaatgt

SEQ ID NO: 3644920 - DNA, 19 bp, Homo sapiens
cattgtcagaatgttgtgt

SEQ ID NO: 3644921 - DNA, 22 bp, Homo sapiens
catttatgtgtgaagcaaattt

SEQ ID NO: 3644922 - DNA, 13 bp, Homo sapiens
catttctttatga

SEQ ID NO: 3644923 - DNA, 14 bp, Homo sapiens
catttgacatgagt

SEQ ID NO: 3644924 - DNA, 20 bp, Homo sapiens
catttgcaggtgaccagaat

SEQ ID NO: 3644925 - DNA, 21 bp, Homo sapiens
catttgcaggtgaccagaatg

SEQ ID NO: 3644926 - DNA, 21 bp, Homo sapiens
catttgctgcatttcaagtta

SEQ ID NO: 3644927 - DNA, 16 bp, Homo sapiens
catttggatataaatc

SEQ ID NO: 3644928 - DNA, 17 bp, Homo sapiens
catttggatataaatct

SEQ ID NO: 3644929 - DNA, 23 bp, Homo sapiens
catttggattttaaacaaaattt

SEQ ID NO: 3644930 - DNA, 14 bp, Homo sapiens
catttgttctgggt

SEQ ID NO: 3644931 - DNA, 19 bp, Homo sapiens
cattttcagatccttccaa

SEQ ID NO: 3644932 - DNA, 16 bp, Homo sapiens
catttttgagtaaaac

SEQ ID NO: 3644933 - DNA, 13 bp, Homo sapiens
ccaaaagcaggaa

SEQ ID NO: 3644934 - DNA, 15 bp, Homo sapiens
ccaaaagtactagca

SEQ ID NO: 3644935 - DNA, 20 bp, Homo sapiens
ccaaatcactgaactttgct

SEQ ID NO: 3644936 - DNA, 19 bp, Homo sapiens
ccaacgatcatatctgtat

SEQ ID NO: 3644937 - DNA, 18 bp, Homo sapiens
ccaccctgcccactccca

SEQ ID NO: 3644938 - DNA, 19 bp, Homo sapiens
ccactcccatcccttcaac

SEQ ID NO: 3644939 - DNA, 14 bp, Homo sapiens
ccacttatttccat

SEQ ID NO: 3644940 - DNA, 18 bp, Homo sapiens
ccagaagctcaaggctgc

SEQ ID NO: 3644941 - DNA, 12 bp, Homo sapiens
ccagaaggaagc

SEQ ID NO: 3644942 - DNA, 13 bp, Homo sapiens
ccagaaggaagcc

SEQ ID NO: 3644943 - DNA, 20 bp, Homo sapiens
ccagaaggaagccctctcag

SEQ ID NO: 3644944 - DNA, 22 bp, Homo sapiens
ccagcagaacaaactcagatct

SEQ ID NO: 3644945 - DNA, 21 bp, Homo sapiens
ccagcctcactccatttccca

SEQ ID NO: 3644946 - DNA, 22 bp, Homo sapiens
ccagcctcactccatttcccac

SEQ ID NO: 3644947 - DNA, 22 bp, Homo sapiens
ccagcctgcatctagctggagc

SEQ ID NO: 3644948 - DNA, 16 bp, Homo sapiens
ccagctctacgtccca

SEQ ID NO: 3644949 - DNA, 18 bp, Homo sapiens
ccaggcacggaggctcgt

SEQ ID NO: 3644950 - DNA, 21 bp, Homo sapiens
ccaggcatggaaagatgggga

SEQ ID NO: 3644951 - DNA, 22 bp, Homo sapiens
ccatcagaaacaccctcacact

SEQ ID NO: 3644952 - DNA, 14 bp, Homo sapiens
ccatcatttcattc

SEQ ID NO: 3644953 - DNA, 21 bp, Homo sapiens
ccatgcattcagatctgaagt

SEQ ID NO: 3644954 - DNA, 16 bp, Homo sapiens
ccatggattcccctgg

SEQ ID NO: 3644955 - DNA, 17 bp, Homo sapiens
ccatggtagactgtgac

SEQ ID NO: 3644956 - DNA, 20 bp, Homo sapiens
ccattcattccattctggaa

SEQ ID NO: 3644957 - DNA, 12 bp, Homo sapiens
ccattctggaag

SEQ ID NO: 3644958 - DNA, 17 bp, Homo sapiens
ccattggctagaatcag

SEQ ID NO: 3644959 - DNA, 14 bp, Homo sapiens
ccattttgaaatat

SEQ ID NO: 3644960 - DNA, 20 bp, Homo sapiens
cccagaagctcaaggctgca

SEQ ID NO: 3644961 - DNA, 17 bp, Homo sapiens
cccagactcagagggaa

SEQ ID NO: 3644962 - DNA, 16 bp, Homo sapiens
cccagcctcactccat

SEQ ID NO: 3644963 - DNA, 21 bp, Homo sapiens
cccagcctcactccatttccc

SEQ ID NO: 3644964 - DNA, 13 bp, Homo sapiens
cccagcctcttcc

SEQ ID NO: 3644965 - DNA, 23 bp, Homo sapiens
cccagcctgcatctagctggagc

SEQ ID NO: 3644966 - DNA, 15 bp, Homo sapiens
cccagtcgaggctgg

SEQ ID NO: 3644967 - DNA, 22 bp, Homo sapiens
cccagttgtccgtgaagagaaa

SEQ ID NO: 3644968 - DNA, 15 bp, Homo sapiens
cccatcccttcaacc

SEQ ID NO: 3644969 - DNA, 18 bp, Homo sapiens
cccattcattccattctg

SEQ ID NO: 3644970 - DNA, 21 bp, Homo sapiens
cccattcattccattctggaa

SEQ ID NO: 3644971 - DNA, 22 bp, Homo sapiens
cccattcattccattctggaag

SEQ ID NO: 3644972 - DNA, 13 bp, Homo sapiens
ccccagcctcact

SEQ ID NO: 3644973 - DNA, 17 bp, Homo sapiens
cccccactgcctttgac

SEQ ID NO: 3644974 - DNA, 23 bp, Homo sapiens
cccgaccagatccttttccatcc

SEQ ID NO: 3644975 - DNA, 15 bp, Homo sapiens
cccgtagccagtcta

SEQ ID NO: 3644976 - DNA, 19 bp, Homo sapiens
cccgttagcttcctgcagg

SEQ ID NO: 3644977 - DNA, 13 bp, Homo sapiens
ccctctcagatca

SEQ ID NO: 3644978 - DNA, 17 bp, Homo sapiens
ccctgcccactcccatc

SEQ ID NO: 3644979 - DNA, 18 bp, Homo sapiens
ccctggcttccccttcag

SEQ ID NO: 3644980 - DNA, 12 bp, Homo sapiens
ccctgggctgga

SEQ ID NO: 3644981 - DNA, 13 bp, Homo sapiens
cccttcaatgtta

SEQ ID NO: 3644982 - DNA, 14 bp, Homo sapiens
cccttcatctggaa

SEQ ID NO: 3644983 - DNA, 15 bp, Homo sapiens
cccttctttccttcc

SEQ ID NO: 3644984 - DNA, 11 bp, Homo sapiens
ccgaggcaggt

SEQ ID NO: 3644985 - DNA, 21 bp, Homo sapiens
cctaactgtgaacaatcagat

SEQ ID NO: 3644986 - DNA, 17 bp, Homo sapiens
cctaaggcagacaggaa

SEQ ID NO: 3644987 - DNA, 18 bp, Homo sapiens
cctagtcttgttgttcat

SEQ ID NO: 3644988 - DNA, 12 bp, Homo sapiens
cctatctttgcc

SEQ ID NO: 3644989 - DNA, 13 bp, Homo sapiens
cctatctttgcca

SEQ ID NO: 3644990 - DNA, 19 bp, Homo sapiens
cctatctttgccaccctca

SEQ ID NO: 3644991 - DNA, 15 bp, Homo sapiens
cctatgtacttgaaa

SEQ ID NO: 3644992 - DNA, 21 bp, Homo sapiens
cctattgctgtaaataaaaat

SEQ ID NO: 3644993 - DNA, 24 bp, Homo sapiens
cctattgctgtaaataaaaatagc

SEQ ID NO: 3644994 - DNA, 21 bp, Homo sapiens
cctccaggcaaatgcccttca

SEQ ID NO: 3644995 - DNA, 17 bp, Homo sapiens
cctcccttctttccttc

SEQ ID NO: 3644996 - DNA, 21 bp, Homo sapiens
cctcccttctttccttccttt

SEQ ID NO: 3644997 - DNA, 23 bp, Homo sapiens
cctctaggtaaactagcaaaagg

SEQ ID NO: 3644998 - DNA, 18 bp, Homo sapiens
cctctcagatcaccccag

SEQ ID NO: 3644999 - DNA, 22 bp, Homo sapiens
cctctcagatcaccccagcctc

SEQ ID NO: 3645000 - DNA, 14 bp, Homo sapiens
cctcttagtccaca

SEQ ID NO: 3645001 - DNA, 16 bp, Homo sapiens
cctgaaccttcctgtc

SEQ ID NO: 3645002 - DNA, 13 bp, Homo sapiens
cctgagactggaa

SEQ ID NO: 3645003 - DNA, 14 bp, Homo sapiens
cctgagactggaaa

SEQ ID NO: 3645004 - DNA, 22 bp, Homo sapiens
cctgcaggactctatccctggc

SEQ ID NO: 3645005 - DNA, 18 bp, Homo sapiens
cctgcatctagctggagc

SEQ ID NO: 3645006 - DNA, 19 bp, Homo sapiens
cctgcatctagctggagcc

SEQ ID NO: 3645007 - DNA, 13 bp, Homo sapiens
cctgcccactccc

SEQ ID NO: 3645008 - DNA, 13 bp, Homo sapiens
cctgctgctctct

SEQ ID NO: 3645009 - DNA, 17 bp, Homo sapiens
cctgctgctctctaaga

SEQ ID NO: 3645010 - DNA, 13 bp, Homo sapiens
cctggaaaaggag

SEQ ID NO: 3645011 - DNA, 18 bp, Homo sapiens
cctggaaatttgtgtgct

SEQ ID NO: 3645012 - DNA, 16 bp, Homo sapiens
cctggcttagaaggca

SEQ ID NO: 3645013 - DNA, 17 bp, Homo sapiens
cctggcttagaaggcac

SEQ ID NO: 3645014 - DNA, 15 bp, Homo sapiens
cctgggaatctaagt

SEQ ID NO: 3645015 - DNA, 23 bp, Homo sapiens
cctgggaatctaagtgggagaca

SEQ ID NO: 3645016 - DNA, 13 bp, Homo sapiens
cctggtaattatc

SEQ ID NO: 3645017 - DNA, 14 bp, Homo sapiens
cctggttgatacag

SEQ ID NO: 3645018 - DNA, 15 bp, Homo sapiens
cctgtaatctcagct

SEQ ID NO: 3645019 - DNA, 12 bp, Homo sapiens
cctgtctcccag

SEQ ID NO: 3645020 - DNA, 12 bp, Homo sapiens
cctgtgaggaag

SEQ ID NO: 3645021 - DNA, 12 bp, Homo sapiens
ccttagaatgtg

SEQ ID NO: 3645022 - DNA, 16 bp, Homo sapiens
ccttagtaaattccta

SEQ ID NO: 3645023 - DNA, 17 bp, Homo sapiens
ccttcagggagagctgg

SEQ ID NO: 3645024 - DNA, 18 bp, Homo sapiens
ccttcagggagagctggg

SEQ ID NO: 3645025 - DNA, 13 bp, Homo sapiens
ccttcatctggaa

SEQ ID NO: 3645026 - DNA, 21 bp, Homo sapiens
ccttcatgcatggaaattccc

SEQ ID NO: 3645027 - DNA, 22 bp, Homo sapiens
ccttcctgtctcccagggacat

SEQ ID NO: 3645028 - DNA, 12 bp, Homo sapiens
ccttctccacag

SEQ ID NO: 3645029 - DNA, 15 bp, Homo sapiens
ccttctttccttcct

SEQ ID NO: 3645030 - DNA, 16 bp, Homo sapiens
ccttctttccttcctt

SEQ ID NO: 3645031 - DNA, 17 bp, Homo sapiens
ccttctttccttccttt

SEQ ID NO: 3645032 - DNA, 17 bp, Homo sapiens
ccttgcctgttaggtct

SEQ ID NO: 3645033 - DNA, 16 bp, Homo sapiens
ccttgtactttacaat

SEQ ID NO: 3645034 - DNA, 17 bp, Homo sapiens
cctttcttccttccttt

SEQ ID NO: 3645035 - DNA, 18 bp, Homo sapiens
cctttcttccttcctttc

SEQ ID NO: 3645036 - DNA, 18 bp, Homo sapiens
cctttggcaggtgcagcc

SEQ ID NO: 3645037 - DNA, 13 bp, Homo sapiens
aaaaaactggaaa

SEQ ID NO: 3645038 - DNA, 11 bp, Homo sapiens
aaaaaagtaat

SEQ ID NO: 3645039 - DNA, 12 bp, Homo sapiens
aaaaactggaaa

SEQ ID NO: 3645040 - DNA, 22 bp, Homo sapiens
aaaaactggaaacatctgattt

SEQ ID NO: 3645041 - DNA, 18 bp, Homo sapiens
aaaaagtgtttttacata

SEQ ID NO: 3645042 - DNA, 16 bp, Homo sapiens
aaaaatactaagagat

SEQ ID NO: 3645043 - DNA, 19 bp, Homo sapiens
aaaaatctgaatttctaaa

SEQ ID NO: 3645044 - DNA, 20 bp, Homo sapiens
aaaagacaagcattgggtca

SEQ ID NO: 3645045 - DNA, 18 bp, Homo sapiens
aaaagacacttttaccga

SEQ ID NO: 3645046 - DNA, 20 bp, Homo sapiens
aaaagaccatgcattcagat

SEQ ID NO: 3645047 - DNA, 21 bp, Homo sapiens
aaaagaccatgcattcagatc

SEQ ID NO: 3645048 - DNA, 13 bp, Homo sapiens
aaaagacttcaaa

SEQ ID NO: 3645049 - DNA, 19 bp, Homo sapiens
aaaagtttatctttgcaca

SEQ ID NO: 3645050 - DNA, 15 bp, Homo sapiens
aaaatattttcttaa

SEQ ID NO: 3645051 - DNA, 18 bp, Homo sapiens
aaaatattttcttaatta

SEQ ID NO: 3645052 - DNA, 14 bp, Homo sapiens
aaaatccttcagca

SEQ ID NO: 3645053 - DNA, 15 bp, Homo sapiens
aaaatggctgaagaa

SEQ ID NO: 3645054 - DNA, 15 bp, Homo sapiens
aaaatgtgtgcttgg

SEQ ID NO: 3645055 - DNA, 14 bp, Homo sapiens
aaaattatctttaa

SEQ ID NO: 3645056 - DNA, 22 bp, Homo sapiens
aaaattatctttaaaacttact

SEQ ID NO: 3645057 - DNA, 23 bp, Homo sapiens
aaaatttatgtcattttcagatc

SEQ ID NO: 3645058 - DNA, 16 bp, Homo sapiens
aaaattttcttcttta

SEQ ID NO: 3645059 - DNA, 20 bp, Homo sapiens
aaaattttcttctttaattt

SEQ ID NO: 3645060 - DNA, 18 bp, Homo sapiens
aaacaaatatactcattt

SEQ ID NO: 3645061 - DNA, 17 bp, Homo sapiens
aaacaaatcattttgat

SEQ ID NO: 3645062 - DNA, 19 bp, Homo sapiens
aaacaaatcattttgatgt

SEQ ID NO: 3645063 - DNA, 17 bp, Homo sapiens
aaacacagcatgcattt

SEQ ID NO: 3645064 - DNA, 21 bp, Homo sapiens
aaacacagcatgcatttagca

SEQ ID NO: 3645065 - DNA, 21 bp, Homo sapiens
aaacacggagtttccatttgg

SEQ ID NO: 3645066 - DNA, 18 bp, Homo sapiens
agacctaaggcagacagg

SEQ ID NO: 3645067 - DNA, 14 bp, Homo sapiens
agactaacttattt

SEQ ID NO: 3645068 - DNA, 23 bp, Homo sapiens
agactaacttattttgattgttt

SEQ ID NO: 3645069 - DNA, 21 bp, Homo sapiens
agactcaaggcctccagccac

SEQ ID NO: 3645070 - DNA, 13 bp, Homo sapiens
agactccatctca

SEQ ID NO: 3645071 - DNA, 17 bp, Homo sapiens
agactgccttatattat

SEQ ID NO: 3645072 - DNA, 22 bp, Homo sapiens
agacttcctattaatttattaa

SEQ ID NO: 3645073 - DNA, 22 bp, Homo sapiens
agagacctagataggtcatgca

SEQ ID NO: 3645074 - DNA, 16 bp, Homo sapiens
agagctgggcagacag

SEQ ID NO: 3645075 - DNA, 13 bp, Homo sapiens
agagcttcatgtg

SEQ ID NO: 3645076 - DNA, 22 bp, Homo sapiens
agaggcaggaccagaaggcaat

SEQ ID NO: 3645077 - DNA, 17 bp, Homo sapiens
agagtatacaagtgttt

SEQ ID NO: 3645078 - DNA, 20 bp, Homo sapiens
agagtgacttggagagagat

SEQ ID NO: 3645079 - DNA, 21 bp, Homo sapiens
agataatgaggcaactcagca

SEQ ID NO: 3645080 - DNA, 18 bp, Homo sapiens
agataattaaatgaaata

SEQ ID NO: 3645081 - DNA, 20 bp, Homo sapiens
agataattaaatgaaatact

SEQ ID NO: 3645082 - DNA, 22 bp, Homo sapiens
agataattaaatgaaatacttg

SEQ ID NO: 3645083 - DNA, 18 bp, Homo sapiens
agataccattttgaaata

SEQ ID NO: 3645084 - DNA, 17 bp, Homo sapiens
agatcccagagttattt

SEQ ID NO: 3645085 - DNA, 21 bp, Homo sapiens
agatccttttccatcccactc

SEQ ID NO: 3645086 - DNA, 23 bp, Homo sapiens
agatctcatcagggtagcagcag

SEQ ID NO: 3645087 - DNA, 20 bp, Homo sapiens
agatctgaagtagtgtgagt

SEQ ID NO: 3645088 - DNA, 22 bp, Homo sapiens
agatggtagaaactttggaagt

SEQ ID NO: 3645089 - DNA, 18 bp, Homo sapiens
agatggtgtcctgcatgt

SEQ ID NO: 3645090 - DNA, 19 bp, Homo sapiens
agatgtcgtggactccagc

SEQ ID NO: 3645091 - DNA, 12 bp, Homo sapiens
agattcctggtt

SEQ ID NO: 3645092 - DNA, 22 bp, Homo sapiens
agatttagggttctatatttac

SEQ ID NO: 3645093 - DNA, 21 bp, Homo sapiens
agcaaactgaaattagtgttt

SEQ ID NO: 3645094 - DNA, 22 bp, Homo sapiens
agcaaggaagtaagggagtcat

SEQ ID NO: 3645095 - DNA, 22 bp, Homo sapiens
agcaataagttgaatgataata

SEQ ID NO: 3645096 - DNA, 21 bp, Homo sapiens
agcaatccttaaaaagaccat

SEQ ID NO: 3645097 - DNA, 16 bp, Homo sapiens
agcacaaaagacaagc

SEQ ID NO: 3645098 - DNA, 19 bp, Homo sapiens
agcacatttgttaatgatt

SEQ ID NO: 3645099 - DNA, 14 bp, Homo sapiens
agcactttgggagg

SEQ ID NO: 3645100 - DNA, 17 bp, Homo sapiens
agcagaacaaactcaga

SEQ ID NO: 3645101 - DNA, 13 bp, Homo sapiens
agcagaatgagat

SEQ ID NO: 3645102 - DNA, 17 bp, Homo sapiens
agcagaatgagatgatt

SEQ ID NO: 3645103 - DNA, 12 bp, Homo sapiens
agcagcagaggc

SEQ ID NO: 3645104 - DNA, 16 bp, Homo sapiens
agcagcagaggcagga

SEQ ID NO: 3645105 - DNA, 14 bp, Homo sapiens
agcagcgagtgcat

SEQ ID NO: 3645106 - DNA, 16 bp, Homo sapiens
agcataaacaatattg

SEQ ID NO: 3645107 - DNA, 15 bp, Homo sapiens
agcataatattttct

SEQ ID NO: 3645108 - DNA, 23 bp, Homo sapiens
agcataatattttctttcttttt

SEQ ID NO: 3645109 - DNA, 18 bp, Homo sapiens
agcatccaaaagcaggaa

SEQ ID NO: 3645110 - DNA, 20 bp, Homo sapiens
agcatccaaaagcaggaacc

SEQ ID NO: 3645111 - DNA, 23 bp, Homo sapiens
agcatcccaaagtgctgggatta

SEQ ID NO: 3645112 - DNA, 23 bp, Homo sapiens
agcatcctggaaatttgtgtgct

SEQ ID NO: 3645113 - DNA, 17 bp, Homo sapiens
agcatgagacatcatgg

SEQ ID NO: 3645114 - DNA, 20 bp, Homo sapiens
agcatgcatttagcatgagt

SEQ ID NO: 3645115 - DNA, 23 bp, Homo sapiens
agcatgcatttagcatgagttct

SEQ ID NO: 3645116 - DNA, 20 bp, Homo sapiens
agcatgcccaaatataacat

SEQ ID NO: 3645117 - DNA, 17 bp, Homo sapiens
agccaaccctggaaaag

SEQ ID NO: 3645118 - DNA, 21 bp, Homo sapiens
agcccagaagctcaaggctgc

SEQ ID NO: 3645119 - DNA, 11 bp, Homo sapiens
agcccagcctg

SEQ ID NO: 3645120 - DNA, 14 bp, Homo sapiens
agcccattcattcc

SEQ ID NO: 3645121 - DNA, 23 bp, Homo sapiens
agcccattcattccattctggaa

SEQ ID NO: 3645122 - DNA, 12 bp, Homo sapiens
agcctcactcca

SEQ ID NO: 3645123 - DNA, 13 bp, Homo sapiens
agcctcactccat

SEQ ID NO: 3645124 - DNA, 18 bp, Homo sapiens
agcctcactccatttccc

SEQ ID NO: 3645125 - DNA, 19 bp, Homo sapiens
agcctggccaacatggtga

SEQ ID NO: 3645126 - DNA, 15 bp, Homo sapiens
agccttattaaaata

SEQ ID NO: 3645127 - DNA, 18 bp, Homo sapiens
agccttattaaaatattt

SEQ ID NO: 3645128 - DNA, 23 bp, Homo sapiens
agccttattaaaatattttctta

SEQ ID NO: 3645129 - DNA, 16 bp, Homo sapiens
agcgagtgcatgggct

SEQ ID NO: 3645130 - DNA, 17 bp, Homo sapiens
agctaagcctgatgatg

SEQ ID NO: 3645131 - DNA, 15 bp, Homo sapiens
agctaatttgtgaaa

SEQ ID NO: 3645132 - DNA, 17 bp, Homo sapiens
agctactcaggaggctg

SEQ ID NO: 3645133 - DNA, 13 bp, Homo sapiens
agctcacagcaca

SEQ ID NO: 3645134 - DNA, 16 bp, Homo sapiens
agctcacagcacattt

SEQ ID NO: 3645135 - DNA, 17 bp, Homo sapiens
agctcatagcacatgtt

SEQ ID NO: 3645136 - DNA, 19 bp, Homo sapiens
agctcatagcacatgtttt

SEQ ID NO: 3645137 - DNA, 23 bp, Homo sapiens
agctcatagcacatgttttacaa

SEQ ID NO: 3645138 - DNA, 16 bp, Homo sapiens
agctctacgtcccaca

SEQ ID NO: 3645139 - DNA, 14 bp, Homo sapiens
agctgagctggcct

SEQ ID NO: 3645140 - DNA, 22 bp, Homo sapiens
agctgctgtatttgaggaaact

SEQ ID NO: 3645141 - DNA, 15 bp, Homo sapiens
agctgggcagacagg

SEQ ID NO: 3645142 - DNA, 16 bp, Homo sapiens
agctgggcagacaggt

SEQ ID NO: 3645143 - DNA, 19 bp, Homo sapiens
agcttccagaaatgccaca

SEQ ID NO: 3645144 - DNA, 14 bp, Homo sapiens
agcttcctgcagga

SEQ ID NO: 3645145 - DNA, 16 bp, Homo sapiens
agctttctgatactta

SEQ ID NO: 3645146 - DNA, 23 bp, Homo sapiens
agctttgcaaccttgtactttac

SEQ ID NO: 3645147 - DNA, 22 bp, Homo sapiens
aggaaaaggctgcagctaattt

SEQ ID NO: 3645148 - DNA, 22 bp, Homo sapiens
aggaaaattttcttctttaatt

SEQ ID NO: 3645149 - DNA, 22 bp, Homo sapiens
aggaaacaacaaaggaagtgag

SEQ ID NO: 3645150 - DNA, 22 bp, Homo sapiens
aggaagaggttgcagtgagctg

SEQ ID NO: 3645151 - DNA, 19 bp, Homo sapiens
aggaagccctctcagatca

SEQ ID NO: 3645152 - DNA, 14 bp, Homo sapiens
aggaagtgaggtag

SEQ ID NO: 3645153 - DNA, 16 bp, Homo sapiens
aggacatctctgtaaa

SEQ ID NO: 3645154 - DNA, 17 bp, Homo sapiens
aggacatttgacatgag

SEQ ID NO: 3645155 - DNA, 11 bp, Homo sapiens
aggactacaga

SEQ ID NO: 3645156 - DNA, 16 bp, Homo sapiens
aggactctatccctgg

SEQ ID NO: 3645157 - DNA, 12 bp, Homo sapiens
aggactgaagaa

SEQ ID NO: 3645158 - DNA, 14 bp, Homo sapiens
aggactgaagaaaa

SEQ ID NO: 3645159 - DNA, 14 bp, Homo sapiens
aggacttaatttag

SEQ ID NO: 3645160 - DNA, 13 bp, Homo sapiens
aggagaattgctt

SEQ ID NO: 3645161 - DNA, 13 bp, Homo sapiens
aggaggctgaggc

SEQ ID NO: 3645162 - DNA, 16 bp, Homo sapiens
aggaggctgaggcagg

SEQ ID NO: 3645163 - DNA, 15 bp, Homo sapiens
aggcaactcagcagg

SEQ ID NO: 3645164 - DNA, 16 bp, Homo sapiens
aggcaactcagcaggc

SEQ ID NO: 3645165 - DNA, 20 bp, Homo sapiens
aggcaatcaagagcttccag

SEQ ID NO: 3645166 - DNA, 21 bp, Homo sapiens
aggcaatcaagagcttccaga

SEQ ID NO: 3645167 - DNA, 14 bp, Homo sapiens
aggcactttagaaa

SEQ ID NO: 3645168 - DNA, 13 bp, Homo sapiens
aggcagacaggaa

SEQ ID NO: 3645169 - DNA, 14 bp, Homo sapiens
aggcagacaggaag

SEQ ID NO: 3645170 - DNA, 16 bp, Homo sapiens
aggcagacaggaagga

SEQ ID NO: 3645171 - DNA, 18 bp, Homo sapiens
aggcaggaccagaaggca

SEQ ID NO: 3645172 - DNA, 15 bp, Homo sapiens
aggcatggaaagatg

SEQ ID NO: 3645173 - DNA, 17 bp, Homo sapiens
aggcatggaaagatggg

SEQ ID NO: 3645174 - DNA, 14 bp, Homo sapiens
aggccgaggcaggt

SEQ ID NO: 3645175 - DNA, 14 bp, Homo sapiens
aggcgagcctggcc

SEQ ID NO: 3645176 - DNA, 18 bp, Homo sapiens
aggcgagcctggccaaca

SEQ ID NO: 3645177 - DNA, 13 bp, Homo sapiens
aggctctctggtc

SEQ ID NO: 3645178 - DNA, 20 bp, Homo sapiens
aggctgcagctaatttgtga

SEQ ID NO: 3645179 - DNA, 17 bp, Homo sapiens
aggctggtaagggacct

SEQ ID NO: 3645180 - DNA, 22 bp, Homo sapiens
aggctggtaagggaccttcagg

SEQ ID NO: 3645181 - DNA, 23 bp, Homo sapiens
aggctggtaagggaccttcaggg

SEQ ID NO: 3645182 - DNA, 16 bp, Homo sapiens
agggaagcccagcctg

SEQ ID NO: 3645183 - DNA, 17 bp, Homo sapiens
agggaaggctctctggt

SEQ ID NO: 3645184 - DNA, 22 bp, Homo sapiens
agggaccttcagggagagctgg

SEQ ID NO: 3645185 - DNA, 23 bp, Homo sapiens
agggagagctgggcagacaggtg

SEQ ID NO: 3645186 - DNA, 17 bp, Homo sapiens
agggagtcattgccttg

SEQ ID NO: 3645187 - DNA, 22 bp, Homo sapiens
agggatgctatctcgctagcca

SEQ ID NO: 3645188 - DNA, 13 bp, Homo sapiens
agggctggctgga

SEQ ID NO: 3645189 - DNA, 19 bp, Homo sapiens
agggctgttccctccaggc

SEQ ID NO: 3645190 - DNA, 20 bp, Homo sapiens
agggctgttccctccaggca

SEQ ID NO: 3645191 - DNA, 12 bp, Homo sapiens
aggggaggctga

SEQ ID NO: 3645192 - DNA, 15 bp, Homo sapiens
aggggcaaaaatttg

SEQ ID NO: 3645193 - DNA, 21 bp, Homo sapiens
aggggtgttgtgagagctggg

SEQ ID NO: 3645194 - DNA, 21 bp, Homo sapiens
agggtagcagcagaggcagga

SEQ ID NO: 3645195 - DNA, 18 bp, Homo sapiens
agggtgaataagattaat

SEQ ID NO: 3645196 - DNA, 16 bp, Homo sapiens
agggtgagactccatc

SEQ ID NO: 3645197 - DNA, 20 bp, Homo sapiens
agggtgagactccatctcaa

SEQ ID NO: 3645198 - DNA, 20 bp, Homo sapiens
cacccccgttagcttcctgc

SEQ ID NO: 3645199 - DNA, 14 bp, Homo sapiens
caccctgcccactc

SEQ ID NO: 3645200 - DNA, 17 bp, Homo sapiens
cacctcccaaaggctgt

SEQ ID NO: 3645201 - DNA, 23 bp, Homo sapiens
caccttgattggaaaataatatc

SEQ ID NO: 3645202 - DNA, 21 bp, Homo sapiens
cacggaggctcgtgcatgtaa

SEQ ID NO: 3645203 - DNA, 20 bp, Homo sapiens
cacggagtttccatttggat

SEQ ID NO: 3645204 - DNA, 15 bp, Homo sapiens
cactcccatcccttc

SEQ ID NO: 3645205 - DNA, 18 bp, Homo sapiens
cactgcagttatttacca

SEQ ID NO: 3645206 - DNA, 13 bp, Homo sapiens
cacttatttccat

SEQ ID NO: 3645207 - DNA, 14 bp, Homo sapiens
cacttcttaaggac

SEQ ID NO: 3645208 - DNA, 23 bp, Homo sapiens
cacttcttaaggacagtgttcaa

SEQ ID NO: 3645209 - DNA, 16 bp, Homo sapiens
cactttacattcttgc

SEQ ID NO: 3645210 - DNA, 16 bp, Homo sapiens
cactttgggaggctga

SEQ ID NO: 3645211 - DNA, 16 bp, Homo sapiens
cacttttgctctgcag

SEQ ID NO: 3645212 - DNA, 20 bp, Homo sapiens
cagaacctttggacaagagg

SEQ ID NO: 3645213 - DNA, 21 bp, Homo sapiens
cagaacctttggacaagagga

SEQ ID NO: 3645214 - DNA, 15 bp, Homo sapiens
cagaagcaaggaagt

SEQ ID NO: 3645215 - DNA, 20 bp, Homo sapiens
cagaagcaaggaagtaaggg

SEQ ID NO: 3645216 - DNA, 20 bp, Homo sapiens
cagaaggaagccctctcaga

SEQ ID NO: 3645217 - DNA, 14 bp, Homo sapiens
cagaagtggaagga

SEQ ID NO: 3645218 - DNA, 22 bp, Homo sapiens
cagaagtttaaatctttgttaa

SEQ ID NO: 3645219 - DNA, 22 bp, Homo sapiens
cagaattgggcccttagaatgt

SEQ ID NO: 3645220 - DNA, 17 bp, Homo sapiens
cagaattgttctttttc

SEQ ID NO: 3645221 - DNA, 14 bp, Homo sapiens
cagacaggaaggaa

SEQ ID NO: 3645222 - DNA, 15 bp, Homo sapiens
cagacaggaaggaag

SEQ ID NO: 3645223 - DNA, 15 bp, Homo sapiens
cagagctccatgctg

SEQ ID NO: 3645224 - DNA, 16 bp, Homo sapiens
cagagtatacaagtgt

SEQ ID NO: 3645225 - DNA, 14 bp, Homo sapiens
cagagttccccgct

SEQ ID NO: 3645226 - DNA, 12 bp, Homo sapiens
cagatccttcca

SEQ ID NO: 3645227 - DNA, 23 bp, Homo sapiens
cagatccttttccatcccactcc

SEQ ID NO: 3645228 - DNA, 14 bp, Homo sapiens
cagattagacacta

SEQ ID NO: 3645229 - DNA, 19 bp, Homo sapiens
cagatttccaaaagtacta

SEQ ID NO: 3645230 - DNA, 17 bp, Homo sapiens
cagcacatttgttaatg

SEQ ID NO: 3645231 - DNA, 23 bp, Homo sapiens
cagcacatttgttaatgattctt

SEQ ID NO: 3645232 - DNA, 22 bp, Homo sapiens
cagcagaacaaactcagatctc

SEQ ID NO: 3645233 - DNA, 14 bp, Homo sapiens
cagcagaggcagga

SEQ ID NO: 3645234 - DNA, 21 bp, Homo sapiens
cagcatccaaaagcaggaacc

SEQ ID NO: 3645235 - DNA, 13 bp, Homo sapiens
cagcatgcattta

SEQ ID NO: 3645236 - DNA, 21 bp, Homo sapiens
cagcatgcatttagcatgagt

SEQ ID NO: 3645237 - DNA, 14 bp, Homo sapiens
cagcctcactccat

SEQ ID NO: 3645238 - DNA, 22 bp, Homo sapiens
cagcctcactccatttcccact

SEQ ID NO: 3645239 - DNA, 21 bp, Homo sapiens
cagcctcttccattccctttc

SEQ ID NO: 3645240 - DNA, 20 bp, Homo sapiens
cagcctgcatctagctggag

SEQ ID NO: 3645241 - DNA, 17 bp, Homo sapiens
cagctaagcctgatgat

SEQ ID NO: 3645242 - DNA, 19 bp, Homo sapiens
cagctaagcctgatgatgg

SEQ ID NO: 3645243 - DNA, 18 bp, Homo sapiens
cagctaatttgtgaaagt

SEQ ID NO: 3645244 - DNA, 19 bp, Homo sapiens
cagctacaggggaggctga

SEQ ID NO: 3645245 - DNA, 20 bp, Homo sapiens
cagctacaggggaggctgag

SEQ ID NO: 3645246 - DNA, 14 bp, Homo sapiens
cagctgtgagcttt

SEQ ID NO: 3645247 - DNA, 15 bp, Homo sapiens
caggaccagaaggca

SEQ ID NO: 3645248 - DNA, 18 bp, Homo sapiens
caggactctatccctggc

SEQ ID NO: 3645249 - DNA, 15 bp, Homo sapiens
caggaggctgaggca

SEQ ID NO: 3645250 - DNA, 16 bp, Homo sapiens
caggaggctgaggcag

SEQ ID NO: 3645251 - DNA, 18 bp, Homo sapiens
caggagttcgaggcgagc

SEQ ID NO: 3645252 - DNA, 22 bp, Homo sapiens
caggagttcgaggcgagcctgg

SEQ ID NO: 3645253 - DNA, 15 bp, Homo sapiens
caggcacggaggctc

SEQ ID NO: 3645254 - DNA, 19 bp, Homo sapiens
caggcatgagccactgtgc

SEQ ID NO: 3645255 - DNA, 14 bp, Homo sapiens
caggcatggaaaga

SEQ ID NO: 3645256 - DNA, 21 bp, Homo sapiens
cagggacatgtatgcttccag

SEQ ID NO: 3645257 - DNA, 12 bp, Homo sapiens
cagggagagctg

SEQ ID NO: 3645258 - DNA, 14 bp, Homo sapiens
cagggagagctggg

SEQ ID NO: 3645259 - DNA, 22 bp, Homo sapiens
cagggagagctgggcagacagg

SEQ ID NO: 3645260 - DNA, 19 bp, Homo sapiens
cagggtagcagcagaggca

SEQ ID NO: 3645261 - DNA, 23 bp, Homo sapiens
caggtaaactgatgctttcagat

SEQ ID NO: 3645262 - DNA, 15 bp, Homo sapiens
caggtgaccagaatg

SEQ ID NO: 3645263 - DNA, 18 bp, Homo sapiens
caggtgcagcccccactg

SEQ ID NO: 3645264 - DNA, 12 bp, Homo sapiens
caggtggcattt

SEQ ID NO: 3645265 - DNA, 16 bp, Homo sapiens
caggtggcatttgcag

SEQ ID NO: 3645266 - DNA, 15 bp, Homo sapiens
caggtgggagatgga

SEQ ID NO: 3645267 - DNA, 21 bp, Homo sapiens
caggttttatgagacttccta

SEQ ID NO: 3645268 - DNA, 12 bp, Homo sapiens
cagtaaatatac

SEQ ID NO: 3645269 - DNA, 20 bp, Homo sapiens
cagtaaatatacactttaca

SEQ ID NO: 3645270 - DNA, 17 bp, Homo sapiens
cagtaaatgtatattga

SEQ ID NO: 3645271 - DNA, 20 bp, Homo sapiens
cagtagcattttaatagttt

SEQ ID NO: 3645272 - DNA, 14 bp, Homo sapiens
cagtatagataaat

SEQ ID NO: 3645273 - DNA, 16 bp, Homo sapiens
cagtatgggttaggga

SEQ ID NO: 3645274 - DNA, 20 bp, Homo sapiens
cagtcaattgcttgagcatg

SEQ ID NO: 3645275 - DNA, 15 bp, Homo sapiens
cagtcatggtggcac

SEQ ID NO: 3645276 - DNA, 18 bp, Homo sapiens
cagtctatgctgtgtgca

SEQ ID NO: 3645277 - DNA, 18 bp, Homo sapiens
cagtgagtcagaggcaga

SEQ ID NO: 3645278 - DNA, 21 bp, Homo sapiens
cagtggaagagctgctgtatt

SEQ ID NO: 3645279 - DNA, 22 bp, Homo sapiens
cagtggaagagctgctgtattt

SEQ ID NO: 3645280 - DNA, 18 bp, Homo sapiens
cagtgttcaaattctgat

SEQ ID NO: 3645281 - DNA, 14 bp, Homo sapiens
cagttacttacaca

SEQ ID NO: 3645282 - DNA, 22 bp, Homo sapiens
catacgtgcccatttcacacaa

SEQ ID NO: 3645283 - DNA, 16 bp, Homo sapiens
catagacctaactgtg

SEQ ID NO: 3645284 - DNA, 14 bp, Homo sapiens
catagcacatgttt

SEQ ID NO: 3645285 - DNA, 15 bp, Homo sapiens
catagtggtatttta

SEQ ID NO: 3645286 - DNA, 17 bp, Homo sapiens
catagtggtattttaac

SEQ ID NO: 3645287 - DNA, 23 bp, Homo sapiens
catagtggtattttaacatagca

SEQ ID NO: 3645288 - DNA, 21 bp, Homo sapiens
catataggggcaaaaatttga

SEQ ID NO: 3645289 - DNA, 23 bp, Homo sapiens
catataggggcaaaaatttgaca

SEQ ID NO: 3645290 - DNA, 24 bp, Homo sapiens
catataggggcaaaaatttgacat

SEQ ID NO: 3645291 - DNA, 17 bp, Homo sapiens
catatgtaggaaaattt

SEQ ID NO: 3645292 - DNA, 19 bp, Homo sapiens
catatgtaggaaaattttc

SEQ ID NO: 3645293 - DNA, 16 bp, Homo sapiens
catcaaacaaatcatt

SEQ ID NO: 3645294 - DNA, 18 bp, Homo sapiens
catcaaacaaatcatttt

SEQ ID NO: 3645295 - DNA, 19 bp, Homo sapiens
catcaaacaaatcattttg

SEQ ID NO: 3645296 - DNA, 22 bp, Homo sapiens
catcagggtagcagcagaggca

SEQ ID NO: 3645297 - DNA, 22 bp, Homo sapiens
catccaaaagcaggaacccatc

SEQ ID NO: 3645298 - DNA, 22 bp, Homo sapiens
catcccttcaaccccacttcct

SEQ ID NO: 3645299 - DNA, 17 bp, Homo sapiens
catctaaaccagaagga

SEQ ID NO: 3645300 - DNA, 12 bp, Homo sapiens
catctctgtaaa

SEQ ID NO: 3645301 - DNA, 12 bp, Homo sapiens
catctgaggaaa

SEQ ID NO: 3645302 - DNA, 15 bp, Homo sapiens
catctgatttctgaa

SEQ ID NO: 3645303 - DNA, 23 bp, Homo sapiens
catgaaagtcaagtctacctgcc

SEQ ID NO: 3645304 - DNA, 21 bp, Homo sapiens
catgaatacgtaaactgcgta

SEQ ID NO: 3645305 - DNA, 18 bp, Homo sapiens
catgaatccatcgatttg

SEQ ID NO: 3645306 - DNA, 12 bp, Homo sapiens
catgagttctgc

SEQ ID NO: 3645307 - DNA, 17 bp, Homo sapiens
catgagttctgcacata

SEQ ID NO: 3645308 - DNA, 17 bp, Homo sapiens
catgatgctagttctta

SEQ ID NO: 3645309 - DNA, 14 bp, Homo sapiens
catgcaagtgagaa

SEQ ID NO: 3645310 - DNA, 17 bp, Homo sapiens
catgcaagtgagaaaga

SEQ ID NO: 3645311 - DNA, 15 bp, Homo sapiens
catgcatggaaattc

SEQ ID NO: 3645312 - DNA, 15 bp, Homo sapiens
catgcatttagcatg

SEQ ID NO: 3645313 - DNA, 16 bp, Homo sapiens
catgcatttagcatga

SEQ ID NO: 3645314 - DNA, 15 bp, Homo sapiens
catgcccaaatataa

SEQ ID NO: 3645315 - DNA, 22 bp, Homo sapiens
catgcctacattagtgagattt

SEQ ID NO: 3645316 - DNA, 21 bp, Homo sapiens
catgctgtgtgactcaaacca

SEQ ID NO: 3645317 - DNA, 21 bp, Homo sapiens
catggaaattcccttcatctg

SEQ ID NO: 3645318 - DNA, 21 bp, Homo sapiens
catggtcagaacctttggaca

SEQ ID NO: 3645319 - DNA, 11 bp, Homo sapiens
catggtggcac

SEQ ID NO: 3645320 - DNA, 15 bp, Homo sapiens
catgtatgttgcatg

SEQ ID NO: 3645321 - DNA, 18 bp, Homo sapiens
catgtatgttgcatgaat

SEQ ID NO: 3645322 - DNA, 21 bp, Homo sapiens
catgtgataattgtaaaggtg

SEQ ID NO: 3645323 - DNA, 19 bp, Homo sapiens
cattacactccagcctggg

SEQ ID NO: 3645324 - DNA, 12 bp, Homo sapiens
cattccatcctt

SEQ ID NO: 3645325 - DNA, 15 bp, Homo sapiens
cattccattctggaa

SEQ ID NO: 3645326 - DNA, 19 bp, Homo sapiens
cattcgtgggcctgctgct

SEQ ID NO: 3645327 - DNA, 19 bp, Homo sapiens
cattctctaagcctggctt

SEQ ID NO: 3645328 - DNA, 20 bp, Homo sapiens
cattctggtccttagtaaat

SEQ ID NO: 3645329 - DNA, 22 bp, Homo sapiens
cattctggtccttagtaaattc

SEQ ID NO: 3645330 - DNA, 18 bp, Homo sapiens
gacctgaattgaaagaga

SEQ ID NO: 3645331 - DNA, 22 bp, Homo sapiens
gacctgcctcccttcatgcatg

SEQ ID NO: 3645332 - DNA, 16 bp, Homo sapiens
gactaacttattttga

SEQ ID NO: 3645333 - DNA, 11 bp, Homo sapiens
gactacagaag

SEQ ID NO: 3645334 - DNA, 21 bp, Homo sapiens
gactcagagggaaggctctct

SEQ ID NO: 3645335 - DNA, 20 bp, Homo sapiens
gacttggagagagattcaga

SEQ ID NO: 3645336 - DNA, 15 bp, Homo sapiens
gacttgtctcccagt

SEQ ID NO: 3645337 - DNA, 16 bp, Homo sapiens
gactttggctgcatgc

SEQ ID NO: 3645338 - DNA, 22 bp, Homo sapiens
gagactaacttattttgattgt

SEQ ID NO: 3645339 - DNA, 19 bp, Homo sapiens
gagacttcctattaattta

SEQ ID NO: 3645340 - DNA, 21 bp, Homo sapiens
gagacttcctattaatttatt

SEQ ID NO: 3645341 - DNA, 12 bp, Homo sapiens
gagagggatgga

SEQ ID NO: 3645342 - DNA, 19 bp, Homo sapiens
gagatggaggtagggctgg

SEQ ID NO: 3645343 - DNA, 17 bp, Homo sapiens
gagattggaaaaaatta

SEQ ID NO: 3645344 - DNA, 22 bp, Homo sapiens
gagatttagggttctatattta

SEQ ID NO: 3645345 - DNA, 18 bp, Homo sapiens
gagcatgcccaaatataa

SEQ ID NO: 3645346 - DNA, 21 bp, Homo sapiens
gagcccagaagctcaaggctg

SEQ ID NO: 3645347 - DNA, 19 bp, Homo sapiens
gagcctgagactggaaaag

SEQ ID NO: 3645348 - DNA, 18 bp, Homo sapiens
gagcctggccaacatggt

SEQ ID NO: 3645349 - DNA, 20 bp, Homo sapiens
gagcctggccaacatggtga

SEQ ID NO: 3645350 - DNA, 21 bp, Homo sapiens
gaggaaaaatactaagagatt

SEQ ID NO: 3645351 - DNA, 13 bp, Homo sapiens
gaggaaaatggaa

SEQ ID NO: 3645352 - DNA, 20 bp, Homo sapiens
gaggatgaggtgggctgaag

SEQ ID NO: 3645353 - DNA, 18 bp, Homo sapiens
gaggcaactcagcaggct

SEQ ID NO: 3645354 - DNA, 20 bp, Homo sapiens
gaggcaggtggatcatgagg

SEQ ID NO: 3645355 - DNA, 23 bp, Homo sapiens
gaggctggtaagggaccttcagg

SEQ ID NO: 3645356 - DNA, 13 bp, Homo sapiens
gaggtagggctgg

SEQ ID NO: 3645357 - DNA, 23 bp, Homo sapiens
gaggtagtgccaatgacaggaca

SEQ ID NO: 3645358 - DNA, 23 bp, Homo sapiens
gaggtcaggagttcgaggcgagc

SEQ ID NO: 3645359 - DNA, 20 bp, Homo sapiens
gagtaaaacttgtattggaa

SEQ ID NO: 3645360 - DNA, 20 bp, Homo sapiens
gagtatacaagtgtttctag

SEQ ID NO: 3645361 - DNA, 21 bp, Homo sapiens
gagtcattgccttgggcctgg

SEQ ID NO: 3645362 - DNA, 22 bp, Homo sapiens
gagtcattgccttgggcctggg

SEQ ID NO: 3645363 - DNA, 23 bp, Homo sapiens
gagtgggacaccattctgaattt

SEQ ID NO: 3645364 - DNA, 19 bp, Homo sapiens
gagttcgaggcgagcctgg

SEQ ID NO: 3645365 - DNA, 22 bp, Homo sapiens
gataatgaggcaactcagcagg

SEQ ID NO: 3645366 - DNA, 14 bp, Homo sapiens
gataattaaatgaa

SEQ ID NO: 3645367 - DNA, 23 bp, Homo sapiens
gatagaagaaggactgaagaaaa

SEQ ID NO: 3645368 - DNA, 21 bp, Homo sapiens
gatagatgtcgtggactccag

SEQ ID NO: 3645369 - DNA, 17 bp, Homo sapiens
gatcagcatccaaaagc

SEQ ID NO: 3645370 - DNA, 16 bp, Homo sapiens
gatcattgtgcccact

SEQ ID NO: 3645371 - DNA, 21 bp, Homo sapiens
gatcgtgccattacactccag

SEQ ID NO: 3645372 - DNA, 22 bp, Homo sapiens
gatcgtgccattacactccagc

SEQ ID NO: 3645373 - DNA, 21 bp, Homo sapiens
gatggaaataacgggtggcat

SEQ ID NO: 3645374 - DNA, 14 bp, Homo sapiens
gatggagagggatg

SEQ ID NO: 3645375 - DNA, 17 bp, Homo sapiens
gatggagagggatggaa

SEQ ID NO: 3645376 - DNA, 16 bp, Homo sapiens
gatggaggtagggctg

SEQ ID NO: 3645377 - DNA, 18 bp, Homo sapiens
gatggaggtagggctggc

SEQ ID NO: 3645378 - DNA, 15 bp, Homo sapiens
gatggtgatggagag

SEQ ID NO: 3645379 - DNA, 13 bp, Homo sapiens
gatgtaatacacc

SEQ ID NO: 3645380 - DNA, 16 bp, Homo sapiens
gattaaggactacaga

SEQ ID NO: 3645381 - DNA, 13 bp, Homo sapiens
gattacagaaaca

SEQ ID NO: 3645382 - DNA, 13 bp, Homo sapiens
gattattacaaca

SEQ ID NO: 3645383 - DNA, 22 bp, Homo sapiens
gattgtttgatgaataaaatgt

SEQ ID NO: 3645384 - DNA, 20 bp, Homo sapiens
gcaaccttgtactttacaat

SEQ ID NO: 3645385 - DNA, 17 bp, Homo sapiens
gcaagagcctgagactg

SEQ ID NO: 3645386 - DNA, 18 bp, Homo sapiens
gcaagagcctgagactgg

SEQ ID NO: 3645387 - DNA, 17 bp, Homo sapiens
gcaagctcatagcacat

SEQ ID NO: 3645388 - DNA, 18 bp, Homo sapiens
gcaagctcatagcacatg

SEQ ID NO: 3645389 - DNA, 23 bp, Homo sapiens
gcaagctcatagcacatgtttta

SEQ ID NO: 3645390 - DNA, 16 bp, Homo sapiens
gcaaggaagtaaggga

SEQ ID NO: 3645391 - DNA, 18 bp, Homo sapiens
gcaaggaagtaagggagt

SEQ ID NO: 3645392 - DNA, 11 bp, Homo sapiens
gcaaggatcac

SEQ ID NO: 3645393 - DNA, 17 bp, Homo sapiens
gcaataagttgaatgat

SEQ ID NO: 3645394 - DNA, 21 bp, Homo sapiens
gcaattgcttctctaaaacag

SEQ ID NO: 3645395 - DNA, 22 bp, Homo sapiens
gcacacgcctgtaatctcagct

SEQ ID NO: 3645396 - DNA, 19 bp, Homo sapiens
gcacatttgttaatgattc

SEQ ID NO: 3645397 - DNA, 17 bp, Homo sapiens
gcaccttgattggaaaa

SEQ ID NO: 3645398 - DNA, 17 bp, Homo sapiens
gcactttgggaggctga

SEQ ID NO: 3645399 - DNA, 23 bp, Homo sapiens
gcagaatgagatgatttaattct

SEQ ID NO: 3645400 - DNA, 13 bp, Homo sapiens
gcagacaggaagg

SEQ ID NO: 3645401 - DNA, 14 bp, Homo sapiens
gcagacaggaagga

SEQ ID NO: 3645402 - DNA, 13 bp, Homo sapiens
gcagacaggtggg

SEQ ID NO: 3645403 - DNA, 20 bp, Homo sapiens
gcagacaggtgggagatgga

SEQ ID NO: 3645404 - DNA, 22 bp, Homo sapiens
gcagaggcaggaccagaaggca

SEQ ID NO: 3645405 - DNA, 19 bp, Homo sapiens
gcagagtatacaagtgttt

SEQ ID NO: 3645406 - DNA, 22 bp, Homo sapiens
gcagagtatacaagtgtttcta

SEQ ID NO: 3645407 - DNA, 16 bp, Homo sapiens
gcagcagaggcaggac

SEQ ID NO: 3645408 - DNA, 14 bp, Homo sapiens
gcagcgagtgcatg

SEQ ID NO: 3645409 - DNA, 18 bp, Homo sapiens
gcagctaatttgtgaaag

SEQ ID NO: 3645410 - DNA, 16 bp, Homo sapiens
gcagggaggggcatgg

SEQ ID NO: 3645411 - DNA, 20 bp, Homo sapiens
gcagggctgttccctccagg

SEQ ID NO: 3645412 - DNA, 21 bp, Homo sapiens
gcagggctgttccctccaggc

SEQ ID NO: 3645413 - DNA, 20 bp, Homo sapiens
gcagtccatttttgagtaaa

SEQ ID NO: 3645414 - DNA, 20 bp, Homo sapiens
gcagttatttaccagaagtt

SEQ ID NO: 3645415 - DNA, 20 bp, Homo sapiens
gcagtttggtatgaaacaaa

SEQ ID NO: 3645416 - DNA, 18 bp, Homo sapiens
gcataaacaatattgcta

SEQ ID NO: 3645417 - DNA, 21 bp, Homo sapiens
gcataatattttctttctttt

SEQ ID NO: 3645418 - DNA, 14 bp, Homo sapiens
gcatcctggaaatt

SEQ ID NO: 3645419 - DNA, 16 bp, Homo sapiens
gcatctagctggagcc

SEQ ID NO: 3645420 - DNA, 20 bp, Homo sapiens
gcatgagccactgtgcctgg

SEQ ID NO: 3645421 - DNA, 17 bp, Homo sapiens
gcatgagttctgcacat

SEQ ID NO: 3645422 - DNA, 21 bp, Homo sapiens
gcatgagttctgcacatacag

SEQ ID NO: 3645423 - DNA, 16 bp, Homo sapiens
gcatgcccaaatataa

SEQ ID NO: 3645424 - DNA, 23 bp, Homo sapiens
gcatggaaattcccttcatctgg

SEQ ID NO: 3645425 - DNA, 13 bp, Homo sapiens
gcatgttaaaata

SEQ ID NO: 3645426 - DNA, 16 bp, Homo sapiens
gcatttagcatgagtt

SEQ ID NO: 3645427 - DNA, 17 bp, Homo sapiens
gcatttagcatgagttc

SEQ ID NO: 3645428 - DNA, 16 bp, Homo sapiens
gccacttatttccatg

SEQ ID NO: 3645429 - DNA, 15 bp, Homo sapiens
gccagtcatggtggc

SEQ ID NO: 3645430 - DNA, 16 bp, Homo sapiens
gccatgtatgttgcat

SEQ ID NO: 3645431 - DNA, 17 bp, Homo sapiens
gccattacactccagcc

SEQ ID NO: 3645432 - DNA, 21 bp, Homo sapiens
gccattacactccagcctggg

SEQ ID NO: 3645433 - DNA, 22 bp, Homo sapiens
gccattacactccagcctgggc

SEQ ID NO: 3645434 - DNA, 16 bp, Homo sapiens
gcccactcccatccct

SEQ ID NO: 3645435 - DNA, 21 bp, Homo sapiens
gcccacttaccctgggctgga

SEQ ID NO: 3645436 - DNA, 23 bp, Homo sapiens
gcccattcattccattctggaag

SEQ ID NO: 3645437 - DNA, 19 bp, Homo sapiens
gcccattctctaagcctgg

SEQ ID NO: 3645438 - DNA, 11 bp, Homo sapiens
gccctctcaga

SEQ ID NO: 3645439 - DNA, 22 bp, Homo sapiens
gccctctcagatcaccccagcc

SEQ ID NO: 3645440 - DNA, 20 bp, Homo sapiens
gcctcccttcatgcatggaa

SEQ ID NO: 3645441 - DNA, 22 bp, Homo sapiens
gcctcccttcatgcatggaaat

SEQ ID NO: 3645442 - DNA, 21 bp, Homo sapiens
gcctctcagtatcttaaaatt

SEQ ID NO: 3645443 - DNA, 22 bp, Homo sapiens
gcctgagactggaaaaggtgga

SEQ ID NO: 3645444 - DNA, 20 bp, Homo sapiens
gcctgctgctctctaagaat

SEQ ID NO: 3645445 - DNA, 16 bp, Homo sapiens
gcctgggcgaaagggt

SEQ ID NO: 3645446 - DNA, 23 bp, Homo sapiens
gcctgggcgaaagggtgagactc

SEQ ID NO: 3645447 - DNA, 16 bp, Homo sapiens
gcctgtaatcccagca

SEQ ID NO: 3645448 - DNA, 15 bp, Homo sapiens
gcctgtaatctcagc

SEQ ID NO: 3645449 - DNA, 21 bp, Homo sapiens
gccttattaaaatattttctt

SEQ ID NO: 3645450 - DNA, 14 bp, Homo sapiens
gccttgcccattct

SEQ ID NO: 3645451 - DNA, 23 bp, Homo sapiens
gcggtggctcatgcctgtaatcc

SEQ ID NO: 3645452 - DNA, 16 bp, Homo sapiens
gctacaaaatgtgtgc

SEQ ID NO: 3645453 - DNA, 19 bp, Homo sapiens
gctactcaggaggctgagg

SEQ ID NO: 3645454 - DNA, 20 bp, Homo sapiens
gctactcaggaggctgaggc

SEQ ID NO: 3645455 - DNA, 23 bp, Homo sapiens
gctactcaggaggctgaggcagg

SEQ ID NO: 3645456 - DNA, 18 bp, Homo sapiens
gctataaatagtgaaaat

SEQ ID NO: 3645457 - DNA, 16 bp, Homo sapiens
gctattcgtaagttct

SEQ ID NO: 3645458 - DNA, 19 bp, Homo sapiens
gctcatctacacatataaa

SEQ ID NO: 3645459 - DNA, 14 bp, Homo sapiens
gctcatttcaggat

SEQ ID NO: 3645460 - DNA, 16 bp, Homo sapiens
tcaagtctacctgcct

SEQ ID NO: 3645461 - DNA, 16 bp, Homo sapiens
tcaagtggaaaccttg

SEQ ID NO: 3645462 - DNA, 15 bp, Homo sapiens
tcaataactattgct

SEQ ID NO: 3645463 - DNA, 24 bp, Homo sapiens
tcaattgcttgagcatgcccaaat

SEQ ID NO: 3645464 - DNA, 19 bp, Homo sapiens
tcacaaaaggttcttctgg

SEQ ID NO: 3645465 - DNA, 18 bp, Homo sapiens
tcacacaaagtgaaatta

SEQ ID NO: 3645466 - DNA, 22 bp, Homo sapiens
tcacacaactgtggataaattt

SEQ ID NO: 3645467 - DNA, 17 bp, Homo sapiens
tcacaccactgccattt

SEQ ID NO: 3645468 - DNA, 19 bp, Homo sapiens
tcacagcacatttgttaat

SEQ ID NO: 3645469 - DNA, 16 bp, Homo sapiens
tcactccatttcccac

SEQ ID NO: 3645470 - DNA, 17 bp, Homo sapiens
tcactccatttcccact

SEQ ID NO: 3645471 - DNA, 21 bp, Homo sapiens
tcactgaactttgctgagcct

SEQ ID NO: 3645472 - DNA, 22 bp, Homo sapiens
tcactgcaacctccgcatcccg

SEQ ID NO: 3645473 - DNA, 14 bp, Homo sapiens
tcactgttcatgaa

SEQ ID NO: 3645474 - DNA, 19 bp, Homo sapiens
tcagaaacaccctcacact

SEQ ID NO: 3645475 - DNA, 21 bp, Homo sapiens
tcagaaacaccctcacactgg

SEQ ID NO: 3645476 - DNA, 22 bp, Homo sapiens
tcagaacctttggacaagagga

SEQ ID NO: 3645477 - DNA, 21 bp, Homo sapiens
tcagacccataaaccacctcc

SEQ ID NO: 3645478 - DNA, 19 bp, Homo sapiens
tcagatccttccaaactct

SEQ ID NO: 3645479 - DNA, 15 bp, Homo sapiens
tcagatctgaagtag

SEQ ID NO: 3645480 - DNA, 22 bp, Homo sapiens
tcagcatccaaaagcaggaacc

SEQ ID NO: 3645481 - DNA, 22 bp, Homo sapiens
tcaggaaaggaagatgtaagaa

SEQ ID NO: 3645482 - DNA, 12 bp, Homo sapiens
tcaggaggctga

SEQ ID NO: 3645483 - DNA, 13 bp, Homo sapiens
tcagggagagctg

SEQ ID NO: 3645484 - DNA, 23 bp, Homo sapiens
tcagggagagctgggcagacagg

SEQ ID NO: 3645485 - DNA, 22 bp, Homo sapiens
tcagggtagcagcagaggcagg

SEQ ID NO: 3645486 - DNA, 20 bp, Homo sapiens
tcagtagcattttaatagtt

SEQ ID NO: 3645487 - DNA, 16 bp, Homo sapiens
tcagtatcttaaaatt

SEQ ID NO: 3645488 - DNA, 18 bp, Homo sapiens
tcagtggacatttgttct

SEQ ID NO: 3645489 - DNA, 13 bp, Homo sapiens
tcagtgttataaa

SEQ ID NO: 3645490 - DNA, 20 bp, Homo sapiens
tcatacagtctctatttgat

SEQ ID NO: 3645491 - DNA, 22 bp, Homo sapiens
tcatagataccattttgaaata

SEQ ID NO: 3645492 - DNA, 12 bp, Homo sapiens
tcatagcacatg

SEQ ID NO: 3645493 - DNA, 21 bp, Homo sapiens
tcatagcacatgttttacaaa

SEQ ID NO: 3645494 - DNA, 12 bp, Homo sapiens
tcatatctgtat

SEQ ID NO: 3645495 - DNA, 19 bp, Homo sapiens
tcatcagggtagcagcaga

SEQ ID NO: 3645496 - DNA, 13 bp, Homo sapiens
tcatgatgctagt

SEQ ID NO: 3645497 - DNA, 17 bp, Homo sapiens
tcatgatgctagttctt

SEQ ID NO: 3645498 - DNA, 18 bp, Homo sapiens
tcatgatgctagttctta

SEQ ID NO: 3645499 - DNA, 18 bp, Homo sapiens
tcatgcaagtgagaaaga

SEQ ID NO: 3645500 - DNA, 19 bp, Homo sapiens
tcatgggcagaggatgagg

SEQ ID NO: 3645501 - DNA, 19 bp, Homo sapiens
tcattccattctggaagtg

SEQ ID NO: 3645502 - DNA, 22 bp, Homo sapiens
tcattcgtgggcctgctgctct

SEQ ID NO: 3645503 - DNA, 20 bp, Homo sapiens
tcattctggtccttagtaaa

SEQ ID NO: 3645504 - DNA, 21 bp, Homo sapiens
tcattctggtccttagtaaat

SEQ ID NO: 3645505 - DNA, 15 bp, Homo sapiens
tcattgcactgcagt

SEQ ID NO: 3645506 - DNA, 20 bp, Homo sapiens
tcatttggatataaatctta

SEQ ID NO: 3645507 - DNA, 13 bp, Homo sapiens
tcattttcagatc

SEQ ID NO: 3645508 - DNA, 18 bp, Homo sapiens
tcattttcagatccttcc

SEQ ID NO: 3645509 - DNA, 12 bp, Homo sapiens
tcattttgatgt

SEQ ID NO: 3645510 - DNA, 17 bp, Homo sapiens
tccaatagtctgccaca

SEQ ID NO: 3645511 - DNA, 21 bp, Homo sapiens
tccacagggacacagtctggt

SEQ ID NO: 3645512 - DNA, 19 bp, Homo sapiens
tccagctaagcctgatgat

SEQ ID NO: 3645513 - DNA, 14 bp, Homo sapiens
tccagttctgatga

SEQ ID NO: 3645514 - DNA, 17 bp, Homo sapiens
tccagttctgatgaggc

SEQ ID NO: 3645515 - DNA, 15 bp, Homo sapiens
tccatcccactccac

SEQ ID NO: 3645516 - DNA, 20 bp, Homo sapiens
tccatccttgagtcaaaaaa

SEQ ID NO: 3645517 - DNA, 15 bp, Homo sapiens
tccattccctttctt

SEQ ID NO: 3645518 - DNA, 13 bp, Homo sapiens
tcccactccacta

SEQ ID NO: 3645519 - DNA, 17 bp, Homo sapiens
tcccagagttatttccc

SEQ ID NO: 3645520 - DNA, 18 bp, Homo sapiens
tcccagcactttgggagg

SEQ ID NO: 3645521 - DNA, 18 bp, Homo sapiens
tcccagcctcttccattc

SEQ ID NO: 3645522 - DNA, 19 bp, Homo sapiens
tcccatcccttcaacccca

SEQ ID NO: 3645523 - DNA, 23 bp, Homo sapiens
tcccatggtagactgtgacacag

SEQ ID NO: 3645524 - DNA, 18 bp, Homo sapiens
tccccccgaccagatcct

SEQ ID NO: 3645525 - DNA, 14 bp, Homo sapiens
tccccttcagacct

SEQ ID NO: 3645526 - DNA, 17 bp, Homo sapiens
tccccttcagaccttgc

SEQ ID NO: 3645527 - DNA, 13 bp, Homo sapiens
tccctaaacatag

SEQ ID NO: 3645528 - DNA, 22 bp, Homo sapiens
tccctccaggcaaatgcccttc

SEQ ID NO: 3645529 - DNA, 14 bp, Homo sapiens
tccctggcttcccc

SEQ ID NO: 3645530 - DNA, 18 bp, Homo sapiens
tcccttcatgcatggaaa

SEQ ID NO: 3645531 - DNA, 16 bp, Homo sapiens
tcccttctttccttcc

SEQ ID NO: 3645532 - DNA, 17 bp, Homo sapiens
tcccttctttccttcct

SEQ ID NO: 3645533 - DNA, 18 bp, Homo sapiens
tccctttcttttcatgcc

SEQ ID NO: 3645534 - DNA, 14 bp, Homo sapiens
tcctaattcctgta

SEQ ID NO: 3645535 - DNA, 19 bp, Homo sapiens
tcctaattcctgtatgtta

SEQ ID NO: 3645536 - DNA, 21 bp, Homo sapiens
tcctaattctatgattaaact

SEQ ID NO: 3645537 - DNA, 17 bp, Homo sapiens
tcctattaatttattaa

SEQ ID NO: 3645538 - DNA, 13 bp, Homo sapiens
tccttagtaaatt

SEQ ID NO: 3645539 - DNA, 14 bp, Homo sapiens
tccttagtaaattc

SEQ ID NO: 3645540 - DNA, 14 bp, Homo sapiens
tccttccaaactct

SEQ ID NO: 3645541 - DNA, 15 bp, Homo sapiens
tccttgccttcaaac

SEQ ID NO: 3645542 - DNA, 15 bp, Homo sapiens
tcctttgtcaaatgg

SEQ ID NO: 3645543 - DNA, 16 bp, Homo sapiens
tcctttgtcaaatggt

SEQ ID NO: 3645544 - DNA, 10 bp, Homo sapiens
tcggaccagc

SEQ ID NO: 3645545 - DNA, 15 bp, Homo sapiens
tcgggattacagaaa

SEQ ID NO: 3645546 - DNA, 18 bp, Homo sapiens
tcgggattacagaaacac

SEQ ID NO: 3645547 - DNA, 12 bp, Homo sapiens
tcgtaagttctg

SEQ ID NO: 3645548 - DNA, 13 bp, Homo sapiens
tcgtaagttctgt

SEQ ID NO: 3645549 - DNA, 18 bp, Homo sapiens
tcgtgccattacactcca

SEQ ID NO: 3645550 - DNA, 15 bp, Homo sapiens
tcgtggactccagct

SEQ ID NO: 3645551 - DNA, 15 bp, Homo sapiens
tctaaaccagaagga

SEQ ID NO: 3645552 - DNA, 19 bp, Homo sapiens
tctaaaccagaaggaagcc

SEQ ID NO: 3645553 - DNA, 16 bp, Homo sapiens
tctaaaccatgaaaag

SEQ ID NO: 3645554 - DNA, 23 bp, Homo sapiens
tctaagcctggcttagaaggcac

SEQ ID NO: 3645555 - DNA, 21 bp, Homo sapiens
tctacaaacttttataaatgt

SEQ ID NO: 3645556 - DNA, 22 bp, Homo sapiens
tctacacatataaacacagtaa

SEQ ID NO: 3645557 - DNA, 12 bp, Homo sapiens
tctagctggagc

SEQ ID NO: 3645558 - DNA, 18 bp, Homo sapiens
tctagctggagccccgca

SEQ ID NO: 3645559 - DNA, 15 bp, Homo sapiens
tctagtgcaggaaaa

SEQ ID NO: 3645560 - DNA, 14 bp, Homo sapiens
tctatccctggctt

SEQ ID NO: 3645561 - DNA, 19 bp, Homo sapiens
tctatccctggcttcccct

SEQ ID NO: 3645562 - DNA, 14 bp, Homo sapiens
tctatgattaaact

SEQ ID NO: 3645563 - DNA, 14 bp, Homo sapiens
tctatgctgtgtgc

SEQ ID NO: 3645564 - DNA, 16 bp, Homo sapiens
tctatttgatttgcaa

SEQ ID NO: 3645565 - DNA, 15 bp, Homo sapiens
tctcagatcacccca

SEQ ID NO: 3645566 - DNA, 20 bp, Homo sapiens
tctcagatcaccccagcctc

SEQ ID NO: 3645567 - DNA, 15 bp, Homo sapiens
tctcagtatcttaaa

SEQ ID NO: 3645568 - DNA, 17 bp, Homo sapiens
tctcagtatcttaaaat

SEQ ID NO: 3645569 - DNA, 16 bp, Homo sapiens
tctccacaacctcctc

SEQ ID NO: 3645570 - DNA, 19 bp, Homo sapiens
tctcctttgtcaaatggta

SEQ ID NO: 3645571 - DNA, 19 bp, Homo sapiens
tctctaagcctggcttaga

SEQ ID NO: 3645572 - DNA, 17 bp, Homo sapiens
tctctatttgatttgca

SEQ ID NO: 3645573 - DNA, 15 bp, Homo sapiens
tctctggtctacctg

SEQ ID NO: 3645574 - DNA, 10 bp, Homo sapiens
tctcttccat

SEQ ID NO: 3645575 - DNA, 18 bp, Homo sapiens
tctctttctcattagaga

SEQ ID NO: 3645576 - DNA, 21 bp, Homo sapiens
tctctttctcattagagatct

SEQ ID NO: 3645577 - DNA, 17 bp, Homo sapiens
tctctttcttttgtgca

SEQ ID NO: 3645578 - DNA, 20 bp, Homo sapiens
tctgaagtagtgtgagtgtt

SEQ ID NO: 3645579 - DNA, 20 bp, Homo sapiens
tctgaatttctaaaaccctt

SEQ ID NO: 3645580 - DNA, 21 bp, Homo sapiens
tctgaggaaaatggaagacct

SEQ ID NO: 3645581 - DNA, 23 bp, Homo sapiens
tctgaggaaaatggaagacctaa

SEQ ID NO: 3645582 - DNA, 16 bp, Homo sapiens
tctgatttctgaacta

SEQ ID NO: 3645583 - DNA, 19 bp, Homo sapiens
tctggaagtgactttggct

SEQ ID NO: 3645584 - DNA, 14 bp, Homo sapiens
tctgggttaacagt

SEQ ID NO: 3645585 - DNA, 18 bp, Homo sapiens
tctgggttaacagtaaat

SEQ ID NO: 3645586 - DNA, 17 bp, Homo sapiens
tctggtccttagtaaat

SEQ ID NO: 3645587 - DNA, 18 bp, Homo sapiens
tctgtaattcttctcctt

SEQ ID NO: 3645588 - DNA, 22 bp, Homo sapiens
tctgtgaaagtctcctgtatca

SEQ ID NO: 3645589 - DNA, 21 bp, Homo sapiens
tcttaaaattggttaatgaaa

SEQ ID NO: 3645590 - DNA, 15 bp, Homo sapiens
tcttaactaatgtaa

SEQ ID NO: 3645591 - DNA, 16 bp, Homo sapiens
tcttaactaatgtaaa

SEQ ID NO: 3645592 - DNA, 13 bp, Homo sapiens
aaggacagtgttc

SEQ ID NO: 3645593 - DNA, 17 bp, Homo sapiens
aaggacagtgttcaaat

SEQ ID NO: 3645594 - DNA, 15 bp, Homo sapiens
aaggactacagaatt

SEQ ID NO: 3645595 - DNA, 22 bp, Homo sapiens
aaggctgcagctaatttgtgaa

SEQ ID NO: 3645596 - DNA, 15 bp, Homo sapiens
aagggaagcccagcc

SEQ ID NO: 3645597 - DNA, 18 bp, Homo sapiens
aagggtgagactccatct

SEQ ID NO: 3645598 - DNA, 22 bp, Homo sapiens
aaggtcagtgttataaaatctg

SEQ ID NO: 3645599 - DNA, 14 bp, Homo sapiens
aaggtcggaccagc

SEQ ID NO: 3645600 - DNA, 20 bp, Homo sapiens
aaggtggacttgtctcccag

SEQ ID NO: 3645601 - DNA, 17 bp, Homo sapiens
aaggtttcactgttcat

SEQ ID NO: 3645602 - DNA, 17 bp, Homo sapiens
aagtagtgtgagtgtta

SEQ ID NO: 3645603 - DNA, 21 bp, Homo sapiens
aagtccatgtgataattgtaa

SEQ ID NO: 3645604 - DNA, 22 bp, Homo sapiens
aagtctacctgccttgcctgtt

SEQ ID NO: 3645605 - DNA, 13 bp, Homo sapiens
aagtgaaattagt

SEQ ID NO: 3645606 - DNA, 12 bp, Homo sapiens
aagtgagaaaga

SEQ ID NO: 3645607 - DNA, 11 bp, Homo sapiens
aagtgcatgtt

SEQ ID NO: 3645608 - DNA, 12 bp, Homo sapiens
aagtgcatgtta

SEQ ID NO: 3645609 - DNA, 20 bp, Homo sapiens
aagtgcatgttaaaataatt

SEQ ID NO: 3645610 - DNA, 22 bp, Homo sapiens
aagtgcatgttaaaataattat

SEQ ID NO: 3645611 - DNA, 17 bp, Homo sapiens
aagtggaaggataatga

SEQ ID NO: 3645612 - DNA, 21 bp, Homo sapiens
aagtgttggccatcatttcat

SEQ ID NO: 3645613 - DNA, 22 bp, Homo sapiens
aagtgtttctagtaacagtatt

SEQ ID NO: 3645614 - DNA, 14 bp, Homo sapiens
aagtgtttttacat

SEQ ID NO: 3645615 - DNA, 21 bp, Homo sapiens
aagttctgtgcagtttggtat

SEQ ID NO: 3645616 - DNA, 14 bp, Homo sapiens
aagttgaatgataa

SEQ ID NO: 3645617 - DNA, 19 bp, Homo sapiens
aagttgaatgataatagct

SEQ ID NO: 3645618 - DNA, 19 bp, Homo sapiens
aagttgtgtgctattcgta

SEQ ID NO: 3645619 - DNA, 21 bp, Homo sapiens
aataattaaaacaaaatcctt

SEQ ID NO: 3645620 - DNA, 18 bp, Homo sapiens
aataccccaccagcagaa

SEQ ID NO: 3645621 - DNA, 22 bp, Homo sapiens
aatacttttcaggcactttaga

SEQ ID NO: 3645622 - DNA, 18 bp, Homo sapiens
aatagctataaatagtga

SEQ ID NO: 3645623 - DNA, 19 bp, Homo sapiens
aatagctcacagcacattt

SEQ ID NO: 3645624 - DNA, 22 bp, Homo sapiens
aatagctcacagcacatttgtt

SEQ ID NO: 3645625 - DNA, 20 bp, Homo sapiens
aatagcttttcacttcttaa

SEQ ID NO: 3645626 - DNA, 16 bp, Homo sapiens
aatagtctgccacaag

SEQ ID NO: 3645627 - DNA, 16 bp, Homo sapiens
aatataaatcacagat

SEQ ID NO: 3645628 - DNA, 18 bp, Homo sapiens
aatataaatcacagattt

SEQ ID NO: 3645629 - DNA, 18 bp, Homo sapiens
aatatactcatttggata

SEQ ID NO: 3645630 - DNA, 20 bp, Homo sapiens
aatatactcatttggatata

SEQ ID NO: 3645631 - DNA, 14 bp, Homo sapiens
aatatccttttaga

SEQ ID NO: 3645632 - DNA, 15 bp, Homo sapiens
aatatgagattggaa

SEQ ID NO: 3645633 - DNA, 19 bp, Homo sapiens
aatattttcttaattatgg

SEQ ID NO: 3645634 - DNA, 16 bp, Homo sapiens
aatcaaaaaattatct

SEQ ID NO: 3645635 - DNA, 18 bp, Homo sapiens
aatcaacagaattgttct

SEQ ID NO: 3645636 - DNA, 12 bp, Homo sapiens
aatcattttgat

SEQ ID NO: 3645637 - DNA, 15 bp, Homo sapiens
aatccaatagtctgc

SEQ ID NO: 3645638 - DNA, 19 bp, Homo sapiens
aatccttcagcaatcctta

SEQ ID NO: 3645639 - DNA, 16 bp, Homo sapiens
aatccttgccttcaaa

SEQ ID NO: 3645640 - DNA, 17 bp, Homo sapiens
aatctaagtgggagaca

SEQ ID NO: 3645641 - DNA, 19 bp, Homo sapiens
aatctacaaacttttataa

SEQ ID NO: 3645642 - DNA, 17 bp, Homo sapiens
aatctcaattcttccct

SEQ ID NO: 3645643 - DNA, 19 bp, Homo sapiens
aatcttacccttcaatgtt

SEQ ID NO: 3645644 - DNA, 20 bp, Homo sapiens
aatcttacccttcaatgtta

SEQ ID NO: 3645645 - DNA, 11 bp, Homo sapiens
aatctttatgt

SEQ ID NO: 3645646 - DNA, 15 bp, Homo sapiens
aatctttatgtattt

SEQ ID NO: 3645647 - DNA, 17 bp, Homo sapiens
aatctttgttaaaatat

SEQ ID NO: 3645648 - DNA, 19 bp, Homo sapiens
aatgaaaatggctgaagaa

SEQ ID NO: 3645649 - DNA, 21 bp, Homo sapiens
aatgaggcacatgacagtggt

SEQ ID NO: 3645650 - DNA, 16 bp, Homo sapiens
aatgattcttgtgtca

SEQ ID NO: 3645651 - DNA, 20 bp, Homo sapiens
aatgctacaaaatgtgtgct

SEQ ID NO: 3645652 - DNA, 16 bp, Homo sapiens
aatggcctcttaaaaa

SEQ ID NO: 3645653 - DNA, 17 bp, Homo sapiens
aatggctgaagaaacac

SEQ ID NO: 3645654 - DNA, 17 bp, Homo sapiens
aatggttgcaaagtgtt

SEQ ID NO: 3645655 - DNA, 15 bp, Homo sapiens
aatgtagggcagaat

SEQ ID NO: 3645656 - DNA, 17 bp, Homo sapiens
aatgtatattgatgtaa

SEQ ID NO: 3645657 - DNA, 13 bp, Homo sapiens
aatgttaaatcta

SEQ ID NO: 3645658 - DNA, 23 bp, Homo sapiens
aatgttttaaagaagtccatgtg

SEQ ID NO: 3645659 - DNA, 23 bp, Homo sapiens
aattaaaaagacacttttaccga

SEQ ID NO: 3645660 - DNA, 14 bp, Homo sapiens
aattaaatgaaata

SEQ ID NO: 3645661 - DNA, 12 bp, Homo sapiens
aattaacaaatt

SEQ ID NO: 3645662 - DNA, 19 bp, Homo sapiens
aattaagggttaccccacc

SEQ ID NO: 3645663 - DNA, 20 bp, Homo sapiens
aattagccagtcatggtggc

SEQ ID NO: 3645664 - DNA, 14 bp, Homo sapiens
aattatatgaagca

SEQ ID NO: 3645665 - DNA, 21 bp, Homo sapiens
aattatcatcaatctttatgt

SEQ ID NO: 3645666 - DNA, 13 bp, Homo sapiens
aattatctttaaa

SEQ ID NO: 3645667 - DNA, 14 bp, Homo sapiens
aattattttctgag

SEQ ID NO: 3645668 - DNA, 19 bp, Homo sapiens
aattcagtagcattttaat

SEQ ID NO: 3645669 - DNA, 16 bp, Homo sapiens
aattcagtggacattt

SEQ ID NO: 3645670 - DNA, 21 bp, Homo sapiens
aattcatgatgctagttctta

SEQ ID NO: 3645671 - DNA, 13 bp, Homo sapiens
aattcctaattct

SEQ ID NO: 3645672 - DNA, 17 bp, Homo sapiens
aattctcagaagtgaaa

SEQ ID NO: 3645673 - DNA, 20 bp, Homo sapiens
aattcttaccgaaatgaaaa

SEQ ID NO: 3645674 - DNA, 21 bp, Homo sapiens
aattcttaccgaaatgaaaat

SEQ ID NO: 3645675 - DNA, 21 bp, Homo sapiens
aattcttctcctttgtcaaat

SEQ ID NO: 3645676 - DNA, 21 bp, Homo sapiens
aattgcttctctaaaacagca

SEQ ID NO: 3645677 - DNA, 23 bp, Homo sapiens
aattgcttgaacctgtgaggaag

SEQ ID NO: 3645678 - DNA, 19 bp, Homo sapiens
aattgggcccttagaatgt

SEQ ID NO: 3645679 - DNA, 14 bp, Homo sapiens
aattggttaatgaa

SEQ ID NO: 3645680 - DNA, 23 bp, Homo sapiens
aatttatgtcattttcagatcct

SEQ ID NO: 3645681 - DNA, 20 bp, Homo sapiens
aatttgacattgtcagaatg

SEQ ID NO: 3645682 - DNA, 16 bp, Homo sapiens
aatttgtgaaagtggc

SEQ ID NO: 3645683 - DNA, 15 bp, Homo sapiens
aatttgtgtgcttca

SEQ ID NO: 3645684 - DNA, 13 bp, Homo sapiens
aattttattgctg

SEQ ID NO: 3645685 - DNA, 12 bp, Homo sapiens
aattttcttctt

SEQ ID NO: 3645686 - DNA, 15 bp, Homo sapiens
aattttgctttatca

SEQ ID NO: 3645687 - DNA, 18 bp, Homo sapiens
aattttggaagaattcat

SEQ ID NO: 3645688 - DNA, 22 bp, Homo sapiens
aatttttctgttggtcttaact

SEQ ID NO: 3645689 - DNA, 19 bp, Homo sapiens
aattttttttctgaatttt

SEQ ID NO: 3645690 - DNA, 23 bp, Homo sapiens
acaaaatataaatcacagatttc

SEQ ID NO: 3645691 - DNA, 21 bp, Homo sapiens
acaaaatgtgtgcttggaaaa

SEQ ID NO: 3645692 - DNA, 22 bp, Homo sapiens
acaaaatgtgtgcttggaaaat

SEQ ID NO: 3645693 - DNA, 23 bp, Homo sapiens
acaaaatttatgtcattttcaga

SEQ ID NO: 3645694 - DNA, 11 bp, Homo sapiens
acaaaggaagt

SEQ ID NO: 3645695 - DNA, 18 bp, Homo sapiens
acaaatatactcatttgg

SEQ ID NO: 3645696 - DNA, 19 bp, Homo sapiens
acaaatatactcatttgga

SEQ ID NO: 3645697 - DNA, 14 bp, Homo sapiens
acaaatgaaaacaa

SEQ ID NO: 3645698 - DNA, 20 bp, Homo sapiens
acaacaagcaaactgaaatt

SEQ ID NO: 3645699 - DNA, 15 bp, Homo sapiens
acaagctacatatgt

SEQ ID NO: 3645700 - DNA, 14 bp, Homo sapiens
acaagtgtttctag

SEQ ID NO: 3645701 - DNA, 13 bp, Homo sapiens
acacacctgagaa

SEQ ID NO: 3645702 - DNA, 17 bp, Homo sapiens
acacacctgagaatgtg

SEQ ID NO: 3645703 - DNA, 19 bp, Homo sapiens
acaccaaatagcttttcac

SEQ ID NO: 3645704 - DNA, 22 bp, Homo sapiens
acaccaaatagcttttcacttc

SEQ ID NO: 3645705 - DNA, 12 bp, Homo sapiens
acaccattctga

SEQ ID NO: 3645706 - DNA, 15 bp, Homo sapiens
acacggagtttccat

SEQ ID NO: 3645707 - DNA, 22 bp, Homo sapiens
acactgccaagccaaccctgga

SEQ ID NO: 3645708 - DNA, 18 bp, Homo sapiens
acactgggacttgcaaaa

SEQ ID NO: 3645709 - DNA, 19 bp, Homo sapiens
acactgggacttgcaaaaa

SEQ ID NO: 3645710 - DNA, 15 bp, Homo sapiens
acactttatacttgc

SEQ ID NO: 3645711 - DNA, 17 bp, Homo sapiens
acacttttgctctgcag

SEQ ID NO: 3645712 - DNA, 22 bp, Homo sapiens
acagaattgttctttttcctgt

SEQ ID NO: 3645713 - DNA, 21 bp, Homo sapiens
acagatggtgtcctgcatgta

SEQ ID NO: 3645714 - DNA, 22 bp, Homo sapiens
acagatggtgtcctgcatgtat

SEQ ID NO: 3645715 - DNA, 16 bp, Homo sapiens
acagcacatttgttaa

SEQ ID NO: 3645716 - DNA, 14 bp, Homo sapiens
acagcatgcattta

SEQ ID NO: 3645717 - DNA, 15 bp, Homo sapiens
acagcatgcatttag

SEQ ID NO: 3645718 - DNA, 18 bp, Homo sapiens
acagcatgcatttagcat

SEQ ID NO: 3645719 - DNA, 13 bp, Homo sapiens
acaggaaggaagc

SEQ ID NO: 3645720 - DNA, 22 bp, Homo sapiens
acaggagatagctttctttccc

SEQ ID NO: 3645721 - DNA, 17 bp, Homo sapiens
acagggacacagtctgg

SEQ ID NO: 3645722 - DNA, 16 bp, Homo sapiens
acaggggaggctgaga

SEQ ID NO: 3645723 - DNA, 23 bp, Homo sapiens
acaggtgggagatggaggtaggg

SEQ ID NO: 3645724 - DNA, 17 bp, Homo sapiens
atcaacagaattgttct

SEQ ID NO: 3645725 - DNA, 19 bp, Homo sapiens
atcaattgggttttgatct

SEQ ID NO: 3645726 - DNA, 16 bp, Homo sapiens
atcagaaacaccctca

SEQ ID NO: 3645727 - DNA, 14 bp, Homo sapiens
atcagaagcaagga

SEQ ID NO: 3645728 - DNA, 20 bp, Homo sapiens
atcagcatccaaaagcagga

SEQ ID NO: 3645729 - DNA, 21 bp, Homo sapiens
atcagcatccaaaagcaggaa

SEQ ID NO: 3645730 - DNA, 22 bp, Homo sapiens
atcagcatccaaaagcaggaac

SEQ ID NO: 3645731 - DNA, 22 bp, Homo sapiens
atcaggaaaggaagatgtaaga

SEQ ID NO: 3645732 - DNA, 18 bp, Homo sapiens
atcagggtagcagcagag

SEQ ID NO: 3645733 - DNA, 14 bp, Homo sapiens
atcagggtggagaa

SEQ ID NO: 3645734 - DNA, 17 bp, Homo sapiens
atcatcaatctttatgt

SEQ ID NO: 3645735 - DNA, 20 bp, Homo sapiens
atcatgaggtcaggagttcg

SEQ ID NO: 3645736 - DNA, 22 bp, Homo sapiens
atcatgcctacattagtgagat

SEQ ID NO: 3645737 - DNA, 20 bp, Homo sapiens
atcattggtatctgatatct

SEQ ID NO: 3645738 - DNA, 15 bp, Homo sapiens
atcatttcattcgtg

SEQ ID NO: 3645739 - DNA, 17 bp, Homo sapiens
atcattttgatgtatta

SEQ ID NO: 3645740 - DNA, 21 bp, Homo sapiens
atcattttgatgtattattat

SEQ ID NO: 3645741 - DNA, 23 bp, Homo sapiens
atccaaaagcaggaacccatcta

SEQ ID NO: 3645742 - DNA, 19 bp, Homo sapiens
atccaatagtctgccacaa

SEQ ID NO: 3645743 - DNA, 16 bp, Homo sapiens
atccatcgatttgtat

SEQ ID NO: 3645744 - DNA, 20 bp, Homo sapiens
atccctggcttccccttcag

SEQ ID NO: 3645745 - DNA, 19 bp, Homo sapiens
atcgtgccattacactcca

SEQ ID NO: 3645746 - DNA, 18 bp, Homo sapiens
atctaaaccagaaggaag

SEQ ID NO: 3645747 - DNA, 16 bp, Homo sapiens
atctaaattaacttct

SEQ ID NO: 3645748 - DNA, 18 bp, Homo sapiens
atctacaaacttttataa

SEQ ID NO: 3645749 - DNA, 23 bp, Homo sapiens
atctacaaacttttataaatgtt

SEQ ID NO: 3645750 - DNA, 22 bp, Homo sapiens
atctacacatataaacacagta

SEQ ID NO: 3645751 - DNA, 19 bp, Homo sapiens
atctactagaaccttctaa

SEQ ID NO: 3645752 - DNA, 14 bp, Homo sapiens
atctcaattcttcc

SEQ ID NO: 3645753 - DNA, 20 bp, Homo sapiens
atctcagcatcctggaaatt

SEQ ID NO: 3645754 - DNA, 16 bp, Homo sapiens
atctcaggtggcattt

SEQ ID NO: 3645755 - DNA, 19 bp, Homo sapiens
atctcaggtggcatttgca

SEQ ID NO: 3645756 - DNA, 13 bp, Homo sapiens
atctcgctagcca

SEQ ID NO: 3645757 - DNA, 19 bp, Homo sapiens
atctctttctcattagaga

SEQ ID NO: 3645758 - DNA, 19 bp, Homo sapiens
atctgaagtagtgtgagtg

SEQ ID NO: 3645759 - DNA, 21 bp, Homo sapiens
atctgaagtagtgtgagtgtt

SEQ ID NO: 3645760 - DNA, 13 bp, Homo sapiens
atctgaatttcta

SEQ ID NO: 3645761 - DNA, 13 bp, Homo sapiens
atctgtatgcctc

SEQ ID NO: 3645762 - DNA, 15 bp, Homo sapiens
atctgtttgcttcta

SEQ ID NO: 3645763 - DNA, 17 bp, Homo sapiens
atctgtttgcttctaaa

SEQ ID NO: 3645764 - DNA, 17 bp, Homo sapiens
atctttgttaaaatata

SEQ ID NO: 3645765 - DNA, 21 bp, Homo sapiens
atgaaaaatagtgtgtccatg

SEQ ID NO: 3645766 - DNA, 16 bp, Homo sapiens
atgaaaaatctgaatt

SEQ ID NO: 3645767 - DNA, 12 bp, Homo sapiens
atgaaaagtttt

SEQ ID NO: 3645768 - DNA, 18 bp, Homo sapiens
atgaaaatggctgaagaa

SEQ ID NO: 3645769 - DNA, 22 bp, Homo sapiens
atgaaaatggctgaagaaacac

SEQ ID NO: 3645770 - DNA, 19 bp, Homo sapiens
atgaaagtcaagtctacct

SEQ ID NO: 3645771 - DNA, 17 bp, Homo sapiens
atgaacatggtcagaac

SEQ ID NO: 3645772 - DNA, 14 bp, Homo sapiens
atgaagcagaatga

SEQ ID NO: 3645773 - DNA, 22 bp, Homo sapiens
atgaagcagaatgagatgattt

SEQ ID NO: 3645774 - DNA, 20 bp, Homo sapiens
atgaagccctaagtaaatct

SEQ ID NO: 3645775 - DNA, 15 bp, Homo sapiens
atgaataaaatgttt

SEQ ID NO: 3645776 - DNA, 24 bp, Homo sapiens
atgaatccatcgatttgtattaat

SEQ ID NO: 3645777 - DNA, 13 bp, Homo sapiens
atgaatttaccat

SEQ ID NO: 3645778 - DNA, 20 bp, Homo sapiens
atgaatttaccatcaaacaa

SEQ ID NO: 3645779 - DNA, 23 bp, Homo sapiens
atgagacttcctattaatttatt

SEQ ID NO: 3645780 - DNA, 13 bp, Homo sapiens
atgagatgtaata

SEQ ID NO: 3645781 - DNA, 15 bp, Homo sapiens
atgagatgtaataca

SEQ ID NO: 3645782 - DNA, 18 bp, Homo sapiens
atgagatgtaatacacca

SEQ ID NO: 3645783 - DNA, 18 bp, Homo sapiens
atgaggcaactcagcagg

SEQ ID NO: 3645784 - DNA, 14 bp, Homo sapiens
atgaggtcaggagt

SEQ ID NO: 3645785 - DNA, 20 bp, Homo sapiens
atgataatagctcacagcac

SEQ ID NO: 3645786 - DNA, 20 bp, Homo sapiens
atgatatgtctttaaaatga

SEQ ID NO: 3645787 - DNA, 15 bp, Homo sapiens
atgatgctagttctt

SEQ ID NO: 3645788 - DNA, 22 bp, Homo sapiens
atgatggaagggccttctccac

SEQ ID NO: 3645789 - DNA, 17 bp, Homo sapiens
atgattcacttttattg

SEQ ID NO: 3645790 - DNA, 14 bp, Homo sapiens
atgcaagtgagaaa

SEQ ID NO: 3645791 - DNA, 17 bp, Homo sapiens
atgcatttagcatgagt

SEQ ID NO: 3645792 - DNA, 19 bp, Homo sapiens
atgcatttagcatgagttc

SEQ ID NO: 3645793 - DNA, 13 bp, Homo sapiens
atgcccaaatata

SEQ ID NO: 3645794 - DNA, 22 bp, Homo sapiens
atgcccaaatataacatgaaag

SEQ ID NO: 3645795 - DNA, 15 bp, Homo sapiens
atgcctacattagtg

SEQ ID NO: 3645796 - DNA, 19 bp, Homo sapiens
atgcctacattagtgagat

SEQ ID NO: 3645797 - DNA, 19 bp, Homo sapiens
atgcgagtgctcatttcag

SEQ ID NO: 3645798 - DNA, 16 bp, Homo sapiens
atgctacaaaatgtgt

SEQ ID NO: 3645799 - DNA, 18 bp, Homo sapiens
atgctacaaaatgtgtgc

SEQ ID NO: 3645800 - DNA, 18 bp, Homo sapiens
atgctatctcgctagcca

SEQ ID NO: 3645801 - DNA, 19 bp, Homo sapiens
atgctatctcgctagccat

SEQ ID NO: 3645802 - DNA, 16 bp, Homo sapiens
atgctgtgtgcagagt

SEQ ID NO: 3645803 - DNA, 23 bp, Homo sapiens
atgctgtgtgcagagtatacaag

SEQ ID NO: 3645804 - DNA, 20 bp, Homo sapiens
atggaaattcccttcatctg

SEQ ID NO: 3645805 - DNA, 16 bp, Homo sapiens
atggaagacctaaggc

SEQ ID NO: 3645806 - DNA, 22 bp, Homo sapiens
atggaagacctaaggcagacag

SEQ ID NO: 3645807 - DNA, 23 bp, Homo sapiens
atggaagacctaaggcagacagg

SEQ ID NO: 3645808 - DNA, 12 bp, Homo sapiens
atggaggtaggg

SEQ ID NO: 3645809 - DNA, 17 bp, Homo sapiens
atggaggtagggctggc

SEQ ID NO: 3645810 - DNA, 16 bp, Homo sapiens
atggcaacgttcatgt

SEQ ID NO: 3645811 - DNA, 18 bp, Homo sapiens
atggcatttttttagtaa

SEQ ID NO: 3645812 - DNA, 14 bp, Homo sapiens
atggccacaagttc

SEQ ID NO: 3645813 - DNA, 17 bp, Homo sapiens
atggctgaagaaacaca

SEQ ID NO: 3645814 - DNA, 19 bp, Homo sapiens
atggctgaagaaacacagc

SEQ ID NO: 3645815 - DNA, 21 bp, Homo sapiens
atggctgaagaaacacagcat

SEQ ID NO: 3645816 - DNA, 23 bp, Homo sapiens
atggctgaagaaacacagcatgc

SEQ ID NO: 3645817 - DNA, 17 bp, Homo sapiens
atgggcagaggatgagg

SEQ ID NO: 3645818 - DNA, 16 bp, Homo sapiens
atggtagactgtgaca

SEQ ID NO: 3645819 - DNA, 13 bp, Homo sapiens
atggtatatattt

SEQ ID NO: 3645820 - DNA, 22 bp, Homo sapiens
atggtattttttgtgaatggtt

SEQ ID NO: 3645821 - DNA, 22 bp, Homo sapiens
atgtaaatattgctgtctgaaa

SEQ ID NO: 3645822 - DNA, 19 bp, Homo sapiens
atgtagggcagaatagctg

SEQ ID NO: 3645823 - DNA, 13 bp, Homo sapiens
atgtcattttcag

SEQ ID NO: 3645824 - DNA, 19 bp, Homo sapiens
atgtctgtccctaaacata

SEQ ID NO: 3645825 - DNA, 13 bp, Homo sapiens
atgtctttaaaat

SEQ ID NO: 3645826 - DNA, 16 bp, Homo sapiens
atgtctttaaaatgat

SEQ ID NO: 3645827 - DNA, 22 bp, Homo sapiens
atgtgaaaaaaaaaagtaatta

SEQ ID NO: 3645828 - DNA, 13 bp, Homo sapiens
atgttaaaataat

SEQ ID NO: 3645829 - DNA, 13 bp, Homo sapiens
atgttaaatctac

SEQ ID NO: 3645830 - DNA, 19 bp, Homo sapiens
atgttctgacagcatttca

SEQ ID NO: 3645831 - DNA, 14 bp, Homo sapiens
atgttgcatgaatc

SEQ ID NO: 3645832 - DNA, 17 bp, Homo sapiens
atgttgcatgaatccat

SEQ ID NO: 3645833 - DNA, 19 bp, Homo sapiens
atgttgtgttggtatttac

SEQ ID NO: 3645834 - DNA, 20 bp, Homo sapiens
atgttgtgttggtatttact

SEQ ID NO: 3645835 - DNA, 23 bp, Homo sapiens
atgttttacaaagaaacaaaata

SEQ ID NO: 3645836 - DNA, 15 bp, Homo sapiens
attaaaaagacactt

SEQ ID NO: 3645837 - DNA, 18 bp, Homo sapiens
attaaaatattttcttaa

SEQ ID NO: 3645838 - DNA, 18 bp, Homo sapiens
attaaactgggaaatgag

SEQ ID NO: 3645839 - DNA, 19 bp, Homo sapiens
attaaactgggaaatgaga

SEQ ID NO: 3645840 - DNA, 13 bp, Homo sapiens
attaaatgaaata

SEQ ID NO: 3645841 - DNA, 17 bp, Homo sapiens
attaaatgaaatacttg

SEQ ID NO: 3645842 - DNA, 13 bp, Homo sapiens
attaaatttatta

SEQ ID NO: 3645843 - DNA, 14 bp, Homo sapiens
attaacaaattcag

SEQ ID NO: 3645844 - DNA, 16 bp, Homo sapiens
attaacaaattcagtg

SEQ ID NO: 3645845 - DNA, 19 bp, Homo sapiens
attaatttattaaatttat

SEQ ID NO: 3645846 - DNA, 17 bp, Homo sapiens
attacaacaagcaaact

SEQ ID NO: 3645847 - DNA, 12 bp, Homo sapiens
attacactccag

SEQ ID NO: 3645848 - DNA, 16 bp, Homo sapiens
attacactccagcctg

SEQ ID NO: 3645849 - DNA, 20 bp, Homo sapiens
attagtgttttcattctggt

SEQ ID NO: 3645850 - DNA, 18 bp, Homo sapiens
attatcctcaagttgtgt

SEQ ID NO: 3645851 - DNA, 15 bp, Homo sapiens
attatctttaaaact

SEQ ID NO: 3645852 - DNA, 14 bp, Homo sapiens
attattttctgtaa

SEQ ID NO: 3645853 - DNA, 14 bp, Homo sapiens
attcaacatcaatt

SEQ ID NO: 3645854 - DNA, 22 bp, Homo sapiens
attcaataactattgctgcttt

SEQ ID NO: 3645855 - DNA, 18 bp, Homo sapiens
attcacttttattgtata

SEQ ID NO: 3645856 - DNA, 15 bp, Homo sapiens
ctatatttactgttt

SEQ ID NO: 3645857 - DNA, 16 bp, Homo sapiens
ctatcagggcaagctc

SEQ ID NO: 3645858 - DNA, 22 bp, Homo sapiens
ctatcagggcaagctcatagca

SEQ ID NO: 3645859 - DNA, 14 bp, Homo sapiens
ctatccctggcttc

SEQ ID NO: 3645860 - DNA, 14 bp, Homo sapiens
ctatctttgccacc

SEQ ID NO: 3645861 - DNA, 15 bp, Homo sapiens
ctatctttgccaccc

SEQ ID NO: 3645862 - DNA, 18 bp, Homo sapiens
ctatctttgccaccctca

SEQ ID NO: 3645863 - DNA, 14 bp, Homo sapiens
ctatgctgtgtgca

SEQ ID NO: 3645864 - DNA, 17 bp, Homo sapiens
ctatgctgtgtgcagag

SEQ ID NO: 3645865 - DNA, 13 bp, Homo sapiens
ctattaatttatt

SEQ ID NO: 3645866 - DNA, 19 bp, Homo sapiens
ctattaatttattaaattt

SEQ ID NO: 3645867 - DNA, 15 bp, Homo sapiens
ctattgctgtaaata

SEQ ID NO: 3645868 - DNA, 18 bp, Homo sapiens
ctcaaaccaaatcactga

SEQ ID NO: 3645869 - DNA, 19 bp, Homo sapiens
ctcaaaccaaatcactgaa

SEQ ID NO: 3645870 - DNA, 23 bp, Homo sapiens
ctcaacacacagtatagataaat

SEQ ID NO: 3645871 - DNA, 12 bp, Homo sapiens
ctcaaggctgca

SEQ ID NO: 3645872 - DNA, 19 bp, Homo sapiens
ctcagaagtgaaaaagact

SEQ ID NO: 3645873 - DNA, 22 bp, Homo sapiens
ctcagagggaaggctctctggt

SEQ ID NO: 3645874 - DNA, 20 bp, Homo sapiens
ctcagatcaccccagcctca

SEQ ID NO: 3645875 - DNA, 12 bp, Homo sapiens
ctcagcatccca

SEQ ID NO: 3645876 - DNA, 18 bp, Homo sapiens
ctcagcatcctggaaatt

SEQ ID NO: 3645877 - DNA, 18 bp, Homo sapiens
ctcagcctccagagtagc

SEQ ID NO: 3645878 - DNA, 13 bp, Homo sapiens
ctcaggtggcatt

SEQ ID NO: 3645879 - DNA, 17 bp, Homo sapiens
ctcaggtggcatttgca

SEQ ID NO: 3645880 - DNA, 21 bp, Homo sapiens
ctcatacagtctctatttgat

SEQ ID NO: 3645881 - DNA, 13 bp, Homo sapiens
ctcatagcacatg

SEQ ID NO: 3645882 - DNA, 21 bp, Homo sapiens
ctcatcaggtaaactgatgct

SEQ ID NO: 3645883 - DNA, 19 bp, Homo sapiens
ctccagagtagctgggact

SEQ ID NO: 3645884 - DNA, 18 bp, Homo sapiens
ctccagccacttatttcc

SEQ ID NO: 3645885 - DNA, 11 bp, Homo sapiens
ctccattctgt

SEQ ID NO: 3645886 - DNA, 13 bp, Homo sapiens
ctccattctgtgt

SEQ ID NO: 3645887 - DNA, 15 bp, Homo sapiens
ctccatttcccactt

SEQ ID NO: 3645888 - DNA, 14 bp, Homo sapiens
ctcccatcccttca

SEQ ID NO: 3645889 - DNA, 15 bp, Homo sapiens
ctcccatcccttcaa

SEQ ID NO: 3645890 - DNA, 16 bp, Homo sapiens
ctcccatcccttcaac

SEQ ID NO: 3645891 - DNA, 13 bp, Homo sapiens
ctcccctccaagt

SEQ ID NO: 3645892 - DNA, 16 bp, Homo sapiens
ctccctcccttctttc

SEQ ID NO: 3645893 - DNA, 19 bp, Homo sapiens
ctcccttctttccttcctt

SEQ ID NO: 3645894 - DNA, 20 bp, Homo sapiens
ctcctccagttctgatgagg

SEQ ID NO: 3645895 - DNA, 13 bp, Homo sapiens
ctcctcctccagt

SEQ ID NO: 3645896 - DNA, 12 bp, Homo sapiens
ctctaagcctgg

SEQ ID NO: 3645897 - DNA, 17 bp, Homo sapiens
ctctacgtcccacattt

SEQ ID NO: 3645898 - DNA, 13 bp, Homo sapiens
ctctagtgcagga

SEQ ID NO: 3645899 - DNA, 18 bp, Homo sapiens
ctctatccctggcttccc

SEQ ID NO: 3645900 - DNA, 19 bp, Homo sapiens
ctctatccctggcttcccc

SEQ ID NO: 3645901 - DNA, 21 bp, Homo sapiens
ctctcagatcaccccagcctc

SEQ ID NO: 3645902 - DNA, 19 bp, Homo sapiens
ctctcagtatcttaaaatt

SEQ ID NO: 3645903 - DNA, 17 bp, Homo sapiens
ctctgcaggcagccttg

SEQ ID NO: 3645904 - DNA, 17 bp, Homo sapiens
ctctgctcatctacaca

SEQ ID NO: 3645905 - DNA, 22 bp, Homo sapiens
ctcttaaaaattatctttaaaa

SEQ ID NO: 3645906 - DNA, 13 bp, Homo sapiens
ctcttagtccaca

SEQ ID NO: 3645907 - DNA, 14 bp, Homo sapiens
ctcttagtccacaa

SEQ ID NO: 3645908 - DNA, 17 bp, Homo sapiens
ctcttccattccctttc

SEQ ID NO: 3645909 - DNA, 13 bp, Homo sapiens
ctgaaagggatgg

SEQ ID NO: 3645910 - DNA, 15 bp, Homo sapiens
ctgaaattagtgttt

SEQ ID NO: 3645911 - DNA, 19 bp, Homo sapiens
ctgaaattagtgttttcat

SEQ ID NO: 3645912 - DNA, 20 bp, Homo sapiens
ctgaaattagtgttttcatt

SEQ ID NO: 3645913 - DNA, 18 bp, Homo sapiens
ctgaaccttcctgtctcc

SEQ ID NO: 3645914 - DNA, 12 bp, Homo sapiens
ctgaactttgct

SEQ ID NO: 3645915 - DNA, 14 bp, Homo sapiens
ctgaactttgctga

SEQ ID NO: 3645916 - DNA, 14 bp, Homo sapiens
ctgaagaaacacag

SEQ ID NO: 3645917 - DNA, 19 bp, Homo sapiens
ctgaagaaacacagcatgc

SEQ ID NO: 3645918 - DNA, 21 bp, Homo sapiens
ctgaagggaagcccagcctgc

SEQ ID NO: 3645919 - DNA, 22 bp, Homo sapiens
ctgaatcccgtagccagtctag

SEQ ID NO: 3645920 - DNA, 15 bp, Homo sapiens
ctgaattgaaagaga

SEQ ID NO: 3645921 - DNA, 18 bp, Homo sapiens
ctgaggaaaatggaagac

SEQ ID NO: 3645922 - DNA, 20 bp, Homo sapiens
ctgatacatctgtcagtgag

SEQ ID NO: 3645923 - DNA, 19 bp, Homo sapiens
ctgcaacctccgcatcccg

SEQ ID NO: 3645924 - DNA, 14 bp, Homo sapiens
ctgcagctaatttg

SEQ ID NO: 3645925 - DNA, 17 bp, Homo sapiens
ctgcagctaatttgtga

SEQ ID NO: 3645926 - DNA, 15 bp, Homo sapiens
ctgcaggcagccttg

SEQ ID NO: 3645927 - DNA, 22 bp, Homo sapiens
ctgcagttatttaccagaagtt

SEQ ID NO: 3645928 - DNA, 16 bp, Homo sapiens
ctgcatctagctggag

SEQ ID NO: 3645929 - DNA, 15 bp, Homo sapiens
ctgcccactcccatc

SEQ ID NO: 3645930 - DNA, 23 bp, Homo sapiens
ctgcccactcccatcccttcaac

SEQ ID NO: 3645931 - DNA, 17 bp, Homo sapiens
ctgcctcccttcatgca

SEQ ID NO: 3645932 - DNA, 16 bp, Homo sapiens
ctgccttatattattt

SEQ ID NO: 3645933 - DNA, 21 bp, Homo sapiens
ctgccttatattattttctgt

SEQ ID NO: 3645934 - DNA, 19 bp, Homo sapiens
ctgccttctcccctccaag

SEQ ID NO: 3645935 - DNA, 18 bp, Homo sapiens
ctgcgtaggagagaacag

SEQ ID NO: 3645936 - DNA, 14 bp, Homo sapiens
ctgctgtggcatca

SEQ ID NO: 3645937 - DNA, 17 bp, Homo sapiens
ctgctttctgatacatc

SEQ ID NO: 3645938 - DNA, 21 bp, Homo sapiens
ctgctttctgatacatctgtc

SEQ ID NO: 3645939 - DNA, 18 bp, Homo sapiens
ctggaaaaaaaaaaatat

SEQ ID NO: 3645940 - DNA, 15 bp, Homo sapiens
ctggaaccatcagaa

SEQ ID NO: 3645941 - DNA, 14 bp, Homo sapiens
ctggacatattccc

SEQ ID NO: 3645942 - DNA, 13 bp, Homo sapiens
ctggagccccgca

SEQ ID NO: 3645943 - DNA, 13 bp, Homo sapiens
ctggaggaaggaa

SEQ ID NO: 3645944 - DNA, 17 bp, Homo sapiens
ctggccaacatggtgaa

SEQ ID NO: 3645945 - DNA, 18 bp, Homo sapiens
ctggctggaggaaggaaa

SEQ ID NO: 3645946 - DNA, 19 bp, Homo sapiens
ctggcttagaaggcactgg

SEQ ID NO: 3645947 - DNA, 17 bp, Homo sapiens
ctggcttccccttcaga

SEQ ID NO: 3645948 - DNA, 20 bp, Homo sapiens
ctgggaaatgagatcccaga

SEQ ID NO: 3645949 - DNA, 21 bp, Homo sapiens
ctgggaatctaagtgggagac

SEQ ID NO: 3645950 - DNA, 23 bp, Homo sapiens
ctgggaatgtcctgtagagagag

SEQ ID NO: 3645951 - DNA, 20 bp, Homo sapiens
ctgggattacaggcatgagc

SEQ ID NO: 3645952 - DNA, 16 bp, Homo sapiens
ctgggcagacaggtgg

SEQ ID NO: 3645953 - DNA, 21 bp, Homo sapiens
ctgggcagacaggtgggagat

SEQ ID NO: 3645954 - DNA, 22 bp, Homo sapiens
ctgggcagacaggtgggagatg

SEQ ID NO: 3645955 - DNA, 21 bp, Homo sapiens
ctgggttaacagtaaatatac

SEQ ID NO: 3645956 - DNA, 12 bp, Homo sapiens
ctggtaattatc

SEQ ID NO: 3645957 - DNA, 16 bp, Homo sapiens
ctggtgagtgcaagag

SEQ ID NO: 3645958 - DNA, 18 bp, Homo sapiens
ctggtgagtgcaagagcc

SEQ ID NO: 3645959 - DNA, 19 bp, Homo sapiens
ctggtgagtgcaagagcct

SEQ ID NO: 3645960 - DNA, 17 bp, Homo sapiens
ctgtaatagatcagcat

SEQ ID NO: 3645961 - DNA, 14 bp, Homo sapiens
ctgtaatcccagca

SEQ ID NO: 3645962 - DNA, 18 bp, Homo sapiens
ctgtaattcttctccttt

SEQ ID NO: 3645963 - DNA, 20 bp, Homo sapiens
ctgtaattcttctcctttgt

SEQ ID NO: 3645964 - DNA, 15 bp, Homo sapiens
ctgtatttgaggaaa

SEQ ID NO: 3645965 - DNA, 20 bp, Homo sapiens
ctgtatttgaggaaactcat

SEQ ID NO: 3645966 - DNA, 21 bp, Homo sapiens
ctgtgaaagtctcctgtatca

SEQ ID NO: 3645967 - DNA, 17 bp, Homo sapiens
ctgtgacacagctgagc

SEQ ID NO: 3645968 - DNA, 18 bp, Homo sapiens
ctgtgacacagctgagct

SEQ ID NO: 3645969 - DNA, 20 bp, Homo sapiens
ctgtgaggaagaggttgcag

SEQ ID NO: 3645970 - DNA, 16 bp, Homo sapiens
ctgtgcagtttggtat

SEQ ID NO: 3645971 - DNA, 18 bp, Homo sapiens
ctgtgtgactcaaaccaa

SEQ ID NO: 3645972 - DNA, 16 bp, Homo sapiens
ctgttccctccaggca

SEQ ID NO: 3645973 - DNA, 20 bp, Homo sapiens
ctgttgaagtgcatgttaaa

SEQ ID NO: 3645974 - DNA, 13 bp, Homo sapiens
ctgtttgcttcta

SEQ ID NO: 3645975 - DNA, 16 bp, Homo sapiens
cttaaaattggttaat

SEQ ID NO: 3645976 - DNA, 21 bp, Homo sapiens
cttaaaattggttaatgaaaa

SEQ ID NO: 3645977 - DNA, 17 bp, Homo sapiens
cttaactaatgtaaata

SEQ ID NO: 3645978 - DNA, 23 bp, Homo sapiens
cttaaggacagtgttcaaattct

SEQ ID NO: 3645979 - DNA, 20 bp, Homo sapiens
cttaataacacttcaccttc

SEQ ID NO: 3645980 - DNA, 19 bp, Homo sapiens
cttacacacctgagaatgt

SEQ ID NO: 3645981 - DNA, 16 bp, Homo sapiens
cttacccttcaatgtt

SEQ ID NO: 3645982 - DNA, 14 bp, Homo sapiens
cttagaatgtgaaa

SEQ ID NO: 3645983 - DNA, 14 bp, Homo sapiens
cttagcataatatt

SEQ ID NO: 3645984 - DNA, 12 bp, Homo sapiens
cttagtccacaa

SEQ ID NO: 3645985 - DNA, 15 bp, Homo sapiens
cttattaaaatattt

SEQ ID NO: 3645986 - DNA, 23 bp, Homo sapiens
cttattaaaatattttcttaatt

SEQ ID NO: 3645987 - DNA, 13 bp, Homo sapiens
cttattcctaatt

SEQ ID NO: 3645988 - DNA, 14 bp, Homo sapiens
cttcaatgttaaat

SEQ ID NO: 3645989 - DNA, 21 bp, Homo sapiens
gctcggccaggcacggaggct

SEQ ID NO: 3645990 - DNA, 14 bp, Homo sapiens
gctcgtgcatgtaa

SEQ ID NO: 3645991 - DNA, 16 bp, Homo sapiens
gctctctaagaattca

SEQ ID NO: 3645992 - DNA, 19 bp, Homo sapiens
gctctgcaggcagccttgc

SEQ ID NO: 3645993 - DNA, 23 bp, Homo sapiens
gctgagacgcaaggatcacttga

SEQ ID NO: 3645994 - DNA, 14 bp, Homo sapiens
gctgagctggccta

SEQ ID NO: 3645995 - DNA, 17 bp, Homo sapiens
gctgaggcaggagaatt

SEQ ID NO: 3645996 - DNA, 22 bp, Homo sapiens
gctgcagctaatttgtgaaagt

SEQ ID NO: 3645997 - DNA, 19 bp, Homo sapiens
gctgctctctaagaattca

SEQ ID NO: 3645998 - DNA, 15 bp, Homo sapiens
gctgctgtggcatca

SEQ ID NO: 3645999 - DNA, 14 bp, Homo sapiens
gctggagccccgca

SEQ ID NO: 3646000 - DNA, 20 bp, Homo sapiens
gctggtaagggaccttcagg

SEQ ID NO: 3646001 - DNA, 21 bp, Homo sapiens
gctgtctgaaaaagtgttttt

SEQ ID NO: 3646002 - DNA, 20 bp, Homo sapiens
gctgtgaaatgactgcatca

SEQ ID NO: 3646003 - DNA, 16 bp, Homo sapiens
gctgttctgaaaggga

SEQ ID NO: 3646004 - DNA, 19 bp, Homo sapiens
gctgttctgaaagggatgg

SEQ ID NO: 3646005 - DNA, 16 bp, Homo sapiens
gcttcacacaaagtga

SEQ ID NO: 3646006 - DNA, 13 bp, Homo sapiens
gcttcctgcagga

SEQ ID NO: 3646007 - DNA, 14 bp, Homo sapiens
gcttcctgcaggac

SEQ ID NO: 3646008 - DNA, 14 bp, Homo sapiens
gcttttcacttctt

SEQ ID NO: 3646009 - DNA, 16 bp, Homo sapiens
gcttttcccaaaagcc

SEQ ID NO: 3646010 - DNA, 22 bp, Homo sapiens
ggaaacaacaaaggaagtgagg

SEQ ID NO: 3646011 - DNA, 22 bp, Homo sapiens
ggaaactcatacagtctctatt

SEQ ID NO: 3646012 - DNA, 15 bp, Homo sapiens
ggaaagatggggagc

SEQ ID NO: 3646013 - DNA, 23 bp, Homo sapiens
ggaacccatctaaaccagaagga

SEQ ID NO: 3646014 - DNA, 14 bp, Homo sapiens
ggaagacctaaggc

SEQ ID NO: 3646015 - DNA, 18 bp, Homo sapiens
ggaagagctgctgtattt

SEQ ID NO: 3646016 - DNA, 12 bp, Homo sapiens
ggaagcccagcc

SEQ ID NO: 3646017 - DNA, 15 bp, Homo sapiens
ggaagccctctcaga

SEQ ID NO: 3646018 - DNA, 22 bp, Homo sapiens
ggaaggctctctggtctacctg

SEQ ID NO: 3646019 - DNA, 13 bp, Homo sapiens
ggaagtgaggtag

SEQ ID NO: 3646020 - DNA, 18 bp, Homo sapiens
ggaatctaagtgggagac

SEQ ID NO: 3646021 - DNA, 15 bp, Homo sapiens
ggactacagaagtgg

SEQ ID NO: 3646022 - DNA, 17 bp, Homo sapiens
ggagagctgggcagaca

SEQ ID NO: 3646023 - DNA, 19 bp, Homo sapiens
ggagagctgggcagacagg

SEQ ID NO: 3646024 - DNA, 17 bp, Homo sapiens
ggagccaggatgggtct

SEQ ID NO: 3646025 - DNA, 18 bp, Homo sapiens
ggagctctggaggtgttg

SEQ ID NO: 3646026 - DNA, 14 bp, Homo sapiens
ggaggaaggaaaca

SEQ ID NO: 3646027 - DNA, 16 bp, Homo sapiens
ggaggctgaggcagga

SEQ ID NO: 3646028 - DNA, 17 bp, Homo sapiens
ggaggctgaggcaggag

SEQ ID NO: 3646029 - DNA, 22 bp, Homo sapiens
ggagtcattgccttgggcctgg

SEQ ID NO: 3646030 - DNA, 17 bp, Homo sapiens
ggatcacttgagcccag

SEQ ID NO: 3646031 - DNA, 23 bp, Homo sapiens
ggatggaaataacgggtggcatt

SEQ ID NO: 3646032 - DNA, 19 bp, Homo sapiens
ggattttaaacaaaattta

SEQ ID NO: 3646033 - DNA, 16 bp, Homo sapiens
ggcaaatgcccttcaa

SEQ ID NO: 3646034 - DNA, 14 bp, Homo sapiens
ggcaactgtggaag

SEQ ID NO: 3646035 - DNA, 15 bp, Homo sapiens
ggcaagctcatagca

SEQ ID NO: 3646036 - DNA, 14 bp, Homo sapiens
ggcaccttgattgg

SEQ ID NO: 3646037 - DNA, 20 bp, Homo sapiens
ggcagacaggtgggagatgg

SEQ ID NO: 3646038 - DNA, 16 bp, Homo sapiens
ggcagccttgcccatt

SEQ ID NO: 3646039 - DNA, 14 bp, Homo sapiens
ggcattgggtggca

SEQ ID NO: 3646040 - DNA, 21 bp, Homo sapiens
ggccacaagttctttcccagc

SEQ ID NO: 3646041 - DNA, 13 bp, Homo sapiens
ggccgaggcaggt

SEQ ID NO: 3646042 - DNA, 12 bp, Homo sapiens
ggcgagcctggc

SEQ ID NO: 3646043 - DNA, 22 bp, Homo sapiens
ggctagaatcagggtggagaag

SEQ ID NO: 3646044 - DNA, 11 bp, Homo sapiens
ggctgaagaaa

SEQ ID NO: 3646045 - DNA, 18 bp, Homo sapiens
ggctgaagaaacacagca

SEQ ID NO: 3646046 - DNA, 14 bp, Homo sapiens
ggctgcagtgagcc

SEQ ID NO: 3646047 - DNA, 17 bp, Homo sapiens
ggctggaggaaggaaac

SEQ ID NO: 3646048 - DNA, 15 bp, Homo sapiens
ggctggtaagggacc

SEQ ID NO: 3646049 - DNA, 19 bp, Homo sapiens
gggaatctaagtgggagac

SEQ ID NO: 3646050 - DNA, 21 bp, Homo sapiens
gggaatctaagtgggagacaa

SEQ ID NO: 3646051 - DNA, 20 bp, Homo sapiens
gggacatgtatgcttccagg

SEQ ID NO: 3646052 - DNA, 12 bp, Homo sapiens
gggaccttcagg

SEQ ID NO: 3646053 - DNA, 20 bp, Homo sapiens
gggagagataatgaggcaac

SEQ ID NO: 3646054 - DNA, 12 bp, Homo sapiens
gggagatggagg

SEQ ID NO: 3646055 - DNA, 21 bp, Homo sapiens
gggagatggaggtagggctgg

SEQ ID NO: 3646056 - DNA, 23 bp, Homo sapiens
gggagatggaggtagggctggct

SEQ ID NO: 3646057 - DNA, 16 bp, Homo sapiens
gggaggccgaggcagg

SEQ ID NO: 3646058 - DNA, 14 bp, Homo sapiens
gggcagaatagctg

SEQ ID NO: 3646059 - DNA, 17 bp, Homo sapiens
gggcagtggaagagctg

SEQ ID NO: 3646060 - DNA, 15 bp, Homo sapiens
gggctggctggagga

SEQ ID NO: 3646061 - DNA, 22 bp, Homo sapiens
gggtcctcttagtccacaaggt

SEQ ID NO: 3646062 - DNA, 19 bp, Homo sapiens
gggtggcaacatttgggga

SEQ ID NO: 3646063 - DNA, 20 bp, Homo sapiens
gggtttcatcatgttggcca

SEQ ID NO: 3646064 - DNA, 18 bp, Homo sapiens
ggtacaagctacatatgt

SEQ ID NO: 3646065 - DNA, 16 bp, Homo sapiens
ggtagaaactttggaa

SEQ ID NO: 3646066 - DNA, 12 bp, Homo sapiens
ggtagggctggc

SEQ ID NO: 3646067 - DNA, 18 bp, Homo sapiens
ggtagtgccaatgacagg

SEQ ID NO: 3646068 - DNA, 20 bp, Homo sapiens
ggtagtgccaatgacaggac

SEQ ID NO: 3646069 - DNA, 11 bp, Homo sapiens
ggtatttactg

SEQ ID NO: 3646070 - DNA, 12 bp, Homo sapiens
ggtatttactgc

SEQ ID NO: 3646071 - DNA, 21 bp, Homo sapiens
ggtatttactgcaatgtctgt

SEQ ID NO: 3646072 - DNA, 17 bp, Homo sapiens
ggtccttagtaaattcc

SEQ ID NO: 3646073 - DNA, 15 bp, Homo sapiens
ggtgagactccatct

SEQ ID NO: 3646074 - DNA, 18 bp, Homo sapiens
ggtgagtgcaagagcctg

SEQ ID NO: 3646075 - DNA, 12 bp, Homo sapiens
ggtgatgaattt

SEQ ID NO: 3646076 - DNA, 14 bp, Homo sapiens
ggtgatggagaggg

SEQ ID NO: 3646077 - DNA, 21 bp, Homo sapiens
ggtgcccagactcaaggcctc

SEQ ID NO: 3646078 - DNA, 22 bp, Homo sapiens
ggtggatcatgaggtcaggagt

SEQ ID NO: 3646079 - DNA, 21 bp, Homo sapiens
ggtggcaacatttggggagag

SEQ ID NO: 3646080 - DNA, 14 bp, Homo sapiens
ggtggcagggctgt

SEQ ID NO: 3646081 - DNA, 22 bp, Homo sapiens
ggtggcatttgcaggtgaccag

SEQ ID NO: 3646082 - DNA, 17 bp, Homo sapiens
ggttcaagagattctgc

SEQ ID NO: 3646083 - DNA, 16 bp, Homo sapiens
ggttctatatttactg

SEQ ID NO: 3646084 - DNA, 22 bp, Homo sapiens
gtaaaggtgatgaatttaccat

SEQ ID NO: 3646085 - DNA, 14 bp, Homo sapiens
gtaaataaaaatag

SEQ ID NO: 3646086 - DNA, 13 bp, Homo sapiens
gtaaatatacact

SEQ ID NO: 3646087 - DNA, 15 bp, Homo sapiens
gtaaatgatatgtct

SEQ ID NO: 3646088 - DNA, 15 bp, Homo sapiens
gtaagataggttctg

SEQ ID NO: 3646089 - DNA, 14 bp, Homo sapiens
gtaattcttctcct

SEQ ID NO: 3646090 - DNA, 21 bp, Homo sapiens
gtaattcttctcctttgtcaa

SEQ ID NO: 3646091 - DNA, 13 bp, Homo sapiens
gtactagcaataa

SEQ ID NO: 3646092 - DNA, 10 bp, Homo sapiens
gtagggctgg

SEQ ID NO: 3646093 - DNA, 15 bp, Homo sapiens
gtagggctggctgga

SEQ ID NO: 3646094 - DNA, 13 bp, Homo sapiens
gtataattatgaa

SEQ ID NO: 3646095 - DNA, 17 bp, Homo sapiens
gtatacaagtgtttcta

SEQ ID NO: 3646096 - DNA, 23 bp, Homo sapiens
gtatctgatatctgtttgcttct

SEQ ID NO: 3646097 - DNA, 13 bp, Homo sapiens
gtatcttaaaatt

SEQ ID NO: 3646098 - DNA, 17 bp, Homo sapiens
gtatgaaacaaatatac

SEQ ID NO: 3646099 - DNA, 20 bp, Homo sapiens
gtattttaacatagcagctg

SEQ ID NO: 3646100 - DNA, 10 bp, Homo sapiens
gtattttgag

SEQ ID NO: 3646101 - DNA, 14 bp, Homo sapiens
gtattttttgtgaa

SEQ ID NO: 3646102 - DNA, 16 bp, Homo sapiens
gtattttttgtgaatg

SEQ ID NO: 3646103 - DNA, 21 bp, Homo sapiens
gtcaaatggtattttttgtga

SEQ ID NO: 3646104 - DNA, 22 bp, Homo sapiens
gtcaaatggtattttttgtgaa

SEQ ID NO: 3646105 - DNA, 23 bp, Homo sapiens
gtcaaatggtattttttgtgaat

SEQ ID NO: 3646106 - DNA, 17 bp, Homo sapiens
gtcaagtctacctgcct

SEQ ID NO: 3646107 - DNA, 13 bp, Homo sapiens
gtcaatgaaaagc

SEQ ID NO: 3646108 - DNA, 16 bp, Homo sapiens
gtcaattgcttgagca

SEQ ID NO: 3646109 - DNA, 17 bp, Homo sapiens
gtcaattgcttgagcat

SEQ ID NO: 3646110 - DNA, 20 bp, Homo sapiens
gtcaattgcttgagcatgcc

SEQ ID NO: 3646111 - DNA, 22 bp, Homo sapiens
gtcagaatgttgtgttggtatt

SEQ ID NO: 3646112 - DNA, 20 bp, Homo sapiens
gtcaggccattcagtctatg

SEQ ID NO: 3646113 - DNA, 22 bp, Homo sapiens
gtcagtgagtcagaggcagaac

SEQ ID NO: 3646114 - DNA, 15 bp, Homo sapiens
gtcatcaagtagtag

SEQ ID NO: 3646115 - DNA, 13 bp, Homo sapiens
gtcatgaacatgg

SEQ ID NO: 3646116 - DNA, 23 bp, Homo sapiens
gtcatgaacatggtcagaacctt

SEQ ID NO: 3646117 - DNA, 11 bp, Homo sapiens
gtcattgcctt

SEQ ID NO: 3646118 - DNA, 19 bp, Homo sapiens
gtcatttcattgcactgga

SEQ ID NO: 3646119 - DNA, 16 bp, Homo sapiens
gtcctcagagctccat

SEQ ID NO: 3646120 - DNA, 18 bp, Homo sapiens
gtcctgcatgtatgccat

SEQ ID NO: 3646121 - DNA, 19 bp, Homo sapiens
gtctcccagtcgaggctgg

SEQ ID NO: 3646122 - DNA, 15 bp, Homo sapiens
ttattacaacaagca

SEQ ID NO: 3646123 - DNA, 20 bp, Homo sapiens
ttattacaacaagcaaactg

SEQ ID NO: 3646124 - DNA, 21 bp, Homo sapiens
ttattacaacaagcaaactga

SEQ ID NO: 3646125 - DNA, 21 bp, Homo sapiens
ttattccatgaggaaaataat

SEQ ID NO: 3646126 - DNA, 16 bp, Homo sapiens
ttattcctaattcctg

SEQ ID NO: 3646127 - DNA, 18 bp, Homo sapiens
ttattcctaattcctgta

SEQ ID NO: 3646128 - DNA, 15 bp, Homo sapiens
ttatttataacattg

SEQ ID NO: 3646129 - DNA, 22 bp, Homo sapiens
ttattttgattgtttgatgaat

SEQ ID NO: 3646130 - DNA, 20 bp, Homo sapiens
ttcaaattctgattattaca

SEQ ID NO: 3646131 - DNA, 19 bp, Homo sapiens
ttcaaccacacctaaatta

SEQ ID NO: 3646132 - DNA, 12 bp, Homo sapiens
ttcaagagattc

SEQ ID NO: 3646133 - DNA, 13 bp, Homo sapiens
ttcaatgttaaat

SEQ ID NO: 3646134 - DNA, 19 bp, Homo sapiens
ttcacacaaagtgaaatta

SEQ ID NO: 3646135 - DNA, 13 bp, Homo sapiens
ttcacttcttaag

SEQ ID NO: 3646136 - DNA, 19 bp, Homo sapiens
ttcagatccttccaaactc

SEQ ID NO: 3646137 - DNA, 20 bp, Homo sapiens
ttcatgatgctagttcttac

SEQ ID NO: 3646138 - DNA, 15 bp, Homo sapiens
ttcatgcatggaaat

SEQ ID NO: 3646139 - DNA, 16 bp, Homo sapiens
ttcattccattctgga

SEQ ID NO: 3646140 - DNA, 17 bp, Homo sapiens
ttccaaaagtactagca

SEQ ID NO: 3646141 - DNA, 21 bp, Homo sapiens
ttccaaaagtactagcaataa

SEQ ID NO: 3646142 - DNA, 18 bp, Homo sapiens
ttccccttcagaccttgc

SEQ ID NO: 3646143 - DNA, 16 bp, Homo sapiens
ttccctatctttgcca

SEQ ID NO: 3646144 - DNA, 15 bp, Homo sapiens
ttccctccaggcaaa

SEQ ID NO: 3646145 - DNA, 19 bp, Homo sapiens
ttccctttcttttcatgcc

SEQ ID NO: 3646146 - DNA, 14 bp, Homo sapiens
ttcctaattctatg

SEQ ID NO: 3646147 - DNA, 15 bp, Homo sapiens
ttcctgtctcccagg

SEQ ID NO: 3646148 - DNA, 21 bp, Homo sapiens
ttcctgtctcccagggacatg

SEQ ID NO: 3646149 - DNA, 17 bp, Homo sapiens
ttccttcctttctctct

SEQ ID NO: 3646150 - DNA, 14 bp, Homo sapiens
ttcctttcttcctt

SEQ ID NO: 3646151 - DNA, 16 bp, Homo sapiens
ttcgtaagttctgtgc

SEQ ID NO: 3646152 - DNA, 22 bp, Homo sapiens
ttctaaaacccttggtctgtgt

SEQ ID NO: 3646153 - DNA, 15 bp, Homo sapiens
ttctaaaccatgaaa

SEQ ID NO: 3646154 - DNA, 19 bp, Homo sapiens
ttctaaaccatgaaaagtt

SEQ ID NO: 3646155 - DNA, 14 bp, Homo sapiens
ttctagcaattgct

SEQ ID NO: 3646156 - DNA, 13 bp, Homo sapiens
ttctatatttact

SEQ ID NO: 3646157 - DNA, 15 bp, Homo sapiens
ttctatatttactgt

SEQ ID NO: 3646158 - DNA, 17 bp, Homo sapiens
ttctatatttactgttt

SEQ ID NO: 3646159 - DNA, 15 bp, Homo sapiens
ttctatgattaaact

SEQ ID NO: 3646160 - DNA, 21 bp, Homo sapiens
ttctcagaagtgaaaaagact

SEQ ID NO: 3646161 - DNA, 15 bp, Homo sapiens
ttctcctttgtcaaa

SEQ ID NO: 3646162 - DNA, 12 bp, Homo sapiens
ttctgaaagagc

SEQ ID NO: 3646163 - DNA, 15 bp, Homo sapiens
ttctgagacttggat

SEQ ID NO: 3646164 - DNA, 17 bp, Homo sapiens
ttctgagacttggatta

SEQ ID NO: 3646165 - DNA, 15 bp, Homo sapiens
ttctgattattacaa

SEQ ID NO: 3646166 - DNA, 16 bp, Homo sapiens
ttctgattattacaac

SEQ ID NO: 3646167 - DNA, 18 bp, Homo sapiens
ttctgggttaacagtaaa

SEQ ID NO: 3646168 - DNA, 13 bp, Homo sapiens
ttctggtccttag

SEQ ID NO: 3646169 - DNA, 23 bp, Homo sapiens
ttctgtaatactaagtcctcaga

SEQ ID NO: 3646170 - DNA, 12 bp, Homo sapiens
ttctgtaattct

SEQ ID NO: 3646171 - DNA, 22 bp, Homo sapiens
ttctgttggtcttaactaatgt

SEQ ID NO: 3646172 - DNA, 15 bp, Homo sapiens
ttcttaccgaaatga

SEQ ID NO: 3646173 - DNA, 14 bp, Homo sapiens
ttcttccttccttt

SEQ ID NO: 3646174 - DNA, 18 bp, Homo sapiens
ttcttgctctgctcatct

SEQ ID NO: 3646175 - DNA, 11 bp, Homo sapiens
ttcttttgtgc

SEQ ID NO: 3646176 - DNA, 16 bp, Homo sapiens
ttcttttgtgcatatg

SEQ ID NO: 3646177 - DNA, 14 bp, Homo sapiens
ttgaagtgcatgtt

SEQ ID NO: 3646178 - DNA, 17 bp, Homo sapiens
ttgaagtgcatgttaaa

SEQ ID NO: 3646179 - DNA, 19 bp, Homo sapiens
ttgaagtgcatgttaaaat

SEQ ID NO: 3646180 - DNA, 18 bp, Homo sapiens
ttgacagttacttacaca

SEQ ID NO: 3646181 - DNA, 18 bp, Homo sapiens
ttgacatgagtctccaga

SEQ ID NO: 3646182 - DNA, 22 bp, Homo sapiens
ttgacatgagtctccagataga

SEQ ID NO: 3646183 - DNA, 22 bp, Homo sapiens
ttgacctgcctcccttcatgca

SEQ ID NO: 3646184 - DNA, 22 bp, Homo sapiens
ttgagcagtaaatgtatattga

SEQ ID NO: 3646185 - DNA, 21 bp, Homo sapiens
ttgagccttattaaaatattt

SEQ ID NO: 3646186 - DNA, 22 bp, Homo sapiens
ttgatgaataaaatgtttattt

SEQ ID NO: 3646187 - DNA, 21 bp, Homo sapiens
ttgcaaccttgtactttacaa

SEQ ID NO: 3646188 - DNA, 23 bp, Homo sapiens
ttgcacaatcaataaaaatggca

SEQ ID NO: 3646189 - DNA, 16 bp, Homo sapiens
ttgcaggtgaccagaa

SEQ ID NO: 3646190 - DNA, 20 bp, Homo sapiens
ttgcaggtgaccagaatgag

SEQ ID NO: 3646191 - DNA, 13 bp, Homo sapiens
ttgccaccctcat

SEQ ID NO: 3646192 - DNA, 23 bp, Homo sapiens
ttgctaagataattaaatgaaat

SEQ ID NO: 3646193 - DNA, 21 bp, Homo sapiens
ttgctctgctcatctacacat

SEQ ID NO: 3646194 - DNA, 15 bp, Homo sapiens
ttgctggcatttgct

SEQ ID NO: 3646195 - DNA, 18 bp, Homo sapiens
ttggaagaattcatgatg

SEQ ID NO: 3646196 - DNA, 14 bp, Homo sapiens
ttggaagtatagat

SEQ ID NO: 3646197 - DNA, 14 bp, Homo sapiens
ttggacaagaggaa

SEQ ID NO: 3646198 - DNA, 15 bp, Homo sapiens
ttggattttaaacaa

SEQ ID NO: 3646199 - DNA, 18 bp, Homo sapiens
ttggtctgtgttctcaac

SEQ ID NO: 3646200 - DNA, 17 bp, Homo sapiens
ttgtaaaggtgatgaat

SEQ ID NO: 3646201 - DNA, 18 bp, Homo sapiens
ttgtaagacattagtttg

SEQ ID NO: 3646202 - DNA, 23 bp, Homo sapiens
ttgtcaaatggtattttttgtga

SEQ ID NO: 3646203 - DNA, 15 bp, Homo sapiens
ttgtcagaatgttgt

SEQ ID NO: 3646204 - DNA, 16 bp, Homo sapiens
ttgtcatcaaacataa

SEQ ID NO: 3646205 - DNA, 22 bp, Homo sapiens
ttgtgaatggttgcaaagtgtt

SEQ ID NO: 3646206 - DNA, 15 bp, Homo sapiens
ttgtgttggtattta

SEQ ID NO: 3646207 - DNA, 19 bp, Homo sapiens
ttgtgttggtatttactgc

SEQ ID NO: 3646208 - DNA, 16 bp, Homo sapiens
tttaaacaaaatttat

SEQ ID NO: 3646209 - DNA, 18 bp, Homo sapiens
tttaaacaaaatttatgt

SEQ ID NO: 3646210 - DNA, 19 bp, Homo sapiens
tttaaatctttgttaaaat

SEQ ID NO: 3646211 - DNA, 11 bp, Homo sapiens
tttaacatagc

SEQ ID NO: 3646212 - DNA, 18 bp, Homo sapiens
tttaacatagcagctggt

SEQ ID NO: 3646213 - DNA, 15 bp, Homo sapiens
tttacaaagaaacaa

SEQ ID NO: 3646214 - DNA, 14 bp, Homo sapiens
tttacattcttgct

SEQ ID NO: 3646215 - DNA, 15 bp, Homo sapiens
tttaccatcaaacaa

SEQ ID NO: 3646216 - DNA, 19 bp, Homo sapiens
tttaccatcaaacaaatca

SEQ ID NO: 3646217 - DNA, 16 bp, Homo sapiens
tttataaatgttttaa

SEQ ID NO: 3646218 - DNA, 20 bp, Homo sapiens
tttataacattgtaaatgat

SEQ ID NO: 3646219 - DNA, 20 bp, Homo sapiens
tttatcagaagcaaggaagt

SEQ ID NO: 3646220 - DNA, 20 bp, Homo sapiens
tttatgaaaaaaaaagaaat

SEQ ID NO: 3646221 - DNA, 17 bp, Homo sapiens
tttatgagacttcctat

SEQ ID NO: 3646222 - DNA, 21 bp, Homo sapiens
tttattctgtcaatgaaaagc

SEQ ID NO: 3646223 - DNA, 17 bp, Homo sapiens
tttcacttcttaaggac

SEQ ID NO: 3646224 - DNA, 20 bp, Homo sapiens
tttcatagataccattttga

SEQ ID NO: 3646225 - DNA, 19 bp, Homo sapiens
tttccatttggattttaaa

SEQ ID NO: 3646226 - DNA, 21 bp, Homo sapiens
tttctcattagagatctgaaa

SEQ ID NO: 3646227 - DNA, 19 bp, Homo sapiens
tttctgttggtcttaacta

SEQ ID NO: 3646228 - DNA, 16 bp, Homo sapiens
tttcttaacttctgaa

SEQ ID NO: 3646229 - DNA, 12 bp, Homo sapiens
tttcttccttcc

SEQ ID NO: 3646230 - DNA, 21 bp, Homo sapiens
tttcttctttaatttttctgt

SEQ ID NO: 3646231 - DNA, 23 bp, Homo sapiens
tttcttctttaatttttctgttg

SEQ ID NO: 3646232 - DNA, 17 bp, Homo sapiens
tttgacacaacatctga

SEQ ID NO: 3646233 - DNA, 21 bp, Homo sapiens
tttgcaggtgaccagaatgag

SEQ ID NO: 3646234 - DNA, 18 bp, Homo sapiens
tttgccaccctcatgctg

SEQ ID NO: 3646235 - DNA, 20 bp, Homo sapiens
tttgctctccctcccttctt

SEQ ID NO: 3646236 - DNA, 22 bp, Homo sapiens
tttgctctccctcccttctttc

SEQ ID NO: 3646237 - DNA, 15 bp, Homo sapiens
tttggtatgaaacaa

SEQ ID NO: 3646238 - DNA, 13 bp, Homo sapiens
tttgtgtgcttca

SEQ ID NO: 3646239 - DNA, 23 bp, Homo sapiens
tttgttctgggttaacagtaaat

SEQ ID NO: 3646240 - DNA, 21 bp, Homo sapiens
ttttaaacaaaatttatgtca

SEQ ID NO: 3646241 - DNA, 17 bp, Homo sapiens
ttttacttgattaagga

SEQ ID NO: 3646242 - DNA, 13 bp, Homo sapiens
ttttattgctgga

SEQ ID NO: 3646243 - DNA, 18 bp, Homo sapiens
ttttcacttcttaaggac

SEQ ID NO: 3646244 - DNA, 14 bp, Homo sapiens
ttttcctttcttcc

SEQ ID NO: 3646245 - DNA, 23 bp, Homo sapiens
ttttctgaatttttttttaacat

SEQ ID NO: 3646246 - DNA, 19 bp, Homo sapiens
ttttctgtaattcttctcc

SEQ ID NO: 3646247 - DNA, 23 bp, Homo sapiens
ttttcttctttaatttttctgtt

SEQ ID NO: 3646248 - DNA, 11 bp, Homo sapiens
ttttgctctcc

SEQ ID NO: 3646249 - DNA, 19 bp, Homo sapiens
ttttttagtaaattaagag

SEQ ID NO: 3646250 - DNA, 15 bp, Homo sapiens
aaaaaactggaaaca

SEQ ID NO: 3646251 - DNA, 13 bp, Homo sapiens
aaaaagcatgaga

SEQ ID NO: 3646252 - DNA, 17 bp, Homo sapiens
aaaaagtgtttttacat

SEQ ID NO: 3646253 - DNA, 18 bp, Homo sapiens
aaaaatcaaaaaattatc

SEQ ID NO: 3646254 - DNA, 13 bp, Homo sapiens
aaaaatctgaatt

SEQ ID NO: 3646255 - DNA, 13 bp, Homo sapiens
aaaaatggcattt

SEQ ID NO: 3646256 - DNA, 22 bp, Homo sapiens
aaaaatggcatttttttagtaa

SEQ ID NO: 3646257 - DNA, 16 bp, Homo sapiens
aaaaattatctttaaa

SEQ ID NO: 3646258 - DNA, 13 bp, Homo sapiens
aaaaatttgacat

SEQ ID NO: 3646259 - DNA, 14 bp, Homo sapiens
aaaaatttgacatt

SEQ ID NO: 3646260 - DNA, 21 bp, Homo sapiens
aaaaatttgacattgtcagaa

SEQ ID NO: 3646261 - DNA, 22 bp, Homo sapiens
aaaaatttgacattgtcagaat

SEQ ID NO: 3646262 - DNA, 23 bp, Homo sapiens
aaaacaaaatccttgccttcaaa

SEQ ID NO: 3646263 - DNA, 17 bp, Homo sapiens
aaaaccattctgcttgg

SEQ ID NO: 3646264 - DNA, 17 bp, Homo sapiens
aaaagtaattaaaaaga

SEQ ID NO: 3646265 - DNA, 12 bp, Homo sapiens
aaaagttttcaa

SEQ ID NO: 3646266 - DNA, 22 bp, Homo sapiens
aaaataataaagtggcatttct

SEQ ID NO: 3646267 - DNA, 12 bp, Homo sapiens
aaaatattttct

SEQ ID NO: 3646268 - DNA, 19 bp, Homo sapiens
aaaatattttcttaattat

SEQ ID NO: 3646269 - DNA, 18 bp, Homo sapiens
aaaatccttgccttcaaa

SEQ ID NO: 3646270 - DNA, 14 bp, Homo sapiens
aaaatctgaatttc

SEQ ID NO: 3646271 - DNA, 14 bp, Homo sapiens
aaaatggctgaaga

SEQ ID NO: 3646272 - DNA, 20 bp, Homo sapiens
aaaatggctgaagaaacaca

SEQ ID NO: 3646273 - DNA, 21 bp, Homo sapiens
aaaatggctgaagaaacacag

SEQ ID NO: 3646274 - DNA, 16 bp, Homo sapiens
aaaattatctttaaaa

SEQ ID NO: 3646275 - DNA, 24 bp, Homo sapiens
aaaatttgacattgtcagaatgtt

SEQ ID NO: 3646276 - DNA, 17 bp, Homo sapiens
aaaattttcttctttaa

SEQ ID NO: 3646277 - DNA, 22 bp, Homo sapiens
aaacaaaatccttgccttcaaa

SEQ ID NO: 3646278 - DNA, 20 bp, Homo sapiens
aaacaaaatttatgtcattt

SEQ ID NO: 3646279 - DNA, 13 bp, Homo sapiens
aaacaaatatact

SEQ ID NO: 3646280 - DNA, 16 bp, Homo sapiens
aaacaacaaaggaagt

SEQ ID NO: 3646281 - DNA, 15 bp, Homo sapiens
aaacaccctcacact

SEQ ID NO: 3646282 - DNA, 16 bp, Homo sapiens
aaacacggagtttcca

SEQ ID NO: 3646283 - DNA, 22 bp, Homo sapiens
aaacacggagtttccatttgga

SEQ ID NO: 3646284 - DNA, 14 bp, Homo sapiens
aaacatagtggtat

SEQ ID NO: 3646285 - DNA, 18 bp, Homo sapiens
aaacatagtggtatttta

SEQ ID NO: 3646286 - DNA, 21 bp, Homo sapiens
aaacatagtggtattttaaca

SEQ ID NO: 3646287 - DNA, 21 bp, Homo sapiens
aaacatcagtcaattgcttga

SEQ ID NO: 3646288 - DNA, 18 bp, Homo sapiens
aaactggaaacatctgat

SEQ ID NO: 3646289 - DNA, 13 bp, Homo sapiens
aaactgggaaatg

SEQ ID NO: 3646290 - DNA, 15 bp, Homo sapiens
aaactgggaaatgag

SEQ ID NO: 3646291 - DNA, 14 bp, Homo sapiens
aaactttggaagtt

SEQ ID NO: 3646292 - DNA, 20 bp, Homo sapiens
aaactttggaagttttactt

SEQ ID NO: 3646293 - DNA, 22 bp, Homo sapiens
aaactttggaagttttacttga

SEQ ID NO: 3646294 - DNA, 15 bp, Homo sapiens
aaacttttataaatg

SEQ ID NO: 3646295 - DNA, 21 bp, Homo sapiens
aaacttttataaatgttttaa

SEQ ID NO: 3646296 - DNA, 17 bp, Homo sapiens
aaagcccattcattcca

SEQ ID NO: 3646297 - DNA, 16 bp, Homo sapiens
aaaggatgatttaaca

SEQ ID NO: 3646298 - DNA, 21 bp, Homo sapiens
aaagggtgagactccatctca

SEQ ID NO: 3646299 - DNA, 13 bp, Homo sapiens
aaaggtggacttg

SEQ ID NO: 3646300 - DNA, 19 bp, Homo sapiens
aaaggtttcactgttcatg

SEQ ID NO: 3646301 - DNA, 22 bp, Homo sapiens
aaaggtttcactgttcatgaat

SEQ ID NO: 3646302 - DNA, 17 bp, Homo sapiens
aaagtctcctgtatcat

SEQ ID NO: 3646303 - DNA, 22 bp, Homo sapiens
aaagtgttgtcttattcctaat

SEQ ID NO: 3646304 - DNA, 18 bp, Homo sapiens
aaagtgtttttacatata

SEQ ID NO: 3646305 - DNA, 21 bp, Homo sapiens
aaatagctataaatagtgaaa

SEQ ID NO: 3646306 - DNA, 21 bp, Homo sapiens
aaatagcttttcacttcttaa

SEQ ID NO: 3646307 - DNA, 15 bp, Homo sapiens
aaatataaaaataat

SEQ ID NO: 3646308 - DNA, 15 bp, Homo sapiens
aaatataaatcacag

SEQ ID NO: 3646309 - DNA, 13 bp, Homo sapiens
aaatataacatga

SEQ ID NO: 3646310 - DNA, 14 bp, Homo sapiens
aaatataacatgaa

SEQ ID NO: 3646311 - DNA, 17 bp, Homo sapiens
aaatataacatgaaagt

SEQ ID NO: 3646312 - DNA, 16 bp, Homo sapiens
aaatatacactttaca

SEQ ID NO: 3646313 - DNA, 19 bp, Homo sapiens
aaatcacagatttccaaaa

SEQ ID NO: 3646314 - DNA, 21 bp, Homo sapiens
aaatcacagatttccaaaagt

SEQ ID NO: 3646315 - DNA, 13 bp, Homo sapiens
aaatcattttgat

SEQ ID NO: 3646316 - DNA, 21 bp, Homo sapiens
aaatccaatagtctgccacaa

SEQ ID NO: 3646317 - DNA, 15 bp, Homo sapiens
aaatctaaattaact

SEQ ID NO: 3646318 - DNA, 16 bp, Homo sapiens
aaatctgaatttctaa

SEQ ID NO: 3646319 - DNA, 21 bp, Homo sapiens
aaatcttacccttcaatgtta

SEQ ID NO: 3646320 - DNA, 23 bp, Homo sapiens
aaatcttacccttcaatgttaaa

SEQ ID NO: 3646321 - DNA, 21 bp, Homo sapiens
aaatctttgttaaaatatagt

SEQ ID NO: 3646322 - DNA, 12 bp, Homo sapiens
aaatgaaatact

SEQ ID NO: 3646323 - DNA, 13 bp, Homo sapiens
aaatgaaatactt

SEQ ID NO: 3646324 - DNA, 17 bp, Homo sapiens
aaatgatatgtctttaa

SEQ ID NO: 3646325 - DNA, 19 bp, Homo sapiens
aaatgatatgtctttaaaa

SEQ ID NO: 3646326 - DNA, 14 bp, Homo sapiens
aaatgatttgcttt

SEQ ID NO: 3646327 - DNA, 15 bp, Homo sapiens
aaatggtattttttg

SEQ ID NO: 3646328 - DNA, 17 bp, Homo sapiens
aaatggtattttttgtg

SEQ ID NO: 3646329 - DNA, 19 bp, Homo sapiens
aaatggtattttttgtgaa

SEQ ID NO: 3646330 - DNA, 18 bp, Homo sapiens
aaatgttattcaataact

SEQ ID NO: 3646331 - DNA, 16 bp, Homo sapiens
aaattaacttctattt

SEQ ID NO: 3646332 - DNA, 13 bp, Homo sapiens
aaattaagagcat

SEQ ID NO: 3646333 - DNA, 18 bp, Homo sapiens
aaattaagagcataaaca

SEQ ID NO: 3646334 - DNA, 12 bp, Homo sapiens
aaattagtattt

SEQ ID NO: 3646335 - DNA, 16 bp, Homo sapiens
aaattagtgttttcat

SEQ ID NO: 3646336 - DNA, 22 bp, Homo sapiens
aaattagtgttttcattctggt

SEQ ID NO: 3646337 - DNA, 14 bp, Homo sapiens
aaattatctttaaa

SEQ ID NO: 3646338 - DNA, 16 bp, Homo sapiens
aaattcccttcatctg

SEQ ID NO: 3646339 - DNA, 11 bp, Homo sapiens
aaattcctaat

SEQ ID NO: 3646340 - DNA, 15 bp, Homo sapiens
aaattcctaattcta

SEQ ID NO: 3646341 - DNA, 20 bp, Homo sapiens
aaattggttaatgaaaaatc

SEQ ID NO: 3646342 - DNA, 21 bp, Homo sapiens
aaatttgacattgtcagaatg

SEQ ID NO: 3646343 - DNA, 23 bp, Homo sapiens
aacaaaatataaatcacagattt

SEQ ID NO: 3646344 - DNA, 15 bp, Homo sapiens
aacaaatcattttga

SEQ ID NO: 3646345 - DNA, 17 bp, Homo sapiens
aacaaatcattttgatg

SEQ ID NO: 3646346 - DNA, 20 bp, Homo sapiens
aacacagcatgcatttagca

SEQ ID NO: 3646347 - DNA, 21 bp, Homo sapiens
aacaccctcacactgggactt

SEQ ID NO: 3646348 - DNA, 15 bp, Homo sapiens
aacactgccaaacat

SEQ ID NO: 3646349 - DNA, 15 bp, Homo sapiens
aacagactgccttat

SEQ ID NO: 3646350 - DNA, 19 bp, Homo sapiens
aacagactgccttatatta

SEQ ID NO: 3646351 - DNA, 16 bp, Homo sapiens
aacagcacagtctttt

SEQ ID NO: 3646352 - DNA, 11 bp, Homo sapiens
aacagtaaata

SEQ ID NO: 3646353 - DNA, 13 bp, Homo sapiens
aacatagtggtat

SEQ ID NO: 3646354 - DNA, 19 bp, Homo sapiens
aacatagtggtattttaac

SEQ ID NO: 3646355 - DNA, 20 bp, Homo sapiens
aacatcaattgggttttgat

SEQ ID NO: 3646356 - DNA, 20 bp, Homo sapiens
aacatcagtcaattgcttga

SEQ ID NO: 3646357 - DNA, 16 bp, Homo sapiens
aaccacctcccaaagg

SEQ ID NO: 3646358 - DNA, 17 bp, Homo sapiens
aaccacctcccaaaggc

SEQ ID NO: 3646359 - DNA, 21 bp, Homo sapiens
aacccatctaaaccagaagga

SEQ ID NO: 3646360 - DNA, 19 bp, Homo sapiens
aacctccgcatcccgggtt

SEQ ID NO: 3646361 - DNA, 13 bp, Homo sapiens
aacctgtgaggaa

SEQ ID NO: 3646362 - DNA, 19 bp, Homo sapiens
aaccttcctgtctcccagg

SEQ ID NO: 3646363 - DNA, 16 bp, Homo sapiens
aaccttgtactttaca

SEQ ID NO: 3646364 - DNA, 15 bp, Homo sapiens
aacgttcatgttcat

SEQ ID NO: 3646365 - DNA, 11 bp, Homo sapiens
aactaatgtaa

SEQ ID NO: 3646366 - DNA, 15 bp, Homo sapiens
aactcatacagtctc

SEQ ID NO: 3646367 - DNA, 21 bp, Homo sapiens
aactcatacagtctctatttg

SEQ ID NO: 3646368 - DNA, 18 bp, Homo sapiens
aactcgggattacagaaa

SEQ ID NO: 3646369 - DNA, 22 bp, Homo sapiens
aactcgggattacagaaacacg

SEQ ID NO: 3646370 - DNA, 16 bp, Homo sapiens
aactgatgctttcaga

SEQ ID NO: 3646371 - DNA, 16 bp, Homo sapiens
aactggaaacatctga

SEQ ID NO: 3646372 - DNA, 17 bp, Homo sapiens
aactgtgaacaatcaga

SEQ ID NO: 3646373 - DNA, 19 bp, Homo sapiens
aactgtggataaattttgg

SEQ ID NO: 3646374 - DNA, 17 bp, Homo sapiens
aacttattttgattgtt

SEQ ID NO: 3646375 - DNA, 15 bp, Homo sapiens
aacttctgaaagagc

SEQ ID NO: 3646376 - DNA, 12 bp, Homo sapiens
aacttgctgtga

SEQ ID NO: 3646377 - DNA, 14 bp, Homo sapiens
aacttgctgtgaaa

SEQ ID NO: 3646378 - DNA, 20 bp, Homo sapiens
aagaaacacagcatgcattt

SEQ ID NO: 3646379 - DNA, 24 bp, Homo sapiens
aagaaacacagcatgcatttagca

SEQ ID NO: 3646380 - DNA, 17 bp, Homo sapiens
aagaagtccatgtgata

SEQ ID NO: 3646381 - DNA, 21 bp, Homo sapiens
aagaagtccatgtgataattg

SEQ ID NO: 3646382 - DNA, 20 bp, Homo sapiens
aagaattcagtagcatttta

SEQ ID NO: 3646383 - DNA, 22 bp, Homo sapiens
aagaattcatgatgctagttct

SEQ ID NO: 3646384 - DNA, 23 bp, Homo sapiens
aagaattcatgatgctagttctt

SEQ ID NO: 3646385 - DNA, 19 bp, Homo sapiens
aagacacgtgcaacagact

SEQ ID NO: 3646386 - DNA, 16 bp, Homo sapiens
aagacatctgaggaaa

SEQ ID NO: 3646387 - DNA, 13 bp, Homo sapiens
aagacttcaaatg

SEQ ID NO: 3646388 - DNA, 22 bp, Homo sapiens
aagacttcaaatgttattcaat

SEQ ID NO: 3646389 - DNA, 19 bp, Homo sapiens
aagagcttcatgtgacaca

SEQ ID NO: 3646390 - DNA, 23 bp, Homo sapiens
aagatgggcaatcctgggctggc

SEQ ID NO: 3646391 - DNA, 12 bp, Homo sapiens
aagattcctggt

SEQ ID NO: 3646392 - DNA, 14 bp, Homo sapiens
aagcaaactgaaat

SEQ ID NO: 3646393 - DNA, 15 bp, Homo sapiens
aagcaaactgaaatt

SEQ ID NO: 3646394 - DNA, 18 bp, Homo sapiens
aagcaaactgaaattagt

SEQ ID NO: 3646395 - DNA, 21 bp, Homo sapiens
aagcaaggaagtaagggagtc

SEQ ID NO: 3646396 - DNA, 18 bp, Homo sapiens
aagcacaaaagacaagca

SEQ ID NO: 3646397 - DNA, 11 bp, Homo sapiens
aagcagaatga

SEQ ID NO: 3646398 - DNA, 21 bp, Homo sapiens
aagcccattcattccattctg

SEQ ID NO: 3646399 - DNA, 18 bp, Homo sapiens
aagctcatagcacatgtt

SEQ ID NO: 3646400 - DNA, 18 bp, Homo sapiens
aaggaaacaacaaaggaa

SEQ ID NO: 3646401 - DNA, 20 bp, Homo sapiens
aaggaaacaacaaaggaagt

SEQ ID NO: 3646402 - DNA, 15 bp, Homo sapiens
aaggacagtgttcaa

SEQ ID NO: 3646403 - DNA, 18 bp, Homo sapiens
aaggacagtgttcaaatt

SEQ ID NO: 3646404 - DNA, 14 bp, Homo sapiens
aaggactacagaat

SEQ ID NO: 3646405 - DNA, 16 bp, Homo sapiens
aaggactacagaattg

SEQ ID NO: 3646406 - DNA, 13 bp, Homo sapiens
aaggactgaagaa

SEQ ID NO: 3646407 - DNA, 21 bp, Homo sapiens
aaggcaatcaagagcttccag

SEQ ID NO: 3646408 - DNA, 17 bp, Homo sapiens
aaggcagacaggaagga

SEQ ID NO: 3646409 - DNA, 14 bp, Homo sapiens
aagggaccttcagg

SEQ ID NO: 3646410 - DNA, 17 bp, Homo sapiens
aagggatggccacaagt

SEQ ID NO: 3646411 - DNA, 14 bp, Homo sapiens
aagggccttctcca

SEQ ID NO: 3646412 - DNA, 17 bp, Homo sapiens
aaggtgatgaatttacc

SEQ ID NO: 3646413 - DNA, 21 bp, Homo sapiens
aaggtgatgaatttaccatca

SEQ ID NO: 3646414 - DNA, 16 bp, Homo sapiens
aaggtttcactgttca

SEQ ID NO: 3646415 - DNA, 15 bp, Homo sapiens
aagtaattaaaaaga

SEQ ID NO: 3646416 - DNA, 18 bp, Homo sapiens
aagtcaggccattcagtc

SEQ ID NO: 3646417 - DNA, 13 bp, Homo sapiens
aagtcctcagagc

SEQ ID NO: 3646418 - DNA, 21 bp, Homo sapiens
aagtctacctgccttgcctgt

SEQ ID NO: 3646419 - DNA, 20 bp, Homo sapiens
aagtgaaattagtattttga

SEQ ID NO: 3646420 - DNA, 19 bp, Homo sapiens
aagtgactttggctgcatg

SEQ ID NO: 3646421 - DNA, 14 bp, Homo sapiens
aagtgagaaagaca

SEQ ID NO: 3646422 - DNA, 13 bp, Homo sapiens
aagtgcatgttaa

SEQ ID NO: 3646423 - DNA, 19 bp, Homo sapiens
aagtggcaagctcttcatt

SEQ ID NO: 3646424 - DNA, 20 bp, Homo sapiens
aagtgttggccatcatttca

SEQ ID NO: 3646425 - DNA, 15 bp, Homo sapiens
aagtgttgtcttatt

SEQ ID NO: 3646426 - DNA, 18 bp, Homo sapiens
aagttctttcccagcctc

SEQ ID NO: 3646427 - DNA, 13 bp, Homo sapiens
aagttgaatgata

SEQ ID NO: 3646428 - DNA, 14 bp, Homo sapiens
aagtttaaatcttt

SEQ ID NO: 3646429 - DNA, 22 bp, Homo sapiens
aagtttatctttgcacaatcaa

SEQ ID NO: 3646430 - DNA, 13 bp, Homo sapiens
aataactattgct

SEQ ID NO: 3646431 - DNA, 15 bp, Homo sapiens
aataattatatgaag

SEQ ID NO: 3646432 - DNA, 16 bp, Homo sapiens
aataccccaccagcag

SEQ ID NO: 3646433 - DNA, 21 bp, Homo sapiens
aatagcttttcacttcttaag

SEQ ID NO: 3646434 - DNA, 22 bp, Homo sapiens
aatagtttctaaaccatgaaaa

SEQ ID NO: 3646435 - DNA, 17 bp, Homo sapiens
aatataaaaataattaa

SEQ ID NO: 3646436 - DNA, 17 bp, Homo sapiens
aatataaatcacagatt

SEQ ID NO: 3646437 - DNA, 16 bp, Homo sapiens
aatataacatgaaagt

SEQ ID NO: 3646438 - DNA, 20 bp, Homo sapiens
aatataatggcctcttaaaa

SEQ ID NO: 3646439 - DNA, 15 bp, Homo sapiens
aatatactcatttgg

SEQ ID NO: 3646440 - DNA, 16 bp, Homo sapiens
aatattttcttaatta

SEQ ID NO: 3646441 - DNA, 20 bp, Homo sapiens
aatcaagtctgtgaaagtct

SEQ ID NO: 3646442 - DNA, 14 bp, Homo sapiens
aatcattttgatgt

SEQ ID NO: 3646443 - DNA, 16 bp, Homo sapiens
aatcattttgatgtat

SEQ ID NO: 3646444 - DNA, 15 bp, Homo sapiens
aatccatgtgctgct

SEQ ID NO: 3646445 - DNA, 17 bp, Homo sapiens
aatctacaaacttttat

SEQ ID NO: 3646446 - DNA, 23 bp, Homo sapiens
aatctacaaacttttataaatgt

SEQ ID NO: 3646447 - DNA, 14 bp, Homo sapiens
aatctgaatttcta

SEQ ID NO: 3646448 - DNA, 22 bp, Homo sapiens
aatcttacccttcaatgttaaa

SEQ ID NO: 3646449 - DNA, 18 bp, Homo sapiens
aatctttgttaaaatata

SEQ ID NO: 3646450 - DNA, 17 bp, Homo sapiens
aatgaaaaatctgaatt

SEQ ID NO: 3646451 - DNA, 21 bp, Homo sapiens
aatgagatcccagagttattt

SEQ ID NO: 3646452 - DNA, 16 bp, Homo sapiens
aatgatatgtctttaa

SEQ ID NO: 3646453 - DNA, 17 bp, Homo sapiens
aatgatatgtctttaaa

SEQ ID NO: 3646454 - DNA, 14 bp, Homo sapiens
aatggcctcttaaa

SEQ ID NO: 3646455 - DNA, 15 bp, Homo sapiens
aatggcctcttaaaa

SEQ ID NO: 3646456 - DNA, 13 bp, Homo sapiens
aatggctgaagaa

SEQ ID NO: 3646457 - DNA, 22 bp, Homo sapiens
aatggctgaagaaacacagcat

SEQ ID NO: 3646458 - DNA, 17 bp, Homo sapiens
aatggtattttttgtga

SEQ ID NO: 3646459 - DNA, 22 bp, Homo sapiens
aatgtgaaaaaaaaaagtaatt

SEQ ID NO: 3646460 - DNA, 15 bp, Homo sapiens
aatgttttaaagaag

SEQ ID NO: 3646461 - DNA, 15 bp, Homo sapiens
aattaaatgaaatac

SEQ ID NO: 3646462 - DNA, 16 bp, Homo sapiens
aattaaatgaaatact

SEQ ID NO: 3646463 - DNA, 14 bp, Homo sapiens
aattagtgttttca

SEQ ID NO: 3646464 - DNA, 20 bp, Homo sapiens
aattatcctcaagttgtgtg

SEQ ID NO: 3646465 - DNA, 16 bp, Homo sapiens
aattatctttaaaact

SEQ ID NO: 3646466 - DNA, 22 bp, Homo sapiens
aattattttctgagacttggat

SEQ ID NO: 3646467 - DNA, 17 bp, Homo sapiens
aattcagtagcatttta

SEQ ID NO: 3646468 - DNA, 18 bp, Homo sapiens
aattcagtagcattttaa

SEQ ID NO: 3646469 - DNA, 18 bp, Homo sapiens
aattcagtggacatttgt

SEQ ID NO: 3646470 - DNA, 19 bp, Homo sapiens
aattcatgatgctagttct

SEQ ID NO: 3646471 - DNA, 19 bp, Homo sapiens
aattcatggtatcttgagt

SEQ ID NO: 3646472 - DNA, 16 bp, Homo sapiens
aattcctaattctatg

SEQ ID NO: 3646473 - DNA, 18 bp, Homo sapiens
aattcttaccgaaatgaa

SEQ ID NO: 3646474 - DNA, 22 bp, Homo sapiens
aattcttaccgaaatgaaaatg

SEQ ID NO: 3646475 - DNA, 15 bp, Homo sapiens
aattcttctcctttg

SEQ ID NO: 3646476 - DNA, 23 bp, Homo sapiens
aattcttctcctttgtcaaatgg

SEQ ID NO: 3646477 - DNA, 14 bp, Homo sapiens
aattgcttctctaa

SEQ ID NO: 3646478 - DNA, 22 bp, Homo sapiens
aattgggcccttagaatgtgaa

SEQ ID NO: 3646479 - DNA, 17 bp, Homo sapiens
aatttagcagtccattt

SEQ ID NO: 3646480 - DNA, 18 bp, Homo sapiens
aatttagcagtccatttt

SEQ ID NO: 3646481 - DNA, 21 bp, Homo sapiens
aatttgtgaaagtggcaagct

SEQ ID NO: 3646482 - DNA, 14 bp, Homo sapiens
aattttggaagaat

SEQ ID NO: 3646483 - DNA, 17 bp, Homo sapiens
aattttggaagaattca

SEQ ID NO: 3646484 - DNA, 14 bp, Homo sapiens
acaaaagacaagca

SEQ ID NO: 3646485 - DNA, 15 bp, Homo sapiens
acaaaatataaatca

SEQ ID NO: 3646486 - DNA, 20 bp, Homo sapiens
acaaaatccttgccttcaaa

SEQ ID NO: 3646487 - DNA, 15 bp, Homo sapiens
acaaactcagatctc

SEQ ID NO: 3646488 - DNA, 12 bp, Homo sapiens
acaaacttttat

SEQ ID NO: 3646489 - DNA, 14 bp, Homo sapiens
acaaacttttataa

SEQ ID NO: 3646490 - DNA, 12 bp, Homo sapiens
acaaagaaacaa

SEQ ID NO: 3646491 - DNA, 23 bp, Homo sapiens
acaaagtgaaattagtattttga

SEQ ID NO: 3646492 - DNA, 20 bp, Homo sapiens
acaaatatactcatttggat

SEQ ID NO: 3646493 - DNA, 21 bp, Homo sapiens
acaaatatactcatttggata

SEQ ID NO: 3646494 - DNA, 15 bp, Homo sapiens
acaaatcattttgat

SEQ ID NO: 3646495 - DNA, 18 bp, Homo sapiens
acaaatcattttgatgta

SEQ ID NO: 3646496 - DNA, 14 bp, Homo sapiens
acaacaaaggaagt

SEQ ID NO: 3646497 - DNA, 12 bp, Homo sapiens
acaacatctgag

SEQ ID NO: 3646498 - DNA, 17 bp, Homo sapiens
acaactgtggataaatt

SEQ ID NO: 3646499 - DNA, 22 bp, Homo sapiens
acaactgtggataaattttgga

SEQ ID NO: 3646500 - DNA, 23 bp, Homo sapiens
acaagcttaggtcatgaacatgg

SEQ ID NO: 3646501 - DNA, 22 bp, Homo sapiens
acaaggttgctggcatttgctg

SEQ ID NO: 3646502 - DNA, 11 bp, Homo sapiens
acaagtgtttc

SEQ ID NO: 3646503 - DNA, 14 bp, Homo sapiens
acaagttctttccc

SEQ ID NO: 3646504 - DNA, 21 bp, Homo sapiens
acaagttctttcccagcctct

SEQ ID NO: 3646505 - DNA, 12 bp, Homo sapiens
acaataagtgtt

SEQ ID NO: 3646506 - DNA, 22 bp, Homo sapiens
acaatattgctagaggtggcat

SEQ ID NO: 3646507 - DNA, 15 bp, Homo sapiens
acacaaagtgaaatt

SEQ ID NO: 3646508 - DNA, 14 bp, Homo sapiens
acacagtctggtgc

SEQ ID NO: 3646509 - DNA, 13 bp, Homo sapiens
acacctaaattaa

SEQ ID NO: 3646510 - DNA, 19 bp, Homo sapiens
acacctaaattaacaaatt

SEQ ID NO: 3646511 - DNA, 17 bp, Homo sapiens
acactcaccgagaggaa

SEQ ID NO: 3646512 - DNA, 14 bp, Homo sapiens
acactccagcctgg

SEQ ID NO: 3646513 - DNA, 13 bp, Homo sapiens
acactgggacttg

SEQ ID NO: 3646514 - DNA, 19 bp, Homo sapiens
acacttgtgtgccacagag

SEQ ID NO: 3646515 - DNA, 22 bp, Homo sapiens
acagaagtggaaggataatgag

SEQ ID NO: 3646516 - DNA, 13 bp, Homo sapiens
acagactgcctta

SEQ ID NO: 3646517 - DNA, 14 bp, Homo sapiens
acagactgccttat

SEQ ID NO: 3646518 - DNA, 19 bp, Homo sapiens
acagactgccttatattat

SEQ ID NO: 3646519 - DNA, 13 bp, Homo sapiens
acagatttccaaa

SEQ ID NO: 3646520 - DNA, 13 bp, Homo sapiens
acagcacatttgt

SEQ ID NO: 3646521 - DNA, 18 bp, Homo sapiens
acagcacatttgttaatg

SEQ ID NO: 3646522 - DNA, 19 bp, Homo sapiens
acagcatttcagctgtgag

SEQ ID NO: 3646523 - DNA, 12 bp, Homo sapiens
acaggaaggaag

SEQ ID NO: 3646524 - DNA, 23 bp, Homo sapiens
acaggaaggaagcacaaaagaca

SEQ ID NO: 3646525 - DNA, 14 bp, Homo sapiens
acaggggaggctga

SEQ ID NO: 3646526 - DNA, 13 bp, Homo sapiens
acagtaaatatac

SEQ ID NO: 3646527 - DNA, 19 bp, Homo sapiens
acagtaaatatacacttta

SEQ ID NO: 3646528 - DNA, 18 bp, Homo sapiens
acagtggttatatttcaa

SEQ ID NO: 3646529 - DNA, 15 bp, Homo sapiens
acagttacttacaca

SEQ ID NO: 3646530 - DNA, 14 bp, Homo sapiens
acatagtggtattt

SEQ ID NO: 3646531 - DNA, 20 bp, Homo sapiens
acatagtggtattttaacat

SEQ ID NO: 3646532 - DNA, 19 bp, Homo sapiens
acatcaattgggttttgat

SEQ ID NO: 3646533 - DNA, 13 bp, Homo sapiens
acatctctgtaaa

SEQ ID NO: 3646534 - DNA, 13 bp, Homo sapiens
acatctgtcagtg

SEQ ID NO: 3646535 - DNA, 14 bp, Homo sapiens
acatgttttacaaa

SEQ ID NO: 3646536 - DNA, 16 bp, Homo sapiens
acattagtgagattta

SEQ ID NO: 3646537 - DNA, 13 bp, Homo sapiens
acattccatcctt

SEQ ID NO: 3646538 - DNA, 14 bp, Homo sapiens
acattgtcagaatg

SEQ ID NO: 3646539 - DNA, 13 bp, Homo sapiens
acatttggggaga

SEQ ID NO: 3646540 - DNA, 18 bp, Homo sapiens
acatttgttaatgattct

SEQ ID NO: 3646541 - DNA, 19 bp, Homo sapiens
acatttgttaatgattctt

SEQ ID NO: 3646542 - DNA, 17 bp, Homo sapiens
acatttgttctgggtta

SEQ ID NO: 3646543 - DNA, 12 bp, Homo sapiens
acattttagaat

SEQ ID NO: 3646544 - DNA, 17 bp, Homo sapiens
accaaaaacaatacttt

SEQ ID NO: 3646545 - DNA, 15 bp, Homo sapiens
accacacctaaatta

SEQ ID NO: 3646546 - DNA, 22 bp, Homo sapiens
accacacctaaattaacaaatt

SEQ ID NO: 3646547 - DNA, 22 bp, Homo sapiens
accagaaggaagccctctcaga

SEQ ID NO: 3646548 - DNA, 23 bp, Homo sapiens
accatcaaacaaatcattttgat

SEQ ID NO: 3646549 - DNA, 22 bp, Homo sapiens
accatgcattcagatctgaagt

SEQ ID NO: 3646550 - DNA, 15 bp, Homo sapiens
accattttgaaatat

SEQ ID NO: 3646551 - DNA, 15 bp, Homo sapiens
acccaggattcaaca

SEQ ID NO: 3646552 - DNA, 13 bp, Homo sapiens
accccaccctgcc

SEQ ID NO: 3646553 - DNA, 21 bp, Homo sapiens
accccacttcctactgtaata

SEQ ID NO: 3646554 - DNA, 19 bp, Homo sapiens
acccccgttagcttcctgc

SEQ ID NO: 3646555 - DNA, 15 bp, Homo sapiens
accctcacactggga

SEQ ID NO: 3646556 - DNA, 20 bp, Homo sapiens
accctcatgctgtgtgactc

SEQ ID NO: 3646557 - DNA, 12 bp, Homo sapiens
accctgcccact

SEQ ID NO: 3646558 - DNA, 13 bp, Homo sapiens
accctgcccactc

SEQ ID NO: 3646559 - DNA, 17 bp, Homo sapiens
accctgggctggagagt

SEQ ID NO: 3646560 - DNA, 23 bp, Homo sapiens
accctgtacccttccttcttccc

SEQ ID NO: 3646561 - DNA, 12 bp, Homo sapiens
acccttcaatgt

SEQ ID NO: 3646562 - DNA, 14 bp, Homo sapiens
accgaaatgaaaat

SEQ ID NO: 3646563 - DNA, 14 bp, Homo sapiens
acctaactgtgaac

SEQ ID NO: 3646564 - DNA, 20 bp, Homo sapiens
acctccctgtctctacaaaa

SEQ ID NO: 3646565 - DNA, 14 bp, Homo sapiens
acctccgcatcccg

SEQ ID NO: 3646566 - DNA, 13 bp, Homo sapiens
acctgaattgaaa

SEQ ID NO: 3646567 - DNA, 17 bp, Homo sapiens
acctgagatctatatgg

SEQ ID NO: 3646568 - DNA, 15 bp, Homo sapiens
acctgcatcattccc

SEQ ID NO: 3646569 - DNA, 21 bp, Homo sapiens
acctgcctcccttcatgcatg

SEQ ID NO: 3646570 - DNA, 22 bp, Homo sapiens
acctgcctcccttcatgcatgg

SEQ ID NO: 3646571 - DNA, 23 bp, Homo sapiens
acctgcctcccttcatgcatgga

SEQ ID NO: 3646572 - DNA, 14 bp, Homo sapiens
acctggtaattatc

SEQ ID NO: 3646573 - DNA, 20 bp, Homo sapiens
accttctaatccatgtgctg

SEQ ID NO: 3646574 - DNA, 17 bp, Homo sapiens
accttctgtaatactaa

SEQ ID NO: 3646575 - DNA, 20 bp, Homo sapiens
acctttggacaagaggaaaa

SEQ ID NO: 3646576 - DNA, 16 bp, Homo sapiens
acgcttgacagttact

SEQ ID NO: 3646577 - DNA, 18 bp, Homo sapiens
acggagtttccatttgga

SEQ ID NO: 3646578 - DNA, 21 bp, Homo sapiens
acggagtttccatttggattt

SEQ ID NO: 3646579 - DNA, 19 bp, Homo sapiens
acgtcccacattttagaat

SEQ ID NO: 3646580 - DNA, 15 bp, Homo sapiens
acgtgcaacagactg

SEQ ID NO: 3646581 - DNA, 12 bp, Homo sapiens
acgttcatgttc

SEQ ID NO: 3646582 - DNA, 14 bp, Homo sapiens
actaactgtggaca

SEQ ID NO: 3646583 - DNA, 23 bp, Homo sapiens
actaatgtaaatattgctgtctg

SEQ ID NO: 3646584 - DNA, 14 bp, Homo sapiens
actagcaataagtt

SEQ ID NO: 3646585 - DNA, 22 bp, Homo sapiens
actatggtatatattttgaaag

SEQ ID NO: 3646586 - DNA, 19 bp, Homo sapiens
actcaaaccaaatcactga

SEQ ID NO: 3646587 - DNA, 22 bp, Homo sapiens
actcaggaggctgaggcaggag

SEQ ID NO: 3646588 - DNA, 23 bp, Homo sapiens
actcaggtttccggctactgaca

SEQ ID NO: 3646589 - DNA, 20 bp, Homo sapiens
actccagctctacgtcccac

SEQ ID NO: 3646590 - DNA, 22 bp, Homo sapiens
actctctagtgcaggaaaaggc

SEQ ID NO: 3646591 - DNA, 21 bp, Homo sapiens
actgaaattagtgttttcatt

SEQ ID NO: 3646592 - DNA, 16 bp, Homo sapiens
actgaagaaaatcctt

SEQ ID NO: 3646593 - DNA, 15 bp, Homo sapiens
actgcaatgtctgtc

SEQ ID NO: 3646594 - DNA, 17 bp, Homo sapiens
actgccaagccaaccct

SEQ ID NO: 3646595 - DNA, 11 bp, Homo sapiens
actgcctttga

SEQ ID NO: 3646596 - DNA, 17 bp, Homo sapiens
actggaaacatctgatt

SEQ ID NO: 3646597 - DNA, 21 bp, Homo sapiens
actgtggataaattttggaag

SEQ ID NO: 3646598 - DNA, 17 bp, Homo sapiens
acttacacacctgagaa

SEQ ID NO: 3646599 - DNA, 14 bp, Homo sapiens
acttactatggtat

SEQ ID NO: 3646600 - DNA, 24 bp, Homo sapiens
acttcttaaggacagtgttcaaat

SEQ ID NO: 3646601 - DNA, 22 bp, Homo sapiens
acttgattaaggactacagaat

SEQ ID NO: 3646602 - DNA, 17 bp, Homo sapiens
acttgcaaaaagggtca

SEQ ID NO: 3646603 - DNA, 18 bp, Homo sapiens
acttgctgtgaaatgact

SEQ ID NO: 3646604 - DNA, 15 bp, Homo sapiens
acttggagagagatt

SEQ ID NO: 3646605 - DNA, 14 bp, Homo sapiens
acttgtctcccagt

SEQ ID NO: 3646606 - DNA, 23 bp, Homo sapiens
acttgtctcccagtcgaggctgg

SEQ ID NO: 3646607 - DNA, 17 bp, Homo sapiens
actttacattcttgctc

SEQ ID NO: 3646608 - DNA, 13 bp, Homo sapiens
actttggaagttt

SEQ ID NO: 3646609 - DNA, 20 bp, Homo sapiens
actttgggaggccgaggcag

SEQ ID NO: 3646610 - DNA, 22 bp, Homo sapiens
actttgggaggccgaggcaggt

SEQ ID NO: 3646611 - DNA, 16 bp, Homo sapiens
acttttataaatgttt

SEQ ID NO: 3646612 - DNA, 23 bp, Homo sapiens
acttttataaatgttttaaagaa

SEQ ID NO: 3646613 - DNA, 15 bp, Homo sapiens
acttttattgtataa

SEQ ID NO: 3646614 - DNA, 22 bp, Homo sapiens
acttttattgtataattatgaa

SEQ ID NO: 3646615 - DNA, 19 bp, Homo sapiens
agaaaaaactggaaacatc

SEQ ID NO: 3646616 - DNA, 14 bp, Homo sapiens
agaaacacagcatg

SEQ ID NO: 3646617 - DNA, 16 bp, Homo sapiens
agaaacacagcatgca

SEQ ID NO: 3646618 - DNA, 18 bp, Homo sapiens
agaaacacggagtttcca

SEQ ID NO: 3646619 - DNA, 16 bp, Homo sapiens
agaaactgtttgatta

SEQ ID NO: 3646620 - DNA, 19 bp, Homo sapiens
agaacaaactcagatctca

SEQ ID NO: 3646621 - DNA, 18 bp, Homo sapiens
agaaccaggcatggaaag

SEQ ID NO: 3646622 - DNA, 22 bp, Homo sapiens
agaacctagtcttgttgttcat

SEQ ID NO: 3646623 - DNA, 13 bp, Homo sapiens
agaagcaaggaag

SEQ ID NO: 3646624 - DNA, 14 bp, Homo sapiens
agaagcaaggaagt

SEQ ID NO: 3646625 - DNA, 17 bp, Homo sapiens
agaagcagcgagtgcat

SEQ ID NO: 3646626 - DNA, 12 bp, Homo sapiens
agaaggaagccc

SEQ ID NO: 3646627 - DNA, 20 bp, Homo sapiens
agaaggaagccctctcagat

SEQ ID NO: 3646628 - DNA, 12 bp, Homo sapiens
agaaggcactgg

SEQ ID NO: 3646629 - DNA, 16 bp, Homo sapiens
agaagtccatgtgata

SEQ ID NO: 3646630 - DNA, 16 bp, Homo sapiens
agaagtgaaaaagact

SEQ ID NO: 3646631 - DNA, 18 bp, Homo sapiens
agaatcagggtggagaag

SEQ ID NO: 3646632 - DNA, 17 bp, Homo sapiens
agaatgagatgatttaa

SEQ ID NO: 3646633 - DNA, 18 bp, Homo sapiens
agaatgagatgatttaat

SEQ ID NO: 3646634 - DNA, 21 bp, Homo sapiens
agaatgagatgatttaattct

SEQ ID NO: 3646635 - DNA, 19 bp, Homo sapiens
agaatgaggcacatgacag

SEQ ID NO: 3646636 - DNA, 13 bp, Homo sapiens
agaatgtgaaaaa

SEQ ID NO: 3646637 - DNA, 23 bp, Homo sapiens
agaattcatgatgctagttctta

SEQ ID NO: 3646638 - DNA, 15 bp, Homo sapiens
agacacttttaccga

SEQ ID NO: 3646639 - DNA, 16 bp, Homo sapiens
agacaggaaggaagca

SEQ ID NO: 3646640 - DNA, 14 bp, Homo sapiens
agacatctgaggaa

SEQ ID NO: 3646641 - DNA, 21 bp, Homo sapiens
agaccatgcattcagatctga

SEQ ID NO: 3646642 - DNA, 22 bp, Homo sapiens
agacctaaggcagacaggaagg

SEQ ID NO: 3646643 - DNA, 23 bp, Homo sapiens
agacctaaggcagacaggaagga

SEQ ID NO: 3646644 - DNA, 18 bp, Homo sapiens
agactaacttattttgat

SEQ ID NO: 3646645 - DNA, 12 bp, Homo sapiens
agactccatctc

SEQ ID NO: 3646646 - DNA, 18 bp, Homo sapiens
agactggaaaaggtggac

SEQ ID NO: 3646647 - DNA, 19 bp, Homo sapiens
agacttcctattaatttat

SEQ ID NO: 3646648 - DNA, 20 bp, Homo sapiens
agagaatttggagccaggat

SEQ ID NO: 3646649 - DNA, 22 bp, Homo sapiens
agagataatgaggcaactcagc

SEQ ID NO: 3646650 - DNA, 16 bp, Homo sapiens
agagcctgagactgga

SEQ ID NO: 3646651 - DNA, 18 bp, Homo sapiens
agagctccatgctgttct

SEQ ID NO: 3646652 - DNA, 18 bp, Homo sapiens
agaggcaggaccagaagg

SEQ ID NO: 3646653 - DNA, 17 bp, Homo sapiens
agagtgacttggagaga

SEQ ID NO: 3646654 - DNA, 16 bp, Homo sapiens
agataaatccaatagt

SEQ ID NO: 3646655 - DNA, 22 bp, Homo sapiens
agatagatgtcgtggactccag

SEQ ID NO: 3646656 - DNA, 23 bp, Homo sapiens
agatagatgtcgtggactccagc

SEQ ID NO: 3646657 - DNA, 20 bp, Homo sapiens
agataggtcatgcaagtgag

SEQ ID NO: 3646658 - DNA, 17 bp, Homo sapiens
agataggttctgctttc

SEQ ID NO: 3646659 - DNA, 23 bp, Homo sapiens
agatatgagaaatataaaaataa

SEQ ID NO: 3646660 - DNA, 16 bp, Homo sapiens
agatcaccccagcctc

SEQ ID NO: 3646661 - DNA, 23 bp, Homo sapiens
agatcagcatccaaaagcaggaa

SEQ ID NO: 3646662 - DNA, 22 bp, Homo sapiens
agatccttttccatcccactcc

SEQ ID NO: 3646663 - DNA, 23 bp, Homo sapiens
agatcgtgccattacactccagc

SEQ ID NO: 3646664 - DNA, 13 bp, Homo sapiens
agatctgaagtag

SEQ ID NO: 3646665 - DNA, 21 bp, Homo sapiens
agatctgaagtagtgtgagtg

SEQ ID NO: 3646666 - DNA, 17 bp, Homo sapiens
agatgatttaattctta

SEQ ID NO: 3646667 - DNA, 18 bp, Homo sapiens
agatgatttaattcttac

SEQ ID NO: 3646668 - DNA, 18 bp, Homo sapiens
agatggaggtagggctgg

SEQ ID NO: 3646669 - DNA, 15 bp, Homo sapiens
agatgtaatacacca

SEQ ID NO: 3646670 - DNA, 23 bp, Homo sapiens
agatgtcgtggactccagctcta

SEQ ID NO: 3646671 - DNA, 18 bp, Homo sapiens
agatttctacactttata

SEQ ID NO: 3646672 - DNA, 17 bp, Homo sapiens
agcaaactgaaattagt

SEQ ID NO: 3646673 - DNA, 16 bp, Homo sapiens
agcaataagttgaatg

SEQ ID NO: 3646674 - DNA, 18 bp, Homo sapiens
agcacaaaagacaagcat

SEQ ID NO: 3646675 - DNA, 13 bp, Homo sapiens
agcacatgtttta

SEQ ID NO: 3646676 - DNA, 22 bp, Homo sapiens
agcactttgggaggccgaggca

SEQ ID NO: 3646677 - DNA, 21 bp, Homo sapiens
agcagaggcaggaccagaagg

SEQ ID NO: 3646678 - DNA, 23 bp, Homo sapiens
agcagaggcaggaccagaaggca

SEQ ID NO: 3646679 - DNA, 15 bp, Homo sapiens
agcagcagaggcagg

SEQ ID NO: 3646680 - DNA, 17 bp, Homo sapiens
agcagcagaggcaggac

SEQ ID NO: 3646681 - DNA, 16 bp, Homo sapiens
agcaggaacccatcta

SEQ ID NO: 3646682 - DNA, 16 bp, Homo sapiens
agcagtaaatgtatat

SEQ ID NO: 3646683 - DNA, 21 bp, Homo sapiens
agcagtaaatgtatattgatg

SEQ ID NO: 3646684 - DNA, 11 bp, Homo sapiens
agcatatataa

SEQ ID NO: 3646685 - DNA, 21 bp, Homo sapiens
agcatcctggaaatttgtgtg

SEQ ID NO: 3646686 - DNA, 16 bp, Homo sapiens
agcatgagttctgcac

SEQ ID NO: 3646687 - DNA, 16 bp, Homo sapiens
agcatgcatttagcat

SEQ ID NO: 3646688 - DNA, 18 bp, Homo sapiens
agcatgcatttagcatga

SEQ ID NO: 3646689 - DNA, 19 bp, Homo sapiens
agcatgcatttagcatgag

SEQ ID NO: 3646690 - DNA, 17 bp, Homo sapiens
agcatgcccaaatataa

SEQ ID NO: 3646691 - DNA, 19 bp, Homo sapiens
agcatgcccaaatataaca

SEQ ID NO: 3646692 - DNA, 13 bp, Homo sapiens
agcattgggtcag

SEQ ID NO: 3646693 - DNA, 22 bp, Homo sapiens
agcattttaatagtttctaaac

SEQ ID NO: 3646694 - DNA, 18 bp, Homo sapiens
agccaaccctggaaaagg

SEQ ID NO: 3646695 - DNA, 19 bp, Homo sapiens
agccacttatttccatgga

SEQ ID NO: 3646696 - DNA, 22 bp, Homo sapiens
agcccattcattccattctgga

SEQ ID NO: 3646697 - DNA, 18 bp, Homo sapiens
agccctaagtaaatctaa

SEQ ID NO: 3646698 - DNA, 16 bp, Homo sapiens
agcctcttccattccc

SEQ ID NO: 3646699 - DNA, 18 bp, Homo sapiens
agcctgagactggaaaag

SEQ ID NO: 3646700 - DNA, 17 bp, Homo sapiens
agcctggccaacatggt

SEQ ID NO: 3646701 - DNA, 17 bp, Homo sapiens
agcctggcttagaaggc

SEQ ID NO: 3646702 - DNA, 13 bp, Homo sapiens
agccttattaaaa

SEQ ID NO: 3646703 - DNA, 21 bp, Homo sapiens
agccttattaaaatattttct

SEQ ID NO: 3646704 - DNA, 15 bp, Homo sapiens
agctaagcctgatga

SEQ ID NO: 3646705 - DNA, 18 bp, Homo sapiens
agctacaggggaggctga

SEQ ID NO: 3646706 - DNA, 17 bp, Homo sapiens
agctacatatgtaggaa

SEQ ID NO: 3646707 - DNA, 22 bp, Homo sapiens
agctactcaggaggctgaggca

SEQ ID NO: 3646708 - DNA, 15 bp, Homo sapiens
agctcacagcacatt

SEQ ID NO: 3646709 - DNA, 22 bp, Homo sapiens
agctcacagcacatttgttaat

SEQ ID NO: 3646710 - DNA, 23 bp, Homo sapiens
agctcactgcaacctccgcatcc

SEQ ID NO: 3646711 - DNA, 20 bp, Homo sapiens
agctcttcattgcactgcag

SEQ ID NO: 3646712 - DNA, 21 bp, Homo sapiens
agctgatagaagaaggactga

SEQ ID NO: 3646713 - DNA, 14 bp, Homo sapiens
agctgctgtatttg

SEQ ID NO: 3646714 - DNA, 15 bp, Homo sapiens
agctggagccccgca

SEQ ID NO: 3646715 - DNA, 14 bp, Homo sapiens
agctgggcagacag

SEQ ID NO: 3646716 - DNA, 18 bp, Homo sapiens
agcttttcacttcttaag

SEQ ID NO: 3646717 - DNA, 16 bp, Homo sapiens
aggaaaaggctgcagc

SEQ ID NO: 3646718 - DNA, 19 bp, Homo sapiens
aggaaacaacaaaggaagt

SEQ ID NO: 3646719 - DNA, 21 bp, Homo sapiens
aggaaacaacaaaggaagtga

SEQ ID NO: 3646720 - DNA, 12 bp, Homo sapiens
aggaaggaagca

SEQ ID NO: 3646721 - DNA, 12 bp, Homo sapiens
aggaccagaagg

SEQ ID NO: 3646722 - DNA, 22 bp, Homo sapiens
aggaccagaaggcaatcaagag

SEQ ID NO: 3646723 - DNA, 16 bp, Homo sapiens
aggactacagaattgg

SEQ ID NO: 3646724 - DNA, 13 bp, Homo sapiens
aggactgaagaaa

SEQ ID NO: 3646725 - DNA, 20 bp, Homo sapiens
aggagaattgcttgaacctg

SEQ ID NO: 3646726 - DNA, 21 bp, Homo sapiens
aggagatagctttctttccct

SEQ ID NO: 3646727 - DNA, 17 bp, Homo sapiens
aggaggctgaggcagga

SEQ ID NO: 3646728 - DNA, 21 bp, Homo sapiens
aggagttcgaggcgagcctgg

SEQ ID NO: 3646729 - DNA, 22 bp, Homo sapiens
aggatgtggatggaggtgatga

SEQ ID NO: 3646730 - DNA, 19 bp, Homo sapiens
aggattaggtttagaatca

SEQ ID NO: 3646731 - DNA, 13 bp, Homo sapiens
aggcaactcagca

SEQ ID NO: 3646732 - DNA, 22 bp, Homo sapiens
aggcaatcaagagcttccagaa

SEQ ID NO: 3646733 - DNA, 19 bp, Homo sapiens
aggcacactgagcaagttt

SEQ ID NO: 3646734 - DNA, 13 bp, Homo sapiens
aggcactttagaa

SEQ ID NO: 3646735 - DNA, 17 bp, Homo sapiens
aggcagacaggaaggaa

SEQ ID NO: 3646736 - DNA, 18 bp, Homo sapiens
aggcagacaggaaggaag

SEQ ID NO: 3646737 - DNA, 20 bp, Homo sapiens
aggcagacaggaaggaagca

SEQ ID NO: 3646738 - DNA, 18 bp, Homo sapiens
aggcatggaaagatgggg

SEQ ID NO: 3646739 - DNA, 21 bp, Homo sapiens
aggcatggaaagatggggagc

SEQ ID NO: 3646740 - DNA, 23 bp, Homo sapiens
aggccattcagtctatgctgtgt

SEQ ID NO: 3646741 - DNA, 16 bp, Homo sapiens
aggccgaggcaggtgg

SEQ ID NO: 3646742 - DNA, 15 bp, Homo sapiens
aggctgaggcaggag

SEQ ID NO: 3646743 - DNA, 17 bp, Homo sapiens
aggctgcagtgagccaa

SEQ ID NO: 3646744 - DNA, 21 bp, Homo sapiens
aggctggtaagggaccttcag

SEQ ID NO: 3646745 - DNA, 18 bp, Homo sapiens
agggaccttcagggagag

SEQ ID NO: 3646746 - DNA, 15 bp, Homo sapiens
agggagagctgggca

SEQ ID NO: 3646747 - DNA, 17 bp, Homo sapiens
agggagagctgggcaga

SEQ ID NO: 3646748 - DNA, 19 bp, Homo sapiens
agggagagctgggcagaca

SEQ ID NO: 3646749 - DNA, 20 bp, Homo sapiens
agggagagctgggcagacag

SEQ ID NO: 3646750 - DNA, 15 bp, Homo sapiens
agggatggccacaag

SEQ ID NO: 3646751 - DNA, 18 bp, Homo sapiens
agggatggccacaagttc

SEQ ID NO: 3646752 - DNA, 15 bp, Homo sapiens
agggctggctggagg

SEQ ID NO: 3646753 - DNA, 16 bp, Homo sapiens
agggctggctggagga

SEQ ID NO: 3646754 - DNA, 22 bp, Homo sapiens
agggctggctggaggaaggaaa

SEQ ID NO: 3646755 - DNA, 18 bp, Homo sapiens
agggctgttccctccagg

SEQ ID NO: 3646756 - DNA, 23 bp, Homo sapiens
aggggcaaaaatttgacattgtc

SEQ ID NO: 3646757 - DNA, 14 bp, Homo sapiens
agggttaccccacc

SEQ ID NO: 3646758 - DNA, 18 bp, Homo sapiens
agggttctatatttactg

SEQ ID NO: 3646759 - DNA, 13 bp, Homo sapiens
aggtagggctggc

SEQ ID NO: 3646760 - DNA, 21 bp, Homo sapiens
aggtcagtgttataaaatctg

SEQ ID NO: 3646761 - DNA, 18 bp, Homo sapiens
aggtcatgaacatggtca

SEQ ID NO: 3646762 - DNA, 14 bp, Homo sapiens
aggtccggatgtca

SEQ ID NO: 3646763 - DNA, 13 bp, Homo sapiens
aggtctgttgaag

SEQ ID NO: 3646764 - DNA, 21 bp, Homo sapiens
aggtctgttgaagtgcatgtt

SEQ ID NO: 3646765 - DNA, 22 bp, Homo sapiens
aggtctgttgaagtgcatgtta

SEQ ID NO: 3646766 - DNA, 14 bp, Homo sapiens
aggtgaccagaatg

SEQ ID NO: 3646767 - DNA, 15 bp, Homo sapiens
aggtgaccagaatga

SEQ ID NO: 3646768 - DNA, 17 bp, Homo sapiens
aggtgaccagaatgagg

SEQ ID NO: 3646769 - DNA, 20 bp, Homo sapiens
aggtggacttgtctcccagt

SEQ ID NO: 3646770 - DNA, 15 bp, Homo sapiens
aggtggcagggctgt

SEQ ID NO: 3646771 - DNA, 16 bp, Homo sapiens
aggtggcatttgcagg

SEQ ID NO: 3646772 - DNA, 17 bp, Homo sapiens
aggtgggagatggaggt

SEQ ID NO: 3646773 - DNA, 23 bp, Homo sapiens
aggtgggctgaagggaagcccag

SEQ ID NO: 3646774 - DNA, 16 bp, Homo sapiens
aggttcttctggtgag

SEQ ID NO: 3646775 - DNA, 16 bp, Homo sapiens
aggtttcactgttcat

SEQ ID NO: 3646776 - DNA, 17 bp, Homo sapiens
aggtttcactgttcatg

SEQ ID NO: 3646777 - DNA, 19 bp, Homo sapiens
agtaaaacttgtattggaa

SEQ ID NO: 3646778 - DNA, 18 bp, Homo sapiens
agtaaatctaaattaact

SEQ ID NO: 3646779 - DNA, 15 bp, Homo sapiens
agtaaattaagagca

SEQ ID NO: 3646780 - DNA, 16 bp, Homo sapiens
agtaacagtatttcca

SEQ ID NO: 3646781 - DNA, 13 bp, Homo sapiens
agtaattaaaaag

SEQ ID NO: 3646782 - DNA, 22 bp, Homo sapiens
agtacaaaaaattagccagtca

SEQ ID NO: 3646783 - DNA, 15 bp, Homo sapiens
agtactagcaataag

SEQ ID NO: 3646784 - DNA, 22 bp, Homo sapiens
agtagcattttaatagtttcta

SEQ ID NO: 3646785 - DNA, 17 bp, Homo sapiens
agtatagataaatccaa

SEQ ID NO: 3646786 - DNA, 20 bp, Homo sapiens
agtatagatggtagaaactt

SEQ ID NO: 3646787 - DNA, 15 bp, Homo sapiens
agtatcttaaaattg

SEQ ID NO: 3646788 - DNA, 18 bp, Homo sapiens
agtatgggttagggaaaa

SEQ ID NO: 3646789 - DNA, 14 bp, Homo sapiens
agtattaagaatat

SEQ ID NO: 3646790 - DNA, 11 bp, Homo sapiens
agtattttgag

SEQ ID NO: 3646791 - DNA, 12 bp, Homo sapiens
agtattttgagc

SEQ ID NO: 3646792 - DNA, 13 bp, Homo sapiens
agtattttgagcc

SEQ ID NO: 3646793 - DNA, 13 bp, Homo sapiens
agtccacaaggtc

SEQ ID NO: 3646794 - DNA, 15 bp, Homo sapiens
agtccatttttgagt

SEQ ID NO: 3646795 - DNA, 19 bp, Homo sapiens
agtccatttttgagtaaaa

SEQ ID NO: 3646796 - DNA, 13 bp, Homo sapiens
agtcgaggctggt

SEQ ID NO: 3646797 - DNA, 14 bp, Homo sapiens
agtctccagataga

SEQ ID NO: 3646798 - DNA, 16 bp, Homo sapiens
agtctcctgtatcatt

SEQ ID NO: 3646799 - DNA, 20 bp, Homo sapiens
agtctctatttgatttgcaa

SEQ ID NO: 3646800 - DNA, 23 bp, Homo sapiens
agtgaaaaagacttcaaatgtta

SEQ ID NO: 3646801 - DNA, 16 bp, Homo sapiens
agtgaaattagtattt

SEQ ID NO: 3646802 - DNA, 17 bp, Homo sapiens
agtgacttggagagaga

SEQ ID NO: 3646803 - DNA, 18 bp, Homo sapiens
agtgactttggctgcatg

SEQ ID NO: 3646804 - DNA, 13 bp, Homo sapiens
agtgagaaagaca

SEQ ID NO: 3646805 - DNA, 23 bp, Homo sapiens
agtgagacctccctgtctctaca

SEQ ID NO: 3646806 - DNA, 22 bp, Homo sapiens
agtgcaggaaaaggctgcagct

SEQ ID NO: 3646807 - DNA, 17 bp, Homo sapiens
agtgccaatgacaggac

SEQ ID NO: 3646808 - DNA, 13 bp, Homo sapiens
agtggaagagctg

SEQ ID NO: 3646809 - DNA, 21 bp, Homo sapiens
agtggaaggataatgagatgt

SEQ ID NO: 3646810 - DNA, 14 bp, Homo sapiens
agtggacatttgtt

SEQ ID NO: 3646811 - DNA, 23 bp, Homo sapiens
agtggtattttaacatagcagct

SEQ ID NO: 3646812 - DNA, 17 bp, Homo sapiens
agtgtgagtgttagaaa

SEQ ID NO: 3646813 - DNA, 23 bp, Homo sapiens
agtgttataaaatctgtattgct

SEQ ID NO: 3646814 - DNA, 23 bp, Homo sapiens
agtgttgtcttattcctaattcc

SEQ ID NO: 3646815 - DNA, 19 bp, Homo sapiens
agtgtttctagtaacagta

SEQ ID NO: 3646816 - DNA, 17 bp, Homo sapiens
agtgttttcattctggt

SEQ ID NO: 3646817 - DNA, 23 bp, Homo sapiens
agtgttttcattctggtccttag

SEQ ID NO: 3646818 - DNA, 15 bp, Homo sapiens
agttacttacacacc

SEQ ID NO: 3646819 - DNA, 19 bp, Homo sapiens
agttccccgctgacccttg

SEQ ID NO: 3646820 - DNA, 14 bp, Homo sapiens
agttctgtgcagtt

SEQ ID NO: 3646821 - DNA, 15 bp, Homo sapiens
agttgtccgtgaaga

SEQ ID NO: 3646822 - DNA, 12 bp, Homo sapiens
agtttaaatctt

SEQ ID NO: 3646823 - DNA, 19 bp, Homo sapiens
agtttaaatctttgttaaa

SEQ ID NO: 3646824 - DNA, 18 bp, Homo sapiens
agtttatctttgcacaat

SEQ ID NO: 3646825 - DNA, 13 bp, Homo sapiens
agtttccatttgg

SEQ ID NO: 3646826 - DNA, 14 bp, Homo sapiens
agtttccatttgga

SEQ ID NO: 3646827 - DNA, 19 bp, Homo sapiens
agtttctaaaccatgaaaa

SEQ ID NO: 3646828 - DNA, 21 bp, Homo sapiens
agtttctaaaccatgaaaagt

SEQ ID NO: 3646829 - DNA, 23 bp, Homo sapiens
agtttggtatgaaacaaatatac

SEQ ID NO: 3646830 - DNA, 16 bp, Homo sapiens
ataaaaataattaaaa

SEQ ID NO: 3646831 - DNA, 20 bp, Homo sapiens
ataaaatgtttatttttgct

SEQ ID NO: 3646832 - DNA, 15 bp, Homo sapiens
ataaagtcaaatcaa

SEQ ID NO: 3646833 - DNA, 14 bp, Homo sapiens
ataaatcacagatt

SEQ ID NO: 3646834 - DNA, 19 bp, Homo sapiens
ataaatcacagatttccaa

SEQ ID NO: 3646835 - DNA, 20 bp, Homo sapiens
ataaatcacagatttccaaa

SEQ ID NO: 3646836 - DNA, 21 bp, Homo sapiens
ataaatcttacccttcaatgt

SEQ ID NO: 3646837 - DNA, 22 bp, Homo sapiens
ataaatcttacccttcaatgtt

SEQ ID NO: 3646838 - DNA, 13 bp, Homo sapiens
ataaattggggtg

SEQ ID NO: 3646839 - DNA, 13 bp, Homo sapiens
ataaattttggaa

SEQ ID NO: 3646840 - DNA, 15 bp, Homo sapiens
ataaattttggaaga

SEQ ID NO: 3646841 - DNA, 20 bp, Homo sapiens
ataaattttggaagaattca

SEQ ID NO: 3646842 - DNA, 21 bp, Homo sapiens
ataaattttggaagaattcat

SEQ ID NO: 3646843 - DNA, 22 bp, Homo sapiens
ataaattttggaagaattcatg

SEQ ID NO: 3646844 - DNA, 18 bp, Homo sapiens
ataacacttcaccttctg

SEQ ID NO: 3646845 - DNA, 13 bp, Homo sapiens
ataacattgtaaa

SEQ ID NO: 3646846 - DNA, 17 bp, Homo sapiens
ataacattgtaaatgat

SEQ ID NO: 3646847 - DNA, 20 bp, Homo sapiens
ataatagctcacagcacatt

SEQ ID NO: 3646848 - DNA, 22 bp, Homo sapiens
ataatagctcacagcacatttg

SEQ ID NO: 3646849 - DNA, 12 bp, Homo sapiens
ataatattttct

SEQ ID NO: 3646850 - DNA, 14 bp, Homo sapiens
ataatgagatgtaa

SEQ ID NO: 3646851 - DNA, 12 bp, Homo sapiens
ataattaaaaca

SEQ ID NO: 3646852 - DNA, 16 bp, Homo sapiens
ataattgtaaaggtga

SEQ ID NO: 3646853 - DNA, 21 bp, Homo sapiens
ataattgtaaaggtgatgaat

SEQ ID NO: 3646854 - DNA, 16 bp, Homo sapiens
atacaccaaatagctt

SEQ ID NO: 3646855 - DNA, 23 bp, Homo sapiens
atactaagagatttgctttttct

SEQ ID NO: 3646856 - DNA, 18 bp, Homo sapiens
atacttgacaacattttt

SEQ ID NO: 3646857 - DNA, 23 bp, Homo sapiens
atacttttcaggcactttagaaa

SEQ ID NO: 3646858 - DNA, 17 bp, Homo sapiens
atagataccattttgaa

SEQ ID NO: 3646859 - DNA, 22 bp, Homo sapiens
atagataccattttgaaatatt

SEQ ID NO: 3646860 - DNA, 14 bp, Homo sapiens
atagatggtagaaa

SEQ ID NO: 3646861 - DNA, 21 bp, Homo sapiens
atagatggtagaaactttgga

SEQ ID NO: 3646862 - DNA, 15 bp, Homo sapiens
atagcacatgtttta

SEQ ID NO: 3646863 - DNA, 18 bp, Homo sapiens
atagctataaatagtgaa

SEQ ID NO: 3646864 - DNA, 18 bp, Homo sapiens
ataggggcaaaaatttga

SEQ ID NO: 3646865 - DNA, 18 bp, Homo sapiens
ataggttctgctttctga

SEQ ID NO: 3646866 - DNA, 19 bp, Homo sapiens
atagtgaaaattttattga

SEQ ID NO: 3646867 - DNA, 16 bp, Homo sapiens
atagtggtattttaac

SEQ ID NO: 3646868 - DNA, 14 bp, Homo sapiens
atagtgtgtccatg

SEQ ID NO: 3646869 - DNA, 20 bp, Homo sapiens
atagtgttgtgttacaataa

SEQ ID NO: 3646870 - DNA, 23 bp, Homo sapiens
atagtgttgtgttacaataagtg

SEQ ID NO: 3646871 - DNA, 13 bp, Homo sapiens
atagtttctaaac

SEQ ID NO: 3646872 - DNA, 15 bp, Homo sapiens
atataaatcacagat

SEQ ID NO: 3646873 - DNA, 17 bp, Homo sapiens
atataaatcacagattt

SEQ ID NO: 3646874 - DNA, 12 bp, Homo sapiens
atataacatgaa

SEQ ID NO: 3646875 - DNA, 13 bp, Homo sapiens
atataacatgaaa

SEQ ID NO: 3646876 - DNA, 17 bp, Homo sapiens
atataacatgaaagtca

SEQ ID NO: 3646877 - DNA, 21 bp, Homo sapiens
atataatggcctcttaaaaat

SEQ ID NO: 3646878 - DNA, 17 bp, Homo sapiens
atataggggcaaaaatt

SEQ ID NO: 3646879 - DNA, 19 bp, Homo sapiens
atatagtgttgtgttacaa

SEQ ID NO: 3646880 - DNA, 13 bp, Homo sapiens
atatattttgaaa

SEQ ID NO: 3646881 - DNA, 14 bp, Homo sapiens
atatctgtgtaaga

SEQ ID NO: 3646882 - DNA, 17 bp, Homo sapiens
atatctgtttgcttcta

SEQ ID NO: 3646883 - DNA, 18 bp, Homo sapiens
atatgagattggaaaaaa

SEQ ID NO: 3646884 - DNA, 22 bp, Homo sapiens
atatggcaacgttcatgttcat

SEQ ID NO: 3646885 - DNA, 23 bp, Homo sapiens
atatgtaggaaaattttcttctt

SEQ ID NO: 3646886 - DNA, 19 bp, Homo sapiens
atatgtatatctgtgtaag

SEQ ID NO: 3646887 - DNA, 13 bp, Homo sapiens
atattattttctg

SEQ ID NO: 3646888 - DNA, 16 bp, Homo sapiens
atattattttctgtaa

SEQ ID NO: 3646889 - DNA, 13 bp, Homo sapiens
atatttactgttt

SEQ ID NO: 3646890 - DNA, 12 bp, Homo sapiens
atattttgaaag

SEQ ID NO: 3646891 - DNA, 15 bp, Homo sapiens
atcacagatttccaa

SEQ ID NO: 3646892 - DNA, 20 bp, Homo sapiens
atcaccccagcctcactcca

SEQ ID NO: 3646893 - DNA, 21 bp, Homo sapiens
atcaccccagcctcactccat

SEQ ID NO: 3646894 - DNA, 15 bp, Homo sapiens
atcagaagcaaggaa

SEQ ID NO: 3646895 - DNA, 22 bp, Homo sapiens
atcagggtagcagcagaggcag

SEQ ID NO: 3646896 - DNA, 18 bp, Homo sapiens
atcaggtaaactgatgct

SEQ ID NO: 3646897 - DNA, 13 bp, Homo sapiens
atcatatctgtat

SEQ ID NO: 3646898 - DNA, 18 bp, Homo sapiens
atcatgaggtcaggagtt

SEQ ID NO: 3646899 - DNA, 19 bp, Homo sapiens
atcattggtatctgatatc

SEQ ID NO: 3646900 - DNA, 14 bp, Homo sapiens
atcatttcattcgt

SEQ ID NO: 3646901 - DNA, 13 bp, Homo sapiens
atcattttgatgt

SEQ ID NO: 3646902 - DNA, 19 bp, Homo sapiens
atccatcggtttatactat

SEQ ID NO: 3646903 - DNA, 18 bp, Homo sapiens
atccatgcgtttcttcca

SEQ ID NO: 3646904 - DNA, 12 bp, Homo sapiens
atcccactccac

SEQ ID NO: 3646905 - DNA, 17 bp, Homo sapiens
atcccagcactttggga

SEQ ID NO: 3646906 - DNA, 22 bp, Homo sapiens
atccctggcttccccttcagac

SEQ ID NO: 3646907 - DNA, 23 bp, Homo sapiens
atccctggcttccccttcagacc

SEQ ID NO: 3646908 - DNA, 19 bp, Homo sapiens
atccgcccgcctcagcatc

SEQ ID NO: 3646909 - DNA, 23 bp, Homo sapiens
atcctagcactttgggaggctga

SEQ ID NO: 3646910 - DNA, 18 bp, Homo sapiens
atcctcaagttgtgtgct

SEQ ID NO: 3646911 - DNA, 22 bp, Homo sapiens
atccttaaaaagaccatgcatt

SEQ ID NO: 3646912 - DNA, 16 bp, Homo sapiens
atccttgagtcaaaaa

SEQ ID NO: 3646913 - DNA, 21 bp, Homo sapiens
atccttttccatcccactcca

SEQ ID NO: 3646914 - DNA, 18 bp, Homo sapiens
atcgatttgtattaatgt

SEQ ID NO: 3646915 - DNA, 19 bp, Homo sapiens
atctaaattaacttctatt

SEQ ID NO: 3646916 - DNA, 17 bp, Homo sapiens
atctacaaacttttata

SEQ ID NO: 3646917 - DNA, 19 bp, Homo sapiens
atctacacatataaacaca

SEQ ID NO: 3646918 - DNA, 14 bp, Homo sapiens
atctactagaacct

SEQ ID NO: 3646919 - DNA, 17 bp, Homo sapiens
atctcagcatcctggaa

SEQ ID NO: 3646920 - DNA, 23 bp, Homo sapiens
atctcagcatcctggaaatttgt

SEQ ID NO: 3646921 - DNA, 18 bp, Homo sapiens
atctcaggtggcatttgc

SEQ ID NO: 3646922 - DNA, 12 bp, Homo sapiens
atctgaagtagt

SEQ ID NO: 3646923 - DNA, 15 bp, Homo sapiens
atctgaatttctaaa

SEQ ID NO: 3646924 - DNA, 21 bp, Homo sapiens
atctgagacactaggatgaat

SEQ ID NO: 3646925 - DNA, 21 bp, Homo sapiens
atctgaggaaaatggaagacc

SEQ ID NO: 3646926 - DNA, 14 bp, Homo sapiens
atctgatttctgaa

SEQ ID NO: 3646927 - DNA, 18 bp, Homo sapiens
atctggaaccatcagaaa

SEQ ID NO: 3646928 - DNA, 21 bp, Homo sapiens
atcttacccttcaatgttaaa

SEQ ID NO: 3646929 - DNA, 14 bp, Homo sapiens
atctttgccaccct

SEQ ID NO: 3646930 - DNA, 16 bp, Homo sapiens
atctttgccaccctca

SEQ ID NO: 3646931 - DNA, 15 bp, Homo sapiens
atctttgttaaaata

SEQ ID NO: 3646932 - DNA, 18 bp, Homo sapiens
atctttgttaaaatatag

SEQ ID NO: 3646933 - DNA, 17 bp, Homo sapiens
atgaaaaatctgaattt

SEQ ID NO: 3646934 - DNA, 18 bp, Homo sapiens
atgaaaaatctgaatttc

SEQ ID NO: 3646935 - DNA, 19 bp, Homo sapiens
atgaaaaccaccctatcat

SEQ ID NO: 3646936 - DNA, 14 bp, Homo sapiens
atgaaaagttttca

SEQ ID NO: 3646937 - DNA, 15 bp, Homo sapiens
atgaaaagttttcaa

SEQ ID NO: 3646938 - DNA, 15 bp, Homo sapiens
atgaaacaaatatac

SEQ ID NO: 3646939 - DNA, 19 bp, Homo sapiens
atgaaacaaatatactcat

SEQ ID NO: 3646940 - DNA, 22 bp, Homo sapiens
atgaactcaggtttccggctac

SEQ ID NO: 3646941 - DNA, 16 bp, Homo sapiens
atgaataaaatgttta

SEQ ID NO: 3646942 - DNA, 20 bp, Homo sapiens
atgaatacgtaaactgcgta

SEQ ID NO: 3646943 - DNA, 20 bp, Homo sapiens
atgacagtggttatatttca

SEQ ID NO: 3646944 - DNA, 21 bp, Homo sapiens
atgacagtggttatatttcaa

SEQ ID NO: 3646945 - DNA, 19 bp, Homo sapiens
atgagaaatataaaaataa

SEQ ID NO: 3646946 - DNA, 23 bp, Homo sapiens
atgagatcccagagttatttccc

SEQ ID NO: 3646947 - DNA, 14 bp, Homo sapiens
atgagatgatttaa

SEQ ID NO: 3646948 - DNA, 18 bp, Homo sapiens
atgagatgatttaattct

SEQ ID NO: 3646949 - DNA, 19 bp, Homo sapiens
atgagattggaaaaaatta

SEQ ID NO: 3646950 - DNA, 16 bp, Homo sapiens
atgaggcaactcagca

SEQ ID NO: 3646951 - DNA, 14 bp, Homo sapiens
atgaggtgggctga

SEQ ID NO: 3646952 - DNA, 15 bp, Homo sapiens
atgaggtgggctgaa

SEQ ID NO: 3646953 - DNA, 22 bp, Homo sapiens
atgagtctccagatagatgtcg

SEQ ID NO: 3646954 - DNA, 20 bp, Homo sapiens
atgagttctgcacatacaga

SEQ ID NO: 3646955 - DNA, 22 bp, Homo sapiens
atgagttctgcacatacagatg

SEQ ID NO: 3646956 - DNA, 13 bp, Homo sapiens
atgataatagctc

SEQ ID NO: 3646957 - DNA, 22 bp, Homo sapiens
atgatatagagtgacttggaga

SEQ ID NO: 3646958 - DNA, 22 bp, Homo sapiens
atgattaaactgggaaatgaga

SEQ ID NO: 3646959 - DNA, 12 bp, Homo sapiens
atgatttaacat

SEQ ID NO: 3646960 - DNA, 15 bp, Homo sapiens
atgcaagtgagaaag

SEQ ID NO: 3646961 - DNA, 16 bp, Homo sapiens
atgcaagtgagaaaga

SEQ ID NO: 3646962 - DNA, 18 bp, Homo sapiens
atgcatgcactcttttga

SEQ ID NO: 3646963 - DNA, 12 bp, Homo sapiens
atgcatggaaat

SEQ ID NO: 3646964 - DNA, 16 bp, Homo sapiens
atgcatttagcatgag

SEQ ID NO: 3646965 - DNA, 14 bp, Homo sapiens
atgccatgtatgtt

SEQ ID NO: 3646966 - DNA, 21 bp, Homo sapiens
atgccatgtatgttgcatgaa

SEQ ID NO: 3646967 - DNA, 22 bp, Homo sapiens
atgcctttctagcaattgcttc

SEQ ID NO: 3646968 - DNA, 14 bp, Homo sapiens
atgctagttcttac

SEQ ID NO: 3646969 - DNA, 15 bp, Homo sapiens
atgctagttcttacg

SEQ ID NO: 3646970 - DNA, 14 bp, Homo sapiens
atgctgtgtgcaga

SEQ ID NO: 3646971 - DNA, 21 bp, Homo sapiens
atgctgtgtgcagagtataca

SEQ ID NO: 3646972 - DNA, 19 bp, Homo sapiens
atgcttccagggacaagct

SEQ ID NO: 3646973 - DNA, 17 bp, Homo sapiens
atggaaataacgggtgg

SEQ ID NO: 3646974 - DNA, 20 bp, Homo sapiens
atggaaataacgggtggcat

SEQ ID NO: 3646975 - DNA, 14 bp, Homo sapiens
atggaagacctaag

SEQ ID NO: 3646976 - DNA, 19 bp, Homo sapiens
atggaagggccttctccac

SEQ ID NO: 3646977 - DNA, 16 bp, Homo sapiens
atggaggtagggctgg

SEQ ID NO: 3646978 - DNA, 21 bp, Homo sapiens
atggaggtagggctggctgga

SEQ ID NO: 3646979 - DNA, 18 bp, Homo sapiens
atggaggtgatgaaaacc

SEQ ID NO: 3646980 - DNA, 19 bp, Homo sapiens
atggcctcttaaaaattat

SEQ ID NO: 3646981 - DNA, 13 bp, Homo sapiens
atggctgaagaaa

SEQ ID NO: 3646982 - DNA, 13 bp, Homo sapiens
atggtagaaactt

SEQ ID NO: 3646983 - DNA, 21 bp, Homo sapiens
atggtagaaactttggaagtt

SEQ ID NO: 3646984 - DNA, 17 bp, Homo sapiens
atggtattttttgtgaa

SEQ ID NO: 3646985 - DNA, 18 bp, Homo sapiens
atggtattttttgtgaat

SEQ ID NO: 3646986 - DNA, 18 bp, Homo sapiens
atggtggcacacgcctgt

SEQ ID NO: 3646987 - DNA, 18 bp, Homo sapiens
atggtgtcctgcatgtat

SEQ ID NO: 3646988 - DNA, 13 bp, Homo sapiens
atggttgggacca

SEQ ID NO: 3646989 - DNA, 16 bp, Homo sapiens
atgtaagtattaagaa

SEQ ID NO: 3646990 - DNA, 18 bp, Homo sapiens
atgtaggaaaattttctt

SEQ ID NO: 3646991 - DNA, 22 bp, Homo sapiens
atgtagggcagaatagctgata

SEQ ID NO: 3646992 - DNA, 18 bp, Homo sapiens
atgtatatctgtgtaaga

SEQ ID NO: 3646993 - DNA, 23 bp, Homo sapiens
atgtatatctgtgtaagacacgt

SEQ ID NO: 3646994 - DNA, 15 bp, Homo sapiens
atgtatgttgcatga

SEQ ID NO: 3646995 - DNA, 20 bp, Homo sapiens
atgtatttgttaaagaaaca

SEQ ID NO: 3646996 - DNA, 16 bp, Homo sapiens
atgtcattttcagatc

SEQ ID NO: 3646997 - DNA, 21 bp, Homo sapiens
atgtcctgtagagagagacct

SEQ ID NO: 3646998 - DNA, 18 bp, Homo sapiens
atgtcgtggactccagct

SEQ ID NO: 3646999 - DNA, 21 bp, Homo sapiens
atgtctgtccctaaacatagt

SEQ ID NO: 3647000 - DNA, 22 bp, Homo sapiens
atgtctgtccctaaacatagtg

SEQ ID NO: 3647001 - DNA, 21 bp, Homo sapiens
atgtgaaaaaaaaaagtaatt

SEQ ID NO: 3647002 - DNA, 15 bp, Homo sapiens
atgtgataattgtaa

SEQ ID NO: 3647003 - DNA, 19 bp, Homo sapiens
atgtgataattgtaaaggt

SEQ ID NO: 3647004 - DNA, 12 bp, Homo sapiens
atgttaaatcta

SEQ ID NO: 3647005 - DNA, 16 bp, Homo sapiens
atgttattcaataact

SEQ ID NO: 3647006 - DNA, 17 bp, Homo sapiens
atgtttatttttgctct

SEQ ID NO: 3647007 - DNA, 19 bp, Homo sapiens
atgttttaaagaagtccat

SEQ ID NO: 3647008 - DNA, 14 bp, Homo sapiens
attaaaaagacact

SEQ ID NO: 3647009 - DNA, 18 bp, Homo sapiens
attaaaaagacactttta

SEQ ID NO: 3647010 - DNA, 19 bp, Homo sapiens
attaaaatattttcttaat

SEQ ID NO: 3647011 - DNA, 21 bp, Homo sapiens
attaaaatattttcttaatta

SEQ ID NO: 3647012 - DNA, 17 bp, Homo sapiens
attaaactgggaaatga

SEQ ID NO: 3647013 - DNA, 14 bp, Homo sapiens
attaaatgaaatac

SEQ ID NO: 3647014 - DNA, 15 bp, Homo sapiens
attaaatgaaatact

SEQ ID NO: 3647015 - DNA, 11 bp, Homo sapiens
attaaatgttg

SEQ ID NO: 3647016 - DNA, 17 bp, Homo sapiens
attaaggactacagaat

SEQ ID NO: 3647017 - DNA, 19 bp, Homo sapiens
attaaggactacagaattg

SEQ ID NO: 3647018 - DNA, 20 bp, Homo sapiens
attacaacaagcaaactgaa

SEQ ID NO: 3647019 - DNA, 14 bp, Homo sapiens
attacactccagcc

SEQ ID NO: 3647020 - DNA, 17 bp, Homo sapiens
attacactccagcctgg

SEQ ID NO: 3647021 - DNA, 18 bp, Homo sapiens
attacactccagcctggg

SEQ ID NO: 3647022 - DNA, 22 bp, Homo sapiens
attactaactgtggacaaaagt

SEQ ID NO: 3647023 - DNA, 14 bp, Homo sapiens
attagtgttttcat

SEQ ID NO: 3647024 - DNA, 19 bp, Homo sapiens
attatatgaagcagaatga

SEQ ID NO: 3647025 - DNA, 23 bp, Homo sapiens
attatcctcaagttgtgtgctat

SEQ ID NO: 3647026 - DNA, 16 bp, Homo sapiens
attattacaacaagca

SEQ ID NO: 3647027 - DNA, 14 bp, Homo sapiens
attcacttttattg

SEQ ID NO: 3647028 - DNA, 15 bp, Homo sapiens
attcacttttattgt

SEQ ID NO: 3647029 - DNA, 14 bp, Homo sapiens
attcagatctgaag

SEQ ID NO: 3647030 - DNA, 22 bp, Homo sapiens
attcagatttctacactttata

SEQ ID NO: 3647031 - DNA, 22 bp, Homo sapiens
attcagtagcattttaatagtt

SEQ ID NO: 3647032 - DNA, 18 bp, Homo sapiens
attcagtctatgctgtgt

SEQ ID NO: 3647033 - DNA, 15 bp, Homo sapiens
attcatggtatcttg

SEQ ID NO: 3647034 - DNA, 19 bp, Homo sapiens
attcattccattctggaag

SEQ ID NO: 3647035 - DNA, 20 bp, Homo sapiens
attcccatggtagactgtga

SEQ ID NO: 3647036 - DNA, 16 bp, Homo sapiens
attcccttcatctgga

SEQ ID NO: 3647037 - DNA, 14 bp, Homo sapiens
attcctaattctat

SEQ ID NO: 3647038 - DNA, 16 bp, Homo sapiens
attcgtaagttctgtg

SEQ ID NO: 3647039 - DNA, 20 bp, Homo sapiens
attcgtaagttctgtgcagt

SEQ ID NO: 3647040 - DNA, 16 bp, Homo sapiens
attctatgattaaact

SEQ ID NO: 3647041 - DNA, 17 bp, Homo sapiens
attctatgattaaactg

SEQ ID NO: 3647042 - DNA, 17 bp, Homo sapiens
attctctaagcctggct

SEQ ID NO: 3647043 - DNA, 15 bp, Homo sapiens
attctgattattaca

SEQ ID NO: 3647044 - DNA, 19 bp, Homo sapiens
attctggtccttagtaaat

SEQ ID NO: 3647045 - DNA, 18 bp, Homo sapiens
attcttaccgaaatgaaa

SEQ ID NO: 3647046 - DNA, 20 bp, Homo sapiens
attcttaccgaaatgaaaat

SEQ ID NO: 3647047 - DNA, 20 bp, Homo sapiens
attcttccctatctttgcca

SEQ ID NO: 3647048 - DNA, 20 bp, Homo sapiens
attcttctcctttgtcaaat

SEQ ID NO: 3647049 - DNA, 22 bp, Homo sapiens
attcttctcctttgtcaaatgg

SEQ ID NO: 3647050 - DNA, 22 bp, Homo sapiens
attgagttggttacctattgct

SEQ ID NO: 3647051 - DNA, 14 bp, Homo sapiens
attgcttctctaaa

SEQ ID NO: 3647052 - DNA, 19 bp, Homo sapiens
attgcttgaacctgtgagg

SEQ ID NO: 3647053 - DNA, 14 bp, Homo sapiens
attgcttgagcatg

SEQ ID NO: 3647054 - DNA, 23 bp, Homo sapiens
attggaagtatagatggtagaaa

SEQ ID NO: 3647055 - DNA, 21 bp, Homo sapiens
attggagattactaactgtgg

SEQ ID NO: 3647056 - DNA, 22 bp, Homo sapiens
attgggcccttagaatgtgaaa

SEQ ID NO: 3647057 - DNA, 12 bp, Homo sapiens
attggggtgatg

SEQ ID NO: 3647058 - DNA, 14 bp, Homo sapiens
attgggtcagaccc

SEQ ID NO: 3647059 - DNA, 17 bp, Homo sapiens
attggttaatgaaaaat

SEQ ID NO: 3647060 - DNA, 21 bp, Homo sapiens
attggttaatgaaaaatctga

SEQ ID NO: 3647061 - DNA, 16 bp, Homo sapiens
attgtaaaggtgatga

SEQ ID NO: 3647062 - DNA, 20 bp, Homo sapiens
attgtaaaggtgatgaattt

SEQ ID NO: 3647063 - DNA, 22 bp, Homo sapiens
attgtaaaggtgatgaatttac

SEQ ID NO: 3647064 - DNA, 14 bp, Homo sapiens
attgtcagaatgtt

SEQ ID NO: 3647065 - DNA, 21 bp, Homo sapiens
attgtttgatgaataaaatgt

SEQ ID NO: 3647066 - DNA, 12 bp, Homo sapiens
atttaattctta

SEQ ID NO: 3647067 - DNA, 17 bp, Homo sapiens
atttaccatcaaacaaa

SEQ ID NO: 3647068 - DNA, 21 bp, Homo sapiens
atttaccatcaaacaaatcat

SEQ ID NO: 3647069 - DNA, 23 bp, Homo sapiens
atttaccatcaaacaaatcattt

SEQ ID NO: 3647070 - DNA, 18 bp, Homo sapiens
atttactgcaatgtctgt

SEQ ID NO: 3647071 - DNA, 21 bp, Homo sapiens
atttagggttctatatttact

SEQ ID NO: 3647072 - DNA, 15 bp, Homo sapiens
atttataacattgta

SEQ ID NO: 3647073 - DNA, 12 bp, Homo sapiens
atttatgtgtga

SEQ ID NO: 3647074 - DNA, 20 bp, Homo sapiens
atttcacacaactgtggata

SEQ ID NO: 3647075 - DNA, 23 bp, Homo sapiens
atttcccaacccaggattcaaca

SEQ ID NO: 3647076 - DNA, 23 bp, Homo sapiens
atttctagatatgagaaatataa

SEQ ID NO: 3647077 - DNA, 19 bp, Homo sapiens
atttgacatgagtctccag

SEQ ID NO: 3647078 - DNA, 21 bp, Homo sapiens
atttgacattgtcagaatgtt

SEQ ID NO: 3647079 - DNA, 23 bp, Homo sapiens
atttgacattgtcagaatgttgt

SEQ ID NO: 3647080 - DNA, 18 bp, Homo sapiens
atttgatttgcaacactg

SEQ ID NO: 3647081 - DNA, 14 bp, Homo sapiens
atttgcaacactgc

SEQ ID NO: 3647082 - DNA, 19 bp, Homo sapiens
atttgcaacactgccaaac

SEQ ID NO: 3647083 - DNA, 21 bp, Homo sapiens
atttgcaggtgaccagaatga

SEQ ID NO: 3647084 - DNA, 16 bp, Homo sapiens
atttggatataaatct

SEQ ID NO: 3647085 - DNA, 17 bp, Homo sapiens
atttggatataaatctt

SEQ ID NO: 3647086 - DNA, 13 bp, Homo sapiens
atttggattttaa

SEQ ID NO: 3647087 - DNA, 21 bp, Homo sapiens
atttggattttaaacaaaatt

SEQ ID NO: 3647088 - DNA, 23 bp, Homo sapiens
atttggggagagataatgaggca

SEQ ID NO: 3647089 - DNA, 17 bp, Homo sapiens
atttgttaaagaaacat

SEQ ID NO: 3647090 - DNA, 15 bp, Homo sapiens
atttgttaatgattc

SEQ ID NO: 3647091 - DNA, 12 bp, Homo sapiens
attttaacatag

SEQ ID NO: 3647092 - DNA, 21 bp, Homo sapiens
attttaacatagcagctggtt

SEQ ID NO: 3647093 - DNA, 22 bp, Homo sapiens
attttaatagtttctaaaccat

SEQ ID NO: 3647094 - DNA, 16 bp, Homo sapiens
attttattgaatataa

SEQ ID NO: 3647095 - DNA, 15 bp, Homo sapiens
attttctgtaattct

SEQ ID NO: 3647096 - DNA, 20 bp, Homo sapiens
attttcttctttaatttttc

SEQ ID NO: 3647097 - DNA, 20 bp, Homo sapiens
attttgagccttattaaaat

SEQ ID NO: 3647098 - DNA, 19 bp, Homo sapiens
attttgatgtattattata

SEQ ID NO: 3647099 - DNA, 18 bp, Homo sapiens
attttgattgtttgatga

SEQ ID NO: 3647100 - DNA, 20 bp, Homo sapiens
attttgattgtttgatgaat

SEQ ID NO: 3647101 - DNA, 21 bp, Homo sapiens
attttggaagaattcatgatg

SEQ ID NO: 3647102 - DNA, 18 bp, Homo sapiens
attttggacgtgtgagga

SEQ ID NO: 3647103 - DNA, 18 bp, Homo sapiens
atttttctgttggtctta

SEQ ID NO: 3647104 - DNA, 22 bp, Homo sapiens
atttttttagtaaattaagagc

SEQ ID NO: 3647105 - DNA, 21 bp, Homo sapiens
caaaaaattagccagtcatgg

SEQ ID NO: 3647106 - DNA, 14 bp, Homo sapiens
caaaagcaggaacc

SEQ ID NO: 3647107 - DNA, 19 bp, Homo sapiens
caaaagcaggaacccatct

SEQ ID NO: 3647108 - DNA, 19 bp, Homo sapiens
caaaagcccattcattcca

SEQ ID NO: 3647109 - DNA, 20 bp, Homo sapiens
caaaagtactagcaataagt

SEQ ID NO: 3647110 - DNA, 13 bp, Homo sapiens
caaaatataaatc

SEQ ID NO: 3647111 - DNA, 15 bp, Homo sapiens
caaaatataaatcac

SEQ ID NO: 3647112 - DNA, 18 bp, Homo sapiens
caaaatttatgtcatttt

SEQ ID NO: 3647113 - DNA, 23 bp, Homo sapiens
caaaatttatgtcattttcagat

SEQ ID NO: 3647114 - DNA, 22 bp, Homo sapiens
caaacaaatcattttgatgtat

SEQ ID NO: 3647115 - DNA, 19 bp, Homo sapiens
caaactctctagtgcagga

SEQ ID NO: 3647116 - DNA, 21 bp, Homo sapiens
caaactgaaattagtgttttc

SEQ ID NO: 3647117 - DNA, 21 bp, Homo sapiens
caaagaaacaaaatataaatc

SEQ ID NO: 3647118 - DNA, 13 bp, Homo sapiens
caaagtgaaatta

SEQ ID NO: 3647119 - DNA, 23 bp, Homo sapiens
caaagtgaaattagtattttgag

SEQ ID NO: 3647120 - DNA, 19 bp, Homo sapiens
caaagtgctgggattacag

SEQ ID NO: 3647121 - DNA, 17 bp, Homo sapiens
caaagtgttgtcttatt

SEQ ID NO: 3647122 - DNA, 21 bp, Homo sapiens
caaagtgttgtcttattccta

SEQ ID NO: 3647123 - DNA, 22 bp, Homo sapiens
caaatagcttttcacttcttaa

SEQ ID NO: 3647124 - DNA, 17 bp, Homo sapiens
caaatataacatgaaag

SEQ ID NO: 3647125 - DNA, 21 bp, Homo sapiens
caaatataacatgaaagtcaa

SEQ ID NO: 3647126 - DNA, 18 bp, Homo sapiens
caaatatactcatttgga

SEQ ID NO: 3647127 - DNA, 14 bp, Homo sapiens
caaatcactgaact

SEQ ID NO: 3647128 - DNA, 18 bp, Homo sapiens
caaattcagtggacattt

SEQ ID NO: 3647129 - DNA, 18 bp, Homo sapiens
caaattctgattattaca

SEQ ID NO: 3647130 - DNA, 16 bp, Homo sapiens
caacagaattgttctt

SEQ ID NO: 3647131 - DNA, 15 bp, Homo sapiens
caacagactgcctta

SEQ ID NO: 3647132 - DNA, 15 bp, Homo sapiens
caacatttggggaga

SEQ ID NO: 3647133 - DNA, 17 bp, Homo sapiens
caacccaggattcaaca

SEQ ID NO: 3647134 - DNA, 19 bp, Homo sapiens
caaccctggaaaaggagtt

SEQ ID NO: 3647135 - DNA, 19 bp, Homo sapiens
caaccttgtactttacaat

SEQ ID NO: 3647136 - DNA, 21 bp, Homo sapiens
caactgtggataaattttgga

SEQ ID NO: 3647137 - DNA, 16 bp, Homo sapiens
caagagcctgagactg

SEQ ID NO: 3647138 - DNA, 17 bp, Homo sapiens
caagctcatagcacatg

SEQ ID NO: 3647139 - DNA, 16 bp, Homo sapiens
caaggcctccagccac

SEQ ID NO: 3647140 - DNA, 16 bp, Homo sapiens
caagggcagtggaaga

SEQ ID NO: 3647141 - DNA, 16 bp, Homo sapiens
caaggtccggatgtca

SEQ ID NO: 3647142 - DNA, 12 bp, Homo sapiens
caagtctgtgaa

SEQ ID NO: 3647143 - DNA, 16 bp, Homo sapiens
caagtgtttctagtaa

SEQ ID NO: 3647144 - DNA, 21 bp, Homo sapiens
caagtgtttctagtaacagta

SEQ ID NO: 3647145 - DNA, 14 bp, Homo sapiens
caataagttgaatg

SEQ ID NO: 3647146 - DNA, 22 bp, Homo sapiens
caatattgctagaggtggcatg

SEQ ID NO: 3647147 - DNA, 17 bp, Homo sapiens
caatcaagagcttccag

SEQ ID NO: 3647148 - DNA, 20 bp, Homo sapiens
caatcaataaaaatggcatt

SEQ ID NO: 3647149 - DNA, 14 bp, Homo sapiens
caatgttaaatcta

SEQ ID NO: 3647150 - DNA, 20 bp, Homo sapiens
caattcttccctatctttgc

SEQ ID NO: 3647151 - DNA, 15 bp, Homo sapiens
caattgcttgagcat

SEQ ID NO: 3647152 - DNA, 17 bp, Homo sapiens
cacaaaagacaagcatt

SEQ ID NO: 3647153 - DNA, 20 bp, Homo sapiens
cacaaaagacaagcattggg

SEQ ID NO: 3647154 - DNA, 19 bp, Homo sapiens
cacaactgtggataaattt

SEQ ID NO: 3647155 - DNA, 21 bp, Homo sapiens
cacaagttctttcccagcctc

SEQ ID NO: 3647156 - DNA, 14 bp, Homo sapiens
cacaatcaataaaa

SEQ ID NO: 3647157 - DNA, 16 bp, Homo sapiens
cacacaaagtgaaatt

SEQ ID NO: 3647158 - DNA, 16 bp, Homo sapiens
cacacctaaattaaca

SEQ ID NO: 3647159 - DNA, 12 bp, Homo sapiens
cacacgcctgta

SEQ ID NO: 3647160 - DNA, 14 bp, Homo sapiens
cacacgcctgtaat

SEQ ID NO: 3647161 - DNA, 19 bp, Homo sapiens
cacactgggacttgcaaaa

SEQ ID NO: 3647162 - DNA, 19 bp, Homo sapiens
cacagtaagataggttctg

SEQ ID NO: 3647163 - DNA, 16 bp, Homo sapiens
cacatataaacacagt

SEQ ID NO: 3647164 - DNA, 12 bp, Homo sapiens
cacatttgttaa

SEQ ID NO: 3647165 - DNA, 15 bp, Homo sapiens
cacatttgttaatga

SEQ ID NO: 3647166 - DNA, 18 bp, Homo sapiens
cacccccgttagcttcct

SEQ ID NO: 3647167 - DNA, 13 bp, Homo sapiens
caccctcatgctg

SEQ ID NO: 3647168 - DNA, 21 bp, Homo sapiens
caccctcatgctgtgtgactc

SEQ ID NO: 3647169 - DNA, 15 bp, Homo sapiens
caccctgcccactcc

SEQ ID NO: 3647170 - DNA, 16 bp, Homo sapiens
cacggagtttccattt

SEQ ID NO: 3647171 - DNA, 20 bp, Homo sapiens
cactgaactttgctgagcct

SEQ ID NO: 3647172 - DNA, 15 bp, Homo sapiens
cactgagtctttctt

SEQ ID NO: 3647173 - DNA, 14 bp, Homo sapiens
cactgccaaacatc

SEQ ID NO: 3647174 - DNA, 14 bp, Homo sapiens
cacttatttccatg

SEQ ID NO: 3647175 - DNA, 13 bp, Homo sapiens
cacttccaccccc

SEQ ID NO: 3647176 - DNA, 20 bp, Homo sapiens
cacttcttaaggacagtgtt

SEQ ID NO: 3647177 - DNA, 14 bp, Homo sapiens
cactttacattctt

SEQ ID NO: 3647178 - DNA, 20 bp, Homo sapiens
cagaaacaccctcacactgg

SEQ ID NO: 3647179 - DNA, 15 bp, Homo sapiens
cagaacctttggaca

SEQ ID NO: 3647180 - DNA, 17 bp, Homo sapiens
cagaagcaaggaagtaa

SEQ ID NO: 3647181 - DNA, 18 bp, Homo sapiens
cagaagcaaggaagtaag

SEQ ID NO: 3647182 - DNA, 23 bp, Homo sapiens
cagaagtttaaatctttgttaaa

SEQ ID NO: 3647183 - DNA, 21 bp, Homo sapiens
cagaatgttgtgttggtattt

SEQ ID NO: 3647184 - DNA, 17 bp, Homo sapiens
cagacaggtgggagatg

SEQ ID NO: 3647185 - DNA, 21 bp, Homo sapiens
cagacaggtgggagatggagg

SEQ ID NO: 3647186 - DNA, 20 bp, Homo sapiens
cagaccttgcaatcacaaaa

SEQ ID NO: 3647187 - DNA, 12 bp, Homo sapiens
cagactgcctta

SEQ ID NO: 3647188 - DNA, 21 bp, Homo sapiens
cagagtatacaagtgtttcta

SEQ ID NO: 3647189 - DNA, 13 bp, Homo sapiens
cagatagatgtcg

SEQ ID NO: 3647190 - DNA, 20 bp, Homo sapiens
cagatggtgtcctgcatgta

SEQ ID NO: 3647191 - DNA, 15 bp, Homo sapiens
cagcacagtcttttc

SEQ ID NO: 3647192 - DNA, 16 bp, Homo sapiens
cagcacatttgttaat

SEQ ID NO: 3647193 - DNA, 22 bp, Homo sapiens
cagcagaggcaggaccagaagg

SEQ ID NO: 3647194 - DNA, 23 bp, Homo sapiens
cagcagaggcaggaccagaaggc

SEQ ID NO: 3647195 - DNA, 14 bp, Homo sapiens
cagcatgcatttag

SEQ ID NO: 3647196 - DNA, 21 bp, Homo sapiens
cagcccccactgcctttgacc

SEQ ID NO: 3647197 - DNA, 16 bp, Homo sapiens
cagccttgcccattct

SEQ ID NO: 3647198 - DNA, 15 bp, Homo sapiens
cagctaagcctgatg

SEQ ID NO: 3647199 - DNA, 17 bp, Homo sapiens
cagctaatttgtgaaag

SEQ ID NO: 3647200 - DNA, 17 bp, Homo sapiens
cagctctacgtcccaca

SEQ ID NO: 3647201 - DNA, 15 bp, Homo sapiens
cagctgagctggcct

SEQ ID NO: 3647202 - DNA, 13 bp, Homo sapiens
caggaaggaagca

SEQ ID NO: 3647203 - DNA, 14 bp, Homo sapiens
caggacatttgaca

SEQ ID NO: 3647204 - DNA, 13 bp, Homo sapiens
caggaccagaagg

SEQ ID NO: 3647205 - DNA, 14 bp, Homo sapiens
caggaccagaaggc

SEQ ID NO: 3647206 - DNA, 17 bp, Homo sapiens
caggaccagaaggcaat

SEQ ID NO: 3647207 - DNA, 17 bp, Homo sapiens
caggaggctgaggcagg

SEQ ID NO: 3647208 - DNA, 16 bp, Homo sapiens
caggcacggaggctcg

SEQ ID NO: 3647209 - DNA, 16 bp, Homo sapiens
cagggagagctgggca

SEQ ID NO: 3647210 - DNA, 17 bp, Homo sapiens
cagggagagctgggcag

SEQ ID NO: 3647211 - DNA, 23 bp, Homo sapiens
cagggagagctgggcagacaggt

SEQ ID NO: 3647212 - DNA, 11 bp, Homo sapiens
cagggcaagct

SEQ ID NO: 3647213 - DNA, 16 bp, Homo sapiens
caggggaggctgagac

SEQ ID NO: 3647214 - DNA, 16 bp, Homo sapiens
caggtgaccagaatga

SEQ ID NO: 3647215 - DNA, 17 bp, Homo sapiens
caggtgaccagaatgag

SEQ ID NO: 3647216 - DNA, 16 bp, Homo sapiens
caggtggatcatgagg

SEQ ID NO: 3647217 - DNA, 18 bp, Homo sapiens
caggtggcatttgcaggt

SEQ ID NO: 3647218 - DNA, 14 bp, Homo sapiens
caggttttatgaga

SEQ ID NO: 3647219 - DNA, 18 bp, Homo sapiens
cagtatagataaatccaa

SEQ ID NO: 3647220 - DNA, 13 bp, Homo sapiens
cagtcgaggctgg

SEQ ID NO: 3647221 - DNA, 14 bp, Homo sapiens
cagtctatgctgtg

SEQ ID NO: 3647222 - DNA, 13 bp, Homo sapiens
cagtctctatttg

SEQ ID NO: 3647223 - DNA, 15 bp, Homo sapiens
cagtctctatttgat

SEQ ID NO: 3647224 - DNA, 23 bp, Homo sapiens
cagtggacatttgttctgggtta

SEQ ID NO: 3647225 - DNA, 19 bp, Homo sapiens
cagtgttcaaattctgatt

SEQ ID NO: 3647226 - DNA, 16 bp, Homo sapiens
cagttacttacacacc

SEQ ID NO: 3647227 - DNA, 16 bp, Homo sapiens
cataattcagatttct

SEQ ID NO: 3647228 - DNA, 17 bp, Homo sapiens
catacagtctctatttg

SEQ ID NO: 3647229 - DNA, 18 bp, Homo sapiens
catagataccattttgaa

SEQ ID NO: 3647230 - DNA, 22 bp, Homo sapiens
catagataccattttgaaatat

SEQ ID NO: 3647231 - DNA, 14 bp, Homo sapiens
catagtggtatttt

SEQ ID NO: 3647232 - DNA, 15 bp, Homo sapiens
catataaacacagta

SEQ ID NO: 3647233 - DNA, 15 bp, Homo sapiens
catatagctttgcaa

SEQ ID NO: 3647234 - DNA, 18 bp, Homo sapiens
catataggggcaaaaatt

SEQ ID NO: 3647235 - DNA, 19 bp, Homo sapiens
catataggggcaaaaattt

SEQ ID NO: 3647236 - DNA, 23 bp, Homo sapiens
catatggcaacgttcatgttcat

SEQ ID NO: 3647237 - DNA, 15 bp, Homo sapiens
catatgtaggaaaat

SEQ ID NO: 3647238 - DNA, 18 bp, Homo sapiens
catatgtaggaaaatttt

SEQ ID NO: 3647239 - DNA, 21 bp, Homo sapiens
catatgtaggaaaattttctt

SEQ ID NO: 3647240 - DNA, 18 bp, Homo sapiens
catcaattgggttttgat

SEQ ID NO: 3647241 - DNA, 17 bp, Homo sapiens
catcagggtagcagcag

SEQ ID NO: 3647242 - DNA, 19 bp, Homo sapiens
catcagggtagcagcagag

SEQ ID NO: 3647243 - DNA, 12 bp, Homo sapiens
catcctggaaat

SEQ ID NO: 3647244 - DNA, 15 bp, Homo sapiens
catcgatttgtatta

SEQ ID NO: 3647245 - DNA, 14 bp, Homo sapiens
catcgggattgtct

SEQ ID NO: 3647246 - DNA, 20 bp, Homo sapiens
catctaaaccagaaggaagc

SEQ ID NO: 3647247 - DNA, 22 bp, Homo sapiens
catctaaaccagaaggaagccc

SEQ ID NO: 3647248 - DNA, 12 bp, Homo sapiens
catctacacata

SEQ ID NO: 3647249 - DNA, 23 bp, Homo sapiens
catctacacatataaacacagta

SEQ ID NO: 3647250 - DNA, 21 bp, Homo sapiens
catctcaggtggcatttgcag

SEQ ID NO: 3647251 - DNA, 23 bp, Homo sapiens
catctcaggtggcatttgcaggt

SEQ ID NO: 3647252 - DNA, 14 bp, Homo sapiens
catctgatttctga

SEQ ID NO: 3647253 - DNA, 12 bp, Homo sapiens
catctggaacca

SEQ ID NO: 3647254 - DNA, 16 bp, Homo sapiens
catgaaaagttttcaa

SEQ ID NO: 3647255 - DNA, 17 bp, Homo sapiens
catgaaaagttttcaag

SEQ ID NO: 3647256 - DNA, 21 bp, Homo sapiens
catgaaaagttttcaagcatt

SEQ ID NO: 3647257 - DNA, 21 bp, Homo sapiens
catgaatccatcgatttgtat

SEQ ID NO: 3647258 - DNA, 22 bp, Homo sapiens
catgacagtggttatatttcaa

SEQ ID NO: 3647259 - DNA, 15 bp, Homo sapiens
catgagttctgcaca

SEQ ID NO: 3647260 - DNA, 22 bp, Homo sapiens
catgagttctgcacatacagat

SEQ ID NO: 3647261 - DNA, 22 bp, Homo sapiens
catgcaagtgagaaagacatct

SEQ ID NO: 3647262 - DNA, 23 bp, Homo sapiens
catgcatttagcatgagttctgc

SEQ ID NO: 3647263 - DNA, 19 bp, Homo sapiens
catgcctacattagtgaga

SEQ ID NO: 3647264 - DNA, 19 bp, Homo sapiens
catgcctgtaatcccagca

SEQ ID NO: 3647265 - DNA, 14 bp, Homo sapiens
catgctgtgtgact

SEQ ID NO: 3647266 - DNA, 13 bp, Homo sapiens
catggaaagatgg

SEQ ID NO: 3647267 - DNA, 17 bp, Homo sapiens
catggtagactgtgaca

SEQ ID NO: 3647268 - DNA, 17 bp, Homo sapiens
catggtatcttgagtct

SEQ ID NO: 3647269 - DNA, 20 bp, Homo sapiens
catggtatcttgagtcttgg

SEQ ID NO: 3647270 - DNA, 16 bp, Homo sapiens
catgtatgttgcatga

SEQ ID NO: 3647271 - DNA, 17 bp, Homo sapiens
catgtatgttgcatgaa

SEQ ID NO: 3647272 - DNA, 17 bp, Homo sapiens
catgtgataattgtaaa

SEQ ID NO: 3647273 - DNA, 17 bp, Homo sapiens
catgtgctgctgtggca

SEQ ID NO: 3647274 - DNA, 16 bp, Homo sapiens
catgttaaaataatta

SEQ ID NO: 3647275 - DNA, 21 bp, Homo sapiens
catgttaaaataattatatga

SEQ ID NO: 3647276 - DNA, 14 bp, Homo sapiens
catgttttacaaag

SEQ ID NO: 3647277 - DNA, 19 bp, Homo sapiens
catgttttacaaagaaaca

SEQ ID NO: 3647278 - DNA, 21 bp, Homo sapiens
catgttttacaaagaaacaaa

SEQ ID NO: 3647279 - DNA, 19 bp, Homo sapiens
cattagagatgttgagtct

SEQ ID NO: 3647280 - DNA, 15 bp, Homo sapiens
cattcattccattct

SEQ ID NO: 3647281 - DNA, 16 bp, Homo sapiens
cattcattccattctg

SEQ ID NO: 3647282 - DNA, 16 bp, Homo sapiens
cattctggaagtgact

SEQ ID NO: 3647283 - DNA, 19 bp, Homo sapiens
cattgtgcccacttaccct

SEQ ID NO: 3647284 - DNA, 20 bp, Homo sapiens
catttagcatgagttctgca

SEQ ID NO: 3647285 - DNA, 13 bp, Homo sapiens
catttatgtgtga

SEQ ID NO: 3647286 - DNA, 15 bp, Homo sapiens
catttcacacaactg

SEQ ID NO: 3647287 - DNA, 15 bp, Homo sapiens
catttcccacttcca

SEQ ID NO: 3647288 - DNA, 19 bp, Homo sapiens
catttggatataaatctta

SEQ ID NO: 3647289 - DNA, 19 bp, Homo sapiens
catttggattttaaacaaa

SEQ ID NO: 3647290 - DNA, 22 bp, Homo sapiens
catttggattttaaacaaaatt

SEQ ID NO: 3647291 - DNA, 12 bp, Homo sapiens
catttggggaga

SEQ ID NO: 3647292 - DNA, 17 bp, Homo sapiens
cattttaatagtttcta

SEQ ID NO: 3647293 - DNA, 11 bp, Homo sapiens
cattttagaat

SEQ ID NO: 3647294 - DNA, 17 bp, Homo sapiens
cattttgatgtattatt

SEQ ID NO: 3647295 - DNA, 12 bp, Homo sapiens
catttttgagta

SEQ ID NO: 3647296 - DNA, 21 bp, Homo sapiens
ccaaagtgctgggattacagg

SEQ ID NO: 3647297 - DNA, 23 bp, Homo sapiens
ccaaatagcttttcacttcttaa

SEQ ID NO: 3647298 - DNA, 23 bp, Homo sapiens
ccaatagtctgccacaagggcag

SEQ ID NO: 3647299 - DNA, 15 bp, Homo sapiens
ccaatgacaggacat

SEQ ID NO: 3647300 - DNA, 18 bp, Homo sapiens
ccacaagttctttcccag

SEQ ID NO: 3647301 - DNA, 19 bp, Homo sapiens
ccacaagttctttcccagc

SEQ ID NO: 3647302 - DNA, 22 bp, Homo sapiens
ccacaagttctttcccagcctc

SEQ ID NO: 3647303 - DNA, 13 bp, Homo sapiens
ccacacttgtgtg

SEQ ID NO: 3647304 - DNA, 14 bp, Homo sapiens
ccaccctgcccact

SEQ ID NO: 3647305 - DNA, 15 bp, Homo sapiens
ccaccctgcccactc

SEQ ID NO: 3647306 - DNA, 22 bp, Homo sapiens
ccactgcctttgacctgcctcc

SEQ ID NO: 3647307 - DNA, 20 bp, Homo sapiens
ccagaagctcaaggctgcag

SEQ ID NO: 3647308 - DNA, 16 bp, Homo sapiens
ccagagttatttccca

SEQ ID NO: 3647309 - DNA, 20 bp, Homo sapiens
ccagatccttttccatccca

SEQ ID NO: 3647310 - DNA, 16 bp, Homo sapiens
ccagcactttgggagg

SEQ ID NO: 3647311 - DNA, 12 bp, Homo sapiens
ccagcctcactc

SEQ ID NO: 3647312 - DNA, 23 bp, Homo sapiens
ccagcctgcatctagctggagcc

SEQ ID NO: 3647313 - DNA, 20 bp, Homo sapiens
ccagctacaggggaggctga

SEQ ID NO: 3647314 - DNA, 23 bp, Homo sapiens
ccagcttttcccaaaagcccatt

SEQ ID NO: 3647315 - DNA, 22 bp, Homo sapiens
ccaggcatggaaagatggggag

SEQ ID NO: 3647316 - DNA, 13 bp, Homo sapiens
ccagggacaagct

SEQ ID NO: 3647317 - DNA, 23 bp, Homo sapiens
ccagggacatgtatgcttccagg

SEQ ID NO: 3647318 - DNA, 14 bp, Homo sapiens
ccagtcgaggctgg

SEQ ID NO: 3647319 - DNA, 18 bp, Homo sapiens
ccatcagaaacaccctca

SEQ ID NO: 3647320 - DNA, 20 bp, Homo sapiens
ccatcagaaacaccctcaca

SEQ ID NO: 3647321 - DNA, 12 bp, Homo sapiens
ccatcatttcat

SEQ ID NO: 3647322 - DNA, 14 bp, Homo sapiens
ccatcccactccac

SEQ ID NO: 3647323 - DNA, 18 bp, Homo sapiens
ccatcccgatgaacctgc

SEQ ID NO: 3647324 - DNA, 20 bp, Homo sapiens
ccatcccgatgaacctgcat

SEQ ID NO: 3647325 - DNA, 20 bp, Homo sapiens
ccatggattcccctggacat

SEQ ID NO: 3647326 - DNA, 19 bp, Homo sapiens
ccatgtatgttgcatgaat

SEQ ID NO: 3647327 - DNA, 15 bp, Homo sapiens
ccatgtgctgctgtg

SEQ ID NO: 3647328 - DNA, 13 bp, Homo sapiens
ccattacactcca

SEQ ID NO: 3647329 - DNA, 18 bp, Homo sapiens
ccattacactccagcctg

SEQ ID NO: 3647330 - DNA, 19 bp, Homo sapiens
ccattccctttcttttcat

SEQ ID NO: 3647331 - DNA, 17 bp, Homo sapiens
ccattctctaagcctgg

SEQ ID NO: 3647332 - DNA, 12 bp, Homo sapiens
ccattctgtgtg

SEQ ID NO: 3647333 - DNA, 16 bp, Homo sapiens
ccatttcccacttcca

SEQ ID NO: 3647334 - DNA, 17 bp, Homo sapiens
ccatttggattttaaac

SEQ ID NO: 3647335 - DNA, 17 bp, Homo sapiens
ccatttttgagtaaaac

SEQ ID NO: 3647336 - DNA, 11 bp, Homo sapiens
cccaccctgcc

SEQ ID NO: 3647337 - DNA, 14 bp, Homo sapiens
cccactgcctttga

SEQ ID NO: 3647338 - DNA, 22 bp, Homo sapiens
cccacttcctactgtaatagat

SEQ ID NO: 3647339 - DNA, 20 bp, Homo sapiens
cccagcctcactccatttcc

SEQ ID NO: 3647340 - DNA, 19 bp, Homo sapiens
cccagcctcttccattccc

SEQ ID NO: 3647341 - DNA, 21 bp, Homo sapiens
cccagctacaggggaggctga

SEQ ID NO: 3647342 - DNA, 20 bp, Homo sapiens
cccatcccgatgaacctgca

SEQ ID NO: 3647343 - DNA, 21 bp, Homo sapiens
cccatcccgatgaacctgcat

SEQ ID NO: 3647344 - DNA, 21 bp, Homo sapiens
cccatctaaaccagaaggaag

SEQ ID NO: 3647345 - DNA, 24 bp, Homo sapiens
cccattggaagaagaaccaggcat

SEQ ID NO: 3647346 - DNA, 16 bp, Homo sapiens
cccatttcacacaact

SEQ ID NO: 3647347 - DNA, 13 bp, Homo sapiens
ccccacttcctac

SEQ ID NO: 3647348 - DNA, 15 bp, Homo sapiens
ccccgttagcttcct

SEQ ID NO: 3647349 - DNA, 17 bp, Homo sapiens
ccccttcagaccttgca

SEQ ID NO: 3647350 - DNA, 18 bp, Homo sapiens
ccctaaacatagtggtat

SEQ ID NO: 3647351 - DNA, 16 bp, Homo sapiens
ccctatctttgccacc

SEQ ID NO: 3647352 - DNA, 21 bp, Homo sapiens
ccctatctttgccaccctcat

SEQ ID NO: 3647353 - DNA, 10 bp, Homo sapiens
ccctcacact

SEQ ID NO: 3647354 - DNA, 14 bp, Homo sapiens
ccctgaaccttcct

SEQ ID NO: 3647355 - DNA, 14 bp, Homo sapiens
ccctgggctggaga

SEQ ID NO: 3647356 - DNA, 19 bp, Homo sapiens
ccctgggctggagagttgg

SEQ ID NO: 3647357 - DNA, 17 bp, Homo sapiens
cccttcaaccccacttc

SEQ ID NO: 3647358 - DNA, 21 bp, Homo sapiens
ccctttcttttcatgcccatc

SEQ ID NO: 3647359 - DNA, 23 bp, Homo sapiens
ccctttcttttcatgcccatccc

SEQ ID NO: 3647360 - DNA, 19 bp, Homo sapiens
ccgaccagatccttttcca

SEQ ID NO: 3647361 - DNA, 11 bp, Homo sapiens
ccgatgatata

SEQ ID NO: 3647362 - DNA, 21 bp, Homo sapiens
cctaaacatagtggtatttta

SEQ ID NO: 3647363 - DNA, 22 bp, Homo sapiens
cctaaacatagtggtattttaa

SEQ ID NO: 3647364 - DNA, 20 bp, Homo sapiens
cctaaatcgtgatattgaaa

SEQ ID NO: 3647365 - DNA, 19 bp, Homo sapiens
cctaaggcagacaggaagg

SEQ ID NO: 3647366 - DNA, 22 bp, Homo sapiens
cctaaggcagacaggaaggaag

SEQ ID NO: 3647367 - DNA, 17 bp, Homo sapiens
cctaattcctgtatgtt

SEQ ID NO: 3647368 - DNA, 16 bp, Homo sapiens
cctaattctatgatta

SEQ ID NO: 3647369 - DNA, 15 bp, Homo sapiens
cctacggtacaagct

SEQ ID NO: 3647370 - DNA, 21 bp, Homo sapiens
cctagcactttgggaggctga

SEQ ID NO: 3647371 - DNA, 23 bp, Homo sapiens
cctatctggaaaaaaaaaaatat

SEQ ID NO: 3647372 - DNA, 15 bp, Homo sapiens
cctatctttgccacc

SEQ ID NO: 3647373 - DNA, 23 bp, Homo sapiens
cctattgctgtaaataaaaatag

SEQ ID NO: 3647374 - DNA, 23 bp, Homo sapiens
cctccaggcaaatgcccttcaaa

SEQ ID NO: 3647375 - DNA, 13 bp, Homo sapiens
cctcccaaaggct

SEQ ID NO: 3647376 - DNA, 18 bp, Homo sapiens
cctgaaccttcctgtctc

SEQ ID NO: 3647377 - DNA, 15 bp, Homo sapiens
cctgaattgaaagag

SEQ ID NO: 3647378 - DNA, 17 bp, Homo sapiens
cctgcatctagctggag

SEQ ID NO: 3647379 - DNA, 21 bp, Homo sapiens
cctgggaatctaagtgggaga

SEQ ID NO: 3647380 - DNA, 21 bp, Homo sapiens
cctgggcaacagagtgagacc

SEQ ID NO: 3647381 - DNA, 19 bp, Homo sapiens
cctgggcgaaagggtgaga

SEQ ID NO: 3647382 - DNA, 21 bp, Homo sapiens
cctgggtaacaaagtgagacc

SEQ ID NO: 3647383 - DNA, 17 bp, Homo sapiens
cctgtaatcccagcact

SEQ ID NO: 3647384 - DNA, 13 bp, Homo sapiens
cctgtctcccagg

SEQ ID NO: 3647385 - DNA, 21 bp, Homo sapiens
cctgtctctacaaaaaaaatc

SEQ ID NO: 3647386 - DNA, 20 bp, Homo sapiens
ccttaaaaagaccatgcatt

SEQ ID NO: 3647387 - DNA, 12 bp, Homo sapiens
ccttattaaaat

SEQ ID NO: 3647388 - DNA, 23 bp, Homo sapiens
ccttattaaaatattttcttaat

SEQ ID NO: 3647389 - DNA, 14 bp, Homo sapiens
ccttcaaccccact

SEQ ID NO: 3647390 - DNA, 14 bp, Homo sapiens
ccttcatctggaac

SEQ ID NO: 3647391 - DNA, 16 bp, Homo sapiens
ccttcctgtctcccag

SEQ ID NO: 3647392 - DNA, 22 bp, Homo sapiens
ccttctaatccatgtgctgctg

SEQ ID NO: 3647393 - DNA, 24 bp, Homo sapiens
ccttctgtaatactaagtcctcag

SEQ ID NO: 3647394 - DNA, 16 bp, Homo sapiens
cctttctctctttctt

SEQ ID NO: 3647395 - DNA, 22 bp, Homo sapiens
cctttgacctgcctcccttcat

SEQ ID NO: 3647396 - DNA, 20 bp, Homo sapiens
cctttggcaggtgcagcccc

SEQ ID NO: 3647397 - DNA, 12 bp, Homo sapiens
cgaggcaggtgg

SEQ ID NO: 3647398 - DNA, 18 bp, Homo sapiens
cgatcatatctgtatgcc

SEQ ID NO: 3647399 - DNA, 17 bp, Homo sapiens
cgatcattgtgcccact

SEQ ID NO: 3647400 - DNA, 17 bp, Homo sapiens
cgatttgtattaatgta

SEQ ID NO: 3647401 - DNA, 22 bp, Homo sapiens
cgcaaggatcacttgagcccag

SEQ ID NO: 3647402 - DNA, 18 bp, Homo sapiens
cggagtttccatttggat

SEQ ID NO: 3647403 - DNA, 19 bp, Homo sapiens
cgtgccattacactccagc

SEQ ID NO: 3647404 - DNA, 20 bp, Homo sapiens
cgtgccattacactccagcc

SEQ ID NO: 3647405 - DNA, 22 bp, Homo sapiens
cgtgccattacactccagcctg

SEQ ID NO: 3647406 - DNA, 17 bp, Homo sapiens
cgtgcccatttcacaca

SEQ ID NO: 3647407 - DNA, 20 bp, Homo sapiens
cgtgcccatttcacacaact

SEQ ID NO: 3647408 - DNA, 13 bp, Homo sapiens
cgtggactccagc

SEQ ID NO: 3647409 - DNA, 14 bp, Homo sapiens
cgtggactccagct

SEQ ID NO: 3647410 - DNA, 17 bp, Homo sapiens
cgttagcttcctgcagg

SEQ ID NO: 3647411 - DNA, 13 bp, Homo sapiens
ctaaaccagaagg

SEQ ID NO: 3647412 - DNA, 17 bp, Homo sapiens
ctaaaccagaaggaagc

SEQ ID NO: 3647413 - DNA, 13 bp, Homo sapiens
ctaaattaacaaa

SEQ ID NO: 3647414 - DNA, 13 bp, Homo sapiens
ctaaattaacttc

SEQ ID NO: 3647415 - DNA, 18 bp, Homo sapiens
ctaaattaacttctattt

SEQ ID NO: 3647416 - DNA, 15 bp, Homo sapiens
ctaacttattttgat

SEQ ID NO: 3647417 - DNA, 17 bp, Homo sapiens
ctaagaattcagtagca

SEQ ID NO: 3647418 - DNA, 19 bp, Homo sapiens
ctaagcctggcttagaagg

SEQ ID NO: 3647419 - DNA, 21 bp, Homo sapiens
ctaaggtcagtgttataaaat

SEQ ID NO: 3647420 - DNA, 23 bp, Homo sapiens
ctaagtcctcagagctccatgct

SEQ ID NO: 3647421 - DNA, 20 bp, Homo sapiens
ctaagtgggagacaatatta

SEQ ID NO: 3647422 - DNA, 21 bp, Homo sapiens
ctaatgtaaatattgctgtct

SEQ ID NO: 3647423 - DNA, 15 bp, Homo sapiens
ctaattctatgatta

SEQ ID NO: 3647424 - DNA, 23 bp, Homo sapiens
ctaatttgtgaaagtggcaagct

SEQ ID NO: 3647425 - DNA, 23 bp, Homo sapiens
ctacaaaaaaaatcaaaaaatta

SEQ ID NO: 3647426 - DNA, 16 bp, Homo sapiens
ctacaaaatgtgtgct

SEQ ID NO: 3647427 - DNA, 20 bp, Homo sapiens
ctacaaacttttataaatgt

SEQ ID NO: 3647428 - DNA, 22 bp, Homo sapiens
ctacaaacttttataaatgttt

SEQ ID NO: 3647429 - DNA, 16 bp, Homo sapiens
ctacaaatgaaaacaa

SEQ ID NO: 3647430 - DNA, 17 bp, Homo sapiens
ctacattagtgagattt

SEQ ID NO: 3647431 - DNA, 16 bp, Homo sapiens
ctagaatcagggtgga

SEQ ID NO: 3647432 - DNA, 20 bp, Homo sapiens
ctagcactttgggaggctga

SEQ ID NO: 3647433 - DNA, 15 bp, Homo sapiens
ctagctggagccccg

SEQ ID NO: 3647434 - DNA, 13 bp, Homo sapiens
ctatatttactgt

SEQ ID NO: 3647435 - DNA, 17 bp, Homo sapiens
ctatcagggcaagctca

SEQ ID NO: 3647436 - DNA, 24 bp, Homo sapiens
ctatcagggcaagctcatagcaca

SEQ ID NO: 3647437 - DNA, 20 bp, Homo sapiens
ctatccctggcttccccttc

SEQ ID NO: 3647438 - DNA, 13 bp, Homo sapiens
ctatctaacactt

SEQ ID NO: 3647439 - DNA, 18 bp, Homo sapiens
ctatctaacacttttgct

SEQ ID NO: 3647440 - DNA, 22 bp, Homo sapiens
ctatgattaaactgggaaatga

SEQ ID NO: 3647441 - DNA, 15 bp, Homo sapiens
ctatgctgttcattg

SEQ ID NO: 3647442 - DNA, 22 bp, Homo sapiens
ctattgctgtaaataaaaatag

SEQ ID NO: 3647443 - DNA, 14 bp, Homo sapiens
ctatttattaaaac

SEQ ID NO: 3647444 - DNA, 18 bp, Homo sapiens
ctattttttctgaggaat

SEQ ID NO: 3647445 - DNA, 14 bp, Homo sapiens
ctcaaggcctccag

SEQ ID NO: 3647446 - DNA, 21 bp, Homo sapiens
ctcaaggctgcagtgagccaa

SEQ ID NO: 3647447 - DNA, 18 bp, Homo sapiens
ctcaagttgtgtgctatt

SEQ ID NO: 3647448 - DNA, 17 bp, Homo sapiens
ctcactccatttcccac

SEQ ID NO: 3647449 - DNA, 22 bp, Homo sapiens
ctcagaagtgaaaaagacttca

SEQ ID NO: 3647450 - DNA, 15 bp, Homo sapiens
ctcagatctcatcag

SEQ ID NO: 3647451 - DNA, 22 bp, Homo sapiens
ctcagcaggctaagttgcgggg

SEQ ID NO: 3647452 - DNA, 17 bp, Homo sapiens
ctcagctactcaggagg

SEQ ID NO: 3647453 - DNA, 19 bp, Homo sapiens
ctcagctactcaggaggct

SEQ ID NO: 3647454 - DNA, 18 bp, Homo sapiens
ctcaggaggctgaggcag

SEQ ID NO: 3647455 - DNA, 19 bp, Homo sapiens
ctcaggaggctgaggcagg

SEQ ID NO: 3647456 - DNA, 15 bp, Homo sapiens
ctcagtatcttaaaa

SEQ ID NO: 3647457 - DNA, 15 bp, Homo sapiens
ctcatagcacatgtt

SEQ ID NO: 3647458 - DNA, 20 bp, Homo sapiens
ctcatagcacatgttttaca

SEQ ID NO: 3647459 - DNA, 21 bp, Homo sapiens
ctcatagcacatgttttacaa

SEQ ID NO: 3647460 - DNA, 21 bp, Homo sapiens
ctcatcagggtagcagcagag

SEQ ID NO: 3647461 - DNA, 14 bp, Homo sapiens
ctcatctacacata

SEQ ID NO: 3647462 - DNA, 13 bp, Homo sapiens
ctcatttcaggat

SEQ ID NO: 3647463 - DNA, 18 bp, Homo sapiens
ctcatttggatataaatc

SEQ ID NO: 3647464 - DNA, 12 bp, Homo sapiens
ctcattttattc

SEQ ID NO: 3647465 - DNA, 23 bp, Homo sapiens
ctccacagggacacagtctggtg

SEQ ID NO: 3647466 - DNA, 18 bp, Homo sapiens
ctccatttcccacttcca

SEQ ID NO: 3647467 - DNA, 13 bp, Homo sapiens
ctcccatcccttc

SEQ ID NO: 3647468 - DNA, 21 bp, Homo sapiens
ctccctcccttctttccttcc

SEQ ID NO: 3647469 - DNA, 19 bp, Homo sapiens
ctcccttcatgcatggaaa

SEQ ID NO: 3647470 - DNA, 14 bp, Homo sapiens
ctcgtgcatgtaat

SEQ ID NO: 3647471 - DNA, 16 bp, Homo sapiens
ctctatccctggcttc

SEQ ID NO: 3647472 - DNA, 14 bp, Homo sapiens
ctctctagtgcagg

SEQ ID NO: 3647473 - DNA, 15 bp, Homo sapiens
ctctctttcttttgt

SEQ ID NO: 3647474 - DNA, 14 bp, Homo sapiens
ctctgcaggcagcc

SEQ ID NO: 3647475 - DNA, 20 bp, Homo sapiens
ctctggaggtgttgtgggga

SEQ ID NO: 3647476 - DNA, 14 bp, Homo sapiens
ctctggtctacctg

SEQ ID NO: 3647477 - DNA, 15 bp, Homo sapiens
ctctttcttttgtgc

SEQ ID NO: 3647478 - DNA, 16 bp, Homo sapiens
ctctttgttggaagaa

SEQ ID NO: 3647479 - DNA, 16 bp, Homo sapiens
ctgaaaaagtgttttt

SEQ ID NO: 3647480 - DNA, 21 bp, Homo sapiens
ctgaaaaagtgtttttacata

SEQ ID NO: 3647481 - DNA, 17 bp, Homo sapiens
ctgaaattagtgttttc

SEQ ID NO: 3647482 - DNA, 21 bp, Homo sapiens
ctgaaccttcctgtctcccag

SEQ ID NO: 3647483 - DNA, 20 bp, Homo sapiens
ctgaactatcagggcaagct

SEQ ID NO: 3647484 - DNA, 21 bp, Homo sapiens
ctgaactttgctgagcctgta

SEQ ID NO: 3647485 - DNA, 16 bp, Homo sapiens
ctgaagaaacacagca

SEQ ID NO: 3647486 - DNA, 18 bp, Homo sapiens
ctgaagggaagcccagcc

SEQ ID NO: 3647487 - DNA, 20 bp, Homo sapiens
ctgaagggaagcccagcctg

SEQ ID NO: 3647488 - DNA, 23 bp, Homo sapiens
ctgaattgaaagagaatttggag

SEQ ID NO: 3647489 - DNA, 17 bp, Homo sapiens
ctgaggaaaatggaaga

SEQ ID NO: 3647490 - DNA, 20 bp, Homo sapiens
ctgaggaaaatggaagacct

SEQ ID NO: 3647491 - DNA, 21 bp, Homo sapiens
ctgatacatctgtcagtgagt

SEQ ID NO: 3647492 - DNA, 22 bp, Homo sapiens
ctgatagaagaaggactgaaga

SEQ ID NO: 3647493 - DNA, 19 bp, Homo sapiens
ctgattattacaacaagca

SEQ ID NO: 3647494 - DNA, 23 bp, Homo sapiens
ctgattattacaacaagcaaact

SEQ ID NO: 3647495 - DNA, 14 bp, Homo sapiens
ctgcaacctccgca

SEQ ID NO: 3647496 - DNA, 13 bp, Homo sapiens
ctgcaatgtctgt

SEQ ID NO: 3647497 - DNA, 15 bp, Homo sapiens
ctgcagctaatttgt

SEQ ID NO: 3647498 - DNA, 20 bp, Homo sapiens
ctgccaagccaaccctggaa

SEQ ID NO: 3647499 - DNA, 14 bp, Homo sapiens
ctgcctcccttcat

SEQ ID NO: 3647500 - DNA, 23 bp, Homo sapiens
ctgcctcccttcatgcatggaaa

SEQ ID NO: 3647501 - DNA, 22 bp, Homo sapiens
ctgctatgctgttcattgatga

SEQ ID NO: 3647502 - DNA, 17 bp, Homo sapiens
ctgctcatctacacata

SEQ ID NO: 3647503 - DNA, 18 bp, Homo sapiens
ctgctctctaagaattca

SEQ ID NO: 3647504 - DNA, 23 bp, Homo sapiens
ctgctgtggcatcaggaaaggaa

SEQ ID NO: 3647505 - DNA, 19 bp, Homo sapiens
ctgctttctgatacatctg

SEQ ID NO: 3647506 - DNA, 14 bp, Homo sapiens
ctggaaatttgtgt

SEQ ID NO: 3647507 - DNA, 15 bp, Homo sapiens
ctggaagtgactttg

SEQ ID NO: 3647508 - DNA, 18 bp, Homo sapiens
ctggaagtgactttggct

SEQ ID NO: 3647509 - DNA, 14 bp, Homo sapiens
ctggaggaaggaaa

SEQ ID NO: 3647510 - DNA, 23 bp, Homo sapiens
ctggaggaaggaaacaacaaagg

SEQ ID NO: 3647511 - DNA, 17 bp, Homo sapiens
ctggaggtgttgtgggg

SEQ ID NO: 3647512 - DNA, 21 bp, Homo sapiens
ctggcttccccttcagacctt

SEQ ID NO: 3647513 - DNA, 17 bp, Homo sapiens
ctgggaatctaagtggg

SEQ ID NO: 3647514 - DNA, 18 bp, Homo sapiens
ctgggaatgtcctgtaga

SEQ ID NO: 3647515 - DNA, 19 bp, Homo sapiens
ctgggcagacaggtgggag

SEQ ID NO: 3647516 - DNA, 17 bp, Homo sapiens
ctgggcgaaagggtgag

SEQ ID NO: 3647517 - DNA, 19 bp, Homo sapiens
ctgggtgcggtggctcatg

SEQ ID NO: 3647518 - DNA, 14 bp, Homo sapiens
ctgggttaacagta

SEQ ID NO: 3647519 - DNA, 17 bp, Homo sapiens
ctggtctacctgagatc

SEQ ID NO: 3647520 - DNA, 18 bp, Homo sapiens
ctgtaaataaaaatagct

SEQ ID NO: 3647521 - DNA, 19 bp, Homo sapiens
ctgtaatagatcagcatcc

SEQ ID NO: 3647522 - DNA, 17 bp, Homo sapiens
ctgtaatcccagcactt

SEQ ID NO: 3647523 - DNA, 19 bp, Homo sapiens
ctgtagagagagacctaga

SEQ ID NO: 3647524 - DNA, 14 bp, Homo sapiens
ctgtatcatttctt

SEQ ID NO: 3647525 - DNA, 19 bp, Homo sapiens
ctgtctataggacttaatt

SEQ ID NO: 3647526 - DNA, 20 bp, Homo sapiens
ctgtctctacaaaaaaaatc

SEQ ID NO: 3647527 - DNA, 18 bp, Homo sapiens
ctgtgaaagtctcctgta

SEQ ID NO: 3647528 - DNA, 16 bp, Homo sapiens
ctgtgaaatgactgca

SEQ ID NO: 3647529 - DNA, 13 bp, Homo sapiens
ctgtgaggaagag

SEQ ID NO: 3647530 - DNA, 17 bp, Homo sapiens
ctgtgaggaagaggttg

SEQ ID NO: 3647531 - DNA, 14 bp, Homo sapiens
ctgtgttctcaaca

SEQ ID NO: 3647532 - DNA, 20 bp, Homo sapiens
ctgtgttctcaacacacagt

SEQ ID NO: 3647533 - DNA, 21 bp, Homo sapiens
ctgtgttctcaacacacagta

SEQ ID NO: 3647534 - DNA, 18 bp, Homo sapiens
ctgttctgaaagggatgg

SEQ ID NO: 3647535 - DNA, 14 bp, Homo sapiens
ctgttgaagtgcat

SEQ ID NO: 3647536 - DNA, 17 bp, Homo sapiens
ctgttgaagtgcatgtt

SEQ ID NO: 3647537 - DNA, 22 bp, Homo sapiens
cttaaaattggttaatgaaaaa

SEQ ID NO: 3647538 - DNA, 15 bp, Homo sapiens
cttaactaatgtaaa

SEQ ID NO: 3647539 - DNA, 16 bp, Homo sapiens
cttaactaatgtaaat

SEQ ID NO: 3647540 - DNA, 16 bp, Homo sapiens
cttaaggacagtgttc

SEQ ID NO: 3647541 - DNA, 21 bp, Homo sapiens
cttaatttagcagtccatttt

SEQ ID NO: 3647542 - DNA, 16 bp, Homo sapiens
cttacacacctgagaa

SEQ ID NO: 3647543 - DNA, 16 bp, Homo sapiens
cttaccctgggctgga

SEQ ID NO: 3647544 - DNA, 16 bp, Homo sapiens
cttaccgaaatgaaaa

SEQ ID NO: 3647545 - DNA, 13 bp, Homo sapiens
cttagaaggcact

SEQ ID NO: 3647546 - DNA, 11 bp, Homo sapiens
cttagaatgtg

SEQ ID NO: 3647547 - DNA, 12 bp, Homo sapiens
cttagaatgtga

SEQ ID NO: 3647548 - DNA, 18 bp, Homo sapiens
cttaggtggcagggctgt

SEQ ID NO: 3647549 - DNA, 23 bp, Homo sapiens
cttaggtggcagggctgttccct

SEQ ID NO: 3647550 - DNA, 18 bp, Homo sapiens
cttagtaaattcctaatt

SEQ ID NO: 3647551 - DNA, 17 bp, Homo sapiens
cttatattattttctgt

SEQ ID NO: 3647552 - DNA, 18 bp, Homo sapiens
cttatattattttctgta

SEQ ID NO: 3647553 - DNA, 13 bp, Homo sapiens
cttattaaaatat

SEQ ID NO: 3647554 - DNA, 16 bp, Homo sapiens
cttcaaacgaaatggc

SEQ ID NO: 3647555 - DNA, 17 bp, Homo sapiens
cttcaaccccacttcct

SEQ ID NO: 3647556 - DNA, 13 bp, Homo sapiens
cttcacacaaagt

SEQ ID NO: 3647557 - DNA, 16 bp, Homo sapiens
cttcagggagagctgg

SEQ ID NO: 3647558 - DNA, 13 bp, Homo sapiens
cttcatctggaac

SEQ ID NO: 3647559 - DNA, 15 bp, Homo sapiens
cttcatgcatggaaa

SEQ ID NO: 3647560 - DNA, 22 bp, Homo sapiens
cttccacccccgttagcttcct

SEQ ID NO: 3647561 - DNA, 13 bp, Homo sapiens
cttccactgagtc

SEQ ID NO: 3647562 - DNA, 16 bp, Homo sapiens
cttccactgagtcttt

SEQ ID NO: 3647563 - DNA, 16 bp, Homo sapiens
cttccataattcagat

SEQ ID NO: 3647564 - DNA, 14 bp, Homo sapiens
cttccccttcagac

SEQ ID NO: 3647565 - DNA, 17 bp, Homo sapiens
cttccctatctttgcca

SEQ ID NO: 3647566 - DNA, 21 bp, Homo sapiens
cttcctattaatttattaaat

SEQ ID NO: 3647567 - DNA, 22 bp, Homo sapiens
cttcctattaatttattaaatt

SEQ ID NO: 3647568 - DNA, 15 bp, Homo sapiens
cttcctgtctcccag

SEQ ID NO: 3647569 - DNA, 13 bp, Homo sapiens
cttccttcttccc

SEQ ID NO: 3647570 - DNA, 23 bp, Homo sapiens
cttctaaaggtttcactgttcat

SEQ ID NO: 3647571 - DNA, 22 bp, Homo sapiens
cttctggtgagtgcaagagcct

SEQ ID NO: 3647572 - DNA, 18 bp, Homo sapiens
cttctttaatttttctgt

SEQ ID NO: 3647573 - DNA, 16 bp, Homo sapiens
cttctttccttccttt

SEQ ID NO: 3647574 - DNA, 19 bp, Homo sapiens
cttgacagttacttacaca

SEQ ID NO: 3647575 - DNA, 22 bp, Homo sapiens
cttgacagttacttacacacct

SEQ ID NO: 3647576 - DNA, 13 bp, Homo sapiens
cttgagcatgccc

SEQ ID NO: 3647577 - DNA, 16 bp, Homo sapiens
cttgcaaaaagggtca

SEQ ID NO: 3647578 - DNA, 15 bp, Homo sapiens
cttggtctgtgttct

SEQ ID NO: 3647579 - DNA, 19 bp, Homo sapiens
ctttatgaaaaaaaaagaa

SEQ ID NO: 3647580 - DNA, 17 bp, Homo sapiens
ctttcccagcctcttcc

SEQ ID NO: 3647581 - DNA, 16 bp, Homo sapiens
ctttcccttactccct

SEQ ID NO: 3647582 - DNA, 21 bp, Homo sapiens
ctttccttccttttttccttt

SEQ ID NO: 3647583 - DNA, 22 bp, Homo sapiens
ctttctctctttcttttgtgca

SEQ ID NO: 3647584 - DNA, 14 bp, Homo sapiens
ctttcttccttcct

SEQ ID NO: 3647585 - DNA, 16 bp, Homo sapiens
ctttcttccttccttt

SEQ ID NO: 3647586 - DNA, 12 bp, Homo sapiens
ctttctttccct

SEQ ID NO: 3647587 - DNA, 14 bp, Homo sapiens
ctttgacctgcctc

SEQ ID NO: 3647588 - DNA, 18 bp, Homo sapiens
ctttgacctgcctccctt

SEQ ID NO: 3647589 - DNA, 20 bp, Homo sapiens
ctttgacctgcctcccttca

SEQ ID NO: 3647590 - DNA, 22 bp, Homo sapiens
ctttgcaaccttgtactttaca

SEQ ID NO: 3647591 - DNA, 15 bp, Homo sapiens
ctttggacaagagga

SEQ ID NO: 3647592 - DNA, 17 bp, Homo sapiens
ctttggacaagaggaaa

SEQ ID NO: 3647593 - DNA, 24 bp, Homo sapiens
ctttggcaggtgcagcccccactg

SEQ ID NO: 3647594 - DNA, 14 bp, Homo sapiens
ctttggctgcatgc

SEQ ID NO: 3647595 - DNA, 18 bp, Homo sapiens
ctttgggaggccgaggca

SEQ ID NO: 3647596 - DNA, 13 bp, Homo sapiens
ctttgggaggctg

SEQ ID NO: 3647597 - DNA, 13 bp, Homo sapiens
ctttgtcaaatgg

SEQ ID NO: 3647598 - DNA, 12 bp, Homo sapiens
cttttataaatg

SEQ ID NO: 3647599 - DNA, 21 bp, Homo sapiens
cttttataaatgttttaaaga

SEQ ID NO: 3647600 - DNA, 15 bp, Homo sapiens
cttttcacttcttaa

SEQ ID NO: 3647601 - DNA, 19 bp, Homo sapiens
cttttcaggcactttagaa

SEQ ID NO: 3647602 - DNA, 16 bp, Homo sapiens
cttttccatcccactc

SEQ ID NO: 3647603 - DNA, 20 bp, Homo sapiens
cttttccatcccactccact

SEQ ID NO: 3647604 - DNA, 21 bp, Homo sapiens
cttttgacgtcttaggtggca

SEQ ID NO: 3647605 - DNA, 17 bp, Homo sapiens
gaaaaaaaaagaaatct

SEQ ID NO: 3647606 - DNA, 14 bp, Homo sapiens
gaaaaaactggaaa

SEQ ID NO: 3647607 - DNA, 18 bp, Homo sapiens
gaaaaagtgtttttacat

SEQ ID NO: 3647608 - DNA, 16 bp, Homo sapiens
gaaaaatctgaatttc

SEQ ID NO: 3647609 - DNA, 18 bp, Homo sapiens
gaaaagttttcaagcatt

SEQ ID NO: 3647610 - DNA, 14 bp, Homo sapiens
gaaaatggaagacc

SEQ ID NO: 3647611 - DNA, 19 bp, Homo sapiens
gaaaattttattgaatata

SEQ ID NO: 3647612 - DNA, 22 bp, Homo sapiens
gaaacaaatatactcatttgga

SEQ ID NO: 3647613 - DNA, 16 bp, Homo sapiens
gaaacaacaaaggaag

SEQ ID NO: 3647614 - DNA, 18 bp, Homo sapiens
gaaacacagcatgcattt

SEQ ID NO: 3647615 - DNA, 18 bp, Homo sapiens
gaaacaccctcacactgg

SEQ ID NO: 3647616 - DNA, 18 bp, Homo sapiens
gaaacacggagtttccat

SEQ ID NO: 3647617 - DNA, 23 bp, Homo sapiens
gaaacacggagtttccatttgga

SEQ ID NO: 3647618 - DNA, 17 bp, Homo sapiens
gaaactcatacagtctc

SEQ ID NO: 3647619 - DNA, 18 bp, Homo sapiens
gaaactttggaagtttta

SEQ ID NO: 3647620 - DNA, 20 bp, Homo sapiens
gaaactttggaagttttact

SEQ ID NO: 3647621 - DNA, 22 bp, Homo sapiens
gaaagatggggagctctggagg

SEQ ID NO: 3647622 - DNA, 21 bp, Homo sapiens
gaaagtcaagtctacctgcct

SEQ ID NO: 3647623 - DNA, 21 bp, Homo sapiens
gaaataacgggtggcattggg

SEQ ID NO: 3647624 - DNA, 16 bp, Homo sapiens
gaaatataaaaataat

SEQ ID NO: 3647625 - DNA, 17 bp, Homo sapiens
gaaatgaaaatggctga

SEQ ID NO: 3647626 - DNA, 14 bp, Homo sapiens
gaaattagtgtttt

SEQ ID NO: 3647627 - DNA, 21 bp, Homo sapiens
gaaattagtgttttcattctg

SEQ ID NO: 3647628 - DNA, 15 bp, Homo sapiens
gaacaaactcagatc

SEQ ID NO: 3647629 - DNA, 20 bp, Homo sapiens
gaacaaactcagatctcatc

SEQ ID NO: 3647630 - DNA, 15 bp, Homo sapiens
gaaccaggcatggaa

SEQ ID NO: 3647631 - DNA, 21 bp, Homo sapiens
gaacctgtgaggaagaggttg

SEQ ID NO: 3647632 - DNA, 15 bp, Homo sapiens
gaagaaacacagcat

SEQ ID NO: 3647633 - DNA, 19 bp, Homo sapiens
gaagaaacacagcatgcat

SEQ ID NO: 3647634 - DNA, 18 bp, Homo sapiens
gaagaagaaccaggcatg

SEQ ID NO: 3647635 - DNA, 20 bp, Homo sapiens
gaagaagaaccaggcatgga

SEQ ID NO: 3647636 - DNA, 14 bp, Homo sapiens
gaagaattcatgat

SEQ ID NO: 3647637 - DNA, 21 bp, Homo sapiens
gaagacctaaggcagacagga

SEQ ID NO: 3647638 - DNA, 22 bp, Homo sapiens
gaagacctaaggcagacaggaa

SEQ ID NO: 3647639 - DNA, 12 bp, Homo sapiens
gaagagaaagac

SEQ ID NO: 3647640 - DNA, 23 bp, Homo sapiens
gaagaggttgcagtgagctgaga

SEQ ID NO: 3647641 - DNA, 14 bp, Homo sapiens
gaagcaaggaagta

SEQ ID NO: 3647642 - DNA, 12 bp, Homo sapiens
gaagcagaatga

SEQ ID NO: 3647643 - DNA, 13 bp, Homo sapiens
gaagcccagcctg

SEQ ID NO: 3647644 - DNA, 15 bp, Homo sapiens
gaagctcaaggctgc

SEQ ID NO: 3647645 - DNA, 17 bp, Homo sapiens
gaaggaaacaacaaagg

SEQ ID NO: 3647646 - DNA, 15 bp, Homo sapiens
gaaggactgaagaaa

SEQ ID NO: 3647647 - DNA, 13 bp, Homo sapiens
gaagtgactttgg

SEQ ID NO: 3647648 - DNA, 15 bp, Homo sapiens
gaagtgactttggct

SEQ ID NO: 3647649 - DNA, 12 bp, Homo sapiens
gaagtgcatgtt

SEQ ID NO: 3647650 - DNA, 19 bp, Homo sapiens
gaagttccctgaaccttcc

SEQ ID NO: 3647651 - DNA, 13 bp, Homo sapiens
gaagtttaaatct

SEQ ID NO: 3647652 - DNA, 22 bp, Homo sapiens
gaagttttacttgattaaggac

SEQ ID NO: 3647653 - DNA, 19 bp, Homo sapiens
gaataccccaccagcagaa

SEQ ID NO: 3647654 - DNA, 16 bp, Homo sapiens
gaatcaagtctgtgaa

SEQ ID NO: 3647655 - DNA, 17 bp, Homo sapiens
gaatcagggtggagaag

SEQ ID NO: 3647656 - DNA, 16 bp, Homo sapiens
gaatgtcctgtagaga

SEQ ID NO: 3647657 - DNA, 17 bp, Homo sapiens
gaattatcttggatgag

SEQ ID NO: 3647658 - DNA, 23 bp, Homo sapiens
gaattcagtagcattttaatagt

SEQ ID NO: 3647659 - DNA, 16 bp, Homo sapiens
gacaagcttaggtcat

SEQ ID NO: 3647660 - DNA, 19 bp, Homo sapiens
gacacagctgagctggcct

SEQ ID NO: 3647661 - DNA, 21 bp, Homo sapiens
gacacgtgcaacagactgcct

SEQ ID NO: 3647662 - DNA, 17 bp, Homo sapiens
gacagtggttatatttc

SEQ ID NO: 3647663 - DNA, 13 bp, Homo sapiens
gacagttacttac

SEQ ID NO: 3647664 - DNA, 22 bp, Homo sapiens
gacatctgaggaaaatggaaga

SEQ ID NO: 3647665 - DNA, 19 bp, Homo sapiens
gacatgagtctccagatag

SEQ ID NO: 3647666 - DNA, 21 bp, Homo sapiens
gaccagatccttttccatccc

SEQ ID NO: 3647667 - DNA, 22 bp, Homo sapiens
gacctaaggcagacaggaagga

SEQ ID NO: 3647668 - DNA, 23 bp, Homo sapiens
gacctaaggcagacaggaaggaa

SEQ ID NO: 3647669 - DNA, 11 bp, Homo sapiens
gacctgcctcc

SEQ ID NO: 3647670 - DNA, 19 bp, Homo sapiens
gaccttcagggagagctgg

SEQ ID NO: 3647671 - DNA, 18 bp, Homo sapiens
gaccttttgtaagacatt

SEQ ID NO: 3647672 - DNA, 17 bp, Homo sapiens
gacggggtttcatcatg

SEQ ID NO: 3647673 - DNA, 14 bp, Homo sapiens
gactacagaagtgg

SEQ ID NO: 3647674 - DNA, 23 bp, Homo sapiens
gactcagagggaaggctctctgg

SEQ ID NO: 3647675 - DNA, 15 bp, Homo sapiens
gacttaatttagcag

SEQ ID NO: 3647676 - DNA, 21 bp, Homo sapiens
gacttcctattaatttattaa

SEQ ID NO: 3647677 - DNA, 23 bp, Homo sapiens
gacttgtctcccagtcgaggctg

SEQ ID NO: 3647678 - DNA, 16 bp, Homo sapiens
gactttcctatgacac

SEQ ID NO: 3647679 - DNA, 19 bp, Homo sapiens
gactttggctgcatgcgag

SEQ ID NO: 3647680 - DNA, 24 bp, Homo sapiens
gagaaaaaaaaagccactaaggtc

SEQ ID NO: 3647681 - DNA, 16 bp, Homo sapiens
gagagataatgaggca

SEQ ID NO: 3647682 - DNA, 18 bp, Homo sapiens
gagagataatgaggcaac

SEQ ID NO: 3647683 - DNA, 14 bp, Homo sapiens
gagagctgggcaga

SEQ ID NO: 3647684 - DNA, 15 bp, Homo sapiens
gagagctgggcagac

SEQ ID NO: 3647685 - DNA, 19 bp, Homo sapiens
gagagctgggcagacaggt

SEQ ID NO: 3647686 - DNA, 17 bp, Homo sapiens
gagataatgaggcaact

SEQ ID NO: 3647687 - DNA, 15 bp, Homo sapiens
gagatggaggtaggg

SEQ ID NO: 3647688 - DNA, 23 bp, Homo sapiens
gagcatgcccaaatataacatga

SEQ ID NO: 3647689 - DNA, 18 bp, Homo sapiens
gagccaggatgggtctcc

SEQ ID NO: 3647690 - DNA, 15 bp, Homo sapiens
gagctgctgtatttg

SEQ ID NO: 3647691 - DNA, 11 bp, Homo sapiens
gaggaaggaaa

SEQ ID NO: 3647692 - DNA, 23 bp, Homo sapiens
gaggaaggaaacaacaaaggaag

SEQ ID NO: 3647693 - DNA, 13 bp, Homo sapiens
gaggcacatgaca

SEQ ID NO: 3647694 - DNA, 15 bp, Homo sapiens
gaggcaggaccagaa

SEQ ID NO: 3647695 - DNA, 19 bp, Homo sapiens
gaggcaggaccagaaggca

SEQ ID NO: 3647696 - DNA, 15 bp, Homo sapiens
gaggccgaggcaggt

SEQ ID NO: 3647697 - DNA, 14 bp, Homo sapiens
gaggcgagcctggc

SEQ ID NO: 3647698 - DNA, 12 bp, Homo sapiens
gaggctgaggca

SEQ ID NO: 3647699 - DNA, 18 bp, Homo sapiens
gaggtgttgtggggatgg

SEQ ID NO: 3647700 - DNA, 19 bp, Homo sapiens
gagtaaaacttgtattgga

SEQ ID NO: 3647701 - DNA, 17 bp, Homo sapiens
gagtatacaagtgtttc

SEQ ID NO: 3647702 - DNA, 13 bp, Homo sapiens
gagtgcaagagcc

SEQ ID NO: 3647703 - DNA, 18 bp, Homo sapiens
gagttcgaggcgagcctg

SEQ ID NO: 3647704 - DNA, 21 bp, Homo sapiens
gagtttccatttggattttaa

SEQ ID NO: 3647705 - DNA, 17 bp, Homo sapiens
gataattaaatgaaata

SEQ ID NO: 3647706 - DNA, 22 bp, Homo sapiens
gatagctttctttcccttactc

SEQ ID NO: 3647707 - DNA, 20 bp, Homo sapiens
gatatgagaaatataaaaat

SEQ ID NO: 3647708 - DNA, 13 bp, Homo sapiens
gatatgtctttaa

SEQ ID NO: 3647709 - DNA, 16 bp, Homo sapiens
gatcatgaggtcagga

SEQ ID NO: 3647710 - DNA, 17 bp, Homo sapiens
gatcccagagttatttc

SEQ ID NO: 3647711 - DNA, 23 bp, Homo sapiens
gatccgcccgcctcagcatccca

SEQ ID NO: 3647712 - DNA, 21 bp, Homo sapiens
gatctcagcatcctggaaatt

SEQ ID NO: 3647713 - DNA, 17 bp, Homo sapiens
gatgaccccatagacct

SEQ ID NO: 3647714 - DNA, 16 bp, Homo sapiens
gatgatttaattctta

SEQ ID NO: 3647715 - DNA, 21 bp, Homo sapiens
gatgggcaatcctgggctggc

SEQ ID NO: 3647716 - DNA, 14 bp, Homo sapiens
gatgtattattata

SEQ ID NO: 3647717 - DNA, 19 bp, Homo sapiens
gatgtcgtggactccagct

SEQ ID NO: 3647718 - DNA, 16 bp, Homo sapiens
gattaaactgggaaat

SEQ ID NO: 3647719 - DNA, 18 bp, Homo sapiens
gattaaggactacagaat

SEQ ID NO: 3647720 - DNA, 18 bp, Homo sapiens
gattaatgacctgaattg

SEQ ID NO: 3647721 - DNA, 15 bp, Homo sapiens
gattaattggagatt

SEQ ID NO: 3647722 - DNA, 14 bp, Homo sapiens
gattacagaaacac

SEQ ID NO: 3647723 - DNA, 16 bp, Homo sapiens
gattacaggcatgagc

SEQ ID NO: 3647724 - DNA, 15 bp, Homo sapiens
gcaaaaatttgacat

SEQ ID NO: 3647725 - DNA, 14 bp, Homo sapiens
gcaaactgaaatta

SEQ ID NO: 3647726 - DNA, 19 bp, Homo sapiens
gcaaactgaaattagtgtt

SEQ ID NO: 3647727 - DNA, 18 bp, Homo sapiens
gcaaagtgttgtcttatt

SEQ ID NO: 3647728 - DNA, 22 bp, Homo sapiens
gcaaatttctagatatgagaaa

SEQ ID NO: 3647729 - DNA, 12 bp, Homo sapiens
gcaacactgcca

SEQ ID NO: 3647730 - DNA, 14 bp, Homo sapiens
gcaaccttgtactt

SEQ ID NO: 3647731 - DNA, 21 bp, Homo sapiens
gcaagagcctgagactggaaa

SEQ ID NO: 3647732 - DNA, 20 bp, Homo sapiens
gcaagctcatagcacatgtt

SEQ ID NO: 3647733 - DNA, 22 bp, Homo sapiens
gcaagctcatagcacatgtttt

SEQ ID NO: 3647734 - DNA, 14 bp, Homo sapiens
gcaagtgagaaaga

SEQ ID NO: 3647735 - DNA, 14 bp, Homo sapiens
gcaataagttgaat

SEQ ID NO: 3647736 - DNA, 20 bp, Homo sapiens
gcacacaactgtggtcccag

SEQ ID NO: 3647737 - DNA, 14 bp, Homo sapiens
gcacacgcctgtaa

SEQ ID NO: 3647738 - DNA, 13 bp, Homo sapiens
gcacatgttttac

SEQ ID NO: 3647739 - DNA, 21 bp, Homo sapiens
gcacatttgttaatgattctt

SEQ ID NO: 3647740 - DNA, 15 bp, Homo sapiens
gcacgcctgccttct

SEQ ID NO: 3647741 - DNA, 19 bp, Homo sapiens
gcactcttttgagcagtaa

SEQ ID NO: 3647742 - DNA, 23 bp, Homo sapiens
gcactttgggaggccgaggcagg

SEQ ID NO: 3647743 - DNA, 16 bp, Homo sapiens
gcactttgggaggctg

SEQ ID NO: 3647744 - DNA, 21 bp, Homo sapiens
gcagaacaaactcagatctca

SEQ ID NO: 3647745 - DNA, 18 bp, Homo sapiens
gcagaatgagatgattta

SEQ ID NO: 3647746 - DNA, 18 bp, Homo sapiens
gcagacaggaaggaagca

SEQ ID NO: 3647747 - DNA, 21 bp, Homo sapiens
gcagacaggtgggagatggag

SEQ ID NO: 3647748 - DNA, 15 bp, Homo sapiens
gcagcagaggcagga

SEQ ID NO: 3647749 - DNA, 23 bp, Homo sapiens
gcagcagaggcaggaccagaagg

SEQ ID NO: 3647750 - DNA, 17 bp, Homo sapiens
gcagctaatttgtgaaa

SEQ ID NO: 3647751 - DNA, 18 bp, Homo sapiens
gcaggaaaaggctgcagc

SEQ ID NO: 3647752 - DNA, 14 bp, Homo sapiens
gcaggactctatcc

SEQ ID NO: 3647753 - DNA, 21 bp, Homo sapiens
gcaggactctatccctggctt

SEQ ID NO: 3647754 - DNA, 15 bp, Homo sapiens
gcagtgagctgagat

SEQ ID NO: 3647755 - DNA, 16 bp, Homo sapiens
gcagttatttaccaga

SEQ ID NO: 3647756 - DNA, 14 bp, Homo sapiens
gcatctagctggag

SEQ ID NO: 3647757 - DNA, 20 bp, Homo sapiens
gcatggaaagatggggagct

SEQ ID NO: 3647758 - DNA, 19 bp, Homo sapiens
gcatgtatgccatgtatgt

SEQ ID NO: 3647759 - DNA, 19 bp, Homo sapiens
gcatttagcatgagttctg

SEQ ID NO: 3647760 - DNA, 20 bp, Homo sapiens
gcattttaatagtttctaaa

SEQ ID NO: 3647761 - DNA, 18 bp, Homo sapiens
gccaaccctggaaaagga

SEQ ID NO: 3647762 - DNA, 19 bp, Homo sapiens
gccacaagggcagtggaag

SEQ ID NO: 3647763 - DNA, 20 bp, Homo sapiens
gccatgtatgttgcatgaat

SEQ ID NO: 3647764 - DNA, 22 bp, Homo sapiens
gccattcagtctatgctgtgtg

SEQ ID NO: 3647765 - DNA, 13 bp, Homo sapiens
gcccactcccatc

SEQ ID NO: 3647766 - DNA, 23 bp, Homo sapiens
gcccagcctgcatctagctggag

SEQ ID NO: 3647767 - DNA, 20 bp, Homo sapiens
gcccattctctaagcctggc

SEQ ID NO: 3647768 - DNA, 14 bp, Homo sapiens
gcccttagaatgtg

SEQ ID NO: 3647769 - DNA, 14 bp, Homo sapiens
gcctcagcatccca

SEQ ID NO: 3647770 - DNA, 18 bp, Homo sapiens
gcctcccttcatgcatgg

SEQ ID NO: 3647771 - DNA, 13 bp, Homo sapiens
gcctcttaaaaat

SEQ ID NO: 3647772 - DNA, 14 bp, Homo sapiens
gcctcttaaaaatt

SEQ ID NO: 3647773 - DNA, 19 bp, Homo sapiens
gcctggccaacatggtgaa

SEQ ID NO: 3647774 - DNA, 15 bp, Homo sapiens
gcctgtaatcccagc

SEQ ID NO: 3647775 - DNA, 14 bp, Homo sapiens
gccttattaaaata

SEQ ID NO: 3647776 - DNA, 14 bp, Homo sapiens
gccttctcccctcc

SEQ ID NO: 3647777 - DNA, 13 bp, Homo sapiens
gcctttggcaggt

SEQ ID NO: 3647778 - DNA, 15 bp, Homo sapiens
gcctttggcaggtgc

SEQ ID NO: 3647779 - DNA, 22 bp, Homo sapiens
gctaagataattaaatgaaata

SEQ ID NO: 3647780 - DNA, 16 bp, Homo sapiens
gctacaggggaggctg

SEQ ID NO: 3647781 - DNA, 14 bp, Homo sapiens
gctactcaggaggc

SEQ ID NO: 3647782 - DNA, 14 bp, Homo sapiens
gctagccatatatt

SEQ ID NO: 3647783 - DNA, 16 bp, Homo sapiens
gctataaatagtgaaa

SEQ ID NO: 3647784 - DNA, 17 bp, Homo sapiens
gctatgctgttcattga

SEQ ID NO: 3647785 - DNA, 20 bp, Homo sapiens
gctattcgtaagttctgtgc

SEQ ID NO: 3647786 - DNA, 17 bp, Homo sapiens
gctcaaggctgcagtga

SEQ ID NO: 3647787 - DNA, 15 bp, Homo sapiens
gctcatagcacatgt

SEQ ID NO: 3647788 - DNA, 16 bp, Homo sapiens
gctcatagcacatgtt

SEQ ID NO: 3647789 - DNA, 22 bp, Homo sapiens
gctcatgcctgtaatcccagca

SEQ ID NO: 3647790 - DNA, 22 bp, Homo sapiens
gctcggccaggcacggaggctc

SEQ ID NO: 3647791 - DNA, 19 bp, Homo sapiens
gctctccctcccttctttc

SEQ ID NO: 3647792 - DNA, 11 bp, Homo sapiens
gctctgcaggc

SEQ ID NO: 3647793 - DNA, 14 bp, Homo sapiens
gctctgcaggcagc

SEQ ID NO: 3647794 - DNA, 18 bp, Homo sapiens
gctgaagaaacacagcat

SEQ ID NO: 3647795 - DNA, 19 bp, Homo sapiens
gctgaagggaagcccagcc

SEQ ID NO: 3647796 - DNA, 19 bp, Homo sapiens
gctgagatgggaggatcac

SEQ ID NO: 3647797 - DNA, 15 bp, Homo sapiens
gctgaggcaggagaa

SEQ ID NO: 3647798 - DNA, 14 bp, Homo sapiens
gctgatagaagaag

SEQ ID NO: 3647799 - DNA, 18 bp, Homo sapiens
gctgctctctaagaattc

SEQ ID NO: 3647800 - DNA, 20 bp, Homo sapiens
gctgctgtatttgaggaaac

SEQ ID NO: 3647801 - DNA, 15 bp, Homo sapiens
gctggaggaaggaaa

SEQ ID NO: 3647802 - DNA, 19 bp, Homo sapiens
gctggctggaggaaggaaa

SEQ ID NO: 3647803 - DNA, 15 bp, Homo sapiens
gctgggcagacaggt

SEQ ID NO: 3647804 - DNA, 22 bp, Homo sapiens
gctgggcagacaggtgggagat

SEQ ID NO: 3647805 - DNA, 19 bp, Homo sapiens
gctgtaaataaaaatagct

SEQ ID NO: 3647806 - DNA, 14 bp, Homo sapiens
gctgtgaaatgact

SEQ ID NO: 3647807 - DNA, 17 bp, Homo sapiens
gcttccagggacaagct

SEQ ID NO: 3647808 - DNA, 17 bp, Homo sapiens
gcttccccttcagacct

SEQ ID NO: 3647809 - DNA, 23 bp, Homo sapiens
gcttctccacaacctcctcctcc

SEQ ID NO: 3647810 - DNA, 23 bp, Homo sapiens
gcttggaaaatgttctgacagca

SEQ ID NO: 3647811 - DNA, 14 bp, Homo sapiens
gctttctgatacat

SEQ ID NO: 3647812 - DNA, 13 bp, Homo sapiens
gcttttcacttct

SEQ ID NO: 3647813 - DNA, 13 bp, Homo sapiens
ggaaaatggaaga

SEQ ID NO: 3647814 - DNA, 14 bp, Homo sapiens
ggaaaatggaagac

SEQ ID NO: 3647815 - DNA, 14 bp, Homo sapiens
ggaaacatctgatt

SEQ ID NO: 3647816 - DNA, 23 bp, Homo sapiens
ggaaactcatacagtctctattt

SEQ ID NO: 3647817 - DNA, 14 bp, Homo sapiens
ggaaagatggggag

SEQ ID NO: 3647818 - DNA, 16 bp, Homo sapiens
ggaaagatggggagct

SEQ ID NO: 3647819 - DNA, 17 bp, Homo sapiens
ggaaagatggggagctc

SEQ ID NO: 3647820 - DNA, 19 bp, Homo sapiens
ggaaattcccttcatctgg

SEQ ID NO: 3647821 - DNA, 20 bp, Homo sapiens
ggaaattcccttcatctgga

SEQ ID NO: 3647822 - DNA, 22 bp, Homo sapiens
ggaaattcccttcatctggaac

SEQ ID NO: 3647823 - DNA, 12 bp, Homo sapiens
ggaaatttgtgt

SEQ ID NO: 3647824 - DNA, 22 bp, Homo sapiens
ggaaatttgtgtgcttcacaca

SEQ ID NO: 3647825 - DNA, 21 bp, Homo sapiens
ggaagaagaaccaggcatgga

SEQ ID NO: 3647826 - DNA, 18 bp, Homo sapiens
ggaagacctaaggcagac

SEQ ID NO: 3647827 - DNA, 23 bp, Homo sapiens
ggaagacctaaggcagacaggaa

SEQ ID NO: 3647828 - DNA, 21 bp, Homo sapiens
ggaagagctgctgtatttgag

SEQ ID NO: 3647829 - DNA, 18 bp, Homo sapiens
ggaagaggttgcagtgag

SEQ ID NO: 3647830 - DNA, 19 bp, Homo sapiens
ggaagaggttgcagtgagc

SEQ ID NO: 3647831 - DNA, 17 bp, Homo sapiens
ggaagcacaaaagacaa

SEQ ID NO: 3647832 - DNA, 14 bp, Homo sapiens
ggaatctaagtggg

SEQ ID NO: 3647833 - DNA, 17 bp, Homo sapiens
ggaatctaagtgggaga

SEQ ID NO: 3647834 - DNA, 13 bp, Homo sapiens
ggacagtgttcaa

SEQ ID NO: 3647835 - DNA, 22 bp, Homo sapiens
ggacatgtatgcttccagggac

SEQ ID NO: 3647836 - DNA, 15 bp, Homo sapiens
ggaccagcttttccc

SEQ ID NO: 3647837 - DNA, 14 bp, Homo sapiens
ggactacagaagtg

SEQ ID NO: 3647838 - DNA, 14 bp, Homo sapiens
ggactgaagaaaat

SEQ ID NO: 3647839 - DNA, 16 bp, Homo sapiens
ggacttaatttagcag

SEQ ID NO: 3647840 - DNA, 14 bp, Homo sapiens
ggagagctgggcag

SEQ ID NO: 3647841 - DNA, 13 bp, Homo sapiens
ggagagggatgga

SEQ ID NO: 3647842 - DNA, 15 bp, Homo sapiens
ggagatggaggtagg

SEQ ID NO: 3647843 - DNA, 19 bp, Homo sapiens
ggagattactaactgtgga

SEQ ID NO: 3647844 - DNA, 14 bp, Homo sapiens
ggagctctggaggt

SEQ ID NO: 3647845 - DNA, 20 bp, Homo sapiens
ggaggctgagatgggaggat

SEQ ID NO: 3647846 - DNA, 14 bp, Homo sapiens
ggaggtagggctgg

SEQ ID NO: 3647847 - DNA, 15 bp, Homo sapiens
ggaggtagggctggc

SEQ ID NO: 3647848 - DNA, 22 bp, Homo sapiens
ggagttcgaggcgagcctggcc

SEQ ID NO: 3647849 - DNA, 17 bp, Homo sapiens
ggagtttccatttggat

SEQ ID NO: 3647850 - DNA, 14 bp, Homo sapiens
ggatgatttaacat

SEQ ID NO: 3647851 - DNA, 16 bp, Homo sapiens
ggattcccctggacat

SEQ ID NO: 3647852 - DNA, 14 bp, Homo sapiens
ggattttaaacaaa

SEQ ID NO: 3647853 - DNA, 21 bp, Homo sapiens
ggcaaaaatttgacattgtca

SEQ ID NO: 3647854 - DNA, 15 bp, Homo sapiens
ggcaacgttcatgtt

SEQ ID NO: 3647855 - DNA, 12 bp, Homo sapiens
ggcaactcagca

SEQ ID NO: 3647856 - DNA, 14 bp, Homo sapiens
ggcaactcagcagg

SEQ ID NO: 3647857 - DNA, 17 bp, Homo sapiens
ggcaagctcatagcaca

SEQ ID NO: 3647858 - DNA, 17 bp, Homo sapiens
ggcaatcctgggctggc

SEQ ID NO: 3647859 - DNA, 13 bp, Homo sapiens
ggcaccttgattg

SEQ ID NO: 3647860 - DNA, 16 bp, Homo sapiens
ggcagacaggaaggaa

SEQ ID NO: 3647861 - DNA, 22 bp, Homo sapiens
ggcagaggatgaggtgggctga

SEQ ID NO: 3647862 - DNA, 19 bp, Homo sapiens
ggcaggaccagaaggcaat

SEQ ID NO: 3647863 - DNA, 23 bp, Homo sapiens
ggcagggctgttccctccaggca

SEQ ID NO: 3647864 - DNA, 16 bp, Homo sapiens
ggcatggaaagatggg

SEQ ID NO: 3647865 - DNA, 17 bp, Homo sapiens
ggcattgggtggcaaca

SEQ ID NO: 3647866 - DNA, 18 bp, Homo sapiens
ggcccttagaatgtgaaa

SEQ ID NO: 3647867 - DNA, 14 bp, Homo sapiens
ggcgaaagggtgag

SEQ ID NO: 3647868 - DNA, 15 bp, Homo sapiens
ggcgaaagggtgaga

SEQ ID NO: 3647869 - DNA, 10 bp, Homo sapiens
ggctgaagaa

SEQ ID NO: 3647870 - DNA, 19 bp, Homo sapiens
ggctgaagaaacacagcat

SEQ ID NO: 3647871 - DNA, 20 bp, Homo sapiens
ggctgaagggaagcccagcc

SEQ ID NO: 3647872 - DNA, 14 bp, Homo sapiens
ggctgaggcaggag

SEQ ID NO: 3647873 - DNA, 16 bp, Homo sapiens
ggctggaggaaggaaa

SEQ ID NO: 3647874 - DNA, 18 bp, Homo sapiens
ggctgttccctccaggca

SEQ ID NO: 3647875 - DNA, 15 bp, Homo sapiens
ggcttccccttcaga

SEQ ID NO: 3647876 - DNA, 16 bp, Homo sapiens
ggcttccccttcagac

SEQ ID NO: 3647877 - DNA, 18 bp, Homo sapiens
ggcttccccttcagacct

SEQ ID NO: 3647878 - DNA, 21 bp, Homo sapiens
ggcttgagggaatcatgggca

SEQ ID NO: 3647879 - DNA, 15 bp, Homo sapiens
gggaagcccagcctg

SEQ ID NO: 3647880 - DNA, 16 bp, Homo sapiens
gggaagcccagcctgc

SEQ ID NO: 3647881 - DNA, 19 bp, Homo sapiens
gggacaccattctgaattt

SEQ ID NO: 3647882 - DNA, 14 bp, Homo sapiens
gggactacagaagt

SEQ ID NO: 3647883 - DNA, 12 bp, Homo sapiens
gggagagctggg

SEQ ID NO: 3647884 - DNA, 11 bp, Homo sapiens
gggaggctgag

SEQ ID NO: 3647885 - DNA, 12 bp, Homo sapiens
gggaggctgaga

SEQ ID NO: 3647886 - DNA, 23 bp, Homo sapiens
gggagtcattgccttgggcctgg

SEQ ID NO: 3647887 - DNA, 21 bp, Homo sapiens
gggatgctatctcgctagcca

SEQ ID NO: 3647888 - DNA, 16 bp, Homo sapiens
gggatggtgatggaga

SEQ ID NO: 3647889 - DNA, 16 bp, Homo sapiens
gggcagaggatgaggt

SEQ ID NO: 3647890 - DNA, 22 bp, Homo sapiens
gggcagaggatgaggtgggctg

SEQ ID NO: 3647891 - DNA, 12 bp, Homo sapiens
gggctggagagt

SEQ ID NO: 3647892 - DNA, 18 bp, Homo sapiens
gggctggctggaggaagg

SEQ ID NO: 3647893 - DNA, 18 bp, Homo sapiens
gggctgttccctccaggc

SEQ ID NO: 3647894 - DNA, 19 bp, Homo sapiens
gggctgttccctccaggca

SEQ ID NO: 3647895 - DNA, 22 bp, Homo sapiens
ggggagagataatgaggcaact

SEQ ID NO: 3647896 - DNA, 16 bp, Homo sapiens
ggggagctctggaggt

SEQ ID NO: 3647897 - DNA, 16 bp, Homo sapiens
ggggaggctgagacgc

SEQ ID NO: 3647898 - DNA, 17 bp, Homo sapiens
gggtaacaaagtgagac

SEQ ID NO: 3647899 - DNA, 14 bp, Homo sapiens
gggtagcagcagag

SEQ ID NO: 3647900 - DNA, 17 bp, Homo sapiens
gggtatataaattgggg

SEQ ID NO: 3647901 - DNA, 19 bp, Homo sapiens
gggttaacagtaaatatac

SEQ ID NO: 3647902 - DNA, 16 bp, Homo sapiens
gggttctatatttact

SEQ ID NO: 3647903 - DNA, 22 bp, Homo sapiens
gggttctatatttactgtttat

SEQ ID NO: 3647904 - DNA, 14 bp, Homo sapiens
ggtagggctggctg

SEQ ID NO: 3647905 - DNA, 22 bp, Homo sapiens
ggtatataaattggggtgatga

SEQ ID NO: 3647906 - DNA, 17 bp, Homo sapiens
ggtattttttgtgaatg

SEQ ID NO: 3647907 - DNA, 22 bp, Homo sapiens
ggtcaggagttcgaggcgagcc

SEQ ID NO: 3647908 - DNA, 23 bp, Homo sapiens
ggtcaggagttcgaggcgagcct

SEQ ID NO: 3647909 - DNA, 22 bp, Homo sapiens
ggtcccagctacaggggaggct

SEQ ID NO: 3647910 - DNA, 22 bp, Homo sapiens
ggtctgtgttctcaacacacag

SEQ ID NO: 3647911 - DNA, 17 bp, Homo sapiens
ggtgatggagagggatg

SEQ ID NO: 3647912 - DNA, 21 bp, Homo sapiens
ggtggatcatgaggtcaggag

SEQ ID NO: 3647913 - DNA, 20 bp, Homo sapiens
ggtggcaacatttggggaga

SEQ ID NO: 3647914 - DNA, 12 bp, Homo sapiens
ggtgggagatgg

SEQ ID NO: 3647915 - DNA, 21 bp, Homo sapiens
gtaaaacttgtattggaagta

SEQ ID NO: 3647916 - DNA, 18 bp, Homo sapiens
gtaaatatacactttaca

SEQ ID NO: 3647917 - DNA, 21 bp, Homo sapiens
gtaaattcctaattctatgat

SEQ ID NO: 3647918 - DNA, 16 bp, Homo sapiens
gtaagggaccttcagg

SEQ ID NO: 3647919 - DNA, 18 bp, Homo sapiens
gtaagggagtcattgcct

SEQ ID NO: 3647920 - DNA, 18 bp, Homo sapiens
gtaatactaagtcctcag

SEQ ID NO: 3647921 - DNA, 12 bp, Homo sapiens
gtaatctcagct

SEQ ID NO: 3647922 - DNA, 16 bp, Homo sapiens
gtaatctcagctactc

SEQ ID NO: 3647923 - DNA, 21 bp, Homo sapiens
gtaattaaaaagacactttta

SEQ ID NO: 3647924 - DNA, 18 bp, Homo sapiens
gtacccttccttcttccc

SEQ ID NO: 3647925 - DNA, 14 bp, Homo sapiens
gtagagagagacct

SEQ ID NO: 3647926 - DNA, 16 bp, Homo sapiens
gtagcagcagaggcag

SEQ ID NO: 3647927 - DNA, 15 bp, Homo sapiens
gtatacaagtgtttc

SEQ ID NO: 3647928 - DNA, 20 bp, Homo sapiens
gtatttggtaacttgctgtg

SEQ ID NO: 3647929 - DNA, 14 bp, Homo sapiens
gtatttgttaaaga

SEQ ID NO: 3647930 - DNA, 15 bp, Homo sapiens
gtattttaacatagc

SEQ ID NO: 3647931 - DNA, 13 bp, Homo sapiens
gtcaaatggtatt

SEQ ID NO: 3647932 - DNA, 14 bp, Homo sapiens
gtcaaatggtattt

SEQ ID NO: 3647933 - DNA, 16 bp, Homo sapiens
gtcaaatggtattttt

SEQ ID NO: 3647934 - DNA, 15 bp, Homo sapiens
gtcatgcaagtgaga

SEQ ID NO: 3647935 - DNA, 21 bp, Homo sapiens
gtcatgcaagtgagaaagaca

SEQ ID NO: 3647936 - DNA, 16 bp, Homo sapiens
gtccggatgtcactca

SEQ ID NO: 3647937 - DNA, 15 bp, Homo sapiens
gtccgtgaagagaaa

SEQ ID NO: 3647938 - DNA, 12 bp, Homo sapiens
gtcctgcatgta

SEQ ID NO: 3647939 - DNA, 17 bp, Homo sapiens
gtctacctgccttgcct

SEQ ID NO: 3647940 - DNA, 16 bp, Homo sapiens
gtctatgctgtgtgca

SEQ ID NO: 3647941 - DNA, 19 bp, Homo sapiens
gtctatgctgtgtgcagag

SEQ ID NO: 3647942 - DNA, 21 bp, Homo sapiens
gtctccattctgtgtggcacc

SEQ ID NO: 3647943 - DNA, 12 bp, Homo sapiens
gtctcccagtcg

SEQ ID NO: 3647944 - DNA, 17 bp, Homo sapiens
gtctgaaaaagtgtttt

SEQ ID NO: 3647945 - DNA, 18 bp, Homo sapiens
gtctgtccctaaacatag

SEQ ID NO: 3647946 - DNA, 22 bp, Homo sapiens
gtctgttgaagtgcatgttaaa

SEQ ID NO: 3647947 - DNA, 13 bp, Homo sapiens
gtcttaggtggca

SEQ ID NO: 3647948 - DNA, 17 bp, Homo sapiens
gtcttattcctaattcc

SEQ ID NO: 3647949 - DNA, 18 bp, Homo sapiens
gtcttgtttaatatttgt

SEQ ID NO: 3647950 - DNA, 14 bp, Homo sapiens
gtctttaaaatgat

SEQ ID NO: 3647951 - DNA, 19 bp, Homo sapiens
gtgaaaaaaaaaagtaatt

SEQ ID NO: 3647952 - DNA, 20 bp, Homo sapiens
gtgagaaagacatctgagga

SEQ ID NO: 3647953 - DNA, 23 bp, Homo sapiens
gtgagatttagggttctatattt

SEQ ID NO: 3647954 - DNA, 16 bp, Homo sapiens
gtgagtgcaagagcct

SEQ ID NO: 3647955 - DNA, 23 bp, Homo sapiens
gtgatgaatttaccatcaaacaa

SEQ ID NO: 3647956 - DNA, 21 bp, Homo sapiens
gtgatgaccccatagacctaa

SEQ ID NO: 3647957 - DNA, 14 bp, Homo sapiens
gtgcaagagcctga

SEQ ID NO: 3647958 - DNA, 20 bp, Homo sapiens
gtgcaagagcctgagactgg

SEQ ID NO: 3647959 - DNA, 22 bp, Homo sapiens
gtgcagtttggtatgaaacaaa

SEQ ID NO: 3647960 - DNA, 12 bp, Homo sapiens
gtgcatgttaaa

SEQ ID NO: 3647961 - DNA, 19 bp, Homo sapiens
gtgcatgttaaaataatta

SEQ ID NO: 3647962 - DNA, 23 bp, Homo sapiens
gtgccattacactccagcctggg

SEQ ID NO: 3647963 - DNA, 20 bp, Homo sapiens
gtgcttcacacaaagtgaaa

SEQ ID NO: 3647964 - DNA, 13 bp, Homo sapiens
gtggactccagct

SEQ ID NO: 3647965 - DNA, 17 bp, Homo sapiens
gtggataaattttggaa

SEQ ID NO: 3647966 - DNA, 20 bp, Homo sapiens
gtggcaacatttggggagag

SEQ ID NO: 3647967 - DNA, 16 bp, Homo sapiens
gtggcattgggtggca

SEQ ID NO: 3647968 - DNA, 16 bp, Homo sapiens
gtggcatttgcaggtg

SEQ ID NO: 3647969 - DNA, 23 bp, Homo sapiens
gtgggctgaagggaagcccagcc

SEQ ID NO: 3647970 - DNA, 23 bp, Homo sapiens
gtggtattttaacatagcagctg

SEQ ID NO: 3647971 - DNA, 15 bp, Homo sapiens
gtggttatatttcaa

SEQ ID NO: 3647972 - DNA, 21 bp, Homo sapiens
gtgtaagacacgtgcaacaga

SEQ ID NO: 3647973 - DNA, 18 bp, Homo sapiens
gtgtacatttatgtgtga

SEQ ID NO: 3647974 - DNA, 16 bp, Homo sapiens
gtgtcaccaggcccag

SEQ ID NO: 3647975 - DNA, 14 bp, Homo sapiens
gtgtcctgcatgta

SEQ ID NO: 3647976 - DNA, 23 bp, Homo sapiens
gtgtgacctacaagattcctggt

SEQ ID NO: 3647977 - DNA, 19 bp, Homo sapiens
gtgtgcagagtatacaagt

SEQ ID NO: 3647978 - DNA, 21 bp, Homo sapiens
gtgtgcagagtatacaagtgt

SEQ ID NO: 3647979 - DNA, 17 bp, Homo sapiens
gtgtgctattcgtaagt

SEQ ID NO: 3647980 - DNA, 15 bp, Homo sapiens
gtgtgcttcacacaa

SEQ ID NO: 3647981 - DNA, 15 bp, Homo sapiens
gtgttcaaattctga

SEQ ID NO: 3647982 - DNA, 14 bp, Homo sapiens
gtgttctcaacaca

SEQ ID NO: 3647983 - DNA, 17 bp, Homo sapiens
gttaaatctacaaactt

SEQ ID NO: 3647984 - DNA, 18 bp, Homo sapiens
gttaaccgggactacaga

SEQ ID NO: 3647985 - DNA, 21 bp, Homo sapiens
gttaatgaaaaatctgaattt

SEQ ID NO: 3647986 - DNA, 20 bp, Homo sapiens
gttaattctcagaagtgaaa

SEQ ID NO: 3647987 - DNA, 14 bp, Homo sapiens
gttaccccaccctg

SEQ ID NO: 3647988 - DNA, 16 bp, Homo sapiens
gttaccccaccctgcc

SEQ ID NO: 3647989 - DNA, 17 bp, Homo sapiens
gttagaaaaaactggaa

SEQ ID NO: 3647990 - DNA, 21 bp, Homo sapiens
gttataaaatctgtattgcta

SEQ ID NO: 3647991 - DNA, 21 bp, Homo sapiens
gttattcaataactattgctg

SEQ ID NO: 3647992 - DNA, 18 bp, Homo sapiens
gttcaatgctacaaaatg

SEQ ID NO: 3647993 - DNA, 16 bp, Homo sapiens
gttccccgctgaccct

SEQ ID NO: 3647994 - DNA, 13 bp, Homo sapiens
gttccctgaacct

SEQ ID NO: 3647995 - DNA, 15 bp, Homo sapiens
gttctcaacacacag

SEQ ID NO: 3647996 - DNA, 16 bp, Homo sapiens
gttctcaacacacagt

SEQ ID NO: 3647997 - DNA, 18 bp, Homo sapiens
gttctcaacacacagtat

SEQ ID NO: 3647998 - DNA, 19 bp, Homo sapiens
gttctgcacatacagatgg

SEQ ID NO: 3647999 - DNA, 16 bp, Homo sapiens
gttctttcccagcctc

SEQ ID NO: 3648000 - DNA, 16 bp, Homo sapiens
gttgaagtgcatgtta

SEQ ID NO: 3648001 - DNA, 16 bp, Homo sapiens
gttgcaaagtgttgtc

SEQ ID NO: 3648002 - DNA, 15 bp, Homo sapiens
gttggtatttactgc

SEQ ID NO: 3648003 - DNA, 18 bp, Homo sapiens
gttggttacctattgctg

SEQ ID NO: 3648004 - DNA, 21 bp, Homo sapiens
gtttagaatcaagtctgtgaa

SEQ ID NO: 3648005 - DNA, 22 bp, Homo sapiens
gtttccagctaagcctgatgat

SEQ ID NO: 3648006 - DNA, 11 bp, Homo sapiens
gtttccatttg

SEQ ID NO: 3648007 - DNA, 12 bp, Homo sapiens
gtttccatttgg

SEQ ID NO: 3648008 - DNA, 19 bp, Homo sapiens
gtttgatgaataaaatgtt

SEQ ID NO: 3648009 - DNA, 22 bp, Homo sapiens
gtttgatgaataaaatgtttat

SEQ ID NO: 3648010 - DNA, 19 bp, Homo sapiens
gtttgcttctaaaggtttc

SEQ ID NO: 3648011 - DNA, 15 bp, Homo sapiens
gtttggtatgaaaca

SEQ ID NO: 3648012 - DNA, 23 bp, Homo sapiens
gttttaaagaagtccatgtgata

SEQ ID NO: 3648013 - DNA, 18 bp, Homo sapiens
gttttatgagacttccta

SEQ ID NO: 3648014 - DNA, 16 bp, Homo sapiens
gttttcaagcattgct

SEQ ID NO: 3648015 - DNA, 15 bp, Homo sapiens
gttttcattctggtc

SEQ ID NO: 3648016 - DNA, 16 bp, Homo sapiens
gttttgatctcagcat

SEQ ID NO: 3648017 - DNA, 18 bp, Homo sapiens
taaaaattatctttaaaa

SEQ ID NO: 3648018 - DNA, 17 bp, Homo sapiens
taaaacttactatggta

SEQ ID NO: 3648019 - DNA, 18 bp, Homo sapiens
taaaacttgtattggaag

SEQ ID NO: 3648020 - DNA, 17 bp, Homo sapiens
taaaataattatatgaa

SEQ ID NO: 3648021 - DNA, 16 bp, Homo sapiens
taaaattggttaatga

SEQ ID NO: 3648022 - DNA, 19 bp, Homo sapiens
taaaattggttaatgaaaa

SEQ ID NO: 3648023 - DNA, 16 bp, Homo sapiens
taaacacagtaagata

SEQ ID NO: 3648024 - DNA, 22 bp, Homo sapiens
taaacacagtaagataggttct

SEQ ID NO: 3648025 - DNA, 22 bp, Homo sapiens
taaacatagtggtattttaaca

SEQ ID NO: 3648026 - DNA, 23 bp, Homo sapiens
taaacatagtggtattttaacat

SEQ ID NO: 3648027 - DNA, 19 bp, Homo sapiens
taaaccacctcccaaaggc

SEQ ID NO: 3648028 - DNA, 22 bp, Homo sapiens
taaaccagaaggaagccctctc

SEQ ID NO: 3648029 - DNA, 12 bp, Homo sapiens
taaactgggaaa

SEQ ID NO: 3648030 - DNA, 19 bp, Homo sapiens
taaagaaacatctacagga

SEQ ID NO: 3648031 - DNA, 15 bp, Homo sapiens
taaagaagtccatgt

SEQ ID NO: 3648032 - DNA, 23 bp, Homo sapiens
taaagaagtccatgtgataattg

SEQ ID NO: 3648033 - DNA, 21 bp, Homo sapiens
taaaggtgatgaatttaccat

SEQ ID NO: 3648034 - DNA, 16 bp, Homo sapiens
taaagtggcatttctt

SEQ ID NO: 3648035 - DNA, 15 bp, Homo sapiens
taaataaaaatagct

SEQ ID NO: 3648036 - DNA, 22 bp, Homo sapiens
taaatattgctgtctgaaaaag

SEQ ID NO: 3648037 - DNA, 23 bp, Homo sapiens
taaatccaatagtctgccacaag

SEQ ID NO: 3648038 - DNA, 16 bp, Homo sapiens
taaatctaaattaact

SEQ ID NO: 3648039 - DNA, 17 bp, Homo sapiens
taaatctaaattaactt

SEQ ID NO: 3648040 - DNA, 19 bp, Homo sapiens
taaatctttgttaaaatat

SEQ ID NO: 3648041 - DNA, 21 bp, Homo sapiens
taaatctttgttaaaatatag

SEQ ID NO: 3648042 - DNA, 14 bp, Homo sapiens
taaatgaaatactt

SEQ ID NO: 3648043 - DNA, 19 bp, Homo sapiens
taaattaacaaattcagtg

SEQ ID NO: 3648044 - DNA, 15 bp, Homo sapiens
taaattaacttctat

SEQ ID NO: 3648045 - DNA, 14 bp, Homo sapiens
taaattcctaattc

SEQ ID NO: 3648046 - DNA, 16 bp, Homo sapiens
taaatttattaaatgt

SEQ ID NO: 3648047 - DNA, 22 bp, Homo sapiens
taaattttggaagaattcatga

SEQ ID NO: 3648048 - DNA, 18 bp, Homo sapiens
taacagtaaatatacact

SEQ ID NO: 3648049 - DNA, 14 bp, Homo sapiens
taacagtatttcca

SEQ ID NO: 3648050 - DNA, 15 bp, Homo sapiens
taacagtatttccat

SEQ ID NO: 3648051 - DNA, 20 bp, Homo sapiens
taacatgaaagtcaagtcta

SEQ ID NO: 3648052 - DNA, 12 bp, Homo sapiens
taacattgtaaa

SEQ ID NO: 3648053 - DNA, 15 bp, Homo sapiens
taacattgtaaatga

SEQ ID NO: 3648054 - DNA, 17 bp, Homo sapiens
taacattgtaaatgata

SEQ ID NO: 3648055 - DNA, 12 bp, Homo sapiens
taactaatgtaa

SEQ ID NO: 3648056 - DNA, 17 bp, Homo sapiens
taactaatgtaaatatt

SEQ ID NO: 3648057 - DNA, 11 bp, Homo sapiens
taactgtgaac

SEQ ID NO: 3648058 - DNA, 18 bp, Homo sapiens
taactgtgaacaatcaga

SEQ ID NO: 3648059 - DNA, 17 bp, Homo sapiens
taacttattttgattgt

SEQ ID NO: 3648060 - DNA, 21 bp, Homo sapiens
taacttattttgattgtttga

SEQ ID NO: 3648061 - DNA, 15 bp, Homo sapiens
taacttgctgtgaaa

SEQ ID NO: 3648062 - DNA, 19 bp, Homo sapiens
taacttgctgtgaaatgac

SEQ ID NO: 3648063 - DNA, 20 bp, Homo sapiens
taacttgctgtgaaatgact

SEQ ID NO: 3648064 - DNA, 19 bp, Homo sapiens
taagaattcagtagcattt

SEQ ID NO: 3648065 - DNA, 21 bp, Homo sapiens
taagaattcagtagcatttta

SEQ ID NO: 3648066 - DNA, 21 bp, Homo sapiens
taagacattagtttgaggtac

SEQ ID NO: 3648067 - DNA, 17 bp, Homo sapiens
taagataattaaatgaa

SEQ ID NO: 3648068 - DNA, 21 bp, Homo sapiens
taagattaatgacctgaattg

SEQ ID NO: 3648069 - DNA, 23 bp, Homo sapiens
taagattaatgacctgaattgaa

SEQ ID NO: 3648070 - DNA, 10 bp, Homo sapiens
taagcctggc

SEQ ID NO: 3648071 - DNA, 13 bp, Homo sapiens
taagcctggctta

SEQ ID NO: 3648072 - DNA, 19 bp, Homo sapiens
taagcctggcttagaaggc

SEQ ID NO: 3648073 - DNA, 15 bp, Homo sapiens
taaggcagacaggaa

SEQ ID NO: 3648074 - DNA, 16 bp, Homo sapiens
taaggcagacaggaag

SEQ ID NO: 3648075 - DNA, 18 bp, Homo sapiens
taaggcagacaggaagga

SEQ ID NO: 3648076 - DNA, 20 bp, Homo sapiens
taaggcagacaggaaggaag

SEQ ID NO: 3648077 - DNA, 19 bp, Homo sapiens
taagggttaccccaccctg

SEQ ID NO: 3648078 - DNA, 22 bp, Homo sapiens
taaggtcagtgttataaaatct

SEQ ID NO: 3648079 - DNA, 23 bp, Homo sapiens
taagtcctcagagctccatgctg

SEQ ID NO: 3648080 - DNA, 16 bp, Homo sapiens
taagttctgtgcagtt

SEQ ID NO: 3648081 - DNA, 17 bp, Homo sapiens
taagtttgacacaacat

SEQ ID NO: 3648082 - DNA, 18 bp, Homo sapiens
taatacaccaaatagctt

SEQ ID NO: 3648083 - DNA, 16 bp, Homo sapiens
taatagctcacagcac

SEQ ID NO: 3648084 - DNA, 23 bp, Homo sapiens
taatagctcacagcacatttgtt

SEQ ID NO: 3648085 - DNA, 23 bp, Homo sapiens
taatagtacccaacctggtaatt

SEQ ID NO: 3648086 - DNA, 20 bp, Homo sapiens
taatccatgtgctgctgtgg

SEQ ID NO: 3648087 - DNA, 18 bp, Homo sapiens
taatgaaaaatctgaatt

SEQ ID NO: 3648088 - DNA, 17 bp, Homo sapiens
taatgacctgaattgaa

SEQ ID NO: 3648089 - DNA, 21 bp, Homo sapiens
taatgtagggcagaatagctg

SEQ ID NO: 3648090 - DNA, 15 bp, Homo sapiens
taattaaatgaaata

SEQ ID NO: 3648091 - DNA, 18 bp, Homo sapiens
taattaaatgaaatactt

SEQ ID NO: 3648092 - DNA, 20 bp, Homo sapiens
taattatcctcaagttgtgt

SEQ ID NO: 3648093 - DNA, 12 bp, Homo sapiens
taattattttct

SEQ ID NO: 3648094 - DNA, 14 bp, Homo sapiens
taattattttctga

SEQ ID NO: 3648095 - DNA, 20 bp, Homo sapiens
taattcttctcctttgtcaa

SEQ ID NO: 3648096 - DNA, 23 bp, Homo sapiens
taattcttctcctttgtcaaatg

SEQ ID NO: 3648097 - DNA, 15 bp, Homo sapiens
taatttgtgaaagtg

SEQ ID NO: 3648098 - DNA, 23 bp, Homo sapiens
taatttgtgaaagtggcaagctc

SEQ ID NO: 3648099 - DNA, 16 bp, Homo sapiens
tacaaacttttataaa

SEQ ID NO: 3648100 - DNA, 20 bp, Homo sapiens
tacaaacttttataaatgtt

SEQ ID NO: 3648101 - DNA, 14 bp, Homo sapiens
tacaaagaaacaaa

SEQ ID NO: 3648102 - DNA, 21 bp, Homo sapiens
tacaaagaaacaaaatataaa

SEQ ID NO: 3648103 - DNA, 12 bp, Homo sapiens
tacaagctacat

SEQ ID NO: 3648104 - DNA, 14 bp, Homo sapiens
tacaagctacatat

SEQ ID NO: 3648105 - DNA, 13 bp, Homo sapiens
tacaagtgtttct

SEQ ID NO: 3648106 - DNA, 17 bp, Homo sapiens
tacacatataaacacag

SEQ ID NO: 3648107 - DNA, 21 bp, Homo sapiens
tacaccaaatagcttttcact

SEQ ID NO: 3648108 - DNA, 16 bp, Homo sapiens
tacagaagtggaagga

SEQ ID NO: 3648109 - DNA, 23 bp, Homo sapiens
tacagatggtgtcctgcatgtat

SEQ ID NO: 3648110 - DNA, 13 bp, Homo sapiens
tacaggcatgagc

SEQ ID NO: 3648111 - DNA, 12 bp, Homo sapiens
tacaggttttat

SEQ ID NO: 3648112 - DNA, 20 bp, Homo sapiens
tacagtctctatttgatttg

SEQ ID NO: 3648113 - DNA, 22 bp, Homo sapiens
tacagtctctatttgatttgca

SEQ ID NO: 3648114 - DNA, 18 bp, Homo sapiens
tacatatagctttgcaac

SEQ ID NO: 3648115 - DNA, 13 bp, Homo sapiens
taccatcaaacaa

SEQ ID NO: 3648116 - DNA, 15 bp, Homo sapiens
taccattttgaaata

SEQ ID NO: 3648117 - DNA, 13 bp, Homo sapiens
taccccaccagca

SEQ ID NO: 3648118 - DNA, 16 bp, Homo sapiens
taccccaccagcagaa

SEQ ID NO: 3648119 - DNA, 16 bp, Homo sapiens
taccctgggctggaga

SEQ ID NO: 3648120 - DNA, 18 bp, Homo sapiens
tacctattgctgtaaata

SEQ ID NO: 3648121 - DNA, 14 bp, Homo sapiens
tactaagtcctcag

SEQ ID NO: 3648122 - DNA, 15 bp, Homo sapiens
tactgcaatgtctgt

SEQ ID NO: 3648123 - DNA, 21 bp, Homo sapiens
tactgtaatagatcagcatcc

SEQ ID NO: 3648124 - DNA, 21 bp, Homo sapiens
tacttacacacctgagaatgt

SEQ ID NO: 3648125 - DNA, 22 bp, Homo sapiens
tacttacacacctgagaatgtg

SEQ ID NO: 3648126 - DNA, 18 bp, Homo sapiens
tactttacaatcatgcct

SEQ ID NO: 3648127 - DNA, 19 bp, Homo sapiens
tagaagaaggactgaagaa

SEQ ID NO: 3648128 - DNA, 22 bp, Homo sapiens
tagaagaaggactgaagaaaat

SEQ ID NO: 3648129 - DNA, 17 bp, Homo sapiens
tagaaggcactgggaat

SEQ ID NO: 3648130 - DNA, 15 bp, Homo sapiens
tagaatcagggtgga

SEQ ID NO: 3648131 - DNA, 17 bp, Homo sapiens
tagataccattttgaaa

SEQ ID NO: 3648132 - DNA, 16 bp, Homo sapiens
tagatatgagaaatat

SEQ ID NO: 3648133 - DNA, 21 bp, Homo sapiens
tagatgtcgtggactccagct

SEQ ID NO: 3648134 - DNA, 22 bp, Homo sapiens
tagatgtcgtggactccagctc

SEQ ID NO: 3648135 - DNA, 23 bp, Homo sapiens
tagcaaaaggatgatttaacatt

SEQ ID NO: 3648136 - DNA, 16 bp, Homo sapiens
tagcagcagaggcagg

SEQ ID NO: 3648137 - DNA, 13 bp, Homo sapiens
tagctcacagcac

SEQ ID NO: 3648138 - DNA, 15 bp, Homo sapiens
taggaaaattttctt

SEQ ID NO: 3648139 - DNA, 22 bp, Homo sapiens
taggacatctctgtaaaaagca

SEQ ID NO: 3648140 - DNA, 13 bp, Homo sapiens
tagggaaaacatt

SEQ ID NO: 3648141 - DNA, 16 bp, Homo sapiens
tagggaaaacattcca

SEQ ID NO: 3648142 - DNA, 18 bp, Homo sapiens
tagggaaaacattccatc

SEQ ID NO: 3648143 - DNA, 17 bp, Homo sapiens
taggggcaaaaatttga

SEQ ID NO: 3648144 - DNA, 23 bp, Homo sapiens
taggggcaaaaatttgacattgt

SEQ ID NO: 3648145 - DNA, 21 bp, Homo sapiens
taggtctgttgaagtgcatgt

SEQ ID NO: 3648146 - DNA, 15 bp, Homo sapiens
taggtggcagggctg

SEQ ID NO: 3648147 - DNA, 17 bp, Homo sapiens
taggttctgctttctga

SEQ ID NO: 3648148 - DNA, 21 bp, Homo sapiens
taggttctgctttctgataca

SEQ ID NO: 3648149 - DNA, 18 bp, Homo sapiens
tagtaacagtatttccat

SEQ ID NO: 3648150 - DNA, 11 bp, Homo sapiens
tagtccacaag

SEQ ID NO: 3648151 - DNA, 12 bp, Homo sapiens
tagtgttttcat

SEQ ID NO: 3648152 - DNA, 17 bp, Homo sapiens
tagtgttttcattctgg

SEQ ID NO: 3648153 - DNA, 20 bp, Homo sapiens
tataaacacagtaagatagg

SEQ ID NO: 3648154 - DNA, 14 bp, Homo sapiens
tataaatgttttaa

SEQ ID NO: 3648155 - DNA, 17 bp, Homo sapiens
tataacatgaaagtcaa

SEQ ID NO: 3648156 - DNA, 17 bp, Homo sapiens
tataatggcctcttaaa

SEQ ID NO: 3648157 - DNA, 19 bp, Homo sapiens
tataattttattgctggaa

SEQ ID NO: 3648158 - DNA, 15 bp, Homo sapiens
tatacaagtgtttct

SEQ ID NO: 3648159 - DNA, 23 bp, Homo sapiens
tatagagtgacttggagagagat

SEQ ID NO: 3648160 - DNA, 20 bp, Homo sapiens
tatagataaatccaatagtc

SEQ ID NO: 3648161 - DNA, 19 bp, Homo sapiens
tatatattttgaaaggaga

SEQ ID NO: 3648162 - DNA, 14 bp, Homo sapiens
tatatgtatatctg

SEQ ID NO: 3648163 - DNA, 15 bp, Homo sapiens
tatatgtatatctgt

SEQ ID NO: 3648164 - DNA, 13 bp, Homo sapiens
tatatttactgtt

SEQ ID NO: 3648165 - DNA, 18 bp, Homo sapiens
tatatttactgtttataa

SEQ ID NO: 3648166 - DNA, 19 bp, Homo sapiens
tatcagaagcaaggaagta

SEQ ID NO: 3648167 - DNA, 19 bp, Homo sapiens
tatcctcaagttgtgtgct

SEQ ID NO: 3648168 - DNA, 21 bp, Homo sapiens
tatcttaaaattggttaatga

SEQ ID NO: 3648169 - DNA, 14 bp, Homo sapiens
tatgaaacaaatat

SEQ ID NO: 3648170 - DNA, 19 bp, Homo sapiens
tatgaaacaaatatactca

SEQ ID NO: 3648171 - DNA, 23 bp, Homo sapiens
tatgagattggaaaaaattagac

SEQ ID NO: 3648172 - DNA, 15 bp, Homo sapiens
tatgattaaactggg

SEQ ID NO: 3648173 - DNA, 22 bp, Homo sapiens
tatgccatgtatgttgcatgaa

SEQ ID NO: 3648174 - DNA, 16 bp, Homo sapiens
tatgctgtgtgcagag

SEQ ID NO: 3648175 - DNA, 14 bp, Homo sapiens
tatggtatatattt

SEQ ID NO: 3648176 - DNA, 12 bp, Homo sapiens
tatgtacttgaa

SEQ ID NO: 3648177 - DNA, 23 bp, Homo sapiens
tatgtacttgaaaataataaagt

SEQ ID NO: 3648178 - DNA, 15 bp, Homo sapiens
tatgtaggaaaattt

SEQ ID NO: 3648179 - DNA, 19 bp, Homo sapiens
tattaaatttattaaatgt

SEQ ID NO: 3648180 - DNA, 20 bp, Homo sapiens
tattaaatttattaaatgtt

SEQ ID NO: 3648181 - DNA, 22 bp, Homo sapiens
tattacaacaagcaaactgaaa

SEQ ID NO: 3648182 - DNA, 20 bp, Homo sapiens
tattatatatgtatatctgt

SEQ ID NO: 3648183 - DNA, 16 bp, Homo sapiens
tattcctaattcctgt

SEQ ID NO: 3648184 - DNA, 14 bp, Homo sapiens
tattgagtgtacat

SEQ ID NO: 3648185 - DNA, 21 bp, Homo sapiens
tattgctgtaaataaaaatag

SEQ ID NO: 3648186 - DNA, 22 bp, Homo sapiens
tattgctgtaaataaaaatagc

SEQ ID NO: 3648187 - DNA, 16 bp, Homo sapiens
tattgctgtctgaaaa

SEQ ID NO: 3648188 - DNA, 16 bp, Homo sapiens
tatttactgcaatgtc

SEQ ID NO: 3648189 - DNA, 17 bp, Homo sapiens
tatttgaggaaactcat

SEQ ID NO: 3648190 - DNA, 17 bp, Homo sapiens
tatttgttaaagaaaca

SEQ ID NO: 3648191 - DNA, 22 bp, Homo sapiens
tattttctgagtagcatatata

SEQ ID NO: 3648192 - DNA, 14 bp, Homo sapiens
tattttctgtaatt

SEQ ID NO: 3648193 - DNA, 19 bp, Homo sapiens
tattttgattgtttgatga

SEQ ID NO: 3648194 - DNA, 13 bp, Homo sapiens
tcaaacaaatcat

SEQ ID NO: 3648195 - DNA, 14 bp, Homo sapiens
tcaaacaaatcatt

SEQ ID NO: 3648196 - DNA, 18 bp, Homo sapiens
tcaaacaaatcattttga

SEQ ID NO: 3648197 - DNA, 20 bp, Homo sapiens
tcaaaccaaatcactgaact

SEQ ID NO: 3648198 - DNA, 18 bp, Homo sapiens
tcaaatgttattcaataa

SEQ ID NO: 3648199 - DNA, 17 bp, Homo sapiens
tcaaattctgattatta

SEQ ID NO: 3648200 - DNA, 23 bp, Homo sapiens
tcaacatcaattgggttttgatc

SEQ ID NO: 3648201 - DNA, 15 bp, Homo sapiens
tcaaccacacctaaa

SEQ ID NO: 3648202 - DNA, 14 bp, Homo sapiens
tcaagagcttccag

SEQ ID NO: 3648203 - DNA, 13 bp, Homo sapiens
tcaaggctgcagt

SEQ ID NO: 3648204 - DNA, 12 bp, Homo sapiens
tcaagtctgtga

SEQ ID NO: 3648205 - DNA, 15 bp, Homo sapiens
tcaagttgtgtgcta

SEQ ID NO: 3648206 - DNA, 16 bp, Homo sapiens
tcaagttgtgtgctat

SEQ ID NO: 3648207 - DNA, 17 bp, Homo sapiens
tcaatgttaaatctaca

SEQ ID NO: 3648208 - DNA, 20 bp, Homo sapiens
tcaatgttaaatctacaaac

SEQ ID NO: 3648209 - DNA, 17 bp, Homo sapiens
tcaattcttccctatct

SEQ ID NO: 3648210 - DNA, 19 bp, Homo sapiens
tcaattcttccctatcttt

SEQ ID NO: 3648211 - DNA, 17 bp, Homo sapiens
tcaattgcttgagcatg

SEQ ID NO: 3648212 - DNA, 12 bp, Homo sapiens
tcacacaaagtg

SEQ ID NO: 3648213 - DNA, 17 bp, Homo sapiens
tcacacaaagtgaaatt

SEQ ID NO: 3648214 - DNA, 20 bp, Homo sapiens
tcacagatttccaaaagtac

SEQ ID NO: 3648215 - DNA, 18 bp, Homo sapiens
tcacagcacatttgttaa

SEQ ID NO: 3648216 - DNA, 20 bp, Homo sapiens
tcactccatttcccacttcc

SEQ ID NO: 3648217 - DNA, 20 bp, Homo sapiens
tcacttcttaaggacagtgt

SEQ ID NO: 3648218 - DNA, 21 bp, Homo sapiens
tcacttcttaaggacagtgtt

SEQ ID NO: 3648219 - DNA, 22 bp, Homo sapiens
tcagaaacaccctcacactggg

SEQ ID NO: 3648220 - DNA, 14 bp, Homo sapiens
tcagaagtgaaaaa

SEQ ID NO: 3648221 - DNA, 17 bp, Homo sapiens
tcagaagtgaaaaagac

SEQ ID NO: 3648222 - DNA, 12 bp, Homo sapiens
tcagaatgttgt

SEQ ID NO: 3648223 - DNA, 16 bp, Homo sapiens
tcagagctccatgctg

SEQ ID NO: 3648224 - DNA, 19 bp, Homo sapiens
tcagatcaccccagcctca

SEQ ID NO: 3648225 - DNA, 13 bp, Homo sapiens
tcagatccttcca

SEQ ID NO: 3648226 - DNA, 15 bp, Homo sapiens
tcagatctcatcagg

SEQ ID NO: 3648227 - DNA, 14 bp, Homo sapiens
tcagatctgaagta

SEQ ID NO: 3648228 - DNA, 17 bp, Homo sapiens
tcagcaatccttaaaaa

SEQ ID NO: 3648229 - DNA, 14 bp, Homo sapiens
tcagcatccaaaag

SEQ ID NO: 3648230 - DNA, 20 bp, Homo sapiens
tcagcatccaaaagcaggaa

SEQ ID NO: 3648231 - DNA, 21 bp, Homo sapiens
tcagcatccaaaagcaggaac

SEQ ID NO: 3648232 - DNA, 18 bp, Homo sapiens
tcagcatcctggaaattt

SEQ ID NO: 3648233 - DNA, 14 bp, Homo sapiens
tcagctactcagga

SEQ ID NO: 3648234 - DNA, 16 bp, Homo sapiens
tcaggaggctgaggca

SEQ ID NO: 3648235 - DNA, 21 bp, Homo sapiens
tcaggaggctgaggcaggaga

SEQ ID NO: 3648236 - DNA, 16 bp, Homo sapiens
tcagggtagcagcaga

SEQ ID NO: 3648237 - DNA, 21 bp, Homo sapiens
tcagggtagcagcagaggcag

SEQ ID NO: 3648238 - DNA, 14 bp, Homo sapiens
tcagggtggagaag

SEQ ID NO: 3648239 - DNA, 15 bp, Homo sapiens
tcaggtaaactgatg

SEQ ID NO: 3648240 - DNA, 15 bp, Homo sapiens
tcagtctatgctgtg

SEQ ID NO: 3648241 - DNA, 16 bp, Homo sapiens
tcagtctatgctgtgt

SEQ ID NO: 3648242 - DNA, 14 bp, Homo sapiens
tcatagataccatt

SEQ ID NO: 3648243 - DNA, 16 bp, Homo sapiens
tcatagcacatgtttt

SEQ ID NO: 3648244 - DNA, 20 bp, Homo sapiens
tcatagcacatgttttacaa

SEQ ID NO: 3648245 - DNA, 20 bp, Homo sapiens
tcatcgggattgtctttttt

SEQ ID NO: 3648246 - DNA, 13 bp, Homo sapiens
tcatctacacata

SEQ ID NO: 3648247 - DNA, 15 bp, Homo sapiens
tcatctacacatata

SEQ ID NO: 3648248 - DNA, 22 bp, Homo sapiens
tcatctacacatataaacacag

SEQ ID NO: 3648249 - DNA, 21 bp, Homo sapiens
tcatctcaggtggcatttgca

SEQ ID NO: 3648250 - DNA, 22 bp, Homo sapiens
tcatctcaggtggcatttgcag

SEQ ID NO: 3648251 - DNA, 13 bp, Homo sapiens
tcatctggaacca

SEQ ID NO: 3648252 - DNA, 19 bp, Homo sapiens
tcatgcaagtgagaaagac

SEQ ID NO: 3648253 - DNA, 14 bp, Homo sapiens
tcatgcatggaaat

SEQ ID NO: 3648254 - DNA, 17 bp, Homo sapiens
tcatgtacttaataaca

SEQ ID NO: 3648255 - DNA, 18 bp, Homo sapiens
tcattccccgacactgcc

SEQ ID NO: 3648256 - DNA, 15 bp, Homo sapiens
tcattgtgcccactt

SEQ ID NO: 3648257 - DNA, 12 bp, Homo sapiens
tcatttcaggat

SEQ ID NO: 3648258 - DNA, 17 bp, Homo sapiens
tcatttggatataaatc

SEQ ID NO: 3648259 - DNA, 21 bp, Homo sapiens
tcattttattctgtcaatgaa

SEQ ID NO: 3648260 - DNA, 15 bp, Homo sapiens
tcattttgatgtatt

SEQ ID NO: 3648261 - DNA, 19 bp, Homo sapiens
tccaaaagtactagcaata

SEQ ID NO: 3648262 - DNA, 22 bp, Homo sapiens
tccaaaagtactagcaataagt

SEQ ID NO: 3648263 - DNA, 23 bp, Homo sapiens
tccacagggacacagtctggtgc

SEQ ID NO: 3648264 - DNA, 20 bp, Homo sapiens
tccactacaggttttatgag

SEQ ID NO: 3648265 - DNA, 23 bp, Homo sapiens
tccatgtgataattgtaaaggtg

SEQ ID NO: 3648266 - DNA, 17 bp, Homo sapiens
tccatgtgctgctgtgg

SEQ ID NO: 3648267 - DNA, 15 bp, Homo sapiens
tccatttcccacttc

SEQ ID NO: 3648268 - DNA, 19 bp, Homo sapiens
tccatttggattttaaaca

SEQ ID NO: 3648269 - DNA, 21 bp, Homo sapiens
tccatttggattttaaacaaa

SEQ ID NO: 3648270 - DNA, 20 bp, Homo sapiens
tcccaaaagcccattcattc

SEQ ID NO: 3648271 - DNA, 17 bp, Homo sapiens
tcccacttccacccccg

SEQ ID NO: 3648272 - DNA, 17 bp, Homo sapiens
tcccagcctcttccatt

SEQ ID NO: 3648273 - DNA, 14 bp, Homo sapiens
tcccagctacaggg

SEQ ID NO: 3648274 - DNA, 22 bp, Homo sapiens
tcccagctacaggggaggctga

SEQ ID NO: 3648275 - DNA, 16 bp, Homo sapiens
tcccagtcgaggctgg

SEQ ID NO: 3648276 - DNA, 22 bp, Homo sapiens
tccctcccttctttccttcctt

SEQ ID NO: 3648277 - DNA, 14 bp, Homo sapiens
tccctgaaccttcc

SEQ ID NO: 3648278 - DNA, 22 bp, Homo sapiens
tccctgaaccttcctgtctccc

SEQ ID NO: 3648279 - DNA, 21 bp, Homo sapiens
tcccttcatctggaaccatca

SEQ ID NO: 3648280 - DNA, 14 bp, Homo sapiens
tcccttctttcctt

SEQ ID NO: 3648281 - DNA, 13 bp, Homo sapiens
tcctaattcctgt

SEQ ID NO: 3648282 - DNA, 18 bp, Homo sapiens
tcctaattcctgtatgtt

SEQ ID NO: 3648283 - DNA, 13 bp, Homo sapiens
tcctacaggagat

SEQ ID NO: 3648284 - DNA, 22 bp, Homo sapiens
tcctagcactttgggaggctga

SEQ ID NO: 3648285 - DNA, 17 bp, Homo sapiens
tcctcaagttgtgtgct

SEQ ID NO: 3648286 - DNA, 14 bp, Homo sapiens
tcctcagagctcca

SEQ ID NO: 3648287 - DNA, 16 bp, Homo sapiens
tcctcagagctccatg

SEQ ID NO: 3648288 - DNA, 20 bp, Homo sapiens
tcctgcaggactctatccct

SEQ ID NO: 3648289 - DNA, 16 bp, Homo sapiens
tcctggaaatttgtgt

SEQ ID NO: 3648290 - DNA, 20 bp, Homo sapiens
tcctggaaatttgtgtgctt

SEQ ID NO: 3648291 - DNA, 22 bp, Homo sapiens
tcctggaaatttgtgtgcttca

SEQ ID NO: 3648292 - DNA, 12 bp, Homo sapiens
tcctgggctggc

SEQ ID NO: 3648293 - DNA, 11 bp, Homo sapiens
tcctgtatgtt

SEQ ID NO: 3648294 - DNA, 13 bp, Homo sapiens
tcctttctctctt

SEQ ID NO: 3648295 - DNA, 15 bp, Homo sapiens
tccttttagaagcag

SEQ ID NO: 3648296 - DNA, 18 bp, Homo sapiens
tcgatttgtattaatgta

SEQ ID NO: 3648297 - DNA, 16 bp, Homo sapiens
tcgtaagttctgtgca

SEQ ID NO: 3648298 - DNA, 20 bp, Homo sapiens
tcgtgccattacactccagc

SEQ ID NO: 3648299 - DNA, 21 bp, Homo sapiens
tcgtgccattacactccagcc

SEQ ID NO: 3648300 - DNA, 14 bp, Homo sapiens
tcgtggactccagc

SEQ ID NO: 3648301 - DNA, 17 bp, Homo sapiens
tctaaaccagaaggaag

SEQ ID NO: 3648302 - DNA, 12 bp, Homo sapiens
tctaagaattca

SEQ ID NO: 3648303 - DNA, 14 bp, Homo sapiens
tctaagaattcagt

SEQ ID NO: 3648304 - DNA, 16 bp, Homo sapiens
tctaatccatgtgctg

SEQ ID NO: 3648305 - DNA, 19 bp, Homo sapiens
tctacaaacttttataaat

SEQ ID NO: 3648306 - DNA, 22 bp, Homo sapiens
tctacaaacttttataaatgtt

SEQ ID NO: 3648307 - DNA, 21 bp, Homo sapiens
tctacacatataaacacagta

SEQ ID NO: 3648308 - DNA, 15 bp, Homo sapiens
tctagatatgagaaa

SEQ ID NO: 3648309 - DNA, 13 bp, Homo sapiens
tctatatttactg

SEQ ID NO: 3648310 - DNA, 14 bp, Homo sapiens
tctatatttactgt

SEQ ID NO: 3648311 - DNA, 17 bp, Homo sapiens
tctatatttactgttta

SEQ ID NO: 3648312 - DNA, 15 bp, Homo sapiens
tctatccctggcttc

SEQ ID NO: 3648313 - DNA, 22 bp, Homo sapiens
tctatccctggcttccccttca

SEQ ID NO: 3648314 - DNA, 17 bp, Homo sapiens
tctatgctgtgtgcaga

SEQ ID NO: 3648315 - DNA, 18 bp, Homo sapiens
tctatttgatttgcaaca

SEQ ID NO: 3648316 - DNA, 17 bp, Homo sapiens
tctattttttctgagga

SEQ ID NO: 3648317 - DNA, 13 bp, Homo sapiens
tctcaacacacag

SEQ ID NO: 3648318 - DNA, 15 bp, Homo sapiens
tctcaacacacagta

SEQ ID NO: 3648319 - DNA, 19 bp, Homo sapiens
tctcagaagtgaaaaagac

SEQ ID NO: 3648320 - DNA, 22 bp, Homo sapiens
tctccacagggacacagtctgg

SEQ ID NO: 3648321 - DNA, 13 bp, Homo sapiens
tctctaagaattc

SEQ ID NO: 3648322 - DNA, 15 bp, Homo sapiens
tctctatttgatttg

SEQ ID NO: 3648323 - DNA, 16 bp, Homo sapiens
tctgatacatctgtca

SEQ ID NO: 3648324 - DNA, 19 bp, Homo sapiens
tctgatacatctgtcagtg

SEQ ID NO: 3648325 - DNA, 15 bp, Homo sapiens
tctgcaggcagcctt

SEQ ID NO: 3648326 - DNA, 17 bp, Homo sapiens
tctgccacaagggcagt

SEQ ID NO: 3648327 - DNA, 16 bp, Homo sapiens
tctgctcatctacaca

SEQ ID NO: 3648328 - DNA, 19 bp, Homo sapiens
tctggaaaaaaaaaaatat

SEQ ID NO: 3648329 - DNA, 22 bp, Homo sapiens
tctggaagtgactttggctgca

SEQ ID NO: 3648330 - DNA, 17 bp, Homo sapiens
tctgggtgcggtggctc

SEQ ID NO: 3648331 - DNA, 13 bp, Homo sapiens
tctgtattgctaa

SEQ ID NO: 3648332 - DNA, 22 bp, Homo sapiens
tctgtccctaaacatagtggta

SEQ ID NO: 3648333 - DNA, 23 bp, Homo sapiens
tctgtccctaaacatagtggtat

SEQ ID NO: 3648334 - DNA, 21 bp, Homo sapiens
tctgtgaaagtctcctgtatc

SEQ ID NO: 3648335 - DNA, 21 bp, Homo sapiens
tctgtgcagtttggtatgaaa

SEQ ID NO: 3648336 - DNA, 18 bp, Homo sapiens
tctgttgaagtgcatgtt

SEQ ID NO: 3648337 - DNA, 20 bp, Homo sapiens
tcttaaaaattatctttaaa

SEQ ID NO: 3648338 - DNA, 14 bp, Homo sapiens
tcttaactaatgta

SEQ ID NO: 3648339 - DNA, 21 bp, Homo sapiens
tcttaaggacagtgttcaaat

SEQ ID NO: 3648340 - DNA, 22 bp, Homo sapiens
tcttaaggacagtgttcaaatt

SEQ ID NO: 3648341 - DNA, 16 bp, Homo sapiens
tcttacccttcaatgt

SEQ ID NO: 3648342 - DNA, 20 bp, Homo sapiens
tcttacccttcaatgttaaa

SEQ ID NO: 3648343 - DNA, 16 bp, Homo sapiens
tcttaccgaaatgaaa

SEQ ID NO: 3648344 - DNA, 19 bp, Homo sapiens
tcttaccgaaatgaaaatg

SEQ ID NO: 3648345 - DNA, 16 bp, Homo sapiens
tcttcattgcactgca

SEQ ID NO: 3648346 - DNA, 13 bp, Homo sapiens
tcttctcctttgt

SEQ ID NO: 3648347 - DNA, 15 bp, Homo sapiens
tcttctcctttgtca

SEQ ID NO: 3648348 - DNA, 18 bp, Homo sapiens
tcttctcctttgtcaaat

SEQ ID NO: 3648349 - DNA, 13 bp, Homo sapiens
tcttgttgttcat

SEQ ID NO: 3648350 - DNA, 16 bp, Homo sapiens
tctttaatttttctgt

SEQ ID NO: 3648351 - DNA, 21 bp, Homo sapiens
tctttattggtgaccttttgt

SEQ ID NO: 3648352 - DNA, 14 bp, Homo sapiens
tctttcccagcctc

SEQ ID NO: 3648353 - DNA, 16 bp, Homo sapiens
tctttgccaccctcat

SEQ ID NO: 3648354 - DNA, 20 bp, Homo sapiens
tctttgccaccctcatgctg

SEQ ID NO: 3648355 - DNA, 21 bp, Homo sapiens
tctttgccaccctcatgctgt

SEQ ID NO: 3648356 - DNA, 13 bp, Homo sapiens
tctttgttaaaat

SEQ ID NO: 3648357 - DNA, 18 bp, Homo sapiens
tgaaaaagacttcaaatg

SEQ ID NO: 3648358 - DNA, 12 bp, Homo sapiens
tgaaaaagtgtt

SEQ ID NO: 3648359 - DNA, 15 bp, Homo sapiens
tgaaaaagtgttttt

SEQ ID NO: 3648360 - DNA, 20 bp, Homo sapiens
tgaaaaagtgtttttacata

SEQ ID NO: 3648361 - DNA, 20 bp, Homo sapiens
tgaaaaatagtgtgtccatg

SEQ ID NO: 3648362 - DNA, 15 bp, Homo sapiens
tgaaaataataaagt

SEQ ID NO: 3648363 - DNA, 16 bp, Homo sapiens
tgaaaatggctgaaga

SEQ ID NO: 3648364 - DNA, 21 bp, Homo sapiens
tgaaacaaatatactcatttg

SEQ ID NO: 3648365 - DNA, 22 bp, Homo sapiens
tgaaacaaatatactcatttgg

SEQ ID NO: 3648366 - DNA, 23 bp, Homo sapiens
tgaaagagaatttggagccagga

SEQ ID NO: 3648367 - DNA, 15 bp, Homo sapiens
tgaaagtcaagtcta

SEQ ID NO: 3648368 - DNA, 20 bp, Homo sapiens
tgaaagtctcctgtatcatt

SEQ ID NO: 3648369 - DNA, 19 bp, Homo sapiens
tgaaataaagtcaaatcaa

SEQ ID NO: 3648370 - DNA, 12 bp, Homo sapiens
tgaaattagtat

SEQ ID NO: 3648371 - DNA, 17 bp, Homo sapiens
tgaaattagtgttttca

SEQ ID NO: 3648372 - DNA, 19 bp, Homo sapiens
tgaaattagtgttttcatt

SEQ ID NO: 3648373 - DNA, 22 bp, Homo sapiens
tgaaattagtgttttcattctg

SEQ ID NO: 3648374 - DNA, 17 bp, Homo sapiens
tgaacaatcagattaga

SEQ ID NO: 3648375 - DNA, 12 bp, Homo sapiens
tgaacctgtgag

SEQ ID NO: 3648376 - DNA, 20 bp, Homo sapiens
tgaactatcagggcaagctc

SEQ ID NO: 3648377 - DNA, 14 bp, Homo sapiens
tgaagaaaatcctt

SEQ ID NO: 3648378 - DNA, 15 bp, Homo sapiens
tgaagaaacacagca

SEQ ID NO: 3648379 - DNA, 18 bp, Homo sapiens
tgaagaaacacagcatgc

SEQ ID NO: 3648380 - DNA, 13 bp, Homo sapiens
tgaagagaaagac

SEQ ID NO: 3648381 - DNA, 21 bp, Homo sapiens
tgaagagaaagacagtatttg

SEQ ID NO: 3648382 - DNA, 15 bp, Homo sapiens
tgaagtgcatgttaa

SEQ ID NO: 3648383 - DNA, 16 bp, Homo sapiens
tgaagtgcatgttaaa

SEQ ID NO: 3648384 - DNA, 14 bp, Homo sapiens
tgaataaaatgttt

SEQ ID NO: 3648385 - DNA, 15 bp, Homo sapiens
tgaatggttgcaaag

SEQ ID NO: 3648386 - DNA, 19 bp, Homo sapiens
tgaatggttgcaaagtgtt

SEQ ID NO: 3648387 - DNA, 20 bp, Homo sapiens
tgaatttaccatcaaacaaa

SEQ ID NO: 3648388 - DNA, 19 bp, Homo sapiens
tgaattttttttctgaatt

SEQ ID NO: 3648389 - DNA, 20 bp, Homo sapiens
tgacagcatttcagctgtga

SEQ ID NO: 3648390 - DNA, 21 bp, Homo sapiens
tgacaggacatttgacatgag

SEQ ID NO: 3648391 - DNA, 17 bp, Homo sapiens
tgacagtggttatattt

SEQ ID NO: 3648392 - DNA, 20 bp, Homo sapiens
tgacagttacttacacacct

SEQ ID NO: 3648393 - DNA, 14 bp, Homo sapiens
tgacattgtcagaa

SEQ ID NO: 3648394 - DNA, 15 bp, Homo sapiens
tgacattgtcagaat

SEQ ID NO: 3648395 - DNA, 16 bp, Homo sapiens
tgacattgtcagaatg

SEQ ID NO: 3648396 - DNA, 17 bp, Homo sapiens
tgacattgtcagaatgt

SEQ ID NO: 3648397 - DNA, 23 bp, Homo sapiens
tgaccagaatgaggcacatgaca

SEQ ID NO: 3648398 - DNA, 18 bp, Homo sapiens
tgacctcgtgatccgccc

SEQ ID NO: 3648399 - DNA, 17 bp, Homo sapiens
tgacgtcttaggtggca

SEQ ID NO: 3648400 - DNA, 18 bp, Homo sapiens
tgacttggagagagattc

SEQ ID NO: 3648401 - DNA, 13 bp, Homo sapiens
tgagaatgtgcct

SEQ ID NO: 3648402 - DNA, 15 bp, Homo sapiens
tgagacggagtcttg

SEQ ID NO: 3648403 - DNA, 19 bp, Homo sapiens
tgagactggaaaaggtgga

SEQ ID NO: 3648404 - DNA, 15 bp, Homo sapiens
tgagatgatttaatt

SEQ ID NO: 3648405 - DNA, 20 bp, Homo sapiens
tgagattggaaaaaattaga

SEQ ID NO: 3648406 - DNA, 21 bp, Homo sapiens
tgagcatgcccaaatataaca

SEQ ID NO: 3648407 - DNA, 23 bp, Homo sapiens
tgagcccagaagctcaaggctgc

SEQ ID NO: 3648408 - DNA, 14 bp, Homo sapiens
tgagccttattaaa

SEQ ID NO: 3648409 - DNA, 17 bp, Homo sapiens
tgagccttattaaaata

SEQ ID NO: 3648410 - DNA, 18 bp, Homo sapiens
tgagccttattaaaatat

SEQ ID NO: 3648411 - DNA, 15 bp, Homo sapiens
tgaggaaaatggaag

SEQ ID NO: 3648412 - DNA, 22 bp, Homo sapiens
tgaggaaaatggaagacctaag

SEQ ID NO: 3648413 - DNA, 17 bp, Homo sapiens
tgaggaagaggttgcag

SEQ ID NO: 3648414 - DNA, 22 bp, Homo sapiens
tgaggcaactcagcaggctaag

SEQ ID NO: 3648415 - DNA, 12 bp, Homo sapiens
tgaggcacatga

SEQ ID NO: 3648416 - DNA, 22 bp, Homo sapiens
tgaggtagtgccaatgacagga

SEQ ID NO: 3648417 - DNA, 15 bp, Homo sapiens
tgagtcaaaaaatct

SEQ ID NO: 3648418 - DNA, 15 bp, Homo sapiens
tgagtgcaagagcct

SEQ ID NO: 3648419 - DNA, 16 bp, Homo sapiens
tgagtgcaagagcctg

SEQ ID NO: 3648420 - DNA, 18 bp, Homo sapiens
tgagtgcaagagcctgag

SEQ ID NO: 3648421 - DNA, 15 bp, Homo sapiens
tgagttctgcacata

SEQ ID NO: 3648422 - DNA, 19 bp, Homo sapiens
tgagttctgcacatacaga

SEQ ID NO: 3648423 - DNA, 19 bp, Homo sapiens
tgagttggttacctattgc

SEQ ID NO: 3648424 - DNA, 18 bp, Homo sapiens
tgagtttccagctaagcc

SEQ ID NO: 3648425 - DNA, 16 bp, Homo sapiens
tgataatagctcacag

SEQ ID NO: 3648426 - DNA, 14 bp, Homo sapiens
tgataattgtaaag

SEQ ID NO: 3648427 - DNA, 24 bp, Homo sapiens
tgataattgtaaaggtgatgaatt

SEQ ID NO: 3648428 - DNA, 21 bp, Homo sapiens
tgatacttatttataacattg

SEQ ID NO: 3648429 - DNA, 20 bp, Homo sapiens
tgatatagagtgacttggag

SEQ ID NO: 3648430 - DNA, 19 bp, Homo sapiens
tgatatctgtttgcttcta

SEQ ID NO: 3648431 - DNA, 14 bp, Homo sapiens
tgatatgtctttaa

SEQ ID NO: 3648432 - DNA, 22 bp, Homo sapiens
tgatctcagcatcctggaaatt

SEQ ID NO: 3648433 - DNA, 15 bp, Homo sapiens
tgatgaataaaatgt

SEQ ID NO: 3648434 - DNA, 16 bp, Homo sapiens
tgatgaataaaatgtt

SEQ ID NO: 3648435 - DNA, 14 bp, Homo sapiens
tgatgatggaaggg

SEQ ID NO: 3648436 - DNA, 13 bp, Homo sapiens
tgattaaggacta

SEQ ID NO: 3648437 - DNA, 17 bp, Homo sapiens
tgattaaggactacaga

SEQ ID NO: 3648438 - DNA, 19 bp, Homo sapiens
tgattaaggactacagaat

SEQ ID NO: 3648439 - DNA, 14 bp, Homo sapiens
tgattattacaaca

SEQ ID NO: 3648440 - DNA, 14 bp, Homo sapiens
tgattcacttttat

SEQ ID NO: 3648441 - DNA, 11 bp, Homo sapiens
tgcaacactgc

SEQ ID NO: 3648442 - DNA, 18 bp, Homo sapiens
tgcaacactgccaaacat

SEQ ID NO: 3648443 - DNA, 14 bp, Homo sapiens
tgcaacagactgcc

SEQ ID NO: 3648444 - DNA, 21 bp, Homo sapiens
tgcaacagactgccttatatt

SEQ ID NO: 3648445 - DNA, 21 bp, Homo sapiens
tgcaacctccgcatcccgggt

SEQ ID NO: 3648446 - DNA, 17 bp, Homo sapiens
tgcaaccttgtacttta

SEQ ID NO: 3648447 - DNA, 14 bp, Homo sapiens
tgcaagagcctgag

SEQ ID NO: 3648448 - DNA, 19 bp, Homo sapiens
tgcaagagcctgagactgg

SEQ ID NO: 3648449 - DNA, 20 bp, Homo sapiens
tgcaagagcctgagactgga

SEQ ID NO: 3648450 - DNA, 23 bp, Homo sapiens
tgcaatgtctgtccctaaacata

SEQ ID NO: 3648451 - DNA, 20 bp, Homo sapiens
tgcactggaattttgcttta

SEQ ID NO: 3648452 - DNA, 19 bp, Homo sapiens
tgcagagtatacaagtgtt

SEQ ID NO: 3648453 - DNA, 23 bp, Homo sapiens
tgcagcccccactgcctttgacc

SEQ ID NO: 3648454 - DNA, 18 bp, Homo sapiens
tgcagctaatttgtgaaa

SEQ ID NO: 3648455 - DNA, 14 bp, Homo sapiens
tgcaggaaaaggct

SEQ ID NO: 3648456 - DNA, 23 bp, Homo sapiens
tgcaggactctatccctggcttc

SEQ ID NO: 3648457 - DNA, 11 bp, Homo sapiens
tgcaggcagcc

SEQ ID NO: 3648458 - DNA, 18 bp, Homo sapiens
tgcaggtgaccagaatga

SEQ ID NO: 3648459 - DNA, 14 bp, Homo sapiens
tgcagtgagctgag

SEQ ID NO: 3648460 - DNA, 15 bp, Homo sapiens
tgcagtgagctgaga

SEQ ID NO: 3648461 - DNA, 22 bp, Homo sapiens
tgcagttatttaccagaagttt

SEQ ID NO: 3648462 - DNA, 19 bp, Homo sapiens
tgcagtttggtatgaaaca

SEQ ID NO: 3648463 - DNA, 16 bp, Homo sapiens
tgcatatggcaacgtt

SEQ ID NO: 3648464 - DNA, 24 bp, Homo sapiens
tgcatatggcaacgttcatgttca

SEQ ID NO: 3648465 - DNA, 13 bp, Homo sapiens
tgcattcagatct

SEQ ID NO: 3648466 - DNA, 19 bp, Homo sapiens
tgcattcagatctgaagta

SEQ ID NO: 3648467 - DNA, 19 bp, Homo sapiens
tgcatttagcatgagttct

SEQ ID NO: 3648468 - DNA, 20 bp, Homo sapiens
tgcatttagcatgagttctg

SEQ ID NO: 3648469 - DNA, 17 bp, Homo sapiens
tgccaatgacaggacat

SEQ ID NO: 3648470 - DNA, 17 bp, Homo sapiens
tgccaccctcatgctgt

SEQ ID NO: 3648471 - DNA, 16 bp, Homo sapiens
tgccatgtatgttgca

SEQ ID NO: 3648472 - DNA, 17 bp, Homo sapiens
tgccatttcctcctggg

SEQ ID NO: 3648473 - DNA, 12 bp, Homo sapiens
tgccttatatta

SEQ ID NO: 3648474 - DNA, 16 bp, Homo sapiens
tgccttatattatttt

SEQ ID NO: 3648475 - DNA, 17 bp, Homo sapiens
tgcctttgacctgcctc

SEQ ID NO: 3648476 - DNA, 16 bp, Homo sapiens
tgctacaaaatgtgtg

SEQ ID NO: 3648477 - DNA, 15 bp, Homo sapiens
tgctagaggtggcat

SEQ ID NO: 3648478 - DNA, 12 bp, Homo sapiens
tgctagttctta

SEQ ID NO: 3648479 - DNA, 17 bp, Homo sapiens
tgctatctcgctagcca

SEQ ID NO: 3648480 - DNA, 18 bp, Homo sapiens
tgctatgctgttcattga

SEQ ID NO: 3648481 - DNA, 18 bp, Homo sapiens
tgctattcgtaagttctg

SEQ ID NO: 3648482 - DNA, 21 bp, Homo sapiens
tgctattcgtaagttctgtgc

SEQ ID NO: 3648483 - DNA, 15 bp, Homo sapiens
tgctcatctacacat

SEQ ID NO: 3648484 - DNA, 17 bp, Homo sapiens
tgctcatctacacatat

SEQ ID NO: 3648485 - DNA, 17 bp, Homo sapiens
tgctctctaagaattca

SEQ ID NO: 3648486 - DNA, 14 bp, Homo sapiens
tgctctgcaggcag

SEQ ID NO: 3648487 - DNA, 19 bp, Homo sapiens
tgctctgcaggcagccttg

SEQ ID NO: 3648488 - DNA, 14 bp, Homo sapiens
tgctgtctgaaaaa

SEQ ID NO: 3648489 - DNA, 18 bp, Homo sapiens
tgctgtctgaaaaagtgt

SEQ ID NO: 3648490 - DNA, 16 bp, Homo sapiens
tgctgtgaaatgactg

SEQ ID NO: 3648491 - DNA, 15 bp, Homo sapiens
tgctgtgtgcagagt

SEQ ID NO: 3648492 - DNA, 14 bp, Homo sapiens
tgcttcacacaaag

SEQ ID NO: 3648493 - DNA, 15 bp, Homo sapiens
tgcttcacacaaagt

SEQ ID NO: 3648494 - DNA, 16 bp, Homo sapiens
tgctttatcagaagca

SEQ ID NO: 3648495 - DNA, 19 bp, Homo sapiens
tgctttatcagaagcaagg

SEQ ID NO: 3648496 - DNA, 13 bp, Homo sapiens
tggaaacatctga

SEQ ID NO: 3648497 - DNA, 14 bp, Homo sapiens
tggaaacatctgat

SEQ ID NO: 3648498 - DNA, 15 bp, Homo sapiens
tggaaacatctgatt

SEQ ID NO: 3648499 - DNA, 17 bp, Homo sapiens
tggaaacatctgatttc

SEQ ID NO: 3648500 - DNA, 20 bp, Homo sapiens
tggaaacatctgatttctga

SEQ ID NO: 3648501 - DNA, 22 bp, Homo sapiens
tggaaattcccttcatctggaa

SEQ ID NO: 3648502 - DNA, 20 bp, Homo sapiens
tggaagaagaaccaggcatg

SEQ ID NO: 3648503 - DNA, 21 bp, Homo sapiens
tggaagaagaaccaggcatgg

SEQ ID NO: 3648504 - DNA, 12 bp, Homo sapiens
tggaagaattca

SEQ ID NO: 3648505 - DNA, 14 bp, Homo sapiens
tggaagacctaagg

SEQ ID NO: 3648506 - DNA, 18 bp, Homo sapiens
tggaagggccttctccac

SEQ ID NO: 3648507 - DNA, 13 bp, Homo sapiens
tggaagtatagat

SEQ ID NO: 3648508 - DNA, 15 bp, Homo sapiens
tggaagtgactttgg

SEQ ID NO: 3648509 - DNA, 16 bp, Homo sapiens
tggaagttttacttga

SEQ ID NO: 3648510 - DNA, 21 bp, Homo sapiens
tggaagttttacttgattaag

SEQ ID NO: 3648511 - DNA, 17 bp, Homo sapiens
tggacttgtctcccagt

SEQ ID NO: 3648512 - DNA, 21 bp, Homo sapiens
tggagaagttccctgaacctt

SEQ ID NO: 3648513 - DNA, 18 bp, Homo sapiens
tggagactaacttatttt

SEQ ID NO: 3648514 - DNA, 14 bp, Homo sapiens
tggagagggatgga

SEQ ID NO: 3648515 - DNA, 22 bp, Homo sapiens
tggagattactaactgtggaca

SEQ ID NO: 3648516 - DNA, 17 bp, Homo sapiens
tggaggtgttgtgggga

SEQ ID NO: 3648517 - DNA, 14 bp, Homo sapiens
tggatataaatctt

SEQ ID NO: 3648518 - DNA, 17 bp, Homo sapiens
tggatcatgaggtcagg

SEQ ID NO: 3648519 - DNA, 19 bp, Homo sapiens
tggattttaaacaaaattt

SEQ ID NO: 3648520 - DNA, 16 bp, Homo sapiens
tggcaacatttgggga

SEQ ID NO: 3648521 - DNA, 20 bp, Homo sapiens
tggcaacatttggggagaga

SEQ ID NO: 3648522 - DNA, 19 bp, Homo sapiens
tggcaacgttcatgttcat

SEQ ID NO: 3648523 - DNA, 20 bp, Homo sapiens
tggcaagctcttcattgcac

SEQ ID NO: 3648524 - DNA, 23 bp, Homo sapiens
tggccacaagttctttcccagcc

SEQ ID NO: 3648525 - DNA, 19 bp, Homo sapiens
tggccatcatttcattcgt

SEQ ID NO: 3648526 - DNA, 23 bp, Homo sapiens
tggcctattttggacgtgtgagg

SEQ ID NO: 3648527 - DNA, 18 bp, Homo sapiens
tggctagaatcagggtgg

SEQ ID NO: 3648528 - DNA, 17 bp, Homo sapiens
tggcttagaaggcactg

SEQ ID NO: 3648529 - DNA, 15 bp, Homo sapiens
tggcttccccttcag

SEQ ID NO: 3648530 - DNA, 19 bp, Homo sapiens
tggcttccccttcagacct

SEQ ID NO: 3648531 - DNA, 15 bp, Homo sapiens
tgggaggccgaggca

SEQ ID NO: 3648532 - DNA, 18 bp, Homo sapiens
tgggaggccgaggcaggt

SEQ ID NO: 3648533 - DNA, 22 bp, Homo sapiens
tgggcccttagaatgtgaaaaa

SEQ ID NO: 3648534 - DNA, 22 bp, Homo sapiens
tgggcctgctgctctctaagaa

SEQ ID NO: 3648535 - DNA, 19 bp, Homo sapiens
tggggatggtgatggagag

SEQ ID NO: 3648536 - DNA, 23 bp, Homo sapiens
tggggtgatgaccccatagacct

SEQ ID NO: 3648537 - DNA, 20 bp, Homo sapiens
tgggttaacagtaaatatac

SEQ ID NO: 3648538 - DNA, 18 bp, Homo sapiens
tgggttagggaaaacatt

SEQ ID NO: 3648539 - DNA, 19 bp, Homo sapiens
tgggttagggaaaacattc

SEQ ID NO: 3648540 - DNA, 18 bp, Homo sapiens
tggtaagggaccttcagg

SEQ ID NO: 3648541 - DNA, 18 bp, Homo sapiens
tggtagaaactttggaag

SEQ ID NO: 3648542 - DNA, 15 bp, Homo sapiens
tggtatgaaacaaat

SEQ ID NO: 3648543 - DNA, 17 bp, Homo sapiens
tggtatgaaacaaatat

SEQ ID NO: 3648544 - DNA, 14 bp, Homo sapiens
tggtatttactgca

SEQ ID NO: 3648545 - DNA, 20 bp, Homo sapiens
tggtatttactgcaatgtct

SEQ ID NO: 3648546 - DNA, 14 bp, Homo sapiens
tggtattttaacat

SEQ ID NO: 3648547 - DNA, 18 bp, Homo sapiens
tggtattttaacatagca

SEQ ID NO: 3648548 - DNA, 20 bp, Homo sapiens
tggtattttaacatagcagc

SEQ ID NO: 3648549 - DNA, 22 bp, Homo sapiens
tggtcagaacctttggacaaga

SEQ ID NO: 3648550 - DNA, 20 bp, Homo sapiens
tggtcttaactaatgtaaat

SEQ ID NO: 3648551 - DNA, 22 bp, Homo sapiens
tggtgagtgcaagagcctgaga

SEQ ID NO: 3648552 - DNA, 19 bp, Homo sapiens
tggtgtcctgcatgtatgc

SEQ ID NO: 3648553 - DNA, 16 bp, Homo sapiens
tggttacctattgctg

SEQ ID NO: 3648554 - DNA, 19 bp, Homo sapiens
tggttacctattgctgtaa

SEQ ID NO: 3648555 - DNA, 19 bp, Homo sapiens
tggttcaatcaacagaatt

SEQ ID NO: 3648556 - DNA, 22 bp, Homo sapiens
tggttccacaatcatctattga

SEQ ID NO: 3648557 - DNA, 18 bp, Homo sapiens
tgtaaaggtgatgaattt

SEQ ID NO: 3648558 - DNA, 19 bp, Homo sapiens
tgtaaaggtgatgaattta

SEQ ID NO: 3648559 - DNA, 22 bp, Homo sapiens
tgtaaatgatatgtctttaaaa

SEQ ID NO: 3648560 - DNA, 18 bp, Homo sapiens
tgtaagacacgtgcaaca

SEQ ID NO: 3648561 - DNA, 22 bp, Homo sapiens
tgtaagacattagtttgaggta

SEQ ID NO: 3648562 - DNA, 13 bp, Homo sapiens
tgtaatcccagca

SEQ ID NO: 3648563 - DNA, 23 bp, Homo sapiens
tgtaatcccagcactttgggagg

SEQ ID NO: 3648564 - DNA, 19 bp, Homo sapiens
tgtaattcttctcctttgt

SEQ ID NO: 3648565 - DNA, 16 bp, Homo sapiens
tgtacatttatgtgtg

SEQ ID NO: 3648566 - DNA, 17 bp, Homo sapiens
tgtacatttatgtgtga

SEQ ID NO: 3648567 - DNA, 14 bp, Homo sapiens
tgtactttacaatc

SEQ ID NO: 3648568 - DNA, 15 bp, Homo sapiens
tgtatatctgtgtaa

SEQ ID NO: 3648569 - DNA, 21 bp, Homo sapiens
tgtatattgatgtaactgtgt

SEQ ID NO: 3648570 - DNA, 17 bp, Homo sapiens
tgtatgccatgtatgtt

SEQ ID NO: 3648571 - DNA, 15 bp, Homo sapiens
tgtatgttgcatgaa

SEQ ID NO: 3648572 - DNA, 22 bp, Homo sapiens
tgtcaaatggtattttttgtga

SEQ ID NO: 3648573 - DNA, 17 bp, Homo sapiens
tgtcagaatgttgtgtt

SEQ ID NO: 3648574 - DNA, 18 bp, Homo sapiens
tgtcatatatcaaatcat

SEQ ID NO: 3648575 - DNA, 21 bp, Homo sapiens
tgtcatcaagtagtagtactt

SEQ ID NO: 3648576 - DNA, 16 bp, Homo sapiens
tgtcatttcattgcac

SEQ ID NO: 3648577 - DNA, 13 bp, Homo sapiens
tgtcctgcatgta

SEQ ID NO: 3648578 - DNA, 13 bp, Homo sapiens
tgtctataggact

SEQ ID NO: 3648579 - DNA, 20 bp, Homo sapiens
tgtctctacaaaaaaaatca

SEQ ID NO: 3648580 - DNA, 15 bp, Homo sapiens
tgtgaaagtctcctg

SEQ ID NO: 3648581 - DNA, 17 bp, Homo sapiens
tgtgaatggttgcaaag

SEQ ID NO: 3648582 - DNA, 12 bp, Homo sapiens
tgtgaggaagag

SEQ ID NO: 3648583 - DNA, 19 bp, Homo sapiens
tgtgaggatgtggatggag

SEQ ID NO: 3648584 - DNA, 20 bp, Homo sapiens
tgtgcagtttggtatgaaac

SEQ ID NO: 3648585 - DNA, 18 bp, Homo sapiens
tgtgcttcacacaaagtg

SEQ ID NO: 3648586 - DNA, 13 bp, Homo sapiens
tgtggataaattt

SEQ ID NO: 3648587 - DNA, 21 bp, Homo sapiens
tgtggggatggtgatggagag

SEQ ID NO: 3648588 - DNA, 18 bp, Homo sapiens
tgtgttggtatttactgc

SEQ ID NO: 3648589 - DNA, 13 bp, Homo sapiens
tgttaaaatatag

SEQ ID NO: 3648590 - DNA, 17 bp, Homo sapiens
tgttaaaatatagtgtt

SEQ ID NO: 3648591 - DNA, 12 bp, Homo sapiens
tgttaaagaaac

SEQ ID NO: 3648592 - DNA, 21 bp, Homo sapiens
tgttaaagaaacatctacagg

SEQ ID NO: 3648593 - DNA, 15 bp, Homo sapiens
tgttaaatctacaaa

SEQ ID NO: 3648594 - DNA, 17 bp, Homo sapiens
tgttaatgattcttgtg

SEQ ID NO: 3648595 - DNA, 20 bp, Homo sapiens
tgttaatgattcttgtgtca

SEQ ID NO: 3648596 - DNA, 17 bp, Homo sapiens
tgttagaaaaaactgga

SEQ ID NO: 3648597 - DNA, 20 bp, Homo sapiens
tgttagaaaaaactggaaac

SEQ ID NO: 3648598 - DNA, 13 bp, Homo sapiens
tgttataaaatct

SEQ ID NO: 3648599 - DNA, 14 bp, Homo sapiens
tgttataaaatctg

SEQ ID NO: 3648600 - DNA, 16 bp, Homo sapiens
tgttcaaattctgatt

SEQ ID NO: 3648601 - DNA, 18 bp, Homo sapiens
tgttcaaattctgattat

SEQ ID NO: 3648602 - DNA, 14 bp, Homo sapiens
tgttccctccaggc

SEQ ID NO: 3648603 - DNA, 15 bp, Homo sapiens
tgttctcaacacaca

SEQ ID NO: 3648604 - DNA, 20 bp, Homo sapiens
tgttgtgttacaataagtgt

SEQ ID NO: 3648605 - DNA, 17 bp, Homo sapiens
tgttttacaaagaaaca

SEQ ID NO: 3648606 - DNA, 22 bp, Homo sapiens
tgttttcacagttcctctttgt

SEQ ID NO: 3648607 - DNA, 12 bp, Homo sapiens
tgtttttacata

SEQ ID NO: 3648608 - DNA, 17 bp, Homo sapiens
ttaaaaagacactttta

SEQ ID NO: 3648609 - DNA, 15 bp, Homo sapiens
ttaaaataattatat

SEQ ID NO: 3648610 - DNA, 19 bp, Homo sapiens
ttaaaataattatatgaag

SEQ ID NO: 3648611 - DNA, 20 bp, Homo sapiens
ttaaagaagtccatgtgata

SEQ ID NO: 3648612 - DNA, 16 bp, Homo sapiens
ttaaatctacaaactt

SEQ ID NO: 3648613 - DNA, 19 bp, Homo sapiens
ttaaatttattaaatgttg

SEQ ID NO: 3648614 - DNA, 16 bp, Homo sapiens
ttaacagtaaatatac

SEQ ID NO: 3648615 - DNA, 11 bp, Homo sapiens
ttaacatagca

SEQ ID NO: 3648616 - DNA, 18 bp, Homo sapiens
ttaacatagcagctggtt

SEQ ID NO: 3648617 - DNA, 15 bp, Homo sapiens
ttaactaatgtaaat

SEQ ID NO: 3648618 - DNA, 16 bp, Homo sapiens
ttaactaatgtaaata

SEQ ID NO: 3648619 - DNA, 17 bp, Homo sapiens
ttaacttctattttcaa

SEQ ID NO: 3648620 - DNA, 13 bp, Homo sapiens
ttaacttctgaaa

SEQ ID NO: 3648621 - DNA, 23 bp, Homo sapiens
ttaataacacttcaccttctgta

SEQ ID NO: 3648622 - DNA, 16 bp, Homo sapiens
ttaatgaaaaatctga

SEQ ID NO: 3648623 - DNA, 16 bp, Homo sapiens
ttaatgattcttgtgt

SEQ ID NO: 3648624 - DNA, 19 bp, Homo sapiens
ttaatgattcttgtgtcat

SEQ ID NO: 3648625 - DNA, 18 bp, Homo sapiens
ttaattattttctgagac

SEQ ID NO: 3648626 - DNA, 23 bp, Homo sapiens
ttaatttagcagtccatttttga

SEQ ID NO: 3648627 - DNA, 20 bp, Homo sapiens
ttaatttattaaatttatta

SEQ ID NO: 3648628 - DNA, 13 bp, Homo sapiens
ttacaacaagcaa

SEQ ID NO: 3648629 - DNA, 17 bp, Homo sapiens
ttacaatcatgcctaca

SEQ ID NO: 3648630 - DNA, 15 bp, Homo sapiens
ttacactccagcctg

SEQ ID NO: 3648631 - DNA, 16 bp, Homo sapiens
ttaccagaagtttaaa

SEQ ID NO: 3648632 - DNA, 22 bp, Homo sapiens
ttaccatcaaacaaatcatttt

SEQ ID NO: 3648633 - DNA, 15 bp, Homo sapiens
ttaccctgggctgga

SEQ ID NO: 3648634 - DNA, 18 bp, Homo sapiens
ttacccttcaatgttaaa

SEQ ID NO: 3648635 - DNA, 16 bp, Homo sapiens
ttactgcaatgtctgt

SEQ ID NO: 3648636 - DNA, 19 bp, Homo sapiens
ttacttacacacctgagaa

SEQ ID NO: 3648637 - DNA, 20 bp, Homo sapiens
ttagaaaaaactggaaacat

SEQ ID NO: 3648638 - DNA, 21 bp, Homo sapiens
ttagaaatatccttttagaag

SEQ ID NO: 3648639 - DNA, 16 bp, Homo sapiens
ttagaaggcactggga

SEQ ID NO: 3648640 - DNA, 20 bp, Homo sapiens
ttagaatcaagtctgtgaaa

SEQ ID NO: 3648641 - DNA, 15 bp, Homo sapiens
ttagagatgttgagt

SEQ ID NO: 3648642 - DNA, 21 bp, Homo sapiens
ttagcatgagttctgcacata

SEQ ID NO: 3648643 - DNA, 14 bp, Homo sapiens
ttagggaaaacatt

SEQ ID NO: 3648644 - DNA, 15 bp, Homo sapiens
ttagggaaaacattc

SEQ ID NO: 3648645 - DNA, 16 bp, Homo sapiens
ttagggttctatattt

SEQ ID NO: 3648646 - DNA, 15 bp, Homo sapiens
ttaggtctgttgaag

SEQ ID NO: 3648647 - DNA, 16 bp, Homo sapiens
ttagtaaattaagagc

SEQ ID NO: 3648648 - DNA, 21 bp, Homo sapiens
ttagtattttgagccttatta

SEQ ID NO: 3648649 - DNA, 14 bp, Homo sapiens
ttagtgttttcatt

SEQ ID NO: 3648650 - DNA, 18 bp, Homo sapiens
ttagtgttttcattctgg

SEQ ID NO: 3648651 - DNA, 14 bp, Homo sapiens
ttataacattgtaa

SEQ ID NO: 3648652 - DNA, 15 bp, Homo sapiens
ttataacattgtaaa

SEQ ID NO: 3648653 - DNA, 13 bp, Homo sapiens
ttatatatgtata

SEQ ID NO: 3648654 - DNA, 20 bp, Homo sapiens
ttatattattttctgtaatt

SEQ ID NO: 3648655 - DNA, 19 bp, Homo sapiens
ttatgaaaaaaaaagaaat

SEQ ID NO: 3648656 - DNA, 18 bp, Homo sapiens
ttatgtcattttcagatc

SEQ ID NO: 3648657 - DNA, 20 bp, Homo sapiens
ttattaaatttattaaatgt

SEQ ID NO: 3648658 - DNA, 21 bp, Homo sapiens
ttattaaatttattaaatgtt

SEQ ID NO: 3648659 - DNA, 17 bp, Homo sapiens
ttattcctaattcctgt

SEQ ID NO: 3648660 - DNA, 15 bp, Homo sapiens
ttattttctgtaatt

SEQ ID NO: 3648661 - DNA, 20 bp, Homo sapiens
ttcaaccacacctaaattaa

SEQ ID NO: 3648662 - DNA, 16 bp, Homo sapiens
ttcaatgctacaaaat

SEQ ID NO: 3648663 - DNA, 18 bp, Homo sapiens
ttcacacaaagtgaaatt

SEQ ID NO: 3648664 - DNA, 21 bp, Homo sapiens
ttcacacaaagtgaaattagt

SEQ ID NO: 3648665 - DNA, 21 bp, Homo sapiens
ttcacacaactgtggataaat

SEQ ID NO: 3648666 - DNA, 21 bp, Homo sapiens
ttcacttcttaaggacagtgt

SEQ ID NO: 3648667 - DNA, 17 bp, Homo sapiens
ttcagatccttccaaac

SEQ ID NO: 3648668 - DNA, 15 bp, Homo sapiens
ttcagatctgaagta

SEQ ID NO: 3648669 - DNA, 18 bp, Homo sapiens
ttcagatttctacacttt

SEQ ID NO: 3648670 - DNA, 13 bp, Homo sapiens
ttcagggagagct

SEQ ID NO: 3648671 - DNA, 17 bp, Homo sapiens
ttcagtctatgctgtgt

SEQ ID NO: 3648672 - DNA, 21 bp, Homo sapiens
ttcagtctatgctgtgtgcag

SEQ ID NO: 3648673 - DNA, 21 bp, Homo sapiens
ttcagtggacatttgttctgg

SEQ ID NO: 3648674 - DNA, 23 bp, Homo sapiens
ttcatagataccattttgaaata

SEQ ID NO: 3648675 - DNA, 12 bp, Homo sapiens
ttcatctggaac

SEQ ID NO: 3648676 - DNA, 17 bp, Homo sapiens
ttcatctggaaccatca

SEQ ID NO: 3648677 - DNA, 13 bp, Homo sapiens
ttcatgcatggaa

SEQ ID NO: 3648678 - DNA, 14 bp, Homo sapiens
ttcatgcatggaaa

SEQ ID NO: 3648679 - DNA, 16 bp, Homo sapiens
ttcatgcatggaaatt

SEQ ID NO: 3648680 - DNA, 15 bp, Homo sapiens
ttcattgcactgcag

SEQ ID NO: 3648681 - DNA, 15 bp, Homo sapiens
ttccataattcagat

SEQ ID NO: 3648682 - DNA, 22 bp, Homo sapiens
ttccatacgtgcccatttcaca

SEQ ID NO: 3648683 - DNA, 21 bp, Homo sapiens
ttccatttggattttaaacaa

SEQ ID NO: 3648684 - DNA, 13 bp, Homo sapiens
ttcccacttccac

SEQ ID NO: 3648685 - DNA, 18 bp, Homo sapiens
ttcccacttccacccccg

SEQ ID NO: 3648686 - DNA, 22 bp, Homo sapiens
ttcccagcctcttccattccct

SEQ ID NO: 3648687 - DNA, 12 bp, Homo sapiens
ttccccttcaga

SEQ ID NO: 3648688 - DNA, 16 bp, Homo sapiens
ttccctgaaccttcct

SEQ ID NO: 3648689 - DNA, 10 bp, Homo sapiens
ttccttcctt

SEQ ID NO: 3648690 - DNA, 17 bp, Homo sapiens
ttcgtaagttctgtgca

SEQ ID NO: 3648691 - DNA, 18 bp, Homo sapiens
ttcgtgggcctgctgctc

SEQ ID NO: 3648692 - DNA, 14 bp, Homo sapiens
ttctaaaccatgaa

SEQ ID NO: 3648693 - DNA, 22 bp, Homo sapiens
ttctaaaccatgaaaagttttc

SEQ ID NO: 3648694 - DNA, 18 bp, Homo sapiens
ttctaaaggtttcactgt

SEQ ID NO: 3648695 - DNA, 14 bp, Homo sapiens
ttctaatccatgtg

SEQ ID NO: 3648696 - DNA, 21 bp, Homo sapiens
ttctacactttatacttgcct

SEQ ID NO: 3648697 - DNA, 20 bp, Homo sapiens
ttctacttcttgtgctttac

SEQ ID NO: 3648698 - DNA, 16 bp, Homo sapiens
ttctagatatgagaaa

SEQ ID NO: 3648699 - DNA, 15 bp, Homo sapiens
ttctagtaacagtat

SEQ ID NO: 3648700 - DNA, 16 bp, Homo sapiens
ttctagtaacagtatt

SEQ ID NO: 3648701 - DNA, 20 bp, Homo sapiens
ttctagtaacagtatttcca

SEQ ID NO: 3648702 - DNA, 16 bp, Homo sapiens
ttctatatttactgtt

SEQ ID NO: 3648703 - DNA, 13 bp, Homo sapiens
ttctcaacacaca

SEQ ID NO: 3648704 - DNA, 20 bp, Homo sapiens
ttctcattagagatctgaaa

SEQ ID NO: 3648705 - DNA, 18 bp, Homo sapiens
ttctcttctacttcttgt

SEQ ID NO: 3648706 - DNA, 16 bp, Homo sapiens
ttctgagacttggatt

SEQ ID NO: 3648707 - DNA, 22 bp, Homo sapiens
ttctgattattacaacaagcaa

SEQ ID NO: 3648708 - DNA, 12 bp, Homo sapiens
ttctgtgcagtt

SEQ ID NO: 3648709 - DNA, 23 bp, Homo sapiens
ttctgttggtcttaactaatgta

SEQ ID NO: 3648710 - DNA, 22 bp, Homo sapiens
ttcttaaggacagtgttcaaat

SEQ ID NO: 3648711 - DNA, 12 bp, Homo sapiens
ttcttccttcct

SEQ ID NO: 3648712 - DNA, 13 bp, Homo sapiens
ttcttccttcctt

SEQ ID NO: 3648713 - DNA, 16 bp, Homo sapiens
ttcttctttaattttt

SEQ ID NO: 3648714 - DNA, 20 bp, Homo sapiens
ttcttctttaatttttctgt

SEQ ID NO: 3648715 - DNA, 14 bp, Homo sapiens
ttcttgctctgctc

SEQ ID NO: 3648716 - DNA, 16 bp, Homo sapiens
ttcttggtatgatcat

SEQ ID NO: 3648717 - DNA, 12 bp, Homo sapiens
ttctttaatttt

SEQ ID NO: 3648718 - DNA, 12 bp, Homo sapiens
ttctttccttcc

SEQ ID NO: 3648719 - DNA, 15 bp, Homo sapiens
ttctttccttccttt

SEQ ID NO: 3648720 - DNA, 14 bp, Homo sapiens
ttcttttgtgcata

SEQ ID NO: 3648721 - DNA, 20 bp, Homo sapiens
ttgaaaggagaaaaaaaaag

SEQ ID NO: 3648722 - DNA, 23 bp, Homo sapiens
ttgaaaggagaaaaaaaaagcca

SEQ ID NO: 3648723 - DNA, 17 bp, Homo sapiens
ttgaacctgtgaggaag

SEQ ID NO: 3648724 - DNA, 17 bp, Homo sapiens
ttgaatgataatagctc

SEQ ID NO: 3648725 - DNA, 13 bp, Homo sapiens
ttgacagttactt

SEQ ID NO: 3648726 - DNA, 23 bp, Homo sapiens
ttgacctgcctcccttcatgcat

SEQ ID NO: 3648727 - DNA, 17 bp, Homo sapiens
ttgagccttattaaaat

SEQ ID NO: 3648728 - DNA, 14 bp, Homo sapiens
ttgaggaaactcat

SEQ ID NO: 3648729 - DNA, 16 bp, Homo sapiens
ttgagtcaaaaaatct

SEQ ID NO: 3648730 - DNA, 21 bp, Homo sapiens
ttgatctcagcatcctggaaa

SEQ ID NO: 3648731 - DNA, 19 bp, Homo sapiens
ttgatgaataaaatgttta

SEQ ID NO: 3648732 - DNA, 17 bp, Homo sapiens
ttgattgtttgatgaat

SEQ ID NO: 3648733 - DNA, 15 bp, Homo sapiens
ttgctagaggtggca

SEQ ID NO: 3648734 - DNA, 19 bp, Homo sapiens
ttgctggaatctactagaa

SEQ ID NO: 3648735 - DNA, 23 bp, Homo sapiens
ttgctgtaaataaaaatagctat

SEQ ID NO: 3648736 - DNA, 14 bp, Homo sapiens
ttgctgtctgaaaa

SEQ ID NO: 3648737 - DNA, 15 bp, Homo sapiens
ttgctgtctgaaaaa

SEQ ID NO: 3648738 - DNA, 20 bp, Homo sapiens
ttgctgtctgaaaaagtgtt

SEQ ID NO: 3648739 - DNA, 22 bp, Homo sapiens
ttgcttgaacctgtgaggaaga

SEQ ID NO: 3648740 - DNA, 15 bp, Homo sapiens
ttgcttgagcatgcc

SEQ ID NO: 3648741 - DNA, 22 bp, Homo sapiens
ttggaagaagaaccaggcatgg

SEQ ID NO: 3648742 - DNA, 18 bp, Homo sapiens
ttggccatcatttcattc

SEQ ID NO: 3648743 - DNA, 19 bp, Homo sapiens
ttggtaacttgctgtgaaa

SEQ ID NO: 3648744 - DNA, 13 bp, Homo sapiens
ttggtatgaaaca

SEQ ID NO: 3648745 - DNA, 21 bp, Homo sapiens
ttggtatgaaacaaatatact

SEQ ID NO: 3648746 - DNA, 16 bp, Homo sapiens
ttggtgaccttttgta

SEQ ID NO: 3648747 - DNA, 23 bp, Homo sapiens
ttggttccacaatcatctattga

SEQ ID NO: 3648748 - DNA, 13 bp, Homo sapiens
ttgtattggaagt

SEQ ID NO: 3648749 - DNA, 12 bp, Homo sapiens
ttgtcagaatgt

SEQ ID NO: 3648750 - DNA, 13 bp, Homo sapiens
ttgtgcccactta

SEQ ID NO: 3648751 - DNA, 13 bp, Homo sapiens
ttgtgttacaata

SEQ ID NO: 3648752 - DNA, 13 bp, Homo sapiens
ttgttaaagaaac

SEQ ID NO: 3648753 - DNA, 14 bp, Homo sapiens
ttgttctttttcct

SEQ ID NO: 3648754 - DNA, 14 bp, Homo sapiens
ttgttttcttaact

SEQ ID NO: 3648755 - DNA, 23 bp, Homo sapiens
tttaaacaaaatttatgtcattt

SEQ ID NO: 3648756 - DNA, 16 bp, Homo sapiens
tttaaatctttgttaa

SEQ ID NO: 3648757 - DNA, 20 bp, Homo sapiens
tttaaatctttgttaaaata

SEQ ID NO: 3648758 - DNA, 16 bp, Homo sapiens
tttaatagtttctaaa

SEQ ID NO: 3648759 - DNA, 15 bp, Homo sapiens
tttaattattttctg

SEQ ID NO: 3648760 - DNA, 12 bp, Homo sapiens
tttacaaagaaa

SEQ ID NO: 3648761 - DNA, 21 bp, Homo sapiens
tttacaaagaaacaaaatata

SEQ ID NO: 3648762 - DNA, 13 bp, Homo sapiens
tttaccagaagtt

SEQ ID NO: 3648763 - DNA, 21 bp, Homo sapiens
tttaccagaagtttaaatctt

SEQ ID NO: 3648764 - DNA, 17 bp, Homo sapiens
tttacttgattaaggac

SEQ ID NO: 3648765 - DNA, 18 bp, Homo sapiens
tttagtctaccaaaaaca

SEQ ID NO: 3648766 - DNA, 12 bp, Homo sapiens
tttataaatgtt

SEQ ID NO: 3648767 - DNA, 15 bp, Homo sapiens
tttatcagaagcaag

SEQ ID NO: 3648768 - DNA, 15 bp, Homo sapiens
tttatgtcattttca

SEQ ID NO: 3648769 - DNA, 17 bp, Homo sapiens
tttattaaaaccattct

SEQ ID NO: 3648770 - DNA, 12 bp, Homo sapiens
tttattaaatgt

SEQ ID NO: 3648771 - DNA, 14 bp, Homo sapiens
tttattaaatttat

SEQ ID NO: 3648772 - DNA, 14 bp, Homo sapiens
tttcacacaactgt

SEQ ID NO: 3648773 - DNA, 16 bp, Homo sapiens
tttcacctatctggaa

SEQ ID NO: 3648774 - DNA, 16 bp, Homo sapiens
tttcacttcttaagga

SEQ ID NO: 3648775 - DNA, 12 bp, Homo sapiens
tttcaggttcct

SEQ ID NO: 3648776 - DNA, 15 bp, Homo sapiens
tttcattctggtcct

SEQ ID NO: 3648777 - DNA, 13 bp, Homo sapiens
tttccatcccact

SEQ ID NO: 3648778 - DNA, 13 bp, Homo sapiens
tttccatttggat

SEQ ID NO: 3648779 - DNA, 17 bp, Homo sapiens
tttccatttggatttta

SEQ ID NO: 3648780 - DNA, 17 bp, Homo sapiens
tttcctttcttccttcc

SEQ ID NO: 3648781 - DNA, 23 bp, Homo sapiens
tttctaaaacccttggtctgtgt

SEQ ID NO: 3648782 - DNA, 22 bp, Homo sapiens
tttctacactttatacttgcct

SEQ ID NO: 3648783 - DNA, 21 bp, Homo sapiens
tttctctctttcttttgtgca

SEQ ID NO: 3648784 - DNA, 14 bp, Homo sapiens
tttctgttggtctt

SEQ ID NO: 3648785 - DNA, 23 bp, Homo sapiens
tttctgttggtcttaactaatgt

SEQ ID NO: 3648786 - DNA, 19 bp, Homo sapiens
tttcttaattatggtacct

SEQ ID NO: 3648787 - DNA, 14 bp, Homo sapiens
tttcttccttcctt

SEQ ID NO: 3648788 - DNA, 18 bp, Homo sapiens
tttgacatgagtctccag

SEQ ID NO: 3648789 - DNA, 12 bp, Homo sapiens
tttgacattgtc

SEQ ID NO: 3648790 - DNA, 13 bp, Homo sapiens
tttgacattgtca

SEQ ID NO: 3648791 - DNA, 18 bp, Homo sapiens
tttgagccttattaaaat

SEQ ID NO: 3648792 - DNA, 13 bp, Homo sapiens
tttgagtaaaact

SEQ ID NO: 3648793 - DNA, 18 bp, Homo sapiens
tttgattgtttgatgaat

SEQ ID NO: 3648794 - DNA, 23 bp, Homo sapiens
tttgcaacactgccaaacatcag

SEQ ID NO: 3648795 - DNA, 17 bp, Homo sapiens
tttgcaaccttgtactt

SEQ ID NO: 3648796 - DNA, 19 bp, Homo sapiens
tttgccaccctcatgctgt

SEQ ID NO: 3648797 - DNA, 17 bp, Homo sapiens
tttggaagaattcatga

SEQ ID NO: 3648798 - DNA, 16 bp, Homo sapiens
tttggacgtgtgagga

SEQ ID NO: 3648799 - DNA, 13 bp, Homo sapiens
tttggcaggtgca

SEQ ID NO: 3648800 - DNA, 22 bp, Homo sapiens
tttggtatgaaacaaatatact

SEQ ID NO: 3648801 - DNA, 16 bp, Homo sapiens
tttgtcaaatggtatt

SEQ ID NO: 3648802 - DNA, 20 bp, Homo sapiens
tttgtgaaagtggcaagctc

SEQ ID NO: 3648803 - DNA, 18 bp, Homo sapiens
tttgtgtgcttcacacaa

SEQ ID NO: 3648804 - DNA, 13 bp, Homo sapiens
tttgttaaaatat

SEQ ID NO: 3648805 - DNA, 13 bp, Homo sapiens
ttttaacatagca

SEQ ID NO: 3648806 - DNA, 13 bp, Homo sapiens
ttttacaaagaaa

SEQ ID NO: 3648807 - DNA, 15 bp, Homo sapiens
ttttacaaagaaaca

SEQ ID NO: 3648808 - DNA, 18 bp, Homo sapiens
ttttacttgattaaggac

SEQ ID NO: 3648809 - DNA, 12 bp, Homo sapiens
ttttataaatgt

SEQ ID NO: 3648810 - DNA, 13 bp, Homo sapiens
ttttataaatgtt

SEQ ID NO: 3648811 - DNA, 22 bp, Homo sapiens
ttttcctgttgttttcttaact

SEQ ID NO: 3648812 - DNA, 13 bp, Homo sapiens
ttttctgaggaat

SEQ ID NO: 3648813 - DNA, 24 bp, Homo sapiens
ttttgtgaatggttgcaaagtgtt

SEQ ID NO: 3648814 - DNA, 16 bp, Homo sapiens
tttttgagtaaaactt

SEQ ID NO: 3648815 - DNA, 13 bp, Homo sapiens
aaaaaaaatatga

SEQ ID NO: 3648816 - DNA, 11 bp, Homo sapiens
aaaaaaatcaa

SEQ ID NO: 3648817 - DNA, 12 bp, Homo sapiens
aaaaaaatcaaa

SEQ ID NO: 3648818 - DNA, 13 bp, Homo sapiens
aaaaaatatgaga

SEQ ID NO: 3648819 - DNA, 14 bp, Homo sapiens
aaaaagacttcaaa

SEQ ID NO: 3648820 - DNA, 20 bp, Homo sapiens
aaaaattatctttaaaactt

SEQ ID NO: 3648821 - DNA, 16 bp, Homo sapiens
aaaacattccatcctt

SEQ ID NO: 3648822 - DNA, 24 bp, Homo sapiens
aaaacccttggtctgtgttctcaa

SEQ ID NO: 3648823 - DNA, 19 bp, Homo sapiens
aaaagaccatgcattcaga

SEQ ID NO: 3648824 - DNA, 19 bp, Homo sapiens
aaaagcggggttcaatgct

SEQ ID NO: 3648825 - DNA, 20 bp, Homo sapiens
aaaaggctgcagctaatttg

SEQ ID NO: 3648826 - DNA, 16 bp, Homo sapiens
aaaagtgtttttacat

SEQ ID NO: 3648827 - DNA, 18 bp, Homo sapiens
aaaagtgtttttacatat

SEQ ID NO: 3648828 - DNA, 16 bp, Homo sapiens
aaaatagctataaata

SEQ ID NO: 3648829 - DNA, 19 bp, Homo sapiens
aaaatatgagattggaaaa

SEQ ID NO: 3648830 - DNA, 16 bp, Homo sapiens
aaaatattttcttaat

SEQ ID NO: 3648831 - DNA, 15 bp, Homo sapiens
aaaatccttcagcaa

SEQ ID NO: 3648832 - DNA, 13 bp, Homo sapiens
aaaatgtttattt

SEQ ID NO: 3648833 - DNA, 16 bp, Homo sapiens
aaaattggttaatgaa

SEQ ID NO: 3648834 - DNA, 15 bp, Homo sapiens
aaaatttatgtcatt

SEQ ID NO: 3648835 - DNA, 13 bp, Homo sapiens
aaaatttgacatt

SEQ ID NO: 3648836 - DNA, 23 bp, Homo sapiens
aaaatttgacattgtcagaatgt

SEQ ID NO: 3648837 - DNA, 19 bp, Homo sapiens
aaaattttattgaatataa

SEQ ID NO: 3648838 - DNA, 15 bp, Homo sapiens
aaaattttcttcttt

SEQ ID NO: 3648839 - DNA, 14 bp, Homo sapiens
aaacaaatcatttt

SEQ ID NO: 3648840 - DNA, 18 bp, Homo sapiens
aaacaaatcattttgatg

SEQ ID NO: 3648841 - DNA, 23 bp, Homo sapiens
aaacacggagtttccatttggat

SEQ ID NO: 3648842 - DNA, 16 bp, Homo sapiens
aaacatagtggtattt

SEQ ID NO: 3648843 - DNA, 13 bp, Homo sapiens
aaacatctgattt

SEQ ID NO: 3648844 - DNA, 13 bp, Homo sapiens
aaaccagaaggaa

SEQ ID NO: 3648845 - DNA, 13 bp, Homo sapiens
aaaccctgtctct

SEQ ID NO: 3648846 - DNA, 13 bp, Homo sapiens
aaactggaaacat

SEQ ID NO: 3648847 - DNA, 15 bp, Homo sapiens
aaactggaaacatct

SEQ ID NO: 3648848 - DNA, 19 bp, Homo sapiens
aaactggaaacatctgatt

SEQ ID NO: 3648849 - DNA, 22 bp, Homo sapiens
aaactggaaacatctgatttct

SEQ ID NO: 3648850 - DNA, 23 bp, Homo sapiens
aaacttactatggtatatatttt

SEQ ID NO: 3648851 - DNA, 15 bp, Homo sapiens
aaagaagtccatgtg

SEQ ID NO: 3648852 - DNA, 15 bp, Homo sapiens
aaagaccatgcattc

SEQ ID NO: 3648853 - DNA, 16 bp, Homo sapiens
aaagaccatgcattca

SEQ ID NO: 3648854 - DNA, 17 bp, Homo sapiens
aaagaccatgcattcag

SEQ ID NO: 3648855 - DNA, 18 bp, Homo sapiens
aaagcaggaacccatcta

SEQ ID NO: 3648856 - DNA, 16 bp, Homo sapiens
aaagcccattcattcc

SEQ ID NO: 3648857 - DNA, 18 bp, Homo sapiens
aaaggtgatgaatttacc

SEQ ID NO: 3648858 - DNA, 14 bp, Homo sapiens
aaaggttcttctgg

SEQ ID NO: 3648859 - DNA, 22 bp, Homo sapiens
aaagtgaaattagtattttgag

SEQ ID NO: 3648860 - DNA, 13 bp, Homo sapiens
aaagtggcaagct

SEQ ID NO: 3648861 - DNA, 13 bp, Homo sapiens
aaatacttgacaa

SEQ ID NO: 3648862 - DNA, 14 bp, Homo sapiens
aaatagctataaat

SEQ ID NO: 3648863 - DNA, 18 bp, Homo sapiens
aaatagctataaatagtg

SEQ ID NO: 3648864 - DNA, 14 bp, Homo sapiens
aaatagcttttcac

SEQ ID NO: 3648865 - DNA, 13 bp, Homo sapiens
aaatagtgaaaat

SEQ ID NO: 3648866 - DNA, 12 bp, Homo sapiens
aaatataaatca

SEQ ID NO: 3648867 - DNA, 18 bp, Homo sapiens
aaatatagtgttgtgtta

SEQ ID NO: 3648868 - DNA, 21 bp, Homo sapiens
aaatatagtgttgtgttacaa

SEQ ID NO: 3648869 - DNA, 14 bp, Homo sapiens
aaatattgctgtct

SEQ ID NO: 3648870 - DNA, 21 bp, Homo sapiens
aaatattgctgtctgaaaaag

SEQ ID NO: 3648871 - DNA, 16 bp, Homo sapiens
aaatcacagatttcca

SEQ ID NO: 3648872 - DNA, 17 bp, Homo sapiens
aaatcacagatttccaa

SEQ ID NO: 3648873 - DNA, 14 bp, Homo sapiens
aaatcattttgatg

SEQ ID NO: 3648874 - DNA, 20 bp, Homo sapiens
aaatcattttgatgtattat

SEQ ID NO: 3648875 - DNA, 22 bp, Homo sapiens
aaatctaaattaacttctattt

SEQ ID NO: 3648876 - DNA, 16 bp, Homo sapiens
aaatctttgttaaaat

SEQ ID NO: 3648877 - DNA, 20 bp, Homo sapiens
aaatctttgttaaaatatag

SEQ ID NO: 3648878 - DNA, 22 bp, Homo sapiens
aaatgagatcccagagttattt

SEQ ID NO: 3648879 - DNA, 13 bp, Homo sapiens
aaatgattcactt

SEQ ID NO: 3648880 - DNA, 21 bp, Homo sapiens
aaatgattcacttttattgta

SEQ ID NO: 3648881 - DNA, 17 bp, Homo sapiens
aaatgatttgcttttga

SEQ ID NO: 3648882 - DNA, 23 bp, Homo sapiens
aaatgccacacttgtgtgccaca

SEQ ID NO: 3648883 - DNA, 14 bp, Homo sapiens
aaatggcatttttt

SEQ ID NO: 3648884 - DNA, 14 bp, Homo sapiens
aaatggctgaagaa

SEQ ID NO: 3648885 - DNA, 15 bp, Homo sapiens
aaatggctgaagaaa

SEQ ID NO: 3648886 - DNA, 12 bp, Homo sapiens
aaatggtatttt

SEQ ID NO: 3648887 - DNA, 21 bp, Homo sapiens
aaatggtattttttgtgaatg

SEQ ID NO: 3648888 - DNA, 18 bp, Homo sapiens
aaatgtgtgcttggaaaa

SEQ ID NO: 3648889 - DNA, 13 bp, Homo sapiens
aaatgtttatttt

SEQ ID NO: 3648890 - DNA, 15 bp, Homo sapiens
aaatgtttatttttg

SEQ ID NO: 3648891 - DNA, 17 bp, Homo sapiens
aaattaacttctatttt

SEQ ID NO: 3648892 - DNA, 20 bp, Homo sapiens
aaattaacttctattttcaa

SEQ ID NO: 3648893 - DNA, 17 bp, Homo sapiens
aaattagtgttttcatt

SEQ ID NO: 3648894 - DNA, 21 bp, Homo sapiens
aaattagtgttttcattctgg

SEQ ID NO: 3648895 - DNA, 13 bp, Homo sapiens
aaattatctttaa

SEQ ID NO: 3648896 - DNA, 17 bp, Homo sapiens
aaattatctttaaaact

SEQ ID NO: 3648897 - DNA, 18 bp, Homo sapiens
aaattcccttcatctgga

SEQ ID NO: 3648898 - DNA, 16 bp, Homo sapiens
aaattcctaattctat

SEQ ID NO: 3648899 - DNA, 12 bp, Homo sapiens
aaattctgatta

SEQ ID NO: 3648900 - DNA, 19 bp, Homo sapiens
aaattggttaatgaaaaat

SEQ ID NO: 3648901 - DNA, 22 bp, Homo sapiens
aaattggttaatgaaaaatctg

SEQ ID NO: 3648902 - DNA, 15 bp, Homo sapiens
aaatttatgtcattt

SEQ ID NO: 3648903 - DNA, 17 bp, Homo sapiens
aaatttatgtcattttc

SEQ ID NO: 3648904 - DNA, 12 bp, Homo sapiens
aaatttattaaa

SEQ ID NO: 3648905 - DNA, 23 bp, Homo sapiens
aaatttgacattgtcagaatgtt

SEQ ID NO: 3648906 - DNA, 13 bp, Homo sapiens
aaatttgtgtgct

SEQ ID NO: 3648907 - DNA, 19 bp, Homo sapiens
aaattttattgaatataat

SEQ ID NO: 3648908 - DNA, 21 bp, Homo sapiens
aacaaaatccttgccttcaaa

SEQ ID NO: 3648909 - DNA, 12 bp, Homo sapiens
aacaaaggaagt

SEQ ID NO: 3648910 - DNA, 13 bp, Homo sapiens
aacaaaggaagtg

SEQ ID NO: 3648911 - DNA, 11 bp, Homo sapiens
aacaaatatac

SEQ ID NO: 3648912 - DNA, 14 bp, Homo sapiens
aacaagcaaactga

SEQ ID NO: 3648913 - DNA, 16 bp, Homo sapiens
aacacagcatgcattt

SEQ ID NO: 3648914 - DNA, 20 bp, Homo sapiens
aacacagtaagataggttct

SEQ ID NO: 3648915 - DNA, 22 bp, Homo sapiens
aacacggagtttccatttggat

SEQ ID NO: 3648916 - DNA, 12 bp, Homo sapiens
aacactgccaaa

SEQ ID NO: 3648917 - DNA, 18 bp, Homo sapiens
aacacttttgctctgcag

SEQ ID NO: 3648918 - DNA, 22 bp, Homo sapiens
aacacttttgctctgcaggcag

SEQ ID NO: 3648919 - DNA, 22 bp, Homo sapiens
aacagcacagtcttttcctacg

SEQ ID NO: 3648920 - DNA, 17 bp, Homo sapiens
aacagtaaatatacact

SEQ ID NO: 3648921 - DNA, 22 bp, Homo sapiens
aacagtaaatatacactttaca

SEQ ID NO: 3648922 - DNA, 12 bp, Homo sapiens
aacagtatttcc

SEQ ID NO: 3648923 - DNA, 13 bp, Homo sapiens
aacagtatttcca

SEQ ID NO: 3648924 - DNA, 16 bp, Homo sapiens
aacatagtggtatttt

SEQ ID NO: 3648925 - DNA, 21 bp, Homo sapiens
aacatagtggtattttaacat

SEQ ID NO: 3648926 - DNA, 12 bp, Homo sapiens
aacatctgattt

SEQ ID NO: 3648927 - DNA, 10 bp, Homo sapiens
aacattccat

SEQ ID NO: 3648928 - DNA, 14 bp, Homo sapiens
aacatttggggaga

SEQ ID NO: 3648929 - DNA, 22 bp, Homo sapiens
aaccaaatcactgaactttgct

SEQ ID NO: 3648930 - DNA, 15 bp, Homo sapiens
aaccacacctaaatt

SEQ ID NO: 3648931 - DNA, 15 bp, Homo sapiens
aaccagaaggaagcc

SEQ ID NO: 3648932 - DNA, 22 bp, Homo sapiens
aaccagaaggaagccctctcag

SEQ ID NO: 3648933 - DNA, 19 bp, Homo sapiens
aacccatctaaaccagaag

SEQ ID NO: 3648934 - DNA, 20 bp, Homo sapiens
aacccatctaaaccagaagg

SEQ ID NO: 3648935 - DNA, 18 bp, Homo sapiens
aaccgggactacagaagt

SEQ ID NO: 3648936 - DNA, 19 bp, Homo sapiens
aacctggtaattatcctca

SEQ ID NO: 3648937 - DNA, 14 bp, Homo sapiens
aacctgtgaggaag

SEQ ID NO: 3648938 - DNA, 15 bp, Homo sapiens
aacctgtgaggaaga

SEQ ID NO: 3648939 - DNA, 15 bp, Homo sapiens
aaccttcctgtctcc

SEQ ID NO: 3648940 - DNA, 18 bp, Homo sapiens
aaccttcctgtctcccag

SEQ ID NO: 3648941 - DNA, 17 bp, Homo sapiens
aaccttgtactttacaa

SEQ ID NO: 3648942 - DNA, 17 bp, Homo sapiens
aacgatcatatctgtat

SEQ ID NO: 3648943 - DNA, 16 bp, Homo sapiens
aacgttcatgttcatc

SEQ ID NO: 3648944 - DNA, 17 bp, Homo sapiens
aactaatgtaaatattg

SEQ ID NO: 3648945 - DNA, 22 bp, Homo sapiens
aactagcaaaaggatgatttaa

SEQ ID NO: 3648946 - DNA, 22 bp, Homo sapiens
aactcatacagtctctatttga

SEQ ID NO: 3648947 - DNA, 20 bp, Homo sapiens
aactcgggattacagaaaca

SEQ ID NO: 3648948 - DNA, 18 bp, Homo sapiens
aactgaaattagtgtttt

SEQ ID NO: 3648949 - DNA, 21 bp, Homo sapiens
aactgaaattagtgttttcat

SEQ ID NO: 3648950 - DNA, 17 bp, Homo sapiens
aactgggaaatgagatc

SEQ ID NO: 3648951 - DNA, 16 bp, Homo sapiens
aactgtgaacaatcag

SEQ ID NO: 3648952 - DNA, 16 bp, Homo sapiens
aactgtggataaattt

SEQ ID NO: 3648953 - DNA, 20 bp, Homo sapiens
aacttactatggtatatatt

SEQ ID NO: 3648954 - DNA, 18 bp, Homo sapiens
aacttgtattggaagtat

SEQ ID NO: 3648955 - DNA, 15 bp, Homo sapiens
aactttgctgagcct

SEQ ID NO: 3648956 - DNA, 13 bp, Homo sapiens
aactttggaagtt

SEQ ID NO: 3648957 - DNA, 23 bp, Homo sapiens
aactttggaagttttacttgatt

SEQ ID NO: 3648958 - DNA, 15 bp, Homo sapiens
aagaaacaaaatata

SEQ ID NO: 3648959 - DNA, 12 bp, Homo sapiens
aagaaacacagc

SEQ ID NO: 3648960 - DNA, 14 bp, Homo sapiens
aagaaacacagcat

SEQ ID NO: 3648961 - DNA, 17 bp, Homo sapiens
aagaaacacagcatgca

SEQ ID NO: 3648962 - DNA, 18 bp, Homo sapiens
aagaaatctcttccataa

SEQ ID NO: 3648963 - DNA, 23 bp, Homo sapiens
aagaagaaccaggcatggaaaga

SEQ ID NO: 3648964 - DNA, 19 bp, Homo sapiens
aagaagctaaaatgaaaaa

SEQ ID NO: 3648965 - DNA, 21 bp, Homo sapiens
aagacatctgaggaaaatgga

SEQ ID NO: 3648966 - DNA, 23 bp, Homo sapiens
aagacatctgaggaaaatggaag

SEQ ID NO: 3648967 - DNA, 19 bp, Homo sapiens
aagacattagtttgaggta

SEQ ID NO: 3648968 - DNA, 16 bp, Homo sapiens
aagaccatgcattcag

SEQ ID NO: 3648969 - DNA, 16 bp, Homo sapiens
aagacctaaggcagac

SEQ ID NO: 3648970 - DNA, 20 bp, Homo sapiens
aagacctaaggcagacagga

SEQ ID NO: 3648971 - DNA, 22 bp, Homo sapiens
aagagattctgcctcagcctcc

SEQ ID NO: 3648972 - DNA, 16 bp, Homo sapiens
aagagcctgagactgg

SEQ ID NO: 3648973 - DNA, 18 bp, Homo sapiens
aagagcctgagactggaa

SEQ ID NO: 3648974 - DNA, 18 bp, Homo sapiens
aagagctgctgtatttga

SEQ ID NO: 3648975 - DNA, 19 bp, Homo sapiens
aagagctgctgtatttgag

SEQ ID NO: 3648976 - DNA, 19 bp, Homo sapiens
aagataattaaatgaaata

SEQ ID NO: 3648977 - DNA, 22 bp, Homo sapiens
aagataggttctgctttctgat

SEQ ID NO: 3648978 - DNA, 13 bp, Homo sapiens
aagcattgctaaa

SEQ ID NO: 3648979 - DNA, 19 bp, Homo sapiens
aagcattgggtcagaccca

SEQ ID NO: 3648980 - DNA, 13 bp, Homo sapiens
aagccaaccctgg

SEQ ID NO: 3648981 - DNA, 20 bp, Homo sapiens
aagccaaccctggaaaagga

SEQ ID NO: 3648982 - DNA, 11 bp, Homo sapiens
aagcccagcct

SEQ ID NO: 3648983 - DNA, 13 bp, Homo sapiens
aagcccagcctgc

SEQ ID NO: 3648984 - DNA, 20 bp, Homo sapiens
aagcctggcttagaaggcac

SEQ ID NO: 3648985 - DNA, 17 bp, Homo sapiens
aagctaaaatgaaaaat

SEQ ID NO: 3648986 - DNA, 15 bp, Homo sapiens
aagctcaaggctgca

SEQ ID NO: 3648987 - DNA, 19 bp, Homo sapiens
aagctcaaggctgcagtga

SEQ ID NO: 3648988 - DNA, 15 bp, Homo sapiens
aagctcatagcacat

SEQ ID NO: 3648989 - DNA, 19 bp, Homo sapiens
aagctcttcattgcactgc

SEQ ID NO: 3648990 - DNA, 20 bp, Homo sapiens
aaggaagcacaaaagacaag

SEQ ID NO: 3648991 - DNA, 17 bp, Homo sapiens
aaggaagccctctcaga

SEQ ID NO: 3648992 - DNA, 22 bp, Homo sapiens
aaggacagtgttcaaattctga

SEQ ID NO: 3648993 - DNA, 14 bp, Homo sapiens
aaggactgaagaaa

SEQ ID NO: 3648994 - DNA, 12 bp, Homo sapiens
aaggagaaaaaa

SEQ ID NO: 3648995 - DNA, 15 bp, Homo sapiens
aaggcagacaggaag

SEQ ID NO: 3648996 - DNA, 16 bp, Homo sapiens
aaggcagacaggaagg

SEQ ID NO: 3648997 - DNA, 14 bp, Homo sapiens
aaggctctctggtc

SEQ ID NO: 3648998 - DNA, 19 bp, Homo sapiens
aaggctgcagctaatttgt

SEQ ID NO: 3648999 - DNA, 23 bp, Homo sapiens
aagggaccttcagggagagctgg

SEQ ID NO: 3649000 - DNA, 11 bp, Homo sapiens
aagggatggcc

SEQ ID NO: 3649001 - DNA, 18 bp, Homo sapiens
aaggtcagtgttataaaa

SEQ ID NO: 3649002 - DNA, 19 bp, Homo sapiens
aaggtggacttgtctccca

SEQ ID NO: 3649003 - DNA, 21 bp, Homo sapiens
aaggtggacttgtctcccagt

SEQ ID NO: 3649004 - DNA, 12 bp, Homo sapiens
aagtcaagtcta

SEQ ID NO: 3649005 - DNA, 21 bp, Homo sapiens
aagtcctcagagctccatgct

SEQ ID NO: 3649006 - DNA, 15 bp, Homo sapiens
aagtctcctgtatca

SEQ ID NO: 3649007 - DNA, 20 bp, Homo sapiens
aagtgaaaaagacttcaaat

SEQ ID NO: 3649008 - DNA, 16 bp, Homo sapiens
aagtgcatgttaaaat

SEQ ID NO: 3649009 - DNA, 21 bp, Homo sapiens
aagtggaaggataatgagatg

SEQ ID NO: 3649010 - DNA, 22 bp, Homo sapiens
aagtgttggccatcatttcatt

SEQ ID NO: 3649011 - DNA, 15 bp, Homo sapiens
aagtgtttttacata

SEQ ID NO: 3649012 - DNA, 12 bp, Homo sapiens
aagttgtgtgct

SEQ ID NO: 3649013 - DNA, 23 bp, Homo sapiens
aagtttaaatctttgttaaaata

SEQ ID NO: 3649014 - DNA, 16 bp, Homo sapiens
aagttttacttgatta

SEQ ID NO: 3649015 - DNA, 13 bp, Homo sapiens
aataaagtggcat

SEQ ID NO: 3649016 - DNA, 19 bp, Homo sapiens
aataaagtggcatttcttt

SEQ ID NO: 3649017 - DNA, 16 bp, Homo sapiens
aataagttgaatgata

SEQ ID NO: 3649018 - DNA, 11 bp, Homo sapiens
aataccccacc

SEQ ID NO: 3649019 - DNA, 15 bp, Homo sapiens
aatacttgacaacat

SEQ ID NO: 3649020 - DNA, 19 bp, Homo sapiens
aatacttgacaacattttt

SEQ ID NO: 3649021 - DNA, 22 bp, Homo sapiens
aatagctataaatagtgaaaat

SEQ ID NO: 3649022 - DNA, 21 bp, Homo sapiens
aatagctcacagcacatttgt

SEQ ID NO: 3649023 - DNA, 18 bp, Homo sapiens
aatagcttttcacttctt

SEQ ID NO: 3649024 - DNA, 13 bp, Homo sapiens
aatagtgaaaatt

SEQ ID NO: 3649025 - DNA, 23 bp, Homo sapiens
aatagtttctaaaccatgaaaag

SEQ ID NO: 3649026 - DNA, 16 bp, Homo sapiens
aatataaaaataatta

SEQ ID NO: 3649027 - DNA, 14 bp, Homo sapiens
aatataaatcacag

SEQ ID NO: 3649028 - DNA, 19 bp, Homo sapiens
aatataaatcacagatttc

SEQ ID NO: 3649029 - DNA, 21 bp, Homo sapiens
aatataaatcacagatttcca

SEQ ID NO: 3649030 - DNA, 22 bp, Homo sapiens
aatataaatcacagatttccaa

SEQ ID NO: 3649031 - DNA, 16 bp, Homo sapiens
aatatacactttacat

SEQ ID NO: 3649032 - DNA, 16 bp, Homo sapiens
aatatactcatttgga

SEQ ID NO: 3649033 - DNA, 21 bp, Homo sapiens
aatatagtgttgtgttacaat

SEQ ID NO: 3649034 - DNA, 20 bp, Homo sapiens
aatatccttttagaagcagc

SEQ ID NO: 3649035 - DNA, 13 bp, Homo sapiens
aatcaaaaaatta

SEQ ID NO: 3649036 - DNA, 14 bp, Homo sapiens
aatcaaaaaattat

SEQ ID NO: 3649037 - DNA, 14 bp, Homo sapiens
aatcaacagaattg

SEQ ID NO: 3649038 - DNA, 13 bp, Homo sapiens
aatcaataaaaat

SEQ ID NO: 3649039 - DNA, 15 bp, Homo sapiens
aatcatctattgagt

SEQ ID NO: 3649040 - DNA, 21 bp, Homo sapiens
aatcatgcctacattagtgag

SEQ ID NO: 3649041 - DNA, 19 bp, Homo sapiens
aatccatgtgctgctgtgg

SEQ ID NO: 3649042 - DNA, 14 bp, Homo sapiens
aatcgtgatattga

SEQ ID NO: 3649043 - DNA, 12 bp, Homo sapiens
aatctaaattaa

SEQ ID NO: 3649044 - DNA, 18 bp, Homo sapiens
aatctacaaacttttata

SEQ ID NO: 3649045 - DNA, 21 bp, Homo sapiens
aatctacaaacttttataaat

SEQ ID NO: 3649046 - DNA, 15 bp, Homo sapiens
aatctgaatttctaa

SEQ ID NO: 3649047 - DNA, 16 bp, Homo sapiens
aatctgaatttctaaa

SEQ ID NO: 3649048 - DNA, 13 bp, Homo sapiens
aatctttgttaaa

SEQ ID NO: 3649049 - DNA, 16 bp, Homo sapiens
aatctttgttaaaata

SEQ ID NO: 3649050 - DNA, 14 bp, Homo sapiens
aatgaaaaatctga

SEQ ID NO: 3649051 - DNA, 15 bp, Homo sapiens
aatgaaaaatctgaa

SEQ ID NO: 3649052 - DNA, 18 bp, Homo sapiens
aatgaaaaatctgaattt

SEQ ID NO: 3649053 - DNA, 12 bp, Homo sapiens
aatgaaatactt

SEQ ID NO: 3649054 - DNA, 16 bp, Homo sapiens
aatgaaatacttgaca

SEQ ID NO: 3649055 - DNA, 16 bp, Homo sapiens
aatgataatagctcac

SEQ ID NO: 3649056 - DNA, 18 bp, Homo sapiens
aatgatatgtctttaaaa

SEQ ID NO: 3649057 - DNA, 21 bp, Homo sapiens
aatgatatgtctttaaaatga

SEQ ID NO: 3649058 - DNA, 17 bp, Homo sapiens
aatgattcttgtgtcat

SEQ ID NO: 3649059 - DNA, 21 bp, Homo sapiens
aatgcctttctagcaattgct

SEQ ID NO: 3649060 - DNA, 18 bp, Homo sapiens
aatggaagacctaaggca

SEQ ID NO: 3649061 - DNA, 20 bp, Homo sapiens
aatggcctcttaaaaattat

SEQ ID NO: 3649062 - DNA, 18 bp, Homo sapiens
aatggtattttttgtgaa

SEQ ID NO: 3649063 - DNA, 19 bp, Homo sapiens
aatggtattttttgtgaat

SEQ ID NO: 3649064 - DNA, 17 bp, Homo sapiens
aatgtaaatattgctgt

SEQ ID NO: 3649065 - DNA, 17 bp, Homo sapiens
aatgtagggcagaatag

SEQ ID NO: 3649066 - DNA, 16 bp, Homo sapiens
aatgtgtgcttggaaa

SEQ ID NO: 3649067 - DNA, 15 bp, Homo sapiens
aatgttaaatctaca

SEQ ID NO: 3649068 - DNA, 18 bp, Homo sapiens
aatgtttatttttgctct

SEQ ID NO: 3649069 - DNA, 17 bp, Homo sapiens
aattaaaacaaaatcct

SEQ ID NO: 3649070 - DNA, 14 bp, Homo sapiens
aattagtattttga

SEQ ID NO: 3649071 - DNA, 20 bp, Homo sapiens
aattagtgttttcattctgg

SEQ ID NO: 3649072 - DNA, 18 bp, Homo sapiens
aattatcctcaagttgtg

SEQ ID NO: 3649073 - DNA, 22 bp, Homo sapiens
aattatcctcaagttgtgtgct

SEQ ID NO: 3649074 - DNA, 20 bp, Homo sapiens
aattatgaagccctaagtaa

SEQ ID NO: 3649075 - DNA, 18 bp, Homo sapiens
aattcatggtatcttgag

SEQ ID NO: 3649076 - DNA, 23 bp, Homo sapiens
aattctatgattaaactgggaaa

SEQ ID NO: 3649077 - DNA, 20 bp, Homo sapiens
aattcttctcctttgtcaaa

SEQ ID NO: 3649078 - DNA, 22 bp, Homo sapiens
aattcttctcctttgtcaaatg

SEQ ID NO: 3649079 - DNA, 16 bp, Homo sapiens
aattgaaagagaattt

SEQ ID NO: 3649080 - DNA, 23 bp, Homo sapiens
aattgggcccttagaatgtgaaa

SEQ ID NO: 3649081 - DNA, 15 bp, Homo sapiens
aattggttaatgaaa

SEQ ID NO: 3649082 - DNA, 22 bp, Homo sapiens
aattggttaatgaaaaatctga

SEQ ID NO: 3649083 - DNA, 23 bp, Homo sapiens
aatttaccatcaaacaaatcatt

SEQ ID NO: 3649084 - DNA, 20 bp, Homo sapiens
aatttagcagtccatttttg

SEQ ID NO: 3649085 - DNA, 19 bp, Homo sapiens
aatttatgtcattttcaga

SEQ ID NO: 3649086 - DNA, 14 bp, Homo sapiens
aatttattaaatgt

SEQ ID NO: 3649087 - DNA, 15 bp, Homo sapiens
aatttattaaattta

SEQ ID NO: 3649088 - DNA, 16 bp, Homo sapiens
aatttattaaatttat

SEQ ID NO: 3649089 - DNA, 19 bp, Homo sapiens
aatttgtgtgcttcacaca

SEQ ID NO: 3649090 - DNA, 22 bp, Homo sapiens
aattttgctttatcagaagcaa

SEQ ID NO: 3649091 - DNA, 19 bp, Homo sapiens
aattttggaagaattcatg

SEQ ID NO: 3649092 - DNA, 11 bp, Homo sapiens
acaaaatataa

SEQ ID NO: 3649093 - DNA, 23 bp, Homo sapiens
acaaaatgtgtgcttggaaaatg

SEQ ID NO: 3649094 - DNA, 12 bp, Homo sapiens
acaaaatttatg

SEQ ID NO: 3649095 - DNA, 22 bp, Homo sapiens
acaaaatttatgtcattttcag

SEQ ID NO: 3649096 - DNA, 18 bp, Homo sapiens
acaaacttttataaatgt

SEQ ID NO: 3649097 - DNA, 18 bp, Homo sapiens
acaaagaaacaaaatata

SEQ ID NO: 3649098 - DNA, 14 bp, Homo sapiens
acaaagtgaaatta

SEQ ID NO: 3649099 - DNA, 17 bp, Homo sapiens
acaaagtgaaattagta

SEQ ID NO: 3649100 - DNA, 16 bp, Homo sapiens
acaaatcattttgatg

SEQ ID NO: 3649101 - DNA, 13 bp, Homo sapiens
acaacaaaggaag

SEQ ID NO: 3649102 - DNA, 17 bp, Homo sapiens
acaacaagcaaactgaa

SEQ ID NO: 3649103 - DNA, 21 bp, Homo sapiens
acaacaagcaaactgaaatta

SEQ ID NO: 3649104 - DNA, 12 bp, Homo sapiens
acaagaggaaaa

SEQ ID NO: 3649105 - DNA, 13 bp, Homo sapiens
acaagaggaaaaa

SEQ ID NO: 3649106 - DNA, 18 bp, Homo sapiens
acaagcaaactgaaatta

SEQ ID NO: 3649107 - DNA, 17 bp, Homo sapiens
acaagctacatatgtag

SEQ ID NO: 3649108 - DNA, 20 bp, Homo sapiens
acaagttctttcccagcctc

SEQ ID NO: 3649109 - DNA, 17 bp, Homo sapiens
acaatcatctattgagt

SEQ ID NO: 3649110 - DNA, 19 bp, Homo sapiens
acacaactgtggataaatt

SEQ ID NO: 3649111 - DNA, 22 bp, Homo sapiens
acacaactgtggataaattttg

SEQ ID NO: 3649112 - DNA, 16 bp, Homo sapiens
acacagcatgcattta

SEQ ID NO: 3649113 - DNA, 22 bp, Homo sapiens
acacagcatgcatttagcatga

SEQ ID NO: 3649114 - DNA, 20 bp, Homo sapiens
acacagtaagataggttctg

SEQ ID NO: 3649115 - DNA, 17 bp, Homo sapiens
acacagtatagataaat

SEQ ID NO: 3649116 - DNA, 14 bp, Homo sapiens
acacatataaacac

SEQ ID NO: 3649117 - DNA, 15 bp, Homo sapiens
acacatataaacaca

SEQ ID NO: 3649118 - DNA, 13 bp, Homo sapiens
acaccctcacact

SEQ ID NO: 3649119 - DNA, 13 bp, Homo sapiens
acacctgagaatg

SEQ ID NO: 3649120 - DNA, 24 bp, Homo sapiens
acacgcctgtaatctcagctactc

SEQ ID NO: 3649121 - DNA, 23 bp, Homo sapiens
acactaggatgaattatcttgga

SEQ ID NO: 3649122 - DNA, 11 bp, Homo sapiens
acactccagcc

SEQ ID NO: 3649123 - DNA, 12 bp, Homo sapiens
acactccagcct

SEQ ID NO: 3649124 - DNA, 15 bp, Homo sapiens
acactccagcctggg

SEQ ID NO: 3649125 - DNA, 17 bp, Homo sapiens
acactgccaaacatcag

SEQ ID NO: 3649126 - DNA, 23 bp, Homo sapiens
acagaaacacggagtttccattt

SEQ ID NO: 3649127 - DNA, 20 bp, Homo sapiens
acagatggtgtcctgcatgt

SEQ ID NO: 3649128 - DNA, 16 bp, Homo sapiens
acagatttccaaaagt

SEQ ID NO: 3649129 - DNA, 20 bp, Homo sapiens
acagatttccaaaagtacta

SEQ ID NO: 3649130 - DNA, 15 bp, Homo sapiens
acagcacatttgtta

SEQ ID NO: 3649131 - DNA, 19 bp, Homo sapiens
acagcacatttgttaatga

SEQ ID NO: 3649132 - DNA, 21 bp, Homo sapiens
acagcatgcatttagcatgag

SEQ ID NO: 3649133 - DNA, 12 bp, Homo sapiens
acaggcatgagc

SEQ ID NO: 3649134 - DNA, 20 bp, Homo sapiens
acagggacacagtctggtgc

SEQ ID NO: 3649135 - DNA, 21 bp, Homo sapiens
acagggcctttggcaggtgca

SEQ ID NO: 3649136 - DNA, 14 bp, Homo sapiens
acaggtgggagatg

SEQ ID NO: 3649137 - DNA, 16 bp, Homo sapiens
acaggttttatgagac

SEQ ID NO: 3649138 - DNA, 22 bp, Homo sapiens
acagtaaatatacactttacat

SEQ ID NO: 3649139 - DNA, 12 bp, Homo sapiens
acagtctctatt

SEQ ID NO: 3649140 - DNA, 16 bp, Homo sapiens
acagtgttcaaattct

SEQ ID NO: 3649141 - DNA, 21 bp, Homo sapiens
acagtgttcaaattctgatta

SEQ ID NO: 3649142 - DNA, 16 bp, Homo sapiens
acagttacttacacac

SEQ ID NO: 3649143 - DNA, 21 bp, Homo sapiens
acatagtggtattttaacata

SEQ ID NO: 3649144 - DNA, 19 bp, Homo sapiens
acatataaacacagtaaga

SEQ ID NO: 3649145 - DNA, 21 bp, Homo sapiens
acatcaattgggttttgatct

SEQ ID NO: 3649146 - DNA, 18 bp, Homo sapiens
acatctctgtaaaaagca

SEQ ID NO: 3649147 - DNA, 22 bp, Homo sapiens
acatctgagacactaggatgaa

SEQ ID NO: 3649148 - DNA, 22 bp, Homo sapiens
acatctgaggaaaatggaagac

SEQ ID NO: 3649149 - DNA, 13 bp, Homo sapiens
acatctgatttct

SEQ ID NO: 3649150 - DNA, 23 bp, Homo sapiens
acatgacagtggttatatttcaa

SEQ ID NO: 3649151 - DNA, 16 bp, Homo sapiens
acatgtatgcttccag

SEQ ID NO: 3649152 - DNA, 15 bp, Homo sapiens
acatgttttacaaag

SEQ ID NO: 3649153 - DNA, 14 bp, Homo sapiens
acattcttgctctg

SEQ ID NO: 3649154 - DNA, 15 bp, Homo sapiens
acattcttgctctgc

SEQ ID NO: 3649155 - DNA, 17 bp, Homo sapiens
acattgtcagaatgttg

SEQ ID NO: 3649156 - DNA, 18 bp, Homo sapiens
acattgtcagaatgttgt

SEQ ID NO: 3649157 - DNA, 17 bp, Homo sapiens
acatttggggagagata

SEQ ID NO: 3649158 - DNA, 20 bp, Homo sapiens
accagaaggaagccctctca

SEQ ID NO: 3649159 - DNA, 21 bp, Homo sapiens
accagaaggcaatcaagagct

SEQ ID NO: 3649160 - DNA, 23 bp, Homo sapiens
accagaatgaggcacatgacagt

SEQ ID NO: 3649161 - DNA, 19 bp, Homo sapiens
accagatccttttccatcc

SEQ ID NO: 3649162 - DNA, 20 bp, Homo sapiens
accagatccttttccatccc

SEQ ID NO: 3649163 - DNA, 16 bp, Homo sapiens
accaggcatggaaaga

SEQ ID NO: 3649164 - DNA, 20 bp, Homo sapiens
accatcagaaacaccctcac

SEQ ID NO: 3649165 - DNA, 15 bp, Homo sapiens
accatgaaaagtttt

SEQ ID NO: 3649166 - DNA, 22 bp, Homo sapiens
acccatctaaaccagaaggaag

SEQ ID NO: 3649167 - DNA, 15 bp, Homo sapiens
accccatagacctaa

SEQ ID NO: 3649168 - DNA, 14 bp, Homo sapiens
accctatcatcagt

SEQ ID NO: 3649169 - DNA, 15 bp, Homo sapiens
accctgcccactccc

SEQ ID NO: 3649170 - DNA, 13 bp, Homo sapiens
accctgggctgga

SEQ ID NO: 3649171 - DNA, 16 bp, Homo sapiens
accctgggctggagag

SEQ ID NO: 3649172 - DNA, 13 bp, Homo sapiens
accctgtctctac

SEQ ID NO: 3649173 - DNA, 20 bp, Homo sapiens
accgaactcgggattacaga

SEQ ID NO: 3649174 - DNA, 23 bp, Homo sapiens
accgaactcgggattacagaaac

SEQ ID NO: 3649175 - DNA, 21 bp, Homo sapiens
accgagaggaaaaaggcttct

SEQ ID NO: 3649176 - DNA, 14 bp, Homo sapiens
accgggactacaga

SEQ ID NO: 3649177 - DNA, 18 bp, Homo sapiens
accgggactacagaagtg

SEQ ID NO: 3649178 - DNA, 16 bp, Homo sapiens
acctaaattaacaaat

SEQ ID NO: 3649179 - DNA, 19 bp, Homo sapiens
acctaaggcagacaggaag

SEQ ID NO: 3649180 - DNA, 22 bp, Homo sapiens
acctattgctgtaaataaaaat

SEQ ID NO: 3649181 - DNA, 20 bp, Homo sapiens
acctcccaaaggctgtcatt

SEQ ID NO: 3649182 - DNA, 14 bp, Homo sapiens
acctgtgaggaaga

SEQ ID NO: 3649183 - DNA, 18 bp, Homo sapiens
accttcagggagagctgg

SEQ ID NO: 3649184 - DNA, 19 bp, Homo sapiens
accttcagggagagctggg

SEQ ID NO: 3649185 - DNA, 15 bp, Homo sapiens
accttcctgtctccc

SEQ ID NO: 3649186 - DNA, 17 bp, Homo sapiens
accttcctgtctcccag

SEQ ID NO: 3649187 - DNA, 14 bp, Homo sapiens
accttgattggaaa

SEQ ID NO: 3649188 - DNA, 18 bp, Homo sapiens
acgatcattgtgcccact

SEQ ID NO: 3649189 - DNA, 20 bp, Homo sapiens
acgtgcaacagactgcctta

SEQ ID NO: 3649190 - DNA, 15 bp, Homo sapiens
acgtgcccatttcac

SEQ ID NO: 3649191 - DNA, 17 bp, Homo sapiens
acgttcatgttcatctc

SEQ ID NO: 3649192 - DNA, 12 bp, Homo sapiens
actaacttattt

SEQ ID NO: 3649193 - DNA, 13 bp, Homo sapiens
actaacttatttt

SEQ ID NO: 3649194 - DNA, 15 bp, Homo sapiens
actaacttattttga

SEQ ID NO: 3649195 - DNA, 15 bp, Homo sapiens
actaatgtaaatatt

SEQ ID NO: 3649196 - DNA, 21 bp, Homo sapiens
actacagaagtggaaggataa

SEQ ID NO: 3649197 - DNA, 17 bp, Homo sapiens
actacaggttttatgag

SEQ ID NO: 3649198 - DNA, 13 bp, Homo sapiens
actagcaataagt

SEQ ID NO: 3649199 - DNA, 15 bp, Homo sapiens
actagcaataagttg

SEQ ID NO: 3649200 - DNA, 16 bp, Homo sapiens
actatcagggcaagct

SEQ ID NO: 3649201 - DNA, 19 bp, Homo sapiens
actatcagggcaagctcat

SEQ ID NO: 3649202 - DNA, 18 bp, Homo sapiens
actatggtatatattttg

SEQ ID NO: 3649203 - DNA, 13 bp, Homo sapiens
actcaaggcctcc

SEQ ID NO: 3649204 - DNA, 14 bp, Homo sapiens
actcaggaggctga

SEQ ID NO: 3649205 - DNA, 21 bp, Homo sapiens
actcaggaggctgaggcagga

SEQ ID NO: 3649206 - DNA, 22 bp, Homo sapiens
actcatacagtctctatttgat

SEQ ID NO: 3649207 - DNA, 19 bp, Homo sapiens
actcatttggatataaatc

SEQ ID NO: 3649208 - DNA, 21 bp, Homo sapiens
actcatttggatataaatctt

SEQ ID NO: 3649209 - DNA, 22 bp, Homo sapiens
actcatttggatataaatctta

SEQ ID NO: 3649210 - DNA, 14 bp, Homo sapiens
actccagcctgggc

SEQ ID NO: 3649211 - DNA, 15 bp, Homo sapiens
actccatttcccact

SEQ ID NO: 3649212 - DNA, 17 bp, Homo sapiens
actccatttcccacttc

SEQ ID NO: 3649213 - DNA, 19 bp, Homo sapiens
actccatttcccacttcca

SEQ ID NO: 3649214 - DNA, 18 bp, Homo sapiens
actcccatcccttcaacc

SEQ ID NO: 3649215 - DNA, 23 bp, Homo sapiens
actcttttgagcagtaaatgtat

SEQ ID NO: 3649216 - DNA, 15 bp, Homo sapiens
actgaaattagtgtt

SEQ ID NO: 3649217 - DNA, 19 bp, Homo sapiens
actgaactttgctgagcct

SEQ ID NO: 3649218 - DNA, 10 bp, Homo sapiens
actgaagaaa

SEQ ID NO: 3649219 - DNA, 19 bp, Homo sapiens
actgccatttcctcctggg

SEQ ID NO: 3649220 - DNA, 22 bp, Homo sapiens
actgccttatattattttctgt

SEQ ID NO: 3649221 - DNA, 13 bp, Homo sapiens
actgcctttgacc

SEQ ID NO: 3649222 - DNA, 21 bp, Homo sapiens
actggaaacatctgatttctg

SEQ ID NO: 3649223 - DNA, 23 bp, Homo sapiens
actggaattttgctttatcagaa

SEQ ID NO: 3649224 - DNA, 14 bp, Homo sapiens
actgggaaatgaga

SEQ ID NO: 3649225 - DNA, 20 bp, Homo sapiens
acttacacacctgagaatgt

SEQ ID NO: 3649226 - DNA, 21 bp, Homo sapiens
acttacacacctgagaatgtg

SEQ ID NO: 3649227 - DNA, 23 bp, Homo sapiens
acttatttataacattgtaaatg

SEQ ID NO: 3649228 - DNA, 12 bp, Homo sapiens
acttattttgat

SEQ ID NO: 3649229 - DNA, 21 bp, Homo sapiens
acttcctattaatttattaaa

SEQ ID NO: 3649230 - DNA, 12 bp, Homo sapiens
acttgctgtgaa

SEQ ID NO: 3649231 - DNA, 18 bp, Homo sapiens
acttggattaattcatgg

SEQ ID NO: 3649232 - DNA, 13 bp, Homo sapiens
acttgtctcccag

SEQ ID NO: 3649233 - DNA, 14 bp, Homo sapiens
acttgtgtgccaca

SEQ ID NO: 3649234 - DNA, 13 bp, Homo sapiens
actttggctgcat

SEQ ID NO: 3649235 - DNA, 15 bp, Homo sapiens
acttttataaatgtt

SEQ ID NO: 3649236 - DNA, 17 bp, Homo sapiens
acttttataaatgtttt

SEQ ID NO: 3649237 - DNA, 22 bp, Homo sapiens
acttttcaggcactttagaaat

SEQ ID NO: 3649238 - DNA, 13 bp, Homo sapiens
agaaacacagcat

SEQ ID NO: 3649239 - DNA, 19 bp, Homo sapiens
agaaacacagcatgcattt

SEQ ID NO: 3649240 - DNA, 20 bp, Homo sapiens
agaaacacggagtttccatt

SEQ ID NO: 3649241 - DNA, 22 bp, Homo sapiens
agaaactttggaagttttactt

SEQ ID NO: 3649242 - DNA, 23 bp, Homo sapiens
agaaactttggaagttttacttg

SEQ ID NO: 3649243 - DNA, 20 bp, Homo sapiens
agaaagacatctgaggaaaa

SEQ ID NO: 3649244 - DNA, 16 bp, Homo sapiens
agaaatataaaaataa

SEQ ID NO: 3649245 - DNA, 17 bp, Homo sapiens
agaaatataaaaataat

SEQ ID NO: 3649246 - DNA, 20 bp, Homo sapiens
agaaatatccttttagaagc

SEQ ID NO: 3649247 - DNA, 21 bp, Homo sapiens
agaaatatccttttagaagca

SEQ ID NO: 3649248 - DNA, 16 bp, Homo sapiens
agaaccaggcatggaa

SEQ ID NO: 3649249 - DNA, 19 bp, Homo sapiens
agaaccaggcatggaaaga

SEQ ID NO: 3649250 - DNA, 19 bp, Homo sapiens
agaagaaggactgaagaaa

SEQ ID NO: 3649251 - DNA, 17 bp, Homo sapiens
agaagcaaggaagtaag

SEQ ID NO: 3649252 - DNA, 21 bp, Homo sapiens
agaagtgaaaaagacttcaaa

SEQ ID NO: 3649253 - DNA, 20 bp, Homo sapiens
agaagtggaaggataatgag

SEQ ID NO: 3649254 - DNA, 17 bp, Homo sapiens
agaataccccaccagca

SEQ ID NO: 3649255 - DNA, 19 bp, Homo sapiens
agaataccccaccagcaga

SEQ ID NO: 3649256 - DNA, 15 bp, Homo sapiens
agaatgagatgattt

SEQ ID NO: 3649257 - DNA, 20 bp, Homo sapiens
agaatgagatgatttaattc

SEQ ID NO: 3649258 - DNA, 20 bp, Homo sapiens
agaatgtgaaaaaaaaaagt

SEQ ID NO: 3649259 - DNA, 15 bp, Homo sapiens
agaattcagtagcat

SEQ ID NO: 3649260 - DNA, 17 bp, Homo sapiens
agaattcatgatgctag

SEQ ID NO: 3649261 - DNA, 21 bp, Homo sapiens
agaattgggcccttagaatgt

SEQ ID NO: 3649262 - DNA, 18 bp, Homo sapiens
agacaagcattgggtcag

SEQ ID NO: 3649263 - DNA, 19 bp, Homo sapiens
agacaagcattgggtcaga

SEQ ID NO: 3649264 - DNA, 18 bp, Homo sapiens
agacaagtctagtggaac

SEQ ID NO: 3649265 - DNA, 21 bp, Homo sapiens
agacaagtctagtggaaccaa

SEQ ID NO: 3649266 - DNA, 17 bp, Homo sapiens
agacaggtgggagatgg

SEQ ID NO: 3649267 - DNA, 20 bp, Homo sapiens
agacaggtgggagatggagg

SEQ ID NO: 3649268 - DNA, 16 bp, Homo sapiens
agaccatgcattcaga

SEQ ID NO: 3649269 - DNA, 23 bp, Homo sapiens
agaccatgcattcagatctgaag

SEQ ID NO: 3649270 - DNA, 20 bp, Homo sapiens
agacccataaaccacctccc

SEQ ID NO: 3649271 - DNA, 21 bp, Homo sapiens
agacccataaaccacctccca

SEQ ID NO: 3649272 - DNA, 17 bp, Homo sapiens
agacctaaggcagacag

SEQ ID NO: 3649273 - DNA, 20 bp, Homo sapiens
agacctaaggcagacaggaa

SEQ ID NO: 3649274 - DNA, 23 bp, Homo sapiens
agacggagtcttgccctctcgcc

SEQ ID NO: 3649275 - DNA, 14 bp, Homo sapiens
agactccatctcaa

SEQ ID NO: 3649276 - DNA, 18 bp, Homo sapiens
agactgccttatattatt

SEQ ID NO: 3649277 - DNA, 17 bp, Homo sapiens
agactggaaaaggtgga

SEQ ID NO: 3649278 - DNA, 17 bp, Homo sapiens
agacttcctattaattt

SEQ ID NO: 3649279 - DNA, 16 bp, Homo sapiens
agagataatgaggcaa

SEQ ID NO: 3649280 - DNA, 19 bp, Homo sapiens
agagataatgaggcaactc

SEQ ID NO: 3649281 - DNA, 17 bp, Homo sapiens
agagatttgctttttct

SEQ ID NO: 3649282 - DNA, 22 bp, Homo sapiens
agagcctgagactggaaaaggt

SEQ ID NO: 3649283 - DNA, 15 bp, Homo sapiens
agagctgctgtattt

SEQ ID NO: 3649284 - DNA, 19 bp, Homo sapiens
agaggatgaggtgggctga

SEQ ID NO: 3649285 - DNA, 22 bp, Homo sapiens
agagtccccccgaccagatcct

SEQ ID NO: 3649286 - DNA, 16 bp, Homo sapiens
agagtgacttggagag

SEQ ID NO: 3649287 - DNA, 17 bp, Homo sapiens
agataatgaggcaactc

SEQ ID NO: 3649288 - DNA, 15 bp, Homo sapiens
agataattaaatgaa

SEQ ID NO: 3649289 - DNA, 15 bp, Homo sapiens
agataccattttgaa

SEQ ID NO: 3649290 - DNA, 22 bp, Homo sapiens
agatcagcatccaaaagcagga

SEQ ID NO: 3649291 - DNA, 23 bp, Homo sapiens
agatccatcggtttatactattt

SEQ ID NO: 3649292 - DNA, 18 bp, Homo sapiens
agatccttttccatccca

SEQ ID NO: 3649293 - DNA, 22 bp, Homo sapiens
agatcgtgccattacactccag

SEQ ID NO: 3649294 - DNA, 17 bp, Homo sapiens
agatctatatggagctt

SEQ ID NO: 3649295 - DNA, 15 bp, Homo sapiens
agatgatttaattct

SEQ ID NO: 3649296 - DNA, 16 bp, Homo sapiens
agatgatttaattctt

SEQ ID NO: 3649297 - DNA, 20 bp, Homo sapiens
agatggaggtagggctggct

SEQ ID NO: 3649298 - DNA, 20 bp, Homo sapiens
agatggggagctctggaggt

SEQ ID NO: 3649299 - DNA, 14 bp, Homo sapiens
agatggtagaaact

SEQ ID NO: 3649300 - DNA, 18 bp, Homo sapiens
agatgtaagtattaagaa

SEQ ID NO: 3649301 - DNA, 18 bp, Homo sapiens
agattggaaaaaattaga

SEQ ID NO: 3649302 - DNA, 15 bp, Homo sapiens
agcaaactgaaatta

SEQ ID NO: 3649303 - DNA, 22 bp, Homo sapiens
agcaaactgaaattagtgtttt

SEQ ID NO: 3649304 - DNA, 21 bp, Homo sapiens
agcaaggaagtaagggagtca

SEQ ID NO: 3649305 - DNA, 17 bp, Homo sapiens
agcaataagttgaatga

SEQ ID NO: 3649306 - DNA, 15 bp, Homo sapiens
agcaatccttaaaaa

SEQ ID NO: 3649307 - DNA, 16 bp, Homo sapiens
agcaatccttaaaaag

SEQ ID NO: 3649308 - DNA, 16 bp, Homo sapiens
agcacatgttttacaa

SEQ ID NO: 3649309 - DNA, 21 bp, Homo sapiens
agcacatttgttaatgattct

SEQ ID NO: 3649310 - DNA, 22 bp, Homo sapiens
agcagaacaaactcagatctca

SEQ ID NO: 3649311 - DNA, 15 bp, Homo sapiens
agcagaatgagatga

SEQ ID NO: 3649312 - DNA, 22 bp, Homo sapiens
agcagaatgagatgatttaatt

SEQ ID NO: 3649313 - DNA, 13 bp, Homo sapiens
agcagaggcagga

SEQ ID NO: 3649314 - DNA, 20 bp, Homo sapiens
agcagaggcaggaccagaag

SEQ ID NO: 3649315 - DNA, 14 bp, Homo sapiens
agcagcagaggcag

SEQ ID NO: 3649316 - DNA, 24 bp, Homo sapiens
agcagtccatttttgagtaaaact

SEQ ID NO: 3649317 - DNA, 22 bp, Homo sapiens
agcatccaaaagcaggaaccca

SEQ ID NO: 3649318 - DNA, 14 bp, Homo sapiens
agcatcctggaaat

SEQ ID NO: 3649319 - DNA, 15 bp, Homo sapiens
agcatcctggaaatt

SEQ ID NO: 3649320 - DNA, 16 bp, Homo sapiens
agcatcctggaaattt

SEQ ID NO: 3649321 - DNA, 14 bp, Homo sapiens
agcatgagttctgc

SEQ ID NO: 3649322 - DNA, 22 bp, Homo sapiens
agcatgcccaaatataacatga

SEQ ID NO: 3649323 - DNA, 20 bp, Homo sapiens
agcattttaatagtttctaa

SEQ ID NO: 3649324 - DNA, 20 bp, Homo sapiens
agccaaccctggaaaaggag

SEQ ID NO: 3649325 - DNA, 22 bp, Homo sapiens
agccctaagtaaatctaaatta

SEQ ID NO: 3649326 - DNA, 20 bp, Homo sapiens
agccctctcagatcacccca

SEQ ID NO: 3649327 - DNA, 21 bp, Homo sapiens
agcctcactccatttcccact

SEQ ID NO: 3649328 - DNA, 16 bp, Homo sapiens
agcctgagactggaaa

SEQ ID NO: 3649329 - DNA, 17 bp, Homo sapiens
agcctgatgatggaagg

SEQ ID NO: 3649330 - DNA, 19 bp, Homo sapiens
agcctggcttagaaggcac

SEQ ID NO: 3649331 - DNA, 12 bp, Homo sapiens
agccttattaaa

SEQ ID NO: 3649332 - DNA, 14 bp, Homo sapiens
agccttattaaaat

SEQ ID NO: 3649333 - DNA, 13 bp, Homo sapiens
agccttgcccatt

SEQ ID NO: 3649334 - DNA, 14 bp, Homo sapiens
agctaatttgtgaa

SEQ ID NO: 3649335 - DNA, 13 bp, Homo sapiens
agctactcaggag

SEQ ID NO: 3649336 - DNA, 15 bp, Homo sapiens
agctactcaggaggc

SEQ ID NO: 3649337 - DNA, 21 bp, Homo sapiens
agctactcaggaggctgaggc

SEQ ID NO: 3649338 - DNA, 17 bp, Homo sapiens
agctcacagcacatttg

SEQ ID NO: 3649339 - DNA, 19 bp, Homo sapiens
agctcacagcacatttgtt

SEQ ID NO: 3649340 - DNA, 15 bp, Homo sapiens
agctcatagcacatg

SEQ ID NO: 3649341 - DNA, 20 bp, Homo sapiens
agctcatagcacatgtttta

SEQ ID NO: 3649342 - DNA, 16 bp, Homo sapiens
agctccatgctgttct

SEQ ID NO: 3649343 - DNA, 13 bp, Homo sapiens
agctgagctggcc

SEQ ID NO: 3649344 - DNA, 15 bp, Homo sapiens
agcttttcacttctt

SEQ ID NO: 3649345 - DNA, 17 bp, Homo sapiens
aggaaaaggctgcagct

SEQ ID NO: 3649346 - DNA, 18 bp, Homo sapiens
aggaaaatggaagaccta

SEQ ID NO: 3649347 - DNA, 17 bp, Homo sapiens
aggaagcacaaaagaca

SEQ ID NO: 3649348 - DNA, 18 bp, Homo sapiens
aggaagcacaaaagacaa

SEQ ID NO: 3649349 - DNA, 14 bp, Homo sapiens
aggaagccctctca

SEQ ID NO: 3649350 - DNA, 16 bp, Homo sapiens
aggaagccctctcaga

SEQ ID NO: 3649351 - DNA, 17 bp, Homo sapiens
aggaagccctctcagat

SEQ ID NO: 3649352 - DNA, 22 bp, Homo sapiens
aggaaggaaacaacaaaggaag

SEQ ID NO: 3649353 - DNA, 11 bp, Homo sapiens
aggaaggaagc

SEQ ID NO: 3649354 - DNA, 17 bp, Homo sapiens
aggaagtaagggagtca

SEQ ID NO: 3649355 - DNA, 19 bp, Homo sapiens
aggacagtgttcaaattct

SEQ ID NO: 3649356 - DNA, 18 bp, Homo sapiens
aggacttaatttagcagt

SEQ ID NO: 3649357 - DNA, 22 bp, Homo sapiens
aggagttcgaggcgagcctggc

SEQ ID NO: 3649358 - DNA, 19 bp, Homo sapiens
aggataatgagatgtaata

SEQ ID NO: 3649359 - DNA, 19 bp, Homo sapiens
aggatcacttgagcccaga

SEQ ID NO: 3649360 - DNA, 16 bp, Homo sapiens
aggatgtggatggagg

SEQ ID NO: 3649361 - DNA, 12 bp, Homo sapiens
aggcaactcagc

SEQ ID NO: 3649362 - DNA, 15 bp, Homo sapiens
aggcactttagaaat

SEQ ID NO: 3649363 - DNA, 21 bp, Homo sapiens
aggcatgagccactgtgcctg

SEQ ID NO: 3649364 - DNA, 19 bp, Homo sapiens
aggcatggaaagatgggga

SEQ ID NO: 3649365 - DNA, 22 bp, Homo sapiens
aggcatggaaagatggggagct

SEQ ID NO: 3649366 - DNA, 13 bp, Homo sapiens
aggccgaggcagg

SEQ ID NO: 3649367 - DNA, 15 bp, Homo sapiens
aggccgaggcaggtg

SEQ ID NO: 3649368 - DNA, 19 bp, Homo sapiens
aggctctctggtctacctg

SEQ ID NO: 3649369 - DNA, 16 bp, Homo sapiens
aggctgaggcaggaga

SEQ ID NO: 3649370 - DNA, 22 bp, Homo sapiens
aggctgcagctaatttgtgaaa

SEQ ID NO: 3649371 - DNA, 20 bp, Homo sapiens
aggctggagtgtagtggcac

SEQ ID NO: 3649372 - DNA, 15 bp, Homo sapiens
agggaaaacattcca

SEQ ID NO: 3649373 - DNA, 16 bp, Homo sapiens
agggaaaacattccat

SEQ ID NO: 3649374 - DNA, 13 bp, Homo sapiens
agggaagcccagc

SEQ ID NO: 3649375 - DNA, 14 bp, Homo sapiens
agggaagcccagcc

SEQ ID NO: 3649376 - DNA, 15 bp, Homo sapiens
agggaagcccagcct

SEQ ID NO: 3649377 - DNA, 18 bp, Homo sapiens
agggaagcccagcctgca

SEQ ID NO: 3649378 - DNA, 16 bp, Homo sapiens
agggaccttcagggag

SEQ ID NO: 3649379 - DNA, 21 bp, Homo sapiens
agggaccttcagggagagctg

SEQ ID NO: 3649380 - DNA, 20 bp, Homo sapiens
agggcaagctcatagcacat

SEQ ID NO: 3649381 - DNA, 20 bp, Homo sapiens
agggctggctggaggaagga

SEQ ID NO: 3649382 - DNA, 21 bp, Homo sapiens
agggctggctggaggaaggaa

SEQ ID NO: 3649383 - DNA, 17 bp, Homo sapiens
agggctgttccctccag

SEQ ID NO: 3649384 - DNA, 19 bp, Homo sapiens
aggggcaaaaatttgacat

SEQ ID NO: 3649385 - DNA, 15 bp, Homo sapiens
agggtgagactccat

SEQ ID NO: 3649386 - DNA, 19 bp, Homo sapiens
aggtaaactgatgctttca

SEQ ID NO: 3649387 - DNA, 18 bp, Homo sapiens
aggtgatgaatttaccat

SEQ ID NO: 3649388 - DNA, 18 bp, Homo sapiens
aggttgcagtgagctgag

SEQ ID NO: 3649389 - DNA, 18 bp, Homo sapiens
agtaaatatacactttac

SEQ ID NO: 3649390 - DNA, 16 bp, Homo sapiens
agtaaatgtatattga

SEQ ID NO: 3649391 - DNA, 17 bp, Homo sapiens
agtaaattcctaattct

SEQ ID NO: 3649392 - DNA, 19 bp, Homo sapiens
agtaaattcctaattctat

SEQ ID NO: 3649393 - DNA, 13 bp, Homo sapiens
agtaagggagtca

SEQ ID NO: 3649394 - DNA, 23 bp, Homo sapiens
agtaagggagtcattgccttggg

SEQ ID NO: 3649395 - DNA, 21 bp, Homo sapiens
agtacccaacctggtaattat

SEQ ID NO: 3649396 - DNA, 23 bp, Homo sapiens
agtatagataaatccaatagtct

SEQ ID NO: 3649397 - DNA, 14 bp, Homo sapiens
agtatcttaaaatt

SEQ ID NO: 3649398 - DNA, 15 bp, Homo sapiens
agtcaagtctacctg

SEQ ID NO: 3649399 - DNA, 23 bp, Homo sapiens
agtcaattgcttgagcatgccca

SEQ ID NO: 3649400 - DNA, 15 bp, Homo sapiens
agtccatgtgataat

SEQ ID NO: 3649401 - DNA, 19 bp, Homo sapiens
agtccatgtgataattgta

SEQ ID NO: 3649402 - DNA, 13 bp, Homo sapiens
agtccatttttga

SEQ ID NO: 3649403 - DNA, 13 bp, Homo sapiens
agtccccccgacc

SEQ ID NO: 3649404 - DNA, 18 bp, Homo sapiens
agtcgaggctggtaaggg

SEQ ID NO: 3649405 - DNA, 19 bp, Homo sapiens
agtctatgctgtgtgcaga

SEQ ID NO: 3649406 - DNA, 15 bp, Homo sapiens
agtcttgttgttcat

SEQ ID NO: 3649407 - DNA, 16 bp, Homo sapiens
agtcttgttgttcata

SEQ ID NO: 3649408 - DNA, 17 bp, Homo sapiens
agtcttgttgttcatat

SEQ ID NO: 3649409 - DNA, 17 bp, Homo sapiens
agtgaaattagtatttt

SEQ ID NO: 3649410 - DNA, 14 bp, Homo sapiens
agtgcaagagcctg

SEQ ID NO: 3649411 - DNA, 16 bp, Homo sapiens
agtgcaagagcctgag

SEQ ID NO: 3649412 - DNA, 22 bp, Homo sapiens
agtgcaagagcctgagactgga

SEQ ID NO: 3649413 - DNA, 17 bp, Homo sapiens
agtgcatgttaaaataa

SEQ ID NO: 3649414 - DNA, 20 bp, Homo sapiens
agtgctgggattacaggcat

SEQ ID NO: 3649415 - DNA, 21 bp, Homo sapiens
agtggaagagctgctgtattt

SEQ ID NO: 3649416 - DNA, 18 bp, Homo sapiens
agtggcatttctttatga

SEQ ID NO: 3649417 - DNA, 22 bp, Homo sapiens
agtgggacaccattctgaattt

SEQ ID NO: 3649418 - DNA, 20 bp, Homo sapiens
agtggtagagtcctaggaca

SEQ ID NO: 3649419 - DNA, 16 bp, Homo sapiens
agtggtattttaacat

SEQ ID NO: 3649420 - DNA, 15 bp, Homo sapiens
agtgtgagtgttaga

SEQ ID NO: 3649421 - DNA, 16 bp, Homo sapiens
agtgttagaaaaaact

SEQ ID NO: 3649422 - DNA, 22 bp, Homo sapiens
agtgttggccatcatttcattc

SEQ ID NO: 3649423 - DNA, 17 bp, Homo sapiens
agtgtttctagtaacag

SEQ ID NO: 3649424 - DNA, 13 bp, Homo sapiens
agtgttttcattc

SEQ ID NO: 3649425 - DNA, 14 bp, Homo sapiens
agtgttttcattct

SEQ ID NO: 3649426 - DNA, 15 bp, Homo sapiens
agtgtttttacatat

SEQ ID NO: 3649427 - DNA, 16 bp, Homo sapiens
agttacttacacacct

SEQ ID NO: 3649428 - DNA, 23 bp, Homo sapiens
agttatttaccagaagtttaaat

SEQ ID NO: 3649429 - DNA, 21 bp, Homo sapiens
agttccctgaaccttcctgtc

SEQ ID NO: 3649430 - DNA, 23 bp, Homo sapiens
agttccctgaaccttcctgtctc

SEQ ID NO: 3649431 - DNA, 12 bp, Homo sapiens
agttctgatgag

SEQ ID NO: 3649432 - DNA, 17 bp, Homo sapiens
agtttaaatctttgtta

SEQ ID NO: 3649433 - DNA, 21 bp, Homo sapiens
agtttccatttggattttaaa

SEQ ID NO: 3649434 - DNA, 16 bp, Homo sapiens
agtttggtatgaaaca

SEQ ID NO: 3649435 - DNA, 20 bp, Homo sapiens
ataaaaggtcggaccagctt

SEQ ID NO: 3649436 - DNA, 13 bp, Homo sapiens
ataaaatgtttat

SEQ ID NO: 3649437 - DNA, 14 bp, Homo sapiens
ataaacacagtaag

SEQ ID NO: 3649438 - DNA, 12 bp, Homo sapiens
ataaagtggcat

SEQ ID NO: 3649439 - DNA, 15 bp, Homo sapiens
ataaatgttttaaag

SEQ ID NO: 3649440 - DNA, 12 bp, Homo sapiens
ataaattttgga

SEQ ID NO: 3649441 - DNA, 14 bp, Homo sapiens
ataaattttggaag

SEQ ID NO: 3649442 - DNA, 17 bp, Homo sapiens
ataaattttggaagaat

SEQ ID NO: 3649443 - DNA, 19 bp, Homo sapiens
ataaattttggaagaattc

SEQ ID NO: 3649444 - DNA, 13 bp, Homo sapiens
ataactattgctg

SEQ ID NO: 3649445 - DNA, 21 bp, Homo sapiens
ataagtgttggccatcatttc

SEQ ID NO: 3649446 - DNA, 17 bp, Homo sapiens
ataagttgaatgataat

SEQ ID NO: 3649447 - DNA, 14 bp, Homo sapiens
ataataaagtggca

SEQ ID NO: 3649448 - DNA, 16 bp, Homo sapiens
ataatggcctcttaaa

SEQ ID NO: 3649449 - DNA, 21 bp, Homo sapiens
ataattatatgaagcagaatg

SEQ ID NO: 3649450 - DNA, 13 bp, Homo sapiens
atacaagtgtttc

SEQ ID NO: 3649451 - DNA, 20 bp, Homo sapiens
atacactttacattcttgct

SEQ ID NO: 3649452 - DNA, 23 bp, Homo sapiens
atacagtctctatttgatttgca

SEQ ID NO: 3649453 - DNA, 15 bp, Homo sapiens
ataccattttgaaat

SEQ ID NO: 3649454 - DNA, 17 bp, Homo sapiens
ataccattttgaaatat

SEQ ID NO: 3649455 - DNA, 24 bp, Homo sapiens
atacgtgcccatttcacacaactg

SEQ ID NO: 3649456 - DNA, 10 bp, Homo sapiens
atactaagag

SEQ ID NO: 3649457 - DNA, 19 bp, Homo sapiens
atactaagtcctcagagct

SEQ ID NO: 3649458 - DNA, 17 bp, Homo sapiens
atactatttattaaaac

SEQ ID NO: 3649459 - DNA, 14 bp, Homo sapiens
atactcatttggat

SEQ ID NO: 3649460 - DNA, 15 bp, Homo sapiens
atagaagaaggactg

SEQ ID NO: 3649461 - DNA, 19 bp, Homo sapiens
atagaagaaggactgaaga

SEQ ID NO: 3649462 - DNA, 20 bp, Homo sapiens
atagaagaaggactgaagaa

SEQ ID NO: 3649463 - DNA, 20 bp, Homo sapiens
atagataccattttgaaata

SEQ ID NO: 3649464 - DNA, 12 bp, Homo sapiens
atagcacatgtt

SEQ ID NO: 3649465 - DNA, 18 bp, Homo sapiens
atagctcacagcacattt

SEQ ID NO: 3649466 - DNA, 19 bp, Homo sapiens
atagcttttcacttcttaa

SEQ ID NO: 3649467 - DNA, 23 bp, Homo sapiens
atagcttttcacttcttaaggac

SEQ ID NO: 3649468 - DNA, 14 bp, Homo sapiens
ataggttctgcttt

SEQ ID NO: 3649469 - DNA, 12 bp, Homo sapiens
atagtgaaaatt

SEQ ID NO: 3649470 - DNA, 22 bp, Homo sapiens
atagtgttgtgttacaataagt

SEQ ID NO: 3649471 - DNA, 10 bp, Homo sapiens
atataaatca

SEQ ID NO: 3649472 - DNA, 19 bp, Homo sapiens
atatagagtgacttggaga

SEQ ID NO: 3649473 - DNA, 14 bp, Homo sapiens
atatagctttgcaa

SEQ ID NO: 3649474 - DNA, 20 bp, Homo sapiens
atataggggcaaaaatttga

SEQ ID NO: 3649475 - DNA, 14 bp, Homo sapiens
atatagtgttgtgt

SEQ ID NO: 3649476 - DNA, 15 bp, Homo sapiens
atatatgtatatctg

SEQ ID NO: 3649477 - DNA, 15 bp, Homo sapiens
atatccttttagaag

SEQ ID NO: 3649478 - DNA, 19 bp, Homo sapiens
atatgagaaatataaaaat

SEQ ID NO: 3649479 - DNA, 22 bp, Homo sapiens
atatgagaaatataaaaataat

SEQ ID NO: 3649480 - DNA, 16 bp, Homo sapiens
atatgagattggaaaa

SEQ ID NO: 3649481 - DNA, 22 bp, Homo sapiens
atatgagattggaaaaaattag

SEQ ID NO: 3649482 - DNA, 18 bp, Homo sapiens
atatggcaacgttcatgt

SEQ ID NO: 3649483 - DNA, 13 bp, Homo sapiens
atatgtatatctg

SEQ ID NO: 3649484 - DNA, 17 bp, Homo sapiens
atatgtatatctgtgta

SEQ ID NO: 3649485 - DNA, 12 bp, Homo sapiens
atattattttct

SEQ ID NO: 3649486 - DNA, 15 bp, Homo sapiens
atattattttctgta

SEQ ID NO: 3649487 - DNA, 21 bp, Homo sapiens
atattattttctgtaattctt

SEQ ID NO: 3649488 - DNA, 14 bp, Homo sapiens
atatttactgttta

SEQ ID NO: 3649489 - DNA, 17 bp, Homo sapiens
atatttactgtttataa

SEQ ID NO: 3649490 - DNA, 22 bp, Homo sapiens
atcaacagaattgttctttttc

SEQ ID NO: 3649491 - DNA, 13 bp, Homo sapiens
atcaagtctgtga

SEQ ID NO: 3649492 - DNA, 14 bp, Homo sapiens
atcaatctttatgt

SEQ ID NO: 3649493 - DNA, 14 bp, Homo sapiens
atcaccccagcctc

SEQ ID NO: 3649494 - DNA, 13 bp, Homo sapiens
atcagaagcaagg

SEQ ID NO: 3649495 - DNA, 16 bp, Homo sapiens
atcagaagcaaggaag

SEQ ID NO: 3649496 - DNA, 17 bp, Homo sapiens
atcagaagcaaggaagt

SEQ ID NO: 3649497 - DNA, 21 bp, Homo sapiens
atcatgcctacattagtgaga

SEQ ID NO: 3649498 - DNA, 15 bp, Homo sapiens
atcattgtgcccact

SEQ ID NO: 3649499 - DNA, 12 bp, Homo sapiens
atccactacagg

SEQ ID NO: 3649500 - DNA, 18 bp, Homo sapiens
atccatcgatttgtatta

SEQ ID NO: 3649501 - DNA, 19 bp, Homo sapiens
atccatgtgctgctgtggc

SEQ ID NO: 3649502 - DNA, 13 bp, Homo sapiens
atcccactccact

SEQ ID NO: 3649503 - DNA, 14 bp, Homo sapiens
atcccagagttatt

SEQ ID NO: 3649504 - DNA, 18 bp, Homo sapiens
atcccgggttcaagagat

SEQ ID NO: 3649505 - DNA, 21 bp, Homo sapiens
atccctggcttccccttcaga

SEQ ID NO: 3649506 - DNA, 15 bp, Homo sapiens
atcccttcaacccca

SEQ ID NO: 3649507 - DNA, 22 bp, Homo sapiens
atcccttcaaccccacttccta

SEQ ID NO: 3649508 - DNA, 21 bp, Homo sapiens
atcctcaagttgtgtgctatt

SEQ ID NO: 3649509 - DNA, 16 bp, Homo sapiens
atcctggaaatttgtg

SEQ ID NO: 3649510 - DNA, 13 bp, Homo sapiens
atcctgggctggc

SEQ ID NO: 3649511 - DNA, 16 bp, Homo sapiens
atccttttccatccca

SEQ ID NO: 3649512 - DNA, 18 bp, Homo sapiens
atccttttccatcccact

SEQ ID NO: 3649513 - DNA, 15 bp, Homo sapiens
atcgatttgtattaa

SEQ ID NO: 3649514 - DNA, 20 bp, Homo sapiens
atcgatttgtattaatgtag

SEQ ID NO: 3649515 - DNA, 22 bp, Homo sapiens
atcgtgccattacactccagcc

SEQ ID NO: 3649516 - DNA, 19 bp, Homo sapiens
atctaaaccagaaggaagc

SEQ ID NO: 3649517 - DNA, 14 bp, Homo sapiens
atctacaaactttt

SEQ ID NO: 3649518 - DNA, 17 bp, Homo sapiens
atctacacatataaaca

SEQ ID NO: 3649519 - DNA, 20 bp, Homo sapiens
atctcagctactcaggaggc

SEQ ID NO: 3649520 - DNA, 19 bp, Homo sapiens
atctgaaaactcattagag

SEQ ID NO: 3649521 - DNA, 22 bp, Homo sapiens
atctgaggaaaatggaagacct

SEQ ID NO: 3649522 - DNA, 14 bp, Homo sapiens
atctgtttgcttct

SEQ ID NO: 3649523 - DNA, 16 bp, Homo sapiens
atctgtttgcttctaa

SEQ ID NO: 3649524 - DNA, 13 bp, Homo sapiens
atcttaaaattgg

SEQ ID NO: 3649525 - DNA, 22 bp, Homo sapiens
atcttaaaattggttaatgaaa

SEQ ID NO: 3649526 - DNA, 22 bp, Homo sapiens
atcttacccttcaatgttaaat

SEQ ID NO: 3649527 - DNA, 23 bp, Homo sapiens
atcttacccttcaatgttaaatc

SEQ ID NO: 3649528 - DNA, 15 bp, Homo sapiens
atctttgccaccctc

SEQ ID NO: 3649529 - DNA, 19 bp, Homo sapiens
atgaaaatggctgaagaaa

SEQ ID NO: 3649530 - DNA, 13 bp, Homo sapiens
atgaaacaaatat

SEQ ID NO: 3649531 - DNA, 14 bp, Homo sapiens
atgaaacaaatata

SEQ ID NO: 3649532 - DNA, 16 bp, Homo sapiens
atgaaacaaatatact

SEQ ID NO: 3649533 - DNA, 21 bp, Homo sapiens
atgaaacaaatatactcattt

SEQ ID NO: 3649534 - DNA, 19 bp, Homo sapiens
atgaaatacttgacaacat

SEQ ID NO: 3649535 - DNA, 21 bp, Homo sapiens
atgaagccctaagtaaatcta

SEQ ID NO: 3649536 - DNA, 20 bp, Homo sapiens
atgaatccatcgatttgtat

SEQ ID NO: 3649537 - DNA, 16 bp, Homo sapiens
atgagatcccagagtt

SEQ ID NO: 3649538 - DNA, 20 bp, Homo sapiens
atgagatgatttaattctta

SEQ ID NO: 3649539 - DNA, 21 bp, Homo sapiens
atgagatgatttaattcttac

SEQ ID NO: 3649540 - DNA, 12 bp, Homo sapiens
atgagattggaa

SEQ ID NO: 3649541 - DNA, 20 bp, Homo sapiens
atgaggcaactcagcaggct

SEQ ID NO: 3649542 - DNA, 20 bp, Homo sapiens
atgaggcacgcctgccttct

SEQ ID NO: 3649543 - DNA, 12 bp, Homo sapiens
atgaggtcagga

SEQ ID NO: 3649544 - DNA, 14 bp, Homo sapiens
atgagtctccagat

SEQ ID NO: 3649545 - DNA, 16 bp, Homo sapiens
atgagttctgcacata

SEQ ID NO: 3649546 - DNA, 22 bp, Homo sapiens
atgataatagctcacagcacat

SEQ ID NO: 3649547 - DNA, 15 bp, Homo sapiens
atgatatgtctttaa

SEQ ID NO: 3649548 - DNA, 15 bp, Homo sapiens
atgattcttgtgtca

SEQ ID NO: 3649549 - DNA, 21 bp, Homo sapiens
atgattcttgtgtcatcaagt

SEQ ID NO: 3649550 - DNA, 13 bp, Homo sapiens
atgatttaacatt

SEQ ID NO: 3649551 - DNA, 15 bp, Homo sapiens
atgatttaattctta

SEQ ID NO: 3649552 - DNA, 16 bp, Homo sapiens
atgatttaattcttac

SEQ ID NO: 3649553 - DNA, 17 bp, Homo sapiens
atgcactcttttgagca

SEQ ID NO: 3649554 - DNA, 16 bp, Homo sapiens
atgcatggaaattccc

SEQ ID NO: 3649555 - DNA, 13 bp, Homo sapiens
atgcatttagcat

SEQ ID NO: 3649556 - DNA, 12 bp, Homo sapiens
atgcccatcccg

SEQ ID NO: 3649557 - DNA, 16 bp, Homo sapiens
atgcctcattttattc

SEQ ID NO: 3649558 - DNA, 18 bp, Homo sapiens
atgcctgtaatcccagca

SEQ ID NO: 3649559 - DNA, 14 bp, Homo sapiens
atgcgtttcttcca

SEQ ID NO: 3649560 - DNA, 21 bp, Homo sapiens
atgctatctcgctagccatat

SEQ ID NO: 3649561 - DNA, 17 bp, Homo sapiens
atggaaagatggggagc

SEQ ID NO: 3649562 - DNA, 20 bp, Homo sapiens
atggaagacctaaggcagac

SEQ ID NO: 3649563 - DNA, 14 bp, Homo sapiens
atggagagggatgg

SEQ ID NO: 3649564 - DNA, 18 bp, Homo sapiens
atggagagggatggaaat

SEQ ID NO: 3649565 - DNA, 20 bp, Homo sapiens
atggaggtagggctggctgg

SEQ ID NO: 3649566 - DNA, 20 bp, Homo sapiens
atggcaacgttcatgttcat

SEQ ID NO: 3649567 - DNA, 16 bp, Homo sapiens
atggctgaagaaacac

SEQ ID NO: 3649568 - DNA, 20 bp, Homo sapiens
atgggcaatcctgggctggc

SEQ ID NO: 3649569 - DNA, 16 bp, Homo sapiens
atgggcagaggatgag

SEQ ID NO: 3649570 - DNA, 22 bp, Homo sapiens
atggtacctctgtctataggac

SEQ ID NO: 3649571 - DNA, 18 bp, Homo sapiens
atggtagaaactttggaa

SEQ ID NO: 3649572 - DNA, 15 bp, Homo sapiens
atggtgatggagagg

SEQ ID NO: 3649573 - DNA, 16 bp, Homo sapiens
atggtgtcctgcatgt

SEQ ID NO: 3649574 - DNA, 15 bp, Homo sapiens
atggttgcaaagtgt

SEQ ID NO: 3649575 - DNA, 16 bp, Homo sapiens
atggttgcaaagtgtt

SEQ ID NO: 3649576 - DNA, 22 bp, Homo sapiens
atggttgcaaagtgttgtctta

SEQ ID NO: 3649577 - DNA, 23 bp, Homo sapiens
atggttgcaaagtgttgtcttat

SEQ ID NO: 3649578 - DNA, 14 bp, Homo sapiens
atgtacttgaaaat

SEQ ID NO: 3649579 - DNA, 15 bp, Homo sapiens
atgtaggaaaatttt

SEQ ID NO: 3649580 - DNA, 22 bp, Homo sapiens
atgtatatctgtgtaagacacg

SEQ ID NO: 3649581 - DNA, 15 bp, Homo sapiens
atgtatgccatgtat

SEQ ID NO: 3649582 - DNA, 22 bp, Homo sapiens
atgtatgccatgtatgttgcat

SEQ ID NO: 3649583 - DNA, 17 bp, Homo sapiens
atgtatgttgcatgaat

SEQ ID NO: 3649584 - DNA, 15 bp, Homo sapiens
atgtcattttcagat

SEQ ID NO: 3649585 - DNA, 16 bp, Homo sapiens
atgtcgtggactccag

SEQ ID NO: 3649586 - DNA, 15 bp, Homo sapiens
atgtctttaaaatga

SEQ ID NO: 3649587 - DNA, 18 bp, Homo sapiens
atgtgaaaaaaaaaagta

SEQ ID NO: 3649588 - DNA, 19 bp, Homo sapiens
atgtgaaaaaaaaaagtaa

SEQ ID NO: 3649589 - DNA, 16 bp, Homo sapiens
atgtgataattgtaaa

SEQ ID NO: 3649590 - DNA, 14 bp, Homo sapiens
atgtgctgctgtgg

SEQ ID NO: 3649591 - DNA, 16 bp, Homo sapiens
atgtgctgctgtggca

SEQ ID NO: 3649592 - DNA, 18 bp, Homo sapiens
atgtggatggaggtgatg

SEQ ID NO: 3649593 - DNA, 18 bp, Homo sapiens
atgttaaaataattatat

SEQ ID NO: 3649594 - DNA, 11 bp, Homo sapiens
atgttaaatct

SEQ ID NO: 3649595 - DNA, 21 bp, Homo sapiens
atgttgtgttggtatttactg

SEQ ID NO: 3649596 - DNA, 22 bp, Homo sapiens
atgttgtgttggtatttactgc

SEQ ID NO: 3649597 - DNA, 16 bp, Homo sapiens
attaaaacaaaatcct

SEQ ID NO: 3649598 - DNA, 13 bp, Homo sapiens
attaaactgggaa

SEQ ID NO: 3649599 - DNA, 23 bp, Homo sapiens
attaaatgaaatacttgacaaca

SEQ ID NO: 3649600 - DNA, 12 bp, Homo sapiens
attaaatttatt

SEQ ID NO: 3649601 - DNA, 19 bp, Homo sapiens
attaaatttattaaatgtt

SEQ ID NO: 3649602 - DNA, 12 bp, Homo sapiens
attaacaaattc

SEQ ID NO: 3649603 - DNA, 15 bp, Homo sapiens
attaaggactacaga

SEQ ID NO: 3649604 - DNA, 16 bp, Homo sapiens
attaatttattaaatt

SEQ ID NO: 3649605 - DNA, 23 bp, Homo sapiens
attacaacaagcaaactgaaatt

SEQ ID NO: 3649606 - DNA, 11 bp, Homo sapiens
attacagaaac

SEQ ID NO: 3649607 - DNA, 13 bp, Homo sapiens
attagagatgttg

SEQ ID NO: 3649608 - DNA, 12 bp, Homo sapiens
attagtgttttc

SEQ ID NO: 3649609 - DNA, 13 bp, Homo sapiens
attagtgttttca

SEQ ID NO: 3649610 - DNA, 19 bp, Homo sapiens
attagtgttttcattctgg

SEQ ID NO: 3649611 - DNA, 21 bp, Homo sapiens
attattacaacaagcaaactg

SEQ ID NO: 3649612 - DNA, 14 bp, Homo sapiens
attattttctgaga

SEQ ID NO: 3649613 - DNA, 13 bp, Homo sapiens
attcaacatcaat

SEQ ID NO: 3649614 - DNA, 17 bp, Homo sapiens
attcacttttattgtat

SEQ ID NO: 3649615 - DNA, 15 bp, Homo sapiens
attcagtggacattt

SEQ ID NO: 3649616 - DNA, 17 bp, Homo sapiens
attcagtggacatttgt

SEQ ID NO: 3649617 - DNA, 18 bp, Homo sapiens
attcatgatgctagttct

SEQ ID NO: 3649618 - DNA, 18 bp, Homo sapiens
attccatgaggaaaataa

SEQ ID NO: 3649619 - DNA, 21 bp, Homo sapiens
attcccatggtagactgtgac

SEQ ID NO: 3649620 - DNA, 22 bp, Homo sapiens
attcccatggtagactgtgaca

SEQ ID NO: 3649621 - DNA, 19 bp, Homo sapiens
attcccttcatctggaacc

SEQ ID NO: 3649622 - DNA, 15 bp, Homo sapiens
attcctaattcctgt

SEQ ID NO: 3649623 - DNA, 16 bp, Homo sapiens
attcctaattcctgta

SEQ ID NO: 3649624 - DNA, 18 bp, Homo sapiens
attcggtgatgactcttg

SEQ ID NO: 3649625 - DNA, 14 bp, Homo sapiens
attcgtaagttctg

SEQ ID NO: 3649626 - DNA, 15 bp, Homo sapiens
attcgtaagttctgt

SEQ ID NO: 3649627 - DNA, 19 bp, Homo sapiens
attcgtgggcctgctgctc

SEQ ID NO: 3649628 - DNA, 16 bp, Homo sapiens
attctctaagcctggc

SEQ ID NO: 3649629 - DNA, 18 bp, Homo sapiens
attctgattattacaaca

SEQ ID NO: 3649630 - DNA, 17 bp, Homo sapiens
attctgtcaatgaaaag

SEQ ID NO: 3649631 - DNA, 15 bp, Homo sapiens
attcttctcctttgt

SEQ ID NO: 3649632 - DNA, 21 bp, Homo sapiens
attgctgtctgaaaaagtgtt

SEQ ID NO: 3649633 - DNA, 20 bp, Homo sapiens
attggctagaatcagggtgg

SEQ ID NO: 3649634 - DNA, 19 bp, Homo sapiens
attgggcccttagaatgtg

SEQ ID NO: 3649635 - DNA, 20 bp, Homo sapiens
attgggcccttagaatgtga

SEQ ID NO: 3649636 - DNA, 23 bp, Homo sapiens
attgggcccttagaatgtgaaaa

SEQ ID NO: 3649637 - DNA, 15 bp, Homo sapiens
attggttaatgaaaa

SEQ ID NO: 3649638 - DNA, 19 bp, Homo sapiens
attggttaatgaaaaatct

SEQ ID NO: 3649639 - DNA, 21 bp, Homo sapiens
attgtaaaggtgatgaattta

SEQ ID NO: 3649640 - DNA, 18 bp, Homo sapiens
attgtcagaatgttgtgt

SEQ ID NO: 3649641 - DNA, 12 bp, Homo sapiens
attgtgcccact

SEQ ID NO: 3649642 - DNA, 14 bp, Homo sapiens
attgtttgatgaat

SEQ ID NO: 3649643 - DNA, 19 bp, Homo sapiens
attgtttgatgaataaaat

SEQ ID NO: 3649644 - DNA, 20 bp, Homo sapiens
attgtttgatgaataaaatg

SEQ ID NO: 3649645 - DNA, 23 bp, Homo sapiens
atttaattcttaccgaaatgaaa

SEQ ID NO: 3649646 - DNA, 13 bp, Homo sapiens
atttaccagaagt

SEQ ID NO: 3649647 - DNA, 14 bp, Homo sapiens
atttaccagaagtt

SEQ ID NO: 3649648 - DNA, 21 bp, Homo sapiens
atttaccagaagtttaaatct

SEQ ID NO: 3649649 - DNA, 14 bp, Homo sapiens
atttactgcaatgt

SEQ ID NO: 3649650 - DNA, 15 bp, Homo sapiens
atttactgcaatgtc

SEQ ID NO: 3649651 - DNA, 21 bp, Homo sapiens
atttactgtttataataggtg

SEQ ID NO: 3649652 - DNA, 16 bp, Homo sapiens
atttatgtcattttca

SEQ ID NO: 3649653 - DNA, 15 bp, Homo sapiens
atttatgtgtgaagc

SEQ ID NO: 3649654 - DNA, 12 bp, Homo sapiens
atttattaaatt

SEQ ID NO: 3649655 - DNA, 23 bp, Homo sapiens
atttattaaatttattaaatgtt

SEQ ID NO: 3649656 - DNA, 21 bp, Homo sapiens
atttcaaccacacctaaatta

SEQ ID NO: 3649657 - DNA, 17 bp, Homo sapiens
atttcactacttagcat

SEQ ID NO: 3649658 - DNA, 20 bp, Homo sapiens
atttcccacttccacccccg

SEQ ID NO: 3649659 - DNA, 16 bp, Homo sapiens
atttctacactttata

SEQ ID NO: 3649660 - DNA, 17 bp, Homo sapiens
atttgacattgtcagaa

SEQ ID NO: 3649661 - DNA, 19 bp, Homo sapiens
atttgacattgtcagaatg

SEQ ID NO: 3649662 - DNA, 13 bp, Homo sapiens
atttgcaacactg

SEQ ID NO: 3649663 - DNA, 23 bp, Homo sapiens
atttgcaacactgccaaacatca

SEQ ID NO: 3649664 - DNA, 18 bp, Homo sapiens
atttgtgtgcttcacaca

SEQ ID NO: 3649665 - DNA, 23 bp, Homo sapiens
atttgttctgggttaacagtaaa

SEQ ID NO: 3649666 - DNA, 18 bp, Homo sapiens
attttaaacaaaatttat

SEQ ID NO: 3649667 - DNA, 13 bp, Homo sapiens
attttaacatagc

SEQ ID NO: 3649668 - DNA, 12 bp, Homo sapiens
attttctgtaat

SEQ ID NO: 3649669 - DNA, 18 bp, Homo sapiens
attttcttctttaatttt

SEQ ID NO: 3649670 - DNA, 19 bp, Homo sapiens
attttgaaaggagaaaaaa

SEQ ID NO: 3649671 - DNA, 12 bp, Homo sapiens
attttgatgtat

SEQ ID NO: 3649672 - DNA, 16 bp, Homo sapiens
attttggaagaattca

SEQ ID NO: 3649673 - DNA, 20 bp, Homo sapiens
attttggaagaattcatgat

SEQ ID NO: 3649674 - DNA, 15 bp, Homo sapiens
atttttgagtaaaac

SEQ ID NO: 3649675 - DNA, 20 bp, Homo sapiens
atttttgagtaaaacttgta

SEQ ID NO: 3649676 - DNA, 16 bp, Homo sapiens
attttttctgaggaat

SEQ ID NO: 3649677 - DNA, 13 bp, Homo sapiens
attttttgtgaat

SEQ ID NO: 3649678 - DNA, 15 bp, Homo sapiens
caaaagcccattcat

SEQ ID NO: 3649679 - DNA, 14 bp, Homo sapiens
caaaaggatgattt

SEQ ID NO: 3649680 - DNA, 15 bp, Homo sapiens
caaaagtttatcttt

SEQ ID NO: 3649681 - DNA, 19 bp, Homo sapiens
caaaatgtgtgcttggaaa

SEQ ID NO: 3649682 - DNA, 21 bp, Homo sapiens
caaaatttatgtcattttcag

SEQ ID NO: 3649683 - DNA, 17 bp, Homo sapiens
caaacaaatcattttga

SEQ ID NO: 3649684 - DNA, 21 bp, Homo sapiens
caaacaaatcattttgatgta

SEQ ID NO: 3649685 - DNA, 15 bp, Homo sapiens
caaactgaaattagt

SEQ ID NO: 3649686 - DNA, 14 bp, Homo sapiens
caaacttttataaa

SEQ ID NO: 3649687 - DNA, 17 bp, Homo sapiens
caaacttttataaatgt

SEQ ID NO: 3649688 - DNA, 18 bp, Homo sapiens
caaacttttataaatgtt

SEQ ID NO: 3649689 - DNA, 17 bp, Homo sapiens
caaagaaacaaaatata

SEQ ID NO: 3649690 - DNA, 18 bp, Homo sapiens
caaagaaacaaaatataa

SEQ ID NO: 3649691 - DNA, 14 bp, Homo sapiens
caaaggaagtgagg

SEQ ID NO: 3649692 - DNA, 17 bp, Homo sapiens
caaatagcttttcactt

SEQ ID NO: 3649693 - DNA, 17 bp, Homo sapiens
caaatatactcatttgg

SEQ ID NO: 3649694 - DNA, 19 bp, Homo sapiens
caaatatactcatttggat

SEQ ID NO: 3649695 - DNA, 15 bp, Homo sapiens
caaatcactgaactt

SEQ ID NO: 3649696 - DNA, 20 bp, Homo sapiens
caaatcattttgatgtatta

SEQ ID NO: 3649697 - DNA, 23 bp, Homo sapiens
caaatcattttgatgtattatta

SEQ ID NO: 3649698 - DNA, 22 bp, Homo sapiens
caaatggtattttttgtgaatg

SEQ ID NO: 3649699 - DNA, 12 bp, Homo sapiens
caaattctgatt

SEQ ID NO: 3649700 - DNA, 13 bp, Homo sapiens
caaattctgatta

SEQ ID NO: 3649701 - DNA, 17 bp, Homo sapiens
caaattctgattattac

SEQ ID NO: 3649702 - DNA, 22 bp, Homo sapiens
caacactgccaaacatcagtca

SEQ ID NO: 3649703 - DNA, 15 bp, Homo sapiens
caacagaattgttct

SEQ ID NO: 3649704 - DNA, 16 bp, Homo sapiens
caactcagcaggctaa

SEQ ID NO: 3649705 - DNA, 20 bp, Homo sapiens
caactgtggataaattttgg

SEQ ID NO: 3649706 - DNA, 21 bp, Homo sapiens
caagaggaaaaatactaagag

SEQ ID NO: 3649707 - DNA, 13 bp, Homo sapiens
caagcaaactgaa

SEQ ID NO: 3649708 - DNA, 15 bp, Homo sapiens
caagcaaactgaaat

SEQ ID NO: 3649709 - DNA, 19 bp, Homo sapiens
caagctcatagcacatgtt

SEQ ID NO: 3649710 - DNA, 19 bp, Homo sapiens
caagctcttcattgcactg

SEQ ID NO: 3649711 - DNA, 17 bp, Homo sapiens
caagcttaggtcatgaa

SEQ ID NO: 3649712 - DNA, 18 bp, Homo sapiens
caagctttgagtgggaca

SEQ ID NO: 3649713 - DNA, 19 bp, Homo sapiens
caaggaagtaagggagtca

SEQ ID NO: 3649714 - DNA, 13 bp, Homo sapiens
caagtctgtgaaa

SEQ ID NO: 3649715 - DNA, 16 bp, Homo sapiens
caagttctttcccagc

SEQ ID NO: 3649716 - DNA, 13 bp, Homo sapiens
caagttgtgtgct

SEQ ID NO: 3649717 - DNA, 21 bp, Homo sapiens
caagttgtgtgctattcgtaa

SEQ ID NO: 3649718 - DNA, 16 bp, Homo sapiens
caatcaacagaattgt

SEQ ID NO: 3649719 - DNA, 23 bp, Homo sapiens
caatcatgcctacattagtgaga

SEQ ID NO: 3649720 - DNA, 20 bp, Homo sapiens
caatgctacaaaatgtgtgc

SEQ ID NO: 3649721 - DNA, 17 bp, Homo sapiens
caattcttccctatctt

SEQ ID NO: 3649722 - DNA, 23 bp, Homo sapiens
caattgggttttgatctcagcat

SEQ ID NO: 3649723 - DNA, 18 bp, Homo sapiens
cacaaaaggttcttctgg

SEQ ID NO: 3649724 - DNA, 15 bp, Homo sapiens
cacaaagtgaaatta

SEQ ID NO: 3649725 - DNA, 23 bp, Homo sapiens
cacaaagtgaaattagtattttg

SEQ ID NO: 3649726 - DNA, 18 bp, Homo sapiens
cacaactgtggataaatt

SEQ ID NO: 3649727 - DNA, 16 bp, Homo sapiens
cacacctgagaatgtg

SEQ ID NO: 3649728 - DNA, 16 bp, Homo sapiens
cacacttgtgtgccac

SEQ ID NO: 3649729 - DNA, 14 bp, Homo sapiens
cacagatttccaaa

SEQ ID NO: 3649730 - DNA, 15 bp, Homo sapiens
cacagcacatttgtt

SEQ ID NO: 3649731 - DNA, 19 bp, Homo sapiens
cacagcatgcatttagcat

SEQ ID NO: 3649732 - DNA, 20 bp, Homo sapiens
cacagcatgcatttagcatg

SEQ ID NO: 3649733 - DNA, 21 bp, Homo sapiens
cacagggcctttggcaggtgc

SEQ ID NO: 3649734 - DNA, 15 bp, Homo sapiens
cacagtcttttccta

SEQ ID NO: 3649735 - DNA, 14 bp, Homo sapiens
cacatataaacaca

SEQ ID NO: 3649736 - DNA, 15 bp, Homo sapiens
cacatgacagtggtt

SEQ ID NO: 3649737 - DNA, 23 bp, Homo sapiens
caccaaatagcttttcacttctt

SEQ ID NO: 3649738 - DNA, 15 bp, Homo sapiens
caccattctgaattt

SEQ ID NO: 3649739 - DNA, 16 bp, Homo sapiens
caccctcatgctgtgt

SEQ ID NO: 3649740 - DNA, 22 bp, Homo sapiens
caccgagaggaaaaaggcttct

SEQ ID NO: 3649741 - DNA, 14 bp, Homo sapiens
cacggagtttccat

SEQ ID NO: 3649742 - DNA, 19 bp, Homo sapiens
cacggagtttccatttgga

SEQ ID NO: 3649743 - DNA, 17 bp, Homo sapiens
cactccatttcccactt

SEQ ID NO: 3649744 - DNA, 12 bp, Homo sapiens
cactcccatccc

SEQ ID NO: 3649745 - DNA, 18 bp, Homo sapiens
cactggaattttgcttta

SEQ ID NO: 3649746 - DNA, 17 bp, Homo sapiens
cactgggacttgcaaaa

SEQ ID NO: 3649747 - DNA, 18 bp, Homo sapiens
cacttaccctgggctgga

SEQ ID NO: 3649748 - DNA, 12 bp, Homo sapiens
cacttcaccttc

SEQ ID NO: 3649749 - DNA, 14 bp, Homo sapiens
cacttcaccttctg

SEQ ID NO: 3649750 - DNA, 16 bp, Homo sapiens
cacttcaccttctgta

SEQ ID NO: 3649751 - DNA, 23 bp, Homo sapiens
cacttccacccccgttagcttcc

SEQ ID NO: 3649752 - DNA, 19 bp, Homo sapiens
cacttttattgtataatta

SEQ ID NO: 3649753 - DNA, 21 bp, Homo sapiens
cagaaacaccctcacactggg

SEQ ID NO: 3649754 - DNA, 23 bp, Homo sapiens
cagaaacaccctcacactgggac

SEQ ID NO: 3649755 - DNA, 20 bp, Homo sapiens
cagaacaaactcagatctca

SEQ ID NO: 3649756 - DNA, 18 bp, Homo sapiens
cagaacctttggacaaga

SEQ ID NO: 3649757 - DNA, 14 bp, Homo sapiens
cagaagcaaggaag

SEQ ID NO: 3649758 - DNA, 19 bp, Homo sapiens
cagaagcaaggaagtaagg

SEQ ID NO: 3649759 - DNA, 19 bp, Homo sapiens
cagaagctcaaggctgcag

SEQ ID NO: 3649760 - DNA, 11 bp, Homo sapiens
cagaaggaagc

SEQ ID NO: 3649761 - DNA, 14 bp, Homo sapiens
cagaagtgaaaaag

SEQ ID NO: 3649762 - DNA, 23 bp, Homo sapiens
cagaatgttgtgttggtatttac

SEQ ID NO: 3649763 - DNA, 23 bp, Homo sapiens
cagaattgggcccttagaatgtg

SEQ ID NO: 3649764 - DNA, 12 bp, Homo sapiens
cagaattgttct

SEQ ID NO: 3649765 - DNA, 16 bp, Homo sapiens
cagacaggaaggaagc

SEQ ID NO: 3649766 - DNA, 17 bp, Homo sapiens
cagacaggaaggaagca

SEQ ID NO: 3649767 - DNA, 18 bp, Homo sapiens
cagacaggaaggaagcac

SEQ ID NO: 3649768 - DNA, 16 bp, Homo sapiens
cagacaggtgggagat

SEQ ID NO: 3649769 - DNA, 17 bp, Homo sapiens
cagactgccttatatta

SEQ ID NO: 3649770 - DNA, 22 bp, Homo sapiens
cagactgccttatattattttc

SEQ ID NO: 3649771 - DNA, 16 bp, Homo sapiens
cagagtagctgggact

SEQ ID NO: 3649772 - DNA, 18 bp, Homo sapiens
cagagtatacaagtgttt

SEQ ID NO: 3649773 - DNA, 15 bp, Homo sapiens
cagatcaccccagcc

SEQ ID NO: 3649774 - DNA, 18 bp, Homo sapiens
cagatccttccaaactct

SEQ ID NO: 3649775 - DNA, 18 bp, Homo sapiens
cagatctcatcagggtag

SEQ ID NO: 3649776 - DNA, 19 bp, Homo sapiens
cagatggtgtcctgcatgt

SEQ ID NO: 3649777 - DNA, 21 bp, Homo sapiens
cagatggtgtcctgcatgtat

SEQ ID NO: 3649778 - DNA, 16 bp, Homo sapiens
cagcagaggcaggacc

SEQ ID NO: 3649779 - DNA, 17 bp, Homo sapiens
cagcatgcatttagcat

SEQ ID NO: 3649780 - DNA, 13 bp, Homo sapiens
cagcctcttccat

SEQ ID NO: 3649781 - DNA, 18 bp, Homo sapiens
cagctaagcctgatgatg

SEQ ID NO: 3649782 - DNA, 16 bp, Homo sapiens
cagctaatttgtgaaa

SEQ ID NO: 3649783 - DNA, 19 bp, Homo sapiens
cagctactcaggaggctga

SEQ ID NO: 3649784 - DNA, 18 bp, Homo sapiens
cagcttttcccaaaagcc

SEQ ID NO: 3649785 - DNA, 17 bp, Homo sapiens
caggaaaaggctgcagc

SEQ ID NO: 3649786 - DNA, 15 bp, Homo sapiens
caggaaaggaagatg

SEQ ID NO: 3649787 - DNA, 21 bp, Homo sapiens
caggaggctgaggcaggagaa

SEQ ID NO: 3649788 - DNA, 21 bp, Homo sapiens
caggagttcgaggcgagcctg

SEQ ID NO: 3649789 - DNA, 15 bp, Homo sapiens
caggcactttagaaa

SEQ ID NO: 3649790 - DNA, 14 bp, Homo sapiens
caggccattcagtc

SEQ ID NO: 3649791 - DNA, 13 bp, Homo sapiens
cagggagagctgg

SEQ ID NO: 3649792 - DNA, 21 bp, Homo sapiens
cagggctgttccctccaggca

SEQ ID NO: 3649793 - DNA, 12 bp, Homo sapiens
caggggaggctg

SEQ ID NO: 3649794 - DNA, 19 bp, Homo sapiens
caggggaggctgagacgca

SEQ ID NO: 3649795 - DNA, 16 bp, Homo sapiens
cagggtagcagcagag

SEQ ID NO: 3649796 - DNA, 21 bp, Homo sapiens
cagggtagcagcagaggcagg

SEQ ID NO: 3649797 - DNA, 23 bp, Homo sapiens
caggtgcagcccccactgccttt

SEQ ID NO: 3649798 - DNA, 15 bp, Homo sapiens
caggtggcatttgca

SEQ ID NO: 3649799 - DNA, 19 bp, Homo sapiens
caggtggcatttgcaggtg

SEQ ID NO: 3649800 - DNA, 15 bp, Homo sapiens
cagtaaatatacact

SEQ ID NO: 3649801 - DNA, 14 bp, Homo sapiens
cagtaaatgtatat

SEQ ID NO: 3649802 - DNA, 23 bp, Homo sapiens
cagtagcattttaatagtttcta

SEQ ID NO: 3649803 - DNA, 14 bp, Homo sapiens
cagtatcttaaaat

SEQ ID NO: 3649804 - DNA, 21 bp, Homo sapiens
cagtatgggttagggaaaaca

SEQ ID NO: 3649805 - DNA, 20 bp, Homo sapiens
cagtccatttttgagtaaaa

SEQ ID NO: 3649806 - DNA, 15 bp, Homo sapiens
cagtcgaggctggta

SEQ ID NO: 3649807 - DNA, 13 bp, Homo sapiens
cagtctatgctgt

SEQ ID NO: 3649808 - DNA, 21 bp, Homo sapiens
cagtctatgctgtgtgcagag

SEQ ID NO: 3649809 - DNA, 21 bp, Homo sapiens
cagtctctatttgatttgcaa

SEQ ID NO: 3649810 - DNA, 15 bp, Homo sapiens
cagtcttttcctacg

SEQ ID NO: 3649811 - DNA, 22 bp, Homo sapiens
cagtgccgatgatatagagtga

SEQ ID NO: 3649812 - DNA, 18 bp, Homo sapiens
cagtggaagagctgctgt

SEQ ID NO: 3649813 - DNA, 19 bp, Homo sapiens
cagtggaagagctgctgta

SEQ ID NO: 3649814 - DNA, 16 bp, Homo sapiens
cagtgttataaaatct

SEQ ID NO: 3649815 - DNA, 16 bp, Homo sapiens
cagtgttcaaattctg

SEQ ID NO: 3649816 - DNA, 19 bp, Homo sapiens
cagttatttaccagaagtt

SEQ ID NO: 3649817 - DNA, 13 bp, Homo sapiens
cagttctgatgag

SEQ ID NO: 3649818 - DNA, 19 bp, Homo sapiens
cagtttggtatgaaacaaa

SEQ ID NO: 3649819 - DNA, 13 bp, Homo sapiens
cataatattttct

SEQ ID NO: 3649820 - DNA, 14 bp, Homo sapiens
catacagatggtgt

SEQ ID NO: 3649821 - DNA, 19 bp, Homo sapiens
catacgtgcccatttcaca

SEQ ID NO: 3649822 - DNA, 20 bp, Homo sapiens
catagataccattttgaaat

SEQ ID NO: 3649823 - DNA, 13 bp, Homo sapiens
catagcacatgtt

SEQ ID NO: 3649824 - DNA, 20 bp, Homo sapiens
catagtggtattttaacata

SEQ ID NO: 3649825 - DNA, 14 bp, Homo sapiens
catatagctttgca

SEQ ID NO: 3649826 - DNA, 20 bp, Homo sapiens
catatggcaacgttcatgtt

SEQ ID NO: 3649827 - DNA, 21 bp, Homo sapiens
catcaaacaaatcattttgat

SEQ ID NO: 3649828 - DNA, 18 bp, Homo sapiens
catcaagtagtagtactt

SEQ ID NO: 3649829 - DNA, 19 bp, Homo sapiens
catcagaaacaccctcaca

SEQ ID NO: 3649830 - DNA, 13 bp, Homo sapiens
catcagtcaattg

SEQ ID NO: 3649831 - DNA, 16 bp, Homo sapiens
catcatttcattcgtg

SEQ ID NO: 3649832 - DNA, 20 bp, Homo sapiens
catcccaaagtgctgggatt

SEQ ID NO: 3649833 - DNA, 14 bp, Homo sapiens
catcccactccact

SEQ ID NO: 3649834 - DNA, 18 bp, Homo sapiens
catcccgatgaacctgca

SEQ ID NO: 3649835 - DNA, 13 bp, Homo sapiens
catcccttcaacc

SEQ ID NO: 3649836 - DNA, 15 bp, Homo sapiens
catcctggaaatttg

SEQ ID NO: 3649837 - DNA, 16 bp, Homo sapiens
catcctggaaatttgt

SEQ ID NO: 3649838 - DNA, 21 bp, Homo sapiens
catcctggaaatttgtgtgct

SEQ ID NO: 3649839 - DNA, 14 bp, Homo sapiens
catccttgagtcaa

SEQ ID NO: 3649840 - DNA, 15 bp, Homo sapiens
catctaaaccagaag

SEQ ID NO: 3649841 - DNA, 18 bp, Homo sapiens
catctaaaccagaaggaa

SEQ ID NO: 3649842 - DNA, 20 bp, Homo sapiens
catctacacatataaacaca

SEQ ID NO: 3649843 - DNA, 17 bp, Homo sapiens
catctctgtaaaaagca

SEQ ID NO: 3649844 - DNA, 18 bp, Homo sapiens
catctgaggaaaatggaa

SEQ ID NO: 3649845 - DNA, 23 bp, Homo sapiens
catctgaggaaaatggaagacct

SEQ ID NO: 3649846 - DNA, 16 bp, Homo sapiens
catctgatttctgaac

SEQ ID NO: 3649847 - DNA, 17 bp, Homo sapiens
catgaacatggtcagaa

SEQ ID NO: 3649848 - DNA, 15 bp, Homo sapiens
catgagtctccagat

SEQ ID NO: 3649849 - DNA, 17 bp, Homo sapiens
catgagtctccagatag

SEQ ID NO: 3649850 - DNA, 18 bp, Homo sapiens
catgagtctccagataga

SEQ ID NO: 3649851 - DNA, 20 bp, Homo sapiens
catgagttctgcacatacag

SEQ ID NO: 3649852 - DNA, 18 bp, Homo sapiens
catgatgctagttcttac

SEQ ID NO: 3649853 - DNA, 20 bp, Homo sapiens
catgcaagtgagaaagacat

SEQ ID NO: 3649854 - DNA, 17 bp, Homo sapiens
catgctgtgtgactcaa

SEQ ID NO: 3649855 - DNA, 16 bp, Homo sapiens
catgctgttctgaaag

SEQ ID NO: 3649856 - DNA, 18 bp, Homo sapiens
catggaaagatggggagc

SEQ ID NO: 3649857 - DNA, 19 bp, Homo sapiens
catggtgaaaccctgtctc

SEQ ID NO: 3649858 - DNA, 13 bp, Homo sapiens
catgtatgccatg

SEQ ID NO: 3649859 - DNA, 17 bp, Homo sapiens
catgtatgccatgtatg

SEQ ID NO: 3649860 - DNA, 15 bp, Homo sapiens
catgtatgcttccag

SEQ ID NO: 3649861 - DNA, 13 bp, Homo sapiens
catgtatgttgca

SEQ ID NO: 3649862 - DNA, 12 bp, Homo sapiens
catgtgataatt

SEQ ID NO: 3649863 - DNA, 20 bp, Homo sapiens
catgtgataattgtaaaggt

SEQ ID NO: 3649864 - DNA, 15 bp, Homo sapiens
catgtgctgctgtgg

SEQ ID NO: 3649865 - DNA, 23 bp, Homo sapiens
cattacactccagcctgggcgaa

SEQ ID NO: 3649866 - DNA, 16 bp, Homo sapiens
cattagtttgaggtac

SEQ ID NO: 3649867 - DNA, 23 bp, Homo sapiens
cattagtttgaggtactacctat

SEQ ID NO: 3649868 - DNA, 17 bp, Homo sapiens
cattcagatctgaagta

SEQ ID NO: 3649869 - DNA, 19 bp, Homo sapiens
cattcagtctatgctgtgt

SEQ ID NO: 3649870 - DNA, 17 bp, Homo sapiens
cattcattccattctgg

SEQ ID NO: 3649871 - DNA, 16 bp, Homo sapiens
cattccccgacactgc

SEQ ID NO: 3649872 - DNA, 20 bp, Homo sapiens
cattctctaagcctggctta

SEQ ID NO: 3649873 - DNA, 12 bp, Homo sapiens
cattctggaagt

SEQ ID NO: 3649874 - DNA, 21 bp, Homo sapiens
cattctggtccttagtaaatt

SEQ ID NO: 3649875 - DNA, 16 bp, Homo sapiens
cattgcactgcagtta

SEQ ID NO: 3649876 - DNA, 15 bp, Homo sapiens
cattgtcagaatgtt

SEQ ID NO: 3649877 - DNA, 19 bp, Homo sapiens
catttagcatgagttctgc

SEQ ID NO: 3649878 - DNA, 17 bp, Homo sapiens
catttcttggtatgatc

SEQ ID NO: 3649879 - DNA, 22 bp, Homo sapiens
catttgacatgagtctccagat

SEQ ID NO: 3649880 - DNA, 18 bp, Homo sapiens
catttggatataaatctt

SEQ ID NO: 3649881 - DNA, 14 bp, Homo sapiens
catttggattttaa

SEQ ID NO: 3649882 - DNA, 20 bp, Homo sapiens
catttgttaatgattcttgt

SEQ ID NO: 3649883 - DNA, 23 bp, Homo sapiens
catttgttctgggttaacagtaa

SEQ ID NO: 3649884 - DNA, 15 bp, Homo sapiens
cattttgaaatattc

SEQ ID NO: 3649885 - DNA, 12 bp, Homo sapiens
cattttgatgta

SEQ ID NO: 3649886 - DNA, 20 bp, Homo sapiens
cattttgatgtattattata

SEQ ID NO: 3649887 - DNA, 18 bp, Homo sapiens
ccaaactctctagtgcag

SEQ ID NO: 3649888 - DNA, 15 bp, Homo sapiens
ccaaatataacatga

SEQ ID NO: 3649889 - DNA, 16 bp, Homo sapiens
ccaaatataacatgaa

SEQ ID NO: 3649890 - DNA, 22 bp, Homo sapiens
ccaacatggtgaaaccctgtct

SEQ ID NO: 3649891 - DNA, 16 bp, Homo sapiens
ccaacctggtaattat

SEQ ID NO: 3649892 - DNA, 17 bp, Homo sapiens
ccaacctggtaattatc

SEQ ID NO: 3649893 - DNA, 12 bp, Homo sapiens
ccaccagcagaa

SEQ ID NO: 3649894 - DNA, 15 bp, Homo sapiens
ccaccagcagaacaa

SEQ ID NO: 3649895 - DNA, 18 bp, Homo sapiens
ccacctcccaaaggctgt

SEQ ID NO: 3649896 - DNA, 13 bp, Homo sapiens
ccactcccatccc

SEQ ID NO: 3649897 - DNA, 17 bp, Homo sapiens
ccacttatttccatgga

SEQ ID NO: 3649898 - DNA, 19 bp, Homo sapiens
ccagaagctcaaggctgca

SEQ ID NO: 3649899 - DNA, 16 bp, Homo sapiens
ccagaagtttaaatct

SEQ ID NO: 3649900 - DNA, 17 bp, Homo sapiens
ccagatccttttccatc

SEQ ID NO: 3649901 - DNA, 19 bp, Homo sapiens
ccagatccttttccatccc

SEQ ID NO: 3649902 - DNA, 15 bp, Homo sapiens
ccagcctcactccat

SEQ ID NO: 3649903 - DNA, 18 bp, Homo sapiens
ccagcctcactccatttc

SEQ ID NO: 3649904 - DNA, 20 bp, Homo sapiens
ccagcctcttccattccctt

SEQ ID NO: 3649905 - DNA, 18 bp, Homo sapiens
ccagctctacgtcccaca

SEQ ID NO: 3649906 - DNA, 13 bp, Homo sapiens
ccagcttttccca

SEQ ID NO: 3649907 - DNA, 23 bp, Homo sapiens
ccaggcatggaaagatggggagc

SEQ ID NO: 3649908 - DNA, 22 bp, Homo sapiens
ccagggacatgtatgcttccag

SEQ ID NO: 3649909 - DNA, 14 bp, Homo sapiens
ccagttctgatgag

SEQ ID NO: 3649910 - DNA, 14 bp, Homo sapiens
ccataaaccacctc

SEQ ID NO: 3649911 - DNA, 22 bp, Homo sapiens
ccatcaaacaaatcattttgat

SEQ ID NO: 3649912 - DNA, 23 bp, Homo sapiens
ccatcagaaacaccctcacactg

SEQ ID NO: 3649913 - DNA, 20 bp, Homo sapiens
ccatcccttcaaccccactt

SEQ ID NO: 3649914 - DNA, 17 bp, Homo sapiens
ccatgaaaagttttcaa

SEQ ID NO: 3649915 - DNA, 15 bp, Homo sapiens
ccatgcattcagatc

SEQ ID NO: 3649916 - DNA, 16 bp, Homo sapiens
ccatggtagactgtga

SEQ ID NO: 3649917 - DNA, 18 bp, Homo sapiens
ccatggtagactgtgaca

SEQ ID NO: 3649918 - DNA, 15 bp, Homo sapiens
ccatgtatgttgcat

SEQ ID NO: 3649919 - DNA, 12 bp, Homo sapiens
ccatgtgctgct

SEQ ID NO: 3649920 - DNA, 14 bp, Homo sapiens
ccattacactccag

SEQ ID NO: 3649921 - DNA, 18 bp, Homo sapiens
ccattcattccattctgg

SEQ ID NO: 3649922 - DNA, 22 bp, Homo sapiens
ccattccctttcttttcatgcc

SEQ ID NO: 3649923 - DNA, 13 bp, Homo sapiens
ccattctgaattt

SEQ ID NO: 3649924 - DNA, 19 bp, Homo sapiens
ccattctggaagtgacttt

SEQ ID NO: 3649925 - DNA, 12 bp, Homo sapiens
ccatttcacaca

SEQ ID NO: 3649926 - DNA, 22 bp, Homo sapiens
ccatttggattttaaacaaaat

SEQ ID NO: 3649927 - DNA, 11 bp, Homo sapiens
cccaccagcag

SEQ ID NO: 3649928 - DNA, 12 bp, Homo sapiens
cccaccagcaga

SEQ ID NO: 3649929 - DNA, 15 bp, Homo sapiens
cccagcctcttccat

SEQ ID NO: 3649930 - DNA, 18 bp, Homo sapiens
cccagcctcttccattcc

SEQ ID NO: 3649931 - DNA, 19 bp, Homo sapiens
cccagttgtccgtgaagag

SEQ ID NO: 3649932 - DNA, 13 bp, Homo sapiens
cccatttcacaca

SEQ ID NO: 3649933 - DNA, 15 bp, Homo sapiens
ccccaccctgcccac

SEQ ID NO: 3649934 - DNA, 15 bp, Homo sapiens
ccccacttcctactg

SEQ ID NO: 3649935 - DNA, 14 bp, Homo sapiens
ccccagcctcactc

SEQ ID NO: 3649936 - DNA, 14 bp, Homo sapiens
ccctatctttgcca

SEQ ID NO: 3649937 - DNA, 12 bp, Homo sapiens
ccctcacactgg

SEQ ID NO: 3649938 - DNA, 13 bp, Homo sapiens
ccctcacactggg

SEQ ID NO: 3649939 - DNA, 14 bp, Homo sapiens
ccctcacactggga

SEQ ID NO: 3649940 - DNA, 19 bp, Homo sapiens
ccctgcccactcccatccc

SEQ ID NO: 3649941 - DNA, 15 bp, Homo sapiens
cccttcaaccccact

SEQ ID NO: 3649942 - DNA, 16 bp, Homo sapiens
cccttcatctggaacc

SEQ ID NO: 3649943 - DNA, 16 bp, Homo sapiens
cccttctttccttcct

SEQ ID NO: 3649944 - DNA, 17 bp, Homo sapiens
cccttctttccttcctt

SEQ ID NO: 3649945 - DNA, 14 bp, Homo sapiens
ccgaccagatcctt

SEQ ID NO: 3649946 - DNA, 17 bp, Homo sapiens
cctaaacatagtggtat

SEQ ID NO: 3649947 - DNA, 14 bp, Homo sapiens
cctaaggcagacag

SEQ ID NO: 3649948 - DNA, 23 bp, Homo sapiens
cctacggtacaagctacatatgt

SEQ ID NO: 3649949 - DNA, 23 bp, Homo sapiens
cctatcatcagttaggattaggt

SEQ ID NO: 3649950 - DNA, 20 bp, Homo sapiens
cctatctttgccaccctcat

SEQ ID NO: 3649951 - DNA, 14 bp, Homo sapiens
cctatgtacttgaa

SEQ ID NO: 3649952 - DNA, 12 bp, Homo sapiens
cctcacactggg

SEQ ID NO: 3649953 - DNA, 20 bp, Homo sapiens
cctcactccatttcccactt

SEQ ID NO: 3649954 - DNA, 17 bp, Homo sapiens
cctcagagctccatgct

SEQ ID NO: 3649955 - DNA, 13 bp, Homo sapiens
cctcagcatccca

SEQ ID NO: 3649956 - DNA, 20 bp, Homo sapiens
cctcatcgggattgtctttt

SEQ ID NO: 3649957 - DNA, 18 bp, Homo sapiens
cctctaggtaaactagca

SEQ ID NO: 3649958 - DNA, 15 bp, Homo sapiens
cctgaaccttcctgt

SEQ ID NO: 3649959 - DNA, 23 bp, Homo sapiens
cctgaaccttcctgtctcccagg

SEQ ID NO: 3649960 - DNA, 12 bp, Homo sapiens
cctgagactgga

SEQ ID NO: 3649961 - DNA, 16 bp, Homo sapiens
cctgcctcccttcatg

SEQ ID NO: 3649962 - DNA, 16 bp, Homo sapiens
cctggacatattccca

SEQ ID NO: 3649963 - DNA, 18 bp, Homo sapiens
cctggcttccccttcaga

SEQ ID NO: 3649964 - DNA, 16 bp, Homo sapiens
cctgggctggcttgag

SEQ ID NO: 3649965 - DNA, 18 bp, Homo sapiens
cctgtaatctcagctact

SEQ ID NO: 3649966 - DNA, 20 bp, Homo sapiens
cctgtagagagagacctaga

SEQ ID NO: 3649967 - DNA, 14 bp, Homo sapiens
ccttactccctatc

SEQ ID NO: 3649968 - DNA, 13 bp, Homo sapiens
ccttattaaaata

SEQ ID NO: 3649969 - DNA, 13 bp, Homo sapiens
ccttctttccttc

SEQ ID NO: 3649970 - DNA, 14 bp, Homo sapiens
ccttctttccttcc

SEQ ID NO: 3649971 - DNA, 23 bp, Homo sapiens
cctttctctctttcttttgtgca

SEQ ID NO: 3649972 - DNA, 13 bp, Homo sapiens
cctttcttccttc

SEQ ID NO: 3649973 - DNA, 14 bp, Homo sapiens
cctttcttccttcc

SEQ ID NO: 3649974 - DNA, 15 bp, Homo sapiens
cctttcttccttcct

SEQ ID NO: 3649975 - DNA, 16 bp, Homo sapiens
cctttcttttcatgcc

SEQ ID NO: 3649976 - DNA, 16 bp, Homo sapiens
cctttgacctgcctcc

SEQ ID NO: 3649977 - DNA, 21 bp, Homo sapiens
cctttgacctgcctcccttca

SEQ ID NO: 3649978 - DNA, 16 bp, Homo sapiens
cctttgtcaaatggta

SEQ ID NO: 3649979 - DNA, 18 bp, Homo sapiens
ccttttccatcccactcc

SEQ ID NO: 3649980 - DNA, 20 bp, Homo sapiens
ccttttttcctttcttcctt

SEQ ID NO: 3649981 - DNA, 13 bp, Homo sapiens
cgaaatgaaaatg

SEQ ID NO: 3649982 - DNA, 22 bp, Homo sapiens
cgaaatgaaaatggctgaagaa

SEQ ID NO: 3649983 - DNA, 23 bp, Homo sapiens
cgaactcgggattacagaaacac

SEQ ID NO: 3649984 - DNA, 15 bp, Homo sapiens
cgagtgctcatttca

SEQ ID NO: 3649985 - DNA, 23 bp, Homo sapiens
cgctggccattggctagaatcag

SEQ ID NO: 3649986 - DNA, 20 bp, Homo sapiens
cggtggctcatgcctgtaat

SEQ ID NO: 3649987 - DNA, 17 bp, Homo sapiens
ctaaaccatgaaaagtt

SEQ ID NO: 3649988 - DNA, 20 bp, Homo sapiens
ctaaagtcaggccattcagt

SEQ ID NO: 3649989 - DNA, 11 bp, Homo sapiens
ctaagaattca

SEQ ID NO: 3649990 - DNA, 22 bp, Homo sapiens
ctaagataattaaatgaaatac

SEQ ID NO: 3649991 - DNA, 20 bp, Homo sapiens
ctaaggcagacaggaaggaa

SEQ ID NO: 3649992 - DNA, 21 bp, Homo sapiens
ctaaggcagacaggaaggaag

SEQ ID NO: 3649993 - DNA, 17 bp, Homo sapiens
ctaagtaaatctaaatt

SEQ ID NO: 3649994 - DNA, 18 bp, Homo sapiens
ctaatccatgtgctgctg

SEQ ID NO: 3649995 - DNA, 11 bp, Homo sapiens
ctaatttgtga

SEQ ID NO: 3649996 - DNA, 14 bp, Homo sapiens
ctaatttgtgaaag

SEQ ID NO: 3649997 - DNA, 15 bp, Homo sapiens
ctacaaaatgtgtgc

SEQ ID NO: 3649998 - DNA, 17 bp, Homo sapiens
ctacaaacttttataaa

SEQ ID NO: 3649999 - DNA, 19 bp, Homo sapiens
ctacaaacttttataaatg

SEQ ID NO: 3650000 - DNA, 20 bp, Homo sapiens
ctacacatataaacacagta

SEQ ID NO: 3650001 - DNA, 22 bp, Homo sapiens
ctacacatataaacacagtaag

SEQ ID NO: 3650002 - DNA, 23 bp, Homo sapiens
ctacacatataaacacagtaaga

SEQ ID NO: 3650003 - DNA, 20 bp, Homo sapiens
ctacatatgtaggaaaattt

SEQ ID NO: 3650004 - DNA, 18 bp, Homo sapiens
ctacattagtgagattta

SEQ ID NO: 3650005 - DNA, 22 bp, Homo sapiens
ctaggacatctctgtaaaaagc

SEQ ID NO: 3650006 - DNA, 15 bp, Homo sapiens
ctagtaacagtattt

SEQ ID NO: 3650007 - DNA, 21 bp, Homo sapiens
ctagtgcaggaaaaggctgca

SEQ ID NO: 3650008 - DNA, 20 bp, Homo sapiens
ctataggacttaatttagca

SEQ ID NO: 3650009 - DNA, 17 bp, Homo sapiens
ctatatttactgtttat

SEQ ID NO: 3650010 - DNA, 15 bp, Homo sapiens
ctatcagggcaagct

SEQ ID NO: 3650011 - DNA, 19 bp, Homo sapiens
ctatctcgctagccatata

SEQ ID NO: 3650012 - DNA, 14 bp, Homo sapiens
ctatctggaaaaaa

SEQ ID NO: 3650013 - DNA, 12 bp, Homo sapiens
ctatctttgcca

SEQ ID NO: 3650014 - DNA, 19 bp, Homo sapiens
ctatgattaaactgggaaa

SEQ ID NO: 3650015 - DNA, 20 bp, Homo sapiens
ctatgattaaactgggaaat

SEQ ID NO: 3650016 - DNA, 20 bp, Homo sapiens
ctatgtacttgaaaataata

SEQ ID NO: 3650017 - DNA, 14 bp, Homo sapiens
ctattaatttatta

SEQ ID NO: 3650018 - DNA, 16 bp, Homo sapiens
ctattaatttattaaa

SEQ ID NO: 3650019 - DNA, 15 bp, Homo sapiens
ctattcgtaagttct

SEQ ID NO: 3650020 - DNA, 17 bp, Homo sapiens
ctattcgtaagttctgt

SEQ ID NO: 3650021 - DNA, 20 bp, Homo sapiens
ctattcgtaagttctgtgca

SEQ ID NO: 3650022 - DNA, 13 bp, Homo sapiens
ctattgctgtaaa

SEQ ID NO: 3650023 - DNA, 17 bp, Homo sapiens
ctattttttctgaggaa

SEQ ID NO: 3650024 - DNA, 22 bp, Homo sapiens
ctcaaaccaaatcactgaactt

SEQ ID NO: 3650025 - DNA, 14 bp, Homo sapiens
ctcaacacacagta

SEQ ID NO: 3650026 - DNA, 15 bp, Homo sapiens
ctcaagttgtgtgct

SEQ ID NO: 3650027 - DNA, 13 bp, Homo sapiens
ctcacagcacatt

SEQ ID NO: 3650028 - DNA, 19 bp, Homo sapiens
ctcacagcacatttgttaa

SEQ ID NO: 3650029 - DNA, 21 bp, Homo sapiens
ctcactccatttcccacttcc

SEQ ID NO: 3650030 - DNA, 23 bp, Homo sapiens
ctcactccatttcccacttccac

SEQ ID NO: 3650031 - DNA, 21 bp, Homo sapiens
ctcagagggaaggctctctgg

SEQ ID NO: 3650032 - DNA, 19 bp, Homo sapiens
ctcagatcaccccagcctc

SEQ ID NO: 3650033 - DNA, 16 bp, Homo sapiens
ctcagctactcaggag

SEQ ID NO: 3650034 - DNA, 20 bp, Homo sapiens
ctcaggaggctgaggcagga

SEQ ID NO: 3650035 - DNA, 23 bp, Homo sapiens
ctcaggaggctgaggcaggagaa

SEQ ID NO: 3650036 - DNA, 14 bp, Homo sapiens
ctcagtatcttaaa

SEQ ID NO: 3650037 - DNA, 18 bp, Homo sapiens
ctcatacagtctctattt

SEQ ID NO: 3650038 - DNA, 20 bp, Homo sapiens
ctcatcagggtagcagcaga

SEQ ID NO: 3650039 - DNA, 16 bp, Homo sapiens
ctcatcgggattgtct

SEQ ID NO: 3650040 - DNA, 12 bp, Homo sapiens
ctcatttcagga

SEQ ID NO: 3650041 - DNA, 20 bp, Homo sapiens
ctcatttggatataaatctt

SEQ ID NO: 3650042 - DNA, 19 bp, Homo sapiens
ctccatttcccacttccac

SEQ ID NO: 3650043 - DNA, 21 bp, Homo sapiens
ctcccatcccttcaaccccac

SEQ ID NO: 3650044 - DNA, 17 bp, Homo sapiens
ctccctatctaacactt

SEQ ID NO: 3650045 - DNA, 16 bp, Homo sapiens
ctcccttctttccttc

SEQ ID NO: 3650046 - DNA, 17 bp, Homo sapiens
ctcccttctttccttcc

SEQ ID NO: 3650047 - DNA, 20 bp, Homo sapiens
ctcccttctttccttccttt

SEQ ID NO: 3650048 - DNA, 16 bp, Homo sapiens
ctcctttgtcaaatgg

SEQ ID NO: 3650049 - DNA, 13 bp, Homo sapiens
ctctaagaattca

SEQ ID NO: 3650050 - DNA, 15 bp, Homo sapiens
ctctacaaaaaaaat

SEQ ID NO: 3650051 - DNA, 13 bp, Homo sapiens
ctctacgtcccac

SEQ ID NO: 3650052 - DNA, 17 bp, Homo sapiens
ctctaggtaaactagca

SEQ ID NO: 3650053 - DNA, 17 bp, Homo sapiens
ctctatttgatttgcaa

SEQ ID NO: 3650054 - DNA, 23 bp, Homo sapiens
ctctcagatcaccccagcctcac

SEQ ID NO: 3650055 - DNA, 18 bp, Homo sapiens
ctctcagtatcttaaaat

SEQ ID NO: 3650056 - DNA, 20 bp, Homo sapiens
ctctgcaggcagccttgccc

SEQ ID NO: 3650057 - DNA, 18 bp, Homo sapiens
ctctgtctataggactta

SEQ ID NO: 3650058 - DNA, 14 bp, Homo sapiens
ctctttcttttgtg

SEQ ID NO: 3650059 - DNA, 14 bp, Homo sapiens
ctgaaaaagtgttt

SEQ ID NO: 3650060 - DNA, 17 bp, Homo sapiens
ctgaaaaagtgttttta

SEQ ID NO: 3650061 - DNA, 23 bp, Homo sapiens
ctgaaaaagtgtttttacatata

SEQ ID NO: 3650062 - DNA, 16 bp, Homo sapiens
ctgaaattagtgtttt

SEQ ID NO: 3650063 - DNA, 18 bp, Homo sapiens
ctgaaattagtgttttca

SEQ ID NO: 3650064 - DNA, 15 bp, Homo sapiens
ctgaaccttcctgtc

SEQ ID NO: 3650065 - DNA, 20 bp, Homo sapiens
ctgaaccttcctgtctccca

SEQ ID NO: 3650066 - DNA, 13 bp, Homo sapiens
ctgaactttgctg

SEQ ID NO: 3650067 - DNA, 20 bp, Homo sapiens
ctgaagaaaatccttcagca

SEQ ID NO: 3650068 - DNA, 18 bp, Homo sapiens
ctgaagaaacacagcatg

SEQ ID NO: 3650069 - DNA, 23 bp, Homo sapiens
ctgaagtagtgtgagtgttagaa

SEQ ID NO: 3650070 - DNA, 19 bp, Homo sapiens
ctgagactggaaaaggtgg

SEQ ID NO: 3650071 - DNA, 17 bp, Homo sapiens
ctgagatgggaggatca

SEQ ID NO: 3650072 - DNA, 21 bp, Homo sapiens
ctgatacttatttataacatt

SEQ ID NO: 3650073 - DNA, 24 bp, Homo sapiens
ctgatagaagaaggactgaagaaa

SEQ ID NO: 3650074 - DNA, 19 bp, Homo sapiens
ctgatatctgtttgcttct

SEQ ID NO: 3650075 - DNA, 20 bp, Homo sapiens
ctgatatctgtttgcttcta

SEQ ID NO: 3650076 - DNA, 22 bp, Homo sapiens
ctgatatctgtttgcttctaaa

SEQ ID NO: 3650077 - DNA, 15 bp, Homo sapiens
ctgatgatggaaggg

SEQ ID NO: 3650078 - DNA, 22 bp, Homo sapiens
ctgattattacaacaagcaaac

SEQ ID NO: 3650079 - DNA, 15 bp, Homo sapiens
ctgcacatacagatg

SEQ ID NO: 3650080 - DNA, 16 bp, Homo sapiens
ctgcacatacagatgg

SEQ ID NO: 3650081 - DNA, 19 bp, Homo sapiens
ctgcagctaatttgtgaaa

SEQ ID NO: 3650082 - DNA, 23 bp, Homo sapiens
ctgcagctaatttgtgaaagtgg

SEQ ID NO: 3650083 - DNA, 14 bp, Homo sapiens
ctgcaggcagcctt

SEQ ID NO: 3650084 - DNA, 23 bp, Homo sapiens
ctgcagttatttaccagaagttt

SEQ ID NO: 3650085 - DNA, 23 bp, Homo sapiens
ctgcatcattccccgacactgcc

SEQ ID NO: 3650086 - DNA, 21 bp, Homo sapiens
ctgcatgtatgccatgtatgt

SEQ ID NO: 3650087 - DNA, 14 bp, Homo sapiens
ctgcccactcccat

SEQ ID NO: 3650088 - DNA, 15 bp, Homo sapiens
ctgccttatattatt

SEQ ID NO: 3650089 - DNA, 14 bp, Homo sapiens
ctgctgtatttgag

SEQ ID NO: 3650090 - DNA, 16 bp, Homo sapiens
ctgctgtatttgagga

SEQ ID NO: 3650091 - DNA, 17 bp, Homo sapiens
ctggaaaaaaaaaaata

SEQ ID NO: 3650092 - DNA, 17 bp, Homo sapiens
ctggaaacatctgattt

SEQ ID NO: 3650093 - DNA, 16 bp, Homo sapiens
ctggaggaaggaaaca

SEQ ID NO: 3650094 - DNA, 20 bp, Homo sapiens
ctggaggtgttgtggggatg

SEQ ID NO: 3650095 - DNA, 15 bp, Homo sapiens
ctggctggaggaagg

SEQ ID NO: 3650096 - DNA, 16 bp, Homo sapiens
ctggctggaggaagga

SEQ ID NO: 3650097 - DNA, 23 bp, Homo sapiens
ctgggaaatgagatcccagagtt

SEQ ID NO: 3650098 - DNA, 18 bp, Homo sapiens
ctgggacttgcaaaaagg

SEQ ID NO: 3650099 - DNA, 13 bp, Homo sapiens
ctgggcagacagg

SEQ ID NO: 3650100 - DNA, 20 bp, Homo sapiens
ctgggcagacaggtgggaga

SEQ ID NO: 3650101 - DNA, 14 bp, Homo sapiens
ctggtaagggacct

SEQ ID NO: 3650102 - DNA, 19 bp, Homo sapiens
ctggtaagggaccttcagg

SEQ ID NO: 3650103 - DNA, 20 bp, Homo sapiens
ctggtccttagtaaattcct

SEQ ID NO: 3650104 - DNA, 17 bp, Homo sapiens
ctgtaaaataaaaggtc

SEQ ID NO: 3650105 - DNA, 16 bp, Homo sapiens
ctgtaaataaaaatag

SEQ ID NO: 3650106 - DNA, 20 bp, Homo sapiens
ctgtaatactaagtcctcag

SEQ ID NO: 3650107 - DNA, 22 bp, Homo sapiens
ctgtaattcttctcctttgtca

SEQ ID NO: 3650108 - DNA, 13 bp, Homo sapiens
ctgtagagagaga

SEQ ID NO: 3650109 - DNA, 11 bp, Homo sapiens
ctgtattgcta

SEQ ID NO: 3650110 - DNA, 17 bp, Homo sapiens
ctgtatttgaggaaact

SEQ ID NO: 3650111 - DNA, 22 bp, Homo sapiens
ctgtccctaaacatagtggtat

SEQ ID NO: 3650112 - DNA, 19 bp, Homo sapiens
ctgtctcccagggacatgt

SEQ ID NO: 3650113 - DNA, 22 bp, Homo sapiens
ctgtctctacaaaaaaaatcaa

SEQ ID NO: 3650114 - DNA, 19 bp, Homo sapiens
ctgtctgaaaaagtgtttt

SEQ ID NO: 3650115 - DNA, 22 bp, Homo sapiens
ctgtgaaagtctcctgtatcat

SEQ ID NO: 3650116 - DNA, 22 bp, Homo sapiens
ctgtgcagtttggtatgaaaca

SEQ ID NO: 3650117 - DNA, 11 bp, Homo sapiens
ctgtggataaa

SEQ ID NO: 3650118 - DNA, 21 bp, Homo sapiens
ctgtggataaattttggaaga

SEQ ID NO: 3650119 - DNA, 21 bp, Homo sapiens
ctgttggtcttaactaatgta

SEQ ID NO: 3650120 - DNA, 20 bp, Homo sapiens
cttaaaaattatctttaaaa

SEQ ID NO: 3650121 - DNA, 20 bp, Homo sapiens
cttaaggacagtgttcaaat

SEQ ID NO: 3650122 - DNA, 18 bp, Homo sapiens
cttaccgaaatgaaaatg

SEQ ID NO: 3650123 - DNA, 12 bp, Homo sapiens
cttagaaggcac

SEQ ID NO: 3650124 - DNA, 18 bp, Homo sapiens
cttagaaggcactgggaa

SEQ ID NO: 3650125 - DNA, 17 bp, Homo sapiens
cttagaatgtgaaaaaa

SEQ ID NO: 3650126 - DNA, 16 bp, Homo sapiens
cttaggtcatgaacat

SEQ ID NO: 3650127 - DNA, 13 bp, Homo sapiens
cttagtaaattcc

SEQ ID NO: 3650128 - DNA, 17 bp, Homo sapiens
cttagtaaattcctaat

SEQ ID NO: 3650129 - DNA, 13 bp, Homo sapiens
cttagtccacaag

SEQ ID NO: 3650130 - DNA, 19 bp, Homo sapiens
cttattcctaattcctgta

SEQ ID NO: 3650131 - DNA, 14 bp, Homo sapiens
cttattttgattgt

SEQ ID NO: 3650132 - DNA, 17 bp, Homo sapiens
cttcaatgttaaatcta

SEQ ID NO: 3650133 - DNA, 11 bp, Homo sapiens
cttcaccttct

SEQ ID NO: 3650134 - DNA, 13 bp, Homo sapiens
cttcaccttctgt

SEQ ID NO: 3650135 - DNA, 17 bp, Homo sapiens
cttcagcaatccttaaa

SEQ ID NO: 3650136 - DNA, 11 bp, Homo sapiens
cttcatctgga

SEQ ID NO: 3650137 - DNA, 13 bp, Homo sapiens
cttccccttcaga

SEQ ID NO: 3650138 - DNA, 16 bp, Homo sapiens
cttccctatctttgcc

SEQ ID NO: 3650139 - DNA, 23 bp, Homo sapiens
cttccctatctttgccaccctca

SEQ ID NO: 3650140 - DNA, 11 bp, Homo sapiens
cttccttcctt

SEQ ID NO: 3650141 - DNA, 12 bp, Homo sapiens
cttccttccttt

SEQ ID NO: 3650142 - DNA, 20 bp, Homo sapiens
cttctaatccatgtgctgct

SEQ ID NO: 3650143 - DNA, 21 bp, Homo sapiens
cttctaatccatgtgctgctg

SEQ ID NO: 3650144 - DNA, 13 bp, Homo sapiens
cttctattttcaa

SEQ ID NO: 3650145 - DNA, 22 bp, Homo sapiens
cttctcctttgtcaaatggtat

SEQ ID NO: 3650146 - DNA, 16 bp, Homo sapiens
cttctctaaaacagca

SEQ ID NO: 3650147 - DNA, 18 bp, Homo sapiens
cttcttaaggacagtgtt

SEQ ID NO: 3650148 - DNA, 13 bp, Homo sapiens
cttctttccttcc

SEQ ID NO: 3650149 - DNA, 18 bp, Homo sapiens
cttgaacctgtgaggaag

SEQ ID NO: 3650150 - DNA, 20 bp, Homo sapiens
cttgagcatgcccaaatata

SEQ ID NO: 3650151 - DNA, 21 bp, Homo sapiens
cttgattaaggactacagaat

SEQ ID NO: 3650152 - DNA, 22 bp, Homo sapiens
cttgattaaggactacagaatt

SEQ ID NO: 3650153 - DNA, 18 bp, Homo sapiens
cttgggcctgggaatcta

SEQ ID NO: 3650154 - DNA, 15 bp, Homo sapiens
cttgtactttacaat

SEQ ID NO: 3650155 - DNA, 12 bp, Homo sapiens
cttgtctcccag

SEQ ID NO: 3650156 - DNA, 15 bp, Homo sapiens
cttgttgttcatata

SEQ ID NO: 3650157 - DNA, 23 bp, Homo sapiens
ctttaaaatgattcacttttatt

SEQ ID NO: 3650158 - DNA, 16 bp, Homo sapiens
ctttaatttttctgtt

SEQ ID NO: 3650159 - DNA, 13 bp, Homo sapiens
ctttcccagcctc

SEQ ID NO: 3650160 - DNA, 11 bp, Homo sapiens
ctttccttcct

SEQ ID NO: 3650161 - DNA, 12 bp, Homo sapiens
ctttccttcctt

SEQ ID NO: 3650162 - DNA, 13 bp, Homo sapiens
ctttcttccttcc

SEQ ID NO: 3650163 - DNA, 13 bp, Homo sapiens
ctttcttttgtgc

SEQ ID NO: 3650164 - DNA, 23 bp, Homo sapiens
ctttgcaaccttgtactttacaa

SEQ ID NO: 3650165 - DNA, 21 bp, Homo sapiens
ctttgccaccctcatgctgtg

SEQ ID NO: 3650166 - DNA, 12 bp, Homo sapiens
ctttgttaaaat

SEQ ID NO: 3650167 - DNA, 15 bp, Homo sapiens
ctttgttaaaatata

SEQ ID NO: 3650168 - DNA, 14 bp, Homo sapiens
ctttgttggaagaa

SEQ ID NO: 3650169 - DNA, 13 bp, Homo sapiens
cttttataaatgt

SEQ ID NO: 3650170 - DNA, 17 bp, Homo sapiens
cttttataaatgtttta

SEQ ID NO: 3650171 - DNA, 16 bp, Homo sapiens
cttttcatgcccatcc

SEQ ID NO: 3650172 - DNA, 18 bp, Homo sapiens
cttttccatcccactcca

SEQ ID NO: 3650173 - DNA, 22 bp, Homo sapiens
cttttgacgtcttaggtggcag

SEQ ID NO: 3650174 - DNA, 16 bp, Homo sapiens
gaaaaaactggaaaca

SEQ ID NO: 3650175 - DNA, 11 bp, Homo sapiens
gaaaaaattag

SEQ ID NO: 3650176 - DNA, 15 bp, Homo sapiens
gaaaaatactaagag

SEQ ID NO: 3650177 - DNA, 13 bp, Homo sapiens
gaaaaatctgaat

SEQ ID NO: 3650178 - DNA, 20 bp, Homo sapiens
gaaaaatctgaatttctaaa

SEQ ID NO: 3650179 - DNA, 17 bp, Homo sapiens
gaaaacattccatcctt

SEQ ID NO: 3650180 - DNA, 20 bp, Homo sapiens
gaaaaggctgcagctaattt

SEQ ID NO: 3650181 - DNA, 12 bp, Homo sapiens
gaaaataatatc

SEQ ID NO: 3650182 - DNA, 17 bp, Homo sapiens
gaaaatggaagacctaa

SEQ ID NO: 3650183 - DNA, 21 bp, Homo sapiens
gaaaatggaagacctaaggca

SEQ ID NO: 3650184 - DNA, 15 bp, Homo sapiens
gaaaatggctgaaga

SEQ ID NO: 3650185 - DNA, 16 bp, Homo sapiens
gaaaatggctgaagaa

SEQ ID NO: 3650186 - DNA, 20 bp, Homo sapiens
gaaaatggctgaagaaacac

SEQ ID NO: 3650187 - DNA, 17 bp, Homo sapiens
gaaaattttcttcttta

SEQ ID NO: 3650188 - DNA, 20 bp, Homo sapiens
gaaacacggagtttccattt

SEQ ID NO: 3650189 - DNA, 16 bp, Homo sapiens
gaaacatctgatttct

SEQ ID NO: 3650190 - DNA, 22 bp, Homo sapiens
gaaactcatacagtctctattt

SEQ ID NO: 3650191 - DNA, 17 bp, Homo sapiens
gaaactttggaagtttt

SEQ ID NO: 3650192 - DNA, 15 bp, Homo sapiens
gaaagacatctgagg

SEQ ID NO: 3650193 - DNA, 18 bp, Homo sapiens
gaaagacatctgaggaaa

SEQ ID NO: 3650194 - DNA, 13 bp, Homo sapiens
gaaagagaatttg

SEQ ID NO: 3650195 - DNA, 13 bp, Homo sapiens
gaaagggatggcc

SEQ ID NO: 3650196 - DNA, 13 bp, Homo sapiens
gaaagggtgagac

SEQ ID NO: 3650197 - DNA, 17 bp, Homo sapiens
gaaatattcacaaggtt

SEQ ID NO: 3650198 - DNA, 21 bp, Homo sapiens
gaaatgaaaatggctgaagaa

SEQ ID NO: 3650199 - DNA, 22 bp, Homo sapiens
gaaatgaaaatggctgaagaaa

SEQ ID NO: 3650200 - DNA, 19 bp, Homo sapiens
gaaatgagatcccagagtt

SEQ ID NO: 3650201 - DNA, 21 bp, Homo sapiens
gaaatgagatcccagagttat

SEQ ID NO: 3650202 - DNA, 22 bp, Homo sapiens
gaaattcccttcatctggaacc

SEQ ID NO: 3650203 - DNA, 21 bp, Homo sapiens
gaaatttgtgtgcttcacaca

SEQ ID NO: 3650204 - DNA, 14 bp, Homo sapiens
gaacaaactcagat

SEQ ID NO: 3650205 - DNA, 14 bp, Homo sapiens
gaacaatcagatta

SEQ ID NO: 3650206 - DNA, 12 bp, Homo sapiens
gaaccatcagaa

SEQ ID NO: 3650207 - DNA, 22 bp, Homo sapiens
gaacccatctaaaccagaagga

SEQ ID NO: 3650208 - DNA, 15 bp, Homo sapiens
gaacctgtgaggaag

SEQ ID NO: 3650209 - DNA, 21 bp, Homo sapiens
gaacctttggacaagaggaaa

SEQ ID NO: 3650210 - DNA, 16 bp, Homo sapiens
gaagaaggactgaaga

SEQ ID NO: 3650211 - DNA, 17 bp, Homo sapiens
gaagaaggactgaagaa

SEQ ID NO: 3650212 - DNA, 20 bp, Homo sapiens
gaagacctaaggcagacagg

SEQ ID NO: 3650213 - DNA, 12 bp, Homo sapiens
gaagcaaggaag

SEQ ID NO: 3650214 - DNA, 15 bp, Homo sapiens
gaagcaaggaagtaa

SEQ ID NO: 3650215 - DNA, 15 bp, Homo sapiens
gaagcacaaaagaca

SEQ ID NO: 3650216 - DNA, 18 bp, Homo sapiens
gaaggaaacaacaaagga

SEQ ID NO: 3650217 - DNA, 22 bp, Homo sapiens
gaaggaaacaacaaaggaagtg

SEQ ID NO: 3650218 - DNA, 14 bp, Homo sapiens
gaaggctctctggt

SEQ ID NO: 3650219 - DNA, 16 bp, Homo sapiens
gaaggctctctggtct

SEQ ID NO: 3650220 - DNA, 16 bp, Homo sapiens
gaagtaagggagtcat

SEQ ID NO: 3650221 - DNA, 20 bp, Homo sapiens
gaagtgactttggctgcatg

SEQ ID NO: 3650222 - DNA, 15 bp, Homo sapiens
gaagtgaggtagtgc

SEQ ID NO: 3650223 - DNA, 16 bp, Homo sapiens
gaataccccaccagca

SEQ ID NO: 3650224 - DNA, 19 bp, Homo sapiens
gaatataatggcctcttaa

SEQ ID NO: 3650225 - DNA, 19 bp, Homo sapiens
gaatcatgggcagaggatg

SEQ ID NO: 3650226 - DNA, 13 bp, Homo sapiens
gaatggttgcaaa

SEQ ID NO: 3650227 - DNA, 11 bp, Homo sapiens
gaatgtgaaaa

SEQ ID NO: 3650228 - DNA, 12 bp, Homo sapiens
gaatgtgaaaaa

SEQ ID NO: 3650229 - DNA, 22 bp, Homo sapiens
gaatgtgaaaaaaaaaagtaat

SEQ ID NO: 3650230 - DNA, 22 bp, Homo sapiens
gaattcatgatgctagttctta

SEQ ID NO: 3650231 - DNA, 20 bp, Homo sapiens
gaattgggcccttagaatgt

SEQ ID NO: 3650232 - DNA, 19 bp, Homo sapiens
gaatttaccatcaaacaaa

SEQ ID NO: 3650233 - DNA, 21 bp, Homo sapiens
gaattttgctttatcagaagc

SEQ ID NO: 3650234 - DNA, 21 bp, Homo sapiens
gacaagcattgggtcagaccc

SEQ ID NO: 3650235 - DNA, 13 bp, Homo sapiens
gacaccattctga

SEQ ID NO: 3650236 - DNA, 12 bp, Homo sapiens
gacaggaaggaa

SEQ ID NO: 3650237 - DNA, 14 bp, Homo sapiens
gacaggaaggaagc

SEQ ID NO: 3650238 - DNA, 20 bp, Homo sapiens
gacaggtgggagatggaggt

SEQ ID NO: 3650239 - DNA, 19 bp, Homo sapiens
gacagtgttcaaattctga

SEQ ID NO: 3650240 - DNA, 13 bp, Homo sapiens
gacatctgaggaa

SEQ ID NO: 3650241 - DNA, 14 bp, Homo sapiens
gacatctgaggaaa

SEQ ID NO: 3650242 - DNA, 17 bp, Homo sapiens
gacatgagtctccagat

SEQ ID NO: 3650243 - DNA, 23 bp, Homo sapiens
gacatgtatgcttccagggacaa

SEQ ID NO: 3650244 - DNA, 15 bp, Homo sapiens
gacattgtcagaatg

SEQ ID NO: 3650245 - DNA, 16 bp, Homo sapiens
gacattgtcagaatgt

SEQ ID NO: 3650246 - DNA, 22 bp, Homo sapiens
gaccagcttttcccaaaagccc

SEQ ID NO: 3650247 - DNA, 18 bp, Homo sapiens
gacctaaggcagacagga

SEQ ID NO: 3650248 - DNA, 19 bp, Homo sapiens
gacctaaggcagacaggaa

SEQ ID NO: 3650249 - DNA, 18 bp, Homo sapiens
gaccttcagggagagctg

SEQ ID NO: 3650250 - DNA, 20 bp, Homo sapiens
gacgtcttaggtggcagggc

SEQ ID NO: 3650251 - DNA, 21 bp, Homo sapiens
gactaacttattttgattgtt

SEQ ID NO: 3650252 - DNA, 17 bp, Homo sapiens
gactacagaagtggaag

SEQ ID NO: 3650253 - DNA, 13 bp, Homo sapiens
gactacagaattg

SEQ ID NO: 3650254 - DNA, 19 bp, Homo sapiens
gactgaagaaaatccttca

SEQ ID NO: 3650255 - DNA, 16 bp, Homo sapiens
gacttgtctcccagtc

SEQ ID NO: 3650256 - DNA, 17 bp, Homo sapiens
gagaaagacagtatttg

SEQ ID NO: 3650257 - DNA, 19 bp, Homo sapiens
gagactaacttattttgat

SEQ ID NO: 3650258 - DNA, 15 bp, Homo sapiens
gagagaacagggatg

SEQ ID NO: 3650259 - DNA, 13 bp, Homo sapiens
gagagagacctag

SEQ ID NO: 3650260 - DNA, 19 bp, Homo sapiens
gagagctgggatggggcca

SEQ ID NO: 3650261 - DNA, 23 bp, Homo sapiens
gagagctgggcagacaggtggga

SEQ ID NO: 3650262 - DNA, 13 bp, Homo sapiens
gagagggatggaa

SEQ ID NO: 3650263 - DNA, 24 bp, Homo sapiens
gagatggaggtagggctggctgga

SEQ ID NO: 3650264 - DNA, 13 bp, Homo sapiens
gagattctgcctc

SEQ ID NO: 3650265 - DNA, 22 bp, Homo sapiens
gagatttgctttttctgggtgc

SEQ ID NO: 3650266 - DNA, 19 bp, Homo sapiens
gagctgggatggggccaga

SEQ ID NO: 3650267 - DNA, 16 bp, Homo sapiens
gagctgggcagacagg

SEQ ID NO: 3650268 - DNA, 22 bp, Homo sapiens
gagctgggcagacaggtgggag

SEQ ID NO: 3650269 - DNA, 18 bp, Homo sapiens
gaggaaaatggaagacct

SEQ ID NO: 3650270 - DNA, 22 bp, Homo sapiens
gaggaaggaaacaacaaaggaa

SEQ ID NO: 3650271 - DNA, 18 bp, Homo sapiens
gaggatgaggtgggctga

SEQ ID NO: 3650272 - DNA, 18 bp, Homo sapiens
gaggcaggaccagaaggc

SEQ ID NO: 3650273 - DNA, 20 bp, Homo sapiens
gaggcaggaccagaaggcaa

SEQ ID NO: 3650274 - DNA, 23 bp, Homo sapiens
gaggcgagcctggccaacatggt

SEQ ID NO: 3650275 - DNA, 17 bp, Homo sapiens
gaggctcgtgcatgtaa

SEQ ID NO: 3650276 - DNA, 15 bp, Homo sapiens
gaggctgaggcagga

SEQ ID NO: 3650277 - DNA, 12 bp, Homo sapiens
gaggtagggctg

SEQ ID NO: 3650278 - DNA, 14 bp, Homo sapiens
gaggtagggctggc

SEQ ID NO: 3650279 - DNA, 18 bp, Homo sapiens
gaggtagggctggctgga

SEQ ID NO: 3650280 - DNA, 23 bp, Homo sapiens
gaggtagggctggctggaggaag

SEQ ID NO: 3650281 - DNA, 17 bp, Homo sapiens
gagtgcaagagcctgag

SEQ ID NO: 3650282 - DNA, 20 bp, Homo sapiens
gagttcgaggcgagcctggc

SEQ ID NO: 3650283 - DNA, 15 bp, Homo sapiens
gagtttccatttgga

SEQ ID NO: 3650284 - DNA, 21 bp, Homo sapiens
gataaattttggaagaattca

SEQ ID NO: 3650285 - DNA, 16 bp, Homo sapiens
gataatgagatgtaat

SEQ ID NO: 3650286 - DNA, 18 bp, Homo sapiens
gataatgagatgtaatac

SEQ ID NO: 3650287 - DNA, 22 bp, Homo sapiens
gataatgagatgtaatacacca

SEQ ID NO: 3650288 - DNA, 12 bp, Homo sapiens
gataattgtaaa

SEQ ID NO: 3650289 - DNA, 17 bp, Homo sapiens
gataattgtaaaggtga

SEQ ID NO: 3650290 - DNA, 21 bp, Homo sapiens
gatagaagaaggactgaagaa

SEQ ID NO: 3650291 - DNA, 22 bp, Homo sapiens
gatagaagaaggactgaagaaa

SEQ ID NO: 3650292 - DNA, 15 bp, Homo sapiens
gatatgtctttaaaa

SEQ ID NO: 3650293 - DNA, 21 bp, Homo sapiens
gatcagcatccaaaagcagga

SEQ ID NO: 3650294 - DNA, 20 bp, Homo sapiens
gatcattggtatctgatatc

SEQ ID NO: 3650295 - DNA, 19 bp, Homo sapiens
gatccttttccatcccact

SEQ ID NO: 3650296 - DNA, 23 bp, Homo sapiens
gatcgtgccattacactccagcc

SEQ ID NO: 3650297 - DNA, 19 bp, Homo sapiens
gatctcagcatcctggaaa

SEQ ID NO: 3650298 - DNA, 21 bp, Homo sapiens
gatctgaaaactcattagaga

SEQ ID NO: 3650299 - DNA, 17 bp, Homo sapiens
gatgaataaaatgttta

SEQ ID NO: 3650300 - DNA, 20 bp, Homo sapiens
gatgaattatcttggatgag

SEQ ID NO: 3650301 - DNA, 17 bp, Homo sapiens
gatgatttaattcttac

SEQ ID NO: 3650302 - DNA, 16 bp, Homo sapiens
gatgctagttcttacg

SEQ ID NO: 3650303 - DNA, 20 bp, Homo sapiens
gatggaaataacgggtggca

SEQ ID NO: 3650304 - DNA, 16 bp, Homo sapiens
gatggagagggatgga

SEQ ID NO: 3650305 - DNA, 20 bp, Homo sapiens
gatgggtctccattctgtgt

SEQ ID NO: 3650306 - DNA, 17 bp, Homo sapiens
gatggtgtcctgcatgt

SEQ ID NO: 3650307 - DNA, 19 bp, Homo sapiens
gattaaggactacagaatt

SEQ ID NO: 3650308 - DNA, 15 bp, Homo sapiens
gattgtttgatgaat

SEQ ID NO: 3650309 - DNA, 12 bp, Homo sapiens
gatttaattctt

SEQ ID NO: 3650310 - DNA, 15 bp, Homo sapiens
gatttaattcttacc

SEQ ID NO: 3650311 - DNA, 12 bp, Homo sapiens
gatttgtattaa

SEQ ID NO: 3650312 - DNA, 13 bp, Homo sapiens
gattttaaacaaa

SEQ ID NO: 3650313 - DNA, 18 bp, Homo sapiens
gcaacactgccaaacatc

SEQ ID NO: 3650314 - DNA, 15 bp, Homo sapiens
gcaacatttggggag

SEQ ID NO: 3650315 - DNA, 17 bp, Homo sapiens
gcaacatttggggagag

SEQ ID NO: 3650316 - DNA, 16 bp, Homo sapiens
gcaagtgagaaagaca

SEQ ID NO: 3650317 - DNA, 16 bp, Homo sapiens
gcaataagttgaatga

SEQ ID NO: 3650318 - DNA, 17 bp, Homo sapiens
gcaatcaagagcttcca

SEQ ID NO: 3650319 - DNA, 21 bp, Homo sapiens
gcaatcaagagcttccagaaa

SEQ ID NO: 3650320 - DNA, 16 bp, Homo sapiens
gcacaaaagacaagca

SEQ ID NO: 3650321 - DNA, 23 bp, Homo sapiens
gcacatgttttacaaagaaacaa

SEQ ID NO: 3650322 - DNA, 18 bp, Homo sapiens
gcacatttgttaatgatt

SEQ ID NO: 3650323 - DNA, 23 bp, Homo sapiens
gcacatttgttaatgattcttgt

SEQ ID NO: 3650324 - DNA, 16 bp, Homo sapiens
gcagaatgagatgatt

SEQ ID NO: 3650325 - DNA, 17 bp, Homo sapiens
gcagaatgagatgattt

SEQ ID NO: 3650326 - DNA, 15 bp, Homo sapiens
gcagacaggaaggaa

SEQ ID NO: 3650327 - DNA, 22 bp, Homo sapiens
gcagacaggtgggagatggagg

SEQ ID NO: 3650328 - DNA, 20 bp, Homo sapiens
gcagaggcaggaccagaagg

SEQ ID NO: 3650329 - DNA, 14 bp, Homo sapiens
gcagcagaggcagg

SEQ ID NO: 3650330 - DNA, 17 bp, Homo sapiens
gcagcagaggcaggacc

SEQ ID NO: 3650331 - DNA, 17 bp, Homo sapiens
gcagccttgcccattct

SEQ ID NO: 3650332 - DNA, 16 bp, Homo sapiens
gcagctaatttgtgaa

SEQ ID NO: 3650333 - DNA, 13 bp, Homo sapiens
gcagtgagctgag

SEQ ID NO: 3650334 - DNA, 17 bp, Homo sapiens
gcagtttggtatgaaac

SEQ ID NO: 3650335 - DNA, 20 bp, Homo sapiens
gcatatggcaacgttcatgt

SEQ ID NO: 3650336 - DNA, 22 bp, Homo sapiens
gcatatggcaacgttcatgttc

SEQ ID NO: 3650337 - DNA, 13 bp, Homo sapiens
gcatcctggaaat

SEQ ID NO: 3650338 - DNA, 18 bp, Homo sapiens
gcatgaatccatcgattt

SEQ ID NO: 3650339 - DNA, 23 bp, Homo sapiens
gcatgaatccatcgatttgtatt

SEQ ID NO: 3650340 - DNA, 23 bp, Homo sapiens
gcatgagttctgcacatacagat

SEQ ID NO: 3650341 - DNA, 19 bp, Homo sapiens
gcatgcatttagcatgagt

SEQ ID NO: 3650342 - DNA, 17 bp, Homo sapiens
gcatggaaagatgggga

SEQ ID NO: 3650343 - DNA, 19 bp, Homo sapiens
gcatggaaagatggggagc

SEQ ID NO: 3650344 - DNA, 14 bp, Homo sapiens
gcatttcagctgtg

SEQ ID NO: 3650345 - DNA, 23 bp, Homo sapiens
gcatttgcaggtgaccagaatga

SEQ ID NO: 3650346 - DNA, 15 bp, Homo sapiens
gcatttttttagtaa

SEQ ID NO: 3650347 - DNA, 20 bp, Homo sapiens
gccaacatggtgaaaccctg

SEQ ID NO: 3650348 - DNA, 20 bp, Homo sapiens
gccacacttgtgtgccacag

SEQ ID NO: 3650349 - DNA, 13 bp, Homo sapiens
gccaccctcatgc

SEQ ID NO: 3650350 - DNA, 15 bp, Homo sapiens
gccaccctcatgctg

SEQ ID NO: 3650351 - DNA, 16 bp, Homo sapiens
gccaccctcatgctgt

SEQ ID NO: 3650352 - DNA, 14 bp, Homo sapiens
gccactaaggtcag

SEQ ID NO: 3650353 - DNA, 23 bp, Homo sapiens
gccaggatgggtctccattctgt

SEQ ID NO: 3650354 - DNA, 18 bp, Homo sapiens
gccatcttcacattctga

SEQ ID NO: 3650355 - DNA, 16 bp, Homo sapiens
gccattacactccagc

SEQ ID NO: 3650356 - DNA, 20 bp, Homo sapiens
gccattacactccagcctgg

SEQ ID NO: 3650357 - DNA, 15 bp, Homo sapiens
gcccactcccatccc

SEQ ID NO: 3650358 - DNA, 17 bp, Homo sapiens
gcccacttaccctgggc

SEQ ID NO: 3650359 - DNA, 20 bp, Homo sapiens
gcccacttaccctgggctgg

SEQ ID NO: 3650360 - DNA, 16 bp, Homo sapiens
gcccattcattccatt

SEQ ID NO: 3650361 - DNA, 17 bp, Homo sapiens
gcctggcttagaaggca

SEQ ID NO: 3650362 - DNA, 20 bp, Homo sapiens
gcctgggcgaaagggtgaga

SEQ ID NO: 3650363 - DNA, 22 bp, Homo sapiens
gcctgtaatctcagctactcag

SEQ ID NO: 3650364 - DNA, 23 bp, Homo sapiens
gcctgtaatctcagctactcagg

SEQ ID NO: 3650365 - DNA, 15 bp, Homo sapiens
gcctgttaggtctgt

SEQ ID NO: 3650366 - DNA, 14 bp, Homo sapiens
gccttgggcctggg

SEQ ID NO: 3650367 - DNA, 16 bp, Homo sapiens
gcctttgacctgcctc

SEQ ID NO: 3650368 - DNA, 20 bp, Homo sapiens
gcgtttcttccactgagtct

SEQ ID NO: 3650369 - DNA, 23 bp, Homo sapiens
gctaagataattaaatgaaatac

SEQ ID NO: 3650370 - DNA, 16 bp, Homo sapiens
gctaagcctgatgatg

SEQ ID NO: 3650371 - DNA, 13 bp, Homo sapiens
gctaatttgtgaa

SEQ ID NO: 3650372 - DNA, 14 bp, Homo sapiens
gctaatttgtgaaa

SEQ ID NO: 3650373 - DNA, 15 bp, Homo sapiens
gctaatttgtgaaag

SEQ ID NO: 3650374 - DNA, 17 bp, Homo sapiens
gctagaatcagggtgga

SEQ ID NO: 3650375 - DNA, 13 bp, Homo sapiens
gctagaggtggca

SEQ ID NO: 3650376 - DNA, 14 bp, Homo sapiens
gctagaggtggcat

SEQ ID NO: 3650377 - DNA, 15 bp, Homo sapiens
gctagaggtggcatg

SEQ ID NO: 3650378 - DNA, 17 bp, Homo sapiens
gctattcgtaagttctg

SEQ ID NO: 3650379 - DNA, 12 bp, Homo sapiens
gctcatagcaca

SEQ ID NO: 3650380 - DNA, 17 bp, Homo sapiens
gctcatagcacatgttt

SEQ ID NO: 3650381 - DNA, 15 bp, Homo sapiens
gctcatctacacata

SEQ ID NO: 3650382 - DNA, 13 bp, Homo sapiens
gctcgtgcatgta

SEQ ID NO: 3650383 - DNA, 16 bp, Homo sapiens
gctctgcaggcagcct

SEQ ID NO: 3650384 - DNA, 19 bp, Homo sapiens
gctctgctcatctacacat

SEQ ID NO: 3650385 - DNA, 21 bp, Homo sapiens
gctgaagggaagcccagcctg

SEQ ID NO: 3650386 - DNA, 20 bp, Homo sapiens
gctgcagctaatttgtgaaa

SEQ ID NO: 3650387 - DNA, 14 bp, Homo sapiens
gctgcatttcaagt

SEQ ID NO: 3650388 - DNA, 14 bp, Homo sapiens
gctggaggaaggaa

SEQ ID NO: 3650389 - DNA, 17 bp, Homo sapiens
gctggctggaggaagga

SEQ ID NO: 3650390 - DNA, 18 bp, Homo sapiens
gctggctggaggaaggaa

SEQ ID NO: 3650391 - DNA, 19 bp, Homo sapiens
gctggtaagggaccttcag

SEQ ID NO: 3650392 - DNA, 23 bp, Homo sapiens
gctggtaagggaccttcagggag

SEQ ID NO: 3650393 - DNA, 16 bp, Homo sapiens
gctgtaaataaaaata

SEQ ID NO: 3650394 - DNA, 16 bp, Homo sapiens
gctgtatttgaggaaa

SEQ ID NO: 3650395 - DNA, 17 bp, Homo sapiens
gctgtatttgaggaaac

SEQ ID NO: 3650396 - DNA, 20 bp, Homo sapiens
gctgtctgaaaaagtgtttt

SEQ ID NO: 3650397 - DNA, 22 bp, Homo sapiens
gctgtctgaaaaagtgttttta

SEQ ID NO: 3650398 - DNA, 18 bp, Homo sapiens
gctgtggcatcaggaaag

SEQ ID NO: 3650399 - DNA, 10 bp, Homo sapiens
gcttcacaca

SEQ ID NO: 3650400 - DNA, 21 bp, Homo sapiens
gcttcacacaaagtgaaatta

SEQ ID NO: 3650401 - DNA, 19 bp, Homo sapiens
gcttgaacctgtgaggaag

SEQ ID NO: 3650402 - DNA, 13 bp, Homo sapiens
gcttgagcatgcc

SEQ ID NO: 3650403 - DNA, 21 bp, Homo sapiens
gctttactctgaatttccagt

SEQ ID NO: 3650404 - DNA, 21 bp, Homo sapiens
gctttgcaaccttgtacttta

SEQ ID NO: 3650405 - DNA, 13 bp, Homo sapiens
ggaaaaaggcttc

SEQ ID NO: 3650406 - DNA, 15 bp, Homo sapiens
ggaaacatctgattt

SEQ ID NO: 3650407 - DNA, 19 bp, Homo sapiens
ggaagaagaaccaggcatg

SEQ ID NO: 3650408 - DNA, 11 bp, Homo sapiens
ggaagaattca

SEQ ID NO: 3650409 - DNA, 16 bp, Homo sapiens
ggaagcccagcctgca

SEQ ID NO: 3650410 - DNA, 16 bp, Homo sapiens
ggaagtaagggagtca

SEQ ID NO: 3650411 - DNA, 19 bp, Homo sapiens
ggaatctaagtgggagaca

SEQ ID NO: 3650412 - DNA, 21 bp, Homo sapiens
ggaatgtcctgtagagagaga

SEQ ID NO: 3650413 - DNA, 22 bp, Homo sapiens
ggaatgtcctgtagagagagac

SEQ ID NO: 3650414 - DNA, 21 bp, Homo sapiens
ggaattttgctttatcagaag

SEQ ID NO: 3650415 - DNA, 23 bp, Homo sapiens
ggacatgtatgcttccagggaca

SEQ ID NO: 3650416 - DNA, 21 bp, Homo sapiens
ggaccttcagggagagctggg

SEQ ID NO: 3650417 - DNA, 19 bp, Homo sapiens
ggacttgcaaaaagggtca

SEQ ID NO: 3650418 - DNA, 16 bp, Homo sapiens
ggacttgtctcccagt

SEQ ID NO: 3650419 - DNA, 23 bp, Homo sapiens
ggagaattgcttgaacctgtgag

SEQ ID NO: 3650420 - DNA, 20 bp, Homo sapiens
ggagatggaggtagggctgg

SEQ ID NO: 3650421 - DNA, 16 bp, Homo sapiens
ggaggccgaggcaggt

SEQ ID NO: 3650422 - DNA, 12 bp, Homo sapiens
ggaggctgagat

SEQ ID NO: 3650423 - DNA, 13 bp, Homo sapiens
ggaggtagggctg

SEQ ID NO: 3650424 - DNA, 14 bp, Homo sapiens
ggagtcattgcctt

SEQ ID NO: 3650425 - DNA, 15 bp, Homo sapiens
ggagttcgaggcgag

SEQ ID NO: 3650426 - DNA, 11 bp, Homo sapiens
ggatataaatc

SEQ ID NO: 3650427 - DNA, 22 bp, Homo sapiens
ggatccgattaattggagatta

SEQ ID NO: 3650428 - DNA, 18 bp, Homo sapiens
ggatgagaaagatgggca

SEQ ID NO: 3650429 - DNA, 19 bp, Homo sapiens
ggatggtgatggagaggga

SEQ ID NO: 3650430 - DNA, 11 bp, Homo sapiens
ggattacagaa

SEQ ID NO: 3650431 - DNA, 14 bp, Homo sapiens
ggattgaggatgaa

SEQ ID NO: 3650432 - DNA, 13 bp, Homo sapiens
ggattttaaacaa

SEQ ID NO: 3650433 - DNA, 16 bp, Homo sapiens
ggcaacagagtgagac

SEQ ID NO: 3650434 - DNA, 17 bp, Homo sapiens
ggcaacatttggggaga

SEQ ID NO: 3650435 - DNA, 19 bp, Homo sapiens
ggcaacatttggggagaga

SEQ ID NO: 3650436 - DNA, 18 bp, Homo sapiens
ggcaagctcatagcacat

SEQ ID NO: 3650437 - DNA, 19 bp, Homo sapiens
ggcaagctcatagcacatg

SEQ ID NO: 3650438 - DNA, 17 bp, Homo sapiens
ggcacaatctcagctca

SEQ ID NO: 3650439 - DNA, 13 bp, Homo sapiens
ggcacggaggctc

SEQ ID NO: 3650440 - DNA, 13 bp, Homo sapiens
ggcagacaggaag

SEQ ID NO: 3650441 - DNA, 15 bp, Homo sapiens
ggcagacaggaagga

SEQ ID NO: 3650442 - DNA, 21 bp, Homo sapiens
ggcagacaggtgggagatgga

SEQ ID NO: 3650443 - DNA, 21 bp, Homo sapiens
ggcagggctgttccctccagg

SEQ ID NO: 3650444 - DNA, 15 bp, Homo sapiens
ggcatcaggaaagga

SEQ ID NO: 3650445 - DNA, 12 bp, Homo sapiens
ggccgaggcagg

SEQ ID NO: 3650446 - DNA, 18 bp, Homo sapiens
ggctagaatcagggtgga

SEQ ID NO: 3650447 - DNA, 21 bp, Homo sapiens
ggctgaagggaagcccagcct

SEQ ID NO: 3650448 - DNA, 12 bp, Homo sapiens
ggctgaggcagg

SEQ ID NO: 3650449 - DNA, 13 bp, Homo sapiens
ggctggagagttg

SEQ ID NO: 3650450 - DNA, 14 bp, Homo sapiens
ggctggaggaagga

SEQ ID NO: 3650451 - DNA, 15 bp, Homo sapiens
ggcttagaaggcact

SEQ ID NO: 3650452 - DNA, 19 bp, Homo sapiens
ggcttccccttcagacctt

SEQ ID NO: 3650453 - DNA, 15 bp, Homo sapiens
gggaccagattgact

SEQ ID NO: 3650454 - DNA, 16 bp, Homo sapiens
gggagagctgggcaga

SEQ ID NO: 3650455 - DNA, 21 bp, Homo sapiens
gggagagctgggcagacaggt

SEQ ID NO: 3650456 - DNA, 17 bp, Homo sapiens
gggcaatcctgggctgg

SEQ ID NO: 3650457 - DNA, 19 bp, Homo sapiens
gggcagacaggtgggagat

SEQ ID NO: 3650458 - DNA, 16 bp, Homo sapiens
gggcctttggcaggtg

SEQ ID NO: 3650459 - DNA, 17 bp, Homo sapiens
gggctggctggaggaag

SEQ ID NO: 3650460 - DNA, 16 bp, Homo sapiens
ggggcaggactgaaga

SEQ ID NO: 3650461 - DNA, 19 bp, Homo sapiens
gggtagcagcagaggcagg

SEQ ID NO: 3650462 - DNA, 21 bp, Homo sapiens
gggtcctcttagtccacaagg

SEQ ID NO: 3650463 - DNA, 18 bp, Homo sapiens
gggtctccattctgtgtg

SEQ ID NO: 3650464 - DNA, 18 bp, Homo sapiens
gggttaacagtaaatata

SEQ ID NO: 3650465 - DNA, 21 bp, Homo sapiens
ggtaaactgatgctttcagat

SEQ ID NO: 3650466 - DNA, 17 bp, Homo sapiens
ggtaacttgctgtgaaa

SEQ ID NO: 3650467 - DNA, 18 bp, Homo sapiens
ggtaagggaccttcaggg

SEQ ID NO: 3650468 - DNA, 22 bp, Homo sapiens
ggtagaaactttggaagtttta

SEQ ID NO: 3650469 - DNA, 18 bp, Homo sapiens
ggtagcagcagaggcagg

SEQ ID NO: 3650470 - DNA, 19 bp, Homo sapiens
ggtagcagcagaggcagga

SEQ ID NO: 3650471 - DNA, 18 bp, Homo sapiens
ggtatataaattggggtg

SEQ ID NO: 3650472 - DNA, 16 bp, Homo sapiens
ggtattttaacatagc

SEQ ID NO: 3650473 - DNA, 19 bp, Homo sapiens
ggtcagtgttataaaatct

SEQ ID NO: 3650474 - DNA, 14 bp, Homo sapiens
ggtcggaccagctt

SEQ ID NO: 3650475 - DNA, 21 bp, Homo sapiens
ggtctgtgttctcaacacaca

SEQ ID NO: 3650476 - DNA, 20 bp, Homo sapiens
ggtctgttgaagtgcatgtt

SEQ ID NO: 3650477 - DNA, 13 bp, Homo sapiens
ggtgatggagagg

SEQ ID NO: 3650478 - DNA, 20 bp, Homo sapiens
ggttaacagtaaatatacac

SEQ ID NO: 3650479 - DNA, 21 bp, Homo sapiens
ggttaacagtaaatatacact

SEQ ID NO: 3650480 - DNA, 16 bp, Homo sapiens
ggttagggaaaacatt

SEQ ID NO: 3650481 - DNA, 13 bp, Homo sapiens
ggttgcaaagtgt

SEQ ID NO: 3650482 - DNA, 20 bp, Homo sapiens
ggtttcaggttcctacagga

SEQ ID NO: 3650483 - DNA, 16 bp, Homo sapiens
gtaaaataaaaggtcg

SEQ ID NO: 3650484 - DNA, 17 bp, Homo sapiens
gtaaaggtgatgaattt

SEQ ID NO: 3650485 - DNA, 14 bp, Homo sapiens
gtaaattaagagca

SEQ ID NO: 3650486 - DNA, 20 bp, Homo sapiens
gtaaattcctaattctatga

SEQ ID NO: 3650487 - DNA, 19 bp, Homo sapiens
gtaacttgctgtgaaatga

SEQ ID NO: 3650488 - DNA, 15 bp, Homo sapiens
gtaagggaccttcag

SEQ ID NO: 3650489 - DNA, 24 bp, Homo sapiens
gtaagggaccttcagggagagctg

SEQ ID NO: 3650490 - DNA, 12 bp, Homo sapiens
gtaagttctgtg

SEQ ID NO: 3650491 - DNA, 15 bp, Homo sapiens
gtacatttatgtgtg

SEQ ID NO: 3650492 - DNA, 15 bp, Homo sapiens
gtagaaactttggaa

SEQ ID NO: 3650493 - DNA, 20 bp, Homo sapiens
gtagaaactttggaagtttt

SEQ ID NO: 3650494 - DNA, 16 bp, Homo sapiens
gtagggctggctggag

SEQ ID NO: 3650495 - DNA, 19 bp, Homo sapiens
gtagggctggctggaggaa

SEQ ID NO: 3650496 - DNA, 22 bp, Homo sapiens
gtagggctggctggaggaagga

SEQ ID NO: 3650497 - DNA, 19 bp, Homo sapiens
gtatataaattggggtgat

SEQ ID NO: 3650498 - DNA, 14 bp, Homo sapiens
gtatatattttgaa

SEQ ID NO: 3650499 - DNA, 18 bp, Homo sapiens
gtatatattttgaaagga

SEQ ID NO: 3650500 - DNA, 14 bp, Homo sapiens
gtatcttaaaattg

SEQ ID NO: 3650501 - DNA, 19 bp, Homo sapiens
gtatgccatgtatgttgca

SEQ ID NO: 3650502 - DNA, 21 bp, Homo sapiens
gtatgggttagggaaaacatt

SEQ ID NO: 3650503 - DNA, 13 bp, Homo sapiens
gtatgttgcatga

SEQ ID NO: 3650504 - DNA, 22 bp, Homo sapiens
gtattaatgtagggcagaatag

SEQ ID NO: 3650505 - DNA, 16 bp, Homo sapiens
gtatttactgcaatgt

SEQ ID NO: 3650506 - DNA, 20 bp, Homo sapiens
gtatttactgcaatgtctgt

SEQ ID NO: 3650507 - DNA, 18 bp, Homo sapiens
gtatttgaggaaactcat

SEQ ID NO: 3650508 - DNA, 15 bp, Homo sapiens
gtattttttgtgaat

SEQ ID NO: 3650509 - DNA, 24 bp, Homo sapiens
gtcagacccataaaccacctccca

SEQ ID NO: 3650510 - DNA, 20 bp, Homo sapiens
gtcatcaagtagtagtactt

SEQ ID NO: 3650511 - DNA, 20 bp, Homo sapiens
gtcattgccttgggcctggg

SEQ ID NO: 3650512 - DNA, 23 bp, Homo sapiens
gtcccagctacaggggaggctga

SEQ ID NO: 3650513 - DNA, 16 bp, Homo sapiens
gtcctcttagtccaca

SEQ ID NO: 3650514 - DNA, 16 bp, Homo sapiens
gtcctgtagagagaga

SEQ ID NO: 3650515 - DNA, 11 bp, Homo sapiens
gtcgaggctgg

SEQ ID NO: 3650516 - DNA, 18 bp, Homo sapiens
gtcgaggctggtaaggga

SEQ ID NO: 3650517 - DNA, 22 bp, Homo sapiens
gtctataggacttaatttagca

SEQ ID NO: 3650518 - DNA, 19 bp, Homo sapiens
gtctattttttctgaggaa

SEQ ID NO: 3650519 - DNA, 20 bp, Homo sapiens
gtctattttttctgaggaat

SEQ ID NO: 3650520 - DNA, 18 bp, Homo sapiens
gtctgtgttctcaacaca

SEQ ID NO: 3650521 - DNA, 18 bp, Homo sapiens
gtcttaactaatgtaaat

SEQ ID NO: 3650522 - DNA, 20 bp, Homo sapiens
gtcttaggtggcagggctgt

SEQ ID NO: 3650523 - DNA, 16 bp, Homo sapiens
gtgaaagtggcaagct

SEQ ID NO: 3650524 - DNA, 18 bp, Homo sapiens
gtgaaattagtattttga

SEQ ID NO: 3650525 - DNA, 19 bp, Homo sapiens
gtgaaattagtattttgag

SEQ ID NO: 3650526 - DNA, 20 bp, Homo sapiens
gtgactttggctgcatgcga

SEQ ID NO: 3650527 - DNA, 22 bp, Homo sapiens
gtgagaaagacatctgaggaaa

SEQ ID NO: 3650528 - DNA, 14 bp, Homo sapiens
gtgagactccatct

SEQ ID NO: 3650529 - DNA, 17 bp, Homo sapiens
gtgagtgcaagagcctg

SEQ ID NO: 3650530 - DNA, 23 bp, Homo sapiens
gtgatccgcccgcctcagcatcc

SEQ ID NO: 3650531 - DNA, 16 bp, Homo sapiens
gtgatgaatttaccat

SEQ ID NO: 3650532 - DNA, 14 bp, Homo sapiens
gtgatgactcttgt

SEQ ID NO: 3650533 - DNA, 15 bp, Homo sapiens
gtgatggagagggat

SEQ ID NO: 3650534 - DNA, 13 bp, Homo sapiens
gtgcaacagactg

SEQ ID NO: 3650535 - DNA, 14 bp, Homo sapiens
gtgcagagtataca

SEQ ID NO: 3650536 - DNA, 19 bp, Homo sapiens
gtgcagtttggtatgaaac

SEQ ID NO: 3650537 - DNA, 20 bp, Homo sapiens
gtgcatatggcaacgttcat

SEQ ID NO: 3650538 - DNA, 21 bp, Homo sapiens
gtgcatatggcaacgttcatg

SEQ ID NO: 3650539 - DNA, 15 bp, Homo sapiens
gtgcatgttaaaata

SEQ ID NO: 3650540 - DNA, 22 bp, Homo sapiens
gtgccattacactccagcctgg

SEQ ID NO: 3650541 - DNA, 23 bp, Homo sapiens
gtgcccacttaccctgggctgga

SEQ ID NO: 3650542 - DNA, 22 bp, Homo sapiens
gtgccgatgatatagagtgact

SEQ ID NO: 3650543 - DNA, 20 bp, Homo sapiens
gtgctattcgtaagttctgt

SEQ ID NO: 3650544 - DNA, 21 bp, Homo sapiens
gtgctattcgtaagttctgtg

SEQ ID NO: 3650545 - DNA, 16 bp, Homo sapiens
gtgctcatttcaggat

SEQ ID NO: 3650546 - DNA, 19 bp, Homo sapiens
gtgcttcacacaaagtgaa

SEQ ID NO: 3650547 - DNA, 16 bp, Homo sapiens
gtggacatttgttctg

SEQ ID NO: 3650548 - DNA, 16 bp, Homo sapiens
gtggacttgtctccca

SEQ ID NO: 3650549 - DNA, 17 bp, Homo sapiens
gtggacttgtctcccag

SEQ ID NO: 3650550 - DNA, 13 bp, Homo sapiens
gtggcaactgtgg

SEQ ID NO: 3650551 - DNA, 17 bp, Homo sapiens
gtggcacacaactgtgg

SEQ ID NO: 3650552 - DNA, 13 bp, Homo sapiens
gtggcagggctgt

SEQ ID NO: 3650553 - DNA, 15 bp, Homo sapiens
gtggcatttgcaggt

SEQ ID NO: 3650554 - DNA, 24 bp, Homo sapiens
gtgtaagacacgtgcaacagactg

SEQ ID NO: 3650555 - DNA, 18 bp, Homo sapiens
gtgtgagtgttagaaaaa

SEQ ID NO: 3650556 - DNA, 14 bp, Homo sapiens
gtgtgccacagagt

SEQ ID NO: 3650557 - DNA, 18 bp, Homo sapiens
gtgttagaaaaaactgga

SEQ ID NO: 3650558 - DNA, 21 bp, Homo sapiens
gtgttagaaaaaactggaaac

SEQ ID NO: 3650559 - DNA, 14 bp, Homo sapiens
gtgttcaaattctg

SEQ ID NO: 3650560 - DNA, 15 bp, Homo sapiens
gtgtttttacatata

SEQ ID NO: 3650561 - DNA, 20 bp, Homo sapiens
gttaaatctacaaactttta

SEQ ID NO: 3650562 - DNA, 12 bp, Homo sapiens
gttaatgaaaaa

SEQ ID NO: 3650563 - DNA, 20 bp, Homo sapiens
gttaccccaccctgcccact

SEQ ID NO: 3650564 - DNA, 12 bp, Homo sapiens
gttacttacaca

SEQ ID NO: 3650565 - DNA, 14 bp, Homo sapiens
gttacttacacacc

SEQ ID NO: 3650566 - DNA, 12 bp, Homo sapiens
gttatatttcaa

SEQ ID NO: 3650567 - DNA, 15 bp, Homo sapiens
gttatccactacagg

SEQ ID NO: 3650568 - DNA, 24 bp, Homo sapiens
gttcaatgctacaaaatgtgtgct

SEQ ID NO: 3650569 - DNA, 16 bp, Homo sapiens
gttctatatttactgt

SEQ ID NO: 3650570 - DNA, 16 bp, Homo sapiens
gttctgaaagggatgg

SEQ ID NO: 3650571 - DNA, 20 bp, Homo sapiens
gttctgggttaacagtaaat

SEQ ID NO: 3650572 - DNA, 13 bp, Homo sapiens
gttctttcccagc

SEQ ID NO: 3650573 - DNA, 14 bp, Homo sapiens
gttctttcccagcc

SEQ ID NO: 3650574 - DNA, 23 bp, Homo sapiens
gttggtttcaggttcctacagga

SEQ ID NO: 3650575 - DNA, 22 bp, Homo sapiens
gttgtctattttttctgaggaa

SEQ ID NO: 3650576 - DNA, 15 bp, Homo sapiens
gtttaaatctttgtt

SEQ ID NO: 3650577 - DNA, 16 bp, Homo sapiens
gtttgattatagaaaa

SEQ ID NO: 3650578 - DNA, 13 bp, Homo sapiens
gtttgcttctaaa

SEQ ID NO: 3650579 - DNA, 20 bp, Homo sapiens
gttttaaagaagtccatgtg

SEQ ID NO: 3650580 - DNA, 18 bp, Homo sapiens
gttttacaaagaaacaaa

SEQ ID NO: 3650581 - DNA, 19 bp, Homo sapiens
gttttcttaacttctgaaa

SEQ ID NO: 3650582 - DNA, 20 bp, Homo sapiens
taaaaagaccatgcattcag

SEQ ID NO: 3650583 - DNA, 16 bp, Homo sapiens
taaaaatagctataaa

SEQ ID NO: 3650584 - DNA, 21 bp, Homo sapiens
taaaaatagctataaatagtg

SEQ ID NO: 3650585 - DNA, 13 bp, Homo sapiens
taaaaatggcatt

SEQ ID NO: 3650586 - DNA, 16 bp, Homo sapiens
taaaataattatatga

SEQ ID NO: 3650587 - DNA, 18 bp, Homo sapiens
taaaatatagtgttgtgt

SEQ ID NO: 3650588 - DNA, 19 bp, Homo sapiens
taaaatatagtgttgtgtt

SEQ ID NO: 3650589 - DNA, 17 bp, Homo sapiens
taaaatctgtattgcta

SEQ ID NO: 3650590 - DNA, 13 bp, Homo sapiens
taaacaaaattta

SEQ ID NO: 3650591 - DNA, 20 bp, Homo sapiens
taaacaaaatttatgtcatt

SEQ ID NO: 3650592 - DNA, 16 bp, Homo sapiens
taaacatagtggtatt

SEQ ID NO: 3650593 - DNA, 15 bp, Homo sapiens
taaaccagaaggaag

SEQ ID NO: 3650594 - DNA, 16 bp, Homo sapiens
taaaccagaaggaagc

SEQ ID NO: 3650595 - DNA, 14 bp, Homo sapiens
taaaccatgaaaag

SEQ ID NO: 3650596 - DNA, 17 bp, Homo sapiens
taaactgggaaatgaga

SEQ ID NO: 3650597 - DNA, 14 bp, Homo sapiens
taaaggtgatgaat

SEQ ID NO: 3650598 - DNA, 18 bp, Homo sapiens
taaatatacactttacat

SEQ ID NO: 3650599 - DNA, 21 bp, Homo sapiens
taaatattgctgtctgaaaaa

SEQ ID NO: 3650600 - DNA, 12 bp, Homo sapiens
taaatcacagat

SEQ ID NO: 3650601 - DNA, 18 bp, Homo sapiens
taaatcacagatttccaa

SEQ ID NO: 3650602 - DNA, 15 bp, Homo sapiens
taaatctacaaactt

SEQ ID NO: 3650603 - DNA, 13 bp, Homo sapiens
taaatgaaatact

SEQ ID NO: 3650604 - DNA, 22 bp, Homo sapiens
taaatgaaatacttgacaacat

SEQ ID NO: 3650605 - DNA, 14 bp, Homo sapiens
taaatgtatattga

SEQ ID NO: 3650606 - DNA, 19 bp, Homo sapiens
taaatgtatattgatgtaa

SEQ ID NO: 3650607 - DNA, 14 bp, Homo sapiens
taaattaacaaatt

SEQ ID NO: 3650608 - DNA, 18 bp, Homo sapiens
taaattaacaaattcagt

SEQ ID NO: 3650609 - DNA, 15 bp, Homo sapiens
taaattcctaattct

SEQ ID NO: 3650610 - DNA, 19 bp, Homo sapiens
taaattcctaattctatga

SEQ ID NO: 3650611 - DNA, 17 bp, Homo sapiens
taaatttattaaatgtt

SEQ ID NO: 3650612 - DNA, 23 bp, Homo sapiens
taaattttggaagaattcatgat

SEQ ID NO: 3650613 - DNA, 13 bp, Homo sapiens
taacaaattcagt

SEQ ID NO: 3650614 - DNA, 12 bp, Homo sapiens
taacagtaaata

SEQ ID NO: 3650615 - DNA, 15 bp, Homo sapiens
taacagtaaatatac

SEQ ID NO: 3650616 - DNA, 16 bp, Homo sapiens
taactaatgtaaatat

SEQ ID NO: 3650617 - DNA, 13 bp, Homo sapiens
taacttattttga

SEQ ID NO: 3650618 - DNA, 18 bp, Homo sapiens
taacttattttgattgtt

SEQ ID NO: 3650619 - DNA, 18 bp, Homo sapiens
taacttgctgtgaaatga

SEQ ID NO: 3650620 - DNA, 17 bp, Homo sapiens
taagacacgtgcaacag

SEQ ID NO: 3650621 - DNA, 19 bp, Homo sapiens
taagacacgtgcaacagac

SEQ ID NO: 3650622 - DNA, 20 bp, Homo sapiens
taagataattaaatgaaata

SEQ ID NO: 3650623 - DNA, 22 bp, Homo sapiens
taagataattaaatgaaatact

SEQ ID NO: 3650624 - DNA, 22 bp, Homo sapiens
taagataggttctgctttctga

SEQ ID NO: 3650625 - DNA, 20 bp, Homo sapiens
taagattaatgacctgaatt

SEQ ID NO: 3650626 - DNA, 13 bp, Homo sapiens
taagcctgatgat

SEQ ID NO: 3650627 - DNA, 22 bp, Homo sapiens
taagcctggcttagaaggcact

SEQ ID NO: 3650628 - DNA, 23 bp, Homo sapiens
taagcctggcttagaaggcactg

SEQ ID NO: 3650629 - DNA, 15 bp, Homo sapiens
taaggactacagaat

SEQ ID NO: 3650630 - DNA, 17 bp, Homo sapiens
taaggcagacaggaagg

SEQ ID NO: 3650631 - DNA, 21 bp, Homo sapiens
taaggcagacaggaaggaagc

SEQ ID NO: 3650632 - DNA, 20 bp, Homo sapiens
taagggaccttcagggagag

SEQ ID NO: 3650633 - DNA, 12 bp, Homo sapiens
taagtgggagac

SEQ ID NO: 3650634 - DNA, 14 bp, Homo sapiens
taagtgttggccat

SEQ ID NO: 3650635 - DNA, 22 bp, Homo sapiens
taagtgttggccatcatttcat

SEQ ID NO: 3650636 - DNA, 13 bp, Homo sapiens
taagttctgtgca

SEQ ID NO: 3650637 - DNA, 15 bp, Homo sapiens
taagttctgtgcagt

SEQ ID NO: 3650638 - DNA, 23 bp, Homo sapiens
taagttctgtgcagtttggtatg

SEQ ID NO: 3650639 - DNA, 12 bp, Homo sapiens
taagttgaatga

SEQ ID NO: 3650640 - DNA, 23 bp, Homo sapiens
taagtttgacacaacatctgaga

SEQ ID NO: 3650641 - DNA, 17 bp, Homo sapiens
taataacacttcacctt

SEQ ID NO: 3650642 - DNA, 14 bp, Homo sapiens
taatgaaaaatctg

SEQ ID NO: 3650643 - DNA, 19 bp, Homo sapiens
taatgaaaaatctgaattt

SEQ ID NO: 3650644 - DNA, 16 bp, Homo sapiens
taatgattcttgtgtc

SEQ ID NO: 3650645 - DNA, 22 bp, Homo sapiens
taattaaatgaaatacttgaca

SEQ ID NO: 3650646 - DNA, 15 bp, Homo sapiens
taattcctgtatgtt

SEQ ID NO: 3650647 - DNA, 18 bp, Homo sapiens
taattcctgtatgttatc

SEQ ID NO: 3650648 - DNA, 23 bp, Homo sapiens
taattcttaccgaaatgaaaatg

SEQ ID NO: 3650649 - DNA, 17 bp, Homo sapiens
taattcttctcctttgt

SEQ ID NO: 3650650 - DNA, 22 bp, Homo sapiens
taatttagcagtccatttttga

SEQ ID NO: 3650651 - DNA, 16 bp, Homo sapiens
taatttattaaattta

SEQ ID NO: 3650652 - DNA, 20 bp, Homo sapiens
taatttattaaatttattaa

SEQ ID NO: 3650653 - DNA, 13 bp, Homo sapiens
taatttgtgaaag

SEQ ID NO: 3650654 - DNA, 14 bp, Homo sapiens
taatttgtgaaagt

SEQ ID NO: 3650655 - DNA, 21 bp, Homo sapiens
tacaaaatgtgtgcttggaaa

SEQ ID NO: 3650656 - DNA, 21 bp, Homo sapiens
tacaaacttttataaatgttt

SEQ ID NO: 3650657 - DNA, 22 bp, Homo sapiens
tacaaacttttataaatgtttt

SEQ ID NO: 3650658 - DNA, 18 bp, Homo sapiens
tacaacaagcaaactgaa

SEQ ID NO: 3650659 - DNA, 19 bp, Homo sapiens
tacaacaagcaaactgaaa

SEQ ID NO: 3650660 - DNA, 22 bp, Homo sapiens
tacaacaagcaaactgaaatta

SEQ ID NO: 3650661 - DNA, 16 bp, Homo sapiens
tacaagctacatatgt

SEQ ID NO: 3650662 - DNA, 17 bp, Homo sapiens
tacaagctacatatgta

SEQ ID NO: 3650663 - DNA, 13 bp, Homo sapiens
tacaataagtgtt

SEQ ID NO: 3650664 - DNA, 18 bp, Homo sapiens
tacacacctgagaatgtg

SEQ ID NO: 3650665 - DNA, 13 bp, Homo sapiens
tacacatataaac

SEQ ID NO: 3650666 - DNA, 21 bp, Homo sapiens
tacacatataaacacagtaag

SEQ ID NO: 3650667 - DNA, 20 bp, Homo sapiens
tacaccaaatagcttttcac

SEQ ID NO: 3650668 - DNA, 15 bp, Homo sapiens
tacaggggaggctga

SEQ ID NO: 3650669 - DNA, 13 bp, Homo sapiens
tacatctgtcagt

SEQ ID NO: 3650670 - DNA, 19 bp, Homo sapiens
tacattcttgctctgctca

SEQ ID NO: 3650671 - DNA, 15 bp, Homo sapiens
tacatttatgtgtga

SEQ ID NO: 3650672 - DNA, 14 bp, Homo sapiens
taccaaatgccttt

SEQ ID NO: 3650673 - DNA, 22 bp, Homo sapiens
taccagaagtttaaatctttgt

SEQ ID NO: 3650674 - DNA, 14 bp, Homo sapiens
taccatcaaacaaa

SEQ ID NO: 3650675 - DNA, 16 bp, Homo sapiens
taccattttgaaatat

SEQ ID NO: 3650676 - DNA, 22 bp, Homo sapiens
taccccaccctgcccactccca

SEQ ID NO: 3650677 - DNA, 14 bp, Homo sapiens
taccctgggctgga

SEQ ID NO: 3650678 - DNA, 15 bp, Homo sapiens
taccgaaatgaaaat

SEQ ID NO: 3650679 - DNA, 24 bp, Homo sapiens
tacctgagatctatatggagctta

SEQ ID NO: 3650680 - DNA, 15 bp, Homo sapiens
tactaagagatttgc

SEQ ID NO: 3650681 - DNA, 15 bp, Homo sapiens
tactaagtcctcaga

SEQ ID NO: 3650682 - DNA, 16 bp, Homo sapiens
tactagaaccttctaa

SEQ ID NO: 3650683 - DNA, 21 bp, Homo sapiens
tactagcaataagttgaatga

SEQ ID NO: 3650684 - DNA, 20 bp, Homo sapiens
tactcatttggatataaatc

SEQ ID NO: 3650685 - DNA, 18 bp, Homo sapiens
tactccctatctaacact

SEQ ID NO: 3650686 - DNA, 16 bp, Homo sapiens
tactgcaatgtctgtc

SEQ ID NO: 3650687 - DNA, 17 bp, Homo sapiens
tacttatttataacatt

SEQ ID NO: 3650688 - DNA, 15 bp, Homo sapiens
tactttacaatcatg

SEQ ID NO: 3650689 - DNA, 16 bp, Homo sapiens
tagaaactttggaagt

SEQ ID NO: 3650690 - DNA, 21 bp, Homo sapiens
tagaagaaggactgaagaaaa

SEQ ID NO: 3650691 - DNA, 23 bp, Homo sapiens
tagaagcagcgagtgcatgggct

SEQ ID NO: 3650692 - DNA, 19 bp, Homo sapiens
tagaatcagggtggagaag

SEQ ID NO: 3650693 - DNA, 12 bp, Homo sapiens
tagaatgtgaaa

SEQ ID NO: 3650694 - DNA, 14 bp, Homo sapiens
tagaatgtgaaaaa

SEQ ID NO: 3650695 - DNA, 18 bp, Homo sapiens
tagcaataagttgaatga

SEQ ID NO: 3650696 - DNA, 14 bp, Homo sapiens
tagcacatgtttta

SEQ ID NO: 3650697 - DNA, 17 bp, Homo sapiens
tagcagcagaggcagga

SEQ ID NO: 3650698 - DNA, 14 bp, Homo sapiens
tagcatgagttctg

SEQ ID NO: 3650699 - DNA, 18 bp, Homo sapiens
tagcatgagttctgcaca

SEQ ID NO: 3650700 - DNA, 19 bp, Homo sapiens
tagctacaaatgaaaacaa

SEQ ID NO: 3650701 - DNA, 15 bp, Homo sapiens
tagctataaatagtg

SEQ ID NO: 3650702 - DNA, 16 bp, Homo sapiens
tagctcacagcacatt

SEQ ID NO: 3650703 - DNA, 20 bp, Homo sapiens
tagctcacagcacatttgtt

SEQ ID NO: 3650704 - DNA, 21 bp, Homo sapiens
tagctttgcaaccttgtactt

SEQ ID NO: 3650705 - DNA, 19 bp, Homo sapiens
tagcttttcacttcttaag

SEQ ID NO: 3650706 - DNA, 12 bp, Homo sapiens
taggaaaatttt

SEQ ID NO: 3650707 - DNA, 17 bp, Homo sapiens
taggacatctctgtaaa

SEQ ID NO: 3650708 - DNA, 22 bp, Homo sapiens
taggtctgttgaagtgcatgtt

SEQ ID NO: 3650709 - DNA, 19 bp, Homo sapiens
tagtgaaaattttattgaa

SEQ ID NO: 3650710 - DNA, 15 bp, Homo sapiens
tagtgagatttaggg

SEQ ID NO: 3650711 - DNA, 16 bp, Homo sapiens
tagtgttttcattctg

SEQ ID NO: 3650712 - DNA, 22 bp, Homo sapiens
tagtgttttcattctggtcctt

SEQ ID NO: 3650713 - DNA, 16 bp, Homo sapiens
tagtttctaaaccatg

SEQ ID NO: 3650714 - DNA, 20 bp, Homo sapiens
tataaaaataattaaaacaa

SEQ ID NO: 3650715 - DNA, 14 bp, Homo sapiens
tataaaatctgtat

SEQ ID NO: 3650716 - DNA, 22 bp, Homo sapiens
tataaatcttacccttcaatgt

SEQ ID NO: 3650717 - DNA, 12 bp, Homo sapiens
tataacatgaaa

SEQ ID NO: 3650718 - DNA, 17 bp, Homo sapiens
tataacattgtaaatga

SEQ ID NO: 3650719 - DNA, 19 bp, Homo sapiens
tataacattgtaaatgata

SEQ ID NO: 3650720 - DNA, 22 bp, Homo sapiens
tatacaagtgtttctagtaaca

SEQ ID NO: 3650721 - DNA, 13 bp, Homo sapiens
tatactcatttgg

SEQ ID NO: 3650722 - DNA, 15 bp, Homo sapiens
tatactcatttggat

SEQ ID NO: 3650723 - DNA, 16 bp, Homo sapiens
tatatgaagcagaatg

SEQ ID NO: 3650724 - DNA, 16 bp, Homo sapiens
tatattattttctgta

SEQ ID NO: 3650725 - DNA, 18 bp, Homo sapiens
tatcagaagcaaggaagt

SEQ ID NO: 3650726 - DNA, 16 bp, Homo sapiens
tatcagggcaagctca

SEQ ID NO: 3650727 - DNA, 16 bp, Homo sapiens
tatcctcaagttgtgt

SEQ ID NO: 3650728 - DNA, 17 bp, Homo sapiens
tatctcgctagccatat

SEQ ID NO: 3650729 - DNA, 13 bp, Homo sapiens
tatctgtgtaaga

SEQ ID NO: 3650730 - DNA, 18 bp, Homo sapiens
tatcttaaaattggttaa

SEQ ID NO: 3650731 - DNA, 15 bp, Homo sapiens
tatctttaaaactta

SEQ ID NO: 3650732 - DNA, 20 bp, Homo sapiens
tatctttgcacaatcaataa

SEQ ID NO: 3650733 - DNA, 16 bp, Homo sapiens
tatgaaacaaatatac

SEQ ID NO: 3650734 - DNA, 20 bp, Homo sapiens
tatgaaacaaatatactcat

SEQ ID NO: 3650735 - DNA, 22 bp, Homo sapiens
tatgaaacaaatatactcattt

SEQ ID NO: 3650736 - DNA, 19 bp, Homo sapiens
tatgaagcagaatgagatg

SEQ ID NO: 3650737 - DNA, 20 bp, Homo sapiens
tatgagaaatataaaaataa

SEQ ID NO: 3650738 - DNA, 22 bp, Homo sapiens
tatgcctgcgccatcttcacat

SEQ ID NO: 3650739 - DNA, 15 bp, Homo sapiens
tatgctgtgtgcaga

SEQ ID NO: 3650740 - DNA, 21 bp, Homo sapiens
tatggcaacgttcatgttcat

SEQ ID NO: 3650741 - DNA, 23 bp, Homo sapiens
tatgtaggaaaattttcttcttt

SEQ ID NO: 3650742 - DNA, 18 bp, Homo sapiens
tatgtatatctgtgtaag

SEQ ID NO: 3650743 - DNA, 23 bp, Homo sapiens
tatgtcattttcagatccttcca

SEQ ID NO: 3650744 - DNA, 12 bp, Homo sapiens
tatgtctttaaa

SEQ ID NO: 3650745 - DNA, 19 bp, Homo sapiens
tatgttgcatgaatccatc

SEQ ID NO: 3650746 - DNA, 21 bp, Homo sapiens
tattaatgtagggcagaatag

SEQ ID NO: 3650747 - DNA, 20 bp, Homo sapiens
tattacaacaagcaaactga

SEQ ID NO: 3650748 - DNA, 19 bp, Homo sapiens
tattatatatgtatatctg

SEQ ID NO: 3650749 - DNA, 18 bp, Homo sapiens
tattattttctgtaattc

SEQ ID NO: 3650750 - DNA, 23 bp, Homo sapiens
tattcccatggtagactgtgaca

SEQ ID NO: 3650751 - DNA, 20 bp, Homo sapiens
tattcgtaagttctgtgcag

SEQ ID NO: 3650752 - DNA, 14 bp, Homo sapiens
tattgctgtaaata

SEQ ID NO: 3650753 - DNA, 19 bp, Homo sapiens
tattgctgtaaataaaaat

SEQ ID NO: 3650754 - DNA, 21 bp, Homo sapiens
tattgctgtctgaaaaagtgt

SEQ ID NO: 3650755 - DNA, 23 bp, Homo sapiens
tatttaccagaagtttaaatctt

SEQ ID NO: 3650756 - DNA, 18 bp, Homo sapiens
tatttactgcaatgtctg

SEQ ID NO: 3650757 - DNA, 12 bp, Homo sapiens
tatttactgttt

SEQ ID NO: 3650758 - DNA, 15 bp, Homo sapiens
tatttataacattgt

SEQ ID NO: 3650759 - DNA, 17 bp, Homo sapiens
tatttataacattgtaa

SEQ ID NO: 3650760 - DNA, 21 bp, Homo sapiens
tatttcaaccacacctaaatt

SEQ ID NO: 3650761 - DNA, 16 bp, Homo sapiens
tatttgaggaaactca

SEQ ID NO: 3650762 - DNA, 17 bp, Homo sapiens
tattttctgtaattctt

SEQ ID NO: 3650763 - DNA, 19 bp, Homo sapiens
tattttggacgtgtgagga

SEQ ID NO: 3650764 - DNA, 15 bp, Homo sapiens
tattttttgtgaatg

SEQ ID NO: 3650765 - DNA, 16 bp, Homo sapiens
tcaaacaaatcatttt

SEQ ID NO: 3650766 - DNA, 21 bp, Homo sapiens
tcaaataaaaagcatgagaca

SEQ ID NO: 3650767 - DNA, 22 bp, Homo sapiens
tcaaatggtattttttgtgaat

SEQ ID NO: 3650768 - DNA, 18 bp, Homo sapiens
tcaaccacacctaaatta

SEQ ID NO: 3650769 - DNA, 22 bp, Homo sapiens
tcaaccacacctaaattaacaa

SEQ ID NO: 3650770 - DNA, 15 bp, Homo sapiens
tcaaccccacttcct

SEQ ID NO: 3650771 - DNA, 20 bp, Homo sapiens
tcaagagcttccagaaatgc

SEQ ID NO: 3650772 - DNA, 22 bp, Homo sapiens
tcaagtagtagtacttaatagt

SEQ ID NO: 3650773 - DNA, 14 bp, Homo sapiens
tcaagtctgtgaaa

SEQ ID NO: 3650774 - DNA, 14 bp, Homo sapiens
tcaagttgtgtgct

SEQ ID NO: 3650775 - DNA, 16 bp, Homo sapiens
tcaataactattgctg

SEQ ID NO: 3650776 - DNA, 16 bp, Homo sapiens
tcaatgctacaaaatg

SEQ ID NO: 3650777 - DNA, 14 bp, Homo sapiens
tcaatgttaaatct

SEQ ID NO: 3650778 - DNA, 15 bp, Homo sapiens
tcaatgttaaatcta

SEQ ID NO: 3650779 - DNA, 23 bp, Homo sapiens
tcaattcttccctatctttgcca

SEQ ID NO: 3650780 - DNA, 19 bp, Homo sapiens
tcaattgggttttgatctc

SEQ ID NO: 3650781 - DNA, 14 bp, Homo sapiens
tcacacaactgtgg

SEQ ID NO: 3650782 - DNA, 16 bp, Homo sapiens
tcacctatctggaaaa

SEQ ID NO: 3650783 - DNA, 19 bp, Homo sapiens
tcactccatttcccacttc

SEQ ID NO: 3650784 - DNA, 14 bp, Homo sapiens
tcacttcttaagga

SEQ ID NO: 3650785 - DNA, 17 bp, Homo sapiens
tcagaagcaaggaagta

SEQ ID NO: 3650786 - DNA, 20 bp, Homo sapiens
tcagagggaaggctctctgg

SEQ ID NO: 3650787 - DNA, 15 bp, Homo sapiens
tcagcatcctggaaa

SEQ ID NO: 3650788 - DNA, 16 bp, Homo sapiens
tcagcatcctggaaat

SEQ ID NO: 3650789 - DNA, 20 bp, Homo sapiens
tcagcctccagagtagctgg

SEQ ID NO: 3650790 - DNA, 22 bp, Homo sapiens
tcaggaggctgaggcaggagaa

SEQ ID NO: 3650791 - DNA, 20 bp, Homo sapiens
tcaggagttcgaggcgagcc

SEQ ID NO: 3650792 - DNA, 17 bp, Homo sapiens
tcagggagagctgggca

SEQ ID NO: 3650793 - DNA, 13 bp, Homo sapiens
tcagggcaagctc

SEQ ID NO: 3650794 - DNA, 23 bp, Homo sapiens
tcagggcaagctcatagcacatg

SEQ ID NO: 3650795 - DNA, 15 bp, Homo sapiens
tcagggtagcagcag

SEQ ID NO: 3650796 - DNA, 18 bp, Homo sapiens
tcaggtggcatttgcagg

SEQ ID NO: 3650797 - DNA, 19 bp, Homo sapiens
tcagtagcattttaatagt

SEQ ID NO: 3650798 - DNA, 19 bp, Homo sapiens
tcagtctatgctgtgtgca

SEQ ID NO: 3650799 - DNA, 15 bp, Homo sapiens
tcagtgagtcagagg

SEQ ID NO: 3650800 - DNA, 15 bp, Homo sapiens
tcagtggacatttgt

SEQ ID NO: 3650801 - DNA, 15 bp, Homo sapiens
tcagtgttataaaat

SEQ ID NO: 3650802 - DNA, 15 bp, Homo sapiens
tcatagataccattt

SEQ ID NO: 3650803 - DNA, 20 bp, Homo sapiens
tcatagataccattttgaaa

SEQ ID NO: 3650804 - DNA, 15 bp, Homo sapiens
tcatatatcaaatca

SEQ ID NO: 3650805 - DNA, 23 bp, Homo sapiens
tcatatctgtatgcctcatttta

SEQ ID NO: 3650806 - DNA, 20 bp, Homo sapiens
tcatcagggtagcagcagag

SEQ ID NO: 3650807 - DNA, 17 bp, Homo sapiens
tcatctacacatataaa

SEQ ID NO: 3650808 - DNA, 19 bp, Homo sapiens
tcatctacacatataaaca

SEQ ID NO: 3650809 - DNA, 21 bp, Homo sapiens
tcatgaacatggtcagaacct

SEQ ID NO: 3650810 - DNA, 17 bp, Homo sapiens
tcatgaggtcaggagtt

SEQ ID NO: 3650811 - DNA, 15 bp, Homo sapiens
tcatgcatggaaatt

SEQ ID NO: 3650812 - DNA, 14 bp, Homo sapiens
tcattccattctgg

SEQ ID NO: 3650813 - DNA, 15 bp, Homo sapiens
tcattccattctgga

SEQ ID NO: 3650814 - DNA, 16 bp, Homo sapiens
tcattgcactgcagtt

SEQ ID NO: 3650815 - DNA, 13 bp, Homo sapiens
tcattttgatgta

SEQ ID NO: 3650816 - DNA, 13 bp, Homo sapiens
tccaaaagcagga

SEQ ID NO: 3650817 - DNA, 16 bp, Homo sapiens
tccaaaagtactagca

SEQ ID NO: 3650818 - DNA, 22 bp, Homo sapiens
tccatacgtgcccatttcacac

SEQ ID NO: 3650819 - DNA, 23 bp, Homo sapiens
tccatacgtgcccatttcacaca

SEQ ID NO: 3650820 - DNA, 12 bp, Homo sapiens
tccatcccactc

SEQ ID NO: 3650821 - DNA, 16 bp, Homo sapiens
tccatgtgataattgt

SEQ ID NO: 3650822 - DNA, 12 bp, Homo sapiens
tccattctggaa

SEQ ID NO: 3650823 - DNA, 14 bp, Homo sapiens
tccattctggaagt

SEQ ID NO: 3650824 - DNA, 14 bp, Homo sapiens
tccatttcccactt

SEQ ID NO: 3650825 - DNA, 11 bp, Homo sapiens
tccatttggat

SEQ ID NO: 3650826 - DNA, 15 bp, Homo sapiens
tccatttggatttta

SEQ ID NO: 3650827 - DNA, 18 bp, Homo sapiens
tccatttggattttaaac

SEQ ID NO: 3650828 - DNA, 16 bp, Homo sapiens
tccatttttgagtaaa

SEQ ID NO: 3650829 - DNA, 17 bp, Homo sapiens
tccatttttgagtaaaa

SEQ ID NO: 3650830 - DNA, 23 bp, Homo sapiens
tcccacattttagaataccccac

SEQ ID NO: 3650831 - DNA, 22 bp, Homo sapiens
tcccagcctcttccattccctt

SEQ ID NO: 3650832 - DNA, 16 bp, Homo sapiens
tccccgctgacccttg

SEQ ID NO: 3650833 - DNA, 22 bp, Homo sapiens
tccctaaacatagtggtatttt

SEQ ID NO: 3650834 - DNA, 16 bp, Homo sapiens
tccctgaaccttcctg

SEQ ID NO: 3650835 - DNA, 17 bp, Homo sapiens
tccctgaaccttcctgt

SEQ ID NO: 3650836 - DNA, 23 bp, Homo sapiens
tccctggcttccccttcagacct

SEQ ID NO: 3650837 - DNA, 18 bp, Homo sapiens
tcccttcaaccccacttc

SEQ ID NO: 3650838 - DNA, 20 bp, Homo sapiens
tcccttcaaccccacttcct

SEQ ID NO: 3650839 - DNA, 17 bp, Homo sapiens
tcccttcatgcatggaa

SEQ ID NO: 3650840 - DNA, 18 bp, Homo sapiens
tcccttctttccttcctt

SEQ ID NO: 3650841 - DNA, 20 bp, Homo sapiens
tcctaattctatgattaaac

SEQ ID NO: 3650842 - DNA, 18 bp, Homo sapiens
tcctcaagttgtgtgcta

SEQ ID NO: 3650843 - DNA, 19 bp, Homo sapiens
tcctcagagctccatgctg

SEQ ID NO: 3650844 - DNA, 16 bp, Homo sapiens
tcctcttagtccacaa

SEQ ID NO: 3650845 - DNA, 14 bp, Homo sapiens
tcctgcatgtatgc

SEQ ID NO: 3650846 - DNA, 21 bp, Homo sapiens
tcctgggcaacagagtgagac

SEQ ID NO: 3650847 - DNA, 20 bp, Homo sapiens
tcctgtagagagagacctag

SEQ ID NO: 3650848 - DNA, 14 bp, Homo sapiens
tcctgtctcccagg

SEQ ID NO: 3650849 - DNA, 13 bp, Homo sapiens
tccttcagcaatc

SEQ ID NO: 3650850 - DNA, 17 bp, Homo sapiens
tccttcagcaatcctta

SEQ ID NO: 3650851 - DNA, 14 bp, Homo sapiens
tcctttcttccttc

SEQ ID NO: 3650852 - DNA, 14 bp, Homo sapiens
tccttttttccttt

SEQ ID NO: 3650853 - DNA, 17 bp, Homo sapiens
tccttttttcctttctt

SEQ ID NO: 3650854 - DNA, 20 bp, Homo sapiens
tcgaggctggtaagggacct

SEQ ID NO: 3650855 - DNA, 16 bp, Homo sapiens
tcgccaggctggagtg

SEQ ID NO: 3650856 - DNA, 13 bp, Homo sapiens
tcgtgcatgtaat

SEQ ID NO: 3650857 - DNA, 22 bp, Homo sapiens
tctaaaacccttggtctgtgtt

SEQ ID NO: 3650858 - DNA, 20 bp, Homo sapiens
tctaaaccagaaggaagccc

SEQ ID NO: 3650859 - DNA, 18 bp, Homo sapiens
tctaaaccatgaaaagtt

SEQ ID NO: 3650860 - DNA, 14 bp, Homo sapiens
tctaagcctggctt

SEQ ID NO: 3650861 - DNA, 20 bp, Homo sapiens
tctacaaaaaaaatcaaaaa

SEQ ID NO: 3650862 - DNA, 18 bp, Homo sapiens
tctacaaacttttataaa

SEQ ID NO: 3650863 - DNA, 17 bp, Homo sapiens
tctagatatgagaaata

SEQ ID NO: 3650864 - DNA, 14 bp, Homo sapiens
tctagtaacagtat

SEQ ID NO: 3650865 - DNA, 17 bp, Homo sapiens
tctagtaacagtatttc

SEQ ID NO: 3650866 - DNA, 20 bp, Homo sapiens
tctagtgcaggaaaaggctg

SEQ ID NO: 3650867 - DNA, 21 bp, Homo sapiens
tctataggacttaatttagca

SEQ ID NO: 3650868 - DNA, 15 bp, Homo sapiens
tctatatttactgtt

SEQ ID NO: 3650869 - DNA, 18 bp, Homo sapiens
tctatatttactgtttat

SEQ ID NO: 3650870 - DNA, 15 bp, Homo sapiens
tctatgctgtgtgca

SEQ ID NO: 3650871 - DNA, 19 bp, Homo sapiens
tctattttttctgaggaat

SEQ ID NO: 3650872 - DNA, 23 bp, Homo sapiens
tctcaacacacagtatagataaa

SEQ ID NO: 3650873 - DNA, 22 bp, Homo sapiens
tctcagcatcctggaaatttgt

SEQ ID NO: 3650874 - DNA, 22 bp, Homo sapiens
tctcagctactcaggaggctga

SEQ ID NO: 3650875 - DNA, 18 bp, Homo sapiens
tctcaggtggcatttgca

SEQ ID NO: 3650876 - DNA, 19 bp, Homo sapiens
tctcagtatcttaaaattg

SEQ ID NO: 3650877 - DNA, 22 bp, Homo sapiens
tctccctcccttctttccttcc

SEQ ID NO: 3650878 - DNA, 14 bp, Homo sapiens
tctcctgtatcatt

SEQ ID NO: 3650879 - DNA, 15 bp, Homo sapiens
tctcctgtatcattt

SEQ ID NO: 3650880 - DNA, 17 bp, Homo sapiens
tctcctttgtcaaatgg

SEQ ID NO: 3650881 - DNA, 14 bp, Homo sapiens
tctctaaaacagca

SEQ ID NO: 3650882 - DNA, 16 bp, Homo sapiens
tctctaagcctggctt

SEQ ID NO: 3650883 - DNA, 15 bp, Homo sapiens
tctctgtaaaaagca

SEQ ID NO: 3650884 - DNA, 20 bp, Homo sapiens
tctcttccataattcagatt

SEQ ID NO: 3650885 - DNA, 18 bp, Homo sapiens
tctctttcttttgtgcat

SEQ ID NO: 3650886 - DNA, 19 bp, Homo sapiens
tctctttcttttgtgcata

SEQ ID NO: 3650887 - DNA, 18 bp, Homo sapiens
tctgaaagagctgtgggt

SEQ ID NO: 3650888 - DNA, 22 bp, Homo sapiens
tctgaactatcagggcaagctc

SEQ ID NO: 3650889 - DNA, 22 bp, Homo sapiens
tctgacagcatttcagctgtga

SEQ ID NO: 3650890 - DNA, 21 bp, Homo sapiens
tctgatacttatttataacat

SEQ ID NO: 3650891 - DNA, 12 bp, Homo sapiens
tctgatttctga

SEQ ID NO: 3650892 - DNA, 12 bp, Homo sapiens
tctgcaggcagc

SEQ ID NO: 3650893 - DNA, 18 bp, Homo sapiens
tctgctcatctacacata

SEQ ID NO: 3650894 - DNA, 14 bp, Homo sapiens
tctgctttctgata

SEQ ID NO: 3650895 - DNA, 17 bp, Homo sapiens
tctgctttctgatacat

SEQ ID NO: 3650896 - DNA, 18 bp, Homo sapiens
tctggaaaaaaaaaaata

SEQ ID NO: 3650897 - DNA, 22 bp, Homo sapiens
tctggtccttagtaaattccta

SEQ ID NO: 3650898 - DNA, 21 bp, Homo sapiens
tctggtgagtgcaagagcctg

SEQ ID NO: 3650899 - DNA, 22 bp, Homo sapiens
tctgtaatactaagtcctcaga

SEQ ID NO: 3650900 - DNA, 20 bp, Homo sapiens
tctgtaattcttctcctttg

SEQ ID NO: 3650901 - DNA, 23 bp, Homo sapiens
tctgtgaaagtctcctgtatcat

SEQ ID NO: 3650902 - DNA, 20 bp, Homo sapiens
tctgtgttctcaacacacag

SEQ ID NO: 3650903 - DNA, 22 bp, Homo sapiens
tctgtgttctcaacacacagta

SEQ ID NO: 3650904 - DNA, 18 bp, Homo sapiens
tcttaaaaattatcttta

SEQ ID NO: 3650905 - DNA, 13 bp, Homo sapiens
tcttaactaatgt

SEQ ID NO: 3650906 - DNA, 17 bp, Homo sapiens
tcttacccttcaatgtt

SEQ ID NO: 3650907 - DNA, 15 bp, Homo sapiens
tcttaccgaaatgaa

SEQ ID NO: 3650908 - DNA, 18 bp, Homo sapiens
tcttaggtggcagggctg

SEQ ID NO: 3650909 - DNA, 13 bp, Homo sapiens
tcttagtccacaa

SEQ ID NO: 3650910 - DNA, 12 bp, Homo sapiens
tcttattcctaa

SEQ ID NO: 3650911 - DNA, 17 bp, Homo sapiens
tcttattcctaattcct

SEQ ID NO: 3650912 - DNA, 18 bp, Homo sapiens
tcttccccaatatgcctg

SEQ ID NO: 3650913 - DNA, 13 bp, Homo sapiens
tcttccttccttt

SEQ ID NO: 3650914 - DNA, 15 bp, Homo sapiens
tcttctacttcttgt

SEQ ID NO: 3650915 - DNA, 17 bp, Homo sapiens
tcttctttaatttttct

SEQ ID NO: 3650916 - DNA, 21 bp, Homo sapiens
tcttctttaatttttctgttg

SEQ ID NO: 3650917 - DNA, 21 bp, Homo sapiens
tcttgtgtcatcaagtagtag

SEQ ID NO: 3650918 - DNA, 23 bp, Homo sapiens
tcttgttatcttttgtgtcctgt

SEQ ID NO: 3650919 - DNA, 23 bp, Homo sapiens
tctttaaaatgattcacttttat

SEQ ID NO: 3650920 - DNA, 21 bp, Homo sapiens
tctttatgtatttgttaaaga

SEQ ID NO: 3650921 - DNA, 12 bp, Homo sapiens
tctttcccagcc

SEQ ID NO: 3650922 - DNA, 14 bp, Homo sapiens
tctttcccttactc

SEQ ID NO: 3650923 - DNA, 22 bp, Homo sapiens
tctttcccttactccctatcta

SEQ ID NO: 3650924 - DNA, 11 bp, Homo sapiens
tctttccttcc

SEQ ID NO: 3650925 - DNA, 16 bp, Homo sapiens
tctttcttagattaaa

SEQ ID NO: 3650926 - DNA, 15 bp, Homo sapiens
tctttcttttgtgca

SEQ ID NO: 3650927 - DNA, 20 bp, Homo sapiens
tctttgcacaatcaataaaa

SEQ ID NO: 3650928 - DNA, 22 bp, Homo sapiens
tctttgccaccctcatgctgtg

SEQ ID NO: 3650929 - DNA, 15 bp, Homo sapiens
tcttttgtgcatatg

SEQ ID NO: 3650930 - DNA, 19 bp, Homo sapiens
tgaaaaaaaaaagtaatta

SEQ ID NO: 3650931 - DNA, 14 bp, Homo sapiens
tgaaaaatctgaat

SEQ ID NO: 3650932 - DNA, 12 bp, Homo sapiens
tgaaaagttttc

SEQ ID NO: 3650933 - DNA, 18 bp, Homo sapiens
tgaaaattttattgaata

SEQ ID NO: 3650934 - DNA, 14 bp, Homo sapiens
tgaaacaaatatac

SEQ ID NO: 3650935 - DNA, 18 bp, Homo sapiens
tgaaacaaatatactcat

SEQ ID NO: 3650936 - DNA, 14 bp, Homo sapiens
tgaaattagtattt

SEQ ID NO: 3650937 - DNA, 16 bp, Homo sapiens
tgaaattagtattttg

SEQ ID NO: 3650938 - DNA, 19 bp, Homo sapiens
tgaaattagtattttgagc

SEQ ID NO: 3650939 - DNA, 23 bp, Homo sapiens
tgaaattagtgttttcattctgg

SEQ ID NO: 3650940 - DNA, 19 bp, Homo sapiens
tgaacatggtcagaacctt

SEQ ID NO: 3650941 - DNA, 11 bp, Homo sapiens
tgaactttgct

SEQ ID NO: 3650942 - DNA, 15 bp, Homo sapiens
tgaactttgctgagc

SEQ ID NO: 3650943 - DNA, 17 bp, Homo sapiens
tgaagaaaatccttcag

SEQ ID NO: 3650944 - DNA, 17 bp, Homo sapiens
tgaagaaacacagcatg

SEQ ID NO: 3650945 - DNA, 19 bp, Homo sapiens
tgaagaaacacagcatgca

SEQ ID NO: 3650946 - DNA, 21 bp, Homo sapiens
tgaagaaacacagcatgcatt

SEQ ID NO: 3650947 - DNA, 17 bp, Homo sapiens
tgaagggaagcccagcc

SEQ ID NO: 3650948 - DNA, 15 bp, Homo sapiens
tgaataaaatgttta

SEQ ID NO: 3650949 - DNA, 17 bp, Homo sapiens
tgaatccatcgatttgt

SEQ ID NO: 3650950 - DNA, 21 bp, Homo sapiens
tgaatccatcgatttgtatta

SEQ ID NO: 3650951 - DNA, 22 bp, Homo sapiens
tgaatgagtttccagctaagcc

SEQ ID NO: 3650952 - DNA, 21 bp, Homo sapiens
tgaatgataatagctcacagc

SEQ ID NO: 3650953 - DNA, 18 bp, Homo sapiens
tgaatggttgcaaagtgt

SEQ ID NO: 3650954 - DNA, 14 bp, Homo sapiens
tgaattgaaagaga

SEQ ID NO: 3650955 - DNA, 16 bp, Homo sapiens
tgaattgaaagagaat

SEQ ID NO: 3650956 - DNA, 18 bp, Homo sapiens
tgaattgaaagagaattt

SEQ ID NO: 3650957 - DNA, 13 bp, Homo sapiens
tgaatttaccatc

SEQ ID NO: 3650958 - DNA, 18 bp, Homo sapiens
tgaatttaccatcaaaca

SEQ ID NO: 3650959 - DNA, 18 bp, Homo sapiens
tgacactcatcaggtaaa

SEQ ID NO: 3650960 - DNA, 15 bp, Homo sapiens
tgacaggacatttga

SEQ ID NO: 3650961 - DNA, 16 bp, Homo sapiens
tgacatgagtctccag

SEQ ID NO: 3650962 - DNA, 13 bp, Homo sapiens
tgacattgtcaga

SEQ ID NO: 3650963 - DNA, 22 bp, Homo sapiens
tgacattgtcagaatgttgtgt

SEQ ID NO: 3650964 - DNA, 17 bp, Homo sapiens
tgacctcgtgatccgcc

SEQ ID NO: 3650965 - DNA, 22 bp, Homo sapiens
tgagatcccagagttatttccc

SEQ ID NO: 3650966 - DNA, 17 bp, Homo sapiens
tgagatgatttaattct

SEQ ID NO: 3650967 - DNA, 18 bp, Homo sapiens
tgagatgatttaattctt

SEQ ID NO: 3650968 - DNA, 18 bp, Homo sapiens
tgagattggaaaaaatta

SEQ ID NO: 3650969 - DNA, 21 bp, Homo sapiens
tgagcagtaaatgtatattga

SEQ ID NO: 3650970 - DNA, 16 bp, Homo sapiens
tgaggaaactcataca

SEQ ID NO: 3650971 - DNA, 13 bp, Homo sapiens
tgaggcaactcag

SEQ ID NO: 3650972 - DNA, 15 bp, Homo sapiens
tgaggcaactcagca

SEQ ID NO: 3650973 - DNA, 16 bp, Homo sapiens
tgaggcacatgacagt

SEQ ID NO: 3650974 - DNA, 17 bp, Homo sapiens
tgagtgcaagagcctga

SEQ ID NO: 3650975 - DNA, 23 bp, Homo sapiens
tgagtgcaagagcctgagactgg

SEQ ID NO: 3650976 - DNA, 21 bp, Homo sapiens
tgagttctgcacatacagatg

SEQ ID NO: 3650977 - DNA, 21 bp, Homo sapiens
tgagttggttacctattgctg

SEQ ID NO: 3650978 - DNA, 18 bp, Homo sapiens
tgataattgtaaaggtga

SEQ ID NO: 3650979 - DNA, 16 bp, Homo sapiens
tgatagaagaaggact

SEQ ID NO: 3650980 - DNA, 15 bp, Homo sapiens
tgatatctgtttgct

SEQ ID NO: 3650981 - DNA, 17 bp, Homo sapiens
tgatgaataaaatgttt

SEQ ID NO: 3650982 - DNA, 15 bp, Homo sapiens
tgatgctagttctta

SEQ ID NO: 3650983 - DNA, 15 bp, Homo sapiens
tgatggagagggatg

SEQ ID NO: 3650984 - DNA, 18 bp, Homo sapiens
tgattattacaacaagca

SEQ ID NO: 3650985 - DNA, 15 bp, Homo sapiens
tgattcttgtgtcat

SEQ ID NO: 3650986 - DNA, 21 bp, Homo sapiens
tgattcttgtgtcatcaagta

SEQ ID NO: 3650987 - DNA, 13 bp, Homo sapiens
tgatttaacatta

SEQ ID NO: 3650988 - DNA, 16 bp, Homo sapiens
tgatttctgaactatc

SEQ ID NO: 3650989 - DNA, 14 bp, Homo sapiens
tgcaaaaagggtca

SEQ ID NO: 3650990 - DNA, 17 bp, Homo sapiens
tgcaaagtgttgtctta

SEQ ID NO: 3650991 - DNA, 12 bp, Homo sapiens
tgcaacactgcc

SEQ ID NO: 3650992 - DNA, 16 bp, Homo sapiens
tgcaacactgccaaac

SEQ ID NO: 3650993 - DNA, 18 bp, Homo sapiens
tgcaacagactgccttat

SEQ ID NO: 3650994 - DNA, 21 bp, Homo sapiens
tgcactcttttgagcagtaaa

SEQ ID NO: 3650995 - DNA, 20 bp, Homo sapiens
tgcactgcagttatttacca

SEQ ID NO: 3650996 - DNA, 16 bp, Homo sapiens
tgcagctaatttgtga

SEQ ID NO: 3650997 - DNA, 21 bp, Homo sapiens
tgcagctaatttgtgaaagtg

SEQ ID NO: 3650998 - DNA, 19 bp, Homo sapiens
tgcaggaaaaggctgcagc

SEQ ID NO: 3650999 - DNA, 13 bp, Homo sapiens
tgcagtgagctga

SEQ ID NO: 3651000 - DNA, 20 bp, Homo sapiens
tgcagtttggtatgaaacaa

SEQ ID NO: 3651001 - DNA, 21 bp, Homo sapiens
tgcagtttggtatgaaacaaa

SEQ ID NO: 3651002 - DNA, 16 bp, Homo sapiens
tgcatctagctggagc

SEQ ID NO: 3651003 - DNA, 16 bp, Homo sapiens
tgcatgaatccatcga

SEQ ID NO: 3651004 - DNA, 13 bp, Homo sapiens
tgcatgttaaaat

SEQ ID NO: 3651005 - DNA, 17 bp, Homo sapiens
tgcattcagatctgaag

SEQ ID NO: 3651006 - DNA, 16 bp, Homo sapiens
tgcatttagcatgagt

SEQ ID NO: 3651007 - DNA, 15 bp, Homo sapiens
tgccaatgacaggac

SEQ ID NO: 3651008 - DNA, 19 bp, Homo sapiens
tgccattacactccagcct

SEQ ID NO: 3651009 - DNA, 20 bp, Homo sapiens
tgccattacactccagcctg

SEQ ID NO: 3651010 - DNA, 22 bp, Homo sapiens
tgccattacactccagcctggg

SEQ ID NO: 3651011 - DNA, 15 bp, Homo sapiens
tgcccatttcacaca

SEQ ID NO: 3651012 - DNA, 16 bp, Homo sapiens
tgcccatttcacacaa

SEQ ID NO: 3651013 - DNA, 18 bp, Homo sapiens
tgcccatttcacacaact

SEQ ID NO: 3651014 - DNA, 16 bp, Homo sapiens
tgcctcccttcatgca

SEQ ID NO: 3651015 - DNA, 19 bp, Homo sapiens
tgcctgttaggtctgttga

SEQ ID NO: 3651016 - DNA, 20 bp, Homo sapiens
tgccttatattattttctgt

SEQ ID NO: 3651017 - DNA, 15 bp, Homo sapiens
tgcctttctagcaat

SEQ ID NO: 3651018 - DNA, 13 bp, Homo sapiens
tgcctttgacctg

SEQ ID NO: 3651019 - DNA, 20 bp, Homo sapiens
tgcgagtgctcatttcagga

SEQ ID NO: 3651020 - DNA, 21 bp, Homo sapiens
tgcgtttcttccactgagtct

SEQ ID NO: 3651021 - DNA, 21 bp, Homo sapiens
tgctaaagtcaggccattcag

SEQ ID NO: 3651022 - DNA, 15 bp, Homo sapiens
tgctacaaaatgtgt

SEQ ID NO: 3651023 - DNA, 16 bp, Homo sapiens
tgctagaggtggcatg

SEQ ID NO: 3651024 - DNA, 14 bp, Homo sapiens
tgctcatctacaca

SEQ ID NO: 3651025 - DNA, 20 bp, Homo sapiens
tgctcatctacacatataaa

SEQ ID NO: 3651026 - DNA, 21 bp, Homo sapiens
tgctcatctacacatataaac

SEQ ID NO: 3651027 - DNA, 21 bp, Homo sapiens
tgctgtatttgaggaaactca

SEQ ID NO: 3651028 - DNA, 15 bp, Homo sapiens
tgctgtgaaatgact

SEQ ID NO: 3651029 - DNA, 13 bp, Homo sapiens
tgctgtggcatca

SEQ ID NO: 3651030 - DNA, 20 bp, Homo sapiens
tgctgtgtgcagagtataca

SEQ ID NO: 3651031 - DNA, 13 bp, Homo sapiens
tgctgttcattga

SEQ ID NO: 3651032 - DNA, 12 bp, Homo sapiens
tgcttcacacaa

SEQ ID NO: 3651033 - DNA, 16 bp, Homo sapiens
tgcttcacacaaagtg

SEQ ID NO: 3651034 - DNA, 21 bp, Homo sapiens
tgcttcacacaaagtgaaatt

SEQ ID NO: 3651035 - DNA, 17 bp, Homo sapiens
tgctttatcagaagcaa

SEQ ID NO: 3651036 - DNA, 12 bp, Homo sapiens
tgctttctgata

SEQ ID NO: 3651037 - DNA, 15 bp, Homo sapiens
tgctttctgatacat

SEQ ID NO: 3651038 - DNA, 16 bp, Homo sapiens
tgctttctgatacatc

SEQ ID NO: 3651039 - DNA, 19 bp, Homo sapiens
tggaaataacgggtggcat

SEQ ID NO: 3651040 - DNA, 15 bp, Homo sapiens
tggaaatttgtgtgc

SEQ ID NO: 3651041 - DNA, 16 bp, Homo sapiens
tggaaatttgtgtgct

SEQ ID NO: 3651042 - DNA, 23 bp, Homo sapiens
tggaaatttgtgtgcttcacaca

SEQ ID NO: 3651043 - DNA, 22 bp, Homo sapiens
tggaagaagaaccaggcatgga

SEQ ID NO: 3651044 - DNA, 18 bp, Homo sapiens
tggaagacctaaggcaga

SEQ ID NO: 3651045 - DNA, 22 bp, Homo sapiens
tggaagagctgctgtatttgag

SEQ ID NO: 3651046 - DNA, 20 bp, Homo sapiens
tggacaaaagtttatctttg

SEQ ID NO: 3651047 - DNA, 19 bp, Homo sapiens
tggagactaacttattttg

SEQ ID NO: 3651048 - DNA, 18 bp, Homo sapiens
tggaggaaggaaacaaca

SEQ ID NO: 3651049 - DNA, 14 bp, Homo sapiens
tggaggtagggctg

SEQ ID NO: 3651050 - DNA, 21 bp, Homo sapiens
tggaggtagggctggctggag

SEQ ID NO: 3651051 - DNA, 12 bp, Homo sapiens
tggatataaatc

SEQ ID NO: 3651052 - DNA, 18 bp, Homo sapiens
tggattttaaacaaaatt

SEQ ID NO: 3651053 - DNA, 18 bp, Homo sapiens
tggcaacatttggggaga

SEQ ID NO: 3651054 - DNA, 21 bp, Homo sapiens
tggcaagctcttcattgcact

SEQ ID NO: 3651055 - DNA, 12 bp, Homo sapiens
tggcagggctgt

SEQ ID NO: 3651056 - DNA, 24 bp, Homo sapiens
tggcagggctgttccctccaggca

SEQ ID NO: 3651057 - DNA, 15 bp, Homo sapiens
tggcaggtgcagccc

SEQ ID NO: 3651058 - DNA, 20 bp, Homo sapiens
tggcattgggtggcaacatt

SEQ ID NO: 3651059 - DNA, 16 bp, Homo sapiens
tggccaacatggtgaa

SEQ ID NO: 3651060 - DNA, 20 bp, Homo sapiens
tggccacaagttctttccca

SEQ ID NO: 3651061 - DNA, 11 bp, Homo sapiens
tggctgaagaa

SEQ ID NO: 3651062 - DNA, 18 bp, Homo sapiens
tggctgaagaaacacagc

SEQ ID NO: 3651063 - DNA, 16 bp, Homo sapiens
tggctggaggaaggaa

SEQ ID NO: 3651064 - DNA, 17 bp, Homo sapiens
tggctggaggaaggaaa

SEQ ID NO: 3651065 - DNA, 23 bp, Homo sapiens
tgggaaatgagatcccagagtta

SEQ ID NO: 3651066 - DNA, 19 bp, Homo sapiens
tgggaatgtcctgtagaga

SEQ ID NO: 3651067 - DNA, 22 bp, Homo sapiens
tgggaatgtcctgtagagagag

SEQ ID NO: 3651068 - DNA, 16 bp, Homo sapiens
tgggagatggaggtag

SEQ ID NO: 3651069 - DNA, 23 bp, Homo sapiens
tgggagatggaggtagggctggc

SEQ ID NO: 3651070 - DNA, 14 bp, Homo sapiens
tgggaggccgaggc

SEQ ID NO: 3651071 - DNA, 21 bp, Homo sapiens
tgggattacaggcatgagcca

SEQ ID NO: 3651072 - DNA, 19 bp, Homo sapiens
tgggcaatcctgggctggc

SEQ ID NO: 3651073 - DNA, 12 bp, Homo sapiens
tgggcagacagg

SEQ ID NO: 3651074 - DNA, 17 bp, Homo sapiens
tgggcccttagaatgtg

SEQ ID NO: 3651075 - DNA, 15 bp, Homo sapiens
tgggcgaaagggtga

SEQ ID NO: 3651076 - DNA, 20 bp, Homo sapiens
tgggctgaagggaagcccag

SEQ ID NO: 3651077 - DNA, 14 bp, Homo sapiens
tgggctggagagtt

SEQ ID NO: 3651078 - DNA, 22 bp, Homo sapiens
tgggtggcaacatttggggaga

SEQ ID NO: 3651079 - DNA, 23 bp, Homo sapiens
tgggtggcaacatttggggagag

SEQ ID NO: 3651080 - DNA, 16 bp, Homo sapiens
tgggttagggaaaaca

SEQ ID NO: 3651081 - DNA, 19 bp, Homo sapiens
tgggttttgatctcagcat

SEQ ID NO: 3651082 - DNA, 17 bp, Homo sapiens
tggtatcttgagtcttg

SEQ ID NO: 3651083 - DNA, 16 bp, Homo sapiens
tggtattttttgtgaa

SEQ ID NO: 3651084 - DNA, 15 bp, Homo sapiens
tggtccttagtaaat

SEQ ID NO: 3651085 - DNA, 17 bp, Homo sapiens
tggtccttagtaaattc

SEQ ID NO: 3651086 - DNA, 22 bp, Homo sapiens
tggtctgtgttctcaacacaca

SEQ ID NO: 3651087 - DNA, 18 bp, Homo sapiens
tggtgagtgcaagagcct

SEQ ID NO: 3651088 - DNA, 21 bp, Homo sapiens
tggttaaccgggactacagaa

SEQ ID NO: 3651089 - DNA, 18 bp, Homo sapiens
tggttaatgaaaaatctg

SEQ ID NO: 3651090 - DNA, 19 bp, Homo sapiens
tggttaatgaaaaatctga

SEQ ID NO: 3651091 - DNA, 15 bp, Homo sapiens
tggttacctattgct

SEQ ID NO: 3651092 - DNA, 20 bp, Homo sapiens
tggttgcaaagtgttgtctt

SEQ ID NO: 3651093 - DNA, 17 bp, Homo sapiens
tgtaaaggtgatgaatt

SEQ ID NO: 3651094 - DNA, 19 bp, Homo sapiens
tgtaaataaaaatagctat

SEQ ID NO: 3651095 - DNA, 20 bp, Homo sapiens
tgtaaatgatatgtctttaa

SEQ ID NO: 3651096 - DNA, 21 bp, Homo sapiens
tgtaaatgatatgtctttaaa

SEQ ID NO: 3651097 - DNA, 23 bp, Homo sapiens
tgtaattcttctcctttgtcaaa

SEQ ID NO: 3651098 - DNA, 15 bp, Homo sapiens
tgtagagagagacct

SEQ ID NO: 3651099 - DNA, 15 bp, Homo sapiens
tgtattattatatat

SEQ ID NO: 3651100 - DNA, 15 bp, Homo sapiens
tgtatttgaggaaac

SEQ ID NO: 3651101 - DNA, 11 bp, Homo sapiens
tgtcagaatgt

SEQ ID NO: 3651102 - DNA, 18 bp, Homo sapiens
tgtcattttcagatcctt

SEQ ID NO: 3651103 - DNA, 21 bp, Homo sapiens
tgtcctgcatgtatgccatgt

SEQ ID NO: 3651104 - DNA, 17 bp, Homo sapiens
tgtcgtggactccagct

SEQ ID NO: 3651105 - DNA, 17 bp, Homo sapiens
tgtctcccagggacatg

SEQ ID NO: 3651106 - DNA, 20 bp, Homo sapiens
tgtgaatggttgcaaagtgt

SEQ ID NO: 3651107 - DNA, 21 bp, Homo sapiens
tgtgcagagtatacaagtgtt

SEQ ID NO: 3651108 - DNA, 16 bp, Homo sapiens
tgtgcccacttaccct

SEQ ID NO: 3651109 - DNA, 22 bp, Homo sapiens
tgtgctattcgtaagttctgtg

SEQ ID NO: 3651110 - DNA, 18 bp, Homo sapiens
tgtgctgctgtggcatca

SEQ ID NO: 3651111 - DNA, 13 bp, Homo sapiens
tgtgcttcacaca

SEQ ID NO: 3651112 - DNA, 23 bp, Homo sapiens
tgtgcttcacacaaagtgaaatt

SEQ ID NO: 3651113 - DNA, 19 bp, Homo sapiens
tgtggggatggtgatggag

SEQ ID NO: 3651114 - DNA, 22 bp, Homo sapiens
tgtgtgcagagtatacaagtgt

SEQ ID NO: 3651115 - DNA, 15 bp, Homo sapiens
tgtgtgcttcacaca

SEQ ID NO: 3651116 - DNA, 16 bp, Homo sapiens
tgtgtgcttcacacaa

SEQ ID NO: 3651117 - DNA, 20 bp, Homo sapiens
tgtgtgcttcacacaaagtg

SEQ ID NO: 3651118 - DNA, 12 bp, Homo sapiens
tgtgttacaata

SEQ ID NO: 3651119 - DNA, 19 bp, Homo sapiens
tgtgttctcaacacacagt

SEQ ID NO: 3651120 - DNA, 20 bp, Homo sapiens
tgtgttctcaacacacagta

SEQ ID NO: 3651121 - DNA, 22 bp, Homo sapiens
tgtgttggtatttactgcaatg

SEQ ID NO: 3651122 - DNA, 19 bp, Homo sapiens
tgttaaatctacaaacttt

SEQ ID NO: 3651123 - DNA, 21 bp, Homo sapiens
tgttataaaatctgtattgct

SEQ ID NO: 3651124 - DNA, 20 bp, Homo sapiens
tgttattcaataactattgc

SEQ ID NO: 3651125 - DNA, 12 bp, Homo sapiens
tgttctcaacac

SEQ ID NO: 3651126 - DNA, 16 bp, Homo sapiens
tgttctcaacacacag

SEQ ID NO: 3651127 - DNA, 16 bp, Homo sapiens
tgttctgacagcattt

SEQ ID NO: 3651128 - DNA, 19 bp, Homo sapiens
tgttctgggttaacagtaa

SEQ ID NO: 3651129 - DNA, 15 bp, Homo sapiens
tgttgaagtgcatgt

SEQ ID NO: 3651130 - DNA, 22 bp, Homo sapiens
tgttgaagtgcatgttaaaata

SEQ ID NO: 3651131 - DNA, 20 bp, Homo sapiens
tgttggccatcatttcattc

SEQ ID NO: 3651132 - DNA, 15 bp, Homo sapiens
tgttggtatttactg

SEQ ID NO: 3651133 - DNA, 21 bp, Homo sapiens
tgttggtatttactgcaatgt

SEQ ID NO: 3651134 - DNA, 13 bp, Homo sapiens
tgttgtcttattc

SEQ ID NO: 3651135 - DNA, 18 bp, Homo sapiens
tgttgtggggatggtgat

SEQ ID NO: 3651136 - DNA, 13 bp, Homo sapiens
tgttgtgttacaa

SEQ ID NO: 3651137 - DNA, 18 bp, Homo sapiens
tgttgtgttacaataagt

SEQ ID NO: 3651138 - DNA, 20 bp, Homo sapiens
tgttttacaaagaaacaaaa

SEQ ID NO: 3651139 - DNA, 22 bp, Homo sapiens
tgttttacaaagaaacaaaata

SEQ ID NO: 3651140 - DNA, 13 bp, Homo sapiens
ttaaaacaaaatc

SEQ ID NO: 3651141 - DNA, 23 bp, Homo sapiens
ttaaaatatagtgttgtgttaca

SEQ ID NO: 3651142 - DNA, 17 bp, Homo sapiens
ttaaaatattttcttaa

SEQ ID NO: 3651143 - DNA, 14 bp, Homo sapiens
ttaaacaaaattta

SEQ ID NO: 3651144 - DNA, 12 bp, Homo sapiens
ttaaatctttgt

SEQ ID NO: 3651145 - DNA, 15 bp, Homo sapiens
ttaaatctttgttaa

SEQ ID NO: 3651146 - DNA, 17 bp, Homo sapiens
ttaaatctttgttaaaa

SEQ ID NO: 3651147 - DNA, 21 bp, Homo sapiens
ttaaatctttgttaaaatata

SEQ ID NO: 3651148 - DNA, 13 bp, Homo sapiens
ttaaatgaaatac

SEQ ID NO: 3651149 - DNA, 14 bp, Homo sapiens
ttaaatttattaaa

SEQ ID NO: 3651150 - DNA, 15 bp, Homo sapiens
ttaaatttattaaat

SEQ ID NO: 3651151 - DNA, 13 bp, Homo sapiens
ttaacagtaaata

SEQ ID NO: 3651152 - DNA, 21 bp, Homo sapiens
ttaaccgggactacagaagtg

SEQ ID NO: 3651153 - DNA, 16 bp, Homo sapiens
ttaagagcataaacaa

SEQ ID NO: 3651154 - DNA, 13 bp, Homo sapiens
ttaatagtttcta

SEQ ID NO: 3651155 - DNA, 19 bp, Homo sapiens
ttaatgaaaaatctgaatt

SEQ ID NO: 3651156 - DNA, 13 bp, Homo sapiens
ttaatgattcttg

SEQ ID NO: 3651157 - DNA, 10 bp, Homo sapiens
ttaattattt

SEQ ID NO: 3651158 - DNA, 17 bp, Homo sapiens
ttaattcttaccgaaat

SEQ ID NO: 3651159 - DNA, 21 bp, Homo sapiens
ttaattcttaccgaaatgaaa

SEQ ID NO: 3651160 - DNA, 14 bp, Homo sapiens
ttacaaagaaacaa

SEQ ID NO: 3651161 - DNA, 18 bp, Homo sapiens
ttacaacaagcaaactga

SEQ ID NO: 3651162 - DNA, 19 bp, Homo sapiens
ttacaacaagcaaactgaa

SEQ ID NO: 3651163 - DNA, 18 bp, Homo sapiens
ttacacacctgagaatgt

SEQ ID NO: 3651164 - DNA, 15 bp, Homo sapiens
ttacagaaacacgga

SEQ ID NO: 3651165 - DNA, 15 bp, Homo sapiens
ttactaactgtggac

SEQ ID NO: 3651166 - DNA, 20 bp, Homo sapiens
ttactgcaatgtctgtccct

SEQ ID NO: 3651167 - DNA, 18 bp, Homo sapiens
ttagaaaaaactggaaac

SEQ ID NO: 3651168 - DNA, 22 bp, Homo sapiens
ttagaaaaaactggaaacatct

SEQ ID NO: 3651169 - DNA, 15 bp, Homo sapiens
ttagaatgtgaaaaa

SEQ ID NO: 3651170 - DNA, 14 bp, Homo sapiens
ttagacactatgtg

SEQ ID NO: 3651171 - DNA, 15 bp, Homo sapiens
ttagcagtccatttt

SEQ ID NO: 3651172 - DNA, 18 bp, Homo sapiens
ttagcagtccatttttga

SEQ ID NO: 3651173 - DNA, 16 bp, Homo sapiens
ttagcttcctgcagga

SEQ ID NO: 3651174 - DNA, 14 bp, Homo sapiens
ttaggggtcctctt

SEQ ID NO: 3651175 - DNA, 11 bp, Homo sapiens
ttagtaaattc

SEQ ID NO: 3651176 - DNA, 13 bp, Homo sapiens
ttagtgttttcat

SEQ ID NO: 3651177 - DNA, 15 bp, Homo sapiens
ttataaatgttttaa

SEQ ID NO: 3651178 - DNA, 19 bp, Homo sapiens
ttatactatttattaaaac

SEQ ID NO: 3651179 - DNA, 20 bp, Homo sapiens
ttatatatgtatatctgtgt

SEQ ID NO: 3651180 - DNA, 19 bp, Homo sapiens
ttatcagaagcaaggaagt

SEQ ID NO: 3651181 - DNA, 22 bp, Homo sapiens
ttatccactacaggttttatga

SEQ ID NO: 3651182 - DNA, 20 bp, Homo sapiens
ttatcctcaagttgtgtgct

SEQ ID NO: 3651183 - DNA, 14 bp, Homo sapiens
ttatcttggatgag

SEQ ID NO: 3651184 - DNA, 12 bp, Homo sapiens
ttatctttaaaa

SEQ ID NO: 3651185 - DNA, 20 bp, Homo sapiens
ttatgagacttcctattaat

SEQ ID NO: 3651186 - DNA, 13 bp, Homo sapiens
ttattaaaatatt

SEQ ID NO: 3651187 - DNA, 21 bp, Homo sapiens
ttattaaaatattttcttaat

SEQ ID NO: 3651188 - DNA, 22 bp, Homo sapiens
ttattaaaatattttcttaatt

SEQ ID NO: 3651189 - DNA, 15 bp, Homo sapiens
ttattaaatttatta

SEQ ID NO: 3651190 - DNA, 16 bp, Homo sapiens
ttattaaatttattaa

SEQ ID NO: 3651191 - DNA, 18 bp, Homo sapiens
ttattaaatttattaaat

SEQ ID NO: 3651192 - DNA, 13 bp, Homo sapiens
ttattcaataact

SEQ ID NO: 3651193 - DNA, 21 bp, Homo sapiens
ttattcggtgatgactcttgt

SEQ ID NO: 3651194 - DNA, 22 bp, Homo sapiens
ttatttcccaacccaggattca

SEQ ID NO: 3651195 - DNA, 13 bp, Homo sapiens
ttattttctgaga

SEQ ID NO: 3651196 - DNA, 14 bp, Homo sapiens
ttattttctgtaat

SEQ ID NO: 3651197 - DNA, 15 bp, Homo sapiens
ttcaaattctgatta

SEQ ID NO: 3651198 - DNA, 20 bp, Homo sapiens
ttcaaccccacttcctactg

SEQ ID NO: 3651199 - DNA, 18 bp, Homo sapiens
ttcaagcattgctaaagt

SEQ ID NO: 3651200 - DNA, 20 bp, Homo sapiens
ttcaatcaacagaattgttc

SEQ ID NO: 3651201 - DNA, 17 bp, Homo sapiens
ttcaatgttaaatctac

SEQ ID NO: 3651202 - DNA, 18 bp, Homo sapiens
ttcacagttcctctttgt

SEQ ID NO: 3651203 - DNA, 16 bp, Homo sapiens
ttcacttttattgtat

SEQ ID NO: 3651204 - DNA, 14 bp, Homo sapiens
ttcagatccttcca

SEQ ID NO: 3651205 - DNA, 20 bp, Homo sapiens
ttcagatccttccaaactct

SEQ ID NO: 3651206 - DNA, 20 bp, Homo sapiens
ttcaggttcctacaggagat

SEQ ID NO: 3651207 - DNA, 23 bp, Homo sapiens
ttcatataggggcaaaaatttga

SEQ ID NO: 3651208 - DNA, 20 bp, Homo sapiens
ttcatctcaggtggcatttg

SEQ ID NO: 3651209 - DNA, 23 bp, Homo sapiens
ttcatctggaaccatcagaaaca

SEQ ID NO: 3651210 - DNA, 21 bp, Homo sapiens
ttcattcgtgggcctgctgct

SEQ ID NO: 3651211 - DNA, 22 bp, Homo sapiens
ttcattctggtccttagtaaat

SEQ ID NO: 3651212 - DNA, 13 bp, Homo sapiens
ttcattgcactgc

SEQ ID NO: 3651213 - DNA, 20 bp, Homo sapiens
ttccacccccgttagcttcc

SEQ ID NO: 3651214 - DNA, 21 bp, Homo sapiens
ttccagctaagcctgatgatg

SEQ ID NO: 3651215 - DNA, 13 bp, Homo sapiens
ttccatcccactc

SEQ ID NO: 3651216 - DNA, 14 bp, Homo sapiens
ttccatcccactcc

SEQ ID NO: 3651217 - DNA, 15 bp, Homo sapiens
ttccattctggaagt

SEQ ID NO: 3651218 - DNA, 14 bp, Homo sapiens
ttcccttcatctgg

SEQ ID NO: 3651219 - DNA, 17 bp, Homo sapiens
ttcctacggtacaagct

SEQ ID NO: 3651220 - DNA, 13 bp, Homo sapiens
ttcctgcaggact

SEQ ID NO: 3651221 - DNA, 13 bp, Homo sapiens
ttcctttcttcct

SEQ ID NO: 3651222 - DNA, 16 bp, Homo sapiens
ttcctttcttccttcc

SEQ ID NO: 3651223 - DNA, 18 bp, Homo sapiens
ttcgtaagttctgtgcag

SEQ ID NO: 3651224 - DNA, 14 bp, Homo sapiens
ttctatatttactg

SEQ ID NO: 3651225 - DNA, 22 bp, Homo sapiens
ttctatgattaaactgggaaat

SEQ ID NO: 3651226 - DNA, 15 bp, Homo sapiens
ttctcaacacacagt

SEQ ID NO: 3651227 - DNA, 15 bp, Homo sapiens
ttctcagaagtgaaa

SEQ ID NO: 3651228 - DNA, 16 bp, Homo sapiens
ttctcagaagtgaaaa

SEQ ID NO: 3651229 - DNA, 22 bp, Homo sapiens
ttctcagaagtgaaaaagactt

SEQ ID NO: 3651230 - DNA, 16 bp, Homo sapiens
ttctcctttgtcaaat

SEQ ID NO: 3651231 - DNA, 12 bp, Homo sapiens
ttctctaaaaca

SEQ ID NO: 3651232 - DNA, 14 bp, Homo sapiens
ttctgcacatacag

SEQ ID NO: 3651233 - DNA, 15 bp, Homo sapiens
ttctgcacatacaga

SEQ ID NO: 3651234 - DNA, 13 bp, Homo sapiens
ttctgctttctga

SEQ ID NO: 3651235 - DNA, 21 bp, Homo sapiens
ttctgtaatactaagtcctca

SEQ ID NO: 3651236 - DNA, 13 bp, Homo sapiens
ttctgtaattctt

SEQ ID NO: 3651237 - DNA, 14 bp, Homo sapiens
ttctgtcaatgaaa

SEQ ID NO: 3651238 - DNA, 16 bp, Homo sapiens
ttctgttggtcttaac

SEQ ID NO: 3651239 - DNA, 16 bp, Homo sapiens
ttcttaacttctgaaa

SEQ ID NO: 3651240 - DNA, 23 bp, Homo sapiens
ttcttaaggacagtgttcaaatt

SEQ ID NO: 3651241 - DNA, 16 bp, Homo sapiens
ttcttaccgaaatgaa

SEQ ID NO: 3651242 - DNA, 19 bp, Homo sapiens
ttcttaccgaaatgaaaat

SEQ ID NO: 3651243 - DNA, 11 bp, Homo sapiens
ttcttccttcc

SEQ ID NO: 3651244 - DNA, 21 bp, Homo sapiens
ttcttctcctttgtcaaatgg

SEQ ID NO: 3651245 - DNA, 14 bp, Homo sapiens
ttcttggtatgatc

SEQ ID NO: 3651246 - DNA, 21 bp, Homo sapiens
ttctttccttccttttttcct

SEQ ID NO: 3651247 - DNA, 18 bp, Homo sapiens
ttgaacctgtgaggaaga

SEQ ID NO: 3651248 - DNA, 18 bp, Homo sapiens
ttgaagtgcatgttaaaa

SEQ ID NO: 3651249 - DNA, 12 bp, Homo sapiens
ttgaatgataat

SEQ ID NO: 3651250 - DNA, 20 bp, Homo sapiens
ttgacattgtcagaatgttg

SEQ ID NO: 3651251 - DNA, 15 bp, Homo sapiens
ttgagcatgcccaaa

SEQ ID NO: 3651252 - DNA, 20 bp, Homo sapiens
ttgagcatgcccaaatataa

SEQ ID NO: 3651253 - DNA, 12 bp, Homo sapiens
ttgagtaaaact

SEQ ID NO: 3651254 - DNA, 13 bp, Homo sapiens
ttgagtcttggtt

SEQ ID NO: 3651255 - DNA, 19 bp, Homo sapiens
ttgatgtattattatatat

SEQ ID NO: 3651256 - DNA, 15 bp, Homo sapiens
ttgcaacactgccaa

SEQ ID NO: 3651257 - DNA, 16 bp, Homo sapiens
ttgcaacactgccaaa

SEQ ID NO: 3651258 - DNA, 21 bp, Homo sapiens
ttgcactgcagttatttacca

SEQ ID NO: 3651259 - DNA, 14 bp, Homo sapiens
ttgcagtgagctga

SEQ ID NO: 3651260 - DNA, 21 bp, Homo sapiens
ttgcccattctctaagcctgg

SEQ ID NO: 3651261 - DNA, 16 bp, Homo sapiens
ttgccttgggcctggg

SEQ ID NO: 3651262 - DNA, 19 bp, Homo sapiens
ttgctaagataattaaatg

SEQ ID NO: 3651263 - DNA, 21 bp, Homo sapiens
ttgctctccctcccttctttc

SEQ ID NO: 3651264 - DNA, 15 bp, Homo sapiens
ttgctgtaaataaaa

SEQ ID NO: 3651265 - DNA, 17 bp, Homo sapiens
ttgctgtgaaatgactg

SEQ ID NO: 3651266 - DNA, 19 bp, Homo sapiens
ttgcttgaacctgtgagga

SEQ ID NO: 3651267 - DNA, 12 bp, Homo sapiens
ttggaagaagtg

SEQ ID NO: 3651268 - DNA, 15 bp, Homo sapiens
ttggacaagaggaaa

SEQ ID NO: 3651269 - DNA, 22 bp, Homo sapiens
ttggagagagattcagaagtta

SEQ ID NO: 3651270 - DNA, 20 bp, Homo sapiens
ttggctagaatcagggtgga

SEQ ID NO: 3651271 - DNA, 18 bp, Homo sapiens
ttgggcccttagaatgtg

SEQ ID NO: 3651272 - DNA, 21 bp, Homo sapiens
ttggggagagataatgaggca

SEQ ID NO: 3651273 - DNA, 23 bp, Homo sapiens
ttgggtggcaacatttggggaga

SEQ ID NO: 3651274 - DNA, 17 bp, Homo sapiens
ttggtaacttgctgtga

SEQ ID NO: 3651275 - DNA, 14 bp, Homo sapiens
ttggtatgaaacaa

SEQ ID NO: 3651276 - DNA, 17 bp, Homo sapiens
ttggtatttactgcaat

SEQ ID NO: 3651277 - DNA, 15 bp, Homo sapiens
ttggttaatgaaaaa

SEQ ID NO: 3651278 - DNA, 13 bp, Homo sapiens
ttgtcttattcct

SEQ ID NO: 3651279 - DNA, 23 bp, Homo sapiens
ttgtcttattcctaattcctgta

SEQ ID NO: 3651280 - DNA, 13 bp, Homo sapiens
ttgtgtgctattc

SEQ ID NO: 3651281 - DNA, 19 bp, Homo sapiens
ttgtgttacaataagtgtt

SEQ ID NO: 3651282 - DNA, 18 bp, Homo sapiens
ttgtgttggtatttactg

SEQ ID NO: 3651283 - DNA, 21 bp, Homo sapiens
ttgttaatgattcttgtgtca

SEQ ID NO: 3651284 - DNA, 21 bp, Homo sapiens
tttaaagaagtccatgtgata

SEQ ID NO: 3651285 - DNA, 17 bp, Homo sapiens
tttaaatctttgttaaa

SEQ ID NO: 3651286 - DNA, 22 bp, Homo sapiens
tttaaatctttgttaaaatata

SEQ ID NO: 3651287 - DNA, 21 bp, Homo sapiens
tttaattcttaccgaaatgaa

SEQ ID NO: 3651288 - DNA, 22 bp, Homo sapiens
tttaattcttaccgaaatgaaa

SEQ ID NO: 3651289 - DNA, 16 bp, Homo sapiens
tttactgcaatgtctg

SEQ ID NO: 3651290 - DNA, 19 bp, Homo sapiens
tttagaatcaagtctgtga

SEQ ID NO: 3651291 - DNA, 16 bp, Homo sapiens
tttagcagtccatttt

SEQ ID NO: 3651292 - DNA, 17 bp, Homo sapiens
tttatgtcattttcaga

SEQ ID NO: 3651293 - DNA, 13 bp, Homo sapiens
tttattaaatgtt

SEQ ID NO: 3651294 - DNA, 21 bp, Homo sapiens
tttattaaatttattaaatgt

SEQ ID NO: 3651295 - DNA, 13 bp, Homo sapiens
tttcacttcttaa

SEQ ID NO: 3651296 - DNA, 21 bp, Homo sapiens
tttcatagataccattttgaa

SEQ ID NO: 3651297 - DNA, 14 bp, Homo sapiens
tttccatcccactc

SEQ ID NO: 3651298 - DNA, 14 bp, Homo sapiens
tttcctcctgggca

SEQ ID NO: 3651299 - DNA, 22 bp, Homo sapiens
tttcctgttgttttcttaactt

SEQ ID NO: 3651300 - DNA, 16 bp, Homo sapiens
tttctagcaattgctt

SEQ ID NO: 3651301 - DNA, 14 bp, Homo sapiens
tttctgtaattctt

SEQ ID NO: 3651302 - DNA, 19 bp, Homo sapiens
tttctgtaattcttctcct

SEQ ID NO: 3651303 - DNA, 21 bp, Homo sapiens
tttcttccttcctttctctct

SEQ ID NO: 3651304 - DNA, 14 bp, Homo sapiens
tttcttctttaatt

SEQ ID NO: 3651305 - DNA, 15 bp, Homo sapiens
tttctttcccttact

SEQ ID NO: 3651306 - DNA, 20 bp, Homo sapiens
tttgacattgtcagaatgtt

SEQ ID NO: 3651307 - DNA, 19 bp, Homo sapiens
tttgagaccaacctgggta

SEQ ID NO: 3651308 - DNA, 12 bp, Homo sapiens
tttgaggaaact

SEQ ID NO: 3651309 - DNA, 24 bp, Homo sapiens
tttgatctcagcatcctggaaatt

SEQ ID NO: 3651310 - DNA, 22 bp, Homo sapiens
tttgatgtattattatatatgt

SEQ ID NO: 3651311 - DNA, 12 bp, Homo sapiens
tttgatttgcaa

SEQ ID NO: 3651312 - DNA, 21 bp, Homo sapiens
tttgcaacactgccaaacatc

SEQ ID NO: 3651313 - DNA, 19 bp, Homo sapiens
tttgcaaccttgtacttta

SEQ ID NO: 3651314 - DNA, 13 bp, Homo sapiens
tttggaagaattc

SEQ ID NO: 3651315 - DNA, 16 bp, Homo sapiens
tttggaagttttactt

SEQ ID NO: 3651316 - DNA, 14 bp, Homo sapiens
tttggacaagagga

SEQ ID NO: 3651317 - DNA, 13 bp, Homo sapiens
tttggggagagat

SEQ ID NO: 3651318 - DNA, 13 bp, Homo sapiens
tttgttaatgatt

SEQ ID NO: 3651319 - DNA, 22 bp, Homo sapiens
ttttaaagaagtccatgtgata

SEQ ID NO: 3651320 - DNA, 22 bp, Homo sapiens
ttttaacatagcagctggttaa

SEQ ID NO: 3651321 - DNA, 20 bp, Homo sapiens
ttttaattattttctgagac

SEQ ID NO: 3651322 - DNA, 14 bp, Homo sapiens
ttttacatatagct

SEQ ID NO: 3651323 - DNA, 12 bp, Homo sapiens
ttttcattctgg

SEQ ID NO: 3651324 - DNA, 16 bp, Homo sapiens
ttttctgtaattcttc

SEQ ID NO: 3651325 - DNA, 17 bp, Homo sapiens
ttttcttaacttctgaa

SEQ ID NO: 3651326 - DNA, 19 bp, Homo sapiens
ttttgagccttattaaaat

SEQ ID NO: 3651327 - DNA, 19 bp, Homo sapiens
ttttgatgtattattatat

SEQ ID NO: 3651328 - DNA, 23 bp, Homo sapiens
ttttgatgtattattatatatgt

SEQ ID NO: 3651329 - DNA, 17 bp, Homo sapiens
ttttgattgtttgatga

SEQ ID NO: 3651330 - DNA, 14 bp, Homo sapiens
ttttgtgaatggtt

SEQ ID NO: 3651331 - DNA, 16 bp, Homo sapiens
tttttaattattttct

SEQ ID NO: 3651332 - DNA, 14 bp, Homo sapiens
tttttgctctccct

SEQ ID NO: 3651333 - DNA, 15 bp, Homo sapiens
acagtaaatatacac

SEQ ID NO: 3651334 - DNA, 18 bp, Homo sapiens
acagtaaatatacacttt

SEQ ID NO: 3651335 - DNA, 22 bp, Homo sapiens
acagtaagataggttctgcttt

SEQ ID NO: 3651336 - DNA, 13 bp, Homo sapiens
acagtatttccat

SEQ ID NO: 3651337 - DNA, 16 bp, Homo sapiens
acagtctctatttgat

SEQ ID NO: 3651338 - DNA, 22 bp, Homo sapiens
acagtctctatttgatttgcaa

SEQ ID NO: 3651339 - DNA, 13 bp, Homo sapiens
acagtgttcaaat

SEQ ID NO: 3651340 - DNA, 19 bp, Homo sapiens
acagtgttcaaattctgat

SEQ ID NO: 3651341 - DNA, 18 bp, Homo sapiens
acatagtggtattttaac

SEQ ID NO: 3651342 - DNA, 22 bp, Homo sapiens
acatagtggtattttaacatag

SEQ ID NO: 3651343 - DNA, 13 bp, Homo sapiens
acatataaacaca

SEQ ID NO: 3651344 - DNA, 16 bp, Homo sapiens
acatataaacacagta

SEQ ID NO: 3651345 - DNA, 16 bp, Homo sapiens
acatatgtaggaaaat

SEQ ID NO: 3651346 - DNA, 20 bp, Homo sapiens
acatatgtaggaaaattttc

SEQ ID NO: 3651347 - DNA, 22 bp, Homo sapiens
acatatgtaggaaaattttctt

SEQ ID NO: 3651348 - DNA, 22 bp, Homo sapiens
acatattcccatggtagactgt

SEQ ID NO: 3651349 - DNA, 23 bp, Homo sapiens
acatctctgtaaaaagcaggtga

SEQ ID NO: 3651350 - DNA, 14 bp, Homo sapiens
acatctgatttctg

SEQ ID NO: 3651351 - DNA, 19 bp, Homo sapiens
acatctgatttctgaacta

SEQ ID NO: 3651352 - DNA, 22 bp, Homo sapiens
acatgacagtggttatatttca

SEQ ID NO: 3651353 - DNA, 20 bp, Homo sapiens
acatggtgaaaccctgtctc

SEQ ID NO: 3651354 - DNA, 15 bp, Homo sapiens
acatgtatgcttcca

SEQ ID NO: 3651355 - DNA, 15 bp, Homo sapiens
acattgtcagaatgt

SEQ ID NO: 3651356 - DNA, 21 bp, Homo sapiens
acatttgacatgagtctccag

SEQ ID NO: 3651357 - DNA, 22 bp, Homo sapiens
acatttgttctgggttaacagt

SEQ ID NO: 3651358 - DNA, 18 bp, Homo sapiens
accagaagtttaaatctt

SEQ ID NO: 3651359 - DNA, 23 bp, Homo sapiens
accatcagaaacaccctcacact

SEQ ID NO: 3651360 - DNA, 18 bp, Homo sapiens
accatgaaaagttttcaa

SEQ ID NO: 3651361 - DNA, 18 bp, Homo sapiens
accatgcattcagatctg

SEQ ID NO: 3651362 - DNA, 19 bp, Homo sapiens
acccaggattcaacatcaa

SEQ ID NO: 3651363 - DNA, 17 bp, Homo sapiens
accccaccctgcccact

SEQ ID NO: 3651364 - DNA, 13 bp, Homo sapiens
accctcatgctgt

SEQ ID NO: 3651365 - DNA, 14 bp, Homo sapiens
accctgcccactcc

SEQ ID NO: 3651366 - DNA, 14 bp, Homo sapiens
accctggaaaagga

SEQ ID NO: 3651367 - DNA, 15 bp, Homo sapiens
accctgggctggaga

SEQ ID NO: 3651368 - DNA, 19 bp, Homo sapiens
acccttcaatgttaaatct

SEQ ID NO: 3651369 - DNA, 17 bp, Homo sapiens
acccttggtctgtgttc

SEQ ID NO: 3651370 - DNA, 23 bp, Homo sapiens
acccttggtctgtgttctcaaca

SEQ ID NO: 3651371 - DNA, 21 bp, Homo sapiens
accgaactcgggattacagaa

SEQ ID NO: 3651372 - DNA, 16 bp, Homo sapiens
accgggactacagaag

SEQ ID NO: 3651373 - DNA, 12 bp, Homo sapiens
acctaaggcaga

SEQ ID NO: 3651374 - DNA, 22 bp, Homo sapiens
acctaaggcagacaggaaggaa

SEQ ID NO: 3651375 - DNA, 17 bp, Homo sapiens
acctacaagattcctgg

SEQ ID NO: 3651376 - DNA, 18 bp, Homo sapiens
acctatgtacttgaaaat

SEQ ID NO: 3651377 - DNA, 15 bp, Homo sapiens
acctgaattgaaaga

SEQ ID NO: 3651378 - DNA, 13 bp, Homo sapiens
acctgagaatgtg

SEQ ID NO: 3651379 - DNA, 13 bp, Homo sapiens
accttcctgtctc

SEQ ID NO: 3651380 - DNA, 23 bp, Homo sapiens
accttctaatccatgtgctgctg

SEQ ID NO: 3651381 - DNA, 16 bp, Homo sapiens
acgtgcaacagactgc

SEQ ID NO: 3651382 - DNA, 13 bp, Homo sapiens
actaatgtaaata

SEQ ID NO: 3651383 - DNA, 18 bp, Homo sapiens
actacagaagtggaagga

SEQ ID NO: 3651384 - DNA, 19 bp, Homo sapiens
actagcaataagttgaatg

SEQ ID NO: 3651385 - DNA, 20 bp, Homo sapiens
actcaaaccaaatcactgaa

SEQ ID NO: 3651386 - DNA, 22 bp, Homo sapiens
actcagagggaaggctctctgg

SEQ ID NO: 3651387 - DNA, 17 bp, Homo sapiens
actcaggaggctgaggc

SEQ ID NO: 3651388 - DNA, 19 bp, Homo sapiens
actcaggaggctgaggcag

SEQ ID NO: 3651389 - DNA, 20 bp, Homo sapiens
actcaggaggctgaggcagg

SEQ ID NO: 3651390 - DNA, 21 bp, Homo sapiens
actcatacagtctctatttga

SEQ ID NO: 3651391 - DNA, 17 bp, Homo sapiens
actcgggattacagaaa

SEQ ID NO: 3651392 - DNA, 15 bp, Homo sapiens
actctatccctggct

SEQ ID NO: 3651393 - DNA, 18 bp, Homo sapiens
actcttttgagcagtaaa

SEQ ID NO: 3651394 - DNA, 20 bp, Homo sapiens
actgaaattagtgttttcat

SEQ ID NO: 3651395 - DNA, 22 bp, Homo sapiens
actgaaattagtgttttcattc

SEQ ID NO: 3651396 - DNA, 16 bp, Homo sapiens
actgaactttgctgag

SEQ ID NO: 3651397 - DNA, 22 bp, Homo sapiens
actgcagttatttaccagaagt

SEQ ID NO: 3651398 - DNA, 22 bp, Homo sapiens
actgccaagccaaccctggaaa

SEQ ID NO: 3651399 - DNA, 12 bp, Homo sapiens
actggaaacatc

SEQ ID NO: 3651400 - DNA, 15 bp, Homo sapiens
actggaaacatctga

SEQ ID NO: 3651401 - DNA, 20 bp, Homo sapiens
actgtgacacagctgagctg

SEQ ID NO: 3651402 - DNA, 24 bp, Homo sapiens
actgtggacaaaagtttatctttg

SEQ ID NO: 3651403 - DNA, 17 bp, Homo sapiens
actgtggataaattttg

SEQ ID NO: 3651404 - DNA, 21 bp, Homo sapiens
actgtggtcccagctacaggg

SEQ ID NO: 3651405 - DNA, 12 bp, Homo sapiens
actgtttataat

SEQ ID NO: 3651406 - DNA, 14 bp, Homo sapiens
actgtttataatag

SEQ ID NO: 3651407 - DNA, 23 bp, Homo sapiens
actgtttataataggtggagact

SEQ ID NO: 3651408 - DNA, 13 bp, Homo sapiens
acttaatttagca

SEQ ID NO: 3651409 - DNA, 22 bp, Homo sapiens
acttacacacctgagaatgtgc

SEQ ID NO: 3651410 - DNA, 17 bp, Homo sapiens
acttattttgattgttt

SEQ ID NO: 3651411 - DNA, 22 bp, Homo sapiens
acttccacccccgttagcttcc

SEQ ID NO: 3651412 - DNA, 16 bp, Homo sapiens
acttcctattaattta

SEQ ID NO: 3651413 - DNA, 22 bp, Homo sapiens
acttcctattaatttattaaat

SEQ ID NO: 3651414 - DNA, 16 bp, Homo sapiens
acttcttgtgctttac

SEQ ID NO: 3651415 - DNA, 23 bp, Homo sapiens
acttgaaaataataaagtggcat

SEQ ID NO: 3651416 - DNA, 14 bp, Homo sapiens
acttgattaaggac

SEQ ID NO: 3651417 - DNA, 16 bp, Homo sapiens
acttgattaaggacta

SEQ ID NO: 3651418 - DNA, 23 bp, Homo sapiens
acttgcaaaaagggtcagtatgg

SEQ ID NO: 3651419 - DNA, 14 bp, Homo sapiens
acttgtattggaag

SEQ ID NO: 3651420 - DNA, 13 bp, Homo sapiens
actttacaatcat

SEQ ID NO: 3651421 - DNA, 14 bp, Homo sapiens
actttacaatcatg

SEQ ID NO: 3651422 - DNA, 18 bp, Homo sapiens
actttatacttgcctccc

SEQ ID NO: 3651423 - DNA, 14 bp, Homo sapiens
actttggctgcatg

SEQ ID NO: 3651424 - DNA, 14 bp, Homo sapiens
acttttataaatgt

SEQ ID NO: 3651425 - DNA, 15 bp, Homo sapiens
agaaaaaactggaaa

SEQ ID NO: 3651426 - DNA, 18 bp, Homo sapiens
agaaaatccttcagcaat

SEQ ID NO: 3651427 - DNA, 24 bp, Homo sapiens
agaaacacagcatgcatttagcat

SEQ ID NO: 3651428 - DNA, 17 bp, Homo sapiens
agaaacaccctcacact

SEQ ID NO: 3651429 - DNA, 13 bp, Homo sapiens
agaaactttggaa

SEQ ID NO: 3651430 - DNA, 15 bp, Homo sapiens
agaacaaactcagat

SEQ ID NO: 3651431 - DNA, 13 bp, Homo sapiens
agaaccttctaat

SEQ ID NO: 3651432 - DNA, 13 bp, Homo sapiens
agaacctttggac

SEQ ID NO: 3651433 - DNA, 22 bp, Homo sapiens
agaacctttggacaagaggaaa

SEQ ID NO: 3651434 - DNA, 17 bp, Homo sapiens
agaagaaccaggcatgg

SEQ ID NO: 3651435 - DNA, 16 bp, Homo sapiens
agaagaaggactgaag

SEQ ID NO: 3651436 - DNA, 15 bp, Homo sapiens
agaagcaaggaagta

SEQ ID NO: 3651437 - DNA, 16 bp, Homo sapiens
agaagcaaggaagtaa

SEQ ID NO: 3651438 - DNA, 11 bp, Homo sapiens
agaaggaagcc

SEQ ID NO: 3651439 - DNA, 16 bp, Homo sapiens
agaaggactgaagaaa

SEQ ID NO: 3651440 - DNA, 23 bp, Homo sapiens
agaaggcaatcaagagcttccag

SEQ ID NO: 3651441 - DNA, 11 bp, Homo sapiens
agaaggcactg

SEQ ID NO: 3651442 - DNA, 15 bp, Homo sapiens
agaaggcactgggaa

SEQ ID NO: 3651443 - DNA, 23 bp, Homo sapiens
agaagtccatgtgataattgtaa

SEQ ID NO: 3651444 - DNA, 14 bp, Homo sapiens
agaagtgaaaaaga

SEQ ID NO: 3651445 - DNA, 22 bp, Homo sapiens
agaagtggaaggataatgagat

SEQ ID NO: 3651446 - DNA, 22 bp, Homo sapiens
agaagtttaaatctttgttaaa

SEQ ID NO: 3651447 - DNA, 14 bp, Homo sapiens
agaatcaagtctgt

SEQ ID NO: 3651448 - DNA, 16 bp, Homo sapiens
agaatcaagtctgtga

SEQ ID NO: 3651449 - DNA, 22 bp, Homo sapiens
agaatgagatgatttaattctt

SEQ ID NO: 3651450 - DNA, 12 bp, Homo sapiens
agaatgtgaaaa

SEQ ID NO: 3651451 - DNA, 14 bp, Homo sapiens
agaattcatgatgc

SEQ ID NO: 3651452 - DNA, 15 bp, Homo sapiens
agaattcatgatgct

SEQ ID NO: 3651453 - DNA, 23 bp, Homo sapiens
agaattgcttgaacctgtgagga

SEQ ID NO: 3651454 - DNA, 22 bp, Homo sapiens
agaattgggcccttagaatgtg

SEQ ID NO: 3651455 - DNA, 14 bp, Homo sapiens
agacaagcattggg

SEQ ID NO: 3651456 - DNA, 23 bp, Homo sapiens
agacaagcattgggtcagaccca

SEQ ID NO: 3651457 - DNA, 13 bp, Homo sapiens
agacaggaaggaa

SEQ ID NO: 3651458 - DNA, 15 bp, Homo sapiens
agacaggaaggaagc

SEQ ID NO: 3651459 - DNA, 19 bp, Homo sapiens
agacaggtgggagatggag

SEQ ID NO: 3651460 - DNA, 17 bp, Homo sapiens
agacagtatttgcagtg

SEQ ID NO: 3651461 - DNA, 13 bp, Homo sapiens
agaccatgcattc

SEQ ID NO: 3651462 - DNA, 17 bp, Homo sapiens
agaccatgcattcagat

SEQ ID NO: 3651463 - DNA, 18 bp, Homo sapiens
agaccatgcattcagatc

SEQ ID NO: 3651464 - DNA, 16 bp, Homo sapiens
agacctaaggcagaca

SEQ ID NO: 3651465 - DNA, 16 bp, Homo sapiens
attcagatctgaagta

SEQ ID NO: 3651466 - DNA, 15 bp, Homo sapiens
attcagatttctaca

SEQ ID NO: 3651467 - DNA, 21 bp, Homo sapiens
attcagtctatgctgtgtgca

SEQ ID NO: 3651468 - DNA, 19 bp, Homo sapiens
attcatgatgctagttctt

SEQ ID NO: 3651469 - DNA, 18 bp, Homo sapiens
attcattccattctggaa

SEQ ID NO: 3651470 - DNA, 21 bp, Homo sapiens
attccattctggaagtgactt

SEQ ID NO: 3651471 - DNA, 20 bp, Homo sapiens
attcctaattcctgtatgtt

SEQ ID NO: 3651472 - DNA, 15 bp, Homo sapiens
attcctaattctatg

SEQ ID NO: 3651473 - DNA, 20 bp, Homo sapiens
attcctaattctatgattaa

SEQ ID NO: 3651474 - DNA, 13 bp, Homo sapiens
attcctgtatgtt

SEQ ID NO: 3651475 - DNA, 13 bp, Homo sapiens
attcgtaagttct

SEQ ID NO: 3651476 - DNA, 17 bp, Homo sapiens
attctgcctcagcctcc

SEQ ID NO: 3651477 - DNA, 21 bp, Homo sapiens
attcttaccgaaatgaaaatg

SEQ ID NO: 3651478 - DNA, 14 bp, Homo sapiens
attcttgctctgct

SEQ ID NO: 3651479 - DNA, 21 bp, Homo sapiens
attcttgtgtcatcaagtagt

SEQ ID NO: 3651480 - DNA, 15 bp, Homo sapiens
attgaaagagaattt

SEQ ID NO: 3651481 - DNA, 16 bp, Homo sapiens
attgaaagagaatttg

SEQ ID NO: 3651482 - DNA, 18 bp, Homo sapiens
attgcactgcagttattt

SEQ ID NO: 3651483 - DNA, 14 bp, Homo sapiens
attgctaaagtcag

SEQ ID NO: 3651484 - DNA, 16 bp, Homo sapiens
attgctagaggtggca

SEQ ID NO: 3651485 - DNA, 14 bp, Homo sapiens
attgctgtaaataa

SEQ ID NO: 3651486 - DNA, 16 bp, Homo sapiens
attgctgtctgaaaaa

SEQ ID NO: 3651487 - DNA, 23 bp, Homo sapiens
attgctgtctgaaaaagtgtttt

SEQ ID NO: 3651488 - DNA, 13 bp, Homo sapiens
attgcttgagcat

SEQ ID NO: 3651489 - DNA, 15 bp, Homo sapiens
attggaaaaaattag

SEQ ID NO: 3651490 - DNA, 20 bp, Homo sapiens
attggaagaagaaccaggca

SEQ ID NO: 3651491 - DNA, 14 bp, Homo sapiens
attggttaatgaaa

SEQ ID NO: 3651492 - DNA, 18 bp, Homo sapiens
attgtaaaggtgatgaat

SEQ ID NO: 3651493 - DNA, 23 bp, Homo sapiens
attgtaaaggtgatgaatttacc

SEQ ID NO: 3651494 - DNA, 17 bp, Homo sapiens
attgtgcccacttaccc

SEQ ID NO: 3651495 - DNA, 23 bp, Homo sapiens
attgtgcccacttaccctgggct

SEQ ID NO: 3651496 - DNA, 15 bp, Homo sapiens
attgttctttttcct

SEQ ID NO: 3651497 - DNA, 23 bp, Homo sapiens
attgtttgatgaataaaatgttt

SEQ ID NO: 3651498 - DNA, 14 bp, Homo sapiens
atttaattcttacc

SEQ ID NO: 3651499 - DNA, 13 bp, Homo sapiens
atttagcatgagt

SEQ ID NO: 3651500 - DNA, 14 bp, Homo sapiens
atttagcatgagtt

SEQ ID NO: 3651501 - DNA, 16 bp, Homo sapiens
atttataacattgtaa

SEQ ID NO: 3651502 - DNA, 17 bp, Homo sapiens
atttataacattgtaaa

SEQ ID NO: 3651503 - DNA, 13 bp, Homo sapiens
atttattaaatgt

SEQ ID NO: 3651504 - DNA, 21 bp, Homo sapiens
atttattaaatttattaaatg

SEQ ID NO: 3651505 - DNA, 19 bp, Homo sapiens
atttcaaccacacctaaat

SEQ ID NO: 3651506 - DNA, 22 bp, Homo sapiens
atttcaaccacacctaaattaa

SEQ ID NO: 3651507 - DNA, 13 bp, Homo sapiens
atttcacacaact

SEQ ID NO: 3651508 - DNA, 19 bp, Homo sapiens
atttcacacaactgtggat

SEQ ID NO: 3651509 - DNA, 18 bp, Homo sapiens
atttcagctgtgagcttt

SEQ ID NO: 3651510 - DNA, 12 bp, Homo sapiens
atttcattcgtg

SEQ ID NO: 3651511 - DNA, 19 bp, Homo sapiens
atttcttggtatgatcatt

SEQ ID NO: 3651512 - DNA, 22 bp, Homo sapiens
atttgacattgtcagaatgttg

SEQ ID NO: 3651513 - DNA, 15 bp, Homo sapiens
atttgaggaaactca

SEQ ID NO: 3651514 - DNA, 18 bp, Homo sapiens
atttgcaacactgccaaa

SEQ ID NO: 3651515 - DNA, 22 bp, Homo sapiens
atttgcaacactgccaaacatc

SEQ ID NO: 3651516 - DNA, 12 bp, Homo sapiens
atttgcttttga

SEQ ID NO: 3651517 - DNA, 18 bp, Homo sapiens
atttgttaatgattcttg

SEQ ID NO: 3651518 - DNA, 21 bp, Homo sapiens
atttgttctgggttaacagta

SEQ ID NO: 3651519 - DNA, 19 bp, Homo sapiens
attttaaacaaaatttatg

SEQ ID NO: 3651520 - DNA, 22 bp, Homo sapiens
attttagaataccccaccagca

SEQ ID NO: 3651521 - DNA, 23 bp, Homo sapiens
attttattgaatataatggcctc

SEQ ID NO: 3651522 - DNA, 16 bp, Homo sapiens
attttcaagtggaaac

SEQ ID NO: 3651523 - DNA, 20 bp, Homo sapiens
attttcaagtggaaaccttg

SEQ ID NO: 3651524 - DNA, 17 bp, Homo sapiens
attttctgagtagcata

SEQ ID NO: 3651525 - DNA, 18 bp, Homo sapiens
attttctgagtagcatat

SEQ ID NO: 3651526 - DNA, 13 bp, Homo sapiens
attttctgtaatt

SEQ ID NO: 3651527 - DNA, 19 bp, Homo sapiens
attttctgtaattcttctc

SEQ ID NO: 3651528 - DNA, 21 bp, Homo sapiens
attttctgtaattcttctcct

SEQ ID NO: 3651529 - DNA, 23 bp, Homo sapiens
attttcttctttaatttttctgt

SEQ ID NO: 3651530 - DNA, 15 bp, Homo sapiens
attttgatgtattat

SEQ ID NO: 3651531 - DNA, 17 bp, Homo sapiens
attttgattgtttgatg

SEQ ID NO: 3651532 - DNA, 21 bp, Homo sapiens
attttgattgtttgatgaata

SEQ ID NO: 3651533 - DNA, 20 bp, Homo sapiens
attttgctttatcagaagca

SEQ ID NO: 3651534 - DNA, 22 bp, Homo sapiens
attttgctttatcagaagcaag

SEQ ID NO: 3651535 - DNA, 22 bp, Homo sapiens
attttggaagaattcatgatgc

SEQ ID NO: 3651536 - DNA, 16 bp, Homo sapiens
attttggacgtgtgag

SEQ ID NO: 3651537 - DNA, 14 bp, Homo sapiens
attttttgtgaatg

SEQ ID NO: 3651538 - DNA, 14 bp, Homo sapiens
attttttttctgaa

SEQ ID NO: 3651539 - DNA, 15 bp, Homo sapiens
caaaaatttgacatt

SEQ ID NO: 3651540 - DNA, 16 bp, Homo sapiens
caaaaatttgacattg

SEQ ID NO: 3651541 - DNA, 16 bp, Homo sapiens
caaaagtactagcaat

SEQ ID NO: 3651542 - DNA, 17 bp, Homo sapiens
caaaatttatgtcattt

SEQ ID NO: 3651543 - DNA, 14 bp, Homo sapiens
caaacgaaatggct

SEQ ID NO: 3651544 - DNA, 16 bp, Homo sapiens
caaactcagatctcat

SEQ ID NO: 3651545 - DNA, 22 bp, Homo sapiens
caaactgaaattagtgttttca

SEQ ID NO: 3651546 - DNA, 23 bp, Homo sapiens
caaactgaaattagtgttttcat

SEQ ID NO: 3651547 - DNA, 15 bp, Homo sapiens
caaacttttataaat

SEQ ID NO: 3651548 - DNA, 21 bp, Homo sapiens
caaacttttataaatgtttta

SEQ ID NO: 3651549 - DNA, 10 bp, Homo sapiens
caaaggaagt

SEQ ID NO: 3651550 - DNA, 20 bp, Homo sapiens
caaagtgaaattagtatttt

SEQ ID NO: 3651551 - DNA, 22 bp, Homo sapiens
caaatcattttgatgtattatt

SEQ ID NO: 3651552 - DNA, 13 bp, Homo sapiens
caaatgaaaacaa

SEQ ID NO: 3651553 - DNA, 13 bp, Homo sapiens
caaatggtatttt

SEQ ID NO: 3651554 - DNA, 14 bp, Homo sapiens
caaatggtattttt

SEQ ID NO: 3651555 - DNA, 20 bp, Homo sapiens
caaatggtattttttgtgaa

SEQ ID NO: 3651556 - DNA, 21 bp, Homo sapiens
caaatggtattttttgtgaat

SEQ ID NO: 3651557 - DNA, 21 bp, Homo sapiens
caaatgttattcaataactat

SEQ ID NO: 3651558 - DNA, 21 bp, Homo sapiens
caaattctgattattacaaca

SEQ ID NO: 3651559 - DNA, 13 bp, Homo sapiens
caacaaaggaagt

SEQ ID NO: 3651560 - DNA, 20 bp, Homo sapiens
caacagactgccttatatta

SEQ ID NO: 3651561 - DNA, 22 bp, Homo sapiens
caacagactgccttatattatt

SEQ ID NO: 3651562 - DNA, 12 bp, Homo sapiens
caacatctgaga

SEQ ID NO: 3651563 - DNA, 19 bp, Homo sapiens
caacctccgcatcccgggt

SEQ ID NO: 3651564 - DNA, 14 bp, Homo sapiens
caactgtggataaa

SEQ ID NO: 3651565 - DNA, 23 bp, Homo sapiens
caactgtggtcccagctacaggg

SEQ ID NO: 3651566 - DNA, 17 bp, Homo sapiens
caagagcctgagactgg

SEQ ID NO: 3651567 - DNA, 17 bp, Homo sapiens
caagcaaactgaaatta

SEQ ID NO: 3651568 - DNA, 18 bp, Homo sapiens
caagcattgggtcagacc

SEQ ID NO: 3651569 - DNA, 14 bp, Homo sapiens
caagctcatagcac

SEQ ID NO: 3651570 - DNA, 16 bp, Homo sapiens
caagctcatagcacat

SEQ ID NO: 3651571 - DNA, 15 bp, Homo sapiens
caagctcttcattgc

SEQ ID NO: 3651572 - DNA, 22 bp, Homo sapiens
caagtagtagtacttaatagta

SEQ ID NO: 3651573 - DNA, 17 bp, Homo sapiens
caagtctacctgccttg

SEQ ID NO: 3651574 - DNA, 15 bp, Homo sapiens
caagtctagtggaac

SEQ ID NO: 3651575 - DNA, 23 bp, Homo sapiens
caagtgagaaagacatctgagga

SEQ ID NO: 3651576 - DNA, 19 bp, Homo sapiens
caagttctttcccagcctc

SEQ ID NO: 3651577 - DNA, 15 bp, Homo sapiens
caagttgtgtgctat

SEQ ID NO: 3651578 - DNA, 15 bp, Homo sapiens
caataaaaatggcat

SEQ ID NO: 3651579 - DNA, 17 bp, Homo sapiens
caataagttgaatgata

SEQ ID NO: 3651580 - DNA, 21 bp, Homo sapiens
caatattgctagaggtggcat

SEQ ID NO: 3651581 - DNA, 13 bp, Homo sapiens
caatgttaaatct

SEQ ID NO: 3651582 - DNA, 16 bp, Homo sapiens
caatgttaaatctaca

SEQ ID NO: 3651583 - DNA, 14 bp, Homo sapiens
caattgcttgagca

SEQ ID NO: 3651584 - DNA, 14 bp, Homo sapiens
cacaaaagacaagc

SEQ ID NO: 3651585 - DNA, 12 bp, Homo sapiens
cacaacatctga

SEQ ID NO: 3651586 - DNA, 20 bp, Homo sapiens
cacaactgtggataaatttt

SEQ ID NO: 3651587 - DNA, 17 bp, Homo sapiens
cacacaaagtgaaatta

SEQ ID NO: 3651588 - DNA, 11 bp, Homo sapiens
cacagcacatt

SEQ ID NO: 3651589 - DNA, 13 bp, Homo sapiens
cacagcatgcatt

SEQ ID NO: 3651590 - DNA, 17 bp, Homo sapiens
cacagctgagctggcct

SEQ ID NO: 3651591 - DNA, 16 bp, Homo sapiens
cacagttcctctttgt

SEQ ID NO: 3651592 - DNA, 21 bp, Homo sapiens
cacatataaacacagtaagat

SEQ ID NO: 3651593 - DNA, 20 bp, Homo sapiens
cacatgacagtggttatatt

SEQ ID NO: 3651594 - DNA, 13 bp, Homo sapiens
cacatgttttaca

SEQ ID NO: 3651595 - DNA, 20 bp, Homo sapiens
cacatttgttaatgattctt

SEQ ID NO: 3651596 - DNA, 21 bp, Homo sapiens
cacattttagaataccccacc

SEQ ID NO: 3651597 - DNA, 16 bp, Homo sapiens
cttcacattctgaagt

SEQ ID NO: 3651598 - DNA, 15 bp, Homo sapiens
cttcatctggaacca

SEQ ID NO: 3651599 - DNA, 21 bp, Homo sapiens
cttcatgcatggaaattccct

SEQ ID NO: 3651600 - DNA, 23 bp, Homo sapiens
cttcatgcatggaaattcccttc

SEQ ID NO: 3651601 - DNA, 18 bp, Homo sapiens
cttcattgcactgcagtt

SEQ ID NO: 3651602 - DNA, 16 bp, Homo sapiens
cttccagggacaagct

SEQ ID NO: 3651603 - DNA, 18 bp, Homo sapiens
cttccctatctttgccac

SEQ ID NO: 3651604 - DNA, 13 bp, Homo sapiens
cttcctgcaggac

SEQ ID NO: 3651605 - DNA, 13 bp, Homo sapiens
cttcctgtctccc

SEQ ID NO: 3651606 - DNA, 14 bp, Homo sapiens
cttcctgtctccca

SEQ ID NO: 3651607 - DNA, 10 bp, Homo sapiens
cttccttcct

SEQ ID NO: 3651608 - DNA, 23 bp, Homo sapiens
cttcttaaggacagtgttcaaat

SEQ ID NO: 3651609 - DNA, 14 bp, Homo sapiens
cttctttccttcct

SEQ ID NO: 3651610 - DNA, 17 bp, Homo sapiens
cttgacagttacttaca

SEQ ID NO: 3651611 - DNA, 15 bp, Homo sapiens
cttgcaaaaagggtc

SEQ ID NO: 3651612 - DNA, 14 bp, Homo sapiens
cttgcctccctcct

SEQ ID NO: 3651613 - DNA, 21 bp, Homo sapiens
cttgctctgctcatctacaca

SEQ ID NO: 3651614 - DNA, 18 bp, Homo sapiens
cttgctgtgaaatgactg

SEQ ID NO: 3651615 - DNA, 12 bp, Homo sapiens
cttggaaaatgt

SEQ ID NO: 3651616 - DNA, 13 bp, Homo sapiens
cttgggcctggga

SEQ ID NO: 3651617 - DNA, 14 bp, Homo sapiens
cttggtctgtgttc

SEQ ID NO: 3651618 - DNA, 22 bp, Homo sapiens
cttggtctgtgttctcaacaca

SEQ ID NO: 3651619 - DNA, 22 bp, Homo sapiens
cttggttcaatcaacagaattg

SEQ ID NO: 3651620 - DNA, 16 bp, Homo sapiens
cttgtactttacaatc

SEQ ID NO: 3651621 - DNA, 12 bp, Homo sapiens
cttgtattggaa

SEQ ID NO: 3651622 - DNA, 13 bp, Homo sapiens
cttgtgtgccaca

SEQ ID NO: 3651623 - DNA, 15 bp, Homo sapiens
cttgtgtgccacaga

SEQ ID NO: 3651624 - DNA, 16 bp, Homo sapiens
ctttaaaacttactat

SEQ ID NO: 3651625 - DNA, 13 bp, Homo sapiens
ctttatcagaagc

SEQ ID NO: 3651626 - DNA, 21 bp, Homo sapiens
ctttatcagaagcaaggaagt

SEQ ID NO: 3651627 - DNA, 21 bp, Homo sapiens
ctttatgaaaaaaaaagaaat

SEQ ID NO: 3651628 - DNA, 21 bp, Homo sapiens
ctttcccagcctcttccattc

SEQ ID NO: 3651629 - DNA, 22 bp, Homo sapiens
ctttctcattagagatctgaaa

SEQ ID NO: 3651630 - DNA, 16 bp, Homo sapiens
ctttctgatacatctg

SEQ ID NO: 3651631 - DNA, 22 bp, Homo sapiens
ctttctgatacatctgtcagtg

SEQ ID NO: 3651632 - DNA, 15 bp, Homo sapiens
ctttcttagattaaa

SEQ ID NO: 3651633 - DNA, 15 bp, Homo sapiens
ctttcttccttcctt

SEQ ID NO: 3651634 - DNA, 21 bp, Homo sapiens
ctttcttccttcctttctctc

SEQ ID NO: 3651635 - DNA, 14 bp, Homo sapiens
ctttctttccctta

SEQ ID NO: 3651636 - DNA, 19 bp, Homo sapiens
ctttcttttcatgcccatc

SEQ ID NO: 3651637 - DNA, 14 bp, Homo sapiens
ctttcttttgtgca

SEQ ID NO: 3651638 - DNA, 15 bp, Homo sapiens
ctttcttttgtgcat

SEQ ID NO: 3651639 - DNA, 16 bp, Homo sapiens
ctttgccaccctcatg

SEQ ID NO: 3651640 - DNA, 17 bp, Homo sapiens
ctttgccaccctcatgc

SEQ ID NO: 3651641 - DNA, 18 bp, Homo sapiens
ctttgccaccctcatgct

SEQ ID NO: 3651642 - DNA, 18 bp, Homo sapiens
ctttgctgagcctgtaaa

SEQ ID NO: 3651643 - DNA, 13 bp, Homo sapiens
ctttggcaggtgc

SEQ ID NO: 3651644 - DNA, 14 bp, Homo sapiens
ctttgggaggctga

SEQ ID NO: 3651645 - DNA, 14 bp, Homo sapiens
cttttataaatgtt

SEQ ID NO: 3651646 - DNA, 15 bp, Homo sapiens
cttttataaatgttt

SEQ ID NO: 3651647 - DNA, 17 bp, Homo sapiens
cttttattgtataatta

SEQ ID NO: 3651648 - DNA, 15 bp, Homo sapiens
cttttccatcccact

SEQ ID NO: 3651649 - DNA, 23 bp, Homo sapiens
cttttgctctgcaggcagccttg

SEQ ID NO: 3651650 - DNA, 14 bp, Homo sapiens
cttttgtgtcctgt

SEQ ID NO: 3651651 - DNA, 16 bp, Homo sapiens
cttttttcctttcttc

SEQ ID NO: 3651652 - DNA, 13 bp, Homo sapiens
gaaaaagtgtttt

SEQ ID NO: 3651653 - DNA, 16 bp, Homo sapiens
gaaaaagtgtttttac

SEQ ID NO: 3651654 - DNA, 15 bp, Homo sapiens
gaaaaatctgaattt

SEQ ID NO: 3651655 - DNA, 18 bp, Homo sapiens
gaaaaatctgaatttcta

SEQ ID NO: 3651656 - DNA, 13 bp, Homo sapiens
gaaaacattccat

SEQ ID NO: 3651657 - DNA, 21 bp, Homo sapiens
gaaaagttttcaagcattgct

SEQ ID NO: 3651658 - DNA, 19 bp, Homo sapiens
gaaaatggaagacctaagg

SEQ ID NO: 3651659 - DNA, 14 bp, Homo sapiens
gaaacaaaatataa

SEQ ID NO: 3651660 - DNA, 16 bp, Homo sapiens
gaaacaaaatataaat

SEQ ID NO: 3651661 - DNA, 17 bp, Homo sapiens
gaaacaaaatataaatc

SEQ ID NO: 3651662 - DNA, 17 bp, Homo sapiens
gaaacaaatatactcat

SEQ ID NO: 3651663 - DNA, 17 bp, Homo sapiens
gaaacaacaaaggaagt

SEQ ID NO: 3651664 - DNA, 15 bp, Homo sapiens
gaaacacagcatgca

SEQ ID NO: 3651665 - DNA, 19 bp, Homo sapiens
gaaacacagcatgcattta

SEQ ID NO: 3651666 - DNA, 23 bp, Homo sapiens
gaaacacagcatgcatttagcat

SEQ ID NO: 3651667 - DNA, 22 bp, Homo sapiens
gaaacaccctcacactgggact

SEQ ID NO: 3651668 - DNA, 18 bp, Homo sapiens
gaaacatctgatttctga

SEQ ID NO: 3651669 - DNA, 20 bp, Homo sapiens
gaaacatctgatttctgaac

SEQ ID NO: 3651670 - DNA, 14 bp, Homo sapiens
gaaaccctgtctct

SEQ ID NO: 3651671 - DNA, 17 bp, Homo sapiens
gaaagacatctgaggaa

SEQ ID NO: 3651672 - DNA, 14 bp, Homo sapiens
gaaagatggggagc

SEQ ID NO: 3651673 - DNA, 21 bp, Homo sapiens
gaaaggaagatgtaagaagct

SEQ ID NO: 3651674 - DNA, 18 bp, Homo sapiens
gaaagggatggccacaag

SEQ ID NO: 3651675 - DNA, 19 bp, Homo sapiens
gaaatataaaaataattaa

SEQ ID NO: 3651676 - DNA, 18 bp, Homo sapiens
gaaatatccttttagaag

SEQ ID NO: 3651677 - DNA, 16 bp, Homo sapiens
gaaatgagatcccaga

SEQ ID NO: 3651678 - DNA, 16 bp, Homo sapiens
gaaattagtattttga

SEQ ID NO: 3651679 - DNA, 17 bp, Homo sapiens
gaaattagtgttttcat

SEQ ID NO: 3651680 - DNA, 23 bp, Homo sapiens
gaaattagtgttttcattctggt

SEQ ID NO: 3651681 - DNA, 17 bp, Homo sapiens
gaaattcccttcatctg

SEQ ID NO: 3651682 - DNA, 21 bp, Homo sapiens
gaacccatctaaaccagaagg

SEQ ID NO: 3651683 - DNA, 14 bp, Homo sapiens
gaacctgtgaggaa

SEQ ID NO: 3651684 - DNA, 17 bp, Homo sapiens
gaacctgtgaggaagag

SEQ ID NO: 3651685 - DNA, 20 bp, Homo sapiens
gaacctttggacaagaggaa

SEQ ID NO: 3651686 - DNA, 19 bp, Homo sapiens
gaactcgggattacagaaa

SEQ ID NO: 3651687 - DNA, 19 bp, Homo sapiens
gaactttgctgagcctgta

SEQ ID NO: 3651688 - DNA, 18 bp, Homo sapiens
gaagaaacacagcatgca

SEQ ID NO: 3651689 - DNA, 21 bp, Homo sapiens
gaagaaggactgaagaaaatc

SEQ ID NO: 3651690 - DNA, 19 bp, Homo sapiens
gaagagctgctgtatttga

SEQ ID NO: 3651691 - DNA, 20 bp, Homo sapiens
gaagaggttgcagtgagctg

SEQ ID NO: 3651692 - DNA, 20 bp, Homo sapiens
gaagcaaggaagtaagggag

SEQ ID NO: 3651693 - DNA, 16 bp, Homo sapiens
gaagcacaaaagacaa

SEQ ID NO: 3651694 - DNA, 11 bp, Homo sapiens
gaagcccagcc

SEQ ID NO: 3651695 - DNA, 19 bp, Homo sapiens
gaagccctaagtaaatcta

SEQ ID NO: 3651696 - DNA, 18 bp, Homo sapiens
gaagctcaaggctgcagt

SEQ ID NO: 3651697 - DNA, 21 bp, Homo sapiens
gaaggaaacaacaaaggaagt

SEQ ID NO: 3651698 - DNA, 12 bp, Homo sapiens
gaaggcactggg

SEQ ID NO: 3651699 - DNA, 16 bp, Homo sapiens
gaagggaagcccagcc

SEQ ID NO: 3651700 - DNA, 22 bp, Homo sapiens
gaagtagtgtgagtgttagaaa

SEQ ID NO: 3651701 - DNA, 22 bp, Homo sapiens
gaagtatagatggtagaaactt

SEQ ID NO: 3651702 - DNA, 21 bp, Homo sapiens
gaagtgactttggctgcatgc

SEQ ID NO: 3651703 - DNA, 13 bp, Homo sapiens
gaagtgcatgtta

SEQ ID NO: 3651704 - DNA, 18 bp, Homo sapiens
gaagtgcatgttaaaata

SEQ ID NO: 3651705 - DNA, 14 bp, Homo sapiens
gaagtttaaatctt

SEQ ID NO: 3651706 - DNA, 15 bp, Homo sapiens
gaagttttacttgat

SEQ ID NO: 3651707 - DNA, 20 bp, Homo sapiens
gaataccccaccagcagaac

SEQ ID NO: 3651708 - DNA, 15 bp, Homo sapiens
gaatcagggtggaga

SEQ ID NO: 3651709 - DNA, 19 bp, Homo sapiens
gaatcagggtggagaagtt

SEQ ID NO: 3651710 - DNA, 16 bp, Homo sapiens
gaatctaagtgggaga

SEQ ID NO: 3651711 - DNA, 17 bp, Homo sapiens
gaatctaagtgggagac

SEQ ID NO: 3651712 - DNA, 23 bp, Homo sapiens
gaatgtgaaaaaaaaaagtaatt

SEQ ID NO: 3651713 - DNA, 23 bp, Homo sapiens
gaatgttgtgttggtatttactg

SEQ ID NO: 3651714 - DNA, 16 bp, Homo sapiens
gaattcagtagcattt

SEQ ID NO: 3651715 - DNA, 13 bp, Homo sapiens
gaattgaaagaga

SEQ ID NO: 3651716 - DNA, 15 bp, Homo sapiens
gaatttaccatcaaa

SEQ ID NO: 3651717 - DNA, 18 bp, Homo sapiens
gacaagcattgggtcaga

SEQ ID NO: 3651718 - DNA, 15 bp, Homo sapiens
gacaggaaggaagca

SEQ ID NO: 3651719 - DNA, 16 bp, Homo sapiens
gacaggtgggagatgg

SEQ ID NO: 3651720 - DNA, 15 bp, Homo sapiens
gacatattcccatgg

SEQ ID NO: 3651721 - DNA, 12 bp, Homo sapiens
gacatctgagga

SEQ ID NO: 3651722 - DNA, 22 bp, Homo sapiens
gacattgtcagaatgttgtgtt

SEQ ID NO: 3651723 - DNA, 22 bp, Homo sapiens
gaccatgcattcagatctgaag

SEQ ID NO: 3651724 - DNA, 13 bp, Homo sapiens
gacctaaggcaga

SEQ ID NO: 3651725 - DNA, 14 bp, Homo sapiens
gacctaaggcagac

SEQ ID NO: 3651726 - DNA, 21 bp, Homo sapiens
gacctaaggcagacaggaagg

SEQ ID NO: 3651727 - DNA, 18 bp, Homo sapiens
gacctacaagattcctgg

SEQ ID NO: 3651728 - DNA, 20 bp, Homo sapiens
gacctccctgtctctacaaa

SEQ ID NO: 3651729 - DNA, 15 bp, Homo sapiens
gacctgaattgaaag

SEQ ID NO: 3651730 - DNA, 15 bp, Homo sapiens
tacaaaaaaaatcaa

SEQ ID NO: 3651731 - DNA, 22 bp, Homo sapiens
tacaaaaaaaatcaaaaaatta

SEQ ID NO: 3651732 - DNA, 18 bp, Homo sapiens
tacaaacttttataaatg

SEQ ID NO: 3651733 - DNA, 19 bp, Homo sapiens
tacaaacttttataaatgt

SEQ ID NO: 3651734 - DNA, 20 bp, Homo sapiens
tacaaagaaacaaaatataa

SEQ ID NO: 3651735 - DNA, 23 bp, Homo sapiens
tacaaagaaacaaaatataaatc

SEQ ID NO: 3651736 - DNA, 17 bp, Homo sapiens
tacaacaagcaaactga

SEQ ID NO: 3651737 - DNA, 22 bp, Homo sapiens
tacaagtgtttctagtaacagt

SEQ ID NO: 3651738 - DNA, 15 bp, Homo sapiens
tacacacctgagaat

SEQ ID NO: 3651739 - DNA, 12 bp, Homo sapiens
tacactccagcc

SEQ ID NO: 3651740 - DNA, 15 bp, Homo sapiens
tacagatggtgtcct

SEQ ID NO: 3651741 - DNA, 21 bp, Homo sapiens
tacagatggtgtcctgcatgt

SEQ ID NO: 3651742 - DNA, 22 bp, Homo sapiens
tacagatggtgtcctgcatgta

SEQ ID NO: 3651743 - DNA, 18 bp, Homo sapiens
tacaggttttatgagact

SEQ ID NO: 3651744 - DNA, 21 bp, Homo sapiens
tacattcttgctctgctcatc

SEQ ID NO: 3651745 - DNA, 20 bp, Homo sapiens
tacatttatgtgtgaagcaa

SEQ ID NO: 3651746 - DNA, 15 bp, Homo sapiens
taccatcaaacaaat

SEQ ID NO: 3651747 - DNA, 18 bp, Homo sapiens
taccatcaaacaaatcat

SEQ ID NO: 3651748 - DNA, 11 bp, Homo sapiens
taccccaccct

SEQ ID NO: 3651749 - DNA, 16 bp, Homo sapiens
tacctgccttgcctgt

SEQ ID NO: 3651750 - DNA, 20 bp, Homo sapiens
tacgtgcccatttcacacaa

SEQ ID NO: 3651751 - DNA, 20 bp, Homo sapiens
tactacctatgtacttgaaa

SEQ ID NO: 3651752 - DNA, 15 bp, Homo sapiens
tactcaggaggctga

SEQ ID NO: 3651753 - DNA, 19 bp, Homo sapiens
tactcatttggatataaat

SEQ ID NO: 3651754 - DNA, 22 bp, Homo sapiens
tactgtaatagatcagcatcca

SEQ ID NO: 3651755 - DNA, 20 bp, Homo sapiens
tacttatttataacattgta

SEQ ID NO: 3651756 - DNA, 19 bp, Homo sapiens
tacttgaaaataataaagt

SEQ ID NO: 3651757 - DNA, 16 bp, Homo sapiens
tacttttcaggcactt

SEQ ID NO: 3651758 - DNA, 15 bp, Homo sapiens
tagaaaaaactggaa

SEQ ID NO: 3651759 - DNA, 16 bp, Homo sapiens
tagaaaaaactggaaa

SEQ ID NO: 3651760 - DNA, 20 bp, Homo sapiens
tagaaaaaactggaaacatc

SEQ ID NO: 3651761 - DNA, 23 bp, Homo sapiens
tagaaaaaactggaaacatctga

SEQ ID NO: 3651762 - DNA, 15 bp, Homo sapiens
tagaaactttggaag

SEQ ID NO: 3651763 - DNA, 13 bp, Homo sapiens
tagaaccttctaa

SEQ ID NO: 3651764 - DNA, 13 bp, Homo sapiens
tagaataccccac

SEQ ID NO: 3651765 - DNA, 17 bp, Homo sapiens
tagaatcaagtctgtga

SEQ ID NO: 3651766 - DNA, 18 bp, Homo sapiens
tagaatcaagtctgtgaa

SEQ ID NO: 3651767 - DNA, 13 bp, Homo sapiens
tagaatgtgaaaa

SEQ ID NO: 3651768 - DNA, 20 bp, Homo sapiens
tagagtccccccgaccagat

SEQ ID NO: 3651769 - DNA, 19 bp, Homo sapiens
tagataccattttgaaata

SEQ ID NO: 3651770 - DNA, 17 bp, Homo sapiens
tagataggtcatgcaag

SEQ ID NO: 3651771 - DNA, 15 bp, Homo sapiens
tagatggtagaaact

SEQ ID NO: 3651772 - DNA, 20 bp, Homo sapiens
tagcaataagttgaatgata

SEQ ID NO: 3651773 - DNA, 18 bp, Homo sapiens
tagcatatataattttat

SEQ ID NO: 3651774 - DNA, 19 bp, Homo sapiens
tagcattttaatagtttct

SEQ ID NO: 3651775 - DNA, 12 bp, Homo sapiens
tagctcacagca

SEQ ID NO: 3651776 - DNA, 14 bp, Homo sapiens
tagcttcctgcagg

SEQ ID NO: 3651777 - DNA, 15 bp, Homo sapiens
tagcttcctgcagga

SEQ ID NO: 3651778 - DNA, 15 bp, Homo sapiens
tagctttctttccct

SEQ ID NO: 3651779 - DNA, 13 bp, Homo sapiens
tagcttttcactt

SEQ ID NO: 3651780 - DNA, 18 bp, Homo sapiens
taggacatctctgtaaaa

SEQ ID NO: 3651781 - DNA, 23 bp, Homo sapiens
taggacatctctgtaaaaagcag

SEQ ID NO: 3651782 - DNA, 17 bp, Homo sapiens
taggacttaatttagca

SEQ ID NO: 3651783 - DNA, 17 bp, Homo sapiens
tagggctggctggagga

SEQ ID NO: 3651784 - DNA, 16 bp, Homo sapiens
taggggcaaaaatttg

SEQ ID NO: 3651785 - DNA, 19 bp, Homo sapiens
tagggttctatatttactg

SEQ ID NO: 3651786 - DNA, 20 bp, Homo sapiens
tagggttctatatttactgt

SEQ ID NO: 3651787 - DNA, 21 bp, Homo sapiens
tagtacccaacctggtaatta

SEQ ID NO: 3651788 - DNA, 12 bp, Homo sapiens
tagtattttgag

SEQ ID NO: 3651789 - DNA, 23 bp, Homo sapiens
tagtattttgagccttattaaaa

SEQ ID NO: 3651790 - DNA, 16 bp, Homo sapiens
tagtcttgttgttcat

SEQ ID NO: 3651791 - DNA, 18 bp, Homo sapiens
tagtgaaaattttattga

SEQ ID NO: 3651792 - DNA, 13 bp, Homo sapiens
tagtgtgtccatg

SEQ ID NO: 3651793 - DNA, 11 bp, Homo sapiens
tataaacacag

SEQ ID NO: 3651794 - DNA, 13 bp, Homo sapiens
tataaacacagta

SEQ ID NO: 3651795 - DNA, 18 bp, Homo sapiens
tataatggcctcttaaaa

SEQ ID NO: 3651796 - DNA, 22 bp, Homo sapiens
tataatggcctcttaaaaatta

SEQ ID NO: 3651797 - DNA, 23 bp, Homo sapiens
tatactatttattaaaaccattc

SEQ ID NO: 3651798 - DNA, 14 bp, Homo sapiens
tatactcatttgga

SEQ ID NO: 3651799 - DNA, 21 bp, Homo sapiens
tatactcatttggatataaat

SEQ ID NO: 3651800 - DNA, 22 bp, Homo sapiens
tatagataaatccaatagtctg

SEQ ID NO: 3651801 - DNA, 21 bp, Homo sapiens
tatagatggtagaaactttgg

SEQ ID NO: 3651802 - DNA, 15 bp, Homo sapiens
tataggacttaattt

SEQ ID NO: 3651803 - DNA, 15 bp, Homo sapiens
tatagtgttgtgtta

SEQ ID NO: 3651804 - DNA, 18 bp, Homo sapiens
tatataattttattgctg

SEQ ID NO: 3651805 - DNA, 20 bp, Homo sapiens
tatatatgtatatctgtgta

SEQ ID NO: 3651806 - DNA, 17 bp, Homo sapiens
tatatattttgaaagga

SEQ ID NO: 3651807 - DNA, 19 bp, Homo sapiens
tatatgaagcagaatgaga

SEQ ID NO: 3651808 - DNA, 17 bp, Homo sapiens
tatattatataaagaat

SEQ ID NO: 3651809 - DNA, 21 bp, Homo sapiens
tatcaaataaaaagcatgaga

SEQ ID NO: 3651810 - DNA, 19 bp, Homo sapiens
tatcatcaatctttatgta

SEQ ID NO: 3651811 - DNA, 19 bp, Homo sapiens
tatccctggcttccccttc

SEQ ID NO: 3651812 - DNA, 15 bp, Homo sapiens
tatctaacacttttg

SEQ ID NO: 3651813 - DNA, 20 bp, Homo sapiens
tatctcgctagccatatatt

SEQ ID NO: 3651814 - DNA, 15 bp, Homo sapiens
tatctgatatctgtt

SEQ ID NO: 3651815 - DNA, 17 bp, Homo sapiens
tatctgtttgcttctaa

SEQ ID NO: 3651816 - DNA, 13 bp, Homo sapiens
tatcttaaaattg

SEQ ID NO: 3651817 - DNA, 16 bp, Homo sapiens
tatctttgccaccctc

SEQ ID NO: 3651818 - DNA, 22 bp, Homo sapiens
tatctttgccaccctcatgctg

SEQ ID NO: 3651819 - DNA, 17 bp, Homo sapiens
tatgaaacaaatatact

SEQ ID NO: 3651820 - DNA, 17 bp, Homo sapiens
tatgaagcagaatgaga

SEQ ID NO: 3651821 - DNA, 23 bp, Homo sapiens
tatgaagccctaagtaaatctaa

SEQ ID NO: 3651822 - DNA, 22 bp, Homo sapiens
tatgagacttcctattaattta

SEQ ID NO: 3651823 - DNA, 22 bp, Homo sapiens
tatgagattggaaaaaattaga

SEQ ID NO: 3651824 - DNA, 14 bp, Homo sapiens
tatgctgtgtgcag

SEQ ID NO: 3651825 - DNA, 18 bp, Homo sapiens
tatggcaacgttcatgtt

SEQ ID NO: 3651826 - DNA, 18 bp, Homo sapiens
tatggtacctctgtctat

SEQ ID NO: 3651827 - DNA, 16 bp, Homo sapiens
tatgtatatctgtgta

SEQ ID NO: 3651828 - DNA, 16 bp, Homo sapiens
tatgtctttaaaatga

SEQ ID NO: 3651829 - DNA, 22 bp, Homo sapiens
tattatatatgtatatctgtgt

SEQ ID NO: 3651830 - DNA, 19 bp, Homo sapiens
tattattttctgtaattct

SEQ ID NO: 3651831 - DNA, 20 bp, Homo sapiens
tattattttctgtaattctt

SEQ ID NO: 3651832 - DNA, 21 bp, Homo sapiens
tattcccatggtagactgtga

SEQ ID NO: 3651833 - DNA, 14 bp, Homo sapiens
tattcctaattcct

SEQ ID NO: 3651834 - DNA, 17 bp, Homo sapiens
tattcctaattcctgta

SEQ ID NO: 3651835 - DNA, 18 bp, Homo sapiens
tattcctaattcctgtat

SEQ ID NO: 3651836 - DNA, 14 bp, Homo sapiens
tattcgaatgaaat

SEQ ID NO: 3651837 - DNA, 14 bp, Homo sapiens
tattgaatataatg

SEQ ID NO: 3651838 - DNA, 18 bp, Homo sapiens
tattgctggaatctacta

SEQ ID NO: 3651839 - DNA, 20 bp, Homo sapiens
tattgctgtaaataaaaata

SEQ ID NO: 3651840 - DNA, 19 bp, Homo sapiens
tatttaccagaagtttaaa

SEQ ID NO: 3651841 - DNA, 14 bp, Homo sapiens
tatttcaaccacac

SEQ ID NO: 3651842 - DNA, 23 bp, Homo sapiens
tatttccatacgtgcccatttca

SEQ ID NO: 3651843 - DNA, 14 bp, Homo sapiens
tatttgatttgcaa

SEQ ID NO: 3651844 - DNA, 12 bp, Homo sapiens
tattttaacata

SEQ ID NO: 3651845 - DNA, 15 bp, Homo sapiens
tattttaacatagca

SEQ ID NO: 3651846 - DNA, 20 bp, Homo sapiens
tattttgagccttattaaaa

SEQ ID NO: 3651847 - DNA, 14 bp, Homo sapiens
tattttgattgttt

SEQ ID NO: 3651848 - DNA, 17 bp, Homo sapiens
tatttttgctctccctc

SEQ ID NO: 3651849 - DNA, 19 bp, Homo sapiens
tcaaacaaatcattttgat

SEQ ID NO: 3651850 - DNA, 23 bp, Homo sapiens
tcaaacaaatcattttgatgtat

SEQ ID NO: 3651851 - DNA, 15 bp, Homo sapiens
tcaaatggtattttt

SEQ ID NO: 3651852 - DNA, 20 bp, Homo sapiens
tcaaatggtattttttgtga

SEQ ID NO: 3651853 - DNA, 23 bp, Homo sapiens
tcaaatggtattttttgtgaatg

SEQ ID NO: 3651854 - DNA, 13 bp, Homo sapiens
tcaaattctgatt

SEQ ID NO: 3651855 - DNA, 14 bp, Homo sapiens
tcaaattctgatta

SEQ ID NO: 3651856 - DNA, 19 bp, Homo sapiens
tcaaattctgattattaca

SEQ ID NO: 3651857 - DNA, 22 bp, Homo sapiens
tcaaattctgattattacaaca

SEQ ID NO: 3651858 - DNA, 11 bp, Homo sapiens
tcaacacacag

SEQ ID NO: 3651859 - DNA, 18 bp, Homo sapiens
tcaaccccacttcctact

SEQ ID NO: 3651860 - DNA, 15 bp, Homo sapiens
tcaagcattgctaaa

SEQ ID NO: 3651861 - DNA, 15 bp, Homo sapiens
tcaaggctgcagtga

SEQ ID NO: 3651862 - DNA, 19 bp, Homo sapiens
tcttaaggacagtgttcaa

SEQ ID NO: 3651863 - DNA, 23 bp, Homo sapiens
tcttaaggacagtgttcaaattc

SEQ ID NO: 3651864 - DNA, 19 bp, Homo sapiens
tcttattcctaattcctgt

SEQ ID NO: 3651865 - DNA, 15 bp, Homo sapiens
tcttcacattctgaa

SEQ ID NO: 3651866 - DNA, 10 bp, Homo sapiens
tcttccttcc

SEQ ID NO: 3651867 - DNA, 11 bp, Homo sapiens
tcttccttcct

SEQ ID NO: 3651868 - DNA, 12 bp, Homo sapiens
tcttccttcctt

SEQ ID NO: 3651869 - DNA, 22 bp, Homo sapiens
tcttccttcctttctctctttc

SEQ ID NO: 3651870 - DNA, 19 bp, Homo sapiens
tcttctcctttgtcaaatg

SEQ ID NO: 3651871 - DNA, 21 bp, Homo sapiens
tcttctcctttgtcaaatggt

SEQ ID NO: 3651872 - DNA, 18 bp, Homo sapiens
tcttctggtgagtgcaag

SEQ ID NO: 3651873 - DNA, 14 bp, Homo sapiens
tcttctttaatttt

SEQ ID NO: 3651874 - DNA, 14 bp, Homo sapiens
tcttgctctgctca

SEQ ID NO: 3651875 - DNA, 15 bp, Homo sapiens
tcttggtatgatcat

SEQ ID NO: 3651876 - DNA, 12 bp, Homo sapiens
tctttccttcct

SEQ ID NO: 3651877 - DNA, 13 bp, Homo sapiens
tctttccttcctt

SEQ ID NO: 3651878 - DNA, 22 bp, Homo sapiens
tctttctcattagagatctgaa

SEQ ID NO: 3651879 - DNA, 18 bp, Homo sapiens
tctttcttttgtgcatat

SEQ ID NO: 3651880 - DNA, 18 bp, Homo sapiens
tctttgccaccctcatgc

SEQ ID NO: 3651881 - DNA, 14 bp, Homo sapiens
tctttgttaaaata

SEQ ID NO: 3651882 - DNA, 19 bp, Homo sapiens
tgaaaaagtgtttttacat

SEQ ID NO: 3651883 - DNA, 14 bp, Homo sapiens
tgaaaagttttcaa

SEQ ID NO: 3651884 - DNA, 18 bp, Homo sapiens
tgaaaagttttcaagcat

SEQ ID NO: 3651885 - DNA, 22 bp, Homo sapiens
tgaaaagttttcaagcattgct

SEQ ID NO: 3651886 - DNA, 20 bp, Homo sapiens
tgaaaataataaagtggcat

SEQ ID NO: 3651887 - DNA, 17 bp, Homo sapiens
tgaaaatggctgaagaa

SEQ ID NO: 3651888 - DNA, 18 bp, Homo sapiens
tgaaaatggctgaagaaa

SEQ ID NO: 3651889 - DNA, 20 bp, Homo sapiens
tgaaaatggctgaagaaaca

SEQ ID NO: 3651890 - DNA, 16 bp, Homo sapiens
tgaaagtggcaagctc

SEQ ID NO: 3651891 - DNA, 17 bp, Homo sapiens
tgaaagtggcaagctct

SEQ ID NO: 3651892 - DNA, 18 bp, Homo sapiens
tgaaataaagtcaaatca

SEQ ID NO: 3651893 - DNA, 21 bp, Homo sapiens
tgaaattagtgttttcattct

SEQ ID NO: 3651894 - DNA, 17 bp, Homo sapiens
tgaacctgtgaggaaga

SEQ ID NO: 3651895 - DNA, 18 bp, Homo sapiens
tgaacctgtgaggaagag

SEQ ID NO: 3651896 - DNA, 22 bp, Homo sapiens
tgaagaaacacagcatgcattt

SEQ ID NO: 3651897 - DNA, 19 bp, Homo sapiens
tgaagggaagcccagcctg

SEQ ID NO: 3651898 - DNA, 20 bp, Homo sapiens
tgaagggaagcccagcctgc

SEQ ID NO: 3651899 - DNA, 17 bp, Homo sapiens
tgaagtagtgtgagtgt

SEQ ID NO: 3651900 - DNA, 18 bp, Homo sapiens
tgaagtagtgtgagtgtt

SEQ ID NO: 3651901 - DNA, 12 bp, Homo sapiens
tgaagtgcatgt

SEQ ID NO: 3651902 - DNA, 13 bp, Homo sapiens
tgaataaaatgtt

SEQ ID NO: 3651903 - DNA, 15 bp, Homo sapiens
tgaatccatcgattt

SEQ ID NO: 3651904 - DNA, 18 bp, Homo sapiens
tgaatccatcgatttgta

SEQ ID NO: 3651905 - DNA, 14 bp, Homo sapiens
tgaatggttgcaaa

SEQ ID NO: 3651906 - DNA, 19 bp, Homo sapiens
tgacagtggttatatttca

SEQ ID NO: 3651907 - DNA, 18 bp, Homo sapiens
tgacatgagtctccagat

SEQ ID NO: 3651908 - DNA, 18 bp, Homo sapiens
tgacattgtcagaatgtt

SEQ ID NO: 3651909 - DNA, 21 bp, Homo sapiens
tgacattgtcagaatgttgtg

SEQ ID NO: 3651910 - DNA, 19 bp, Homo sapiens
tgacctgcctcccttcatg

SEQ ID NO: 3651911 - DNA, 19 bp, Homo sapiens
tgacgtcttaggtggcagg

SEQ ID NO: 3651912 - DNA, 16 bp, Homo sapiens
tgactttggctgcatg

SEQ ID NO: 3651913 - DNA, 18 bp, Homo sapiens
tgagaaagacatctgagg

SEQ ID NO: 3651914 - DNA, 22 bp, Homo sapiens
tgagaaagacatctgaggaaaa

SEQ ID NO: 3651915 - DNA, 15 bp, Homo sapiens
tgagaaatataaaaa

SEQ ID NO: 3651916 - DNA, 18 bp, Homo sapiens
tgagaaatataaaaataa

SEQ ID NO: 3651917 - DNA, 14 bp, Homo sapiens
tgagactccatctc

SEQ ID NO: 3651918 - DNA, 16 bp, Homo sapiens
tgagccttattaaaat

SEQ ID NO: 3651919 - DNA, 17 bp, Homo sapiens
tgaggaaactcatacag

SEQ ID NO: 3651920 - DNA, 23 bp, Homo sapiens
tgaggaattaagggttaccccac

SEQ ID NO: 3651921 - DNA, 16 bp, Homo sapiens
tgaggcaactcagcag

SEQ ID NO: 3651922 - DNA, 18 bp, Homo sapiens
tgaggcaactcagcaggc

SEQ ID NO: 3651923 - DNA, 13 bp, Homo sapiens
tgaggtgggctga

SEQ ID NO: 3651924 - DNA, 12 bp, Homo sapiens
tgagtagcatat

SEQ ID NO: 3651925 - DNA, 23 bp, Homo sapiens
tgagtcagaggcagaacctagtc

SEQ ID NO: 3651926 - DNA, 22 bp, Homo sapiens
tgagtgtacatttatgtgtgaa

SEQ ID NO: 3651927 - DNA, 17 bp, Homo sapiens
tgagttctgcacataca

SEQ ID NO: 3651928 - DNA, 18 bp, Homo sapiens
tgataatagctcacagca

SEQ ID NO: 3651929 - DNA, 22 bp, Homo sapiens
tgataatagctcacagcacatt

SEQ ID NO: 3651930 - DNA, 22 bp, Homo sapiens
tgatagaagaaggactgaagaa

SEQ ID NO: 3651931 - DNA, 23 bp, Homo sapiens
tgatagaagaaggactgaagaaa

SEQ ID NO: 3651932 - DNA, 15 bp, Homo sapiens
tgatatgtctttaaa

SEQ ID NO: 3651933 - DNA, 22 bp, Homo sapiens
tgatgaatttaccatcaaacaa

SEQ ID NO: 3651934 - DNA, 19 bp, Homo sapiens
tgattaaactgggaaatga

SEQ ID NO: 3651935 - DNA, 20 bp, Homo sapiens
tgattaaggactacagaatt

SEQ ID NO: 3651936 - DNA, 21 bp, Homo sapiens
tgattaaggactacagaattg

SEQ ID NO: 3651937 - DNA, 15 bp, Homo sapiens
tgattggaaaataat

SEQ ID NO: 3651938 - DNA, 17 bp, Homo sapiens
tgattgtttgatgaata

SEQ ID NO: 3651939 - DNA, 14 bp, Homo sapiens
tgatttaattctta

SEQ ID NO: 3651940 - DNA, 17 bp, Homo sapiens
tgatttgcaacactgcc

SEQ ID NO: 3651941 - DNA, 19 bp, Homo sapiens
tgcaacactgccaaacatc

SEQ ID NO: 3651942 - DNA, 20 bp, Homo sapiens
tgcaacactgccaaacatca

SEQ ID NO: 3651943 - DNA, 18 bp, Homo sapiens
tgcaagagcctgagactg

SEQ ID NO: 3651944 - DNA, 21 bp, Homo sapiens
tgcaagagcctgagactggaa

SEQ ID NO: 3651945 - DNA, 22 bp, Homo sapiens
tgcaatgtctgtccctaaacat

SEQ ID NO: 3651946 - DNA, 23 bp, Homo sapiens
tgcacaatcaataaaaatggcat

SEQ ID NO: 3651947 - DNA, 18 bp, Homo sapiens
tgcactcttttgagcagt

SEQ ID NO: 3651948 - DNA, 17 bp, Homo sapiens
tgcagctaatttgtgaa

SEQ ID NO: 3651949 - DNA, 17 bp, Homo sapiens
tgcaggaaaaggctgca

SEQ ID NO: 3651950 - DNA, 21 bp, Homo sapiens
tgcagttatttaccagaagtt

SEQ ID NO: 3651951 - DNA, 18 bp, Homo sapiens
tgcagtttggtatgaaac

SEQ ID NO: 3651952 - DNA, 22 bp, Homo sapiens
tgcatatggcaacgttcatgtt

SEQ ID NO: 3651953 - DNA, 23 bp, Homo sapiens
tgcatggaaattcccttcatctg

SEQ ID NO: 3651954 - DNA, 16 bp, Homo sapiens
tgcatgtatgccatgt

SEQ ID NO: 3651955 - DNA, 14 bp, Homo sapiens
tgcatgttaaaata

SEQ ID NO: 3651956 - DNA, 12 bp, Homo sapiens
tgcattcagatc

SEQ ID NO: 3651957 - DNA, 18 bp, Homo sapiens
tgcattcagatctgaagt

SEQ ID NO: 3651958 - DNA, 12 bp, Homo sapiens
tgcatttagcat

SEQ ID NO: 3651959 - DNA, 21 bp, Homo sapiens
tgcatttagcatgagttctgc

SEQ ID NO: 3651960 - DNA, 16 bp, Homo sapiens
tgccaaacatcagtca

SEQ ID NO: 3651961 - DNA, 23 bp, Homo sapiens
tgccaaacatcagtcaattgctt

SEQ ID NO: 3651962 - DNA, 21 bp, Homo sapiens
tgccacacttgtgtgccacag

SEQ ID NO: 3651963 - DNA, 19 bp, Homo sapiens
tgccatgtatgttgcatga

SEQ ID NO: 3651964 - DNA, 18 bp, Homo sapiens
tgccattacactccagcc

SEQ ID NO: 3651965 - DNA, 18 bp, Homo sapiens
tgcccaaatataacatga

SEQ ID NO: 3651966 - DNA, 19 bp, Homo sapiens
tgcccactcccatcccttc

SEQ ID NO: 3651967 - DNA, 20 bp, Homo sapiens
tgcccatttcacacaactgt

SEQ ID NO: 3651968 - DNA, 20 bp, Homo sapiens
tgcctacattagtgagattt

SEQ ID NO: 3651969 - DNA, 16 bp, Homo sapiens
tgcctgtaatcccagc

SEQ ID NO: 3651970 - DNA, 23 bp, Homo sapiens
tgcctttgacctgcctcccttca

SEQ ID NO: 3651971 - DNA, 23 bp, Homo sapiens
tgcgtttcttccactgagtcttt

SEQ ID NO: 3651972 - DNA, 17 bp, Homo sapiens
tgctattcgtaagttct

SEQ ID NO: 3651973 - DNA, 20 bp, Homo sapiens
tgctattcgtaagttctgtg

SEQ ID NO: 3651974 - DNA, 14 bp, Homo sapiens
tgctcatttcagga

SEQ ID NO: 3651975 - DNA, 13 bp, Homo sapiens
tgctctctaagaa

SEQ ID NO: 3651976 - DNA, 23 bp, Homo sapiens
tgctgagcctgtaaaataaaagg

SEQ ID NO: 3651977 - DNA, 16 bp, Homo sapiens
tgctgtaaataaaaat

SEQ ID NO: 3651978 - DNA, 20 bp, Homo sapiens
tgctgtaaataaaaatagct

SEQ ID NO: 3651979 - DNA, 11 bp, Homo sapiens
tgctgtatttg

SEQ ID NO: 3651980 - DNA, 22 bp, Homo sapiens
tgctgtctgaaaaagtgttttt

SEQ ID NO: 3651981 - DNA, 13 bp, Homo sapiens
tgctgtgtgcaga

SEQ ID NO: 3651982 - DNA, 11 bp, Homo sapiens
tgcttcacaca

SEQ ID NO: 3651983 - DNA, 22 bp, Homo sapiens
tgcttcacacaaagtgaaatta

SEQ ID NO: 3651984 - DNA, 22 bp, Homo sapiens
tgcttgaacctgtgaggaagag

SEQ ID NO: 3651985 - DNA, 18 bp, Homo sapiens
tgcttgagcatgcccaaa

SEQ ID NO: 3651986 - DNA, 19 bp, Homo sapiens
tgctttctgatacatctgt

SEQ ID NO: 3651987 - DNA, 17 bp, Homo sapiens
tggaaaaaaaaaaatat

SEQ ID NO: 3651988 - DNA, 16 bp, Homo sapiens
tggaaacatctgattt

SEQ ID NO: 3651989 - DNA, 23 bp, Homo sapiens
tggaagaagaaccaggcatggaa

SEQ ID NO: 3651990 - DNA, 14 bp, Homo sapiens
tggaagaattcatg

SEQ ID NO: 3651991 - DNA, 17 bp, Homo sapiens
tggaagaattcatgatg

SEQ ID NO: 3651992 - DNA, 20 bp, Homo sapiens
tggaagacctaaggcagaca

SEQ ID NO: 3651993 - DNA, 18 bp, Homo sapiens
acacctaaattaacaaat

SEQ ID NO: 3651994 - DNA, 15 bp, Homo sapiens
acacctgagaatgtg

SEQ ID NO: 3651995 - DNA, 16 bp, Homo sapiens
acactcatcaggtaaa

SEQ ID NO: 3651996 - DNA, 13 bp, Homo sapiens
acactccagcctg

SEQ ID NO: 3651997 - DNA, 16 bp, Homo sapiens
acactccagcctgggc

SEQ ID NO: 3651998 - DNA, 13 bp, Homo sapiens
acacttcaccttc

SEQ ID NO: 3651999 - DNA, 15 bp, Homo sapiens
acactttacattctt

SEQ ID NO: 3652000 - DNA, 20 bp, Homo sapiens
acacttttgctctgcaggca

SEQ ID NO: 3652001 - DNA, 21 bp, Homo sapiens
acagaagtggaaggataatga

SEQ ID NO: 3652002 - DNA, 22 bp, Homo sapiens
acagaattgggcccttagaatg

SEQ ID NO: 3652003 - DNA, 23 bp, Homo sapiens
acagaattgggcccttagaatgt

SEQ ID NO: 3652004 - DNA, 18 bp, Homo sapiens
acagactgccttatatta

SEQ ID NO: 3652005 - DNA, 13 bp, Homo sapiens
acagcatgcattt

SEQ ID NO: 3652006 - DNA, 20 bp, Homo sapiens
acagcatgcatttagcatga

SEQ ID NO: 3652007 - DNA, 18 bp, Homo sapiens
acagcatttcagctgtga

SEQ ID NO: 3652008 - DNA, 14 bp, Homo sapiens
acaggaaggaagca

SEQ ID NO: 3652009 - DNA, 17 bp, Homo sapiens
acaggttttatgagact

SEQ ID NO: 3652010 - DNA, 17 bp, Homo sapiens
acagtatagataaatcc

SEQ ID NO: 3652011 - DNA, 15 bp, Homo sapiens
acagtgttcaaattc

SEQ ID NO: 3652012 - DNA, 18 bp, Homo sapiens
acagtgttcaaattctga

SEQ ID NO: 3652013 - DNA, 22 bp, Homo sapiens
acagttcctctttgttggaaga

SEQ ID NO: 3652014 - DNA, 12 bp, Homo sapiens
acatacagatgg

SEQ ID NO: 3652015 - DNA, 16 bp, Homo sapiens
acatagcagctggtta

SEQ ID NO: 3652016 - DNA, 16 bp, Homo sapiens
acatagtggtatttta

SEQ ID NO: 3652017 - DNA, 17 bp, Homo sapiens
acatagtggtattttaa

SEQ ID NO: 3652018 - DNA, 16 bp, Homo sapiens
acatatagctttgcaa

SEQ ID NO: 3652019 - DNA, 21 bp, Homo sapiens
acatctgaggaaaatggaaga

SEQ ID NO: 3652020 - DNA, 15 bp, Homo sapiens
acatctgatttctga

SEQ ID NO: 3652021 - DNA, 16 bp, Homo sapiens
acatctgtcagtgagt

SEQ ID NO: 3652022 - DNA, 20 bp, Homo sapiens
acatctgtcagtgagtcaga

SEQ ID NO: 3652023 - DNA, 17 bp, Homo sapiens
acatgaaagtcaagtct

SEQ ID NO: 3652024 - DNA, 19 bp, Homo sapiens
acatgaaagtcaagtctac

SEQ ID NO: 3652025 - DNA, 15 bp, Homo sapiens
acatgagtctccaga

SEQ ID NO: 3652026 - DNA, 16 bp, Homo sapiens
acatgagtctccagat

SEQ ID NO: 3652027 - DNA, 13 bp, Homo sapiens
acatgttttacaa

SEQ ID NO: 3652028 - DNA, 19 bp, Homo sapiens
acatgttttacaaagaaac

SEQ ID NO: 3652029 - DNA, 20 bp, Homo sapiens
acatgttttacaaagaaaca

SEQ ID NO: 3652030 - DNA, 13 bp, Homo sapiens
acattgtcagaat

SEQ ID NO: 3652031 - DNA, 16 bp, Homo sapiens
acattgtcagaatgtt

SEQ ID NO: 3652032 - DNA, 14 bp, Homo sapiens
acatttatgtgtga

SEQ ID NO: 3652033 - DNA, 22 bp, Homo sapiens
acatttgacatgagtctccaga

SEQ ID NO: 3652034 - DNA, 17 bp, Homo sapiens
acatttgttaatgattc

SEQ ID NO: 3652035 - DNA, 12 bp, Homo sapiens
acatttgttctg

SEQ ID NO: 3652036 - DNA, 23 bp, Homo sapiens
accaccctatcatcagttaggat

SEQ ID NO: 3652037 - DNA, 13 bp, Homo sapiens
accagaaggaagc

SEQ ID NO: 3652038 - DNA, 14 bp, Homo sapiens
accagaaggaagcc

SEQ ID NO: 3652039 - DNA, 17 bp, Homo sapiens
accagaagtttaaatct

SEQ ID NO: 3652040 - DNA, 17 bp, Homo sapiens
accagaatgaggcacat

SEQ ID NO: 3652041 - DNA, 21 bp, Homo sapiens
accagaatgaggcacatgaca

SEQ ID NO: 3652042 - DNA, 22 bp, Homo sapiens
accattttgaaatattcacaag

SEQ ID NO: 3652043 - DNA, 20 bp, Homo sapiens
acccatctaaaccagaagga

SEQ ID NO: 3652044 - DNA, 15 bp, Homo sapiens
accccagcctcactc

SEQ ID NO: 3652045 - DNA, 12 bp, Homo sapiens
accctcatgctg

SEQ ID NO: 3652046 - DNA, 16 bp, Homo sapiens
accctgcccactccca

SEQ ID NO: 3652047 - DNA, 18 bp, Homo sapiens
accctgggctggagagtt

SEQ ID NO: 3652048 - DNA, 14 bp, Homo sapiens
accctgtctctact

SEQ ID NO: 3652049 - DNA, 13 bp, Homo sapiens
acccttcaatgtt

SEQ ID NO: 3652050 - DNA, 16 bp, Homo sapiens
acccttcaatgttaaa

SEQ ID NO: 3652051 - DNA, 17 bp, Homo sapiens
acccttcaatgttaaat

SEQ ID NO: 3652052 - DNA, 22 bp, Homo sapiens
accgaactcgggattacagaaa

SEQ ID NO: 3652053 - DNA, 17 bp, Homo sapiens
acctaaattaacaaatt

SEQ ID NO: 3652054 - DNA, 18 bp, Homo sapiens
acctaaattaacaaattc

SEQ ID NO: 3652055 - DNA, 13 bp, Homo sapiens
acctaaggcagac

SEQ ID NO: 3652056 - DNA, 16 bp, Homo sapiens
acctaaggcagacagg

SEQ ID NO: 3652057 - DNA, 19 bp, Homo sapiens
acctgaattgaaagagaat

SEQ ID NO: 3652058 - DNA, 16 bp, Homo sapiens
acctgccttgcctgtt

SEQ ID NO: 3652059 - DNA, 15 bp, Homo sapiens
acctgtgaggaagag

SEQ ID NO: 3652060 - DNA, 22 bp, Homo sapiens
acgatcattgtgcccacttacc

SEQ ID NO: 3652061 - DNA, 10 bp, Homo sapiens
acggaggctc

SEQ ID NO: 3652062 - DNA, 12 bp, Homo sapiens
acggagtcttgc

SEQ ID NO: 3652063 - DNA, 14 bp, Homo sapiens
acgtgcccatttca

SEQ ID NO: 3652064 - DNA, 17 bp, Homo sapiens
acgtgcccatttcacac

SEQ ID NO: 3652065 - DNA, 18 bp, Homo sapiens
acgtgcccatttcacaca

SEQ ID NO: 3652066 - DNA, 12 bp, Homo sapiens
acgtgtgaggat

SEQ ID NO: 3652067 - DNA, 14 bp, Homo sapiens
acgttcatgttcat

SEQ ID NO: 3652068 - DNA, 13 bp, Homo sapiens
actaaaagtacaa

SEQ ID NO: 3652069 - DNA, 17 bp, Homo sapiens
actaacttattttgatt

SEQ ID NO: 3652070 - DNA, 18 bp, Homo sapiens
actaacttattttgattg

SEQ ID NO: 3652071 - DNA, 13 bp, Homo sapiens
actacagaagtgg

SEQ ID NO: 3652072 - DNA, 16 bp, Homo sapiens
actacagaagtggaag

SEQ ID NO: 3652073 - DNA, 12 bp, Homo sapiens
actacagaattg

SEQ ID NO: 3652074 - DNA, 15 bp, Homo sapiens
actacaggttttatg

SEQ ID NO: 3652075 - DNA, 16 bp, Homo sapiens
actacaggttttatga

SEQ ID NO: 3652076 - DNA, 20 bp, Homo sapiens
actagcaataagttgaatga

SEQ ID NO: 3652077 - DNA, 20 bp, Homo sapiens
actatggtatatattttgaa

SEQ ID NO: 3652078 - DNA, 18 bp, Homo sapiens
actatttattaaaaccat

SEQ ID NO: 3652079 - DNA, 18 bp, Homo sapiens
actcaggaggctgaggca

SEQ ID NO: 3652080 - DNA, 18 bp, Homo sapiens
actcatttggatataaat

SEQ ID NO: 3652081 - DNA, 13 bp, Homo sapiens
actccatctcaaa

SEQ ID NO: 3652082 - DNA, 21 bp, Homo sapiens
actccatttcccacttccacc

SEQ ID NO: 3652083 - DNA, 16 bp, Homo sapiens
actctatccctggctt

SEQ ID NO: 3652084 - DNA, 17 bp, Homo sapiens
actctatccctggcttc

SEQ ID NO: 3652085 - DNA, 18 bp, Homo sapiens
actctctagtgcaggaaa

SEQ ID NO: 3652086 - DNA, 19 bp, Homo sapiens
actgaaattagtgttttca

SEQ ID NO: 3652087 - DNA, 21 bp, Homo sapiens
actgaactttgctgagcctgt

SEQ ID NO: 3652088 - DNA, 13 bp, Homo sapiens
actgccaaacatc

SEQ ID NO: 3652089 - DNA, 17 bp, Homo sapiens
actgccttatattattt

SEQ ID NO: 3652090 - DNA, 16 bp, Homo sapiens
actggaaacatctgat

SEQ ID NO: 3652091 - DNA, 18 bp, Homo sapiens
actggaaacatctgattt

SEQ ID NO: 3652092 - DNA, 20 bp, Homo sapiens
actggaattttgctttatca

SEQ ID NO: 3652093 - DNA, 12 bp, Homo sapiens
actgggaaatga

SEQ ID NO: 3652094 - DNA, 17 bp, Homo sapiens
actgtgacacagctgag

SEQ ID NO: 3652095 - DNA, 20 bp, Homo sapiens
actgttcatgaatacgtaaa

SEQ ID NO: 3652096 - DNA, 20 bp, Homo sapiens
acttaataacacttcacctt

SEQ ID NO: 3652097 - DNA, 11 bp, Homo sapiens
acttaatttag

SEQ ID NO: 3652098 - DNA, 18 bp, Homo sapiens
acttacacacctgagaat

SEQ ID NO: 3652099 - DNA, 23 bp, Homo sapiens
acttagcataatattttctttct

SEQ ID NO: 3652100 - DNA, 17 bp, Homo sapiens
acttatttataacattg

SEQ ID NO: 3652101 - DNA, 13 bp, Homo sapiens
acttatttccatg

SEQ ID NO: 3652102 - DNA, 15 bp, Homo sapiens
acttattttgattgt

SEQ ID NO: 3652103 - DNA, 17 bp, Homo sapiens
acttcctattaatttat

SEQ ID NO: 3652104 - DNA, 22 bp, Homo sapiens
acttctattttcaagtggaaac

SEQ ID NO: 3652105 - DNA, 14 bp, Homo sapiens
acttctgaaagagc

SEQ ID NO: 3652106 - DNA, 23 bp, Homo sapiens
acttcttaaggacagtgttcaaa

SEQ ID NO: 3652107 - DNA, 16 bp, Homo sapiens
acttgctgtgaaatga

SEQ ID NO: 3652108 - DNA, 18 bp, Homo sapiens
acttggagagagattcag

SEQ ID NO: 3652109 - DNA, 23 bp, Homo sapiens
acttggagagagattcagaagtt

SEQ ID NO: 3652110 - DNA, 14 bp, Homo sapiens
actttcctatgaca

SEQ ID NO: 3652111 - DNA, 17 bp, Homo sapiens
actttggctgcatgcga

SEQ ID NO: 3652112 - DNA, 21 bp, Homo sapiens
actttgggaggccgaggcagg

SEQ ID NO: 3652113 - DNA, 14 bp, Homo sapiens
actttgggaggctg

SEQ ID NO: 3652114 - DNA, 18 bp, Homo sapiens
agaaaaaactggaaacat

SEQ ID NO: 3652115 - DNA, 17 bp, Homo sapiens
agaaaagaccccagact

SEQ ID NO: 3652116 - DNA, 15 bp, Homo sapiens
agaaacaaaatataa

SEQ ID NO: 3652117 - DNA, 18 bp, Homo sapiens
agaaacacagcatgcatt

SEQ ID NO: 3652118 - DNA, 20 bp, Homo sapiens
agaaacacagcatgcattta

SEQ ID NO: 3652119 - DNA, 16 bp, Homo sapiens
agaaacacggagtttc

SEQ ID NO: 3652120 - DNA, 24 bp, Homo sapiens
agaaactttggaagttttacttga

SEQ ID NO: 3652121 - DNA, 17 bp, Homo sapiens
agaaagacatctgagga

SEQ ID NO: 3652122 - DNA, 13 bp, Homo sapiens
agaacagggatgc

SEQ ID NO: 3652123 - DNA, 21 bp, Homo sapiens
agaacctttggacaagaggaa

SEQ ID NO: 3652124 - DNA, 22 bp, Homo sapiens
agaagaaccaggcatggaaaga

SEQ ID NO: 3652125 - DNA, 14 bp, Homo sapiens
agaaggactgaaga

SEQ ID NO: 3652126 - DNA, 14 bp, Homo sapiens
agaaggcactggga

SEQ ID NO: 3652127 - DNA, 19 bp, Homo sapiens
agaagttccctgaaccttc

SEQ ID NO: 3652128 - DNA, 21 bp, Homo sapiens
agaagtttaaatctttgttaa

SEQ ID NO: 3652129 - DNA, 18 bp, Homo sapiens
agaataccccaccagcag

SEQ ID NO: 3652130 - DNA, 19 bp, Homo sapiens
agaatcagggtggagaagt

SEQ ID NO: 3652131 - DNA, 14 bp, Homo sapiens
agaatgttgtgttg

SEQ ID NO: 3652132 - DNA, 17 bp, Homo sapiens
agaattcagtagcattt

SEQ ID NO: 3652133 - DNA, 14 bp, Homo sapiens
agacaggaaggaag

SEQ ID NO: 3652134 - DNA, 22 bp, Homo sapiens
agacaggaaggaagcacaaaag

SEQ ID NO: 3652135 - DNA, 16 bp, Homo sapiens
agacaggtgggagatg

SEQ ID NO: 3652136 - DNA, 14 bp, Homo sapiens
agacctaaggcaga

SEQ ID NO: 3652137 - DNA, 20 bp, Homo sapiens
agaccttgcaatcacaaaag

SEQ ID NO: 3652138 - DNA, 19 bp, Homo sapiens
agactgccttatattattt

SEQ ID NO: 3652139 - DNA, 23 bp, Homo sapiens
agactgccttatattattttctg

SEQ ID NO: 3652140 - DNA, 20 bp, Homo sapiens
agacttcctattaatttatt

SEQ ID NO: 3652141 - DNA, 23 bp, Homo sapiens
agacttcctattaatttattaaa

SEQ ID NO: 3652142 - DNA, 12 bp, Homo sapiens
agacttggatta

SEQ ID NO: 3652143 - DNA, 13 bp, Homo sapiens
agagaatttggag

SEQ ID NO: 3652144 - DNA, 12 bp, Homo sapiens
agagagacctag

SEQ ID NO: 3652145 - DNA, 13 bp, Homo sapiens
agagataatgagg

SEQ ID NO: 3652146 - DNA, 15 bp, Homo sapiens
agagataatgaggca

SEQ ID NO: 3652147 - DNA, 14 bp, Homo sapiens
agagcataaacaat

SEQ ID NO: 3652148 - DNA, 14 bp, Homo sapiens
agagcctgagactg

SEQ ID NO: 3652149 - DNA, 12 bp, Homo sapiens
agagctgctgta

SEQ ID NO: 3652150 - DNA, 17 bp, Homo sapiens
agagctgggatggggcc

SEQ ID NO: 3652151 - DNA, 15 bp, Homo sapiens
agagctgggcagaca

SEQ ID NO: 3652152 - DNA, 20 bp, Homo sapiens
agagctgggcagacaggtgg

SEQ ID NO: 3652153 - DNA, 21 bp, Homo sapiens
agagctgggcagacaggtggg

SEQ ID NO: 3652154 - DNA, 17 bp, Homo sapiens
agaggcaggaccagaag

SEQ ID NO: 3652155 - DNA, 19 bp, Homo sapiens
agagtatacaagtgtttct

SEQ ID NO: 3652156 - DNA, 18 bp, Homo sapiens
agataaatccaatagtct

SEQ ID NO: 3652157 - DNA, 20 bp, Homo sapiens
agataccattttgaaatatt

SEQ ID NO: 3652158 - DNA, 21 bp, Homo sapiens
agatatgagaaatataaaaat

SEQ ID NO: 3652159 - DNA, 14 bp, Homo sapiens
agatcaccccagcc

SEQ ID NO: 3652160 - DNA, 11 bp, Homo sapiens
agatccttcca

SEQ ID NO: 3652161 - DNA, 19 bp, Homo sapiens
agatggggagctctggagg

SEQ ID NO: 3652162 - DNA, 21 bp, Homo sapiens
agatggggagctctggaggtg

SEQ ID NO: 3652163 - DNA, 23 bp, Homo sapiens
agatgtaaatgtgccaagaatat

SEQ ID NO: 3652164 - DNA, 17 bp, Homo sapiens
agatgtaagaagctaaa

SEQ ID NO: 3652165 - DNA, 14 bp, Homo sapiens
agatgtaatacacc

SEQ ID NO: 3652166 - DNA, 20 bp, Homo sapiens
agatgtcgtggactccagct

SEQ ID NO: 3652167 - DNA, 19 bp, Homo sapiens
agattaatgacctgaattg

SEQ ID NO: 3652168 - DNA, 20 bp, Homo sapiens
agattaatgacctgaattga

SEQ ID NO: 3652169 - DNA, 14 bp, Homo sapiens
agattagacactat

SEQ ID NO: 3652170 - DNA, 18 bp, Homo sapiens
agatttagggttctatat

SEQ ID NO: 3652171 - DNA, 13 bp, Homo sapiens
agcaaaaggatga

SEQ ID NO: 3652172 - DNA, 21 bp, Homo sapiens
agcaaatttctagatatgaga

SEQ ID NO: 3652173 - DNA, 14 bp, Homo sapiens
agcaaggaagtaag

SEQ ID NO: 3652174 - DNA, 17 bp, Homo sapiens
agcaatccttaaaaaga

SEQ ID NO: 3652175 - DNA, 19 bp, Homo sapiens
agcacatgttttacaaaga

SEQ ID NO: 3652176 - DNA, 20 bp, Homo sapiens
agcactatcgaggtatttgg

SEQ ID NO: 3652177 - DNA, 21 bp, Homo sapiens
agcactttgggaggccgaggc

SEQ ID NO: 3652178 - DNA, 18 bp, Homo sapiens
agcactttgggaggctga

SEQ ID NO: 3652179 - DNA, 19 bp, Homo sapiens
agcagaatgagatgattta

SEQ ID NO: 3652180 - DNA, 13 bp, Homo sapiens
agcagcagaggca

SEQ ID NO: 3652181 - DNA, 16 bp, Homo sapiens
agcagtccatttttga

SEQ ID NO: 3652182 - DNA, 21 bp, Homo sapiens
agcatccaaaagcaggaaccc

SEQ ID NO: 3652183 - DNA, 13 bp, Homo sapiens
agcatcctggaaa

SEQ ID NO: 3652184 - DNA, 20 bp, Homo sapiens
agcatcctggaaatttgtgt

SEQ ID NO: 3652185 - DNA, 19 bp, Homo sapiens
agcatgagttctgcacata

SEQ ID NO: 3652186 - DNA, 12 bp, Homo sapiens
agcattgctaaa

SEQ ID NO: 3652187 - DNA, 21 bp, Homo sapiens
agcattttaatagtttctaaa

SEQ ID NO: 3652188 - DNA, 20 bp, Homo sapiens
agccatatattttctgagta

SEQ ID NO: 3652189 - DNA, 17 bp, Homo sapiens
agcccattcattccatt

SEQ ID NO: 3652190 - DNA, 13 bp, Homo sapiens
agccctctcagat

SEQ ID NO: 3652191 - DNA, 21 bp, Homo sapiens
agcctcttccattccctttct

SEQ ID NO: 3652192 - DNA, 13 bp, Homo sapiens
agcctgagactgg

SEQ ID NO: 3652193 - DNA, 22 bp, Homo sapiens
agcctgcatctagctggagccc

SEQ ID NO: 3652194 - DNA, 14 bp, Homo sapiens
agcctggcttagaa

SEQ ID NO: 3652195 - DNA, 18 bp, Homo sapiens
agcctggcttagaaggca

SEQ ID NO: 3652196 - DNA, 16 bp, Homo sapiens
agccttattaaaatat

SEQ ID NO: 3652197 - DNA, 16 bp, Homo sapiens
agctaatttgtgaaag

SEQ ID NO: 3652198 - DNA, 17 bp, Homo sapiens
agctaatttgtgaaagt

SEQ ID NO: 3652199 - DNA, 17 bp, Homo sapiens
agctacaggggaggctg

SEQ ID NO: 3652200 - DNA, 15 bp, Homo sapiens
atacagtctctattt

SEQ ID NO: 3652201 - DNA, 20 bp, Homo sapiens
atacagtctctatttgattt

SEQ ID NO: 3652202 - DNA, 21 bp, Homo sapiens
atacagtctctatttgatttg

SEQ ID NO: 3652203 - DNA, 17 bp, Homo sapiens
ataccccaccagcagaa

SEQ ID NO: 3652204 - DNA, 20 bp, Homo sapiens
atacgtgcccatttcacaca

SEQ ID NO: 3652205 - DNA, 15 bp, Homo sapiens
atactaagtcctcag

SEQ ID NO: 3652206 - DNA, 16 bp, Homo sapiens
atactatttattaaaa

SEQ ID NO: 3652207 - DNA, 19 bp, Homo sapiens
atactatttattaaaacca

SEQ ID NO: 3652208 - DNA, 13 bp, Homo sapiens
atactcatttgga

SEQ ID NO: 3652209 - DNA, 23 bp, Homo sapiens
atactcatttggatataaatctt

SEQ ID NO: 3652210 - DNA, 20 bp, Homo sapiens
atacttatttataacattgt

SEQ ID NO: 3652211 - DNA, 21 bp, Homo sapiens
atagaagaaggactgaagaaa

SEQ ID NO: 3652212 - DNA, 16 bp, Homo sapiens
atagacctaactgtga

SEQ ID NO: 3652213 - DNA, 17 bp, Homo sapiens
atagctgatagaagaag

SEQ ID NO: 3652214 - DNA, 22 bp, Homo sapiens
atagctgatagaagaaggactg

SEQ ID NO: 3652215 - DNA, 12 bp, Homo sapiens
atagctttgcaa

SEQ ID NO: 3652216 - DNA, 19 bp, Homo sapiens
ataggacttaatttagcag

SEQ ID NO: 3652217 - DNA, 13 bp, Homo sapiens
ataggttctgctt

SEQ ID NO: 3652218 - DNA, 20 bp, Homo sapiens
ataggttctgctttctgata

SEQ ID NO: 3652219 - DNA, 14 bp, Homo sapiens
atagtggtatttta

SEQ ID NO: 3652220 - DNA, 17 bp, Homo sapiens
atagtggtattttaaca

SEQ ID NO: 3652221 - DNA, 19 bp, Homo sapiens
atagtgttgtgttacaata

SEQ ID NO: 3652222 - DNA, 22 bp, Homo sapiens
atagtttctaaaccatgaaaag

SEQ ID NO: 3652223 - DNA, 12 bp, Homo sapiens
atataaaaataa

SEQ ID NO: 3652224 - DNA, 12 bp, Homo sapiens
atataaacacag

SEQ ID NO: 3652225 - DNA, 13 bp, Homo sapiens
atataaatcttac

SEQ ID NO: 3652226 - DNA, 18 bp, Homo sapiens
atataatggcctcttaaa

SEQ ID NO: 3652227 - DNA, 15 bp, Homo sapiens
atatacactttacat

SEQ ID NO: 3652228 - DNA, 16 bp, Homo sapiens
atatactcatttggat

SEQ ID NO: 3652229 - DNA, 22 bp, Homo sapiens
atatagctacaaatgaaaacaa

SEQ ID NO: 3652230 - DNA, 15 bp, Homo sapiens
atatgaagcagaatg

SEQ ID NO: 3652231 - DNA, 17 bp, Homo sapiens
atatgaagcagaatgag

SEQ ID NO: 3652232 - DNA, 14 bp, Homo sapiens
atatgagattggaa

SEQ ID NO: 3652233 - DNA, 16 bp, Homo sapiens
atatgtaggaaaattt

SEQ ID NO: 3652234 - DNA, 14 bp, Homo sapiens
atatgtctttaaaa

SEQ ID NO: 3652235 - DNA, 17 bp, Homo sapiens
atattgctgtctgaaaa

SEQ ID NO: 3652236 - DNA, 13 bp, Homo sapiens
atattttcttaat

SEQ ID NO: 3652237 - DNA, 21 bp, Homo sapiens
atcaacagaattgttcttttt

SEQ ID NO: 3652238 - DNA, 23 bp, Homo sapiens
atcaagtagtagtacttaatagt

SEQ ID NO: 3652239 - DNA, 14 bp, Homo sapiens
atcaagtctgtgaa

SEQ ID NO: 3652240 - DNA, 18 bp, Homo sapiens
atcaattgggttttgatc

SEQ ID NO: 3652241 - DNA, 14 bp, Homo sapiens
atcactgaactttg

SEQ ID NO: 3652242 - DNA, 21 bp, Homo sapiens
atcactgaactttgctgagcc

SEQ ID NO: 3652243 - DNA, 20 bp, Homo sapiens
atcagaaacaccctcacact

SEQ ID NO: 3652244 - DNA, 19 bp, Homo sapiens
atcagcatccaaaagcagg

SEQ ID NO: 3652245 - DNA, 23 bp, Homo sapiens
atcagggcaagctcatagcacat

SEQ ID NO: 3652246 - DNA, 23 bp, Homo sapiens
atcagggtagcagcagaggcagg

SEQ ID NO: 3652247 - DNA, 16 bp, Homo sapiens
atcagtcaattgcttg

SEQ ID NO: 3652248 - DNA, 16 bp, Homo sapiens
atcatatctgtatgcc

SEQ ID NO: 3652249 - DNA, 19 bp, Homo sapiens
atcatctattgagtgtaca

SEQ ID NO: 3652250 - DNA, 22 bp, Homo sapiens
atcattggtatctgatatctgt

SEQ ID NO: 3652251 - DNA, 14 bp, Homo sapiens
atcattttgatgta

SEQ ID NO: 3652252 - DNA, 20 bp, Homo sapiens
atcattttgatgtattatta

SEQ ID NO: 3652253 - DNA, 21 bp, Homo sapiens
atccatcgatttgtattaatg

SEQ ID NO: 3652254 - DNA, 17 bp, Homo sapiens
atccatgtgctgctgtg

SEQ ID NO: 3652255 - DNA, 20 bp, Homo sapiens
atcctggaaatttgtgtgct

SEQ ID NO: 3652256 - DNA, 23 bp, Homo sapiens
atccttaaaaagaccatgcattc

SEQ ID NO: 3652257 - DNA, 19 bp, Homo sapiens
atccttttccatcccactc

SEQ ID NO: 3652258 - DNA, 23 bp, Homo sapiens
atccttttccatcccactccact

SEQ ID NO: 3652259 - DNA, 14 bp, Homo sapiens
atcgtgatattgaa

SEQ ID NO: 3652260 - DNA, 21 bp, Homo sapiens
atcgtgccattacactccagc

SEQ ID NO: 3652261 - DNA, 12 bp, Homo sapiens
atctacaaactt

SEQ ID NO: 3652262 - DNA, 15 bp, Homo sapiens
atctacaaactttta

SEQ ID NO: 3652263 - DNA, 21 bp, Homo sapiens
atctacaaacttttataaatg

SEQ ID NO: 3652264 - DNA, 22 bp, Homo sapiens
atctacaaacttttataaatgt

SEQ ID NO: 3652265 - DNA, 21 bp, Homo sapiens
atctacacatataaacacagt

SEQ ID NO: 3652266 - DNA, 16 bp, Homo sapiens
atctcaattcttccct

SEQ ID NO: 3652267 - DNA, 19 bp, Homo sapiens
atctcagcatcctggaaat

SEQ ID NO: 3652268 - DNA, 20 bp, Homo sapiens
atctcaggtggcatttgcag

SEQ ID NO: 3652269 - DNA, 22 bp, Homo sapiens
atctcatcagggtagcagcaga

SEQ ID NO: 3652270 - DNA, 12 bp, Homo sapiens
atctctgtaaaa

SEQ ID NO: 3652271 - DNA, 11 bp, Homo sapiens
atctcttccat

SEQ ID NO: 3652272 - DNA, 13 bp, Homo sapiens
atctgatttctga

SEQ ID NO: 3652273 - DNA, 20 bp, Homo sapiens
atctggaaaaaaaaaaatat

SEQ ID NO: 3652274 - DNA, 15 bp, Homo sapiens
atctgtcagtgagtc

SEQ ID NO: 3652275 - DNA, 18 bp, Homo sapiens
atcttacccttcaatgtt

SEQ ID NO: 3652276 - DNA, 15 bp, Homo sapiens
atcttcacattctga

SEQ ID NO: 3652277 - DNA, 13 bp, Homo sapiens
atcttggatgaga

SEQ ID NO: 3652278 - DNA, 23 bp, Homo sapiens
atctttgcacaatcaataaaaat

SEQ ID NO: 3652279 - DNA, 12 bp, Homo sapiens
atctttgttaaa

SEQ ID NO: 3652280 - DNA, 13 bp, Homo sapiens
atctttgttaaaa

SEQ ID NO: 3652281 - DNA, 21 bp, Homo sapiens
atgaaaaaaaaagaaatctct

SEQ ID NO: 3652282 - DNA, 14 bp, Homo sapiens
atgaaaaatctgaa

SEQ ID NO: 3652283 - DNA, 23 bp, Homo sapiens
atgaaaatggctgaagaaacaca

SEQ ID NO: 3652284 - DNA, 16 bp, Homo sapiens
atgaacatggtcagaa

SEQ ID NO: 3652285 - DNA, 15 bp, Homo sapiens
atgaagcagaatgag

SEQ ID NO: 3652286 - DNA, 13 bp, Homo sapiens
atgaataaaatgt

SEQ ID NO: 3652287 - DNA, 14 bp, Homo sapiens
atgaataaaatgtt

SEQ ID NO: 3652288 - DNA, 18 bp, Homo sapiens
atgaattatcttggatga

SEQ ID NO: 3652289 - DNA, 12 bp, Homo sapiens
atgacaggacat

SEQ ID NO: 3652290 - DNA, 13 bp, Homo sapiens
atgacctgaattg

SEQ ID NO: 3652291 - DNA, 16 bp, Homo sapiens
atgagaaatataaaaa

SEQ ID NO: 3652292 - DNA, 22 bp, Homo sapiens
atgagacttcctattaatttat

SEQ ID NO: 3652293 - DNA, 19 bp, Homo sapiens
atgagatcccagagttatt

SEQ ID NO: 3652294 - DNA, 22 bp, Homo sapiens
atgagattggaaaaaattagac

SEQ ID NO: 3652295 - DNA, 16 bp, Homo sapiens
atgagtctccagatag

SEQ ID NO: 3652296 - DNA, 20 bp, Homo sapiens
atgagtttccagctaagcct

SEQ ID NO: 3652297 - DNA, 15 bp, Homo sapiens
atgataatagctcac

SEQ ID NO: 3652298 - DNA, 16 bp, Homo sapiens
atgatatgtctttaaa

SEQ ID NO: 3652299 - DNA, 18 bp, Homo sapiens
atgattcacttttattgt

SEQ ID NO: 3652300 - DNA, 21 bp, Homo sapiens
atgattcacttttattgtata

SEQ ID NO: 3652301 - DNA, 18 bp, Homo sapiens
atgcaagtgagaaagaca

SEQ ID NO: 3652302 - DNA, 13 bp, Homo sapiens
atgcattcagatc

SEQ ID NO: 3652303 - DNA, 18 bp, Homo sapiens
atgccatgtatgttgcat

SEQ ID NO: 3652304 - DNA, 20 bp, Homo sapiens
atgccatgtatgttgcatga

SEQ ID NO: 3652305 - DNA, 20 bp, Homo sapiens
atgcctacattagtgagatt

SEQ ID NO: 3652306 - DNA, 19 bp, Homo sapiens
atgcctttctagcaattgc

SEQ ID NO: 3652307 - DNA, 14 bp, Homo sapiens
atgctgtgtgactc

SEQ ID NO: 3652308 - DNA, 12 bp, Homo sapiens
atgctgtgtgca

SEQ ID NO: 3652309 - DNA, 17 bp, Homo sapiens
atgctgtgtgcagagta

SEQ ID NO: 3652310 - DNA, 14 bp, Homo sapiens
atgctgttcattga

SEQ ID NO: 3652311 - DNA, 23 bp, Homo sapiens
atggaaataacgggtggcattgg

SEQ ID NO: 3652312 - DNA, 19 bp, Homo sapiens
atggaagacctaaggcaga

SEQ ID NO: 3652313 - DNA, 15 bp, Homo sapiens
atggaggtagggctg

SEQ ID NO: 3652314 - DNA, 18 bp, Homo sapiens
atggattcccctggacat

SEQ ID NO: 3652315 - DNA, 12 bp, Homo sapiens
atggctgaagaa

SEQ ID NO: 3652316 - DNA, 20 bp, Homo sapiens
atggctgaagaaacacagca

SEQ ID NO: 3652317 - DNA, 15 bp, Homo sapiens
atgggcagaggatga

SEQ ID NO: 3652318 - DNA, 19 bp, Homo sapiens
atggggagctctggaggtg

SEQ ID NO: 3652319 - DNA, 22 bp, Homo sapiens
atgggttagggaaaacattcca

SEQ ID NO: 3652320 - DNA, 15 bp, Homo sapiens
atggtagactgtgac

SEQ ID NO: 3652321 - DNA, 17 bp, Homo sapiens
atggtatatattttgaa

SEQ ID NO: 3652322 - DNA, 17 bp, Homo sapiens
atggtgaaaccctgtct

SEQ ID NO: 3652323 - DNA, 20 bp, Homo sapiens
atggtgatggagagggatgg

SEQ ID NO: 3652324 - DNA, 17 bp, Homo sapiens
atggtgtcctgcatgta

SEQ ID NO: 3652325 - DNA, 15 bp, Homo sapiens
atgtaaatattgctg

SEQ ID NO: 3652326 - DNA, 17 bp, Homo sapiens
atgtaaatattgctgtc

SEQ ID NO: 3652327 - DNA, 20 bp, Homo sapiens
atgtaatacaccaaatagct

SEQ ID NO: 3652328 - DNA, 17 bp, Homo sapiens
atgtatgccatgtatgt

SEQ ID NO: 3652329 - DNA, 14 bp, Homo sapiens
atgtatgcttccag

SEQ ID NO: 3652330 - DNA, 23 bp, Homo sapiens
atgtatgcttccagggacaagct

SEQ ID NO: 3652331 - DNA, 19 bp, Homo sapiens
atgtcattttcagatcctt

SEQ ID NO: 3652332 - DNA, 20 bp, Homo sapiens
atgtctgtccctaaacatag

SEQ ID NO: 3652333 - DNA, 13 bp, Homo sapiens
atgtgataattgt

SEQ ID NO: 3652334 - DNA, 14 bp, Homo sapiens
atgttaaatctaca

SEQ ID NO: 3652335 - DNA, 19 bp, Homo sapiens
atgttaaatctacaaactt

SEQ ID NO: 3652336 - DNA, 19 bp, Homo sapiens
agctacatatgtaggaaaa

SEQ ID NO: 3652337 - DNA, 19 bp, Homo sapiens
agctactcaggaggctgag

SEQ ID NO: 3652338 - DNA, 12 bp, Homo sapiens
agctataaatag

SEQ ID NO: 3652339 - DNA, 14 bp, Homo sapiens
agctcaaggctgca

SEQ ID NO: 3652340 - DNA, 15 bp, Homo sapiens
agctcaaggctgcag

SEQ ID NO: 3652341 - DNA, 12 bp, Homo sapiens
agctcacagcac

SEQ ID NO: 3652342 - DNA, 16 bp, Homo sapiens
agctcatagcacatgt

SEQ ID NO: 3652343 - DNA, 22 bp, Homo sapiens
agctcatagcacatgttttaca

SEQ ID NO: 3652344 - DNA, 15 bp, Homo sapiens
agctctacgtcccac

SEQ ID NO: 3652345 - DNA, 14 bp, Homo sapiens
agctggagccccgc

SEQ ID NO: 3652346 - DNA, 15 bp, Homo sapiens
agctgggatggggcc

SEQ ID NO: 3652347 - DNA, 23 bp, Homo sapiens
agctgggcagacaggtgggagat

SEQ ID NO: 3652348 - DNA, 21 bp, Homo sapiens
agcttaaaggagggtgaataa

SEQ ID NO: 3652349 - DNA, 17 bp, Homo sapiens
agcttttcacttcttaa

SEQ ID NO: 3652350 - DNA, 18 bp, Homo sapiens
agcttttcccaaaagccc

SEQ ID NO: 3652351 - DNA, 22 bp, Homo sapiens
aggaaaatggaagacctaaggc

SEQ ID NO: 3652352 - DNA, 17 bp, Homo sapiens
aggaaacaacaaaggaa

SEQ ID NO: 3652353 - DNA, 22 bp, Homo sapiens
aggaacccatctaaaccagaag

SEQ ID NO: 3652354 - DNA, 21 bp, Homo sapiens
aggaagcacaaaagacaagca

SEQ ID NO: 3652355 - DNA, 23 bp, Homo sapiens
aggaaggaaacaacaaaggaagt

SEQ ID NO: 3652356 - DNA, 21 bp, Homo sapiens
aggacagtgttcaaattctga

SEQ ID NO: 3652357 - DNA, 14 bp, Homo sapiens
aggaccagaaggca

SEQ ID NO: 3652358 - DNA, 14 bp, Homo sapiens
aggactacagaatt

SEQ ID NO: 3652359 - DNA, 15 bp, Homo sapiens
aggactacagaattg

SEQ ID NO: 3652360 - DNA, 16 bp, Homo sapiens
aggactgaagaaaatc

SEQ ID NO: 3652361 - DNA, 14 bp, Homo sapiens
aggaggctgaggca

SEQ ID NO: 3652362 - DNA, 18 bp, Homo sapiens
aggaggctgaggcaggag

SEQ ID NO: 3652363 - DNA, 15 bp, Homo sapiens
aggataatgagatgt

SEQ ID NO: 3652364 - DNA, 12 bp, Homo sapiens
aggattcaacat

SEQ ID NO: 3652365 - DNA, 15 bp, Homo sapiens
aggcagacaggaagg

SEQ ID NO: 3652366 - DNA, 22 bp, Homo sapiens
aggcaggaccagaaggcaatca

SEQ ID NO: 3652367 - DNA, 22 bp, Homo sapiens
aggcaggtggatcatgaggtca

SEQ ID NO: 3652368 - DNA, 21 bp, Homo sapiens
aggccaagagtttgagaccaa

SEQ ID NO: 3652369 - DNA, 17 bp, Homo sapiens
aggccgaggcaggtgga

SEQ ID NO: 3652370 - DNA, 12 bp, Homo sapiens
aggcgagcctgg

SEQ ID NO: 3652371 - DNA, 19 bp, Homo sapiens
aggctgagacgcaaggatc

SEQ ID NO: 3652372 - DNA, 14 bp, Homo sapiens
aggctgaggcagga

SEQ ID NO: 3652373 - DNA, 17 bp, Homo sapiens
aggctgcagctaatttg

SEQ ID NO: 3652374 - DNA, 23 bp, Homo sapiens
aggctgcagctaatttgtgaaag

SEQ ID NO: 3652375 - DNA, 12 bp, Homo sapiens
aggctggagtgt

SEQ ID NO: 3652376 - DNA, 16 bp, Homo sapiens
aggctgtcatttcatt

SEQ ID NO: 3652377 - DNA, 12 bp, Homo sapiens
aggcttctccac

SEQ ID NO: 3652378 - DNA, 18 bp, Homo sapiens
agggaaaacattccatcc

SEQ ID NO: 3652379 - DNA, 17 bp, Homo sapiens
agggaagcccagcctgc

SEQ ID NO: 3652380 - DNA, 23 bp, Homo sapiens
agggatgctatctcgctagccat

SEQ ID NO: 3652381 - DNA, 14 bp, Homo sapiens
agggatggaaataa

SEQ ID NO: 3652382 - DNA, 18 bp, Homo sapiens
agggcaagctcatagcac

SEQ ID NO: 3652383 - DNA, 18 bp, Homo sapiens
agggctggctggaggaag

SEQ ID NO: 3652384 - DNA, 11 bp, Homo sapiens
aggggaggctg

SEQ ID NO: 3652385 - DNA, 16 bp, Homo sapiens
aggggcaaaaatttga

SEQ ID NO: 3652386 - DNA, 20 bp, Homo sapiens
agggtagcagcagaggcagg

SEQ ID NO: 3652387 - DNA, 19 bp, Homo sapiens
agggttctatatttactgt

SEQ ID NO: 3652388 - DNA, 16 bp, Homo sapiens
aggtaaactgatgctt

SEQ ID NO: 3652389 - DNA, 18 bp, Homo sapiens
aggtagggctggctggag

SEQ ID NO: 3652390 - DNA, 20 bp, Homo sapiens
aggtcagtgttataaaatct

SEQ ID NO: 3652391 - DNA, 22 bp, Homo sapiens
aggtcatgaacatggtcagaac

SEQ ID NO: 3652392 - DNA, 17 bp, Homo sapiens
aggtcatgcaagtgaga

SEQ ID NO: 3652393 - DNA, 20 bp, Homo sapiens
aggtctgttgaagtgcatgt

SEQ ID NO: 3652394 - DNA, 19 bp, Homo sapiens
aggtggacttgtctcccag

SEQ ID NO: 3652395 - DNA, 21 bp, Homo sapiens
aggtggacttgtctcccagtc

SEQ ID NO: 3652396 - DNA, 14 bp, Homo sapiens
aggtggcagggctg

SEQ ID NO: 3652397 - DNA, 13 bp, Homo sapiens
aggtgggagatgg

SEQ ID NO: 3652398 - DNA, 18 bp, Homo sapiens
aggttgctggcatttgct

SEQ ID NO: 3652399 - DNA, 20 bp, Homo sapiens
aggtttagaatcaagtctgt

SEQ ID NO: 3652400 - DNA, 19 bp, Homo sapiens
aggtttcactgttcatgaa

SEQ ID NO: 3652401 - DNA, 18 bp, Homo sapiens
agtaaaacttgtattgga

SEQ ID NO: 3652402 - DNA, 14 bp, Homo sapiens
agtaaatatacact

SEQ ID NO: 3652403 - DNA, 20 bp, Homo sapiens
agtaaatatacactttacat

SEQ ID NO: 3652404 - DNA, 17 bp, Homo sapiens
agtaaatctaaattaac

SEQ ID NO: 3652405 - DNA, 14 bp, Homo sapiens
agtaaattaagagc

SEQ ID NO: 3652406 - DNA, 16 bp, Homo sapiens
agtaaattaagagcat

SEQ ID NO: 3652407 - DNA, 17 bp, Homo sapiens
agtaacagtatttccat

SEQ ID NO: 3652408 - DNA, 16 bp, Homo sapiens
agtactagcaataagt

SEQ ID NO: 3652409 - DNA, 13 bp, Homo sapiens
agtacttaatagt

SEQ ID NO: 3652410 - DNA, 13 bp, Homo sapiens
agtagtgtgagtg

SEQ ID NO: 3652411 - DNA, 21 bp, Homo sapiens
agtagtgtgagtgttagaaaa

SEQ ID NO: 3652412 - DNA, 12 bp, Homo sapiens
agtatagatggt

SEQ ID NO: 3652413 - DNA, 21 bp, Homo sapiens
agtattttgagccttattaaa

SEQ ID NO: 3652414 - DNA, 17 bp, Homo sapiens
agtccatgtgataattg

SEQ ID NO: 3652415 - DNA, 17 bp, Homo sapiens
agtccatttttgagtaa

SEQ ID NO: 3652416 - DNA, 18 bp, Homo sapiens
agtccatttttgagtaaa

SEQ ID NO: 3652417 - DNA, 21 bp, Homo sapiens
agtccatttttgagtaaaact

SEQ ID NO: 3652418 - DNA, 10 bp, Homo sapiens
agtcctcaga

SEQ ID NO: 3652419 - DNA, 17 bp, Homo sapiens
agtcctcagagctccat

SEQ ID NO: 3652420 - DNA, 22 bp, Homo sapiens
agtcgaggctggtaagggacct

SEQ ID NO: 3652421 - DNA, 14 bp, Homo sapiens
agtctatgctgtgt

SEQ ID NO: 3652422 - DNA, 17 bp, Homo sapiens
agtctatgctgtgtgca

SEQ ID NO: 3652423 - DNA, 14 bp, Homo sapiens
agtctcctgtatca

SEQ ID NO: 3652424 - DNA, 18 bp, Homo sapiens
agtcttgttgttcatata

SEQ ID NO: 3652425 - DNA, 19 bp, Homo sapiens
agtgaaaaagacttcaaat

SEQ ID NO: 3652426 - DNA, 20 bp, Homo sapiens
agtgaaaaagacttcaaatg

SEQ ID NO: 3652427 - DNA, 19 bp, Homo sapiens
agtgaaattagtattttga

SEQ ID NO: 3652428 - DNA, 21 bp, Homo sapiens
agtgaaattagtattttgagc

SEQ ID NO: 3652429 - DNA, 15 bp, Homo sapiens
agtgcaagagcctga

SEQ ID NO: 3652430 - DNA, 16 bp, Homo sapiens
agtgcatgttaaaata

SEQ ID NO: 3652431 - DNA, 19 bp, Homo sapiens
agtgccaatgacaggacat

SEQ ID NO: 3652432 - DNA, 17 bp, Homo sapiens
agtgctcatttcaggat

SEQ ID NO: 3652433 - DNA, 17 bp, Homo sapiens
agtgctgggattacagg

SEQ ID NO: 3652434 - DNA, 20 bp, Homo sapiens
agtgttcaaattctgattat

SEQ ID NO: 3652435 - DNA, 19 bp, Homo sapiens
agtgttggccatcatttca

SEQ ID NO: 3652436 - DNA, 24 bp, Homo sapiens
agtgttggccatcatttcattcgt

SEQ ID NO: 3652437 - DNA, 18 bp, Homo sapiens
agtgttgtcttattccta

SEQ ID NO: 3652438 - DNA, 16 bp, Homo sapiens
agtgttgtgttacaat

SEQ ID NO: 3652439 - DNA, 22 bp, Homo sapiens
agtgttgtgttacaataagtgt

SEQ ID NO: 3652440 - DNA, 16 bp, Homo sapiens
agtgtttttacatata

SEQ ID NO: 3652441 - DNA, 11 bp, Homo sapiens
agttatttacc

SEQ ID NO: 3652442 - DNA, 20 bp, Homo sapiens
agttatttaccagaagttta

SEQ ID NO: 3652443 - DNA, 16 bp, Homo sapiens
agttctgcacatacag

SEQ ID NO: 3652444 - DNA, 19 bp, Homo sapiens
agttctgcacatacagatg

SEQ ID NO: 3652445 - DNA, 18 bp, Homo sapiens
agttcttacgcttgacag

SEQ ID NO: 3652446 - DNA, 15 bp, Homo sapiens
agttctttcccagcc

SEQ ID NO: 3652447 - DNA, 18 bp, Homo sapiens
agttgccgtggcaactgt

SEQ ID NO: 3652448 - DNA, 19 bp, Homo sapiens
agttggttacctattgctg

SEQ ID NO: 3652449 - DNA, 20 bp, Homo sapiens
agtttaaatctttgttaaaa

SEQ ID NO: 3652450 - DNA, 17 bp, Homo sapiens
agtttccatttggattt

SEQ ID NO: 3652451 - DNA, 23 bp, Homo sapiens
agtttccatttggattttaaaca

SEQ ID NO: 3652452 - DNA, 15 bp, Homo sapiens
agtttggtatgaaac

SEQ ID NO: 3652453 - DNA, 17 bp, Homo sapiens
agtttggtatgaaacaa

SEQ ID NO: 3652454 - DNA, 22 bp, Homo sapiens
agtttggtatgaaacaaatata

SEQ ID NO: 3652455 - DNA, 14 bp, Homo sapiens
agttttcaagcatt

SEQ ID NO: 3652456 - DNA, 16 bp, Homo sapiens
ataaaaagcatgagac

SEQ ID NO: 3652457 - DNA, 13 bp, Homo sapiens
ataaaaatggcat

SEQ ID NO: 3652458 - DNA, 13 bp, Homo sapiens
ataaagtggcatt

SEQ ID NO: 3652459 - DNA, 23 bp, Homo sapiens
ataacgggtggcattgggtggca

SEQ ID NO: 3652460 - DNA, 17 bp, Homo sapiens
ataatagctcacagcac

SEQ ID NO: 3652461 - DNA, 16 bp, Homo sapiens
ataatattttctttct

SEQ ID NO: 3652462 - DNA, 21 bp, Homo sapiens
ataatgaggcaactcagcagg

SEQ ID NO: 3652463 - DNA, 17 bp, Homo sapiens
ataatggcctcttaaaa

SEQ ID NO: 3652464 - DNA, 13 bp, Homo sapiens
ataattaaaacaa

SEQ ID NO: 3652465 - DNA, 14 bp, Homo sapiens
ataattaaaacaaa

SEQ ID NO: 3652466 - DNA, 21 bp, Homo sapiens
ataattaaaacaaaatccttg

SEQ ID NO: 3652467 - DNA, 14 bp, Homo sapiens
ataattaaatgaaa

SEQ ID NO: 3652468 - DNA, 18 bp, Homo sapiens
ataattaaatgaaatact

SEQ ID NO: 3652469 - DNA, 17 bp, Homo sapiens
ataattttattgctgga

SEQ ID NO: 3652470 - DNA, 15 bp, Homo sapiens
atacaagtgtttcta

SEQ ID NO: 3652471 - DNA, 19 bp, Homo sapiens
atacaagtgtttctagtaa

SEQ ID NO: 3652472 - DNA, 22 bp, Homo sapiens
atacagatggtgtcctgcatgt

SEQ ID NO: 3652473 - DNA, 16 bp, Homo sapiens
gtagaaactttggaag

SEQ ID NO: 3652474 - DNA, 13 bp, Homo sapiens
gtagactgtgaca

SEQ ID NO: 3652475 - DNA, 17 bp, Homo sapiens
gtagagtcctaggacat

SEQ ID NO: 3652476 - DNA, 15 bp, Homo sapiens
gtagcagcagaggca

SEQ ID NO: 3652477 - DNA, 17 bp, Homo sapiens
gtagcagcagaggcagg

SEQ ID NO: 3652478 - DNA, 18 bp, Homo sapiens
gtagcagcagaggcagga

SEQ ID NO: 3652479 - DNA, 13 bp, Homo sapiens
gtagcatatataa

SEQ ID NO: 3652480 - DNA, 18 bp, Homo sapiens
gtatagatggtagaaact

SEQ ID NO: 3652481 - DNA, 13 bp, Homo sapiens
gtatatctgtgta

SEQ ID NO: 3652482 - DNA, 16 bp, Homo sapiens
gtatatctgtgtaaga

SEQ ID NO: 3652483 - DNA, 21 bp, Homo sapiens
gtatattgatgtaactgtgtc

SEQ ID NO: 3652484 - DNA, 13 bp, Homo sapiens
gtatgttatccac

SEQ ID NO: 3652485 - DNA, 12 bp, Homo sapiens
gtattaatgtag

SEQ ID NO: 3652486 - DNA, 18 bp, Homo sapiens
gtatttactgcaatgtct

SEQ ID NO: 3652487 - DNA, 23 bp, Homo sapiens
gtatttgaggaaactcatacagt

SEQ ID NO: 3652488 - DNA, 16 bp, Homo sapiens
gtcactcatgtactta

SEQ ID NO: 3652489 - DNA, 18 bp, Homo sapiens
catgtgataattgtaaag

SEQ ID NO: 3652490 - DNA, 12 bp, Homo sapiens
catgttaaaata

SEQ ID NO: 3652491 - DNA, 13 bp, Homo sapiens
catgttaaaataa

SEQ ID NO: 3652492 - DNA, 18 bp, Homo sapiens
catgttaaaataattata

SEQ ID NO: 3652493 - DNA, 14 bp, Homo sapiens
cattacactccagc

SEQ ID NO: 3652494 - DNA, 15 bp, Homo sapiens
cattacactccagcc

SEQ ID NO: 3652495 - DNA, 13 bp, Homo sapiens
cattcagatctga

SEQ ID NO: 3652496 - DNA, 16 bp, Homo sapiens
cattcagatctgaagt

SEQ ID NO: 3652497 - DNA, 14 bp, Homo sapiens
cattccatccttga

SEQ ID NO: 3652498 - DNA, 14 bp, Homo sapiens
cattccattctgga

SEQ ID NO: 3652499 - DNA, 17 bp, Homo sapiens
cattccccgacactgcc

SEQ ID NO: 3652500 - DNA, 20 bp, Homo sapiens
cattcgtgggcctgctgctc

SEQ ID NO: 3652501 - DNA, 21 bp, Homo sapiens
cattcgtgggcctgctgctct

SEQ ID NO: 3652502 - DNA, 16 bp, Homo sapiens
cattctctaagcctgg

SEQ ID NO: 3652503 - DNA, 19 bp, Homo sapiens
cattctggtccttagtaaa

SEQ ID NO: 3652504 - DNA, 15 bp, Homo sapiens
cattgcactgcagtt

SEQ ID NO: 3652505 - DNA, 14 bp, Homo sapiens
cattgcactggaat

SEQ ID NO: 3652506 - DNA, 17 bp, Homo sapiens
cattgccttgggcctgg

SEQ ID NO: 3652507 - DNA, 11 bp, Homo sapiens
gactgaagaaa

SEQ ID NO: 3652508 - DNA, 17 bp, Homo sapiens
gactggaaaaggtggac

SEQ ID NO: 3652509 - DNA, 12 bp, Homo sapiens
gacttaatttag

SEQ ID NO: 3652510 - DNA, 18 bp, Homo sapiens
gacttcctattaatttat

SEQ ID NO: 3652511 - DNA, 14 bp, Homo sapiens
gacttgtctcccag

SEQ ID NO: 3652512 - DNA, 18 bp, Homo sapiens
gagactggaaaaggtgga

SEQ ID NO: 3652513 - DNA, 20 bp, Homo sapiens
gagagacctagataggtcat

SEQ ID NO: 3652514 - DNA, 15 bp, Homo sapiens
gagaggaaaaaggct

SEQ ID NO: 3652515 - DNA, 14 bp, Homo sapiens
gagataatgaggca

SEQ ID NO: 3652516 - DNA, 16 bp, Homo sapiens
gagataatgaggcaac

SEQ ID NO: 3652517 - DNA, 23 bp, Homo sapiens
gagatcgtgccattacactccag

SEQ ID NO: 3652518 - DNA, 20 bp, Homo sapiens
gagatggaggtagggctggc

SEQ ID NO: 3652519 - DNA, 20 bp, Homo sapiens
gagattctgcctcagcctcc

SEQ ID NO: 3652520 - DNA, 19 bp, Homo sapiens
gagattggaaaaaattaga

SEQ ID NO: 3652521 - DNA, 21 bp, Homo sapiens
gagcatgcccaaatataacat

SEQ ID NO: 3652522 - DNA, 22 bp, Homo sapiens
gagcatgcccaaatataacatg

SEQ ID NO: 3652523 - DNA, 15 bp, Homo sapiens
gagccactgtgcctg

SEQ ID NO: 3652524 - DNA, 17 bp, Homo sapiens
gagccttattaaaatat

SEQ ID NO: 3652525 - DNA, 21 bp, Homo sapiens
gagctggcctattttggacgt

SEQ ID NO: 3652526 - DNA, 16 bp, Homo sapiens
gagcttaaaggagggt

SEQ ID NO: 3652527 - DNA, 20 bp, Homo sapiens
gagcttccagaaatgccaca

SEQ ID NO: 3652528 - DNA, 12 bp, Homo sapiens
gaggaaggaaac

SEQ ID NO: 3652529 - DNA, 22 bp, Homo sapiens
gaggcaggaccagaaggcaatc

SEQ ID NO: 3652530 - DNA, 14 bp, Homo sapiens
gaggccgaggcagg

SEQ ID NO: 3652531 - DNA, 18 bp, Homo sapiens
gaggccgaggcaggtgga

SEQ ID NO: 3652532 - DNA, 14 bp, Homo sapiens
gaggctgaggcagg

SEQ ID NO: 3652533 - DNA, 22 bp, Homo sapiens
gaggctggtaagggaccttcag

SEQ ID NO: 3652534 - DNA, 19 bp, Homo sapiens
gaggtgttgtggggatggt

SEQ ID NO: 3652535 - DNA, 16 bp, Homo sapiens
gaggttgcagtgagct

SEQ ID NO: 3652536 - DNA, 15 bp, Homo sapiens
gagtgcaagagcctg

SEQ ID NO: 3652537 - DNA, 20 bp, Homo sapiens
gagtgcaagagcctgagact

SEQ ID NO: 3652538 - DNA, 22 bp, Homo sapiens
gagtgcaagagcctgagactgg

SEQ ID NO: 3652539 - DNA, 17 bp, Homo sapiens
gagttcgaggcgagcct

SEQ ID NO: 3652540 - DNA, 12 bp, Homo sapiens
gagttctgcaca

SEQ ID NO: 3652541 - DNA, 20 bp, Homo sapiens
gagttctgcacatacagatg

SEQ ID NO: 3652542 - DNA, 16 bp, Homo sapiens
gagtttccatttggat

SEQ ID NO: 3652543 - DNA, 16 bp, Homo sapiens
gataaattttggaaga

SEQ ID NO: 3652544 - DNA, 21 bp, Homo sapiens
gataatagctcacagcacatt

SEQ ID NO: 3652545 - DNA, 18 bp, Homo sapiens
gataattaaatgaaatac

SEQ ID NO: 3652546 - DNA, 19 bp, Homo sapiens
gataattaaatgaaatact

SEQ ID NO: 3652547 - DNA, 16 bp, Homo sapiens
gataccattttgaaat

SEQ ID NO: 3652548 - DNA, 17 bp, Homo sapiens
gataccattttgaaata

SEQ ID NO: 3652549 - DNA, 22 bp, Homo sapiens
gatagatgtcgtggactccagc

SEQ ID NO: 3652550 - DNA, 20 bp, Homo sapiens
gataggtcatgcaagtgaga

SEQ ID NO: 3652551 - DNA, 19 bp, Homo sapiens
gataggttctgctttctga

SEQ ID NO: 3652552 - DNA, 20 bp, Homo sapiens
gatatctgtttgcttctaaa

SEQ ID NO: 3652553 - DNA, 22 bp, Homo sapiens
gatatgagaaatataaaaataa

SEQ ID NO: 3652554 - DNA, 18 bp, Homo sapiens
gatatgtctttaaaatga

SEQ ID NO: 3652555 - DNA, 23 bp, Homo sapiens
gatcagcatccaaaagcaggaac

SEQ ID NO: 3652556 - DNA, 21 bp, Homo sapiens
gatctttattggtgacctttt

SEQ ID NO: 3652557 - DNA, 14 bp, Homo sapiens
gatgaataaaatgt

SEQ ID NO: 3652558 - DNA, 15 bp, Homo sapiens
gatgatttaattctt

SEQ ID NO: 3652559 - DNA, 14 bp, Homo sapiens
gatggaggtagggc

SEQ ID NO: 3652560 - DNA, 15 bp, Homo sapiens
gatggggagctctgg

SEQ ID NO: 3652561 - DNA, 18 bp, Homo sapiens
gatggtgatggagaggga

SEQ ID NO: 3652562 - DNA, 15 bp, Homo sapiens
gatgtattattatat

SEQ ID NO: 3652563 - DNA, 18 bp, Homo sapiens
gatgtcgtggactccagc

SEQ ID NO: 3652564 - DNA, 22 bp, Homo sapiens
gatgtcgtggactccagctcta

SEQ ID NO: 3652565 - DNA, 19 bp, Homo sapiens
gatgtggatggaggtgatg

SEQ ID NO: 3652566 - DNA, 14 bp, Homo sapiens
gattaaactgggaa

SEQ ID NO: 3652567 - DNA, 20 bp, Homo sapiens
gattaaactgggaaatgaga

SEQ ID NO: 3652568 - DNA, 13 bp, Homo sapiens
gattcaacatcaa

SEQ ID NO: 3652569 - DNA, 17 bp, Homo sapiens
gatttgcaacactgcca

SEQ ID NO: 3652570 - DNA, 19 bp, Homo sapiens
gattttaaacaaaatttat

SEQ ID NO: 3652571 - DNA, 21 bp, Homo sapiens
gcaaactgaaattagtgtttt

SEQ ID NO: 3652572 - DNA, 22 bp, Homo sapiens
gcaaactgaaattagtgttttc

SEQ ID NO: 3652573 - DNA, 24 bp, Homo sapiens
gcaaatttctagatatgagaaata

SEQ ID NO: 3652574 - DNA, 15 bp, Homo sapiens
gcaacagactgcctt

SEQ ID NO: 3652575 - DNA, 23 bp, Homo sapiens
gcaacagactgccttatattatt

SEQ ID NO: 3652576 - DNA, 16 bp, Homo sapiens
gcaacatttggggaga

SEQ ID NO: 3652577 - DNA, 20 bp, Homo sapiens
gcaacatttggggagagata

SEQ ID NO: 3652578 - DNA, 16 bp, Homo sapiens
gcaaccttgtacttta

SEQ ID NO: 3652579 - DNA, 19 bp, Homo sapiens
gcaagagcctgagactgga

SEQ ID NO: 3652580 - DNA, 20 bp, Homo sapiens
gcaagagcctgagactggaa

SEQ ID NO: 3652581 - DNA, 16 bp, Homo sapiens
gcaatcaagagcttcc

SEQ ID NO: 3652582 - DNA, 20 bp, Homo sapiens
gcaatccttaaaaagaccat

SEQ ID NO: 3652583 - DNA, 15 bp, Homo sapiens
gcacatacagatggt

SEQ ID NO: 3652584 - DNA, 15 bp, Homo sapiens
gcacatgttttacaa

SEQ ID NO: 3652585 - DNA, 15 bp, Homo sapiens
gcactttagaaatat

SEQ ID NO: 3652586 - DNA, 20 bp, Homo sapiens
gcagaacaaactcagatctc

SEQ ID NO: 3652587 - DNA, 16 bp, Homo sapiens
gcagacaggaaggaag

SEQ ID NO: 3652588 - DNA, 17 bp, Homo sapiens
gcagacaggaaggaagc

SEQ ID NO: 3652589 - DNA, 21 bp, Homo sapiens
gcagaggcaggaccagaaggc

SEQ ID NO: 3652590 - DNA, 19 bp, Homo sapiens
gcagcagaggcaggaccag

SEQ ID NO: 3652591 - DNA, 19 bp, Homo sapiens
gcagctaatttgtgaaagt

SEQ ID NO: 3652592 - DNA, 19 bp, Homo sapiens
gcaggaacccatctaaacc

SEQ ID NO: 3652593 - DNA, 14 bp, Homo sapiens
gcaggaccagaagg

SEQ ID NO: 3652594 - DNA, 20 bp, Homo sapiens
gcaggaccagaaggcaatca

SEQ ID NO: 3652595 - DNA, 23 bp, Homo sapiens
gcaggaccagaaggcaatcaaga

SEQ ID NO: 3652596 - DNA, 13 bp, Homo sapiens
gcaggcagccttg

SEQ ID NO: 3652597 - DNA, 22 bp, Homo sapiens
gcagggctgttccctccaggca

SEQ ID NO: 3652598 - DNA, 17 bp, Homo sapiens
gcaggtgaccagaatga

SEQ ID NO: 3652599 - DNA, 18 bp, Homo sapiens
gcaggtgaccagaatgag

SEQ ID NO: 3652600 - DNA, 20 bp, Homo sapiens
gcaggtgaccagaatgaggc

SEQ ID NO: 3652601 - DNA, 16 bp, Homo sapiens
gcagtgagctgagatc

SEQ ID NO: 3652602 - DNA, 16 bp, Homo sapiens
gcatccaaaagcagga

SEQ ID NO: 3652603 - DNA, 17 bp, Homo sapiens
gcatccaaaagcaggaa

SEQ ID NO: 3652604 - DNA, 19 bp, Homo sapiens
gcatccaaaagcaggaacc

SEQ ID NO: 3652605 - DNA, 22 bp, Homo sapiens
gcatcctggaaatttgtgtgct

SEQ ID NO: 3652606 - DNA, 13 bp, Homo sapiens
gcatgagttctgc

SEQ ID NO: 3652607 - DNA, 16 bp, Homo sapiens
gcatgagttctgcaca

SEQ ID NO: 3652608 - DNA, 15 bp, Homo sapiens
gcatggaaagatggg

SEQ ID NO: 3652609 - DNA, 18 bp, Homo sapiens
gcatggaaagatggggag

SEQ ID NO: 3652610 - DNA, 13 bp, Homo sapiens
gcatgtatgccat

SEQ ID NO: 3652611 - DNA, 14 bp, Homo sapiens
gcatgtttagtcta

SEQ ID NO: 3652612 - DNA, 22 bp, Homo sapiens
gcatttttttagtaaattaaga

SEQ ID NO: 3652613 - DNA, 22 bp, Homo sapiens
gccaaccctggaaaaggagttc

SEQ ID NO: 3652614 - DNA, 21 bp, Homo sapiens
gccacaagttctttcccagcc

SEQ ID NO: 3652615 - DNA, 17 bp, Homo sapiens
gccaggcacggaggctc

SEQ ID NO: 3652616 - DNA, 19 bp, Homo sapiens
gccatatattttctgagta

SEQ ID NO: 3652617 - DNA, 13 bp, Homo sapiens
gccatcatttcat

SEQ ID NO: 3652618 - DNA, 19 bp, Homo sapiens
gccattacactccagcctg

SEQ ID NO: 3652619 - DNA, 19 bp, Homo sapiens
gcccattcattccattctg

SEQ ID NO: 3652620 - DNA, 14 bp, Homo sapiens
gcccatttcacaca

SEQ ID NO: 3652621 - DNA, 19 bp, Homo sapiens
gcccccactgcctttgacc

SEQ ID NO: 3652622 - DNA, 15 bp, Homo sapiens
gcctcccttcatgca

SEQ ID NO: 3652623 - DNA, 23 bp, Homo sapiens
gcctcccttcatgcatggaaatt

SEQ ID NO: 3652624 - DNA, 22 bp, Homo sapiens
gcctcttaaaaattatctttaa

SEQ ID NO: 3652625 - DNA, 17 bp, Homo sapiens
gcctcttccattccctt

SEQ ID NO: 3652626 - DNA, 18 bp, Homo sapiens
gcctgcatctagctggag

SEQ ID NO: 3652627 - DNA, 20 bp, Homo sapiens
gcctgcatctagctggagcc

SEQ ID NO: 3652628 - DNA, 18 bp, Homo sapiens
gcctggcttagaaggcac

SEQ ID NO: 3652629 - DNA, 16 bp, Homo sapiens
gcctgtaatctcagct

SEQ ID NO: 3652630 - DNA, 13 bp, Homo sapiens
gccttctcccctc

SEQ ID NO: 3652631 - DNA, 20 bp, Homo sapiens
gcgaaagggtgagactccat

SEQ ID NO: 3652632 - DNA, 12 bp, Homo sapiens
gcgtaggagaga

SEQ ID NO: 3652633 - DNA, 17 bp, Homo sapiens
gctaatttttgtatttt

SEQ ID NO: 3652634 - DNA, 17 bp, Homo sapiens
gctacaggggaggctga

SEQ ID NO: 3652635 - DNA, 18 bp, Homo sapiens
gctacatatgtaggaaaa

SEQ ID NO: 3652636 - DNA, 17 bp, Homo sapiens
gctactcaggaggctga

SEQ ID NO: 3652637 - DNA, 21 bp, Homo sapiens
gctagaatcagggtggagaag

SEQ ID NO: 3652638 - DNA, 18 bp, Homo sapiens
gctattcgtaagttctgt

SEQ ID NO: 3652639 - DNA, 11 bp, Homo sapiens
gctcacagcac

SEQ ID NO: 3652640 - DNA, 15 bp, Homo sapiens
gctcacagcacattt

SEQ ID NO: 3652641 - DNA, 17 bp, Homo sapiens
gctcacagcacatttgt

SEQ ID NO: 3652642 - DNA, 22 bp, Homo sapiens
gctcatagcacatgttttacaa

SEQ ID NO: 3652643 - DNA, 15 bp, Homo sapiens
gctctctaagaattc

SEQ ID NO: 3652644 - DNA, 15 bp, Homo sapiens
gctctgcaggcagcc

SEQ ID NO: 3652645 - DNA, 18 bp, Homo sapiens
gctctgcaggcagccttg

SEQ ID NO: 3652646 - DNA, 22 bp, Homo sapiens
caattcttccctatctttgcca

SEQ ID NO: 3652647 - DNA, 15 bp, Homo sapiens
cacaaaagacaagca

SEQ ID NO: 3652648 - DNA, 13 bp, Homo sapiens
cacaaagtgaaat

SEQ ID NO: 3652649 - DNA, 17 bp, Homo sapiens
cacaaagtgaaattagt

SEQ ID NO: 3652650 - DNA, 18 bp, Homo sapiens
cacaacctcctcctccag

SEQ ID NO: 3652651 - DNA, 14 bp, Homo sapiens
cacaactgtggata

SEQ ID NO: 3652652 - DNA, 19 bp, Homo sapiens
cacaagttctttcccagcc

SEQ ID NO: 3652653 - DNA, 15 bp, Homo sapiens
cacacagtatagata

SEQ ID NO: 3652654 - DNA, 14 bp, Homo sapiens
cacacctaaattaa

SEQ ID NO: 3652655 - DNA, 20 bp, Homo sapiens
cacacctaaattaacaaatt

SEQ ID NO: 3652656 - DNA, 21 bp, Homo sapiens
cacacgcctgtaatctcagct

SEQ ID NO: 3652657 - DNA, 16 bp, Homo sapiens
cacagagttccccgct

SEQ ID NO: 3652658 - DNA, 15 bp, Homo sapiens
cacagcatgcattta

SEQ ID NO: 3652659 - DNA, 18 bp, Homo sapiens
cacagcatgcatttagca

SEQ ID NO: 3652660 - DNA, 21 bp, Homo sapiens
cacagcatgcatttagcatga

SEQ ID NO: 3652661 - DNA, 18 bp, Homo sapiens
cacagctgagctggccta

SEQ ID NO: 3652662 - DNA, 14 bp, Homo sapiens
cacatacagatggt

SEQ ID NO: 3652663 - DNA, 16 bp, Homo sapiens
cacatgttttacaaag

SEQ ID NO: 3652664 - DNA, 19 bp, Homo sapiens
cacatttgttaatgattct

SEQ ID NO: 3652665 - DNA, 11 bp, Homo sapiens
caccagcagaa

SEQ ID NO: 3652666 - DNA, 12 bp, Homo sapiens
caccccagcctc

SEQ ID NO: 3652667 - DNA, 12 bp, Homo sapiens
caccctcacact

SEQ ID NO: 3652668 - DNA, 14 bp, Homo sapiens
caccctcatgctgt

SEQ ID NO: 3652669 - DNA, 19 bp, Homo sapiens
cacgcctgtaatctcagct

SEQ ID NO: 3652670 - DNA, 13 bp, Homo sapiens
cactccagcctgg

SEQ ID NO: 3652671 - DNA, 14 bp, Homo sapiens
cactgcaacctccg

SEQ ID NO: 3652672 - DNA, 15 bp, Homo sapiens
cactgcagttattta

SEQ ID NO: 3652673 - DNA, 19 bp, Homo sapiens
cactgcagttatttaccag

SEQ ID NO: 3652674 - DNA, 21 bp, Homo sapiens
cactgccaagccaaccctgga

SEQ ID NO: 3652675 - DNA, 20 bp, Homo sapiens
cactgccatttcctcctggg

SEQ ID NO: 3652676 - DNA, 12 bp, Homo sapiens
cactgcctttga

SEQ ID NO: 3652677 - DNA, 20 bp, Homo sapiens
cactgggaatgtcctgtaga

SEQ ID NO: 3652678 - DNA, 20 bp, Homo sapiens
cactttacattcttgctctg

SEQ ID NO: 3652679 - DNA, 18 bp, Homo sapiens
cagaaacaccctcacact

SEQ ID NO: 3652680 - DNA, 19 bp, Homo sapiens
cagaaacacggagtttcca

SEQ ID NO: 3652681 - DNA, 23 bp, Homo sapiens
cagaaacacggagtttccatttg

SEQ ID NO: 3652682 - DNA, 17 bp, Homo sapiens
cagaacaaactcagatc

SEQ ID NO: 3652683 - DNA, 22 bp, Homo sapiens
cagaacctttggacaagaggaa

SEQ ID NO: 3652684 - DNA, 23 bp, Homo sapiens
cagaacctttggacaagaggaaa

SEQ ID NO: 3652685 - DNA, 18 bp, Homo sapiens
cagaagctcaaggctgca

SEQ ID NO: 3652686 - DNA, 12 bp, Homo sapiens
cagaaggaagcc

SEQ ID NO: 3652687 - DNA, 18 bp, Homo sapiens
cagaaggaagccctctca

SEQ ID NO: 3652688 - DNA, 16 bp, Homo sapiens
cagaaggcaatcaaga

SEQ ID NO: 3652689 - DNA, 17 bp, Homo sapiens
cagaagtgaaaaagact

SEQ ID NO: 3652690 - DNA, 14 bp, Homo sapiens
cagaatgagatgat

SEQ ID NO: 3652691 - DNA, 16 bp, Homo sapiens
cagaatgagatgattt

SEQ ID NO: 3652692 - DNA, 20 bp, Homo sapiens
cagaatgagatgatttaatt

SEQ ID NO: 3652693 - DNA, 22 bp, Homo sapiens
cagaatgagatgatttaattct

SEQ ID NO: 3652694 - DNA, 23 bp, Homo sapiens
cagaatgagatgatttaattctt

SEQ ID NO: 3652695 - DNA, 15 bp, Homo sapiens
cagaatgaggcacat

SEQ ID NO: 3652696 - DNA, 13 bp, Homo sapiens
cagacaggaagga

SEQ ID NO: 3652697 - DNA, 19 bp, Homo sapiens
cagacccataaaccacctc

SEQ ID NO: 3652698 - DNA, 14 bp, Homo sapiens
cagactcagaggga

SEQ ID NO: 3652699 - DNA, 22 bp, Homo sapiens
cagaggatgaggtgggctgaag

SEQ ID NO: 3652700 - DNA, 21 bp, Homo sapiens
cagaggcaggaccagaaggca

SEQ ID NO: 3652701 - DNA, 14 bp, Homo sapiens
cagatcaccccagc

SEQ ID NO: 3652702 - DNA, 17 bp, Homo sapiens
cagatcaccccagcctc

SEQ ID NO: 3652703 - DNA, 13 bp, Homo sapiens
cagatccatcggt

SEQ ID NO: 3652704 - DNA, 22 bp, Homo sapiens
cagatccttttccatcccactc

SEQ ID NO: 3652705 - DNA, 22 bp, Homo sapiens
cagatctgaagtagtgtgagtg

SEQ ID NO: 3652706 - DNA, 13 bp, Homo sapiens
cagatttccaaaa

SEQ ID NO: 3652707 - DNA, 16 bp, Homo sapiens
cagatttccaaaagta

SEQ ID NO: 3652708 - DNA, 19 bp, Homo sapiens
cagcactttgggaggccga

SEQ ID NO: 3652709 - DNA, 23 bp, Homo sapiens
cagcagaacaaactcagatctca

SEQ ID NO: 3652710 - DNA, 12 bp, Homo sapiens
cagcagaggcag

SEQ ID NO: 3652711 - DNA, 13 bp, Homo sapiens
cagcagaggcagg

SEQ ID NO: 3652712 - DNA, 21 bp, Homo sapiens
cagcatcctggaaatttgtgt

SEQ ID NO: 3652713 - DNA, 12 bp, Homo sapiens
cagcatgcattt

SEQ ID NO: 3652714 - DNA, 19 bp, Homo sapiens
cagcatgcatttagcatga

SEQ ID NO: 3652715 - DNA, 22 bp, Homo sapiens
cagcatgcatttagcatgagtt

SEQ ID NO: 3652716 - DNA, 20 bp, Homo sapiens
cagcctcactccatttccca

SEQ ID NO: 3652717 - DNA, 14 bp, Homo sapiens
cagctaatttgtga

SEQ ID NO: 3652718 - DNA, 15 bp, Homo sapiens
cagctaatttgtgaa

SEQ ID NO: 3652719 - DNA, 19 bp, Homo sapiens
cagctaatttgtgaaagtg

SEQ ID NO: 3652720 - DNA, 16 bp, Homo sapiens
cagctactcaggaggc

SEQ ID NO: 3652721 - DNA, 20 bp, Homo sapiens
cagcttttcccaaaagccca

SEQ ID NO: 3652722 - DNA, 14 bp, Homo sapiens
caggaaggaagcac

SEQ ID NO: 3652723 - DNA, 16 bp, Homo sapiens
caggaccagaaggcaa

SEQ ID NO: 3652724 - DNA, 19 bp, Homo sapiens
caggaccagaaggcaatca

SEQ ID NO: 3652725 - DNA, 16 bp, Homo sapiens
caggagaattgcttga

SEQ ID NO: 3652726 - DNA, 16 bp, Homo sapiens
caggagttcgaggcga

SEQ ID NO: 3652727 - DNA, 13 bp, Homo sapiens
caggcagccttgc

SEQ ID NO: 3652728 - DNA, 15 bp, Homo sapiens
caggcatggaaagat

SEQ ID NO: 3652729 - DNA, 22 bp, Homo sapiens
caggcatggaaagatggggagc

SEQ ID NO: 3652730 - DNA, 13 bp, Homo sapiens
caggctggagtgt

SEQ ID NO: 3652731 - DNA, 20 bp, Homo sapiens
cagggacatgtatgcttcca

SEQ ID NO: 3652732 - DNA, 21 bp, Homo sapiens
cagggagagctgggcagacag

SEQ ID NO: 3652733 - DNA, 19 bp, Homo sapiens
cagggatgctatctcgcta

SEQ ID NO: 3652734 - DNA, 13 bp, Homo sapiens
caggggaggctga

SEQ ID NO: 3652735 - DNA, 14 bp, Homo sapiens
caggggaggctgag

SEQ ID NO: 3652736 - DNA, 20 bp, Homo sapiens
caggtgcagcccccactgcc

SEQ ID NO: 3652737 - DNA, 21 bp, Homo sapiens
cagtaagataggttctgcttt

SEQ ID NO: 3652738 - DNA, 15 bp, Homo sapiens
cagtatcttaaaatt

SEQ ID NO: 3652739 - DNA, 23 bp, Homo sapiens
cagtatgggttagggaaaacatt

SEQ ID NO: 3652740 - DNA, 14 bp, Homo sapiens
cagtcgaggctggt

SEQ ID NO: 3652741 - DNA, 15 bp, Homo sapiens
cagtctatgctgtgt

SEQ ID NO: 3652742 - DNA, 23 bp, Homo sapiens
cagtctctatttgatttgcaaca

SEQ ID NO: 3652743 - DNA, 15 bp, Homo sapiens
cagtgttcaaattct

SEQ ID NO: 3652744 - DNA, 22 bp, Homo sapiens
cagtgttcaaattctgattatt

SEQ ID NO: 3652745 - DNA, 22 bp, Homo sapiens
cagtttggtatgaaacaaatat

SEQ ID NO: 3652746 - DNA, 19 bp, Homo sapiens
catacagtctctatttgat

SEQ ID NO: 3652747 - DNA, 17 bp, Homo sapiens
catacgtgcccatttca

SEQ ID NO: 3652748 - DNA, 21 bp, Homo sapiens
catacgtgcccatttcacaca

SEQ ID NO: 3652749 - DNA, 12 bp, Homo sapiens
catagataccat

SEQ ID NO: 3652750 - DNA, 21 bp, Homo sapiens
catagataccattttgaaata

SEQ ID NO: 3652751 - DNA, 18 bp, Homo sapiens
catagtggtattttaaca

SEQ ID NO: 3652752 - DNA, 16 bp, Homo sapiens
catataaacacagtaa

SEQ ID NO: 3652753 - DNA, 19 bp, Homo sapiens
catataaacacagtaagat

SEQ ID NO: 3652754 - DNA, 20 bp, Homo sapiens
catataaacacagtaagata

SEQ ID NO: 3652755 - DNA, 17 bp, Homo sapiens
catataggggcaaaaat

SEQ ID NO: 3652756 - DNA, 17 bp, Homo sapiens
catcagaaacaccctca

SEQ ID NO: 3652757 - DNA, 18 bp, Homo sapiens
catcccttcaaccccact

SEQ ID NO: 3652758 - DNA, 19 bp, Homo sapiens
catctaaaccagaaggaag

SEQ ID NO: 3652759 - DNA, 21 bp, Homo sapiens
catctaaaccagaaggaagcc

SEQ ID NO: 3652760 - DNA, 13 bp, Homo sapiens
catctagctggag

SEQ ID NO: 3652761 - DNA, 17 bp, Homo sapiens
catctgaggaaaatgga

SEQ ID NO: 3652762 - DNA, 17 bp, Homo sapiens
catctggaaccatcaga

SEQ ID NO: 3652763 - DNA, 19 bp, Homo sapiens
catctggaaccatcagaaa

SEQ ID NO: 3652764 - DNA, 20 bp, Homo sapiens
catctgtcagtgagtcagag

SEQ ID NO: 3652765 - DNA, 15 bp, Homo sapiens
catgaaaagttttca

SEQ ID NO: 3652766 - DNA, 13 bp, Homo sapiens
catgacagtggtt

SEQ ID NO: 3652767 - DNA, 14 bp, Homo sapiens
catgaggaaaataa

SEQ ID NO: 3652768 - DNA, 14 bp, Homo sapiens
catgaggtcaggag

SEQ ID NO: 3652769 - DNA, 13 bp, Homo sapiens
catgagtctccag

SEQ ID NO: 3652770 - DNA, 22 bp, Homo sapiens
catgagtctccagatagatgtc

SEQ ID NO: 3652771 - DNA, 19 bp, Homo sapiens
catgagttctgcacataca

SEQ ID NO: 3652772 - DNA, 15 bp, Homo sapiens
catgatgctagttct

SEQ ID NO: 3652773 - DNA, 19 bp, Homo sapiens
catgatgctagttcttacg

SEQ ID NO: 3652774 - DNA, 17 bp, Homo sapiens
catgcatggaaattccc

SEQ ID NO: 3652775 - DNA, 14 bp, Homo sapiens
catgcattcagatc

SEQ ID NO: 3652776 - DNA, 17 bp, Homo sapiens
catgcattcagatctga

SEQ ID NO: 3652777 - DNA, 17 bp, Homo sapiens
catgcccaaatataaca

SEQ ID NO: 3652778 - DNA, 12 bp, Homo sapiens
catgcccatccc

SEQ ID NO: 3652779 - DNA, 20 bp, Homo sapiens
catgcctacattagtgagat

SEQ ID NO: 3652780 - DNA, 22 bp, Homo sapiens
catgctgtgtgactcaaaccaa

SEQ ID NO: 3652781 - DNA, 22 bp, Homo sapiens
catgctgttctgaaagggatgg

SEQ ID NO: 3652782 - DNA, 15 bp, Homo sapiens
catggtagactgtga

SEQ ID NO: 3652783 - DNA, 13 bp, Homo sapiens
attaaaacaaaat

SEQ ID NO: 3652784 - DNA, 11 bp, Homo sapiens
attaaaatatt

SEQ ID NO: 3652785 - DNA, 15 bp, Homo sapiens
attaaactgggaaat

SEQ ID NO: 3652786 - DNA, 18 bp, Homo sapiens
attaaatttattaaatgt

SEQ ID NO: 3652787 - DNA, 18 bp, Homo sapiens
attaacttctattttcaa

SEQ ID NO: 3652788 - DNA, 20 bp, Homo sapiens
attaacttctattttcaagt

SEQ ID NO: 3652789 - DNA, 18 bp, Homo sapiens
attaagggttaccccacc

SEQ ID NO: 3652790 - DNA, 22 bp, Homo sapiens
attaagggttaccccaccctgc

SEQ ID NO: 3652791 - DNA, 23 bp, Homo sapiens
attaatgtagggcagaatagctg

SEQ ID NO: 3652792 - DNA, 21 bp, Homo sapiens
attacaacaagcaaactgaaa

SEQ ID NO: 3652793 - DNA, 13 bp, Homo sapiens
attacactccagc

SEQ ID NO: 3652794 - DNA, 13 bp, Homo sapiens
attacagaaacac

SEQ ID NO: 3652795 - DNA, 20 bp, Homo sapiens
attagccagtcatggtggca

SEQ ID NO: 3652796 - DNA, 16 bp, Homo sapiens
attaggtttagaatca

SEQ ID NO: 3652797 - DNA, 12 bp, Homo sapiens
attagtattttg

SEQ ID NO: 3652798 - DNA, 14 bp, Homo sapiens
attagtattttgag

SEQ ID NO: 3652799 - DNA, 21 bp, Homo sapiens
attatcctcaagttgtgtgct

SEQ ID NO: 3652800 - DNA, 15 bp, Homo sapiens
attatctgatccttg

SEQ ID NO: 3652801 - DNA, 18 bp, Homo sapiens
attcaataactattgctg

SEQ ID NO: 3652802 - DNA, 21 bp, Homo sapiens
attcagtagcattttaatagt

SEQ ID NO: 3652803 - DNA, 16 bp, Homo sapiens
attcagtctatgctgt

SEQ ID NO: 3652804 - DNA, 17 bp, Homo sapiens
attcagtctatgctgtg

SEQ ID NO: 3652805 - DNA, 22 bp, Homo sapiens
attcagtggacatttgttctgg

SEQ ID NO: 3652806 - DNA, 12 bp, Homo sapiens
attcatgatgct

SEQ ID NO: 3652807 - DNA, 15 bp, Homo sapiens
attcatgatgctagt

SEQ ID NO: 3652808 - DNA, 20 bp, Homo sapiens
attcatgatgctagttctta

SEQ ID NO: 3652809 - DNA, 12 bp, Homo sapiens
attcattccatt

SEQ ID NO: 3652810 - DNA, 17 bp, Homo sapiens
attcattccattctgga

SEQ ID NO: 3652811 - DNA, 11 bp, Homo sapiens
attccatcctt

SEQ ID NO: 3652812 - DNA, 23 bp, Homo sapiens
attcctaattctatgattaaact

SEQ ID NO: 3652813 - DNA, 13 bp, Homo sapiens
attcgaatgaaat

SEQ ID NO: 3652814 - DNA, 22 bp, Homo sapiens
attctatgattaaactgggaaa

SEQ ID NO: 3652815 - DNA, 19 bp, Homo sapiens
attctcagaagtgaaaaag

SEQ ID NO: 3652816 - DNA, 23 bp, Homo sapiens
attcttaccgaaatgaaaatggc

SEQ ID NO: 3652817 - DNA, 21 bp, Homo sapiens
attcttccctatctttgccac

SEQ ID NO: 3652818 - DNA, 23 bp, Homo sapiens
attcttctcctttgtcaaatggt

SEQ ID NO: 3652819 - DNA, 13 bp, Homo sapiens
attgagtgtacat

SEQ ID NO: 3652820 - DNA, 19 bp, Homo sapiens
attgcactgcagttattta

SEQ ID NO: 3652821 - DNA, 22 bp, Homo sapiens
attgcactgcagttatttacca

SEQ ID NO: 3652822 - DNA, 17 bp, Homo sapiens
attgccttgggcctggg

SEQ ID NO: 3652823 - DNA, 22 bp, Homo sapiens
attgccttgggcctgggaatct

SEQ ID NO: 3652824 - DNA, 18 bp, Homo sapiens
attgctgtaaataaaaat

SEQ ID NO: 3652825 - DNA, 20 bp, Homo sapiens
attgctgtaaataaaaatag

SEQ ID NO: 3652826 - DNA, 21 bp, Homo sapiens
attgctgtaaataaaaatagc

SEQ ID NO: 3652827 - DNA, 22 bp, Homo sapiens
attgctgtaaataaaaatagct

SEQ ID NO: 3652828 - DNA, 15 bp, Homo sapiens
attgctgtctgaaaa

SEQ ID NO: 3652829 - DNA, 17 bp, Homo sapiens
attgcttctctaaaaca

SEQ ID NO: 3652830 - DNA, 15 bp, Homo sapiens
attgcttgagcatgc

SEQ ID NO: 3652831 - DNA, 19 bp, Homo sapiens
attgtaaaggtgatgaatt

SEQ ID NO: 3652832 - DNA, 13 bp, Homo sapiens
attgtcagaatgt

SEQ ID NO: 3652833 - DNA, 22 bp, Homo sapiens
attgtttgatgaataaaatgtt

SEQ ID NO: 3652834 - DNA, 15 bp, Homo sapiens
atttaccagaagttt

SEQ ID NO: 3652835 - DNA, 17 bp, Homo sapiens
atttaccagaagtttaa

SEQ ID NO: 3652836 - DNA, 19 bp, Homo sapiens
atttaccagaagtttaaat

SEQ ID NO: 3652837 - DNA, 12 bp, Homo sapiens
atttactgttta

SEQ ID NO: 3652838 - DNA, 16 bp, Homo sapiens
atttactgtttataat

SEQ ID NO: 3652839 - DNA, 17 bp, Homo sapiens
atttagcatgagttctg

SEQ ID NO: 3652840 - DNA, 18 bp, Homo sapiens
atttagcatgagttctgc

SEQ ID NO: 3652841 - DNA, 19 bp, Homo sapiens
atttagggttctatattta

SEQ ID NO: 3652842 - DNA, 22 bp, Homo sapiens
atttagggttctatatttactg

SEQ ID NO: 3652843 - DNA, 14 bp, Homo sapiens
atttattaaatgtt

SEQ ID NO: 3652844 - DNA, 15 bp, Homo sapiens
atttattaaatttat

SEQ ID NO: 3652845 - DNA, 22 bp, Homo sapiens
atttattaaatttattaaatgt

SEQ ID NO: 3652846 - DNA, 21 bp, Homo sapiens
atttccatggattcccctgga

SEQ ID NO: 3652847 - DNA, 20 bp, Homo sapiens
atttgacattgtcagaatgt

SEQ ID NO: 3652848 - DNA, 15 bp, Homo sapiens
atttgctgcatttca

SEQ ID NO: 3652849 - DNA, 13 bp, Homo sapiens
atttgtattaatg

SEQ ID NO: 3652850 - DNA, 16 bp, Homo sapiens
atttgtattaatgtag

SEQ ID NO: 3652851 - DNA, 16 bp, Homo sapiens
atttgttaatgattct

SEQ ID NO: 3652852 - DNA, 17 bp, Homo sapiens
atttgttaatgattctt

SEQ ID NO: 3652853 - DNA, 15 bp, Homo sapiens
attttaaacaaaatt

SEQ ID NO: 3652854 - DNA, 20 bp, Homo sapiens
attttaaacaaaatttatgt

SEQ ID NO: 3652855 - DNA, 20 bp, Homo sapiens
attttaacatagcagctggt

SEQ ID NO: 3652856 - DNA, 13 bp, Homo sapiens
attttattgaata

SEQ ID NO: 3652857 - DNA, 15 bp, Homo sapiens
attttattgaatata

SEQ ID NO: 3652858 - DNA, 14 bp, Homo sapiens
attttcagatcctt

SEQ ID NO: 3652859 - DNA, 16 bp, Homo sapiens
attttcagatccttcc

SEQ ID NO: 3652860 - DNA, 16 bp, Homo sapiens
attttctgtaattctt

SEQ ID NO: 3652861 - DNA, 17 bp, Homo sapiens
attttctgtaattcttc

SEQ ID NO: 3652862 - DNA, 14 bp, Homo sapiens
attttcttaattat

SEQ ID NO: 3652863 - DNA, 13 bp, Homo sapiens
attttcttcttta

SEQ ID NO: 3652864 - DNA, 16 bp, Homo sapiens
attttctttctttttt

SEQ ID NO: 3652865 - DNA, 12 bp, Homo sapiens
attttgaaatat

SEQ ID NO: 3652866 - DNA, 21 bp, Homo sapiens
attttgagccttattaaaata

SEQ ID NO: 3652867 - DNA, 16 bp, Homo sapiens
attttgatgtattatt

SEQ ID NO: 3652868 - DNA, 19 bp, Homo sapiens
attttggaagaattcatga

SEQ ID NO: 3652869 - DNA, 22 bp, Homo sapiens
atttttctgttggtcttaacta

SEQ ID NO: 3652870 - DNA, 16 bp, Homo sapiens
atttttgagtaaaact

SEQ ID NO: 3652871 - DNA, 13 bp, Homo sapiens
caaaagacaagca

SEQ ID NO: 3652872 - DNA, 22 bp, Homo sapiens
caaaagacaagcattgggtcag

SEQ ID NO: 3652873 - DNA, 22 bp, Homo sapiens
caaaagcaggaacccatctaaa

SEQ ID NO: 3652874 - DNA, 20 bp, Homo sapiens
caaaagcccattcattccat

SEQ ID NO: 3652875 - DNA, 22 bp, Homo sapiens
caaaagcccattcattccattc

SEQ ID NO: 3652876 - DNA, 21 bp, Homo sapiens
caaaaggatgatttaacatta

SEQ ID NO: 3652877 - DNA, 21 bp, Homo sapiens
caaaatataaatcacagattt

SEQ ID NO: 3652878 - DNA, 19 bp, Homo sapiens
caaaatttatgtcattttc

SEQ ID NO: 3652879 - DNA, 20 bp, Homo sapiens
caaaatttatgtcattttca

SEQ ID NO: 3652880 - DNA, 13 bp, Homo sapiens
caaacaaatcatt

SEQ ID NO: 3652881 - DNA, 18 bp, Homo sapiens
caaacaaatcattttgat

SEQ ID NO: 3652882 - DNA, 15 bp, Homo sapiens
caaacatcagtcaat

SEQ ID NO: 3652883 - DNA, 23 bp, Homo sapiens
caaactctctagtgcaggaaaag

SEQ ID NO: 3652884 - DNA, 13 bp, Homo sapiens
caaactgaaatta

SEQ ID NO: 3652885 - DNA, 16 bp, Homo sapiens
caaacttttataaatg

SEQ ID NO: 3652886 - DNA, 11 bp, Homo sapiens
caaaggaagtg

SEQ ID NO: 3652887 - DNA, 16 bp, Homo sapiens
caaaggaagtgaggta

SEQ ID NO: 3652888 - DNA, 21 bp, Homo sapiens
caaagtgaaattagtattttg

SEQ ID NO: 3652889 - DNA, 21 bp, Homo sapiens
caaatagcttttcacttctta

SEQ ID NO: 3652890 - DNA, 12 bp, Homo sapiens
caaatataacat

SEQ ID NO: 3652891 - DNA, 13 bp, Homo sapiens
caaatatactcat

SEQ ID NO: 3652892 - DNA, 14 bp, Homo sapiens
caaatcattttgat

SEQ ID NO: 3652893 - DNA, 21 bp, Homo sapiens
caaattcagtggacatttgtt

SEQ ID NO: 3652894 - DNA, 19 bp, Homo sapiens
caaattctgattattacaa

SEQ ID NO: 3652895 - DNA, 22 bp, Homo sapiens
caacaagcaaactgaaattagt

SEQ ID NO: 3652896 - DNA, 23 bp, Homo sapiens
caacagactgccttatattattt

SEQ ID NO: 3652897 - DNA, 20 bp, Homo sapiens
caacatggtgaaaccctgtc

SEQ ID NO: 3652898 - DNA, 23 bp, Homo sapiens
caacatggtgaaaccctgtctct

SEQ ID NO: 3652899 - DNA, 17 bp, Homo sapiens
caaccttgtactttaca

SEQ ID NO: 3652900 - DNA, 18 bp, Homo sapiens
caactgtggataaatttt

SEQ ID NO: 3652901 - DNA, 22 bp, Homo sapiens
caactgtggataaattttggaa

SEQ ID NO: 3652902 - DNA, 18 bp, Homo sapiens
caagagcctgagactgga

SEQ ID NO: 3652903 - DNA, 20 bp, Homo sapiens
caagaggaaaaatactaaga

SEQ ID NO: 3652904 - DNA, 12 bp, Homo sapiens
caagattcctgg

SEQ ID NO: 3652905 - DNA, 19 bp, Homo sapiens
caagcattgctaaagtcag

SEQ ID NO: 3652906 - DNA, 16 bp, Homo sapiens
caagcattgggtcaga

SEQ ID NO: 3652907 - DNA, 20 bp, Homo sapiens
caagcattgggtcagaccca

SEQ ID NO: 3652908 - DNA, 13 bp, Homo sapiens
caagctacatatg

SEQ ID NO: 3652909 - DNA, 16 bp, Homo sapiens
caagtagtagtactta

SEQ ID NO: 3652910 - DNA, 23 bp, Homo sapiens
caagtctacctgccttgcctgtt

SEQ ID NO: 3652911 - DNA, 11 bp, Homo sapiens
caagtctgtga

SEQ ID NO: 3652912 - DNA, 20 bp, Homo sapiens
caagtgaatgagtttccagc

SEQ ID NO: 3652913 - DNA, 14 bp, Homo sapiens
caataaaaatggca

SEQ ID NO: 3652914 - DNA, 20 bp, Homo sapiens
caatattgctagaggtggca

SEQ ID NO: 3652915 - DNA, 16 bp, Homo sapiens
caatcaagagcttcca

SEQ ID NO: 3652916 - DNA, 21 bp, Homo sapiens
caatgtctgtccctaaacata

SEQ ID NO: 3652917 - DNA, 21 bp, Homo sapiens
caatgttaaatctacaaactt

SEQ ID NO: 3652918 - DNA, 21 bp, Homo sapiens
caattcttccctatctttgcc

SEQ ID NO: 3652919 - DNA, 13 bp, Homo sapiens
ttccattctggaa

SEQ ID NO: 3652920 - DNA, 20 bp, Homo sapiens
ttccatttggattttaaaca

SEQ ID NO: 3652921 - DNA, 11 bp, Homo sapiens
ttcccaaaagc

SEQ ID NO: 3652922 - DNA, 21 bp, Homo sapiens
ttcccaaaagcccattcattc

SEQ ID NO: 3652923 - DNA, 19 bp, Homo sapiens
ttcccatggtagactgtga

SEQ ID NO: 3652924 - DNA, 20 bp, Homo sapiens
ttcccatggtagactgtgac

SEQ ID NO: 3652925 - DNA, 15 bp, Homo sapiens
ttccccgacactgcc

SEQ ID NO: 3652926 - DNA, 12 bp, Homo sapiens
ttccctccaggc

SEQ ID NO: 3652927 - DNA, 15 bp, Homo sapiens
ttcccttcatctgga

SEQ ID NO: 3652928 - DNA, 16 bp, Homo sapiens
ttcccttcatctggaa

SEQ ID NO: 3652929 - DNA, 15 bp, Homo sapiens
ttcctaattcctgta

SEQ ID NO: 3652930 - DNA, 14 bp, Homo sapiens
ttcctacaggagat

SEQ ID NO: 3652931 - DNA, 22 bp, Homo sapiens
ttcctacaggagatagctttct

SEQ ID NO: 3652932 - DNA, 11 bp, Homo sapiens
ttccttccttt

SEQ ID NO: 3652933 - DNA, 15 bp, Homo sapiens
ttcctttcttccttc

SEQ ID NO: 3652934 - DNA, 13 bp, Homo sapiens
ttcgtaagttctg

SEQ ID NO: 3652935 - DNA, 14 bp, Homo sapiens
ttcgtaagttctgt

SEQ ID NO: 3652936 - DNA, 15 bp, Homo sapiens
ttcgtgggcctgctg

SEQ ID NO: 3652937 - DNA, 16 bp, Homo sapiens
ttctcccctccaagtg

SEQ ID NO: 3652938 - DNA, 15 bp, Homo sapiens
ttctctaagcctggc

SEQ ID NO: 3652939 - DNA, 23 bp, Homo sapiens
ttctgaactatcagggcaagctc

SEQ ID NO: 3652940 - DNA, 18 bp, Homo sapiens
ttctgaattttttttctg

SEQ ID NO: 3652941 - DNA, 17 bp, Homo sapiens
ttctgatacatctgtca

SEQ ID NO: 3652942 - DNA, 13 bp, Homo sapiens
ttctgcacataca

SEQ ID NO: 3652943 - DNA, 17 bp, Homo sapiens
ttctgcacatacagatg

SEQ ID NO: 3652944 - DNA, 14 bp, Homo sapiens
ttctgctttctgat

SEQ ID NO: 3652945 - DNA, 20 bp, Homo sapiens
ttctggtccttagtaaattc

SEQ ID NO: 3652946 - DNA, 19 bp, Homo sapiens
ttctgtaattcttctcctt

SEQ ID NO: 3652947 - DNA, 19 bp, Homo sapiens
ttctgtgtggcaccttgat

SEQ ID NO: 3652948 - DNA, 15 bp, Homo sapiens
ttctgttggtcttaa

SEQ ID NO: 3652949 - DNA, 20 bp, Homo sapiens
ttcttaaggacagtgttcaa

SEQ ID NO: 3652950 - DNA, 12 bp, Homo sapiens
ttcttaattatg

SEQ ID NO: 3652951 - DNA, 12 bp, Homo sapiens
ttcttctccttt

SEQ ID NO: 3652952 - DNA, 17 bp, Homo sapiens
ttctttaatttttctgt

SEQ ID NO: 3652953 - DNA, 14 bp, Homo sapiens
ttctttccttcctt

SEQ ID NO: 3652954 - DNA, 14 bp, Homo sapiens
ttgacagttactta

SEQ ID NO: 3652955 - DNA, 15 bp, Homo sapiens
ttgacattgtcagaa

SEQ ID NO: 3652956 - DNA, 18 bp, Homo sapiens
ttgacattgtcagaatgt

SEQ ID NO: 3652957 - DNA, 19 bp, Homo sapiens
ttgacattgtcagaatgtt

SEQ ID NO: 3652958 - DNA, 21 bp, Homo sapiens
ttgacctgcctcccttcatgc

SEQ ID NO: 3652959 - DNA, 21 bp, Homo sapiens
ttgacgtcttaggtggcaggg

SEQ ID NO: 3652960 - DNA, 23 bp, Homo sapiens
ttgagcatgcccaaatataacat

SEQ ID NO: 3652961 - DNA, 19 bp, Homo sapiens
ttgagccttattaaaatat

SEQ ID NO: 3652962 - DNA, 22 bp, Homo sapiens
ttgatttgcaacactgccaaac

SEQ ID NO: 3652963 - DNA, 18 bp, Homo sapiens
ttgcaggtgaccagaatg

SEQ ID NO: 3652964 - DNA, 16 bp, Homo sapiens
ttgccaccctcatgct

SEQ ID NO: 3652965 - DNA, 13 bp, Homo sapiens
ttgctaaagtcag

SEQ ID NO: 3652966 - DNA, 22 bp, Homo sapiens
ttgctaagataattaaatgaaa

SEQ ID NO: 3652967 - DNA, 23 bp, Homo sapiens
ttgctctccctcccttctttcct

SEQ ID NO: 3652968 - DNA, 11 bp, Homo sapiens
ttgctgagcct

SEQ ID NO: 3652969 - DNA, 12 bp, Homo sapiens
ttgctgtgaaat

SEQ ID NO: 3652970 - DNA, 22 bp, Homo sapiens
ttggaaaatgttctgacagcat

SEQ ID NO: 3652971 - DNA, 13 bp, Homo sapiens
ttggaagaattca

SEQ ID NO: 3652972 - DNA, 22 bp, Homo sapiens
ttggaagttttacttgattaag

SEQ ID NO: 3652973 - DNA, 14 bp, Homo sapiens
ttggagagagattc

SEQ ID NO: 3652974 - DNA, 21 bp, Homo sapiens
ttggagattactaactgtgga

SEQ ID NO: 3652975 - DNA, 23 bp, Homo sapiens
ttggagattactaactgtggaca

SEQ ID NO: 3652976 - DNA, 15 bp, Homo sapiens
ttggatataaatctt

SEQ ID NO: 3652977 - DNA, 17 bp, Homo sapiens
ttggccatcatttcatt

SEQ ID NO: 3652978 - DNA, 11 bp, Homo sapiens
ttgggaggctg

SEQ ID NO: 3652979 - DNA, 12 bp, Homo sapiens
ttgggaggctga

SEQ ID NO: 3652980 - DNA, 17 bp, Homo sapiens
ttgggcccttagaatgt

SEQ ID NO: 3652981 - DNA, 16 bp, Homo sapiens
ttggtatgaaacaaat

SEQ ID NO: 3652982 - DNA, 12 bp, Homo sapiens
ttggtatttact

SEQ ID NO: 3652983 - DNA, 13 bp, Homo sapiens
ttggtatttactg

SEQ ID NO: 3652984 - DNA, 21 bp, Homo sapiens
ttggttaatgaaaaatctgaa

SEQ ID NO: 3652985 - DNA, 14 bp, Homo sapiens
ttgtactttacaat

SEQ ID NO: 3652986 - DNA, 15 bp, Homo sapiens
ttgtataattatgaa

SEQ ID NO: 3652987 - DNA, 16 bp, Homo sapiens
ttgtcagaatgttgtg

SEQ ID NO: 3652988 - DNA, 19 bp, Homo sapiens
ttgtgaaagtggcaagctc

SEQ ID NO: 3652989 - DNA, 20 bp, Homo sapiens
ttgtgaaagtggcaagctct

SEQ ID NO: 3652990 - DNA, 17 bp, Homo sapiens
ttgtgaatggttgcaaa

SEQ ID NO: 3652991 - DNA, 21 bp, Homo sapiens
ttgtggggatggtgatggaga

SEQ ID NO: 3652992 - DNA, 17 bp, Homo sapiens
ttgtgtgcttcacacaa

SEQ ID NO: 3652993 - DNA, 18 bp, Homo sapiens
ttgttaatgattcttgtg

SEQ ID NO: 3652994 - DNA, 14 bp, Homo sapiens
ttgttctgggttaa

SEQ ID NO: 3652995 - DNA, 14 bp, Homo sapiens
ttaacagtaaatat

SEQ ID NO: 3652996 - DNA, 17 bp, Homo sapiens
ttaacagtaaatataca

SEQ ID NO: 3652997 - DNA, 19 bp, Homo sapiens
ttaacagtaaatatacact

SEQ ID NO: 3652998 - DNA, 15 bp, Homo sapiens
ttaacatagcagctg

SEQ ID NO: 3652999 - DNA, 13 bp, Homo sapiens
ttaaggacagtgt

SEQ ID NO: 3653000 - DNA, 17 bp, Homo sapiens
ttaaggacagtgttcaa

SEQ ID NO: 3653001 - DNA, 16 bp, Homo sapiens
ttaaggactacagaat

SEQ ID NO: 3653002 - DNA, 17 bp, Homo sapiens
ttaaggactacagaatt

SEQ ID NO: 3653003 - DNA, 19 bp, Homo sapiens
ttaaggactacagaattgg

SEQ ID NO: 3653004 - DNA, 24 bp, Homo sapiens
ttaatagtacccaacctggtaatt

SEQ ID NO: 3653005 - DNA, 14 bp, Homo sapiens
ttaatagtttctaa

SEQ ID NO: 3653006 - DNA, 19 bp, Homo sapiens
ttaatagtttctaaaccat

SEQ ID NO: 3653007 - DNA, 21 bp, Homo sapiens
ttaatgaaaaatctgaatttc

SEQ ID NO: 3653008 - DNA, 14 bp, Homo sapiens
ttaatgacctgaat

SEQ ID NO: 3653009 - DNA, 18 bp, Homo sapiens
ttaatgattcttgtgtca

SEQ ID NO: 3653010 - DNA, 21 bp, Homo sapiens
ttacaaagaaacaaaatataa

SEQ ID NO: 3653011 - DNA, 12 bp, Homo sapiens
ttacaacaagca

SEQ ID NO: 3653012 - DNA, 23 bp, Homo sapiens
ttacaacaagcaaactgaaatta

SEQ ID NO: 3653013 - DNA, 22 bp, Homo sapiens
ttacacacctgagaatgtgcct

SEQ ID NO: 3653014 - DNA, 13 bp, Homo sapiens
ttacactccagcc

SEQ ID NO: 3653015 - DNA, 13 bp, Homo sapiens
ttaccgaaatgaa

SEQ ID NO: 3653016 - DNA, 17 bp, Homo sapiens
ttacctattgctgtaaa

SEQ ID NO: 3653017 - DNA, 17 bp, Homo sapiens
ttagaaaaaactggaaa

SEQ ID NO: 3653018 - DNA, 18 bp, Homo sapiens
ttagaatcaagtctgtga

SEQ ID NO: 3653019 - DNA, 13 bp, Homo sapiens
ttagaatgtgaaa

SEQ ID NO: 3653020 - DNA, 15 bp, Homo sapiens
ttagcttcctgcagg

SEQ ID NO: 3653021 - DNA, 17 bp, Homo sapiens
ttagggaaaacattcca

SEQ ID NO: 3653022 - DNA, 21 bp, Homo sapiens
ttaggtctgttgaagtgcatg

SEQ ID NO: 3653023 - DNA, 14 bp, Homo sapiens
ttagtaaattccta

SEQ ID NO: 3653024 - DNA, 15 bp, Homo sapiens
ttataaaatctgtat

SEQ ID NO: 3653025 - DNA, 16 bp, Homo sapiens
ttataaatgttttaaa

SEQ ID NO: 3653026 - DNA, 18 bp, Homo sapiens
ttataaatgttttaaaga

SEQ ID NO: 3653027 - DNA, 17 bp, Homo sapiens
ttataacattgtaaatg

SEQ ID NO: 3653028 - DNA, 17 bp, Homo sapiens
ttatattattttctgta

SEQ ID NO: 3653029 - DNA, 12 bp, Homo sapiens
ttatatttcaac

SEQ ID NO: 3653030 - DNA, 13 bp, Homo sapiens
ttatcctcaagtt

SEQ ID NO: 3653031 - DNA, 23 bp, Homo sapiens
ttatgtatttgttaaagaaacat

SEQ ID NO: 3653032 - DNA, 12 bp, Homo sapiens
ttatgtcatttt

SEQ ID NO: 3653033 - DNA, 14 bp, Homo sapiens
ttatgtcattttca

SEQ ID NO: 3653034 - DNA, 22 bp, Homo sapiens
ttattacaacaagcaaactgaa

SEQ ID NO: 3653035 - DNA, 21 bp, Homo sapiens
ttattcctaattcctgtatgt

SEQ ID NO: 3653036 - DNA, 23 bp, Homo sapiens
ttcaaattctgattattacaaca

SEQ ID NO: 3653037 - DNA, 22 bp, Homo sapiens
ttcacagttcctctttgttgga

SEQ ID NO: 3653038 - DNA, 15 bp, Homo sapiens
ttcacttcttaagga

SEQ ID NO: 3653039 - DNA, 22 bp, Homo sapiens
ttcacttcttaaggacagtgtt

SEQ ID NO: 3653040 - DNA, 15 bp, Homo sapiens
ttcaggcactttaga

SEQ ID NO: 3653041 - DNA, 14 bp, Homo sapiens
ttcagtctatgctg

SEQ ID NO: 3653042 - DNA, 15 bp, Homo sapiens
ttcatgatgctagtt

SEQ ID NO: 3653043 - DNA, 22 bp, Homo sapiens
ttcatggtatcttgagtcttgg

SEQ ID NO: 3653044 - DNA, 23 bp, Homo sapiens
ttcattctggtccttagtaaatt

SEQ ID NO: 3653045 - DNA, 21 bp, Homo sapiens
ttccacccccgttagcttcct

SEQ ID NO: 3653046 - DNA, 19 bp, Homo sapiens
ttccagctaagcctgatga

SEQ ID NO: 3653047 - DNA, 20 bp, Homo sapiens
ttccatacgtgcccatttca

SEQ ID NO: 3653048 - DNA, 22 bp, Homo sapiens
aaacatagtggtattttaacat

SEQ ID NO: 3653049 - DNA, 18 bp, Homo sapiens
aaaccaaatcactgaact

SEQ ID NO: 3653050 - DNA, 14 bp, Homo sapiens
aaaccagaaggaag

SEQ ID NO: 3653051 - DNA, 16 bp, Homo sapiens
aaaccagaaggaagcc

SEQ ID NO: 3653052 - DNA, 19 bp, Homo sapiens
aaaccatgaaaagttttca

SEQ ID NO: 3653053 - DNA, 20 bp, Homo sapiens
aaaccatgaaaagttttcaa

SEQ ID NO: 3653054 - DNA, 21 bp, Homo sapiens
aaaccatgaaaagttttcaag

SEQ ID NO: 3653055 - DNA, 13 bp, Homo sapiens
aaactcatacagt

SEQ ID NO: 3653056 - DNA, 12 bp, Homo sapiens
aaactgaaatta

SEQ ID NO: 3653057 - DNA, 13 bp, Homo sapiens
aaactgatgcttt

SEQ ID NO: 3653058 - DNA, 17 bp, Homo sapiens
aaactgatgctttcaga

SEQ ID NO: 3653059 - DNA, 18 bp, Homo sapiens
aaactgcgtaggagagaa

SEQ ID NO: 3653060 - DNA, 14 bp, Homo sapiens
aaactggaaacatc

SEQ ID NO: 3653061 - DNA, 22 bp, Homo sapiens
aaacttactatggtatatattt

SEQ ID NO: 3653062 - DNA, 17 bp, Homo sapiens
aaacttttataaatgtt

SEQ ID NO: 3653063 - DNA, 17 bp, Homo sapiens
aaagaaacatctacagg

SEQ ID NO: 3653064 - DNA, 23 bp, Homo sapiens
aaagaccatgcattcagatctga

SEQ ID NO: 3653065 - DNA, 12 bp, Homo sapiens
aaagatggggag

SEQ ID NO: 3653066 - DNA, 23 bp, Homo sapiens
aaaggctgcagctaatttgtgaa

SEQ ID NO: 3653067 - DNA, 13 bp, Homo sapiens
aaaggcttctcca

SEQ ID NO: 3653068 - DNA, 14 bp, Homo sapiens
aaaggcttctccac

SEQ ID NO: 3653069 - DNA, 16 bp, Homo sapiens
aaaggtgatgaattta

SEQ ID NO: 3653070 - DNA, 20 bp, Homo sapiens
aaaggttcttctggtgagtg

SEQ ID NO: 3653071 - DNA, 20 bp, Homo sapiens
aaagtcaagtctacctgcct

SEQ ID NO: 3653072 - DNA, 14 bp, Homo sapiens
aaagtctcctgtat

SEQ ID NO: 3653073 - DNA, 15 bp, Homo sapiens
aaagtgttgtcttat

SEQ ID NO: 3653074 - DNA, 17 bp, Homo sapiens
aaagtgttgtcttattc

SEQ ID NO: 3653075 - DNA, 10 bp, Homo sapiens
aaagtgtttt

SEQ ID NO: 3653076 - DNA, 14 bp, Homo sapiens
aaagtgtttttaca

SEQ ID NO: 3653077 - DNA, 13 bp, Homo sapiens
aaataattaaaac

SEQ ID NO: 3653078 - DNA, 21 bp, Homo sapiens
aaatactaagagatttgcttt

SEQ ID NO: 3653079 - DNA, 13 bp, Homo sapiens
aaatagctataaa

SEQ ID NO: 3653080 - DNA, 20 bp, Homo sapiens
aaatagctataaatagtgaa

SEQ ID NO: 3653081 - DNA, 18 bp, Homo sapiens
aaatagtgtgtccatgca

SEQ ID NO: 3653082 - DNA, 15 bp, Homo sapiens
aaatataacatgaaa

SEQ ID NO: 3653083 - DNA, 17 bp, Homo sapiens
aaatatacactttacat

SEQ ID NO: 3653084 - DNA, 16 bp, Homo sapiens
aaatatactcatttgg

SEQ ID NO: 3653085 - DNA, 15 bp, Homo sapiens
aaatatagtgttgtg

SEQ ID NO: 3653086 - DNA, 17 bp, Homo sapiens
aaatatgagattggaaa

SEQ ID NO: 3653087 - DNA, 22 bp, Homo sapiens
aaatattgctgtctgaaaaagt

SEQ ID NO: 3653088 - DNA, 16 bp, Homo sapiens
aaatattttcttaatt

SEQ ID NO: 3653089 - DNA, 19 bp, Homo sapiens
aaatattttcttaattatg

SEQ ID NO: 3653090 - DNA, 20 bp, Homo sapiens
aaatattttcttaattatgg

SEQ ID NO: 3653091 - DNA, 15 bp, Homo sapiens
aaatcacagatttcc

SEQ ID NO: 3653092 - DNA, 18 bp, Homo sapiens
aaatctacaaacttttat

SEQ ID NO: 3653093 - DNA, 12 bp, Homo sapiens
aaatctgaattt

SEQ ID NO: 3653094 - DNA, 14 bp, Homo sapiens
aaatctgaatttct

SEQ ID NO: 3653095 - DNA, 15 bp, Homo sapiens
aaatctgtattgcta

SEQ ID NO: 3653096 - DNA, 19 bp, Homo sapiens
aaatcttacccttcaatgt

SEQ ID NO: 3653097 - DNA, 13 bp, Homo sapiens
aaatctttgttaa

SEQ ID NO: 3653098 - DNA, 19 bp, Homo sapiens
aaatctttgttaaaatata

SEQ ID NO: 3653099 - DNA, 20 bp, Homo sapiens
aaatgatatgtctttaaaat

SEQ ID NO: 3653100 - DNA, 22 bp, Homo sapiens
aaatgattcacttttattgtat

SEQ ID NO: 3653101 - DNA, 20 bp, Homo sapiens
aaatggaagacctaaggcag

SEQ ID NO: 3653102 - DNA, 16 bp, Homo sapiens
aaatggctgaagaaac

SEQ ID NO: 3653103 - DNA, 17 bp, Homo sapiens
aaatggctgaagaaaca

SEQ ID NO: 3653104 - DNA, 23 bp, Homo sapiens
aaatggctgaagaaacacagcat

SEQ ID NO: 3653105 - DNA, 20 bp, Homo sapiens
aaatggtattttttgtgaat

SEQ ID NO: 3653106 - DNA, 17 bp, Homo sapiens
aaatgtgtgcttggaaa

SEQ ID NO: 3653107 - DNA, 16 bp, Homo sapiens
aaattaacaaattcag

SEQ ID NO: 3653108 - DNA, 13 bp, Homo sapiens
aaattagtatttt

SEQ ID NO: 3653109 - DNA, 16 bp, Homo sapiens
aaattagtattttgag

SEQ ID NO: 3653110 - DNA, 20 bp, Homo sapiens
aaattagtattttgagcctt

SEQ ID NO: 3653111 - DNA, 13 bp, Homo sapiens
aaattagtgtttt

SEQ ID NO: 3653112 - DNA, 13 bp, Homo sapiens
aaattctgattat

SEQ ID NO: 3653113 - DNA, 18 bp, Homo sapiens
aaattctgattattacaa

SEQ ID NO: 3653114 - DNA, 18 bp, Homo sapiens
aaattggttaatgaaaaa

SEQ ID NO: 3653115 - DNA, 18 bp, Homo sapiens
aaatttatgtcattttca

SEQ ID NO: 3653116 - DNA, 16 bp, Homo sapiens
aaatttattaaatgtt

SEQ ID NO: 3653117 - DNA, 20 bp, Homo sapiens
aaatttctagatatgagaaa

SEQ ID NO: 3653118 - DNA, 22 bp, Homo sapiens
aaatttgacattgtcagaatgt

SEQ ID NO: 3653119 - DNA, 12 bp, Homo sapiens
aaatttgtgtgc

SEQ ID NO: 3653120 - DNA, 16 bp, Homo sapiens
aaattttattgaatat

SEQ ID NO: 3653121 - DNA, 23 bp, Homo sapiens
aaattttcttctttaatttttct

SEQ ID NO: 3653122 - DNA, 17 bp, Homo sapiens
aaattttggaagaattc

SEQ ID NO: 3653123 - DNA, 22 bp, Homo sapiens
aaattttggaagaattcatgat

SEQ ID NO: 3653124 - DNA, 14 bp, Homo sapiens
aacaaatatactca

SEQ ID NO: 3653125 - DNA, 16 bp, Homo sapiens
aacaaatatactcatt

SEQ ID NO: 3653126 - DNA, 16 bp, Homo sapiens
aacaaatcattttgat

SEQ ID NO: 3653127 - DNA, 15 bp, Homo sapiens
aacaacaaaggaagt

SEQ ID NO: 3653128 - DNA, 20 bp, Homo sapiens
aacaatacttttcaggcact

SEQ ID NO: 3653129 - DNA, 23 bp, Homo sapiens
aacacacagtatagataaatcca

SEQ ID NO: 3653130 - DNA, 19 bp, Homo sapiens
aacacggagtttccatttg

SEQ ID NO: 3653131 - DNA, 21 bp, Homo sapiens
aacagactgccttatattatt

SEQ ID NO: 3653132 - DNA, 10 bp, Homo sapiens
aacagtaaat

SEQ ID NO: 3653133 - DNA, 18 bp, Homo sapiens
aacatagtggtattttaa

SEQ ID NO: 3653134 - DNA, 22 bp, Homo sapiens
aacatcaattgggttttgatct

SEQ ID NO: 3653135 - DNA, 16 bp, Homo sapiens
aacatctacaggatct

SEQ ID NO: 3653136 - DNA, 13 bp, Homo sapiens
aacatctctttct

SEQ ID NO: 3653137 - DNA, 23 bp, Homo sapiens
aacatctctttctcattagagat

SEQ ID NO: 3653138 - DNA, 14 bp, Homo sapiens
aacatctgatttct

SEQ ID NO: 3653139 - DNA, 21 bp, Homo sapiens
aacatctgatttctgaactat

SEQ ID NO: 3653140 - DNA, 21 bp, Homo sapiens
aacatggtgaaaccctgtctc

SEQ ID NO: 3653141 - DNA, 13 bp, Homo sapiens
aacattccatcct

SEQ ID NO: 3653142 - DNA, 14 bp, Homo sapiens
aacattccatcctt

SEQ ID NO: 3653143 - DNA, 13 bp, Homo sapiens
aaccagaaggaag

SEQ ID NO: 3653144 - DNA, 14 bp, Homo sapiens
aaccagaaggaagc

SEQ ID NO: 3653145 - DNA, 12 bp, Homo sapiens
aaccatgaaaag

SEQ ID NO: 3653146 - DNA, 14 bp, Homo sapiens
aaccatgaaaagtt

SEQ ID NO: 3653147 - DNA, 16 bp, Homo sapiens
aacccaggattcaaca

SEQ ID NO: 3653148 - DNA, 14 bp, Homo sapiens
aacccatctaaacc

SEQ ID NO: 3653149 - DNA, 17 bp, Homo sapiens
aaccgggactacagaag

SEQ ID NO: 3653150 - DNA, 19 bp, Homo sapiens
aacctttggacaagaggaa

SEQ ID NO: 3653151 - DNA, 20 bp, Homo sapiens
aactcatacagtctctattt

SEQ ID NO: 3653152 - DNA, 14 bp, Homo sapiens
aactcattagagat

SEQ ID NO: 3653153 - DNA, 19 bp, Homo sapiens
aactctctagtgcaggaaa

SEQ ID NO: 3653154 - DNA, 14 bp, Homo sapiens
aactgatgctttca

SEQ ID NO: 3653155 - DNA, 13 bp, Homo sapiens
aactgtgaacaat

SEQ ID NO: 3653156 - DNA, 15 bp, Homo sapiens
aacttattttgattg

SEQ ID NO: 3653157 - DNA, 18 bp, Homo sapiens
aacttttataaatgtttt

SEQ ID NO: 3653158 - DNA, 15 bp, Homo sapiens
aagaaaatccttcag

SEQ ID NO: 3653159 - DNA, 15 bp, Homo sapiens
aagaaggactgaaga

SEQ ID NO: 3653160 - DNA, 20 bp, Homo sapiens
aagaatatattatataaaga

SEQ ID NO: 3653161 - DNA, 21 bp, Homo sapiens
aagacaagcattgggtcagac

SEQ ID NO: 3653162 - DNA, 14 bp, Homo sapiens
aagacatctgagga

SEQ ID NO: 3653163 - DNA, 21 bp, Homo sapiens
aagacctaaggcagacaggaa

SEQ ID NO: 3653164 - DNA, 15 bp, Homo sapiens
aagagctgctgtatt

SEQ ID NO: 3653165 - DNA, 16 bp, Homo sapiens
aagagctgctgtattt

SEQ ID NO: 3653166 - DNA, 21 bp, Homo sapiens
aagaggttgcagtgagctgag

SEQ ID NO: 3653167 - DNA, 21 bp, Homo sapiens
aagataattaaatgaaatact

SEQ ID NO: 3653168 - DNA, 22 bp, Homo sapiens
aagataattaaatgaaatactt

SEQ ID NO: 3653169 - DNA, 22 bp, Homo sapiens
aagcaaactgaaattagtgttt

SEQ ID NO: 3653170 - DNA, 20 bp, Homo sapiens
aagcaaatttctagatatga

SEQ ID NO: 3653171 - DNA, 12 bp, Homo sapiens
aagcagaatgag

SEQ ID NO: 3653172 - DNA, 23 bp, Homo sapiens
aagcagaatgagatgatttaatt

SEQ ID NO: 3653173 - DNA, 12 bp, Homo sapiens
aagcagcgagtg

SEQ ID NO: 3653174 - DNA, 15 bp, Homo sapiens
aagcagcgagtgcat

SEQ ID NO: 3653175 - DNA, 12 bp, Homo sapiens
aagcccagcctg

SEQ ID NO: 3653176 - DNA, 16 bp, Homo sapiens
aagcccattcattcca

SEQ ID NO: 3653177 - DNA, 23 bp, Homo sapiens
aagcccattcattccattctgga

SEQ ID NO: 3653178 - DNA, 19 bp, Homo sapiens
aagcctggcttagaaggca

SEQ ID NO: 3653179 - DNA, 19 bp, Homo sapiens
aaggaaacaacaaaggaag

SEQ ID NO: 3653180 - DNA, 18 bp, Homo sapiens
aaggaagcacaaaagaca

SEQ ID NO: 3653181 - DNA, 19 bp, Homo sapiens
aggtactacctatgtactt

SEQ ID NO: 3653182 - DNA, 20 bp, Homo sapiens
aggtcatgaacatggtcaga

SEQ ID NO: 3653183 - DNA, 22 bp, Homo sapiens
aggtggatcatgaggtcaggag

SEQ ID NO: 3653184 - DNA, 20 bp, Homo sapiens
aggtggcagggctgttccct

SEQ ID NO: 3653185 - DNA, 14 bp, Homo sapiens
aggtggcatttgca

SEQ ID NO: 3653186 - DNA, 15 bp, Homo sapiens
aggtggcatttgcag

SEQ ID NO: 3653187 - DNA, 15 bp, Homo sapiens
aggtgggagatggag

SEQ ID NO: 3653188 - DNA, 16 bp, Homo sapiens
aggtgggagatggagg

SEQ ID NO: 3653189 - DNA, 17 bp, Homo sapiens
aggttctgctttctgat

SEQ ID NO: 3653190 - DNA, 18 bp, Homo sapiens
aggttctgctttctgata

SEQ ID NO: 3653191 - DNA, 17 bp, Homo sapiens
aggttcttctggtgagt

SEQ ID NO: 3653192 - DNA, 20 bp, Homo sapiens
aggttcttctggtgagtgca

SEQ ID NO: 3653193 - DNA, 14 bp, Homo sapiens
aggttgcagtgagc

SEQ ID NO: 3653194 - DNA, 22 bp, Homo sapiens
aggtttagaatcaagtctgtga

SEQ ID NO: 3653195 - DNA, 15 bp, Homo sapiens
agtaaatatacactt

SEQ ID NO: 3653196 - DNA, 21 bp, Homo sapiens
agtaaatatacactttacatt

SEQ ID NO: 3653197 - DNA, 20 bp, Homo sapiens
agtaaattcctaattctatg

SEQ ID NO: 3653198 - DNA, 14 bp, Homo sapiens
agtaacagtatttc

SEQ ID NO: 3653199 - DNA, 14 bp, Homo sapiens
agtaagggagtcat

SEQ ID NO: 3653200 - DNA, 22 bp, Homo sapiens
agtaagggagtcattgccttgg

SEQ ID NO: 3653201 - DNA, 18 bp, Homo sapiens
agtagcattttaatagtt

SEQ ID NO: 3653202 - DNA, 20 bp, Homo sapiens
agtagcattttaatagtttc

SEQ ID NO: 3653203 - DNA, 23 bp, Homo sapiens
agtagcattttaatagtttctaa

SEQ ID NO: 3653204 - DNA, 17 bp, Homo sapiens
agtagtacttaatagta

SEQ ID NO: 3653205 - DNA, 22 bp, Homo sapiens
agtagtgtgagtgttagaaaaa

SEQ ID NO: 3653206 - DNA, 16 bp, Homo sapiens
agtatacaagtgtttc

SEQ ID NO: 3653207 - DNA, 17 bp, Homo sapiens
agtatacaagtgtttct

SEQ ID NO: 3653208 - DNA, 15 bp, Homo sapiens
agtatagataaatcc

SEQ ID NO: 3653209 - DNA, 17 bp, Homo sapiens
agtatagatggtagaaa

SEQ ID NO: 3653210 - DNA, 23 bp, Homo sapiens
agtattttgagccttattaaaat

SEQ ID NO: 3653211 - DNA, 20 bp, Homo sapiens
agtccatgtgataattgtaa

SEQ ID NO: 3653212 - DNA, 21 bp, Homo sapiens
agtctacctgccttgcctgtt

SEQ ID NO: 3653213 - DNA, 22 bp, Homo sapiens
agtctacctgccttgcctgtta

SEQ ID NO: 3653214 - DNA, 13 bp, Homo sapiens
agtctttcttaga

SEQ ID NO: 3653215 - DNA, 20 bp, Homo sapiens
agtgaatgagtttccagcta

SEQ ID NO: 3653216 - DNA, 22 bp, Homo sapiens
agtgaggtagtgccaatgacag

SEQ ID NO: 3653217 - DNA, 21 bp, Homo sapiens
agtgcaagagcctgagactgg

SEQ ID NO: 3653218 - DNA, 14 bp, Homo sapiens
agtgcatgttaaaa

SEQ ID NO: 3653219 - DNA, 22 bp, Homo sapiens
agtgggagacaatattaatttg

SEQ ID NO: 3653220 - DNA, 21 bp, Homo sapiens
agtggtattttaacatagcag

SEQ ID NO: 3653221 - DNA, 15 bp, Homo sapiens
agtgttataaaatct

SEQ ID NO: 3653222 - DNA, 17 bp, Homo sapiens
agtgttataaaatctgt

SEQ ID NO: 3653223 - DNA, 19 bp, Homo sapiens
agtgttataaaatctgtat

SEQ ID NO: 3653224 - DNA, 16 bp, Homo sapiens
agtgttcaaattctga

SEQ ID NO: 3653225 - DNA, 17 bp, Homo sapiens
agtgttcaaattctgat

SEQ ID NO: 3653226 - DNA, 18 bp, Homo sapiens
agtgttcaaattctgatt

SEQ ID NO: 3653227 - DNA, 22 bp, Homo sapiens
agtgtttctagtaacagtattt

SEQ ID NO: 3653228 - DNA, 18 bp, Homo sapiens
agttatttaccagaagtt

SEQ ID NO: 3653229 - DNA, 23 bp, Homo sapiens
agttatttcccaacccaggattc

SEQ ID NO: 3653230 - DNA, 15 bp, Homo sapiens
agttccccgctgacc

SEQ ID NO: 3653231 - DNA, 19 bp, Homo sapiens
agttcgaggcgagcctggc

SEQ ID NO: 3653232 - DNA, 15 bp, Homo sapiens
agttgaatgataata

SEQ ID NO: 3653233 - DNA, 11 bp, Homo sapiens
agttgtgtgct

SEQ ID NO: 3653234 - DNA, 16 bp, Homo sapiens
agtttatctttgcaca

SEQ ID NO: 3653235 - DNA, 19 bp, Homo sapiens
agtttccagctaagcctga

SEQ ID NO: 3653236 - DNA, 16 bp, Homo sapiens
agtttccatttggatt

SEQ ID NO: 3653237 - DNA, 18 bp, Homo sapiens
agtttgacacaacatctg

SEQ ID NO: 3653238 - DNA, 17 bp, Homo sapiens
agttttcaagcattgct

SEQ ID NO: 3653239 - DNA, 13 bp, Homo sapiens
ataaaaataatta

SEQ ID NO: 3653240 - DNA, 15 bp, Homo sapiens
ataaaatctgtattg

SEQ ID NO: 3653241 - DNA, 24 bp, Homo sapiens
ataaagtggcatttctttatgaaa

SEQ ID NO: 3653242 - DNA, 22 bp, Homo sapiens
ataaatagtgaaaattttattg

SEQ ID NO: 3653243 - DNA, 24 bp, Homo sapiens
ataaatccaatagtctgccacaag

SEQ ID NO: 3653244 - DNA, 12 bp, Homo sapiens
ataaatgtttta

SEQ ID NO: 3653245 - DNA, 18 bp, Homo sapiens
ataaattttggaagaatt

SEQ ID NO: 3653246 - DNA, 12 bp, Homo sapiens
ataacatgaaag

SEQ ID NO: 3653247 - DNA, 13 bp, Homo sapiens
ataacatgaaagt

SEQ ID NO: 3653248 - DNA, 12 bp, Homo sapiens
ataacattgtaa

SEQ ID NO: 3653249 - DNA, 13 bp, Homo sapiens
ataagttgaatga

SEQ ID NO: 3653250 - DNA, 19 bp, Homo sapiens
ataatagctcacagcacat

SEQ ID NO: 3653251 - DNA, 19 bp, Homo sapiens
ataatatccatgcgtttct

SEQ ID NO: 3653252 - DNA, 19 bp, Homo sapiens
ataatgaggcaactcagca

SEQ ID NO: 3653253 - DNA, 19 bp, Homo sapiens
ataatggcctcttaaaaat

SEQ ID NO: 3653254 - DNA, 23 bp, Homo sapiens
ataatggcctcttaaaaattatc

SEQ ID NO: 3653255 - DNA, 15 bp, Homo sapiens
ataattaaatgaaat

SEQ ID NO: 3653256 - DNA, 16 bp, Homo sapiens
ataattaaatgaaata

SEQ ID NO: 3653257 - DNA, 12 bp, Homo sapiens
ataattgtaaag

SEQ ID NO: 3653258 - DNA, 20 bp, Homo sapiens
ataattgtaaaggtgatgaa

SEQ ID NO: 3653259 - DNA, 23 bp, Homo sapiens
ataattgtaaaggtgatgaattt

SEQ ID NO: 3653260 - DNA, 23 bp, Homo sapiens
atacagatggtgtcctgcatgta

SEQ ID NO: 3653261 - DNA, 16 bp, Homo sapiens
atacagtctctatttg

SEQ ID NO: 3653262 - DNA, 19 bp, Homo sapiens
atacagtctctatttgatt

SEQ ID NO: 3653263 - DNA, 14 bp, Homo sapiens
ataccattttgaaa

SEQ ID NO: 3653264 - DNA, 16 bp, Homo sapiens
ataccattttgaaata

SEQ ID NO: 3653265 - DNA, 22 bp, Homo sapiens
atactaagtcctcagagctcca

SEQ ID NO: 3653266 - DNA, 22 bp, Homo sapiens
atactcatttggatataaatct

SEQ ID NO: 3653267 - DNA, 17 bp, Homo sapiens
atagagtgacttggaga

SEQ ID NO: 3653268 - DNA, 18 bp, Homo sapiens
atagataccattttgaaa

SEQ ID NO: 3653269 - DNA, 21 bp, Homo sapiens
atagatcagcatccaaaagca

SEQ ID NO: 3653270 - DNA, 15 bp, Homo sapiens
atagatggtagaaac

SEQ ID NO: 3653271 - DNA, 21 bp, Homo sapiens
atagatgtcgtggactccagc

SEQ ID NO: 3653272 - DNA, 17 bp, Homo sapiens
atagctacaaatgaaaa

SEQ ID NO: 3653273 - DNA, 14 bp, Homo sapiens
atagctataaatag

SEQ ID NO: 3653274 - DNA, 17 bp, Homo sapiens
atagctataaatagtga

SEQ ID NO: 3653275 - DNA, 14 bp, Homo sapiens
atagctcacagcac

SEQ ID NO: 3653276 - DNA, 17 bp, Homo sapiens
atagctcacagcacatt

SEQ ID NO: 3653277 - DNA, 20 bp, Homo sapiens
atagctttctttcccttact

SEQ ID NO: 3653278 - DNA, 17 bp, Homo sapiens
atagcttttcacttctt

SEQ ID NO: 3653279 - DNA, 20 bp, Homo sapiens
atagcttttcacttcttaag

SEQ ID NO: 3653280 - DNA, 19 bp, Homo sapiens
atagtggtattttaacata

SEQ ID NO: 3653281 - DNA, 13 bp, Homo sapiens
atagtgttgtgtt

SEQ ID NO: 3653282 - DNA, 14 bp, Homo sapiens
atagtgttgtgtta

SEQ ID NO: 3653283 - DNA, 13 bp, Homo sapiens
atataaaaataat

SEQ ID NO: 3653284 - DNA, 20 bp, Homo sapiens
atataaaaataattaaaaca

SEQ ID NO: 3653285 - DNA, 22 bp, Homo sapiens
atataaaaataattaaaacaaa

SEQ ID NO: 3653286 - DNA, 20 bp, Homo sapiens
atataaatcacagatttcca

SEQ ID NO: 3653287 - DNA, 15 bp, Homo sapiens
atataacatgaaagt

SEQ ID NO: 3653288 - DNA, 18 bp, Homo sapiens
atataacatgaaagtcaa

SEQ ID NO: 3653289 - DNA, 14 bp, Homo sapiens
atatactcatttgg

SEQ ID NO: 3653290 - DNA, 20 bp, Homo sapiens
atatagctttgcaaccttgt

SEQ ID NO: 3653291 - DNA, 23 bp, Homo sapiens
atataggggcaaaaatttgacat

SEQ ID NO: 3653292 - DNA, 18 bp, Homo sapiens
atatagtgttgtgttaca

SEQ ID NO: 3653293 - DNA, 16 bp, Homo sapiens
atatatgtatatctgt

SEQ ID NO: 3653294 - DNA, 18 bp, Homo sapiens
atatattttgaaaggaga

SEQ ID NO: 3653295 - DNA, 16 bp, Homo sapiens
atatgaagcagaatga

SEQ ID NO: 3653296 - DNA, 19 bp, Homo sapiens
atatggcaacgttcatgtt

SEQ ID NO: 3653297 - DNA, 16 bp, Homo sapiens
atatgtatatctgtgt

SEQ ID NO: 3653298 - DNA, 23 bp, Homo sapiens
atatgtatatctgtgtaagacac

SEQ ID NO: 3653299 - DNA, 13 bp, Homo sapiens
atatgtctttaaa

SEQ ID NO: 3653300 - DNA, 14 bp, Homo sapiens
atattatataaaga

SEQ ID NO: 3653301 - DNA, 18 bp, Homo sapiens
atattattttctgtaatt

SEQ ID NO: 3653302 - DNA, 14 bp, Homo sapiens
atattcccatggta

SEQ ID NO: 3653303 - DNA, 14 bp, Homo sapiens
atattgatgtaact

SEQ ID NO: 3653304 - DNA, 18 bp, Homo sapiens
atattgatgtaactgtgt

SEQ ID NO: 3653305 - DNA, 12 bp, Homo sapiens
atattgctgtct

SEQ ID NO: 3653306 - DNA, 15 bp, Homo sapiens
atatttactgtttat

SEQ ID NO: 3653307 - DNA, 19 bp, Homo sapiens
atattttctgagtagcata

SEQ ID NO: 3653308 - DNA, 12 bp, Homo sapiens
atattttcttaa

SEQ ID NO: 3653309 - DNA, 13 bp, Homo sapiens
atattttctttct

SEQ ID NO: 3653310 - DNA, 14 bp, Homo sapiens
atattttctttctt

SEQ ID NO: 3653311 - DNA, 16 bp, Homo sapiens
atcaaacaaatcattt

SEQ ID NO: 3653312 - DNA, 22 bp, Homo sapiens
atcaaacaaatcattttgatgt

SEQ ID NO: 3653313 - DNA, 12 bp, Homo sapiens
cattcttgctct

SEQ ID NO: 3653314 - DNA, 16 bp, Homo sapiens
catttcacacaactgt

SEQ ID NO: 3653315 - DNA, 13 bp, Homo sapiens
catttcccacttc

SEQ ID NO: 3653316 - DNA, 18 bp, Homo sapiens
catttgttaatgattctt

SEQ ID NO: 3653317 - DNA, 12 bp, Homo sapiens
cattttcagatc

SEQ ID NO: 3653318 - DNA, 18 bp, Homo sapiens
cattttcagatccttcca

SEQ ID NO: 3653319 - DNA, 13 bp, Homo sapiens
cattttgatgtat

SEQ ID NO: 3653320 - DNA, 22 bp, Homo sapiens
catttttgagtaaaacttgtat

SEQ ID NO: 3653321 - DNA, 17 bp, Homo sapiens
ccaaatagcttttcact

SEQ ID NO: 3653322 - DNA, 18 bp, Homo sapiens
ccaaatagcttttcactt

SEQ ID NO: 3653323 - DNA, 22 bp, Homo sapiens
ccaacccaggattcaacatcaa

SEQ ID NO: 3653324 - DNA, 22 bp, Homo sapiens
ccaagaatatattatataaaga

SEQ ID NO: 3653325 - DNA, 18 bp, Homo sapiens
ccacaagggcagtggaag

SEQ ID NO: 3653326 - DNA, 19 bp, Homo sapiens
ccacacttgtgtgccacag

SEQ ID NO: 3653327 - DNA, 14 bp, Homo sapiens
ccactgcctttgac

SEQ ID NO: 3653328 - DNA, 14 bp, Homo sapiens
ccagaaatgccaca

SEQ ID NO: 3653329 - DNA, 20 bp, Homo sapiens
ccagaaggcaatcaagagct

SEQ ID NO: 3653330 - DNA, 20 bp, Homo sapiens
ccagaatgaggcacatgaca

SEQ ID NO: 3653331 - DNA, 22 bp, Homo sapiens
ccagaatgaggcacatgacagt

SEQ ID NO: 3653332 - DNA, 15 bp, Homo sapiens
ccagatccttttcca

SEQ ID NO: 3653333 - DNA, 22 bp, Homo sapiens
ccagatccttttccatcccact

SEQ ID NO: 3653334 - DNA, 23 bp, Homo sapiens
ccagatccttttccatcccactc

SEQ ID NO: 3653335 - DNA, 21 bp, Homo sapiens
ccagcctgcatctagctggag

SEQ ID NO: 3653336 - DNA, 16 bp, Homo sapiens
ccagtcatggtggcac

SEQ ID NO: 3653337 - DNA, 13 bp, Homo sapiens
ccagttctgatga

SEQ ID NO: 3653338 - DNA, 12 bp, Homo sapiens
ccatagacctaa

SEQ ID NO: 3653339 - DNA, 19 bp, Homo sapiens
ccatagacctaactgtgaa

SEQ ID NO: 3653340 - DNA, 21 bp, Homo sapiens
ccatagacctaactgtgaaca

SEQ ID NO: 3653341 - DNA, 15 bp, Homo sapiens
ccatcccactccact

SEQ ID NO: 3653342 - DNA, 22 bp, Homo sapiens
ccatcccttcaaccccacttcc

SEQ ID NO: 3653343 - DNA, 14 bp, Homo sapiens
ccatcgatttgtat

SEQ ID NO: 3653344 - DNA, 16 bp, Homo sapiens
ccatctaaaccagaag

SEQ ID NO: 3653345 - DNA, 15 bp, Homo sapiens
ccatggtagactgtg

SEQ ID NO: 3653346 - DNA, 17 bp, Homo sapiens
ccatgtatgttgcatga

SEQ ID NO: 3653347 - DNA, 18 bp, Homo sapiens
ccattcagtctatgctgt

SEQ ID NO: 3653348 - DNA, 23 bp, Homo sapiens
ccattcagtctatgctgtgtgca

SEQ ID NO: 3653349 - DNA, 13 bp, Homo sapiens
ccattcattccat

SEQ ID NO: 3653350 - DNA, 14 bp, Homo sapiens
ccattcattccatt

SEQ ID NO: 3653351 - DNA, 12 bp, Homo sapiens
ccattctctaag

SEQ ID NO: 3653352 - DNA, 15 bp, Homo sapiens
ccattctggaagtga

SEQ ID NO: 3653353 - DNA, 15 bp, Homo sapiens
ccatttcccacttcc

SEQ ID NO: 3653354 - DNA, 15 bp, Homo sapiens
ccatttcctcctggg

SEQ ID NO: 3653355 - DNA, 22 bp, Homo sapiens
cccacattttagaataccccac

SEQ ID NO: 3653356 - DNA, 13 bp, Homo sapiens
cccaccagcagaa

SEQ ID NO: 3653357 - DNA, 18 bp, Homo sapiens
cccaccctgcccactccc

SEQ ID NO: 3653358 - DNA, 15 bp, Homo sapiens
cccacttccaccccc

SEQ ID NO: 3653359 - DNA, 23 bp, Homo sapiens
cccagggacatgtatgcttccag

SEQ ID NO: 3653360 - DNA, 17 bp, Homo sapiens
cccatggtagactgtga

SEQ ID NO: 3653361 - DNA, 18 bp, Homo sapiens
ccccagcctcactccatt

SEQ ID NO: 3653362 - DNA, 16 bp, Homo sapiens
cccccgaccagatcct

SEQ ID NO: 3653363 - DNA, 19 bp, Homo sapiens
ccctatctttgccaccctc

SEQ ID NO: 3653364 - DNA, 12 bp, Homo sapiens
ccctcatgctgt

SEQ ID NO: 3653365 - DNA, 23 bp, Homo sapiens
ccctctcagatcaccccagcctc

SEQ ID NO: 3653366 - DNA, 23 bp, Homo sapiens
ccctgaaccttcctgtctcccag

SEQ ID NO: 3653367 - DNA, 13 bp, Homo sapiens
ccctgcccactcc

SEQ ID NO: 3653368 - DNA, 16 bp, Homo sapiens
ccctgcccactcccat

SEQ ID NO: 3653369 - DNA, 22 bp, Homo sapiens
ccctggcttccccttcagacct

SEQ ID NO: 3653370 - DNA, 19 bp, Homo sapiens
cccttcaaccccacttcct

SEQ ID NO: 3653371 - DNA, 16 bp, Homo sapiens
cccttcagaccttgca

SEQ ID NO: 3653372 - DNA, 16 bp, Homo sapiens
cccttcatgcatggaa

SEQ ID NO: 3653373 - DNA, 19 bp, Homo sapiens
ccgacactgccaagccaac

SEQ ID NO: 3653374 - DNA, 23 bp, Homo sapiens
ccgggttcaagagattctgcctc

SEQ ID NO: 3653375 - DNA, 22 bp, Homo sapiens
cctaaattaacaaattcagtgg

SEQ ID NO: 3653376 - DNA, 15 bp, Homo sapiens
cctaaggcagacagg

SEQ ID NO: 3653377 - DNA, 23 bp, Homo sapiens
cctaaggcagacaggaaggaagc

SEQ ID NO: 3653378 - DNA, 19 bp, Homo sapiens
cctaagtaaatctaaatta

SEQ ID NO: 3653379 - DNA, 16 bp, Homo sapiens
cctacaagattcctgg

SEQ ID NO: 3653380 - DNA, 22 bp, Homo sapiens
cctactgtaatagatcagcatc

SEQ ID NO: 3653381 - DNA, 15 bp, Homo sapiens
cctatcatcagttag

SEQ ID NO: 3653382 - DNA, 20 bp, Homo sapiens
cctattttggacgtgtgagg

SEQ ID NO: 3653383 - DNA, 16 bp, Homo sapiens
cctcaagttgtgtgct

SEQ ID NO: 3653384 - DNA, 13 bp, Homo sapiens
cctcacactggga

SEQ ID NO: 3653385 - DNA, 15 bp, Homo sapiens
cctcacactgggact

SEQ ID NO: 3653386 - DNA, 20 bp, Homo sapiens
cctccagccacttatttcca

SEQ ID NO: 3653387 - DNA, 22 bp, Homo sapiens
cctccaggcaaatgcccttcaa

SEQ ID NO: 3653388 - DNA, 16 bp, Homo sapiens
cctccagttctgatga

SEQ ID NO: 3653389 - DNA, 19 bp, Homo sapiens
cctccagttctgatgaggc

SEQ ID NO: 3653390 - DNA, 18 bp, Homo sapiens
cctcccttctttccttcc

SEQ ID NO: 3653391 - DNA, 13 bp, Homo sapiens
cctccgcatcccg

SEQ ID NO: 3653392 - DNA, 21 bp, Homo sapiens
cctcctccagttctgatgagg

SEQ ID NO: 3653393 - DNA, 22 bp, Homo sapiens
cctgaaccttcctgtctcccag

SEQ ID NO: 3653394 - DNA, 22 bp, Homo sapiens
cctgagactggaaaaggtggac

SEQ ID NO: 3653395 - DNA, 14 bp, Homo sapiens
cctgcatcattccc

SEQ ID NO: 3653396 - DNA, 12 bp, Homo sapiens
cctgcccactcc

SEQ ID NO: 3653397 - DNA, 14 bp, Homo sapiens
cctgcccactccca

SEQ ID NO: 3653398 - DNA, 16 bp, Homo sapiens
cctgcccactcccatc

SEQ ID NO: 3653399 - DNA, 22 bp, Homo sapiens
cctgcccactcccatcccttca

SEQ ID NO: 3653400 - DNA, 22 bp, Homo sapiens
cctgctgctctctaagaattca

SEQ ID NO: 3653401 - DNA, 15 bp, Homo sapiens
cctgtaatcccagca

SEQ ID NO: 3653402 - DNA, 17 bp, Homo sapiens
cctgtagagagagacct

SEQ ID NO: 3653403 - DNA, 22 bp, Homo sapiens
ccttcaaccccacttcctactg

SEQ ID NO: 3653404 - DNA, 15 bp, Homo sapiens
ccttcaatgttaaat

SEQ ID NO: 3653405 - DNA, 14 bp, Homo sapiens
ccttcagaccttgc

SEQ ID NO: 3653406 - DNA, 12 bp, Homo sapiens
ccttcatgcatg

SEQ ID NO: 3653407 - DNA, 15 bp, Homo sapiens
ccttcatgcatggaa

SEQ ID NO: 3653408 - DNA, 21 bp, Homo sapiens
ccttccaaactctctagtgca

SEQ ID NO: 3653409 - DNA, 9 bp, Homo sapiens
ccttccttt

SEQ ID NO: 3653410 - DNA, 12 bp, Homo sapiens
ccttctcccctc

SEQ ID NO: 3653411 - DNA, 21 bp, Homo sapiens
ccttcttccccaatatgcctg

SEQ ID NO: 3653412 - DNA, 18 bp, Homo sapiens
ccttctttccttcctttt

SEQ ID NO: 3653413 - DNA, 16 bp, Homo sapiens
cctttctagcaattgc

SEQ ID NO: 3653414 - DNA, 16 bp, Homo sapiens
cctttcttccttcctt

SEQ ID NO: 3653415 - DNA, 15 bp, Homo sapiens
cctttgacctgcctc

SEQ ID NO: 3653416 - DNA, 16 bp, Homo sapiens
ccttttccatcccact

SEQ ID NO: 3653417 - DNA, 21 bp, Homo sapiens
cgacgatcattgtgcccactt

SEQ ID NO: 3653418 - DNA, 17 bp, Homo sapiens
cgcctgtaatctcagct

SEQ ID NO: 3653419 - DNA, 21 bp, Homo sapiens
cggggtatataaattggggtg

SEQ ID NO: 3653420 - DNA, 14 bp, Homo sapiens
cgtaagttctgtgc

SEQ ID NO: 3653421 - DNA, 14 bp, Homo sapiens
cgtcttaggtggca

SEQ ID NO: 3653422 - DNA, 20 bp, Homo sapiens
cgttagcttcctgcaggact

SEQ ID NO: 3653423 - DNA, 21 bp, Homo sapiens
cgttcatgttcatctcaggtg

SEQ ID NO: 3653424 - DNA, 17 bp, Homo sapiens
ctaaacatagtggtatt

SEQ ID NO: 3653425 - DNA, 15 bp, Homo sapiens
ctaaaccagaaggaa

SEQ ID NO: 3653426 - DNA, 19 bp, Homo sapiens
ctaaattaacaaattcagt

SEQ ID NO: 3653427 - DNA, 20 bp, Homo sapiens
ctaacacttttgctctgcag

SEQ ID NO: 3653428 - DNA, 14 bp, Homo sapiens
ctaacttattttga

SEQ ID NO: 3653429 - DNA, 17 bp, Homo sapiens
ctaagataattaaatga

SEQ ID NO: 3653430 - DNA, 14 bp, Homo sapiens
ctaaggcagacagg

SEQ ID NO: 3653431 - DNA, 22 bp, Homo sapiens
ctaaggcagacaggaaggaagc

SEQ ID NO: 3653432 - DNA, 12 bp, Homo sapiens
ctaattcctgta

SEQ ID NO: 3653433 - DNA, 18 bp, Homo sapiens
ctaattcctgtatgttat

SEQ ID NO: 3653434 - DNA, 13 bp, Homo sapiens
ctaatttgtgaaa

SEQ ID NO: 3653435 - DNA, 13 bp, Homo sapiens
ctacaaatgaaaa

SEQ ID NO: 3653436 - DNA, 15 bp, Homo sapiens
ctacaagattcctgg

SEQ ID NO: 3653437 - DNA, 16 bp, Homo sapiens
ctacactttatacttg

SEQ ID NO: 3653438 - DNA, 15 bp, Homo sapiens
ctacagaagtggaag

SEQ ID NO: 3653439 - DNA, 17 bp, Homo sapiens
ctacagaagtggaagga

SEQ ID NO: 3653440 - DNA, 16 bp, Homo sapiens
ctacaggggaggctga

SEQ ID NO: 3653441 - DNA, 15 bp, Homo sapiens
ctacaggttttatga

SEQ ID NO: 3653442 - DNA, 21 bp, Homo sapiens
ctacctatgtacttgaaaata

SEQ ID NO: 3653443 - DNA, 12 bp, Homo sapiens
ctagaggtggca

SEQ ID NO: 3653444 - DNA, 20 bp, Homo sapiens
ctagcaataagttgaatgat

SEQ ID NO: 3653445 - DNA, 17 bp, Homo sapiens
ctagccatatattttct

SEQ ID NO: 3653446 - DNA, 18 bp, Homo sapiens
gtctcctgtatcatttct

SEQ ID NO: 3653447 - DNA, 20 bp, Homo sapiens
gtctctacaaaaaaaatcaa

SEQ ID NO: 3653448 - DNA, 18 bp, Homo sapiens
gtctctatttgatttgca

SEQ ID NO: 3653449 - DNA, 14 bp, Homo sapiens
gtctgaaaaagtgt

SEQ ID NO: 3653450 - DNA, 23 bp, Homo sapiens
gtctgaaaaagtgtttttacata

SEQ ID NO: 3653451 - DNA, 19 bp, Homo sapiens
gtctgtccctaaacatagt

SEQ ID NO: 3653452 - DNA, 11 bp, Homo sapiens
gtctgtgttct

SEQ ID NO: 3653453 - DNA, 15 bp, Homo sapiens
gtctgtgttctcaac

SEQ ID NO: 3653454 - DNA, 17 bp, Homo sapiens
gtcttaactaatgtaaa

SEQ ID NO: 3653455 - DNA, 17 bp, Homo sapiens
gtgaaaattttattgaa

SEQ ID NO: 3653456 - DNA, 20 bp, Homo sapiens
gtgacacagctgagctggcc

SEQ ID NO: 3653457 - DNA, 20 bp, Homo sapiens
gtgagatttagggttctata

SEQ ID NO: 3653458 - DNA, 20 bp, Homo sapiens
gtgagtgcaagagcctgaga

SEQ ID NO: 3653459 - DNA, 19 bp, Homo sapiens
gtgcaagagcctgagactg

SEQ ID NO: 3653460 - DNA, 22 bp, Homo sapiens
gtgcatatggcaacgttcatgt

SEQ ID NO: 3653461 - DNA, 15 bp, Homo sapiens
gtgccaatgacagga

SEQ ID NO: 3653462 - DNA, 19 bp, Homo sapiens
gtgccattacactccagcc

SEQ ID NO: 3653463 - DNA, 21 bp, Homo sapiens
gtgcccacttaccctgggctg

SEQ ID NO: 3653464 - DNA, 16 bp, Homo sapiens
gtgcccatttcacaca

SEQ ID NO: 3653465 - DNA, 17 bp, Homo sapiens
gtgctgctgtggcatca

SEQ ID NO: 3653466 - DNA, 16 bp, Homo sapiens
gtgctgggattacagg

SEQ ID NO: 3653467 - DNA, 20 bp, Homo sapiens
gtggaagagctgctgtattt

SEQ ID NO: 3653468 - DNA, 18 bp, Homo sapiens
gtggcaacatttggggag

SEQ ID NO: 3653469 - DNA, 22 bp, Homo sapiens
gtggcaacatttggggagagat

SEQ ID NO: 3653470 - DNA, 12 bp, Homo sapiens
gtggcagggctg

SEQ ID NO: 3653471 - DNA, 13 bp, Homo sapiens
gtggcattgggtg

SEQ ID NO: 3653472 - DNA, 19 bp, Homo sapiens
gtgggagatggaggtaggg

SEQ ID NO: 3653473 - DNA, 22 bp, Homo sapiens
gtggtattttaacatagcagct

SEQ ID NO: 3653474 - DNA, 17 bp, Homo sapiens
gtgtacatttatgtgtg

SEQ ID NO: 3653475 - DNA, 19 bp, Homo sapiens
gtgtcaggattgaggatga

SEQ ID NO: 3653476 - DNA, 13 bp, Homo sapiens
gtgtgcagagtat

SEQ ID NO: 3653477 - DNA, 22 bp, Homo sapiens
gtgtgccacagagttccccgct

SEQ ID NO: 3653478 - DNA, 16 bp, Homo sapiens
gtgttcaaattctgat

SEQ ID NO: 3653479 - DNA, 15 bp, Homo sapiens
gttaaaatatagtgt

SEQ ID NO: 3653480 - DNA, 17 bp, Homo sapiens
gttaatgaaaaatctga

SEQ ID NO: 3653481 - DNA, 19 bp, Homo sapiens
gttaggattaggtttagaa

SEQ ID NO: 3653482 - DNA, 22 bp, Homo sapiens
gttaggattaggtttagaatca

SEQ ID NO: 3653483 - DNA, 23 bp, Homo sapiens
gttagggaaaacattccatcctt

SEQ ID NO: 3653484 - DNA, 13 bp, Homo sapiens
gttcaaattctga

SEQ ID NO: 3653485 - DNA, 13 bp, Homo sapiens
gttccctccaggc

SEQ ID NO: 3653486 - DNA, 17 bp, Homo sapiens
gttccctgaaccttcct

SEQ ID NO: 3653487 - DNA, 23 bp, Homo sapiens
gttccctgaaccttcctgtctcc

SEQ ID NO: 3653488 - DNA, 18 bp, Homo sapiens
gttcgctggccattggct

SEQ ID NO: 3653489 - DNA, 13 bp, Homo sapiens
gttctatatttac

SEQ ID NO: 3653490 - DNA, 16 bp, Homo sapiens
gttctgcacatacaga

SEQ ID NO: 3653491 - DNA, 14 bp, Homo sapiens
gttctgctttctga

SEQ ID NO: 3653492 - DNA, 21 bp, Homo sapiens
gttctgctttctgatacatct

SEQ ID NO: 3653493 - DNA, 19 bp, Homo sapiens
gttctgggttaacagtaaa

SEQ ID NO: 3653494 - DNA, 15 bp, Homo sapiens
gttgaagtgcatgtt

SEQ ID NO: 3653495 - DNA, 21 bp, Homo sapiens
gttgaagtgcatgttaaaata

SEQ ID NO: 3653496 - DNA, 20 bp, Homo sapiens
gttgaatgataatagctcac

SEQ ID NO: 3653497 - DNA, 23 bp, Homo sapiens
gttgcatgaatccatcgatttgt

SEQ ID NO: 3653498 - DNA, 23 bp, Homo sapiens
gttgtctattttttctgaggaat

SEQ ID NO: 3653499 - DNA, 21 bp, Homo sapiens
gtttaaatctttgttaaaata

SEQ ID NO: 3653500 - DNA, 22 bp, Homo sapiens
gtttatctttgcacaatcaata

SEQ ID NO: 3653501 - DNA, 13 bp, Homo sapiens
gtttccatttgga

SEQ ID NO: 3653502 - DNA, 23 bp, Homo sapiens
gtttccatttggattttaaacaa

SEQ ID NO: 3653503 - DNA, 17 bp, Homo sapiens
gttttacaaagaaacaa

SEQ ID NO: 3653504 - DNA, 22 bp, Homo sapiens
gttttacaaagaaacaaaatat

SEQ ID NO: 3653505 - DNA, 22 bp, Homo sapiens
gtttttacatatagctttgcaa

SEQ ID NO: 3653506 - DNA, 17 bp, Homo sapiens
taaaaagaccatgcatt

SEQ ID NO: 3653507 - DNA, 12 bp, Homo sapiens
taaaacaaaatc

SEQ ID NO: 3653508 - DNA, 22 bp, Homo sapiens
taaaacccttggtctgtgttct

SEQ ID NO: 3653509 - DNA, 18 bp, Homo sapiens
taaaacttactatggtat

SEQ ID NO: 3653510 - DNA, 14 bp, Homo sapiens
taaaatattttctt

SEQ ID NO: 3653511 - DNA, 19 bp, Homo sapiens
taaaatattttcttaatta

SEQ ID NO: 3653512 - DNA, 18 bp, Homo sapiens
taaaatctgtattgctaa

SEQ ID NO: 3653513 - DNA, 14 bp, Homo sapiens
taaaatgattcact

SEQ ID NO: 3653514 - DNA, 23 bp, Homo sapiens
taaaatgattcacttttattgta

SEQ ID NO: 3653515 - DNA, 13 bp, Homo sapiens
taaaatgtttatt

SEQ ID NO: 3653516 - DNA, 18 bp, Homo sapiens
taaaattggttaatgaaa

SEQ ID NO: 3653517 - DNA, 20 bp, Homo sapiens
taaaattggttaatgaaaaa

SEQ ID NO: 3653518 - DNA, 21 bp, Homo sapiens
taaaattggttaatgaaaaat

SEQ ID NO: 3653519 - DNA, 21 bp, Homo sapiens
taaacaaaatttatgtcattt

SEQ ID NO: 3653520 - DNA, 19 bp, Homo sapiens
taaacatagtggtatttta

SEQ ID NO: 3653521 - DNA, 14 bp, Homo sapiens
taaaccagaaggaa

SEQ ID NO: 3653522 - DNA, 12 bp, Homo sapiens
taaactagcaaa

SEQ ID NO: 3653523 - DNA, 14 bp, Homo sapiens
taaactgggaaatg

SEQ ID NO: 3653524 - DNA, 19 bp, Homo sapiens
taaaggtgatgaatttacc

SEQ ID NO: 3653525 - DNA, 21 bp, Homo sapiens
taaaggtttcactgttcatga

SEQ ID NO: 3653526 - DNA, 14 bp, Homo sapiens
taaagtcaaatcaa

SEQ ID NO: 3653527 - DNA, 13 bp, Homo sapiens
taaataaaaatag

SEQ ID NO: 3653528 - DNA, 13 bp, Homo sapiens
taaatattgctgt

SEQ ID NO: 3653529 - DNA, 13 bp, Homo sapiens
taaatcacagatt

SEQ ID NO: 3653530 - DNA, 16 bp, Homo sapiens
taaatcacagatttcc

SEQ ID NO: 3653531 - DNA, 17 bp, Homo sapiens
taaatcacagatttcca

SEQ ID NO: 3653532 - DNA, 21 bp, Homo sapiens
taaatctacaaacttttataa

SEQ ID NO: 3653533 - DNA, 20 bp, Homo sapiens
taaatctttgttaaaatata

SEQ ID NO: 3653534 - DNA, 12 bp, Homo sapiens
taaatgaaatac

SEQ ID NO: 3653535 - DNA, 15 bp, Homo sapiens
taaatgaaatacttg

SEQ ID NO: 3653536 - DNA, 19 bp, Homo sapiens
taaatgatatgtctttaaa

SEQ ID NO: 3653537 - DNA, 16 bp, Homo sapiens
taaattaacaaattca

SEQ ID NO: 3653538 - DNA, 17 bp, Homo sapiens
taaattcctaattctat

SEQ ID NO: 3653539 - DNA, 15 bp, Homo sapiens
taacacttcaccttc

SEQ ID NO: 3653540 - DNA, 17 bp, Homo sapiens
taacacttcaccttctg

SEQ ID NO: 3653541 - DNA, 16 bp, Homo sapiens
taacagtaaatataca

SEQ ID NO: 3653542 - DNA, 19 bp, Homo sapiens
taaccgggactacagaagt

SEQ ID NO: 3653543 - DNA, 21 bp, Homo sapiens
taaccgggactacagaagtgg

SEQ ID NO: 3653544 - DNA, 13 bp, Homo sapiens
taactaatgtaaa

SEQ ID NO: 3653545 - DNA, 14 bp, Homo sapiens
taactaatgtaaat

SEQ ID NO: 3653546 - DNA, 22 bp, Homo sapiens
taactaatgtaaatattgctgt

SEQ ID NO: 3653547 - DNA, 16 bp, Homo sapiens
taacttctgaaagagc

SEQ ID NO: 3653548 - DNA, 13 bp, Homo sapiens
taacttgctgtga

SEQ ID NO: 3653549 - DNA, 16 bp, Homo sapiens
taacttgctgtgaaat

SEQ ID NO: 3653550 - DNA, 10 bp, Homo sapiens
taagaattca

SEQ ID NO: 3653551 - DNA, 21 bp, Homo sapiens
taagataattaaatgaaatac

SEQ ID NO: 3653552 - DNA, 18 bp, Homo sapiens
taagataggttctgcttt

SEQ ID NO: 3653553 - DNA, 15 bp, Homo sapiens
taaggacagtgttca

SEQ ID NO: 3653554 - DNA, 16 bp, Homo sapiens
taaggactacagaatt

SEQ ID NO: 3653555 - DNA, 16 bp, Homo sapiens
taagggaccttcaggg

SEQ ID NO: 3653556 - DNA, 23 bp, Homo sapiens
taagggaccttcagggagagctg

SEQ ID NO: 3653557 - DNA, 19 bp, Homo sapiens
taaggtcagtgttataaaa

SEQ ID NO: 3653558 - DNA, 19 bp, Homo sapiens
taagttctgtgcagtttgg

SEQ ID NO: 3653559 - DNA, 19 bp, Homo sapiens
taatacaccaaatagcttt

SEQ ID NO: 3653560 - DNA, 20 bp, Homo sapiens
taatacaccaaatagctttt

SEQ ID NO: 3653561 - DNA, 19 bp, Homo sapiens
taatagtttctaaaccatg

SEQ ID NO: 3653562 - DNA, 16 bp, Homo sapiens
taatccatgtgctgct

SEQ ID NO: 3653563 - DNA, 22 bp, Homo sapiens
taatccatgtgctgctgtggca

SEQ ID NO: 3653564 - DNA, 15 bp, Homo sapiens
taatgaaaaatctga

SEQ ID NO: 3653565 - DNA, 14 bp, Homo sapiens
taatgacctgaatt

SEQ ID NO: 3653566 - DNA, 17 bp, Homo sapiens
taatgagatgtaataca

SEQ ID NO: 3653567 - DNA, 17 bp, Homo sapiens
taatgattcttgtgtca

SEQ ID NO: 3653568 - DNA, 18 bp, Homo sapiens
taatgattcttgtgtcat

SEQ ID NO: 3653569 - DNA, 16 bp, Homo sapiens
taatgtagggcagaat

SEQ ID NO: 3653570 - DNA, 12 bp, Homo sapiens
taattaaatgaa

SEQ ID NO: 3653571 - DNA, 16 bp, Homo sapiens
taattaaatgaaatac

SEQ ID NO: 3653572 - DNA, 16 bp, Homo sapiens
taattctatgattaaa

SEQ ID NO: 3653573 - DNA, 23 bp, Homo sapiens
taattctcagaagtgaaaaagac

SEQ ID NO: 3653574 - DNA, 16 bp, Homo sapiens
taattgtaaaggtgat

SEQ ID NO: 3653575 - DNA, 22 bp, Homo sapiens
taattgtaaaggtgatgaattt

SEQ ID NO: 3653576 - DNA, 23 bp, Homo sapiens
taatttagcagtccatttttgag

SEQ ID NO: 3653577 - DNA, 12 bp, Homo sapiens
taatttgtgaaa

SEQ ID NO: 3653578 - DNA, 22 bp, Homo sapiens
tggaagacctaaggcagacagg

SEQ ID NO: 3653579 - DNA, 23 bp, Homo sapiens
tggaagtgactttggctgcatgc

SEQ ID NO: 3653580 - DNA, 18 bp, Homo sapiens
tggaatctactagaacct

SEQ ID NO: 3653581 - DNA, 14 bp, Homo sapiens
tggacgtgtgagga

SEQ ID NO: 3653582 - DNA, 21 bp, Homo sapiens
tggagactaacttattttgat

SEQ ID NO: 3653583 - DNA, 21 bp, Homo sapiens
tggagagggatggaaataacg

SEQ ID NO: 3653584 - DNA, 18 bp, Homo sapiens
tggagattactaactgtg

SEQ ID NO: 3653585 - DNA, 18 bp, Homo sapiens
tggagccaggatgggtct

SEQ ID NO: 3653586 - DNA, 15 bp, Homo sapiens
tggaggtagggctgg

SEQ ID NO: 3653587 - DNA, 12 bp, Homo sapiens
tggaggtgatga

SEQ ID NO: 3653588 - DNA, 13 bp, Homo sapiens
tggatcatgaggt

SEQ ID NO: 3653589 - DNA, 14 bp, Homo sapiens
tggattcccctgga

SEQ ID NO: 3653590 - DNA, 15 bp, Homo sapiens
tggattttaaacaaa

SEQ ID NO: 3653591 - DNA, 17 bp, Homo sapiens
tggcaacatttggggag

SEQ ID NO: 3653592 - DNA, 15 bp, Homo sapiens
tggcaacgttcatgt

SEQ ID NO: 3653593 - DNA, 14 bp, Homo sapiens
tggcaactgtggaa

SEQ ID NO: 3653594 - DNA, 15 bp, Homo sapiens
tggcaagctcttcat

SEQ ID NO: 3653595 - DNA, 23 bp, Homo sapiens
tggcagggctgttccctccaggc

SEQ ID NO: 3653596 - DNA, 17 bp, Homo sapiens
tggcatttctttatgaa

SEQ ID NO: 3653597 - DNA, 13 bp, Homo sapiens
tggccaacatggt

SEQ ID NO: 3653598 - DNA, 14 bp, Homo sapiens
tggctggaggaagg

SEQ ID NO: 3653599 - DNA, 13 bp, Homo sapiens
tggcttccccttc

SEQ ID NO: 3653600 - DNA, 20 bp, Homo sapiens
tgggagacaatattaatttg

SEQ ID NO: 3653601 - DNA, 13 bp, Homo sapiens
tgggagatggagg

SEQ ID NO: 3653602 - DNA, 17 bp, Homo sapiens
tgggcaatcctgggctg

SEQ ID NO: 3653603 - DNA, 13 bp, Homo sapiens
tgggcagacaggt

SEQ ID NO: 3653604 - DNA, 20 bp, Homo sapiens
tgggcagacaggtgggagat

SEQ ID NO: 3653605 - DNA, 21 bp, Homo sapiens
tgggcagacaggtgggagatg

SEQ ID NO: 3653606 - DNA, 15 bp, Homo sapiens
tgggcagaggatgag

SEQ ID NO: 3653607 - DNA, 16 bp, Homo sapiens
tgggcccttagaatgt

SEQ ID NO: 3653608 - DNA, 21 bp, Homo sapiens
tgggcccttagaatgtgaaaa

SEQ ID NO: 3653609 - DNA, 20 bp, Homo sapiens
tggggagagataatgaggca

SEQ ID NO: 3653610 - DNA, 22 bp, Homo sapiens
tggggatggtgatggagaggga

SEQ ID NO: 3653611 - DNA, 19 bp, Homo sapiens
tgggtctccattctgtgtg

SEQ ID NO: 3653612 - DNA, 16 bp, Homo sapiens
tgggttaacagtaaat

SEQ ID NO: 3653613 - DNA, 23 bp, Homo sapiens
tgggttaacagtaaatatacact

SEQ ID NO: 3653614 - DNA, 21 bp, Homo sapiens
tgggttagggaaaacattcca

SEQ ID NO: 3653615 - DNA, 16 bp, Homo sapiens
tggtaagggaccttca

SEQ ID NO: 3653616 - DNA, 16 bp, Homo sapiens
tggtacctctgtctat

SEQ ID NO: 3653617 - DNA, 12 bp, Homo sapiens
tggtatttactg

SEQ ID NO: 3653618 - DNA, 13 bp, Homo sapiens
tggtatttactgc

SEQ ID NO: 3653619 - DNA, 17 bp, Homo sapiens
tggtattttttgtgaat

SEQ ID NO: 3653620 - DNA, 13 bp, Homo sapiens
tggtctgtgttct

SEQ ID NO: 3653621 - DNA, 23 bp, Homo sapiens
tggtctgtgttctcaacacacag

SEQ ID NO: 3653622 - DNA, 16 bp, Homo sapiens
tggtcttaactaatgt

SEQ ID NO: 3653623 - DNA, 22 bp, Homo sapiens
tggtcttaactaatgtaaatat

SEQ ID NO: 3653624 - DNA, 22 bp, Homo sapiens
tggtgcccagactcaaggcctc

SEQ ID NO: 3653625 - DNA, 23 bp, Homo sapiens
tggttaaccgggactacagaagt

SEQ ID NO: 3653626 - DNA, 22 bp, Homo sapiens
tgtaaatattgctgtctgaaaa

SEQ ID NO: 3653627 - DNA, 19 bp, Homo sapiens
tgtaagacacgtgcaacag

SEQ ID NO: 3653628 - DNA, 22 bp, Homo sapiens
tgtaattcttctcctttgtcaa

SEQ ID NO: 3653629 - DNA, 22 bp, Homo sapiens
tgtagtggcacaatctcagctc

SEQ ID NO: 3653630 - DNA, 13 bp, Homo sapiens
tgtatatctgtgt

SEQ ID NO: 3653631 - DNA, 23 bp, Homo sapiens
tgtatttgaggaaactcatacag

SEQ ID NO: 3653632 - DNA, 17 bp, Homo sapiens
tgtatttttaataaaga

SEQ ID NO: 3653633 - DNA, 12 bp, Homo sapiens
tgtcagaatgtt

SEQ ID NO: 3653634 - DNA, 15 bp, Homo sapiens
tgtcatcaagtagta

SEQ ID NO: 3653635 - DNA, 22 bp, Homo sapiens
tgtcattttcagatccttccaa

SEQ ID NO: 3653636 - DNA, 20 bp, Homo sapiens
tgtcctgcatgtatgccatg

SEQ ID NO: 3653637 - DNA, 21 bp, Homo sapiens
tgtcctgtagagagagaccta

SEQ ID NO: 3653638 - DNA, 20 bp, Homo sapiens
tgtcgtggactccagctcta

SEQ ID NO: 3653639 - DNA, 10 bp, Homo sapiens
tgtctcccag

SEQ ID NO: 3653640 - DNA, 11 bp, Homo sapiens
tgtctcccagg

SEQ ID NO: 3653641 - DNA, 16 bp, Homo sapiens
tgtctcccagggacat

SEQ ID NO: 3653642 - DNA, 20 bp, Homo sapiens
tgtctgaaaaagtgttttta

SEQ ID NO: 3653643 - DNA, 18 bp, Homo sapiens
tgtctgtccctaaacata

SEQ ID NO: 3653644 - DNA, 19 bp, Homo sapiens
tgtcttattcctaattcct

SEQ ID NO: 3653645 - DNA, 11 bp, Homo sapiens
tgtctttaaaa

SEQ ID NO: 3653646 - DNA, 17 bp, Homo sapiens
tgtgaggaagaggttgc

SEQ ID NO: 3653647 - DNA, 14 bp, Homo sapiens
tgtgagtgttagaa

SEQ ID NO: 3653648 - DNA, 18 bp, Homo sapiens
tgtgataattgtaaaggt

SEQ ID NO: 3653649 - DNA, 16 bp, Homo sapiens
tgtgcagagtatacaa

SEQ ID NO: 3653650 - DNA, 20 bp, Homo sapiens
tgtgcagagtatacaagtgt

SEQ ID NO: 3653651 - DNA, 15 bp, Homo sapiens
tgtgcagtttggtat

SEQ ID NO: 3653652 - DNA, 21 bp, Homo sapiens
tgtgcctctcagtatcttaaa

SEQ ID NO: 3653653 - DNA, 16 bp, Homo sapiens
tgtgcttcacacaaag

SEQ ID NO: 3653654 - DNA, 19 bp, Homo sapiens
tgtgcttcacacaaagtga

SEQ ID NO: 3653655 - DNA, 19 bp, Homo sapiens
tgtggataaattttggaag

SEQ ID NO: 3653656 - DNA, 17 bp, Homo sapiens
tgtggcatcaggaaagg

SEQ ID NO: 3653657 - DNA, 10 bp, Homo sapiens
tgttaaaata

SEQ ID NO: 3653658 - DNA, 14 bp, Homo sapiens
tgttaaatctacaa

SEQ ID NO: 3653659 - DNA, 14 bp, Homo sapiens
tgttacaataagtg

SEQ ID NO: 3653660 - DNA, 20 bp, Homo sapiens
tgttataaaatctgtattgc

SEQ ID NO: 3653661 - DNA, 17 bp, Homo sapiens
tgttatccactacaggt

SEQ ID NO: 3653662 - DNA, 19 bp, Homo sapiens
tgttattcaataactattg

SEQ ID NO: 3653663 - DNA, 15 bp, Homo sapiens
tgttcaaattctgat

SEQ ID NO: 3653664 - DNA, 19 bp, Homo sapiens
tgttcaaattctgattatt

SEQ ID NO: 3653665 - DNA, 15 bp, Homo sapiens
tgttccctccaggca

SEQ ID NO: 3653666 - DNA, 19 bp, Homo sapiens
tgttctcaacacacagtat

SEQ ID NO: 3653667 - DNA, 20 bp, Homo sapiens
tgttctcaacacacagtata

SEQ ID NO: 3653668 - DNA, 18 bp, Homo sapiens
tgttgaagtgcatgttaa

SEQ ID NO: 3653669 - DNA, 20 bp, Homo sapiens
tgttgaagtgcatgttaaaa

SEQ ID NO: 3653670 - DNA, 23 bp, Homo sapiens
tgttgcatgaatccatcgatttg

SEQ ID NO: 3653671 - DNA, 14 bp, Homo sapiens
tgttggtatttact

SEQ ID NO: 3653672 - DNA, 23 bp, Homo sapiens
tgtttatttttgctctccctccc

SEQ ID NO: 3653673 - DNA, 14 bp, Homo sapiens
tgtttgattataga

SEQ ID NO: 3653674 - DNA, 14 bp, Homo sapiens
tgttttcattctgg

SEQ ID NO: 3653675 - DNA, 16 bp, Homo sapiens
ttaaaaagacactttt

SEQ ID NO: 3653676 - DNA, 18 bp, Homo sapiens
ttaaaaagaccatgcatt

SEQ ID NO: 3653677 - DNA, 20 bp, Homo sapiens
ttaaaaattatctttaaaac

SEQ ID NO: 3653678 - DNA, 15 bp, Homo sapiens
ttaaaatatagtgtt

SEQ ID NO: 3653679 - DNA, 18 bp, Homo sapiens
ttaaaatattttcttaat

SEQ ID NO: 3653680 - DNA, 15 bp, Homo sapiens
ttaaaattggttaat

SEQ ID NO: 3653681 - DNA, 23 bp, Homo sapiens
ttaaacaaaatttatgtcatttt

SEQ ID NO: 3653682 - DNA, 18 bp, Homo sapiens
ttaaactgggaaatgaga

SEQ ID NO: 3653683 - DNA, 23 bp, Homo sapiens
ttaaagaagtccatgtgataatt

SEQ ID NO: 3653684 - DNA, 19 bp, Homo sapiens
ttaaatctacaaactttta

SEQ ID NO: 3653685 - DNA, 12 bp, Homo sapiens
ttaaatgaaata

SEQ ID NO: 3653686 - DNA, 22 bp, Homo sapiens
ttaaccgggactacagaagtgg

SEQ ID NO: 3653687 - DNA, 14 bp, Homo sapiens
ttaactaatgtaaa

SEQ ID NO: 3653688 - DNA, 17 bp, Homo sapiens
ttaactaatgtaaatat

SEQ ID NO: 3653689 - DNA, 21 bp, Homo sapiens
ttaaggacagtgttcaaattc

SEQ ID NO: 3653690 - DNA, 14 bp, Homo sapiens
ttaatttattaaat

SEQ ID NO: 3653691 - DNA, 16 bp, Homo sapiens
ttacaaagaaacaaaa

SEQ ID NO: 3653692 - DNA, 17 bp, Homo sapiens
ttacaaagaaacaaaat

SEQ ID NO: 3653693 - DNA, 20 bp, Homo sapiens
ttacaacaagcaaactgaaa

SEQ ID NO: 3653694 - DNA, 19 bp, Homo sapiens
ttacacacctgagaatgtg

SEQ ID NO: 3653695 - DNA, 13 bp, Homo sapiens
ttacagaaacacg

SEQ ID NO: 3653696 - DNA, 20 bp, Homo sapiens
ttaccagaagtttaaatctt

SEQ ID NO: 3653697 - DNA, 22 bp, Homo sapiens
ttaccagaagtttaaatctttg

SEQ ID NO: 3653698 - DNA, 20 bp, Homo sapiens
ttaccccaccctgcccactc

SEQ ID NO: 3653699 - DNA, 15 bp, Homo sapiens
ttacccttcaatgtt

SEQ ID NO: 3653700 - DNA, 13 bp, Homo sapiens
ttactgcaatgtc

SEQ ID NO: 3653701 - DNA, 14 bp, Homo sapiens
ttacttacacacct

SEQ ID NO: 3653702 - DNA, 15 bp, Homo sapiens
ttacttgattaagga

SEQ ID NO: 3653703 - DNA, 11 bp, Homo sapiens
ttagaatgtga

SEQ ID NO: 3653704 - DNA, 16 bp, Homo sapiens
ttagaatgtgaaaaaa

SEQ ID NO: 3653705 - DNA, 15 bp, Homo sapiens
ttagtaaattcctaa

SEQ ID NO: 3653706 - DNA, 15 bp, Homo sapiens
ttagtgttttcattc

SEQ ID NO: 3653707 - DNA, 22 bp, Homo sapiens
ttagtgttttcattctggtcct

SEQ ID NO: 3653708 - DNA, 12 bp, Homo sapiens
ttataaaatctg

SEQ ID NO: 3653709 - DNA, 17 bp, Homo sapiens
ttatcagaagcaaggaa

SEQ ID NO: 3653710 - DNA, 23 bp, Homo sapiens
gcatccgcctctgagccaggagc

SEQ ID NO: 3653711 - DNA, 19 bp, Homo sapiens
gcatgcgaatgagctgggc

SEQ ID NO: 3653712 - DNA, 17 bp, Homo sapiens
gcatggcccagcctgga

SEQ ID NO: 3653713 - DNA, 13 bp, Homo sapiens
gcccagcctggag

SEQ ID NO: 3653714 - DNA, 16 bp, Homo sapiens
gcctagtggggagggg

SEQ ID NO: 3653715 - DNA, 21 bp, Homo sapiens
gcctagtggggaggggcctgg

SEQ ID NO: 3653716 - DNA, 19 bp, Homo sapiens
gcctctgagccaggagcct

SEQ ID NO: 3653717 - DNA, 20 bp, Homo sapiens
gcctctgagccaggagcctc

SEQ ID NO: 3653718 - DNA, 21 bp, Homo sapiens
gcctgacacaggggacactga

SEQ ID NO: 3653719 - DNA, 22 bp, Homo sapiens
gcctgacacaggggacactgaa

SEQ ID NO: 3653720 - DNA, 18 bp, Homo sapiens
gcctgcctcatgctctct

SEQ ID NO: 3653721 - DNA, 14 bp, Homo sapiens
gcctggttccctct

SEQ ID NO: 3653722 - DNA, 17 bp, Homo sapiens
gcctggttccctctttc

SEQ ID NO: 3653723 - DNA, 23 bp, Homo sapiens
gctctgtattctgcaacagcctg

SEQ ID NO: 3653724 - DNA, 21 bp, Homo sapiens
gctgtccctcctgaggtctgg

SEQ ID NO: 3653725 - DNA, 19 bp, Homo sapiens
gcttctgctcacattccct

SEQ ID NO: 3653726 - DNA, 23 bp, Homo sapiens
ggaaccagtaggttgaggacagg

SEQ ID NO: 3653727 - DNA, 19 bp, Homo sapiens
ggacactgaaccttgttga

SEQ ID NO: 3653728 - DNA, 12 bp, Homo sapiens
ggagcagctggg

SEQ ID NO: 3653729 - DNA, 13 bp, Homo sapiens
ggaggggcctggc

SEQ ID NO: 3653730 - DNA, 14 bp, Homo sapiens
ggagtggaaacaaa

SEQ ID NO: 3653731 - DNA, 24 bp, Homo sapiens
ggagttgctcctacccctgtcctg

SEQ ID NO: 3653732 - DNA, 19 bp, Homo sapiens
ggatggtcatcgtgacagc

SEQ ID NO: 3653733 - DNA, 14 bp, Homo sapiens
ggcaagccacagaa

SEQ ID NO: 3653734 - DNA, 21 bp, Homo sapiens
ggcactgggccggcagcctgg

SEQ ID NO: 3653735 - DNA, 11 bp, Homo sapiens
ggcagcctggt

SEQ ID NO: 3653736 - DNA, 16 bp, Homo sapiens
ggcagggcctggcctg

SEQ ID NO: 3653737 - DNA, 13 bp, Homo sapiens
ggcatcaaagatg

SEQ ID NO: 3653738 - DNA, 23 bp, Homo sapiens
ggcatgcgaatgagctgggccct

SEQ ID NO: 3653739 - DNA, 17 bp, Homo sapiens
ggcatggcccagcctgg

SEQ ID NO: 3653740 - DNA, 18 bp, Homo sapiens
ggcatggcccagcctgga

SEQ ID NO: 3653741 - DNA, 20 bp, Homo sapiens
ggcatggcccagcctggagc

SEQ ID NO: 3653742 - DNA, 12 bp, Homo sapiens
ggcccagcctgg

SEQ ID NO: 3653743 - DNA, 13 bp, Homo sapiens
ggcccagcctgga

SEQ ID NO: 3653744 - DNA, 13 bp, Homo sapiens
ggcctggcctggt

SEQ ID NO: 3653745 - DNA, 20 bp, Homo sapiens
ggcctgggtggggcagggcc

SEQ ID NO: 3653746 - DNA, 21 bp, Homo sapiens
ggcctgggtggggcagggcct

SEQ ID NO: 3653747 - DNA, 16 bp, Homo sapiens
ggctattccctggaga

SEQ ID NO: 3653748 - DNA, 13 bp, Homo sapiens
ggctccagggcca

SEQ ID NO: 3653749 - DNA, 15 bp, Homo sapiens
gggagcagctgggca

SEQ ID NO: 3653750 - DNA, 14 bp, Homo sapiens
gggaggggaaccag

SEQ ID NO: 3653751 - DNA, 13 bp, Homo sapiens
gggaggggcctgg

SEQ ID NO: 3653752 - DNA, 16 bp, Homo sapiens
gggaggggcctggcct

SEQ ID NO: 3653753 - DNA, 23 bp, Homo sapiens
gggatatccctatgtcccagccc

SEQ ID NO: 3653754 - DNA, 13 bp, Homo sapiens
gggcagggcctgg

SEQ ID NO: 3653755 - DNA, 12 bp, Homo sapiens
gggcttccctag

SEQ ID NO: 3653756 - DNA, 16 bp, Homo sapiens
ggggaggggcctggcc

SEQ ID NO: 3653757 - DNA, 13 bp, Homo sapiens
ggggcctggcctg

SEQ ID NO: 3653758 - DNA, 13 bp, Homo sapiens
gggtaacactgat

SEQ ID NO: 3653759 - DNA, 22 bp, Homo sapiens
gggtgggcatcaaagatgagaa

SEQ ID NO: 3653760 - DNA, 18 bp, Homo sapiens
ggtgtgtttcaggacagc

SEQ ID NO: 3653761 - DNA, 12 bp, Homo sapiens
ggttccctcttt

SEQ ID NO: 3653762 - DNA, 15 bp, Homo sapiens
ggttgccagtcctgc

SEQ ID NO: 3653763 - DNA, 17 bp, Homo sapiens
gtcaagttccgtctcct

SEQ ID NO: 3653764 - DNA, 13 bp, Homo sapiens
gtccctcctgagg

SEQ ID NO: 3653765 - DNA, 22 bp, Homo sapiens
gtcctgcaagtccatagctgag

SEQ ID NO: 3653766 - DNA, 17 bp, Homo sapiens
gtctcctctccagccct

SEQ ID NO: 3653767 - DNA, 18 bp, Homo sapiens
gtctcctctccagcccta

SEQ ID NO: 3653768 - DNA, 22 bp, Homo sapiens
gtgaggtgggggtctggcctag

SEQ ID NO: 3653769 - DNA, 19 bp, Homo sapiens
gtgcatttgtgtctgcctg

SEQ ID NO: 3653770 - DNA, 13 bp, Homo sapiens
gtgccaggactct

SEQ ID NO: 3653771 - DNA, 19 bp, Homo sapiens
gtgccaggactctctttct

SEQ ID NO: 3653772 - DNA, 16 bp, Homo sapiens
aaggcaagccacagaa

SEQ ID NO: 3653773 - DNA, 18 bp, Homo sapiens
aagttccgtctcctctcc

SEQ ID NO: 3653774 - DNA, 21 bp, Homo sapiens
aatcaattctgatacagcctt

SEQ ID NO: 3653775 - DNA, 21 bp, Homo sapiens
aatcctgaggggatatcccta

SEQ ID NO: 3653776 - DNA, 19 bp, Homo sapiens
aatgagctgggccctgggt

SEQ ID NO: 3653777 - DNA, 14 bp, Homo sapiens
acaactccagccac

SEQ ID NO: 3653778 - DNA, 16 bp, Homo sapiens
acacaggggacactga

SEQ ID NO: 3653779 - DNA, 24 bp, Homo sapiens
acactgaaccttgttgatgccagc

SEQ ID NO: 3653780 - DNA, 23 bp, Homo sapiens
acactgattacttttgggagggg

SEQ ID NO: 3653781 - DNA, 13 bp, Homo sapiens
acagaggccaggc

SEQ ID NO: 3653782 - DNA, 13 bp, Homo sapiens
acagctgcttctg

SEQ ID NO: 3653783 - DNA, 21 bp, Homo sapiens
accttgttgatgccagctgta

SEQ ID NO: 3653784 - DNA, 16 bp, Homo sapiens
actcccccagccctca

SEQ ID NO: 3653785 - DNA, 15 bp, Homo sapiens
actgctgtccctcct

SEQ ID NO: 3653786 - DNA, 16 bp, Homo sapiens
actgctgtccctcctg

SEQ ID NO: 3653787 - DNA, 19 bp, Homo sapiens
actgctgtccctcctgagg

SEQ ID NO: 3653788 - DNA, 19 bp, Homo sapiens
actgggccggcagcctggt

SEQ ID NO: 3653789 - DNA, 18 bp, Homo sapiens
actggttaaatcaattct

SEQ ID NO: 3653790 - DNA, 13 bp, Homo sapiens
acttcctcctcct

SEQ ID NO: 3653791 - DNA, 14 bp, Homo sapiens
agaaacaacagaaa

SEQ ID NO: 3653792 - DNA, 13 bp, Homo sapiens
agaataaatgggt

SEQ ID NO: 3653793 - DNA, 16 bp, Homo sapiens
agaccccagagtaggg

SEQ ID NO: 3653794 - DNA, 14 bp, Homo sapiens
agatggttcccttt

SEQ ID NO: 3653795 - DNA, 15 bp, Homo sapiens
agatggttccctttg

SEQ ID NO: 3653796 - DNA, 18 bp, Homo sapiens
agccaggagcctcctgac

SEQ ID NO: 3653797 - DNA, 15 bp, Homo sapiens
agcctcctgaccctg

SEQ ID NO: 3653798 - DNA, 13 bp, Homo sapiens
agcctggagccgt

SEQ ID NO: 3653799 - DNA, 18 bp, Homo sapiens
agcctggttccctctttc

SEQ ID NO: 3653800 - DNA, 19 bp, Homo sapiens
agcctggttccctctttcc

SEQ ID NO: 3653801 - DNA, 21 bp, Homo sapiens
agcctggttccctctttcctg

SEQ ID NO: 3653802 - DNA, 22 bp, Homo sapiens
agcctggttccctctttcctgt

SEQ ID NO: 3653803 - DNA, 14 bp, Homo sapiens
aggactctctttct

SEQ ID NO: 3653804 - DNA, 13 bp, Homo sapiens
aggagttgctcct

SEQ ID NO: 3653805 - DNA, 14 bp, Homo sapiens
aggatgcttctgct

SEQ ID NO: 3653806 - DNA, 15 bp, Homo sapiens
aggcaagccacagaa

SEQ ID NO: 3653807 - DNA, 19 bp, Homo sapiens
aggcatgcgaatgagctgg

SEQ ID NO: 3653808 - DNA, 20 bp, Homo sapiens
aggcatgcgaatgagctggg

SEQ ID NO: 3653809 - DNA, 16 bp, Homo sapiens
aggcatggcccagcct

SEQ ID NO: 3653810 - DNA, 19 bp, Homo sapiens
aggcatggcccagcctgga

SEQ ID NO: 3653811 - DNA, 20 bp, Homo sapiens
agggatggggagcagctggg

SEQ ID NO: 3653812 - DNA, 15 bp, Homo sapiens
agggcctggcctggt

SEQ ID NO: 3653813 - DNA, 20 bp, Homo sapiens
agggggctattccctggaga

SEQ ID NO: 3653814 - DNA, 15 bp, Homo sapiens
aggtcctttccttct

SEQ ID NO: 3653815 - DNA, 21 bp, Homo sapiens
aggtcctttccttctcgtctt

SEQ ID NO: 3653816 - DNA, 17 bp, Homo sapiens
agtaggttgaggacagg

SEQ ID NO: 3653817 - DNA, 19 bp, Homo sapiens
agtccatagctgagctgga

SEQ ID NO: 3653818 - DNA, 23 bp, Homo sapiens
agtgatttgggggtgcaatgata

SEQ ID NO: 3653819 - DNA, 19 bp, Homo sapiens
agttccgtctcctctccag

SEQ ID NO: 3653820 - DNA, 22 bp, Homo sapiens
agttccgtctcctctccagccc

SEQ ID NO: 3653821 - DNA, 14 bp, Homo sapiens
agttctcatccaca

SEQ ID NO: 3653822 - DNA, 17 bp, Homo sapiens
agttctcatccacagag

SEQ ID NO: 3653823 - DNA, 18 bp, Homo sapiens
agttctcatccacagagg

SEQ ID NO: 3653824 - DNA, 18 bp, Homo sapiens
ataaatgggtaacactga

SEQ ID NO: 3653825 - DNA, 13 bp, Homo sapiens
ataatgaagaatg

SEQ ID NO: 3653826 - DNA, 18 bp, Homo sapiens
atacagccttacaataca

SEQ ID NO: 3653827 - DNA, 20 bp, Homo sapiens
cgttcccttgtgtctgttgc

SEQ ID NO: 3653828 - DNA, 21 bp, Homo sapiens
cgttcccttgtgtctgttgct

SEQ ID NO: 3653829 - DNA, 21 bp, Homo sapiens
ctaaaggactggttaaatcaa

SEQ ID NO: 3653830 - DNA, 16 bp, Homo sapiens
ctaatcagagtggcca

SEQ ID NO: 3653831 - DNA, 14 bp, Homo sapiens
ctacaactccagcc

SEQ ID NO: 3653832 - DNA, 14 bp, Homo sapiens
ctacttcctcctcc

SEQ ID NO: 3653833 - DNA, 15 bp, Homo sapiens
ctacttcctcctcct

SEQ ID NO: 3653834 - DNA, 19 bp, Homo sapiens
ctatcctgcaatttctccc

SEQ ID NO: 3653835 - DNA, 20 bp, Homo sapiens
ctatcctgcaatttctcccg

SEQ ID NO: 3653836 - DNA, 13 bp, Homo sapiens
ctattcaaaataa

SEQ ID NO: 3653837 - DNA, 14 bp, Homo sapiens
ctattccctggaga

SEQ ID NO: 3653838 - DNA, 15 bp, Homo sapiens
ctattccctggagac

SEQ ID NO: 3653839 - DNA, 18 bp, Homo sapiens
ctcaagttagcatttcaa

SEQ ID NO: 3653840 - DNA, 23 bp, Homo sapiens
ctcacattccctctcatccaggt

SEQ ID NO: 3653841 - DNA, 14 bp, Homo sapiens
ctcacctacttcct

SEQ ID NO: 3653842 - DNA, 16 bp, Homo sapiens
ctcacctacttcctcc

SEQ ID NO: 3653843 - DNA, 17 bp, Homo sapiens
ctcacctacttcctcct

SEQ ID NO: 3653844 - DNA, 13 bp, Homo sapiens
ctcatccacagag

SEQ ID NO: 3653845 - DNA, 17 bp, Homo sapiens
ctcatccacagaggcca

SEQ ID NO: 3653846 - DNA, 15 bp, Homo sapiens
ctcatccaggtcctt

SEQ ID NO: 3653847 - DNA, 22 bp, Homo sapiens
ctcatccaggtcctttccttct

SEQ ID NO: 3653848 - DNA, 20 bp, Homo sapiens
ctccagccacccagccagga

SEQ ID NO: 3653849 - DNA, 13 bp, Homo sapiens
ctccctcgcatcc

SEQ ID NO: 3653850 - DNA, 14 bp, Homo sapiens
ctccctcgcatccg

SEQ ID NO: 3653851 - DNA, 14 bp, Homo sapiens
ctcctcctcctcct

SEQ ID NO: 3653852 - DNA, 16 bp, Homo sapiens
ctcctcctcctcctgt

SEQ ID NO: 3653853 - DNA, 12 bp, Homo sapiens
ctcctcctgttc

SEQ ID NO: 3653854 - DNA, 20 bp, Homo sapiens
ctcctcctgttcctgccttc

SEQ ID NO: 3653855 - DNA, 13 bp, Homo sapiens
ctcctctccagcc

SEQ ID NO: 3653856 - DNA, 14 bp, Homo sapiens
ctcctgaccctgtg

SEQ ID NO: 3653857 - DNA, 15 bp, Homo sapiens
ctcctgaccctgtga

SEQ ID NO: 3653858 - DNA, 18 bp, Homo sapiens
ctcctgaggtctggattg

SEQ ID NO: 3653859 - DNA, 14 bp, Homo sapiens
ctcctgttcctgcc

SEQ ID NO: 3653860 - DNA, 21 bp, Homo sapiens
ctcctgttcctgccttctctt

SEQ ID NO: 3653861 - DNA, 22 bp, Homo sapiens
ctcctgttcctgccttctcttc

SEQ ID NO: 3653862 - DNA, 19 bp, Homo sapiens
ctcgcatccgcctctgagc

SEQ ID NO: 3653863 - DNA, 13 bp, Homo sapiens
ctcgtcttcctct

SEQ ID NO: 3653864 - DNA, 14 bp, Homo sapiens
ctctcatccaggtc

SEQ ID NO: 3653865 - DNA, 22 bp, Homo sapiens
ctctcatccaggtcctttcctt

SEQ ID NO: 3653866 - DNA, 13 bp, Homo sapiens
ctctccagcccta

SEQ ID NO: 3653867 - DNA, 14 bp, Homo sapiens
ctctccagccctat

SEQ ID NO: 3653868 - DNA, 21 bp, Homo sapiens
ctctgagccaggagcctcctg

SEQ ID NO: 3653869 - DNA, 23 bp, Homo sapiens
ctctgagccaggagcctcctgac

SEQ ID NO: 3653870 - DNA, 10 bp, Homo sapiens
ctctttcctg

SEQ ID NO: 3653871 - DNA, 20 bp, Homo sapiens
ctctttcttccactaccctc

SEQ ID NO: 3653872 - DNA, 20 bp, Homo sapiens
ctgacacaggggacactgaa

SEQ ID NO: 3653873 - DNA, 19 bp, Homo sapiens
ctgagccaggagcctcctg

SEQ ID NO: 3653874 - DNA, 15 bp, Homo sapiens
ctgagttctcatcca

SEQ ID NO: 3653875 - DNA, 22 bp, Homo sapiens
ctgagttctcatccacagaggc

SEQ ID NO: 3653876 - DNA, 21 bp, Homo sapiens
ctgatacagccttacaataca

SEQ ID NO: 3653877 - DNA, 13 bp, Homo sapiens
ctgccttctcttc

SEQ ID NO: 3653878 - DNA, 18 bp, Homo sapiens
ctgctcacattccctctc

SEQ ID NO: 3653879 - DNA, 14 bp, Homo sapiens
ctgctgtccctcct

SEQ ID NO: 3653880 - DNA, 15 bp, Homo sapiens
ctgctgtccctcctg

SEQ ID NO: 3653881 - DNA, 18 bp, Homo sapiens
ctgctgtccctcctgagg

SEQ ID NO: 3653882 - DNA, 13 bp, Homo sapiens
ctgcttctgtgca

SEQ ID NO: 3653883 - DNA, 16 bp, Homo sapiens
ctgcttctgtgcattt

SEQ ID NO: 3653884 - DNA, 20 bp, Homo sapiens
ctgcttctgtgcatttgtgt

SEQ ID NO: 3653885 - DNA, 20 bp, Homo sapiens
ctggaaaggatgcttctgct

SEQ ID NO: 3653886 - DNA, 20 bp, Homo sapiens
gtggccaagggctccagggc

SEQ ID NO: 3653887 - DNA, 15 bp, Homo sapiens
gtgtgtttcaggaca

SEQ ID NO: 3653888 - DNA, 19 bp, Homo sapiens
gtgtttcaggacagctgct

SEQ ID NO: 3653889 - DNA, 20 bp, Homo sapiens
gttccctctttcctgtgcca

SEQ ID NO: 3653890 - DNA, 16 bp, Homo sapiens
gttctcatccacagag

SEQ ID NO: 3653891 - DNA, 13 bp, Homo sapiens
taaacaataaatg

SEQ ID NO: 3653892 - DNA, 19 bp, Homo sapiens
tactcccccagccctcagt

SEQ ID NO: 3653893 - DNA, 13 bp, Homo sapiens
tagctgagctgga

SEQ ID NO: 3653894 - DNA, 18 bp, Homo sapiens
taggttgaggacaggaga

SEQ ID NO: 3653895 - DNA, 13 bp, Homo sapiens
tattccctggaga

SEQ ID NO: 3653896 - DNA, 17 bp, Homo sapiens
tattctgcaacagcctg

SEQ ID NO: 3653897 - DNA, 23 bp, Homo sapiens
tattgggagtaggagttgctcct

SEQ ID NO: 3653898 - DNA, 20 bp, Homo sapiens
tcaattctgatacagcctta

SEQ ID NO: 3653899 - DNA, 18 bp, Homo sapiens
tcacctacttcctcctcc

SEQ ID NO: 3653900 - DNA, 18 bp, Homo sapiens
tccagccacccagccagg

SEQ ID NO: 3653901 - DNA, 17 bp, Homo sapiens
tccatagctgagctgga

SEQ ID NO: 3653902 - DNA, 19 bp, Homo sapiens
tcccagcccctggtactcc

SEQ ID NO: 3653903 - DNA, 16 bp, Homo sapiens
tcccatcactgctgtc

SEQ ID NO: 3653904 - DNA, 17 bp, Homo sapiens
tcccatcactgctgtcc

SEQ ID NO: 3653905 - DNA, 17 bp, Homo sapiens
tcccatttgtgtttcag

SEQ ID NO: 3653906 - DNA, 21 bp, Homo sapiens
tccctagatggttccctttgt

SEQ ID NO: 3653907 - DNA, 17 bp, Homo sapiens
tccctcgcatccgcctc

SEQ ID NO: 3653908 - DNA, 23 bp, Homo sapiens
tccctcgcatccgcctctgagcc

SEQ ID NO: 3653909 - DNA, 15 bp, Homo sapiens
tccctctttcctgtg

SEQ ID NO: 3653910 - DNA, 17 bp, Homo sapiens
tccctttgttgctgtct

SEQ ID NO: 3653911 - DNA, 13 bp, Homo sapiens
tccgcctctgagc

SEQ ID NO: 3653912 - DNA, 13 bp, Homo sapiens
tccgtctcctctc

SEQ ID NO: 3653913 - DNA, 14 bp, Homo sapiens
tcctcctcctcctg

SEQ ID NO: 3653914 - DNA, 16 bp, Homo sapiens
tcctcctcctgttcct

SEQ ID NO: 3653915 - DNA, 20 bp, Homo sapiens
tcctcctgttcctgccttct

SEQ ID NO: 3653916 - DNA, 21 bp, Homo sapiens
tcctcctgttcctgccttctc

SEQ ID NO: 3653917 - DNA, 13 bp, Homo sapiens
tcctctccagccc

SEQ ID NO: 3653918 - DNA, 20 bp, Homo sapiens
tcctctctctcacctacttc

SEQ ID NO: 3653919 - DNA, 21 bp, Homo sapiens
tcctgaggggatatccctatg

SEQ ID NO: 3653920 - DNA, 16 bp, Homo sapiens
tcctgaggtctggatt

SEQ ID NO: 3653921 - DNA, 21 bp, Homo sapiens
tcctgccttctcttctatcct

SEQ ID NO: 3653922 - DNA, 22 bp, Homo sapiens
tcctgtgccaggactctctttc

SEQ ID NO: 3653923 - DNA, 16 bp, Homo sapiens
tccttctcgtcttcct

SEQ ID NO: 3653924 - DNA, 18 bp, Homo sapiens
tcgcatccgcctctgagc

SEQ ID NO: 3653925 - DNA, 18 bp, Homo sapiens
tcgttcccttgtgtctgt

SEQ ID NO: 3653926 - DNA, 16 bp, Homo sapiens
tctcctctccagccct

SEQ ID NO: 3653927 - DNA, 18 bp, Homo sapiens
tctcttctatcctgcaat

SEQ ID NO: 3653928 - DNA, 15 bp, Homo sapiens
tctgagccaggagcc

SEQ ID NO: 3653929 - DNA, 14 bp, Homo sapiens
tctgcaacagcctg

SEQ ID NO: 3653930 - DNA, 16 bp, Homo sapiens
tctgcaacagcctgtt

SEQ ID NO: 3653931 - DNA, 13 bp, Homo sapiens
tctgcctgcctca

SEQ ID NO: 3653932 - DNA, 17 bp, Homo sapiens
tctgcctgcctcatgct

SEQ ID NO: 3653933 - DNA, 20 bp, Homo sapiens
tctgctcacattccctctca

SEQ ID NO: 3653934 - DNA, 22 bp, Homo sapiens
tctgtattctgcaacagcctgt

SEQ ID NO: 3653935 - DNA, 18 bp, Homo sapiens
tctgtgcatttgtgtctg

SEQ ID NO: 3653936 - DNA, 13 bp, Homo sapiens
tcttcctctctct

SEQ ID NO: 3653937 - DNA, 15 bp, Homo sapiens
tcttcctctctctca

SEQ ID NO: 3653938 - DNA, 23 bp, Homo sapiens
tgagctggaaaggatgcttctgc

SEQ ID NO: 3653939 - DNA, 21 bp, Homo sapiens
tgagctgggccctgggtgagg

SEQ ID NO: 3653940 - DNA, 21 bp, Homo sapiens
tgagggatggggagcagctgg

SEQ ID NO: 3653941 - DNA, 21 bp, Homo sapiens
tgaggtgggggtctggcctag

SEQ ID NO: 3653942 - DNA, 20 bp, Homo sapiens
tgatgcctgacacaggggac

SEQ ID NO: 3653943 - DNA, 18 bp, Homo sapiens
tgccaggactctctttct

SEQ ID NO: 3653944 - DNA, 14 bp, Homo sapiens
tgccttctcttcta

SEQ ID NO: 3653945 - DNA, 14 bp, Homo sapiens
tgctcctacccctg

SEQ ID NO: 3653946 - DNA, 17 bp, Homo sapiens
tgctgtctggctttccc

SEQ ID NO: 3653947 - DNA, 17 bp, Homo sapiens
tggagccgtggccgagg

SEQ ID NO: 3653948 - DNA, 18 bp, Homo sapiens
tggcctgggtggggcagg

SEQ ID NO: 3653949 - DNA, 14 bp, Homo sapiens
tggcctggtccagg

SEQ ID NO: 3653950 - DNA, 14 bp, Homo sapiens
tgggcactgggccg

SEQ ID NO: 3653951 - DNA, 15 bp, Homo sapiens
tgggcatcaaagatg

SEQ ID NO: 3653952 - DNA, 14 bp, Homo sapiens
tgggccggcagcct

SEQ ID NO: 3653953 - DNA, 14 bp, Homo sapiens
tgggtaacactgat

SEQ ID NO: 3653954 - DNA, 21 bp, Homo sapiens
tgggtggggcagggcctggcc

SEQ ID NO: 3653955 - DNA, 12 bp, Homo sapiens
tggttccctctt

SEQ ID NO: 3653956 - DNA, 15 bp, Homo sapiens
tgtaccagggctctg

SEQ ID NO: 3653957 - DNA, 18 bp, Homo sapiens
tgtactgagttctcatcc

SEQ ID NO: 3653958 - DNA, 20 bp, Homo sapiens
tgtattctgcaacagcctgt

SEQ ID NO: 3653959 - DNA, 14 bp, Homo sapiens
tgtccctcctgagg

SEQ ID NO: 3653960 - DNA, 24 bp, Homo sapiens
tgtcgttcccttgtgtctgttgct

SEQ ID NO: 3653961 - DNA, 13 bp, Homo sapiens
tgtctgcctgcct

SEQ ID NO: 3653962 - DNA, 18 bp, Homo sapiens
tgtgcatttgtgtctgcc

SEQ ID NO: 3653963 - DNA, 21 bp, Homo sapiens
tgtgccaggactctctttctt

SEQ ID NO: 3653964 - DNA, 12 bp, Homo sapiens
tgtgtctgcctg

SEQ ID NO: 3653965 - DNA, 15 bp, Homo sapiens
tgtgtctgcctgcct

SEQ ID NO: 3653966 - DNA, 19 bp, Homo sapiens
tgtgtttcaggacagctgc

SEQ ID NO: 3653967 - DNA, 10 bp, Homo sapiens
tgttcctgcc

SEQ ID NO: 3653968 - DNA, 20 bp, Homo sapiens
tgttcctgccttctcttcta

SEQ ID NO: 3653969 - DNA, 14 bp, Homo sapiens
ttcagaataaatgg

SEQ ID NO: 3653970 - DNA, 13 bp, Homo sapiens
ttcaggacagctg

SEQ ID NO: 3653971 - DNA, 21 bp, Homo sapiens
ttccctagatggttccctttg

SEQ ID NO: 3653972 - DNA, 13 bp, Homo sapiens
ttccctctcatcc

SEQ ID NO: 3653973 - DNA, 14 bp, Homo sapiens
ttccctctcatcca

SEQ ID NO: 3653974 - DNA, 14 bp, Homo sapiens
ttccctttgttgct

SEQ ID NO: 3653975 - DNA, 16 bp, Homo sapiens
ttccgtctcctctcca

SEQ ID NO: 3653976 - DNA, 23 bp, Homo sapiens
ttcctcctcctcctcctgttcct

SEQ ID NO: 3653977 - DNA, 12 bp, Homo sapiens
ttcctctctctc

SEQ ID NO: 3653978 - DNA, 23 bp, Homo sapiens
ttcctgtgccaggactctctttc

SEQ ID NO: 3653979 - DNA, 22 bp, Homo sapiens
ttccttctcgtcttcctctctc

SEQ ID NO: 3653980 - DNA, 16 bp, Homo sapiens
ttctcgtcttcctctc

SEQ ID NO: 3653981 - DNA, 22 bp, Homo sapiens
ttctcgtcttcctctctctcac

SEQ ID NO: 3653982 - DNA, 17 bp, Homo sapiens
ttctcttctatcctgca

SEQ ID NO: 3653983 - DNA, 16 bp, Homo sapiens
ttctgcaacagcctgt

SEQ ID NO: 3653984 - DNA, 18 bp, Homo sapiens
ttctgctcacattccctc

SEQ ID NO: 3653985 - DNA, 20 bp, Homo sapiens
ttctgctcacattccctctc

SEQ ID NO: 3653986 - DNA, 22 bp, Homo sapiens
ttctgtgcatttgtgtctgcct

SEQ ID NO: 3653987 - DNA, 15 bp, Homo sapiens
ttgaggacaggagag

SEQ ID NO: 3653988 - DNA, 14 bp, Homo sapiens
ttgatgccagctgt

SEQ ID NO: 3653989 - DNA, 21 bp, Homo sapiens
ttgatgccagctgtactgagt

SEQ ID NO: 3653990 - DNA, 18 bp, Homo sapiens
ttgtgtctgcctgcctca

SEQ ID NO: 3653991 - DNA, 12 bp, Homo sapiens
ttgtgtctgttg

SEQ ID NO: 3653992 - DNA, 13 bp, Homo sapiens
tttgtgtttcaga

SEQ ID NO: 3653993 - DNA, 12 bp, Homo sapiens
tttttaggccac

SEQ ID NO: 3653994 - DNA, 15 bp, Homo sapiens
gtctcctctccagcc

SEQ ID NO: 3653995 - DNA, 20 bp, Homo sapiens
gtctgcctgcctcatgctct

SEQ ID NO: 3653996 - DNA, 17 bp, Homo sapiens
gtcttcctctctctcac

SEQ ID NO: 3653997 - DNA, 17 bp, Homo sapiens
gtgtttcaggacagctg

SEQ ID NO: 3653998 - DNA, 12 bp, Homo sapiens
gttccctctttc

SEQ ID NO: 3653999 - DNA, 20 bp, Homo sapiens
gttcccttgtgtctgttgct

SEQ ID NO: 3654000 - DNA, 20 bp, Homo sapiens
gttccctttgttgctgtctg

SEQ ID NO: 3654001 - DNA, 9 bp, Homo sapiens
gttcctgcc

SEQ ID NO: 3654002 - DNA, 11 bp, Homo sapiens
gttcctgcctt

SEQ ID NO: 3654003 - DNA, 17 bp, Homo sapiens
gttcctgccttctcttc

SEQ ID NO: 3654004 - DNA, 18 bp, Homo sapiens
gttcctgccttctcttct

SEQ ID NO: 3654005 - DNA, 21 bp, Homo sapiens
gttctcatccacagaggccag

SEQ ID NO: 3654006 - DNA, 22 bp, Homo sapiens
gttttcagtcaagttccgtctc

SEQ ID NO: 3654007 - DNA, 22 bp, Homo sapiens
taaatcaattctgatacagcct

SEQ ID NO: 3654008 - DNA, 17 bp, Homo sapiens
tactgagttctcatcca

SEQ ID NO: 3654009 - DNA, 16 bp, Homo sapiens
tagctgagctggaaag

SEQ ID NO: 3654010 - DNA, 18 bp, Homo sapiens
tattctgcaacagcctgt

SEQ ID NO: 3654011 - DNA, 19 bp, Homo sapiens
tcacattccctctcatcca

SEQ ID NO: 3654012 - DNA, 17 bp, Homo sapiens
tcactgctgtccctcct

SEQ ID NO: 3654013 - DNA, 20 bp, Homo sapiens
tcactgctgtccctcctgag

SEQ ID NO: 3654014 - DNA, 21 bp, Homo sapiens
tcactgctgtccctcctgagg

SEQ ID NO: 3654015 - DNA, 12 bp, Homo sapiens
tcagaataaatg

SEQ ID NO: 3654016 - DNA, 12 bp, Homo sapiens
tcaggacagctg

SEQ ID NO: 3654017 - DNA, 17 bp, Homo sapiens
tcaggacagctgcttct

SEQ ID NO: 3654018 - DNA, 22 bp, Homo sapiens
tcaggcatgcgaatgagctggg

SEQ ID NO: 3654019 - DNA, 21 bp, Homo sapiens
tcaggtgaaaaaggcaagcca

SEQ ID NO: 3654020 - DNA, 16 bp, Homo sapiens
tcatccacagaggcca

SEQ ID NO: 3654021 - DNA, 19 bp, Homo sapiens
tcatccaggtcctttcctt

SEQ ID NO: 3654022 - DNA, 19 bp, Homo sapiens
tccagccacccagccagga

SEQ ID NO: 3654023 - DNA, 19 bp, Homo sapiens
tccaggtcctttccttctc

SEQ ID NO: 3654024 - DNA, 15 bp, Homo sapiens
tcccagcccctggta

SEQ ID NO: 3654025 - DNA, 22 bp, Homo sapiens
tcccagcccctggtactccccc

SEQ ID NO: 3654026 - DNA, 23 bp, Homo sapiens
tcccagcccctggtactccccca

SEQ ID NO: 3654027 - DNA, 12 bp, Homo sapiens
tcccatcactgc

SEQ ID NO: 3654028 - DNA, 16 bp, Homo sapiens
tcccccagccctcagt

SEQ ID NO: 3654029 - DNA, 15 bp, Homo sapiens
tcccgaatcctgagg

SEQ ID NO: 3654030 - DNA, 14 bp, Homo sapiens
tccctctttcctgt

SEQ ID NO: 3654031 - DNA, 16 bp, Homo sapiens
tccctctttcctgtgc

SEQ ID NO: 3654032 - DNA, 13 bp, Homo sapiens
tcccttgtgtctg

SEQ ID NO: 3654033 - DNA, 17 bp, Homo sapiens
tcccttgtgtctgttgc

SEQ ID NO: 3654034 - DNA, 15 bp, Homo sapiens
tccctttgttgctgt

SEQ ID NO: 3654035 - DNA, 21 bp, Homo sapiens
tccctttgttgctgtctggct

SEQ ID NO: 3654036 - DNA, 15 bp, Homo sapiens
tccgcctctgagcca

SEQ ID NO: 3654037 - DNA, 17 bp, Homo sapiens
tccgtctcctctccagc

SEQ ID NO: 3654038 - DNA, 14 bp, Homo sapiens
tcctcctcctcctc

SEQ ID NO: 3654039 - DNA, 18 bp, Homo sapiens
tcctcctgttcctgcctt

SEQ ID NO: 3654040 - DNA, 14 bp, Homo sapiens
tcctgccttctctt

SEQ ID NO: 3654041 - DNA, 15 bp, Homo sapiens
tcctgccttctcttc

SEQ ID NO: 3654042 - DNA, 13 bp, Homo sapiens
tcctgtgccagga

SEQ ID NO: 3654043 - DNA, 21 bp, Homo sapiens
tcctgtgccaggactctcttt

SEQ ID NO: 3654044 - DNA, 13 bp, Homo sapiens
tcctgttcctgcc

SEQ ID NO: 3654045 - DNA, 19 bp, Homo sapiens
tcctgttcctgccttctct

SEQ ID NO: 3654046 - DNA, 21 bp, Homo sapiens
tcctgttcctgccttctcttc

SEQ ID NO: 3654047 - DNA, 17 bp, Homo sapiens
tccttctcgtcttcctc

SEQ ID NO: 3654048 - DNA, 18 bp, Homo sapiens
tccttctcgtcttcctct

SEQ ID NO: 3654049 - DNA, 19 bp, Homo sapiens
tccttctcgtcttcctctc

SEQ ID NO: 3654050 - DNA, 20 bp, Homo sapiens
tccttctcgtcttcctctct

SEQ ID NO: 3654051 - DNA, 13 bp, Homo sapiens
tcctttccttctc

SEQ ID NO: 3654052 - DNA, 12 bp, Homo sapiens
tcgtcttcctct

SEQ ID NO: 3654053 - DNA, 15 bp, Homo sapiens
tcgtcttcctctctc

SEQ ID NO: 3654054 - DNA, 18 bp, Homo sapiens
tcgtcttcctctctctca

SEQ ID NO: 3654055 - DNA, 14 bp, Homo sapiens
tcgttcccttgtgt

SEQ ID NO: 3654056 - DNA, 14 bp, Homo sapiens
tctaaaggactggt

SEQ ID NO: 3654057 - DNA, 18 bp, Homo sapiens
tctcacctacttcctcct

SEQ ID NO: 3654058 - DNA, 21 bp, Homo sapiens
tctcacctacttcctcctcct

SEQ ID NO: 3654059 - DNA, 13 bp, Homo sapiens
tctccagccctat

SEQ ID NO: 3654060 - DNA, 16 bp, Homo sapiens
tctcccgaatcctgag

SEQ ID NO: 3654061 - DNA, 14 bp, Homo sapiens
tctcctctccagcc

SEQ ID NO: 3654062 - DNA, 22 bp, Homo sapiens
tctctcacctacttcctcctcc

SEQ ID NO: 3654063 - DNA, 17 bp, Homo sapiens
tctcttctatcctgcaa

SEQ ID NO: 3654064 - DNA, 21 bp, Homo sapiens
tctctttcttccactaccctc

SEQ ID NO: 3654065 - DNA, 14 bp, Homo sapiens
tctgagccaggagc

SEQ ID NO: 3654066 - DNA, 19 bp, Homo sapiens
tctgcctgcctcatgctct

SEQ ID NO: 3654067 - DNA, 23 bp, Homo sapiens
tctgctcacattccctctcatcc

SEQ ID NO: 3654068 - DNA, 22 bp, Homo sapiens
tctgtgcatttgtgtctgcctg

SEQ ID NO: 3654069 - DNA, 15 bp, Homo sapiens
tcttctatcctgcaa

SEQ ID NO: 3654070 - DNA, 22 bp, Homo sapiens
tctttcttccactaccctccct

SEQ ID NO: 3654071 - DNA, 19 bp, Homo sapiens
tgacacaggggacactgaa

SEQ ID NO: 3654072 - DNA, 22 bp, Homo sapiens
tgacacaggggacactgaacct

SEQ ID NO: 3654073 - DNA, 12 bp, Homo sapiens
tgagccaggagc

SEQ ID NO: 3654074 - DNA, 13 bp, Homo sapiens
tgagccaggagcc

SEQ ID NO: 3654075 - DNA, 18 bp, Homo sapiens
tgagccaggagcctcctg

SEQ ID NO: 3654076 - DNA, 20 bp, Homo sapiens
tgagccaggagcctcctgac

SEQ ID NO: 3654077 - DNA, 13 bp, Homo sapiens
tgatgccagctgt

SEQ ID NO: 3654078 - DNA, 15 bp, Homo sapiens
tgatgcctgacacag

SEQ ID NO: 3654079 - DNA, 13 bp, Homo sapiens
tgcaacagcctgt

SEQ ID NO: 3654080 - DNA, 15 bp, Homo sapiens
tgcatttgtgtctgc

SEQ ID NO: 3654081 - DNA, 14 bp, Homo sapiens
tgcctcatgctctc

SEQ ID NO: 3654082 - DNA, 15 bp, Homo sapiens
tgcctgcctcatgct

SEQ ID NO: 3654083 - DNA, 19 bp, Homo sapiens
tgcctgcctcatgctctct

SEQ ID NO: 3654084 - DNA, 16 bp, Homo sapiens
tgccttctcttctatc

SEQ ID NO: 3654085 - DNA, 14 bp, Homo sapiens
tgctcacattccct

SEQ ID NO: 3654086 - DNA, 18 bp, Homo sapiens
tgctcacattccctctca

SEQ ID NO: 3654087 - DNA, 23 bp, Homo sapiens
tgctcctacccctgtcctggggc

SEQ ID NO: 3654088 - DNA, 13 bp, Homo sapiens
tgctgtccctcct

SEQ ID NO: 3654089 - DNA, 15 bp, Homo sapiens
tgctgtccctcctga

SEQ ID NO: 3654090 - DNA, 16 bp, Homo sapiens
tgctgtccctcctgag

SEQ ID NO: 3654091 - DNA, 23 bp, Homo sapiens
tgcttctgctcacattccctctc

SEQ ID NO: 3654092 - DNA, 12 bp, Homo sapiens
tgcttctgtgca

SEQ ID NO: 3654093 - DNA, 20 bp, Homo sapiens
tggccattttgtaccagggc

SEQ ID NO: 3654094 - DNA, 14 bp, Homo sapiens
tggcccagcctgga

SEQ ID NO: 3654095 - DNA, 16 bp, Homo sapiens
tggcccagcctggagc

SEQ ID NO: 3654096 - DNA, 19 bp, Homo sapiens
tggcccagcctggagccgt

SEQ ID NO: 3654097 - DNA, 20 bp, Homo sapiens
tggcctagtggggaggggcc

SEQ ID NO: 3654098 - DNA, 15 bp, Homo sapiens
tgggccggcagcctg

SEQ ID NO: 3654099 - DNA, 17 bp, Homo sapiens
tgggccggcagcctggt

SEQ ID NO: 3654100 - DNA, 16 bp, Homo sapiens
tgggggtctggcctag

SEQ ID NO: 3654101 - DNA, 14 bp, Homo sapiens
tgggtgtgtttcag

SEQ ID NO: 3654102 - DNA, 18 bp, Homo sapiens
tgggtgtgtttcaggaca

SEQ ID NO: 3654103 - DNA, 17 bp, Homo sapiens
aagatgagaagccaaag

SEQ ID NO: 3654104 - DNA, 15 bp, Homo sapiens
aaggactctaaaagg

SEQ ID NO: 3654105 - DNA, 23 bp, Homo sapiens
aaggatgcttctgctcacattcc

SEQ ID NO: 3654106 - DNA, 21 bp, Homo sapiens
aagggggctattccctggaga

SEQ ID NO: 3654107 - DNA, 23 bp, Homo sapiens
aagggggctattccctggagacc

SEQ ID NO: 3654108 - DNA, 20 bp, Homo sapiens
aagtccatagctgagctgga

SEQ ID NO: 3654109 - DNA, 22 bp, Homo sapiens
aagtgatttgggggtgcaatga

SEQ ID NO: 3654110 - DNA, 17 bp, Homo sapiens
aatcacattcaggcatg

SEQ ID NO: 3654111 - DNA, 13 bp, Homo sapiens
aatgagctgggcc

SEQ ID NO: 3654112 - DNA, 14 bp, Homo sapiens
aatgagctgggccc

SEQ ID NO: 3654113 - DNA, 21 bp, Homo sapiens
aatttctcccgaatcctgagg

SEQ ID NO: 3654114 - DNA, 15 bp, Homo sapiens
acaggggacactgaa

SEQ ID NO: 3654115 - DNA, 18 bp, Homo sapiens
acaggggacactgaacct

SEQ ID NO: 3654116 - DNA, 14 bp, Homo sapiens
acattcaggcatgc

SEQ ID NO: 3654117 - DNA, 12 bp, Homo sapiens
acattccctctc

SEQ ID NO: 3654118 - DNA, 23 bp, Homo sapiens
accagtaggttgaggacaggaga

SEQ ID NO: 3654119 - DNA, 20 bp, Homo sapiens
accttgttgatgccagctgt

SEQ ID NO: 3654120 - DNA, 21 bp, Homo sapiens
actccagccacccagccagga

SEQ ID NO: 3654121 - DNA, 14 bp, Homo sapiens
actcccccagccct

SEQ ID NO: 3654122 - DNA, 13 bp, Homo sapiens
acttttttctcta

SEQ ID NO: 3654123 - DNA, 14 bp, Homo sapiens
agaggccaggcatg

SEQ ID NO: 3654124 - DNA, 21 bp, Homo sapiens
agagtagggttgccagtcctg

SEQ ID NO: 3654125 - DNA, 16 bp, Homo sapiens
agatgagaagccaaag

SEQ ID NO: 3654126 - DNA, 14 bp, Homo sapiens
agcaagagatgaga

SEQ ID NO: 3654127 - DNA, 12 bp, Homo sapiens
agcagctgggca

SEQ ID NO: 3654128 - DNA, 16 bp, Homo sapiens
agcagctgggcactgg

SEQ ID NO: 3654129 - DNA, 16 bp, Homo sapiens
agccaggagcctcctg

SEQ ID NO: 3654130 - DNA, 12 bp, Homo sapiens
agctgagctgga

SEQ ID NO: 3654131 - DNA, 17 bp, Homo sapiens
agctgggcactgggccg

SEQ ID NO: 3654132 - DNA, 16 bp, Homo sapiens
agctgtactgagttct

SEQ ID NO: 3654133 - DNA, 23 bp, Homo sapiens
aggagtagaatataaacacataa

SEQ ID NO: 3654134 - DNA, 16 bp, Homo sapiens
aggcaagccacagaaa

SEQ ID NO: 3654135 - DNA, 13 bp, Homo sapiens
agggcctggcctg

SEQ ID NO: 3654136 - DNA, 17 bp, Homo sapiens
agggctccagggccagg

SEQ ID NO: 3654137 - DNA, 12 bp, Homo sapiens
aggggcctggcc

SEQ ID NO: 3654138 - DNA, 18 bp, Homo sapiens
agggggctattccctgga

SEQ ID NO: 3654139 - DNA, 16 bp, Homo sapiens
agggtgtgagggatgg

SEQ ID NO: 3654140 - DNA, 13 bp, Homo sapiens
aggtcctttcctt

SEQ ID NO: 3654141 - DNA, 16 bp, Homo sapiens
agtagggttgccagtc

SEQ ID NO: 3654142 - DNA, 15 bp, Homo sapiens
agtccatagctgagc

SEQ ID NO: 3654143 - DNA, 18 bp, Homo sapiens
agtggggaggggcctggc

SEQ ID NO: 3654144 - DNA, 13 bp, Homo sapiens
agttccgtctcct

SEQ ID NO: 3654145 - DNA, 14 bp, Homo sapiens
agttccgtctcctc

SEQ ID NO: 3654146 - DNA, 22 bp, Homo sapiens
agttctcatccacagaggccag

SEQ ID NO: 3654147 - DNA, 13 bp, Homo sapiens
atagctgagctgg

SEQ ID NO: 3654148 - DNA, 17 bp, Homo sapiens
atagctgagctggaaag

SEQ ID NO: 3654149 - DNA, 18 bp, Homo sapiens
atagtatgcagctaaaaa

SEQ ID NO: 3654150 - DNA, 22 bp, Homo sapiens
atagtatgcagctaaaaaataa

SEQ ID NO: 3654151 - DNA, 21 bp, Homo sapiens
atccctatgtcccagcccctg

SEQ ID NO: 3654152 - DNA, 22 bp, Homo sapiens
atcctgaggggatatccctatg

SEQ ID NO: 3654153 - DNA, 14 bp, Homo sapiens
atcgtgacagcagc

SEQ ID NO: 3654154 - DNA, 15 bp, Homo sapiens
atgcgaatgagctgg

SEQ ID NO: 3654155 - DNA, 15 bp, Homo sapiens
atgcttctgctcaca

SEQ ID NO: 3654156 - DNA, 14 bp, Homo sapiens
atggcccagcctgg

SEQ ID NO: 3654157 - DNA, 18 bp, Homo sapiens
atggcccagcctggagcc

SEQ ID NO: 3654158 - DNA, 15 bp, Homo sapiens
atgggtaacactgat

SEQ ID NO: 3654159 - DNA, 22 bp, Homo sapiens
atgtggccaagggctccagggc

SEQ ID NO: 3654160 - DNA, 18 bp, Homo sapiens
attcaaaataaacaataa

SEQ ID NO: 3654161 - DNA, 13 bp, Homo sapiens
attccctctcatc

SEQ ID NO: 3654162 - DNA, 17 bp, Homo sapiens
attctgcaacagcctgt

SEQ ID NO: 3654163 - DNA, 18 bp, Homo sapiens
atttgggggtgcaatgat

SEQ ID NO: 3654164 - DNA, 17 bp, Homo sapiens
atttgtgtctgcctgcc

SEQ ID NO: 3654165 - DNA, 14 bp, Homo sapiens
caaagaaatagcaa

SEQ ID NO: 3654166 - DNA, 13 bp, Homo sapiens
caactccagccac

SEQ ID NO: 3654167 - DNA, 22 bp, Homo sapiens
caactccagccacccagccagg

SEQ ID NO: 3654168 - DNA, 23 bp, Homo sapiens
caactccagccacccagccagga

SEQ ID NO: 3654169 - DNA, 20 bp, Homo sapiens
caagtccatagctgagctgg

SEQ ID NO: 3654170 - DNA, 21 bp, Homo sapiens
caagtccatagctgagctgga

SEQ ID NO: 3654171 - DNA, 23 bp, Homo sapiens
caagttccgtctcctctccagcc

SEQ ID NO: 3654172 - DNA, 12 bp, Homo sapiens
caatcacattca

SEQ ID NO: 3654173 - DNA, 18 bp, Homo sapiens
caattctgatacagcctt

SEQ ID NO: 3654174 - DNA, 15 bp, Homo sapiens
cacaggggacactga

SEQ ID NO: 3654175 - DNA, 13 bp, Homo sapiens
cacattccctctc

SEQ ID NO: 3654176 - DNA, 17 bp, Homo sapiens
cacattccctctcatcc

SEQ ID NO: 3654177 - DNA, 16 bp, Homo sapiens
cacctacttcctcctc

SEQ ID NO: 3654178 - DNA, 22 bp, Homo sapiens
cactgaaccttgttgatgccag

SEQ ID NO: 3654179 - DNA, 23 bp, Homo sapiens
cactgaaccttgttgatgccagc

SEQ ID NO: 3654180 - DNA, 19 bp, Homo sapiens
cactgggccggcagcctgg

SEQ ID NO: 3654181 - DNA, 20 bp, Homo sapiens
cactgggccggcagcctggt

SEQ ID NO: 3654182 - DNA, 16 bp, Homo sapiens
cacttcccatttgtgt

SEQ ID NO: 3654183 - DNA, 15 bp, Homo sapiens
cagccacccagccag

SEQ ID NO: 3654184 - DNA, 11 bp, Homo sapiens
cagccaggagg

SEQ ID NO: 3654185 - DNA, 14 bp, Homo sapiens
cagcctggttccct

SEQ ID NO: 3654186 - DNA, 16 bp, Homo sapiens
cagcctggttccctct

SEQ ID NO: 3654187 - DNA, 13 bp, Homo sapiens
cagctgcttctgt

SEQ ID NO: 3654188 - DNA, 16 bp, Homo sapiens
cagctgtactgagttc

SEQ ID NO: 3654189 - DNA, 17 bp, Homo sapiens
caggcatggcccagcct

SEQ ID NO: 3654190 - DNA, 20 bp, Homo sapiens
caggcatggcccagcctgga

SEQ ID NO: 3654191 - DNA, 22 bp, Homo sapiens
caggcatggcccagcctggagc

SEQ ID NO: 3654192 - DNA, 23 bp, Homo sapiens
caggcttgggctccattcccatc

SEQ ID NO: 3654193 - DNA, 23 bp, Homo sapiens
caggtcctttccttctcgtcttc

SEQ ID NO: 3654194 - DNA, 19 bp, Homo sapiens
cagtcaagttccgtctcct

SEQ ID NO: 3654195 - DNA, 11 bp, Homo sapiens
cagtcctgcaa

SEQ ID NO: 3654196 - DNA, 20 bp, Homo sapiens
catcaaagatgagaagccaa

SEQ ID NO: 3654197 - DNA, 18 bp, Homo sapiens
catcactgctgtccctcc

SEQ ID NO: 3654198 - DNA, 19 bp, Homo sapiens
catcactgctgtccctcct

SEQ ID NO: 3654199 - DNA, 13 bp, Homo sapiens
catccgcctctga

SEQ ID NO: 3654200 - DNA, 17 bp, Homo sapiens
catccgcctctgagcca

SEQ ID NO: 3654201 - DNA, 19 bp, Homo sapiens
catccgcctctgagccagg

SEQ ID NO: 3654202 - DNA, 16 bp, Homo sapiens
catggcccagcctgga

SEQ ID NO: 3654203 - DNA, 18 bp, Homo sapiens
catggcccagcctggagc

SEQ ID NO: 3654204 - DNA, 23 bp, Homo sapiens
catgtgactgtattacctattca

SEQ ID NO: 3654205 - DNA, 18 bp, Homo sapiens
cattcccatcactgctgt

SEQ ID NO: 3654206 - DNA, 15 bp, Homo sapiens
catttgtgtctgcct

SEQ ID NO: 3654207 - DNA, 20 bp, Homo sapiens
catttgtgtctgcctgcctc

SEQ ID NO: 3654208 - DNA, 19 bp, Homo sapiens
ccacagaggccaggcatgg

SEQ ID NO: 3654209 - DNA, 12 bp, Homo sapiens
ccagcctggagc

SEQ ID NO: 3654210 - DNA, 16 bp, Homo sapiens
ccagctgtactgagtt

SEQ ID NO: 3654211 - DNA, 20 bp, Homo sapiens
ccaggactctctttcttcca

SEQ ID NO: 3654212 - DNA, 19 bp, Homo sapiens
ccaggagcctcctgaccct

SEQ ID NO: 3654213 - DNA, 20 bp, Homo sapiens
ccaggcatggcccagcctgg

SEQ ID NO: 3654214 - DNA, 18 bp, Homo sapiens
ccagggtgtgagggatgg

SEQ ID NO: 3654215 - DNA, 23 bp, Homo sapiens
ccaggtcctttccttctcgtctt

SEQ ID NO: 3654216 - DNA, 19 bp, Homo sapiens
ccagtaggttgaggacagg

SEQ ID NO: 3654217 - DNA, 17 bp, Homo sapiens
cccagccaggaggggct

SEQ ID NO: 3654218 - DNA, 17 bp, Homo sapiens
cccctacaactccagcc

SEQ ID NO: 3654219 - DNA, 24 bp, Homo sapiens
ccctatgtcccagcccctggtact

SEQ ID NO: 3654220 - DNA, 15 bp, Homo sapiens
ccctccctcgcatcc

SEQ ID NO: 3654221 - DNA, 24 bp, Homo sapiens
ccctcgcatccgcctctgagccag

SEQ ID NO: 3654222 - DNA, 18 bp, Homo sapiens
ccctctttcctgtgccag

SEQ ID NO: 3654223 - DNA, 14 bp, Homo sapiens
ccctgtgatgcctg

SEQ ID NO: 3654224 - DNA, 20 bp, Homo sapiens
ccctgtgtgtcgttcccttg

SEQ ID NO: 3654225 - DNA, 12 bp, Homo sapiens
cccttgtgtctg

SEQ ID NO: 3654226 - DNA, 15 bp, Homo sapiens
ccctttgttgctgtc

SEQ ID NO: 3654227 - DNA, 13 bp, Homo sapiens
ccggcagcctggt

SEQ ID NO: 3654228 - DNA, 23 bp, Homo sapiens
ccggcagcctggttccctctttc

SEQ ID NO: 3654229 - DNA, 16 bp, Homo sapiens
cctacttcctcctcct

SEQ ID NO: 3654230 - DNA, 18 bp, Homo sapiens
cctagatggttccctttg

SEQ ID NO: 3654231 - DNA, 12 bp, Homo sapiens
cctagtggggag

SEQ ID NO: 3654232 - DNA, 20 bp, Homo sapiens
cctagtggggaggggcctgg

SEQ ID NO: 3654233 - DNA, 13 bp, Homo sapiens
cctcatgctctct

SEQ ID NO: 3654234 - DNA, 13 bp, Homo sapiens
cctcctcctcctc

SEQ ID NO: 3654235 - DNA, 14 bp, Homo sapiens
cctcctcctgttcc

SEQ ID NO: 3654236 - DNA, 15 bp, Homo sapiens
cctcctgttcctgcc

SEQ ID NO: 3654237 - DNA, 17 bp, Homo sapiens
cctcctgttcctgcctt

SEQ ID NO: 3654238 - DNA, 20 bp, Homo sapiens
cctcgcatccgcctctgagc

SEQ ID NO: 3654239 - DNA, 23 bp, Homo sapiens
cctctcatccaggtcctttcctt

SEQ ID NO: 3654240 - DNA, 10 bp, Homo sapiens
cctctctctc

SEQ ID NO: 3654241 - DNA, 20 bp, Homo sapiens
cctctctctcacctacttcc

SEQ ID NO: 3654242 - DNA, 11 bp, Homo sapiens
cctctgagcca

SEQ ID NO: 3654243 - DNA, 18 bp, Homo sapiens
cctctgagccaggagcct

SEQ ID NO: 3654244 - DNA, 20 bp, Homo sapiens
cctgccttctcttctatcct

SEQ ID NO: 3654245 - DNA, 19 bp, Homo sapiens
cctggagccgtggccgagg

SEQ ID NO: 3654246 - DNA, 12 bp, Homo sapiens
cctggcctgggt

SEQ ID NO: 3654247 - DNA, 13 bp, Homo sapiens
cctggcctggtcc

SEQ ID NO: 3654248 - DNA, 20 bp, Homo sapiens
cctggtactcccccagccct

SEQ ID NO: 3654249 - DNA, 13 bp, Homo sapiens
cctggttccctct

SEQ ID NO: 3654250 - DNA, 14 bp, Homo sapiens
cctggttccctctt

SEQ ID NO: 3654251 - DNA, 18 bp, Homo sapiens
cctggttccctctttcct

SEQ ID NO: 3654252 - DNA, 14 bp, Homo sapiens
cctgtgatgcctga

SEQ ID NO: 3654253 - DNA, 22 bp, Homo sapiens
cctgtgccaggactctctttct

SEQ ID NO: 3654254 - DNA, 17 bp, Homo sapiens
cctgttcctgccttctc

SEQ ID NO: 3654255 - DNA, 21 bp, Homo sapiens
cctgttcctgccttctcttct

SEQ ID NO: 3654256 - DNA, 22 bp, Homo sapiens
cctgttcctgccttctcttcta

SEQ ID NO: 3654257 - DNA, 18 bp, Homo sapiens
cctgtttgggaggctgga

SEQ ID NO: 3654258 - DNA, 22 bp, Homo sapiens
ccttctcgtcttcctctctctc

SEQ ID NO: 3654259 - DNA, 15 bp, Homo sapiens
ccttgttgatgccag

SEQ ID NO: 3654260 - DNA, 23 bp, Homo sapiens
ccttgttgatgccagctgtactg

SEQ ID NO: 3654261 - DNA, 12 bp, Homo sapiens
cctttccttctc

SEQ ID NO: 3654262 - DNA, 14 bp, Homo sapiens
cctttccttctcgt

SEQ ID NO: 3654263 - DNA, 20 bp, Homo sapiens
cgaatgagctgggccctggg

SEQ ID NO: 3654264 - DNA, 12 bp, Homo sapiens
cggcagcctggt

SEQ ID NO: 3654265 - DNA, 20 bp, Homo sapiens
cggcagcctggttccctctt

SEQ ID NO: 3654266 - DNA, 14 bp, Homo sapiens
ctaaaggactggtt

SEQ ID NO: 3654267 - DNA, 14 bp, Homo sapiens
ctacccctgtcctg

SEQ ID NO: 3654268 - DNA, 13 bp, Homo sapiens
ctaccctccctcg

SEQ ID NO: 3654269 - DNA, 16 bp, Homo sapiens
ctacttcctcctcctc

SEQ ID NO: 3654270 - DNA, 20 bp, Homo sapiens
ctagatggttccctttgttg

SEQ ID NO: 3654271 - DNA, 13 bp, Homo sapiens
ctatagaggagga

SEQ ID NO: 3654272 - DNA, 13 bp, Homo sapiens
ctatgtcccagcc

SEQ ID NO: 3654273 - DNA, 19 bp, Homo sapiens
ctatgtcccagcccctggt

SEQ ID NO: 3654274 - DNA, 19 bp, Homo sapiens
ctattcagaataaatgggt

SEQ ID NO: 3654275 - DNA, 19 bp, Homo sapiens
ctcacattccctctcatcc

SEQ ID NO: 3654276 - DNA, 18 bp, Homo sapiens
ctcatccaggtcctttcc

SEQ ID NO: 3654277 - DNA, 14 bp, Homo sapiens
ctcatgctctctat

SEQ ID NO: 3654278 - DNA, 14 bp, Homo sapiens
ctccaaggactcta

SEQ ID NO: 3654279 - DNA, 22 bp, Homo sapiens
ctccattcccatcactgctgtc

SEQ ID NO: 3654280 - DNA, 13 bp, Homo sapiens
ctcccgaatcctg

SEQ ID NO: 3654281 - DNA, 14 bp, Homo sapiens
ctcccgaatcctga

SEQ ID NO: 3654282 - DNA, 15 bp, Homo sapiens
ctcccgaatcctgag

SEQ ID NO: 3654283 - DNA, 15 bp, Homo sapiens
ctcctacccctgtcc

SEQ ID NO: 3654284 - DNA, 23 bp, Homo sapiens
ctcctacccctgtcctggggctg

SEQ ID NO: 3654285 - DNA, 15 bp, Homo sapiens
ctcctcctcctgttc

SEQ ID NO: 3654286 - DNA, 15 bp, Homo sapiens
ctcctcctgttcctg

SEQ ID NO: 3654287 - DNA, 12 bp, Homo sapiens
ctcctctccagc

SEQ ID NO: 3654288 - DNA, 13 bp, Homo sapiens
ctcctgaggtctg

SEQ ID NO: 3654289 - DNA, 17 bp, Homo sapiens
ctcctgaggtctggatt

SEQ ID NO: 3654290 - DNA, 18 bp, Homo sapiens
ctcgcatccgcctctgag

SEQ ID NO: 3654291 - DNA, 19 bp, Homo sapiens
ctctcacctacttcctcct

SEQ ID NO: 3654292 - DNA, 19 bp, Homo sapiens
ctctctcacctacttcctc

SEQ ID NO: 3654293 - DNA, 13 bp, Homo sapiens
ctctgagccagga

SEQ ID NO: 3654294 - DNA, 16 bp, Homo sapiens
ctcttctatcctgcaa

SEQ ID NO: 3654295 - DNA, 12 bp, Homo sapiens
ctctttcctgtg

SEQ ID NO: 3654296 - DNA, 13 bp, Homo sapiens
ctctttcctgtgc

SEQ ID NO: 3654297 - DNA, 22 bp, Homo sapiens
ctctttcttccactaccctccc

SEQ ID NO: 3654298 - DNA, 18 bp, Homo sapiens
ctgaccctgtgatgcctg

SEQ ID NO: 3654299 - DNA, 13 bp, Homo sapiens
ctgagccaggagc

SEQ ID NO: 3654300 - DNA, 21 bp, Homo sapiens
ctgagccaggagcctcctgac

SEQ ID NO: 3654301 - DNA, 23 bp, Homo sapiens
ctgagctggaaaggatgcttctg

SEQ ID NO: 3654302 - DNA, 15 bp, Homo sapiens
ctgaggtctggattg

SEQ ID NO: 3654303 - DNA, 14 bp, Homo sapiens
ctgcaacagcctgt

SEQ ID NO: 3654304 - DNA, 22 bp, Homo sapiens
ctgcaagtccatagctgagctg

SEQ ID NO: 3654305 - DNA, 23 bp, Homo sapiens
ctgcaagtccatagctgagctgg

SEQ ID NO: 3654306 - DNA, 16 bp, Homo sapiens
ctgccttctcttctat

SEQ ID NO: 3654307 - DNA, 15 bp, Homo sapiens
ctgctcacattccct

SEQ ID NO: 3654308 - DNA, 19 bp, Homo sapiens
ctgggccggcagcctggtt

SEQ ID NO: 3654309 - DNA, 12 bp, Homo sapiens
ctgtattctgca

SEQ ID NO: 3654310 - DNA, 21 bp, Homo sapiens
ctgtattctgcaacagcctgt

SEQ ID NO: 3654311 - DNA, 17 bp, Homo sapiens
ctgtccaatcacattca

SEQ ID NO: 3654312 - DNA, 17 bp, Homo sapiens
ctgtgatgcctgacaca

SEQ ID NO: 3654313 - DNA, 18 bp, Homo sapiens
ctgttcctgccttctctt

SEQ ID NO: 3654314 - DNA, 20 bp, Homo sapiens
ctgtttgggaggctggagtg

SEQ ID NO: 3654315 - DNA, 18 bp, Homo sapiens
cttctgctcacattccct

SEQ ID NO: 3654316 - DNA, 17 bp, Homo sapiens
gaaaggatgcttctgct

SEQ ID NO: 3654317 - DNA, 22 bp, Homo sapiens
gaaccttgttgatgccagctgt

SEQ ID NO: 3654318 - DNA, 13 bp, Homo sapiens
gaagaatggccat

SEQ ID NO: 3654319 - DNA, 15 bp, Homo sapiens
gaatgagctgggccc

SEQ ID NO: 3654320 - DNA, 15 bp, Homo sapiens
gaccccagagtaggg

SEQ ID NO: 3654321 - DNA, 22 bp, Homo sapiens
gaccctgtgatgcctgacacag

SEQ ID NO: 3654322 - DNA, 12 bp, Homo sapiens
gagccaggagcc

SEQ ID NO: 3654323 - DNA, 13 bp, Homo sapiens
gagccaggagcct

SEQ ID NO: 3654324 - DNA, 14 bp, Homo sapiens
gagccaggagcctc

SEQ ID NO: 3654325 - DNA, 23 bp, Homo sapiens
gaggatggtcatcgtgacagcag

SEQ ID NO: 3654326 - DNA, 12 bp, Homo sapiens
gaggggcctggc

SEQ ID NO: 3654327 - DNA, 13 bp, Homo sapiens
gaggggcctggcc

SEQ ID NO: 3654328 - DNA, 19 bp, Homo sapiens
gaggggcctggcctgggtg

SEQ ID NO: 3654329 - DNA, 17 bp, Homo sapiens
gagtagggttgccagtc

SEQ ID NO: 3654330 - DNA, 19 bp, Homo sapiens
gagtagggttgccagtcct

SEQ ID NO: 3654331 - DNA, 19 bp, Homo sapiens
gagttctcatccacagagg

SEQ ID NO: 3654332 - DNA, 12 bp, Homo sapiens
gatgccagctgt

SEQ ID NO: 3654333 - DNA, 14 bp, Homo sapiens
gatgcctgacacag

SEQ ID NO: 3654334 - DNA, 20 bp, Homo sapiens
gatgcttctgctcacattcc

SEQ ID NO: 3654335 - DNA, 13 bp, Homo sapiens
gcaagagatgaga

SEQ ID NO: 3654336 - DNA, 13 bp, Homo sapiens
gcaagccacagaa

SEQ ID NO: 3654337 - DNA, 20 bp, Homo sapiens
gcactgggccggcagcctgg

SEQ ID NO: 3654338 - DNA, 17 bp, Homo sapiens
gcatgcgaatgagctgg

SEQ ID NO: 3654339 - DNA, 15 bp, Homo sapiens
gcatggcccagcctg

SEQ ID NO: 3654340 - DNA, 16 bp, Homo sapiens
gcatggcccagcctgg

SEQ ID NO: 3654341 - DNA, 19 bp, Homo sapiens
gcatggcccagcctggagc

SEQ ID NO: 3654342 - DNA, 18 bp, Homo sapiens
gcatttgtgtctgcctgc

SEQ ID NO: 3654343 - DNA, 23 bp, Homo sapiens
gccaagggctccagggccagggt

SEQ ID NO: 3654344 - DNA, 11 bp, Homo sapiens
gccacagaaat

SEQ ID NO: 3654345 - DNA, 14 bp, Homo sapiens
gccacccagccagg

SEQ ID NO: 3654346 - DNA, 14 bp, Homo sapiens
gccaggactctctt

SEQ ID NO: 3654347 - DNA, 16 bp, Homo sapiens
gccaggagcctcctga

SEQ ID NO: 3654348 - DNA, 18 bp, Homo sapiens
gccaggaggggctgtcca

SEQ ID NO: 3654349 - DNA, 12 bp, Homo sapiens
gcccagcctgga

SEQ ID NO: 3654350 - DNA, 23 bp, Homo sapiens
gcctagtggggaggggcctggcc

SEQ ID NO: 3654351 - DNA, 14 bp, Homo sapiens
gcctctgagccagg

SEQ ID NO: 3654352 - DNA, 13 bp, Homo sapiens
gcctggcctgggt

SEQ ID NO: 3654353 - DNA, 12 bp, Homo sapiens
gcctggcctggt

SEQ ID NO: 3654354 - DNA, 15 bp, Homo sapiens
gcctggttccctctt

SEQ ID NO: 3654355 - DNA, 20 bp, Homo sapiens
gcctggttccctctttcctg

SEQ ID NO: 3654356 - DNA, 14 bp, Homo sapiens
gcgaatgagctggg

SEQ ID NO: 3654357 - DNA, 16 bp, Homo sapiens
gctcacattccctctc

SEQ ID NO: 3654358 - DNA, 18 bp, Homo sapiens
gctcacattccctctcat

SEQ ID NO: 3654359 - DNA, 12 bp, Homo sapiens
gctccattccca

SEQ ID NO: 3654360 - DNA, 15 bp, Homo sapiens
gctccattcccatca

SEQ ID NO: 3654361 - DNA, 14 bp, Homo sapiens
gctctgtattctgc

SEQ ID NO: 3654362 - DNA, 11 bp, Homo sapiens
gctgcttctgt

SEQ ID NO: 3654363 - DNA, 14 bp, Homo sapiens
gctgcttctgtgca

SEQ ID NO: 3654364 - DNA, 15 bp, Homo sapiens
gcttccctagatggt

SEQ ID NO: 3654365 - DNA, 12 bp, Homo sapiens
gcttctgctcac

SEQ ID NO: 3654366 - DNA, 15 bp, Homo sapiens
gcttgggctccattc

SEQ ID NO: 3654367 - DNA, 16 bp, Homo sapiens
ggaggggcctggcctg

SEQ ID NO: 3654368 - DNA, 12 bp, Homo sapiens
ggagttgctcct

SEQ ID NO: 3654369 - DNA, 18 bp, Homo sapiens
ggatggggagcagctggg

SEQ ID NO: 3654370 - DNA, 22 bp, Homo sapiens
ggatggtcatcgtgacagcagc

SEQ ID NO: 3654371 - DNA, 16 bp, Homo sapiens
ggcatgcgaatgagct

SEQ ID NO: 3654372 - DNA, 21 bp, Homo sapiens
ggcatggcccagcctggagcc

SEQ ID NO: 3654373 - DNA, 15 bp, Homo sapiens
ggcccagcctggagc

SEQ ID NO: 3654374 - DNA, 14 bp, Homo sapiens
ggccggcagcctgg

SEQ ID NO: 3654375 - DNA, 21 bp, Homo sapiens
ggcctagtggggaggggcctg

SEQ ID NO: 3654376 - DNA, 19 bp, Homo sapiens
ggctgtccaatcacattca

SEQ ID NO: 3654377 - DNA, 13 bp, Homo sapiens
gggagcagctggg

SEQ ID NO: 3654378 - DNA, 19 bp, Homo sapiens
gggaggggcctggcctggg

SEQ ID NO: 3654379 - DNA, 14 bp, Homo sapiens
gggcctggcctggg

SEQ ID NO: 3654380 - DNA, 17 bp, Homo sapiens
gggctattccctggaga

SEQ ID NO: 3654381 - DNA, 20 bp, Homo sapiens
gggcttccctagatggttcc

SEQ ID NO: 3654382 - DNA, 15 bp, Homo sapiens
ggggacactgaacct

SEQ ID NO: 3654383 - DNA, 18 bp, Homo sapiens
ggggctattccctggaga

SEQ ID NO: 3654384 - DNA, 21 bp, Homo sapiens
gggtgcaatgataatgaagaa

SEQ ID NO: 3654385 - DNA, 12 bp, Homo sapiens
ggtcctttcctt

SEQ ID NO: 3654386 - DNA, 21 bp, Homo sapiens
ggtcctttccttctcgtcttc

SEQ ID NO: 3654387 - DNA, 21 bp, Homo sapiens
ggtgtgtttcaggacagctgc

SEQ ID NO: 3654388 - DNA, 14 bp, Homo sapiens
ggttccctctttcc

SEQ ID NO: 3654389 - DNA, 16 bp, Homo sapiens
gtactcccccagccct

SEQ ID NO: 3654390 - DNA, 17 bp, Homo sapiens
gtactcccccagccctc

SEQ ID NO: 3654391 - DNA, 16 bp, Homo sapiens
gtaggttgaggacagg

SEQ ID NO: 3654392 - DNA, 22 bp, Homo sapiens
gtcaagttccgtctcctctcca

SEQ ID NO: 3654393 - DNA, 21 bp, Homo sapiens
gtcctgcaagtccatagctga

SEQ ID NO: 3654394 - DNA, 14 bp, Homo sapiens
gtcctttccttctc

SEQ ID NO: 3654395 - DNA, 17 bp, Homo sapiens
gtctgcctgcctcatgc

SEQ ID NO: 3654396 - DNA, 18 bp, Homo sapiens
gtgcatttgtgtctgcct

SEQ ID NO: 3654397 - DNA, 17 bp, Homo sapiens
gtgccaggactctcttt

SEQ ID NO: 3654398 - DNA, 22 bp, Homo sapiens
gttccgtctcctctccagccct

SEQ ID NO: 3654399 - DNA, 14 bp, Homo sapiens
gttcctgccttctc

SEQ ID NO: 3654400 - DNA, 15 bp, Homo sapiens
gttcctgccttctct

SEQ ID NO: 3654401 - DNA, 23 bp, Homo sapiens
gttctcatccacagaggccaggc

SEQ ID NO: 3654402 - DNA, 23 bp, Homo sapiens
taaaagggggctattccctggag

SEQ ID NO: 3654403 - DNA, 13 bp, Homo sapiens
tacccctgtcctg

SEQ ID NO: 3654404 - DNA, 12 bp, Homo sapiens
taccctccctcg

SEQ ID NO: 3654405 - DNA, 21 bp, Homo sapiens
tacttcctcctcctcctcctg

SEQ ID NO: 3654406 - DNA, 24 bp, Homo sapiens
tacttcctcctcctcctcctgttc

SEQ ID NO: 3654407 - DNA, 15 bp, Homo sapiens
tagaatataaacaca

SEQ ID NO: 3654408 - DNA, 18 bp, Homo sapiens
tagaatataaacacataa

SEQ ID NO: 3654409 - DNA, 18 bp, Homo sapiens
tagggttgccagtcctgc

SEQ ID NO: 3654410 - DNA, 20 bp, Homo sapiens
tagtggggaggggcctggcc

SEQ ID NO: 3654411 - DNA, 14 bp, Homo sapiens
tatgtcccagcccc

SEQ ID NO: 3654412 - DNA, 19 bp, Homo sapiens
tattctgcaacagcctgtt

SEQ ID NO: 3654413 - DNA, 18 bp, Homo sapiens
tcaagttccgtctcctct

SEQ ID NO: 3654414 - DNA, 21 bp, Homo sapiens
tcaagttccgtctcctctcca

SEQ ID NO: 3654415 - DNA, 13 bp, Homo sapiens
tcacattccctct

SEQ ID NO: 3654416 - DNA, 14 bp, Homo sapiens
tcacattccctctc

SEQ ID NO: 3654417 - DNA, 16 bp, Homo sapiens
tcacattccctctcat

SEQ ID NO: 3654418 - DNA, 15 bp, Homo sapiens
tcacctacttcctcc

SEQ ID NO: 3654419 - DNA, 17 bp, Homo sapiens
tcacctacttcctcctc

SEQ ID NO: 3654420 - DNA, 18 bp, Homo sapiens
tcactgctgtccctcctg

SEQ ID NO: 3654421 - DNA, 22 bp, Homo sapiens
tcagagtggccaatccctgtgt

SEQ ID NO: 3654422 - DNA, 19 bp, Homo sapiens
tcaggacagctgcttctgt

SEQ ID NO: 3654423 - DNA, 22 bp, Homo sapiens
tcagtcaagttccgtctcctct

SEQ ID NO: 3654424 - DNA, 23 bp, Homo sapiens
tcagtcaagttccgtctcctctc

SEQ ID NO: 3654425 - DNA, 15 bp, Homo sapiens
tcatccacagaggcc

SEQ ID NO: 3654426 - DNA, 15 bp, Homo sapiens
tccacagaggccagg

SEQ ID NO: 3654427 - DNA, 14 bp, Homo sapiens
tccactaccctccc

SEQ ID NO: 3654428 - DNA, 21 bp, Homo sapiens
tccactaccctccctcgcatc

SEQ ID NO: 3654429 - DNA, 23 bp, Homo sapiens
tccaggcttgggctccattccca

SEQ ID NO: 3654430 - DNA, 16 bp, Homo sapiens
tccaggtcctttcctt

SEQ ID NO: 3654431 - DNA, 18 bp, Homo sapiens
tccaggtcctttccttct

SEQ ID NO: 3654432 - DNA, 15 bp, Homo sapiens
tcccatttgtgtttc

SEQ ID NO: 3654433 - DNA, 21 bp, Homo sapiens
tccctcgcatccgcctctgag

SEQ ID NO: 3654434 - DNA, 14 bp, Homo sapiens
tccctttgttgctg

SEQ ID NO: 3654435 - DNA, 18 bp, Homo sapiens
tccgcctctgagccagga

SEQ ID NO: 3654436 - DNA, 21 bp, Homo sapiens
tccgcctctgagccaggagcc

SEQ ID NO: 3654437 - DNA, 20 bp, Homo sapiens
tcctacccctgtcctggggc

SEQ ID NO: 3654438 - DNA, 15 bp, Homo sapiens
tcctcctcctcctgt

SEQ ID NO: 3654439 - DNA, 15 bp, Homo sapiens
tcctcctgttcctgc

SEQ ID NO: 3654440 - DNA, 17 bp, Homo sapiens
tcctcctgttcctgcct

SEQ ID NO: 3654441 - DNA, 19 bp, Homo sapiens
tcctcctgttcctgccttc

SEQ ID NO: 3654442 - DNA, 22 bp, Homo sapiens
tcctcctgttcctgccttctct

SEQ ID NO: 3654443 - DNA, 23 bp, Homo sapiens
tcctggggctgggtgtgtttcag

SEQ ID NO: 3654444 - DNA, 14 bp, Homo sapiens
tcctgttcctgcct

SEQ ID NO: 3654445 - DNA, 15 bp, Homo sapiens
tcctgttcctgcctt

SEQ ID NO: 3654446 - DNA, 23 bp, Homo sapiens
tccttctcgtcttcctctctctc

SEQ ID NO: 3654447 - DNA, 15 bp, Homo sapiens
tcctttccttctcgt

SEQ ID NO: 3654448 - DNA, 23 bp, Homo sapiens
tcgcatccgcctctgagccagga

SEQ ID NO: 3654449 - DNA, 20 bp, Homo sapiens
tctcatccaggtcctttcct

SEQ ID NO: 3654450 - DNA, 23 bp, Homo sapiens
tctcatccaggtcctttccttct

SEQ ID NO: 3654451 - DNA, 17 bp, Homo sapiens
tctcccgaatcctgagg

SEQ ID NO: 3654452 - DNA, 13 bp, Homo sapiens
tctctcacctact

SEQ ID NO: 3654453 - DNA, 16 bp, Homo sapiens
tctctcacctacttcc

SEQ ID NO: 3654454 - DNA, 21 bp, Homo sapiens
tctgcctgcctcatgctctct

SEQ ID NO: 3654455 - DNA, 18 bp, Homo sapiens
tctgctcacattccctct

SEQ ID NO: 3654456 - DNA, 21 bp, Homo sapiens
tctgctcacattccctctcat

SEQ ID NO: 3654457 - DNA, 14 bp, Homo sapiens
tctgtattctgcaa

SEQ ID NO: 3654458 - DNA, 22 bp, Homo sapiens
tcttcaggtgaaaaaggcaagc

SEQ ID NO: 3654459 - DNA, 14 bp, Homo sapiens
tcttctatcctgca

SEQ ID NO: 3654460 - DNA, 21 bp, Homo sapiens
tgaaccttgttgatgccagct

SEQ ID NO: 3654461 - DNA, 18 bp, Homo sapiens
tgaccctgtgatgcctga

SEQ ID NO: 3654462 - DNA, 22 bp, Homo sapiens
tgagctggaaaggatgcttctg

SEQ ID NO: 3654463 - DNA, 16 bp, Homo sapiens
tgagctgggccctggg

SEQ ID NO: 3654464 - DNA, 14 bp, Homo sapiens
tgaggacaggagag

SEQ ID NO: 3654465 - DNA, 12 bp, Homo sapiens
tgatacagcctt

SEQ ID NO: 3654466 - DNA, 21 bp, Homo sapiens
tgatgccagctgtactgagtt

SEQ ID NO: 3654467 - DNA, 13 bp, Homo sapiens
tgccagtcctgca

SEQ ID NO: 3654468 - DNA, 16 bp, Homo sapiens
tgcctcatgctctcta

SEQ ID NO: 3654469 - DNA, 13 bp, Homo sapiens
tgccttctcttct

SEQ ID NO: 3654470 - DNA, 21 bp, Homo sapiens
tgctcctacccctgtcctggg

SEQ ID NO: 3654471 - DNA, 12 bp, Homo sapiens
tgcttctgctca

SEQ ID NO: 3654472 - DNA, 13 bp, Homo sapiens
tggcccagcctgg

SEQ ID NO: 3654473 - DNA, 22 bp, Homo sapiens
tggcctagtggggaggggcctg

SEQ ID NO: 3654474 - DNA, 16 bp, Homo sapiens
tgggccggcagcctgg

SEQ ID NO: 3654475 - DNA, 15 bp, Homo sapiens
tggggagcagctggg

SEQ ID NO: 3654476 - DNA, 20 bp, Homo sapiens
tggggaggggcctggcctgg

SEQ ID NO: 3654477 - DNA, 19 bp, Homo sapiens
tggggatggggacaaagaa

SEQ ID NO: 3654478 - DNA, 17 bp, Homo sapiens
tggggcagggcctggcc

SEQ ID NO: 3654479 - DNA, 14 bp, Homo sapiens
tgtcccagcccctg

SEQ ID NO: 3654480 - DNA, 16 bp, Homo sapiens
tgtcccagcccctggt

SEQ ID NO: 3654481 - DNA, 14 bp, Homo sapiens
tgtctgcctgcctc

SEQ ID NO: 3654482 - DNA, 15 bp, Homo sapiens
tgtgcatttgtgtct

SEQ ID NO: 3654483 - DNA, 13 bp, Homo sapiens
tgtgtctgcctgc

SEQ ID NO: 3654484 - DNA, 11 bp, Homo sapiens
tgtgtttcagg

SEQ ID NO: 3654485 - DNA, 24 bp, Homo sapiens
tgtgtttcaggacagctgcttctg

SEQ ID NO: 3654486 - DNA, 13 bp, Homo sapiens
tgttcctgccttc

SEQ ID NO: 3654487 - DNA, 17 bp, Homo sapiens
tgttcctgccttctctt

SEQ ID NO: 3654488 - DNA, 13 bp, Homo sapiens
tgttgctgtctgg

SEQ ID NO: 3654489 - DNA, 17 bp, Homo sapiens
tgttgctgtctggcttt

SEQ ID NO: 3654490 - DNA, 18 bp, Homo sapiens
tgtttgggaggctggagt

SEQ ID NO: 3654491 - DNA, 14 bp, Homo sapiens
ttacaatacaatag

SEQ ID NO: 3654492 - DNA, 21 bp, Homo sapiens
ttcaaaataaacaataaatgg

SEQ ID NO: 3654493 - DNA, 17 bp, Homo sapiens
ttcccatcactgctgtc

SEQ ID NO: 3654494 - DNA, 15 bp, Homo sapiens
ttcctctctctcacc

SEQ ID NO: 3654495 - DNA, 21 bp, Homo sapiens
ttcctgtgccaggactctctt

SEQ ID NO: 3654496 - DNA, 13 bp, Homo sapiens
ttctcttctatcc

SEQ ID NO: 3654497 - DNA, 17 bp, Homo sapiens
ttctgctcacattccct

SEQ ID NO: 3654498 - DNA, 21 bp, Homo sapiens
ttctgctcacattccctctca

SEQ ID NO: 3654499 - DNA, 21 bp, Homo sapiens
ttctgtgcatttgtgtctgcc

SEQ ID NO: 3654500 - DNA, 15 bp, Homo sapiens
ttgccagtcctgcaa

SEQ ID NO: 3654501 - DNA, 12 bp, Homo sapiens
ttgctcctaccc

SEQ ID NO: 3654502 - DNA, 20 bp, Homo sapiens
ttgctcctacccctgtcctg

SEQ ID NO: 3654503 - DNA, 15 bp, Homo sapiens
ttgctgtctggcttt

SEQ ID NO: 3654504 - DNA, 11 bp, Homo sapiens
tttcaggacag

SEQ ID NO: 3654505 - DNA, 21 bp, Homo sapiens
tttcaggacagctgcttctgt

SEQ ID NO: 3654506 - DNA, 22 bp, Homo sapiens
tttcctgtgccaggactctctt

SEQ ID NO: 3654507 - DNA, 20 bp, Homo sapiens
tttccttctcgtcttcctct

SEQ ID NO: 3654508 - DNA, 22 bp, Homo sapiens
tttccttctcgtcttcctctct

SEQ ID NO: 3654509 - DNA, 20 bp, Homo sapiens
tttcttccactaccctccct

SEQ ID NO: 3654510 - DNA, 15 bp, Homo sapiens
tttgtgtctgcctgc

SEQ ID NO: 3654511 - DNA, 23 bp, Homo sapiens
aaaagggggctattccctggaga

SEQ ID NO: 3654512 - DNA, 13 bp, Homo sapiens
aaacaacagaaac

SEQ ID NO: 3654513 - DNA, 22 bp, Homo sapiens
aaagggggctattccctggaga

SEQ ID NO: 3654514 - DNA, 22 bp, Homo sapiens
aacagcctgtttgggaggctgg

SEQ ID NO: 3654515 - DNA, 21 bp, Homo sapiens
aactccagccacccagccagg

SEQ ID NO: 3654516 - DNA, 16 bp, Homo sapiens
aagatgagaagccaaa

SEQ ID NO: 3654517 - DNA, 13 bp, Homo sapiens
aagccacagaaat

SEQ ID NO: 3654518 - DNA, 18 bp, Homo sapiens
aagggtgggcatcaaaga

SEQ ID NO: 3654519 - DNA, 23 bp, Homo sapiens
aagggtgggcatcaaagatgaga

SEQ ID NO: 3654520 - DNA, 19 bp, Homo sapiens
aatacaatagtatgcagct

SEQ ID NO: 3654521 - DNA, 11 bp, Homo sapiens
aatcacattca

SEQ ID NO: 3654522 - DNA, 23 bp, Homo sapiens
aatcagagtggccaatccctgtg

SEQ ID NO: 3654523 - DNA, 13 bp, Homo sapiens
acaactccagcca

SEQ ID NO: 3654524 - DNA, 17 bp, Homo sapiens
acacttacacccttttg

SEQ ID NO: 3654525 - DNA, 15 bp, Homo sapiens
acagaggccaggcat

SEQ ID NO: 3654526 - DNA, 22 bp, Homo sapiens
acagcctgtttgggaggctgga

SEQ ID NO: 3654527 - DNA, 12 bp, Homo sapiens
accagggctctg

SEQ ID NO: 3654528 - DNA, 13 bp, Homo sapiens
accagggctctgt

SEQ ID NO: 3654529 - DNA, 22 bp, Homo sapiens
accagggctctgtattctgcaa

SEQ ID NO: 3654530 - DNA, 14 bp, Homo sapiens
acccagccaggagg

SEQ ID NO: 3654531 - DNA, 18 bp, Homo sapiens
acccctgtcctggggctg

SEQ ID NO: 3654532 - DNA, 18 bp, Homo sapiens
accttgttgatgccagct

SEQ ID NO: 3654533 - DNA, 13 bp, Homo sapiens
actcccccagccc

SEQ ID NO: 3654534 - DNA, 18 bp, Homo sapiens
actcccccagccctcagt

SEQ ID NO: 3654535 - DNA, 15 bp, Homo sapiens
actctctttcttcca

SEQ ID NO: 3654536 - DNA, 18 bp, Homo sapiens
actgctgtccctcctgag

SEQ ID NO: 3654537 - DNA, 17 bp, Homo sapiens
actgggccggcagcctg

SEQ ID NO: 3654538 - DNA, 16 bp, Homo sapiens
acttcctcctcctcct

SEQ ID NO: 3654539 - DNA, 15 bp, Homo sapiens
agcagctgggcactg

SEQ ID NO: 3654540 - DNA, 16 bp, Homo sapiens
agccacagaaatgtgt

SEQ ID NO: 3654541 - DNA, 15 bp, Homo sapiens
agccacccagccagg

SEQ ID NO: 3654542 - DNA, 16 bp, Homo sapiens
agccacccagccagga

SEQ ID NO: 3654543 - DNA, 19 bp, Homo sapiens
agcccctacaactccagcc

SEQ ID NO: 3654544 - DNA, 22 bp, Homo sapiens
agccgtggccgagggcttccct

SEQ ID NO: 3654545 - DNA, 12 bp, Homo sapiens
agcctcctgacc

SEQ ID NO: 3654546 - DNA, 14 bp, Homo sapiens
agcctggagccgtg

SEQ ID NO: 3654547 - DNA, 20 bp, Homo sapiens
agcctggttccctctttcct

SEQ ID NO: 3654548 - DNA, 13 bp, Homo sapiens
agcgcacttccca

SEQ ID NO: 3654549 - DNA, 15 bp, Homo sapiens
aggactctctttctt

SEQ ID NO: 3654550 - DNA, 14 bp, Homo sapiens
aggagcctcctgac

SEQ ID NO: 3654551 - DNA, 21 bp, Homo sapiens
aggcatggcccagcctggagc

SEQ ID NO: 3654552 - DNA, 22 bp, Homo sapiens
aggcatggcccagcctggagcc

SEQ ID NO: 3654553 - DNA, 20 bp, Homo sapiens
aggccacctccaaggactct

SEQ ID NO: 3654554 - DNA, 23 bp, Homo sapiens
aggccaggcatggcccagcctgg

SEQ ID NO: 3654555 - DNA, 15 bp, Homo sapiens
agggatggggagcag

SEQ ID NO: 3654556 - DNA, 18 bp, Homo sapiens
agggatggggagcagctg

SEQ ID NO: 3654557 - DNA, 11 bp, Homo sapiens
agggcctggcc

SEQ ID NO: 3654558 - DNA, 12 bp, Homo sapiens
agggcctggcct

SEQ ID NO: 3654559 - DNA, 15 bp, Homo sapiens
aggggcctggcctgg

SEQ ID NO: 3654560 - DNA, 16 bp, Homo sapiens
aggtcctttccttctc

SEQ ID NO: 3654561 - DNA, 15 bp, Homo sapiens
aggttgaggacagga

SEQ ID NO: 3654562 - DNA, 23 bp, Homo sapiens
agtaggttgaggacaggagaggg

SEQ ID NO: 3654563 - DNA, 19 bp, Homo sapiens
agtggggaggggcctggcc

SEQ ID NO: 3654564 - DNA, 15 bp, Homo sapiens
agttccgtctcctct

SEQ ID NO: 3654565 - DNA, 23 bp, Homo sapiens
agttctcatccacagaggccagg

SEQ ID NO: 3654566 - DNA, 20 bp, Homo sapiens
ataaatgggtaacactgatt

SEQ ID NO: 3654567 - DNA, 18 bp, Homo sapiens
ataatgaagaatggccat

SEQ ID NO: 3654568 - DNA, 13 bp, Homo sapiens
atagcaagagatg

SEQ ID NO: 3654569 - DNA, 13 bp, Homo sapiens
atataaacacata

SEQ ID NO: 3654570 - DNA, 14 bp, Homo sapiens
atataaacacataa

SEQ ID NO: 3654571 - DNA, 17 bp, Homo sapiens
atatccctatgtcccag

SEQ ID NO: 3654572 - DNA, 21 bp, Homo sapiens
atcaattctgatacagcctta

SEQ ID NO: 3654573 - DNA, 19 bp, Homo sapiens
atcactgctgtccctcctg

SEQ ID NO: 3654574 - DNA, 18 bp, Homo sapiens
atccacagaggccaggca

SEQ ID NO: 3654575 - DNA, 21 bp, Homo sapiens
atccaggtcctttccttctcg

SEQ ID NO: 3654576 - DNA, 18 bp, Homo sapiens
atccgcctctgagccagg

SEQ ID NO: 3654577 - DNA, 16 bp, Homo sapiens
atcctgcaatttctcc

SEQ ID NO: 3654578 - DNA, 18 bp, Homo sapiens
atgagctgggccctgggt

SEQ ID NO: 3654579 - DNA, 18 bp, Homo sapiens
atgcctgacacaggggac

SEQ ID NO: 3654580 - DNA, 20 bp, Homo sapiens
atgctctctatagaggagga

SEQ ID NO: 3654581 - DNA, 17 bp, Homo sapiens
atgcttctgctcacatt

SEQ ID NO: 3654582 - DNA, 21 bp, Homo sapiens
atgcttctgctcacattccct

SEQ ID NO: 3654583 - DNA, 17 bp, Homo sapiens
atggcccagcctggagc

SEQ ID NO: 3654584 - DNA, 16 bp, Homo sapiens
atggggagcagctggg

SEQ ID NO: 3654585 - DNA, 22 bp, Homo sapiens
attcccatcactgctgtccctc

SEQ ID NO: 3654586 - DNA, 20 bp, Homo sapiens
attctgcaacagcctgtttg

SEQ ID NO: 3654587 - DNA, 22 bp, Homo sapiens
caaagcccctacaactccagcc

SEQ ID NO: 3654588 - DNA, 20 bp, Homo sapiens
caactccagccacccagcca

SEQ ID NO: 3654589 - DNA, 12 bp, Homo sapiens
caagccacagaa

SEQ ID NO: 3654590 - DNA, 18 bp, Homo sapiens
caagccacagaaatgtgt

SEQ ID NO: 3654591 - DNA, 17 bp, Homo sapiens
caagtccatagctgagc

SEQ ID NO: 3654592 - DNA, 22 bp, Homo sapiens
caatttctcccgaatcctgagg

SEQ ID NO: 3654593 - DNA, 14 bp, Homo sapiens
cacagaggccaggc

SEQ ID NO: 3654594 - DNA, 15 bp, Homo sapiens
cacagaggccaggca

SEQ ID NO: 3654595 - DNA, 13 bp, Homo sapiens
cacctacttcctc

SEQ ID NO: 3654596 - DNA, 21 bp, Homo sapiens
cactgattacttttgggaggg

SEQ ID NO: 3654597 - DNA, 20 bp, Homo sapiens
cagagtggccaatccctgtg

SEQ ID NO: 3654598 - DNA, 14 bp, Homo sapiens
cagcagcagctcaa

SEQ ID NO: 3654599 - DNA, 20 bp, Homo sapiens
cagccaggaggggctgtcca

SEQ ID NO: 3654600 - DNA, 13 bp, Homo sapiens
cagccctcagttt

SEQ ID NO: 3654601 - DNA, 11 bp, Homo sapiens
cagcctggagc

SEQ ID NO: 3654602 - DNA, 13 bp, Homo sapiens
cagcctggagccg

SEQ ID NO: 3654603 - DNA, 15 bp, Homo sapiens
cagcctggttccctc

SEQ ID NO: 3654604 - DNA, 17 bp, Homo sapiens
cagcctggttccctctt

SEQ ID NO: 3654605 - DNA, 19 bp, Homo sapiens
cagcctggttccctctttc

SEQ ID NO: 3654606 - DNA, 19 bp, Homo sapiens
cagcctgtttgggaggctg

SEQ ID NO: 3654607 - DNA, 14 bp, Homo sapiens
cagggcctggcctg

SEQ ID NO: 3654608 - DNA, 14 bp, Homo sapiens
caggtcctttcctt

SEQ ID NO: 3654609 - DNA, 16 bp, Homo sapiens
caggtcctttccttct

SEQ ID NO: 3654610 - DNA, 18 bp, Homo sapiens
caggtcctttccttctcg

SEQ ID NO: 3654611 - DNA, 23 bp, Homo sapiens
cagtcaagttccgtctcctctcc

SEQ ID NO: 3654612 - DNA, 19 bp, Homo sapiens
cagttttcagtcaagttcc

SEQ ID NO: 3654613 - DNA, 15 bp, Homo sapiens
catccaggtcctttc

SEQ ID NO: 3654614 - DNA, 17 bp, Homo sapiens
catccaggtcctttcct

SEQ ID NO: 3654615 - DNA, 18 bp, Homo sapiens
catccgcctctgagccag

SEQ ID NO: 3654616 - DNA, 17 bp, Homo sapiens
catgcgaatgagctggg

SEQ ID NO: 3654617 - DNA, 18 bp, Homo sapiens
catgcgaatgagctgggc

SEQ ID NO: 3654618 - DNA, 20 bp, Homo sapiens
catggcccagcctggagccg

SEQ ID NO: 3654619 - DNA, 12 bp, Homo sapiens
catgtggccaag

SEQ ID NO: 3654620 - DNA, 13 bp, Homo sapiens
ccaatcacattca

SEQ ID NO: 3654621 - DNA, 20 bp, Homo sapiens
ccaatcacattcaggcatgc

SEQ ID NO: 3654622 - DNA, 13 bp, Homo sapiens
ccacagaggccag

SEQ ID NO: 3654623 - DNA, 14 bp, Homo sapiens
ccacccagccagga

SEQ ID NO: 3654624 - DNA, 24 bp, Homo sapiens
ccagagtagggttgccagtcctgc

SEQ ID NO: 3654625 - DNA, 13 bp, Homo sapiens
ccaggactctctt

SEQ ID NO: 3654626 - DNA, 16 bp, Homo sapiens
ccaggactctctttct

SEQ ID NO: 3654627 - DNA, 22 bp, Homo sapiens
ccaggagcctcctgaccctgtg

SEQ ID NO: 3654628 - DNA, 15 bp, Homo sapiens
ccaggcatggcccag

SEQ ID NO: 3654629 - DNA, 23 bp, Homo sapiens
ccaggcatggcccagcctggagc

SEQ ID NO: 3654630 - DNA, 22 bp, Homo sapiens
ccatcactgctgtccctcctga

SEQ ID NO: 3654631 - DNA, 10 bp, Homo sapiens
cccagcctgg

SEQ ID NO: 3654632 - DNA, 11 bp, Homo sapiens
cccagcctgga

SEQ ID NO: 3654633 - DNA, 16 bp, Homo sapiens
cccatttgtgtttcag

SEQ ID NO: 3654634 - DNA, 15 bp, Homo sapiens
ccctacaactccagc

SEQ ID NO: 3654635 - DNA, 19 bp, Homo sapiens
ccctagatggttccctttg

SEQ ID NO: 3654636 - DNA, 19 bp, Homo sapiens
ccctctttcctgtgccagg

SEQ ID NO: 3654637 - DNA, 23 bp, Homo sapiens
ccctggtactcccccagccctca

SEQ ID NO: 3654638 - DNA, 12 bp, Homo sapiens
ccctgtcctggg

SEQ ID NO: 3654639 - DNA, 13 bp, Homo sapiens
ccctgtgatgcct

SEQ ID NO: 3654640 - DNA, 17 bp, Homo sapiens
ccctttgttgctgtctg

SEQ ID NO: 3654641 - DNA, 21 bp, Homo sapiens
ccctttgttgctgtctggctt

SEQ ID NO: 3654642 - DNA, 12 bp, Homo sapiens
ccgcctctgagc

SEQ ID NO: 3654643 - DNA, 12 bp, Homo sapiens
ccggcagcctgg

SEQ ID NO: 3654644 - DNA, 14 bp, Homo sapiens
ccggcagcctggtt

SEQ ID NO: 3654645 - DNA, 15 bp, Homo sapiens
cctagatggttccct

SEQ ID NO: 3654646 - DNA, 14 bp, Homo sapiens
cctagtggggaggg

SEQ ID NO: 3654647 - DNA, 23 bp, Homo sapiens
cctagtggggaggggcctggcct

SEQ ID NO: 3654648 - DNA, 14 bp, Homo sapiens
cctcatgctctcta

SEQ ID NO: 3654649 - DNA, 20 bp, Homo sapiens
cctcctgaccctgtgatgcc

SEQ ID NO: 3654650 - DNA, 18 bp, Homo sapiens
cctcctgttcctgccttc

SEQ ID NO: 3654651 - DNA, 13 bp, Homo sapiens
cctctgagccagg

SEQ ID NO: 3654652 - DNA, 14 bp, Homo sapiens
cctctgagccagga

SEQ ID NO: 3654653 - DNA, 16 bp, Homo sapiens
cctctgagccaggagc

SEQ ID NO: 3654654 - DNA, 21 bp, Homo sapiens
cctctgagccaggagcctcct

SEQ ID NO: 3654655 - DNA, 21 bp, Homo sapiens
cctgaccctgtgatgcctgac

SEQ ID NO: 3654656 - DNA, 14 bp, Homo sapiens
cctgcctcatgctc

SEQ ID NO: 3654657 - DNA, 15 bp, Homo sapiens
cctgcctcatgctct

SEQ ID NO: 3654658 - DNA, 14 bp, Homo sapiens
cctgccttctcttc

SEQ ID NO: 3654659 - DNA, 16 bp, Homo sapiens
cctggcctggtccagg

SEQ ID NO: 3654660 - DNA, 21 bp, Homo sapiens
cctgggtggggcagggcctgg

SEQ ID NO: 3654661 - DNA, 14 bp, Homo sapiens
cctggtccaggctt

SEQ ID NO: 3654662 - DNA, 20 bp, Homo sapiens
cctggttccctctttcctgt

SEQ ID NO: 3654663 - DNA, 20 bp, Homo sapiens
cctgtgtgtcgttcccttgt

SEQ ID NO: 3654664 - DNA, 18 bp, Homo sapiens
cctgttcctgccttctct

SEQ ID NO: 3654665 - DNA, 17 bp, Homo sapiens
cctgtttgggaggctgg

SEQ ID NO: 3654666 - DNA, 20 bp, Homo sapiens
cctgtttgggaggctggagt

SEQ ID NO: 3654667 - DNA, 19 bp, Homo sapiens
ccttctcgtcttcctctct

SEQ ID NO: 3654668 - DNA, 23 bp, Homo sapiens
ccttctcgtcttcctctctctca

SEQ ID NO: 3654669 - DNA, 17 bp, Homo sapiens
cctttgttgctgtctgg

SEQ ID NO: 3654670 - DNA, 19 bp, Homo sapiens
cgcatccgcctctgagcca

SEQ ID NO: 3654671 - DNA, 20 bp, Homo sapiens
cgcatccgcctctgagccag

SEQ ID NO: 3654672 - DNA, 14 bp, Homo sapiens
cgcctctgagccag

SEQ ID NO: 3654673 - DNA, 16 bp, Homo sapiens
cgcctctgagccagga

SEQ ID NO: 3654674 - DNA, 15 bp, Homo sapiens
ctacccctgtcctgg

SEQ ID NO: 3654675 - DNA, 21 bp, Homo sapiens
ctagtggggaggggcctggcc

SEQ ID NO: 3654676 - DNA, 13 bp, Homo sapiens
ctattcagaataa

SEQ ID NO: 3654677 - DNA, 20 bp, Homo sapiens
ctcacattccctctcatcca

SEQ ID NO: 3654678 - DNA, 15 bp, Homo sapiens
ctcatccacagaggc

SEQ ID NO: 3654679 - DNA, 18 bp, Homo sapiens
ctcatccacagaggccag

SEQ ID NO: 3654680 - DNA, 18 bp, Homo sapiens
ctccagccacccagccag

SEQ ID NO: 3654681 - DNA, 17 bp, Homo sapiens
ctccagggccagggtgt

SEQ ID NO: 3654682 - DNA, 13 bp, Homo sapiens
ctcccccagccct

SEQ ID NO: 3654683 - DNA, 13 bp, Homo sapiens
ctcctacccctgt

SEQ ID NO: 3654684 - DNA, 21 bp, Homo sapiens
ctcctacccctgtcctggggc

SEQ ID NO: 3654685 - DNA, 20 bp, Homo sapiens
ctcctgaccctgtgatgcct

SEQ ID NO: 3654686 - DNA, 15 bp, Homo sapiens
ctcctgaggtctgga

SEQ ID NO: 3654687 - DNA, 19 bp, Homo sapiens
ctcctgttcctgccttctc

SEQ ID NO: 3654688 - DNA, 22 bp, Homo sapiens
ctcgcatccgcctctgagccag

SEQ ID NO: 3654689 - DNA, 14 bp, Homo sapiens
ctcgtcttcctctc

SEQ ID NO: 3654690 - DNA, 15 bp, Homo sapiens
ctcgtcttcctctct

SEQ ID NO: 3654691 - DNA, 19 bp, Homo sapiens
ctcgtcttcctctctctca

SEQ ID NO: 3654692 - DNA, 15 bp, Homo sapiens
ctctaaaagggggct

SEQ ID NO: 3654693 - DNA, 22 bp, Homo sapiens
ctctaaaagggggctattccct

SEQ ID NO: 3654694 - DNA, 23 bp, Homo sapiens
ctctaaaagggggctattccctg

SEQ ID NO: 3654695 - DNA, 18 bp, Homo sapiens
ctctcacctacttcctcc

SEQ ID NO: 3654696 - DNA, 19 bp, Homo sapiens
ctctcatccaggtcctttc

SEQ ID NO: 3654697 - DNA, 12 bp, Homo sapiens
ctctgagccagg

SEQ ID NO: 3654698 - DNA, 20 bp, Homo sapiens
ctctgagccaggagcctcct

SEQ ID NO: 3654699 - DNA, 14 bp, Homo sapiens
ctctgtattctgca

SEQ ID NO: 3654700 - DNA, 22 bp, Homo sapiens
ctctgtattctgcaacagcctg

SEQ ID NO: 3654701 - DNA, 23 bp, Homo sapiens
ctctgtattctgcaacagcctgt

SEQ ID NO: 3654702 - DNA, 13 bp, Homo sapiens
ctctttcttccac

SEQ ID NO: 3654703 - DNA, 18 bp, Homo sapiens
ctgacacaggggacactg

SEQ ID NO: 3654704 - DNA, 19 bp, Homo sapiens
ctgacacaggggacactga

SEQ ID NO: 3654705 - DNA, 21 bp, Homo sapiens
ctgaccctgtgatgcctgaca

SEQ ID NO: 3654706 - DNA, 16 bp, Homo sapiens
ctgagccaggagcctc

SEQ ID NO: 3654707 - DNA, 22 bp, Homo sapiens
ctgagccaggagcctcctgacc

SEQ ID NO: 3654708 - DNA, 13 bp, Homo sapiens
ctgagctggaaag

SEQ ID NO: 3654709 - DNA, 21 bp, Homo sapiens
ctgagttctcatccacagagg

SEQ ID NO: 3654710 - DNA, 11 bp, Homo sapiens
ctgccttctct

SEQ ID NO: 3654711 - DNA, 12 bp, Homo sapiens
ctgccttctctt

SEQ ID NO: 3654712 - DNA, 13 bp, Homo sapiens
ctgctcacattcc

SEQ ID NO: 3654713 - DNA, 16 bp, Homo sapiens
ctgctcacattccctc

SEQ ID NO: 3654714 - DNA, 17 bp, Homo sapiens
ctgctcacattccctct

SEQ ID NO: 3654715 - DNA, 19 bp, Homo sapiens
ctgctcacattccctctca

SEQ ID NO: 3654716 - DNA, 21 bp, Homo sapiens
ctgctcacattccctctcatc

SEQ ID NO: 3654717 - DNA, 17 bp, Homo sapiens
ctgctgtccctcctgag

SEQ ID NO: 3654718 - DNA, 19 bp, Homo sapiens
ctggaaaggatgcttctgc

SEQ ID NO: 3654719 - DNA, 21 bp, Homo sapiens
ctggcctagtggggaggggcc

SEQ ID NO: 3654720 - DNA, 23 bp, Homo sapiens
ctggcctagtggggaggggcctg

SEQ ID NO: 3654721 - DNA, 22 bp, Homo sapiens
ctggcctgggtggggcagggcc

SEQ ID NO: 3654722 - DNA, 16 bp, Homo sapiens
ctggcctggtccaggc

SEQ ID NO: 3654723 - DNA, 14 bp, Homo sapiens
ctgggcactgggcc

SEQ ID NO: 3654724 - DNA, 19 bp, Homo sapiens
ctgggtggggcagggcctg

SEQ ID NO: 3654725 - DNA, 20 bp, Homo sapiens
ctgggtggggcagggcctgg

SEQ ID NO: 3654726 - DNA, 14 bp, Homo sapiens
ctggtccaggcttg

SEQ ID NO: 3654727 - DNA, 18 bp, Homo sapiens
ctggttccctctttcctg

SEQ ID NO: 3654728 - DNA, 14 bp, Homo sapiens
ctgtactgagttct

SEQ ID NO: 3654729 - DNA, 20 bp, Homo sapiens
ctgtactgagttctcatcca

SEQ ID NO: 3654730 - DNA, 20 bp, Homo sapiens
ctgtattctgcaacagcctg

SEQ ID NO: 3654731 - DNA, 14 bp, Homo sapiens
ctgtccctcctgag

SEQ ID NO: 3654732 - DNA, 19 bp, Homo sapiens
cttccctagatggttccct

SEQ ID NO: 3654733 - DNA, 13 bp, Homo sapiens
cttctatcctgca

SEQ ID NO: 3654734 - DNA, 21 bp, Homo sapiens
cttctatcctgcaatttctcc

SEQ ID NO: 3654735 - DNA, 15 bp, Homo sapiens
cttctcttctatcct

SEQ ID NO: 3654736 - DNA, 21 bp, Homo sapiens
cttctgtgcatttgtgtctgc

SEQ ID NO: 3654737 - DNA, 14 bp, Homo sapiens
ctttccttctcgtc

SEQ ID NO: 3654738 - DNA, 14 bp, Homo sapiens
gaaaggatgcttct

SEQ ID NO: 3654739 - DNA, 12 bp, Homo sapiens
gaatgagctggg

SEQ ID NO: 3654740 - DNA, 21 bp, Homo sapiens
gaatgagctgggccctgggtg

SEQ ID NO: 3654741 - DNA, 16 bp, Homo sapiens
gacacaggggacactg

SEQ ID NO: 3654742 - DNA, 14 bp, Homo sapiens
gacagctgcttctg

SEQ ID NO: 3654743 - DNA, 18 bp, Homo sapiens
gacagctgcttctgtgca

SEQ ID NO: 3654744 - DNA, 17 bp, Homo sapiens
gagaccccagagtaggg

SEQ ID NO: 3654745 - DNA, 17 bp, Homo sapiens
gagatgagaaacaacag

SEQ ID NO: 3654746 - DNA, 20 bp, Homo sapiens
gagcagctgggcactgggcc

SEQ ID NO: 3654747 - DNA, 16 bp, Homo sapiens
gagctgggccctgggt

SEQ ID NO: 3654748 - DNA, 17 bp, Homo sapiens
gagggcttccctagatg

SEQ ID NO: 3654749 - DNA, 16 bp, Homo sapiens
gaggggcctggcctgg

SEQ ID NO: 3654750 - DNA, 21 bp, Homo sapiens
gaggtgggggtctggcctagt

SEQ ID NO: 3654751 - DNA, 23 bp, Homo sapiens
gagttgctcctacccctgtcctg

SEQ ID NO: 3654752 - DNA, 19 bp, Homo sapiens
gatgagaaacaacagaaac

SEQ ID NO: 3654753 - DNA, 11 bp, Homo sapiens
gatgcttctgc

SEQ ID NO: 3654754 - DNA, 16 bp, Homo sapiens
gatggggagcagctgg

SEQ ID NO: 3654755 - DNA, 18 bp, Homo sapiens
gatggggagcagctgggc

SEQ ID NO: 3654756 - DNA, 12 bp, Homo sapiens
gcaacagcctgt

SEQ ID NO: 3654757 - DNA, 18 bp, Homo sapiens
gcaagtccatagctgagc

SEQ ID NO: 3654758 - DNA, 20 bp, Homo sapiens
gcaagtccatagctgagctg

SEQ ID NO: 3654759 - DNA, 15 bp, Homo sapiens
gcagggcctggcctg

SEQ ID NO: 3654760 - DNA, 17 bp, Homo sapiens
gcagggcctggcctggt

SEQ ID NO: 3654761 - DNA, 13 bp, Homo sapiens
gcatccgcctctg

SEQ ID NO: 3654762 - DNA, 21 bp, Homo sapiens
gcatccgcctctgagccagga

SEQ ID NO: 3654763 - DNA, 14 bp, Homo sapiens
gcatggcccagcct

SEQ ID NO: 3654764 - DNA, 15 bp, Homo sapiens
gccacccagccagga

SEQ ID NO: 3654765 - DNA, 19 bp, Homo sapiens
gccaggcatggcccagcct

SEQ ID NO: 3654766 - DNA, 23 bp, Homo sapiens
gccaggcatggcccagcctggag

SEQ ID NO: 3654767 - DNA, 13 bp, Homo sapiens
gccagtcctgcaa

SEQ ID NO: 3654768 - DNA, 11 bp, Homo sapiens
gcccagcctgg

SEQ ID NO: 3654769 - DNA, 14 bp, Homo sapiens
gcccagcctggagc

SEQ ID NO: 3654770 - DNA, 15 bp, Homo sapiens
gcccagcctggagcc

SEQ ID NO: 3654771 - DNA, 14 bp, Homo sapiens
gccggcagcctggt

SEQ ID NO: 3654772 - DNA, 19 bp, Homo sapiens
gcctcatgctctctataga

SEQ ID NO: 3654773 - DNA, 12 bp, Homo sapiens
gcctctgagcca

SEQ ID NO: 3654774 - DNA, 13 bp, Homo sapiens
gcctctgagccag

SEQ ID NO: 3654775 - DNA, 15 bp, Homo sapiens
gcctctgagccagga

SEQ ID NO: 3654776 - DNA, 17 bp, Homo sapiens
gcctctgagccaggagc

SEQ ID NO: 3654777 - DNA, 14 bp, Homo sapiens
gcctggagccgtgg

SEQ ID NO: 3654778 - DNA, 20 bp, Homo sapiens
gcctgggtggggcagggcct

SEQ ID NO: 3654779 - DNA, 21 bp, Homo sapiens
gcctgggtggggcagggcctg

SEQ ID NO: 3654780 - DNA, 23 bp, Homo sapiens
gcctgggtggggcagggcctggc

SEQ ID NO: 3654781 - DNA, 24 bp, Homo sapiens
gcctggttccctctttcctgtgcc

SEQ ID NO: 3654782 - DNA, 19 bp, Homo sapiens
gcctgtttgggaggctgga

SEQ ID NO: 3654783 - DNA, 15 bp, Homo sapiens
gctattccctggaga

SEQ ID NO: 3654784 - DNA, 20 bp, Homo sapiens
gctcacattccctctcatcc

SEQ ID NO: 3654785 - DNA, 21 bp, Homo sapiens
gctcctacccctgtcctgggg

SEQ ID NO: 3654786 - DNA, 15 bp, Homo sapiens
gctctgtattctgca

SEQ ID NO: 3654787 - DNA, 11 bp, Homo sapiens
gctgagctgga

SEQ ID NO: 3654788 - DNA, 22 bp, Homo sapiens
gctgggtgtgtttcaggacagc

SEQ ID NO: 3654789 - DNA, 20 bp, Homo sapiens
gctgtactgagttctcatcc

SEQ ID NO: 3654790 - DNA, 15 bp, Homo sapiens
gctgtccctcctgag

SEQ ID NO: 3654791 - DNA, 20 bp, Homo sapiens
gctgtccctcctgaggtctg

SEQ ID NO: 3654792 - DNA, 22 bp, Homo sapiens
gcttctgctcacattccctctc

SEQ ID NO: 3654793 - DNA, 22 bp, Homo sapiens
gcttctgtgcatttgtgtctgc

SEQ ID NO: 3654794 - DNA, 14 bp, Homo sapiens
ggaggggcctggcc

SEQ ID NO: 3654795 - DNA, 19 bp, Homo sapiens
ggatggggcatgtggccaa

SEQ ID NO: 3654796 - DNA, 15 bp, Homo sapiens
ggcactgggccggca

SEQ ID NO: 3654797 - DNA, 20 bp, Homo sapiens
ggcactgggccggcagcctg

SEQ ID NO: 3654798 - DNA, 22 bp, Homo sapiens
ggcactgggccggcagcctggt

SEQ ID NO: 3654799 - DNA, 14 bp, Homo sapiens
ggcagggcctggcc

SEQ ID NO: 3654800 - DNA, 15 bp, Homo sapiens
ggcagggcctggcct

SEQ ID NO: 3654801 - DNA, 16 bp, Homo sapiens
ggcatcaaagatgaga

SEQ ID NO: 3654802 - DNA, 18 bp, Homo sapiens
ggcatcaaagatgagaag

SEQ ID NO: 3654803 - DNA, 19 bp, Homo sapiens
ggcatggcccagcctggag

SEQ ID NO: 3654804 - DNA, 22 bp, Homo sapiens
ggccaggcatggcccagcctgg

SEQ ID NO: 3654805 - DNA, 23 bp, Homo sapiens
ggccaggcatggcccagcctgga

SEQ ID NO: 3654806 - DNA, 15 bp, Homo sapiens
ggccggcagcctggt

SEQ ID NO: 3654807 - DNA, 13 bp, Homo sapiens
ggcctggcctggg

SEQ ID NO: 3654808 - DNA, 15 bp, Homo sapiens
ggcctggcctgggtg

SEQ ID NO: 3654809 - DNA, 15 bp, Homo sapiens
ggctattccctggag

SEQ ID NO: 3654810 - DNA, 17 bp, Homo sapiens
ggctccagggccagggt

SEQ ID NO: 3654811 - DNA, 13 bp, Homo sapiens
ggctccattccca

SEQ ID NO: 3654812 - DNA, 16 bp, Homo sapiens
ggctctgtattctgca

SEQ ID NO: 3654813 - DNA, 20 bp, Homo sapiens
ggctctgtattctgcaacag

SEQ ID NO: 3654814 - DNA, 19 bp, Homo sapiens
gggagcagctgggcactgg

SEQ ID NO: 3654815 - DNA, 22 bp, Homo sapiens
gggcactgggccggcagcctgg

SEQ ID NO: 3654816 - DNA, 16 bp, Homo sapiens
gggccggcagcctggt

SEQ ID NO: 3654817 - DNA, 14 bp, Homo sapiens
gggctattccctgg

SEQ ID NO: 3654818 - DNA, 12 bp, Homo sapiens
ggggcctggcct

SEQ ID NO: 3654819 - DNA, 16 bp, Homo sapiens
gggttgccagtcctgc

SEQ ID NO: 3654820 - DNA, 17 bp, Homo sapiens
gggttgccagtcctgca

SEQ ID NO: 3654821 - DNA, 16 bp, Homo sapiens
ggtcctttccttctcg

SEQ ID NO: 3654822 - DNA, 15 bp, Homo sapiens
ggtctggcctagtgg

SEQ ID NO: 3654823 - DNA, 16 bp, Homo sapiens
ggttccctctttcctg

SEQ ID NO: 3654824 - DNA, 13 bp, Homo sapiens
ggttgaggacagg

SEQ ID NO: 3654825 - DNA, 16 bp, Homo sapiens
ggttgaggacaggaga

SEQ ID NO: 3654826 - DNA, 15 bp, Homo sapiens
gtaccagggctctgt

SEQ ID NO: 3654827 - DNA, 21 bp, Homo sapiens
gtactgagttctcatccacag

SEQ ID NO: 3654828 - DNA, 19 bp, Homo sapiens
gtagggttgccagtcctgc

SEQ ID NO: 3654829 - DNA, 19 bp, Homo sapiens
gtattctgcaacagcctgt

SEQ ID NO: 3654830 - DNA, 15 bp, Homo sapiens
gtcctggggctgggt

SEQ ID NO: 3654831 - DNA, 23 bp, Homo sapiens
gtcgttcccttgtgtctgttgct

SEQ ID NO: 3654832 - DNA, 16 bp, Homo sapiens
gtctcctctccagccc

SEQ ID NO: 3654833 - DNA, 23 bp, Homo sapiens
gtctgcctgcctcatgctctcta

SEQ ID NO: 3654834 - DNA, 23 bp, Homo sapiens
gtgcatttgtgtctgcctgcctc

SEQ ID NO: 3654835 - DNA, 14 bp, Homo sapiens
gtgtcgttcccttg

SEQ ID NO: 3654836 - DNA, 19 bp, Homo sapiens
gtgtgtttcaggacagctg

SEQ ID NO: 3654837 - DNA, 20 bp, Homo sapiens
gtgtgtttcaggacagctgc

SEQ ID NO: 3654838 - DNA, 13 bp, Homo sapiens
gttccctctttcc

SEQ ID NO: 3654839 - DNA, 15 bp, Homo sapiens
gttccctctttcctg

SEQ ID NO: 3654840 - DNA, 12 bp, Homo sapiens
gttcccttgtgt

SEQ ID NO: 3654841 - DNA, 14 bp, Homo sapiens
gttccgtctcctct

SEQ ID NO: 3654842 - DNA, 16 bp, Homo sapiens
gttccgtctcctctcc

SEQ ID NO: 3654843 - DNA, 13 bp, Homo sapiens
gttcctgccttct

SEQ ID NO: 3654844 - DNA, 16 bp, Homo sapiens
gttcctgccttctctt

SEQ ID NO: 3654845 - DNA, 18 bp, Homo sapiens
gttgaggacaggagaggg

SEQ ID NO: 3654846 - DNA, 20 bp, Homo sapiens
gttgctcctacccctgtcct

SEQ ID NO: 3654847 - DNA, 21 bp, Homo sapiens
gttgctcctacccctgtcctg

SEQ ID NO: 3654848 - DNA, 13 bp, Homo sapiens
gtttcaggacagc

SEQ ID NO: 3654849 - DNA, 16 bp, Homo sapiens
gtttcaggacagctgc

SEQ ID NO: 3654850 - DNA, 15 bp, Homo sapiens
tactcccccagccct

SEQ ID NO: 3654851 - DNA, 14 bp, Homo sapiens
tacttcctcctcct

SEQ ID NO: 3654852 - DNA, 23 bp, Homo sapiens
tagtggggaggggcctggcctgg

SEQ ID NO: 3654853 - DNA, 15 bp, Homo sapiens
tcacattcaggcatg

SEQ ID NO: 3654854 - DNA, 17 bp, Homo sapiens
tcacattccctctcatc

SEQ ID NO: 3654855 - DNA, 19 bp, Homo sapiens
tcacctacttcctcctcct

SEQ ID NO: 3654856 - DNA, 16 bp, Homo sapiens
tcactgctgtccctcc

SEQ ID NO: 3654857 - DNA, 23 bp, Homo sapiens
tcagaataaatgggtaacactga

SEQ ID NO: 3654858 - DNA, 21 bp, Homo sapiens
tcagagtggccaatccctgtg

SEQ ID NO: 3654859 - DNA, 13 bp, Homo sapiens
tcaggacagctgc

SEQ ID NO: 3654860 - DNA, 19 bp, Homo sapiens
tcagtcaagttccgtctcc

SEQ ID NO: 3654861 - DNA, 18 bp, Homo sapiens
tcatccacagaggccagg

SEQ ID NO: 3654862 - DNA, 18 bp, Homo sapiens
tcatccaggtcctttcct

SEQ ID NO: 3654863 - DNA, 17 bp, Homo sapiens
tccactaccctccctcg

SEQ ID NO: 3654864 - DNA, 19 bp, Homo sapiens
tccactaccctccctcgca

SEQ ID NO: 3654865 - DNA, 17 bp, Homo sapiens
tccagccacccagccag

SEQ ID NO: 3654866 - DNA, 21 bp, Homo sapiens
tccagccacccagccaggagg

SEQ ID NO: 3654867 - DNA, 15 bp, Homo sapiens
tccaggtcctttcct

SEQ ID NO: 3654868 - DNA, 20 bp, Homo sapiens
tccaggtcctttccttctcg

SEQ ID NO: 3654869 - DNA, 19 bp, Homo sapiens
tccattcccatcactgctg

SEQ ID NO: 3654870 - DNA, 14 bp, Homo sapiens
tcccagcccctggt

SEQ ID NO: 3654871 - DNA, 22 bp, Homo sapiens
tcccatcactgctgtccctcct

SEQ ID NO: 3654872 - DNA, 21 bp, Homo sapiens
tcccgaatctttttaggccac

SEQ ID NO: 3654873 - DNA, 16 bp, Homo sapiens
tccctatgtcccagcc

SEQ ID NO: 3654874 - DNA, 22 bp, Homo sapiens
tccctatgtcccagcccctggt

SEQ ID NO: 3654875 - DNA, 13 bp, Homo sapiens
tccctctcatcca

SEQ ID NO: 3654876 - DNA, 14 bp, Homo sapiens
tccctctcatccag

SEQ ID NO: 3654877 - DNA, 12 bp, Homo sapiens
tccctctttcct

SEQ ID NO: 3654878 - DNA, 13 bp, Homo sapiens
tccctctttcctg

SEQ ID NO: 3654879 - DNA, 17 bp, Homo sapiens
tccctctttcctgtgcc

SEQ ID NO: 3654880 - DNA, 11 bp, Homo sapiens
tccctggagac

SEQ ID NO: 3654881 - DNA, 22 bp, Homo sapiens
tccctgtgtgtcgttcccttgt

SEQ ID NO: 3654882 - DNA, 18 bp, Homo sapiens
tcccttgtgtctgttgct

SEQ ID NO: 3654883 - DNA, 16 bp, Homo sapiens
tccgcctctgagccag

SEQ ID NO: 3654884 - DNA, 20 bp, Homo sapiens
tccgtctcctctccagccct

SEQ ID NO: 3654885 - DNA, 21 bp, Homo sapiens
tccgtctcctctccagcccta

SEQ ID NO: 3654886 - DNA, 15 bp, Homo sapiens
tcctacccctgtcct

SEQ ID NO: 3654887 - DNA, 16 bp, Homo sapiens
tcctacccctgtcctg

SEQ ID NO: 3654888 - DNA, 16 bp, Homo sapiens
tcctcctcctcctcct

SEQ ID NO: 3654889 - DNA, 21 bp, Homo sapiens
tcctctctctcacctacttcc

SEQ ID NO: 3654890 - DNA, 16 bp, Homo sapiens
tcctgcaatttctccc

SEQ ID NO: 3654891 - DNA, 21 bp, Homo sapiens
tcctggggctgggtgtgtttc

SEQ ID NO: 3654892 - DNA, 16 bp, Homo sapiens
tcctgttcctgccttc

SEQ ID NO: 3654893 - DNA, 17 bp, Homo sapiens
tcctgttcctgccttct

SEQ ID NO: 3654894 - DNA, 14 bp, Homo sapiens
tccttctcgtcttc

SEQ ID NO: 3654895 - DNA, 24 bp, Homo sapiens
tccttctcgtcttcctctctctca

SEQ ID NO: 3654896 - DNA, 22 bp, Homo sapiens
tcctttccttctcgtcttcctc

SEQ ID NO: 3654897 - DNA, 17 bp, Homo sapiens
tctcctctccagcccta

SEQ ID NO: 3654898 - DNA, 11 bp, Homo sapiens
tctctctcacc

SEQ ID NO: 3654899 - DNA, 15 bp, Homo sapiens
tctgcaacagcctgt

SEQ ID NO: 3654900 - DNA, 22 bp, Homo sapiens
tctgcctgcctcatgctctcta

SEQ ID NO: 3654901 - DNA, 17 bp, Homo sapiens
tctgctcacattccctc

SEQ ID NO: 3654902 - DNA, 22 bp, Homo sapiens
tctgctcacattccctctcatc

SEQ ID NO: 3654903 - DNA, 22 bp, Homo sapiens
tctggcctagtggggaggggcc

SEQ ID NO: 3654904 - DNA, 19 bp, Homo sapiens
tctgtgcatttgtgtctgc

SEQ ID NO: 3654905 - DNA, 23 bp, Homo sapiens
tctgtgcatttgtgtctgcctgc

SEQ ID NO: 3654906 - DNA, 16 bp, Homo sapiens
tcttcctctctctcac

SEQ ID NO: 3654907 - DNA, 14 bp, Homo sapiens
tctttcctgtgcca

SEQ ID NO: 3654908 - DNA, 15 bp, Homo sapiens
tctttcctgtgccag

SEQ ID NO: 3654909 - DNA, 20 bp, Homo sapiens
tgaccctgtgatgcctgaca

SEQ ID NO: 3654910 - DNA, 19 bp, Homo sapiens
tgagaagccaaagccccta

SEQ ID NO: 3654911 - DNA, 14 bp, Homo sapiens
tgagccaggagcct

SEQ ID NO: 3654912 - DNA, 17 bp, Homo sapiens
tgagctgggccctgggt

SEQ ID NO: 3654913 - DNA, 15 bp, Homo sapiens
tgaggacaggagagg

SEQ ID NO: 3654914 - DNA, 18 bp, Homo sapiens
tgagggatggggagcagc

SEQ ID NO: 3654915 - DNA, 13 bp, Homo sapiens
tgaggtctggatt

SEQ ID NO: 3654916 - DNA, 14 bp, Homo sapiens
tgagttctcatcca

SEQ ID NO: 3654917 - DNA, 21 bp, Homo sapiens
tgatgcctgacacaggggaca

SEQ ID NO: 3654918 - DNA, 19 bp, Homo sapiens
tgcaagtccatagctgagc

SEQ ID NO: 3654919 - DNA, 23 bp, Homo sapiens
tgcaagtccatagctgagctgga

SEQ ID NO: 3654920 - DNA, 15 bp, Homo sapiens
tgcaatttctcccga

SEQ ID NO: 3654921 - DNA, 14 bp, Homo sapiens
tgcatttgtgtctg

SEQ ID NO: 3654922 - DNA, 19 bp, Homo sapiens
tgcatttgtgtctgcctgc

SEQ ID NO: 3654923 - DNA, 13 bp, Homo sapiens
tgccaggactctc

SEQ ID NO: 3654924 - DNA, 15 bp, Homo sapiens
tgccaggactctctt

SEQ ID NO: 3654925 - DNA, 14 bp, Homo sapiens
tgccagtcctgcaa

SEQ ID NO: 3654926 - DNA, 13 bp, Homo sapiens
tgcctcatgctct

SEQ ID NO: 3654927 - DNA, 17 bp, Homo sapiens
tgcctgacacaggggac

SEQ ID NO: 3654928 - DNA, 18 bp, Homo sapiens
tgccttctcttctatcct

SEQ ID NO: 3654929 - DNA, 15 bp, Homo sapiens
tgcgaatgagctggg

SEQ ID NO: 3654930 - DNA, 19 bp, Homo sapiens
tgcgaatgagctgggccct

SEQ ID NO: 3654931 - DNA, 17 bp, Homo sapiens
tgctcacattccctctc

SEQ ID NO: 3654932 - DNA, 14 bp, Homo sapiens
tgctgtctggcttt

SEQ ID NO: 3654933 - DNA, 20 bp, Homo sapiens
tgcttatgtatgcctattca

SEQ ID NO: 3654934 - DNA, 13 bp, Homo sapiens
tgcttctgctcac

SEQ ID NO: 3654935 - DNA, 23 bp, Homo sapiens
tggaaaggatgcttctgctcaca

SEQ ID NO: 3654936 - DNA, 23 bp, Homo sapiens
tggcctagtggggaggggcctgg

SEQ ID NO: 3654937 - DNA, 21 bp, Homo sapiens
tggcctgggtggggcagggcc

SEQ ID NO: 3654938 - DNA, 15 bp, Homo sapiens
tggcctggtccaggc

SEQ ID NO: 3654939 - DNA, 20 bp, Homo sapiens
tggcctggtccaggcttggg

SEQ ID NO: 3654940 - DNA, 20 bp, Homo sapiens
tgggagtaggagttgctcct

SEQ ID NO: 3654941 - DNA, 23 bp, Homo sapiens
tgggcactgggccggcagcctgg

SEQ ID NO: 3654942 - DNA, 17 bp, Homo sapiens
tggggaggggcctggcc

SEQ ID NO: 3654943 - DNA, 21 bp, Homo sapiens
tggggaggggcctggcctggg

SEQ ID NO: 3654944 - DNA, 22 bp, Homo sapiens
tggggaggggcctggcctgggt

SEQ ID NO: 3654945 - DNA, 14 bp, Homo sapiens
tggggcagggcctg

SEQ ID NO: 3654946 - DNA, 15 bp, Homo sapiens
tggggcagggcctgg

SEQ ID NO: 3654947 - DNA, 19 bp, Homo sapiens
tggggcagggcctggcctg

SEQ ID NO: 3654948 - DNA, 19 bp, Homo sapiens
tggtactcccccagccctc

SEQ ID NO: 3654949 - DNA, 19 bp, Homo sapiens
tggtccaggcttgggctcc

SEQ ID NO: 3654950 - DNA, 17 bp, Homo sapiens
tggttccctctttcctg

SEQ ID NO: 3654951 - DNA, 24 bp, Homo sapiens
tggttccctctttcctgtgccagg

SEQ ID NO: 3654952 - DNA, 16 bp, Homo sapiens
tgtccaatcacattca

SEQ ID NO: 3654953 - DNA, 13 bp, Homo sapiens
tgtccctcctgag

SEQ ID NO: 3654954 - DNA, 14 bp, Homo sapiens
tgtcgttcccttgt

SEQ ID NO: 3654955 - DNA, 20 bp, Homo sapiens
tgtcgttcccttgtgtctgt

SEQ ID NO: 3654956 - DNA, 21 bp, Homo sapiens
tgtcgttcccttgtgtctgtt

SEQ ID NO: 3654957 - DNA, 23 bp, Homo sapiens
tgtcgttcccttgtgtctgttgc

SEQ ID NO: 3654958 - DNA, 22 bp, Homo sapiens
tgtgagggatggggagcagctg

SEQ ID NO: 3654959 - DNA, 22 bp, Homo sapiens
tgtgcatttgtgtctgcctgcc

SEQ ID NO: 3654960 - DNA, 16 bp, Homo sapiens
tgtgtctgcctgcctc

SEQ ID NO: 3654961 - DNA, 17 bp, Homo sapiens
tgtgtctgcctgcctca

SEQ ID NO: 3654962 - DNA, 16 bp, Homo sapiens
tgtgtttcaggacagc

SEQ ID NO: 3654963 - DNA, 23 bp, Homo sapiens
tgtgtttcaggacagctgcttct

SEQ ID NO: 3654964 - DNA, 15 bp, Homo sapiens
tgttcctgccttctc

SEQ ID NO: 3654965 - DNA, 16 bp, Homo sapiens
tgttcctgccttctct

SEQ ID NO: 3654966 - DNA, 23 bp, Homo sapiens
tgtttcaggacagctgcttctgt

SEQ ID NO: 3654967 - DNA, 14 bp, Homo sapiens
ttacttttgggagg

SEQ ID NO: 3654968 - DNA, 16 bp, Homo sapiens
ttccactaccctccct

SEQ ID NO: 3654969 - DNA, 18 bp, Homo sapiens
ttccactaccctccctcg

SEQ ID NO: 3654970 - DNA, 14 bp, Homo sapiens
ttccctctttcctg

SEQ ID NO: 3654971 - DNA, 19 bp, Homo sapiens
ttccctctttcctgtgcca

SEQ ID NO: 3654972 - DNA, 11 bp, Homo sapiens
ttccctggaga

SEQ ID NO: 3654973 - DNA, 15 bp, Homo sapiens
ttcccttgtgtctgt

SEQ ID NO: 3654974 - DNA, 17 bp, Homo sapiens
ttccctttgttgctgtc

SEQ ID NO: 3654975 - DNA, 18 bp, Homo sapiens
ttccctttgttgctgtct

SEQ ID NO: 3654976 - DNA, 14 bp, Homo sapiens
ttccgtctcctctc

SEQ ID NO: 3654977 - DNA, 19 bp, Homo sapiens
ttcctcctcctcctcctgt

SEQ ID NO: 3654978 - DNA, 14 bp, Homo sapiens
ttcctctctctcac

SEQ ID NO: 3654979 - DNA, 13 bp, Homo sapiens
ttcctgccttctc

SEQ ID NO: 3654980 - DNA, 15 bp, Homo sapiens
ttcctgccttctctt

SEQ ID NO: 3654981 - DNA, 18 bp, Homo sapiens
ttcctgccttctcttcta

SEQ ID NO: 3654982 - DNA, 17 bp, Homo sapiens
ttcctgtgccaggactc

SEQ ID NO: 3654983 - DNA, 12 bp, Homo sapiens
ttccttctcgtc

SEQ ID NO: 3654984 - DNA, 19 bp, Homo sapiens
ttccttctcgtcttcctct

SEQ ID NO: 3654985 - DNA, 21 bp, Homo sapiens
ttccttctcgtcttcctctct

SEQ ID NO: 3654986 - DNA, 18 bp, Homo sapiens
ttctcgtcttcctctctc

SEQ ID NO: 3654987 - DNA, 21 bp, Homo sapiens
ttctcgtcttcctctctctca

SEQ ID NO: 3654988 - DNA, 24 bp, Homo sapiens
ttctgtgcatttgtgtctgcctgc

SEQ ID NO: 3654989 - DNA, 11 bp, Homo sapiens
ttgctcctacc

SEQ ID NO: 3654990 - DNA, 19 bp, Homo sapiens
ttgctcctacccctgtcct

SEQ ID NO: 3654991 - DNA, 18 bp, Homo sapiens
ttgctgtctggctttccc

SEQ ID NO: 3654992 - DNA, 19 bp, Homo sapiens
ttgctgtctggctttcccg

SEQ ID NO: 3654993 - DNA, 15 bp, Homo sapiens
ttgggaggctggagt

SEQ ID NO: 3654994 - DNA, 15 bp, Homo sapiens
ttgtgtctgcctgcc

SEQ ID NO: 3654995 - DNA, 13 bp, Homo sapiens
tttccttctcgtc

SEQ ID NO: 3654996 - DNA, 19 bp, Homo sapiens
tttctcccgaatcctgagg

SEQ ID NO: 3654997 - DNA, 12 bp, Homo sapiens
tttgtgtttcag

SEQ ID NO: 3654998 - DNA, 23 bp, Homo sapiens
aacagcctgtttgggaggctgga

SEQ ID NO: 3654999 - DNA, 22 bp, Homo sapiens
aactccagccacccagccagga

SEQ ID NO: 3655000 - DNA, 22 bp, Homo sapiens
aagggggctattccctggagac

SEQ ID NO: 3655001 - DNA, 19 bp, Homo sapiens
aagtccatagctgagctgg

SEQ ID NO: 3655002 - DNA, 22 bp, Homo sapiens
aagttccgtctcctctccagcc

SEQ ID NO: 3655003 - DNA, 23 bp, Homo sapiens
aatacaatagtatgcagctaaaa

SEQ ID NO: 3655004 - DNA, 16 bp, Homo sapiens
aatcagagtggccaat

SEQ ID NO: 3655005 - DNA, 12 bp, Homo sapiens
acaactccagcc

SEQ ID NO: 3655006 - DNA, 20 bp, Homo sapiens
acaactccagccacccagcc

SEQ ID NO: 3655007 - DNA, 22 bp, Homo sapiens
acaactccagccacccagccag

SEQ ID NO: 3655008 - DNA, 13 bp, Homo sapiens
acagcagcagctc

SEQ ID NO: 3655009 - DNA, 21 bp, Homo sapiens
acagcctgtttgggaggctgg

SEQ ID NO: 3655010 - DNA, 17 bp, Homo sapiens
acagctgcttctgtgca

SEQ ID NO: 3655011 - DNA, 13 bp, Homo sapiens
acattccctctca

SEQ ID NO: 3655012 - DNA, 17 bp, Homo sapiens
acattccctctcatcca

SEQ ID NO: 3655013 - DNA, 15 bp, Homo sapiens
acctacttcctcctc

SEQ ID NO: 3655014 - DNA, 17 bp, Homo sapiens
accttgttgatgccagc

SEQ ID NO: 3655015 - DNA, 20 bp, Homo sapiens
actccagccacccagccagg

SEQ ID NO: 3655016 - DNA, 16 bp, Homo sapiens
actctctttcttccac

SEQ ID NO: 3655017 - DNA, 18 bp, Homo sapiens
actctctttcttccacta

SEQ ID NO: 3655018 - DNA, 21 bp, Homo sapiens
actgaaccttgttgatgccag

SEQ ID NO: 3655019 - DNA, 12 bp, Homo sapiens
actgggccggca

SEQ ID NO: 3655020 - DNA, 18 bp, Homo sapiens
actgggccggcagcctgg

SEQ ID NO: 3655021 - DNA, 14 bp, Homo sapiens
acttcctcctcctc

SEQ ID NO: 3655022 - DNA, 15 bp, Homo sapiens
agaaatagcaagaga

SEQ ID NO: 3655023 - DNA, 17 bp, Homo sapiens
agaatataaacacataa

SEQ ID NO: 3655024 - DNA, 12 bp, Homo sapiens
agaggaggatgg

SEQ ID NO: 3655025 - DNA, 19 bp, Homo sapiens
agagtggccaatccctgtg

SEQ ID NO: 3655026 - DNA, 16 bp, Homo sapiens
agcaagagatgagaaa

SEQ ID NO: 3655027 - DNA, 24 bp, Homo sapiens
agcaagagatgagaaacaacagaa

SEQ ID NO: 3655028 - DNA, 13 bp, Homo sapiens
agccacccagcca

SEQ ID NO: 3655029 - DNA, 14 bp, Homo sapiens
agccacccagccag

SEQ ID NO: 3655030 - DNA, 19 bp, Homo sapiens
agccacccagccaggaggg

SEQ ID NO: 3655031 - DNA, 19 bp, Homo sapiens
agccaggagcctcctgacc

SEQ ID NO: 3655032 - DNA, 20 bp, Homo sapiens
agccaggagcctcctgaccc

SEQ ID NO: 3655033 - DNA, 15 bp, Homo sapiens
agcctggttccctct

SEQ ID NO: 3655034 - DNA, 16 bp, Homo sapiens
agcctggttccctctt

SEQ ID NO: 3655035 - DNA, 18 bp, Homo sapiens
agcctgtttgggaggctg

SEQ ID NO: 3655036 - DNA, 20 bp, Homo sapiens
agcctgtttgggaggctgga

SEQ ID NO: 3655037 - DNA, 23 bp, Homo sapiens
agcctgtttgggaggctggagtg

SEQ ID NO: 3655038 - DNA, 19 bp, Homo sapiens
aggactctctttcttccac

SEQ ID NO: 3655039 - DNA, 20 bp, Homo sapiens
aggagcctcctgaccctgtg

SEQ ID NO: 3655040 - DNA, 18 bp, Homo sapiens
aggatgcttctgctcaca

SEQ ID NO: 3655041 - DNA, 17 bp, Homo sapiens
aggcatggcccagcctg

SEQ ID NO: 3655042 - DNA, 18 bp, Homo sapiens
aggcatggcccagcctgg

SEQ ID NO: 3655043 - DNA, 14 bp, Homo sapiens
agggcctggcctgg

SEQ ID NO: 3655044 - DNA, 14 bp, Homo sapiens
agggctccagggcc

SEQ ID NO: 3655045 - DNA, 18 bp, Homo sapiens
agggctccagggccaggg

SEQ ID NO: 3655046 - DNA, 16 bp, Homo sapiens
aggggacactgaacct

SEQ ID NO: 3655047 - DNA, 14 bp, Homo sapiens
aggggcctggcctg

SEQ ID NO: 3655048 - DNA, 17 bp, Homo sapiens
aggggcctggcctgggt

SEQ ID NO: 3655049 - DNA, 20 bp, Homo sapiens
aggggctgtccaatcacatt

SEQ ID NO: 3655050 - DNA, 16 bp, Homo sapiens
aggtgggggtctggcc

SEQ ID NO: 3655051 - DNA, 20 bp, Homo sapiens
agtaggttgaggacaggaga

SEQ ID NO: 3655052 - DNA, 20 bp, Homo sapiens
agtcaagttccgtctcctct

SEQ ID NO: 3655053 - DNA, 18 bp, Homo sapiens
agtccatagctgagctgg

SEQ ID NO: 3655054 - DNA, 17 bp, Homo sapiens
agtggggaggggcctgg

SEQ ID NO: 3655055 - DNA, 20 bp, Homo sapiens
agtggggaggggcctggcct

SEQ ID NO: 3655056 - DNA, 23 bp, Homo sapiens
agtggggaggggcctggcctggg

SEQ ID NO: 3655057 - DNA, 12 bp, Homo sapiens
agttctcatcca

SEQ ID NO: 3655058 - DNA, 13 bp, Homo sapiens
agttctcatccac

SEQ ID NO: 3655059 - DNA, 20 bp, Homo sapiens
agttgctcctacccctgtcc

SEQ ID NO: 3655060 - DNA, 21 bp, Homo sapiens
agttgctcctacccctgtcct

SEQ ID NO: 3655061 - DNA, 20 bp, Homo sapiens
atatccctatgtcccagccc

SEQ ID NO: 3655062 - DNA, 19 bp, Homo sapiens
atcaattctgatacagcct

SEQ ID NO: 3655063 - DNA, 24 bp, Homo sapiens
atcacattcaggcatgcgaatgag

SEQ ID NO: 3655064 - DNA, 18 bp, Homo sapiens
atcactgctgtccctcct

SEQ ID NO: 3655065 - DNA, 17 bp, Homo sapiens
atccaggtcctttcctt

SEQ ID NO: 3655066 - DNA, 18 bp, Homo sapiens
atccaggtcctttccttc

SEQ ID NO: 3655067 - DNA, 18 bp, Homo sapiens
atccctatgtcccagccc

SEQ ID NO: 3655068 - DNA, 14 bp, Homo sapiens
atccgcctctgagc

SEQ ID NO: 3655069 - DNA, 16 bp, Homo sapiens
atccgcctctgagcca

SEQ ID NO: 3655070 - DNA, 21 bp, Homo sapiens
atccgcctctgagccaggagc

SEQ ID NO: 3655071 - DNA, 18 bp, Homo sapiens
atctttttaggccacctc

SEQ ID NO: 3655072 - DNA, 15 bp, Homo sapiens
atgagaaacaacaga

SEQ ID NO: 3655073 - DNA, 12 bp, Homo sapiens
atgagctgggcc

SEQ ID NO: 3655074 - DNA, 15 bp, Homo sapiens
atgagctgggccctg

SEQ ID NO: 3655075 - DNA, 21 bp, Homo sapiens
atgcctgacacaggggacact

SEQ ID NO: 3655076 - DNA, 16 bp, Homo sapiens
atgcgaatgagctggg

SEQ ID NO: 3655077 - DNA, 19 bp, Homo sapiens
atgcttctgctcacattcc

SEQ ID NO: 3655078 - DNA, 23 bp, Homo sapiens
atgcttctgctcacattccctct

SEQ ID NO: 3655079 - DNA, 16 bp, Homo sapiens
attcccatcactgctg

SEQ ID NO: 3655080 - DNA, 20 bp, Homo sapiens
attcccatcactgctgtccc

SEQ ID NO: 3655081 - DNA, 12 bp, Homo sapiens
attccctggaga

SEQ ID NO: 3655082 - DNA, 13 bp, Homo sapiens
attgggagtagga

SEQ ID NO: 3655083 - DNA, 18 bp, Homo sapiens
caaagaaatagcaagaga

SEQ ID NO: 3655084 - DNA, 11 bp, Homo sapiens
caacagcctgt

SEQ ID NO: 3655085 - DNA, 22 bp, Homo sapiens
caagagatgagaaacaacagaa

SEQ ID NO: 3655086 - DNA, 17 bp, Homo sapiens
caagttccgtctcctct

SEQ ID NO: 3655087 - DNA, 20 bp, Homo sapiens
caagttccgtctcctctcca

SEQ ID NO: 3655088 - DNA, 16 bp, Homo sapiens
cacccagccaggaggg

SEQ ID NO: 3655089 - DNA, 18 bp, Homo sapiens
cactgctgtccctcctga

SEQ ID NO: 3655090 - DNA, 19 bp, Homo sapiens
cactgctgtccctcctgag

SEQ ID NO: 3655091 - DNA, 13 bp, Homo sapiens
cactgggccggca

SEQ ID NO: 3655092 - DNA, 21 bp, Homo sapiens
cactgggccggcagcctggtt

SEQ ID NO: 3655093 - DNA, 23 bp, Homo sapiens
cagaaacttttttctctaaagga

SEQ ID NO: 3655094 - DNA, 22 bp, Homo sapiens
cagaataaatgggtaacactga

SEQ ID NO: 3655095 - DNA, 17 bp, Homo sapiens
cagccacccagccagga

SEQ ID NO: 3655096 - DNA, 18 bp, Homo sapiens
cagcctggttccctcttt

SEQ ID NO: 3655097 - DNA, 20 bp, Homo sapiens
cagcctggttccctctttcc

SEQ ID NO: 3655098 - DNA, 20 bp, Homo sapiens
cagcctgtttgggaggctgg

SEQ ID NO: 3655099 - DNA, 12 bp, Homo sapiens
cagctcaagtta

SEQ ID NO: 3655100 - DNA, 22 bp, Homo sapiens
cagctgcttctgtgcatttgtg

SEQ ID NO: 3655101 - DNA, 14 bp, Homo sapiens
cagctgtactgagt

SEQ ID NO: 3655102 - DNA, 19 bp, Homo sapiens
caggacagctgcttctgtg

SEQ ID NO: 3655103 - DNA, 13 bp, Homo sapiens
caggactctcttt

SEQ ID NO: 3655104 - DNA, 20 bp, Homo sapiens
caggcatgcgaatgagctgg

SEQ ID NO: 3655105 - DNA, 18 bp, Homo sapiens
caggcatggcccagcctg

SEQ ID NO: 3655106 - DNA, 20 bp, Homo sapiens
tgggtgtgtttcaggacagc

SEQ ID NO: 3655107 - DNA, 22 bp, Homo sapiens
tgggtgtgtttcaggacagctg

SEQ ID NO: 3655108 - DNA, 17 bp, Homo sapiens
tggtactcccccagccc

SEQ ID NO: 3655109 - DNA, 18 bp, Homo sapiens
tggtcatcgtgacagcag

SEQ ID NO: 3655110 - DNA, 17 bp, Homo sapiens
tgtaccagggctctgta

SEQ ID NO: 3655111 - DNA, 13 bp, Homo sapiens
tgtcccagcccct

SEQ ID NO: 3655112 - DNA, 15 bp, Homo sapiens
tgtctggctttcccg

SEQ ID NO: 3655113 - DNA, 21 bp, Homo sapiens
tgtctgttgcttattgggagt

SEQ ID NO: 3655114 - DNA, 19 bp, Homo sapiens
tgtgcatttgtgtctgcct

SEQ ID NO: 3655115 - DNA, 17 bp, Homo sapiens
tgtgccaggactctctt

SEQ ID NO: 3655116 - DNA, 23 bp, Homo sapiens
tgtggccaagggctccagggcca

SEQ ID NO: 3655117 - DNA, 23 bp, Homo sapiens
tgtgtctgcctgcctcatgctct

SEQ ID NO: 3655118 - DNA, 12 bp, Homo sapiens
tgttcctgcctt

SEQ ID NO: 3655119 - DNA, 16 bp, Homo sapiens
tgttgctgtctggctt

SEQ ID NO: 3655120 - DNA, 19 bp, Homo sapiens
tgtttcaggacagctgctt

SEQ ID NO: 3655121 - DNA, 16 bp, Homo sapiens
ttccctagatggttcc

SEQ ID NO: 3655122 - DNA, 20 bp, Homo sapiens
ttccctggagaccccagagt

SEQ ID NO: 3655123 - DNA, 13 bp, Homo sapiens
ttccgtctcctct

SEQ ID NO: 3655124 - DNA, 24 bp, Homo sapiens
ttcctcctcctcctcctgttcctg

SEQ ID NO: 3655125 - DNA, 16 bp, Homo sapiens
ttcctgccttctcttc

SEQ ID NO: 3655126 - DNA, 14 bp, Homo sapiens
ttcctgtgccagga

SEQ ID NO: 3655127 - DNA, 14 bp, Homo sapiens
ttccttctcgtctt

SEQ ID NO: 3655128 - DNA, 15 bp, Homo sapiens
ttctcttctatcctg

SEQ ID NO: 3655129 - DNA, 15 bp, Homo sapiens
ttctgcaacagcctg

SEQ ID NO: 3655130 - DNA, 15 bp, Homo sapiens
ttctgctcacattcc

SEQ ID NO: 3655131 - DNA, 13 bp, Homo sapiens
ttgtgtctgcctg

SEQ ID NO: 3655132 - DNA, 23 bp, Homo sapiens
tttcagtcaagttccgtctcctc

SEQ ID NO: 3655133 - DNA, 20 bp, Homo sapiens
tttgtgtctgcctgcctcat

SEQ ID NO: 3655134 - DNA, 23 bp, Homo sapiens
ttttcagtcaagttccgtctcct

SEQ ID NO: 3655135 - DNA, 16 bp, Homo sapiens
aaaaaggcaagccaca

SEQ ID NO: 3655136 - DNA, 22 bp, Homo sapiens
aaatcaattctgatacagcctt

SEQ ID NO: 3655137 - DNA, 12 bp, Homo sapiens
aacaacagaaac

SEQ ID NO: 3655138 - DNA, 16 bp, Homo sapiens
ctgcctgcctcatgct

SEQ ID NO: 3655139 - DNA, 14 bp, Homo sapiens
ctgccttctcttct

SEQ ID NO: 3655140 - DNA, 14 bp, Homo sapiens
ctgctcacattccc

SEQ ID NO: 3655141 - DNA, 16 bp, Homo sapiens
ctgctgtccctcctga

SEQ ID NO: 3655142 - DNA, 20 bp, Homo sapiens
ctgctgtccctcctgaggtc

SEQ ID NO: 3655143 - DNA, 23 bp, Homo sapiens
ctgcttctgtgcatttgtgtctg

SEQ ID NO: 3655144 - DNA, 23 bp, Homo sapiens
ctggaaaggatgcttctgctcac

SEQ ID NO: 3655145 - DNA, 20 bp, Homo sapiens
ctggcctgggtggggcaggg

SEQ ID NO: 3655146 - DNA, 23 bp, Homo sapiens
ctgggatggggcatgtggccaag

SEQ ID NO: 3655147 - DNA, 16 bp, Homo sapiens
ctgggccggcagcctg

SEQ ID NO: 3655148 - DNA, 17 bp, Homo sapiens
ctgggccggcagcctgg

SEQ ID NO: 3655149 - DNA, 18 bp, Homo sapiens
ctgggccggcagcctggt

SEQ ID NO: 3655150 - DNA, 22 bp, Homo sapiens
ctggttccctctttcctgtgcc

SEQ ID NO: 3655151 - DNA, 13 bp, Homo sapiens
ctgtccctcctga

SEQ ID NO: 3655152 - DNA, 17 bp, Homo sapiens
ctgtgcatttgtgtctg

SEQ ID NO: 3655153 - DNA, 11 bp, Homo sapiens
ctgttcctgcc

SEQ ID NO: 3655154 - DNA, 12 bp, Homo sapiens
ctgttcctgcct

SEQ ID NO: 3655155 - DNA, 19 bp, Homo sapiens
ctgtttgggaggctggagt

SEQ ID NO: 3655156 - DNA, 13 bp, Homo sapiens
cttaacacttaca

SEQ ID NO: 3655157 - DNA, 17 bp, Homo sapiens
cttccactaccctccct

SEQ ID NO: 3655158 - DNA, 13 bp, Homo sapiens
cttcctcctcctc

SEQ ID NO: 3655159 - DNA, 14 bp, Homo sapiens
cttctcgtcttcct

SEQ ID NO: 3655160 - DNA, 15 bp, Homo sapiens
cttctcgtcttcctc

SEQ ID NO: 3655161 - DNA, 13 bp, Homo sapiens
cttctgctcacat

SEQ ID NO: 3655162 - DNA, 16 bp, Homo sapiens
cttctgctcacattcc

SEQ ID NO: 3655163 - DNA, 21 bp, Homo sapiens
cttctgctcacattccctctc

SEQ ID NO: 3655164 - DNA, 22 bp, Homo sapiens
cttctgctcacattccctctca

SEQ ID NO: 3655165 - DNA, 14 bp, Homo sapiens
cttgtgtctgttgc

SEQ ID NO: 3655166 - DNA, 21 bp, Homo sapiens
ctttcttccactaccctccct

SEQ ID NO: 3655167 - DNA, 14 bp, Homo sapiens
gaaacaacagaaac

SEQ ID NO: 3655168 - DNA, 20 bp, Homo sapiens
gacaaagaaatagcaagaga

SEQ ID NO: 3655169 - DNA, 21 bp, Homo sapiens
gacacaggggacactgaacct

SEQ ID NO: 3655170 - DNA, 15 bp, Homo sapiens
gagccgtggccgagg

SEQ ID NO: 3655171 - DNA, 17 bp, Homo sapiens
gagcctcctgaccctgt

SEQ ID NO: 3655172 - DNA, 19 bp, Homo sapiens
gaggccaggcatggcccag

SEQ ID NO: 3655173 - DNA, 15 bp, Homo sapiens
gaggggcctggcctg

SEQ ID NO: 3655174 - DNA, 14 bp, Homo sapiens
gaggtgggggtctg

SEQ ID NO: 3655175 - DNA, 22 bp, Homo sapiens
gagtagggttgccagtcctgca

SEQ ID NO: 3655176 - DNA, 20 bp, Homo sapiens
gagtggccaatccctgtgtg

SEQ ID NO: 3655177 - DNA, 14 bp, Homo sapiens
gatggggacaaaga

SEQ ID NO: 3655178 - DNA, 17 bp, Homo sapiens
gatggggagcagctggg

SEQ ID NO: 3655179 - DNA, 17 bp, Homo sapiens
gcaagagatgagaaaca

SEQ ID NO: 3655180 - DNA, 15 bp, Homo sapiens
gcaagccacagaaat

SEQ ID NO: 3655181 - DNA, 22 bp, Homo sapiens
gcaagtccatagctgagctgga

SEQ ID NO: 3655182 - DNA, 16 bp, Homo sapiens
gcactgggccggcagc

SEQ ID NO: 3655183 - DNA, 19 bp, Homo sapiens
gcactgggccggcagcctg

SEQ ID NO: 3655184 - DNA, 22 bp, Homo sapiens
gcagcctggttccctctttcct

SEQ ID NO: 3655185 - DNA, 23 bp, Homo sapiens
gcagcctggttccctctttcctg

SEQ ID NO: 3655186 - DNA, 14 bp, Homo sapiens
gcagctgggcactg

SEQ ID NO: 3655187 - DNA, 13 bp, Homo sapiens
gcagggcctggcc

SEQ ID NO: 3655188 - DNA, 17 bp, Homo sapiens
gcatccgcctctgagcc

SEQ ID NO: 3655189 - DNA, 18 bp, Homo sapiens
gcatccgcctctgagcca

SEQ ID NO: 3655190 - DNA, 16 bp, Homo sapiens
gccagctgtactgagt

SEQ ID NO: 3655191 - DNA, 17 bp, Homo sapiens
gccagctgtactgagtt

SEQ ID NO: 3655192 - DNA, 12 bp, Homo sapiens
gccaggactctc

SEQ ID NO: 3655193 - DNA, 21 bp, Homo sapiens
gccaggagcctcctgaccctg

SEQ ID NO: 3655194 - DNA, 21 bp, Homo sapiens
gccaggcatggcccagcctgg

SEQ ID NO: 3655195 - DNA, 22 bp, Homo sapiens
gccaggcatggcccagcctgga

SEQ ID NO: 3655196 - DNA, 16 bp, Homo sapiens
gcccagcctggagccg

SEQ ID NO: 3655197 - DNA, 13 bp, Homo sapiens
gccggcagcctgg

SEQ ID NO: 3655198 - DNA, 19 bp, Homo sapiens
gcctagtggggaggggcct

SEQ ID NO: 3655199 - DNA, 20 bp, Homo sapiens
gcctagtggggaggggcctg

SEQ ID NO: 3655200 - DNA, 20 bp, Homo sapiens
gcctgacacaggggacactg

SEQ ID NO: 3655201 - DNA, 13 bp, Homo sapiens
gcctggcctggtc

SEQ ID NO: 3655202 - DNA, 15 bp, Homo sapiens
gcctggcctggtcca

SEQ ID NO: 3655203 - DNA, 22 bp, Homo sapiens
gcctgggtggggcagggcctgg

SEQ ID NO: 3655204 - DNA, 21 bp, Homo sapiens
gcctggttccctctttcctgt

SEQ ID NO: 3655205 - DNA, 17 bp, Homo sapiens
gcctgtttgggaggctg

SEQ ID NO: 3655206 - DNA, 21 bp, Homo sapiens
gcctgtttgggaggctggagt

SEQ ID NO: 3655207 - DNA, 18 bp, Homo sapiens
gccttctcttctatcctg

SEQ ID NO: 3655208 - DNA, 21 bp, Homo sapiens
gccttctcttctatcctgcaa

SEQ ID NO: 3655209 - DNA, 14 bp, Homo sapiens
gctattccctggag

SEQ ID NO: 3655210 - DNA, 15 bp, Homo sapiens
gctcacattccctct

SEQ ID NO: 3655211 - DNA, 23 bp, Homo sapiens
gctcacattccctctcatccagg

SEQ ID NO: 3655212 - DNA, 14 bp, Homo sapiens
gctccagggccagg

SEQ ID NO: 3655213 - DNA, 12 bp, Homo sapiens
gctgcttctgtg

SEQ ID NO: 3655214 - DNA, 21 bp, Homo sapiens
gctggaaaggatgcttctgct

SEQ ID NO: 3655215 - DNA, 23 bp, Homo sapiens
gctgggcactgggccggcagcct

SEQ ID NO: 3655216 - DNA, 16 bp, Homo sapiens
gctgtccctcctgagg

SEQ ID NO: 3655217 - DNA, 21 bp, Homo sapiens
gcttctgctcacattccctct

SEQ ID NO: 3655218 - DNA, 23 bp, Homo sapiens
ggacaaagaaatagcaagagatg

SEQ ID NO: 3655219 - DNA, 13 bp, Homo sapiens
ggactctctttct

SEQ ID NO: 3655220 - DNA, 21 bp, Homo sapiens
ggagcagctgggcactgggcc

SEQ ID NO: 3655221 - DNA, 20 bp, Homo sapiens
ggagcctcctgaccctgtga

SEQ ID NO: 3655222 - DNA, 13 bp, Homo sapiens
ggcagggcctggc

SEQ ID NO: 3655223 - DNA, 17 bp, Homo sapiens
ggcatgcgaatgagctg

SEQ ID NO: 3655224 - DNA, 19 bp, Homo sapiens
ggcatgcgaatgagctggg

SEQ ID NO: 3655225 - DNA, 24 bp, Homo sapiens
ggcatgcgaatgagctgggccctg

SEQ ID NO: 3655226 - DNA, 22 bp, Homo sapiens
ggcatggcccagcctggagccg

SEQ ID NO: 3655227 - DNA, 16 bp, Homo sapiens
ggccaagggctccagg

SEQ ID NO: 3655228 - DNA, 20 bp, Homo sapiens
ggccacctccaaggactcta

SEQ ID NO: 3655229 - DNA, 16 bp, Homo sapiens
ggccaggcatggccca

SEQ ID NO: 3655230 - DNA, 21 bp, Homo sapiens
ggccgagggcttccctagatg

SEQ ID NO: 3655231 - DNA, 14 bp, Homo sapiens
ggcctggcctgggt

SEQ ID NO: 3655232 - DNA, 22 bp, Homo sapiens
ggcctgggtggggcagggcctg

SEQ ID NO: 3655233 - DNA, 11 bp, Homo sapiens
gggacactgaa

SEQ ID NO: 3655234 - DNA, 10 bp, Homo sapiens
gggagtagga

SEQ ID NO: 3655235 - DNA, 15 bp, Homo sapiens
gggccggcagcctgg

SEQ ID NO: 3655236 - DNA, 16 bp, Homo sapiens
ggggcagggcctggcc

SEQ ID NO: 3655237 - DNA, 12 bp, Homo sapiens
ggtaacactgat

SEQ ID NO: 3655238 - DNA, 19 bp, Homo sapiens
ggtactcccccagccctca

SEQ ID NO: 3655239 - DNA, 22 bp, Homo sapiens
ggtcctgggatggggcatgtgg

SEQ ID NO: 3655240 - DNA, 21 bp, Homo sapiens
ggtgaggtgggggtctggcct

SEQ ID NO: 3655241 - DNA, 23 bp, Homo sapiens
ggtgaggtgggggtctggcctag

SEQ ID NO: 3655242 - DNA, 15 bp, Homo sapiens
gtactcccccagccc

SEQ ID NO: 3655243 - DNA, 17 bp, Homo sapiens
gtactgagttctcatcc

SEQ ID NO: 3655244 - DNA, 17 bp, Homo sapiens
gtagggttgccagtcct

SEQ ID NO: 3655245 - DNA, 15 bp, Homo sapiens
gtaggttgaggacag

SEQ ID NO: 3655246 - DNA, 16 bp, Homo sapiens
aaacaaagggtgggca

SEQ ID NO: 3655247 - DNA, 17 bp, Homo sapiens
catggcccagcctggag

SEQ ID NO: 3655248 - DNA, 19 bp, Homo sapiens
catggcccagcctggagcc

SEQ ID NO: 3655249 - DNA, 20 bp, Homo sapiens
ccaagggctccagggccagg

SEQ ID NO: 3655250 - DNA, 19 bp, Homo sapiens
ccaatcacattcaggcatg

SEQ ID NO: 3655251 - DNA, 12 bp, Homo sapiens
ccacccagccag

SEQ ID NO: 3655252 - DNA, 23 bp, Homo sapiens
ccagagtagggttgccagtcctg

SEQ ID NO: 3655253 - DNA, 16 bp, Homo sapiens
ccagccacccagccag

SEQ ID NO: 3655254 - DNA, 17 bp, Homo sapiens
ccagccacccagccagg

SEQ ID NO: 3655255 - DNA, 18 bp, Homo sapiens
ccagccacccagccagga

SEQ ID NO: 3655256 - DNA, 16 bp, Homo sapiens
ccagcctggagccgtg

SEQ ID NO: 3655257 - DNA, 15 bp, Homo sapiens
ccaggactctctttc

SEQ ID NO: 3655258 - DNA, 19 bp, Homo sapiens
ccaggcatggcccagcctg

SEQ ID NO: 3655259 - DNA, 21 bp, Homo sapiens
ccaggcatggcccagcctgga

SEQ ID NO: 3655260 - DNA, 12 bp, Homo sapiens
ccagtcctgcaa

SEQ ID NO: 3655261 - DNA, 11 bp, Homo sapiens
cccccagccct

SEQ ID NO: 3655262 - DNA, 23 bp, Homo sapiens
cccctggtactcccccagccctc

SEQ ID NO: 3655263 - DNA, 13 bp, Homo sapiens
cccgaatcctgag

SEQ ID NO: 3655264 - DNA, 14 bp, Homo sapiens
cccgaatcctgagg

SEQ ID NO: 3655265 - DNA, 23 bp, Homo sapiens
ccctagatggttccctttgttgc

SEQ ID NO: 3655266 - DNA, 14 bp, Homo sapiens
ccctatgtcccagc

SEQ ID NO: 3655267 - DNA, 15 bp, Homo sapiens
ccctatgtcccagcc

SEQ ID NO: 3655268 - DNA, 17 bp, Homo sapiens
ccctatgtcccagcccc

SEQ ID NO: 3655269 - DNA, 21 bp, Homo sapiens
ccctcgcatccgcctctgagc

SEQ ID NO: 3655270 - DNA, 21 bp, Homo sapiens
ccctctcatccaggtcctttc

SEQ ID NO: 3655271 - DNA, 19 bp, Homo sapiens
ccctgtgtgtcgttccctt

SEQ ID NO: 3655272 - DNA, 16 bp, Homo sapiens
ccgcctctgagccagg

SEQ ID NO: 3655273 - DNA, 15 bp, Homo sapiens
cctccaaggactcta

SEQ ID NO: 3655274 - DNA, 21 bp, Homo sapiens
cctcctgttcctgccttctct

SEQ ID NO: 3655275 - DNA, 21 bp, Homo sapiens
cctcgcatccgcctctgagcc

SEQ ID NO: 3655276 - DNA, 20 bp, Homo sapiens
cctctcatccaggtcctttc

SEQ ID NO: 3655277 - DNA, 22 bp, Homo sapiens
cctctcatccaggtcctttcct

SEQ ID NO: 3655278 - DNA, 13 bp, Homo sapiens
cctctccagccct

SEQ ID NO: 3655279 - DNA, 19 bp, Homo sapiens
cctctttcctgtgccagga

SEQ ID NO: 3655280 - DNA, 21 bp, Homo sapiens
cctctttcctgtgccaggact

SEQ ID NO: 3655281 - DNA, 21 bp, Homo sapiens
cctgcaagtccatagctgagc

SEQ ID NO: 3655282 - DNA, 12 bp, Homo sapiens
cctggcctggtc

SEQ ID NO: 3655283 - DNA, 19 bp, Homo sapiens
cctgggtggggcagggcct

SEQ ID NO: 3655284 - DNA, 23 bp, Homo sapiens
cctgggtggggcagggcctggcc

SEQ ID NO: 3655285 - DNA, 17 bp, Homo sapiens
cctggttccctctttcc

SEQ ID NO: 3655286 - DNA, 19 bp, Homo sapiens
cctgtgatgcctgacacag

SEQ ID NO: 3655287 - DNA, 22 bp, Homo sapiens
cctgtgtgtcgttcccttgtgt

SEQ ID NO: 3655288 - DNA, 14 bp, Homo sapiens
cctgttcctgcctt

SEQ ID NO: 3655289 - DNA, 18 bp, Homo sapiens
ccttctcgtcttcctctc

SEQ ID NO: 3655290 - DNA, 15 bp, Homo sapiens
cctttgttgctgtct

SEQ ID NO: 3655291 - DNA, 22 bp, Homo sapiens
cgcatccgcctctgagccagga

SEQ ID NO: 3655292 - DNA, 12 bp, Homo sapiens
cgcctctgagcc

SEQ ID NO: 3655293 - DNA, 13 bp, Homo sapiens
cgcctctgagcca

SEQ ID NO: 3655294 - DNA, 18 bp, Homo sapiens
cgcctctgagccaggagc

SEQ ID NO: 3655295 - DNA, 21 bp, Homo sapiens
cgcctctgagccaggagcctc

SEQ ID NO: 3655296 - DNA, 17 bp, Homo sapiens
cggcagcctggttccct

SEQ ID NO: 3655297 - DNA, 12 bp, Homo sapiens
cgtctcctctcc

SEQ ID NO: 3655298 - DNA, 21 bp, Homo sapiens
ctggaaaggatgcttctgctc

SEQ ID NO: 3655299 - DNA, 20 bp, Homo sapiens
ctggagaccccagagtaggg

SEQ ID NO: 3655300 - DNA, 22 bp, Homo sapiens
ctggcctagtggggaggggcct

SEQ ID NO: 3655301 - DNA, 15 bp, Homo sapiens
ctgggcactgggccg

SEQ ID NO: 3655302 - DNA, 13 bp, Homo sapiens
ctgggccctgggt

SEQ ID NO: 3655303 - DNA, 16 bp, Homo sapiens
ctgggccctgggtgag

SEQ ID NO: 3655304 - DNA, 23 bp, Homo sapiens
ctgggtggggcagggcctggcct

SEQ ID NO: 3655305 - DNA, 19 bp, Homo sapiens
ctggtactcccccagccct

SEQ ID NO: 3655306 - DNA, 13 bp, Homo sapiens
ctggttccctctt

SEQ ID NO: 3655307 - DNA, 20 bp, Homo sapiens
ctggttccctctttcctgtg

SEQ ID NO: 3655308 - DNA, 21 bp, Homo sapiens
ctggttccctctttcctgtgc

SEQ ID NO: 3655309 - DNA, 12 bp, Homo sapiens
ctgtactgagtt

SEQ ID NO: 3655310 - DNA, 15 bp, Homo sapiens
ctgtccctcctgagg

SEQ ID NO: 3655311 - DNA, 15 bp, Homo sapiens
ctgtgatgcctgaca

SEQ ID NO: 3655312 - DNA, 18 bp, Homo sapiens
ctgtgcatttgtgtctgc

SEQ ID NO: 3655313 - DNA, 17 bp, Homo sapiens
ctgttcctgccttctct

SEQ ID NO: 3655314 - DNA, 16 bp, Homo sapiens
cttattgggagtagga

SEQ ID NO: 3655315 - DNA, 22 bp, Homo sapiens
cttccctagatggttccctttg

SEQ ID NO: 3655316 - DNA, 15 bp, Homo sapiens
cttcctcctcctcct

SEQ ID NO: 3655317 - DNA, 19 bp, Homo sapiens
cttcctcctcctcctcctg

SEQ ID NO: 3655318 - DNA, 15 bp, Homo sapiens
cttcctctctctcac

SEQ ID NO: 3655319 - DNA, 14 bp, Homo sapiens
cttctatcctgcaa

SEQ ID NO: 3655320 - DNA, 16 bp, Homo sapiens
cttctcgtcttcctct

SEQ ID NO: 3655321 - DNA, 22 bp, Homo sapiens
cttctcgtcttcctctctctca

SEQ ID NO: 3655322 - DNA, 23 bp, Homo sapiens
cttctgtgcatttgtgtctgcct

SEQ ID NO: 3655323 - DNA, 22 bp, Homo sapiens
cttgggctccattcccatcact

SEQ ID NO: 3655324 - DNA, 12 bp, Homo sapiens
cttgtgtctgtt

SEQ ID NO: 3655325 - DNA, 17 bp, Homo sapiens
ctttcctgtgccaggac

SEQ ID NO: 3655326 - DNA, 23 bp, Homo sapiens
ctttttaggccacctccaaggac

SEQ ID NO: 3655327 - DNA, 14 bp, Homo sapiens
gaatgagctgggcc

SEQ ID NO: 3655328 - DNA, 12 bp, Homo sapiens
gactctctttct

SEQ ID NO: 3655329 - DNA, 23 bp, Homo sapiens
gactctctttcttccactaccct

SEQ ID NO: 3655330 - DNA, 16 bp, Homo sapiens
gagcagctgggcactg

SEQ ID NO: 3655331 - DNA, 18 bp, Homo sapiens
gagcagctgggcactggg

SEQ ID NO: 3655332 - DNA, 22 bp, Homo sapiens
gagctggaaaggatgcttctgc

SEQ ID NO: 3655333 - DNA, 15 bp, Homo sapiens
gaggacaggagaggg

SEQ ID NO: 3655334 - DNA, 22 bp, Homo sapiens
gatatccctatgtcccagcccc

SEQ ID NO: 3655335 - DNA, 15 bp, Homo sapiens
gatgcctgacacagg

SEQ ID NO: 3655336 - DNA, 11 bp, Homo sapiens
gcaacagcctg

SEQ ID NO: 3655337 - DNA, 21 bp, Homo sapiens
gcactgggccggcagcctggt

SEQ ID NO: 3655338 - DNA, 17 bp, Homo sapiens
gcagcctggttccctct

SEQ ID NO: 3655339 - DNA, 18 bp, Homo sapiens
gcagcctggttccctctt

SEQ ID NO: 3655340 - DNA, 22 bp, Homo sapiens
gcagctcaagttagcatttcaa

SEQ ID NO: 3655341 - DNA, 13 bp, Homo sapiens
gcagctgggcact

SEQ ID NO: 3655342 - DNA, 22 bp, Homo sapiens
gcagctgggcactgggccggca

SEQ ID NO: 3655343 - DNA, 16 bp, Homo sapiens
gcagggcctggcctgg

SEQ ID NO: 3655344 - DNA, 19 bp, Homo sapiens
gcatccgcctctgagccag

SEQ ID NO: 3655345 - DNA, 14 bp, Homo sapiens
atagctgagctgga

SEQ ID NO: 3655346 - DNA, 16 bp, Homo sapiens
atccaggtcctttcct

SEQ ID NO: 3655347 - DNA, 19 bp, Homo sapiens
atccaggtcctttccttct

SEQ ID NO: 3655348 - DNA, 19 bp, Homo sapiens
atccctatgtcccagcccc

SEQ ID NO: 3655349 - DNA, 20 bp, Homo sapiens
atccctatgtcccagcccct

SEQ ID NO: 3655350 - DNA, 20 bp, Homo sapiens
atccctgtgtgtcgttccct

SEQ ID NO: 3655351 - DNA, 19 bp, Homo sapiens
atccgcctctgagccagga

SEQ ID NO: 3655352 - DNA, 15 bp, Homo sapiens
atcgtgacagcagca

SEQ ID NO: 3655353 - DNA, 17 bp, Homo sapiens
atgagctgggccctggg

SEQ ID NO: 3655354 - DNA, 22 bp, Homo sapiens
atgcgaatgagctgggccctgg

SEQ ID NO: 3655355 - DNA, 16 bp, Homo sapiens
atgctctctatagagg

SEQ ID NO: 3655356 - DNA, 13 bp, Homo sapiens
atgcttctgctca

SEQ ID NO: 3655357 - DNA, 14 bp, Homo sapiens
atgcttctgctcac

SEQ ID NO: 3655358 - DNA, 22 bp, Homo sapiens
atgcttctgctcacattccctc

SEQ ID NO: 3655359 - DNA, 15 bp, Homo sapiens
atggcccagcctgga

SEQ ID NO: 3655360 - DNA, 19 bp, Homo sapiens
atggcccagcctggagccg

SEQ ID NO: 3655361 - DNA, 14 bp, Homo sapiens
attccctctcatcc

SEQ ID NO: 3655362 - DNA, 20 bp, Homo sapiens
attccctctcatccaggtcc

SEQ ID NO: 3655363 - DNA, 13 bp, Homo sapiens
attccctggagac

SEQ ID NO: 3655364 - DNA, 16 bp, Homo sapiens
attctgatacagcctt

SEQ ID NO: 3655365 - DNA, 17 bp, Homo sapiens
attctgatacagcctta

SEQ ID NO: 3655366 - DNA, 19 bp, Homo sapiens
atttgtgtctgcctgcctc

SEQ ID NO: 3655367 - DNA, 16 bp, Homo sapiens
caaagatgagaagcca

SEQ ID NO: 3655368 - DNA, 10 bp, Homo sapiens
caacagaaac

SEQ ID NO: 3655369 - DNA, 22 bp, Homo sapiens
caacagcctgtttgggaggctg

SEQ ID NO: 3655370 - DNA, 18 bp, Homo sapiens
caagggctccagggccag

SEQ ID NO: 3655371 - DNA, 16 bp, Homo sapiens
caagttccgtctcctc

SEQ ID NO: 3655372 - DNA, 9 bp, Homo sapiens
cacagaaat

SEQ ID NO: 3655373 - DNA, 17 bp, Homo sapiens
cacagaggccaggcatg

SEQ ID NO: 3655374 - DNA, 16 bp, Homo sapiens
cacaggggacactgaa

SEQ ID NO: 3655375 - DNA, 17 bp, Homo sapiens
cacaggggacactgaac

SEQ ID NO: 3655376 - DNA, 16 bp, Homo sapiens
cacattccctctcatc

SEQ ID NO: 3655377 - DNA, 15 bp, Homo sapiens
cacctacttcctcct

SEQ ID NO: 3655378 - DNA, 18 bp, Homo sapiens
cactgggccggcagcctg

SEQ ID NO: 3655379 - DNA, 19 bp, Homo sapiens
cacttcccatttgtgtttc

SEQ ID NO: 3655380 - DNA, 23 bp, Homo sapiens
cagaataaatgggtaacactgat

SEQ ID NO: 3655381 - DNA, 19 bp, Homo sapiens
cagccacccagccaggagg

SEQ ID NO: 3655382 - DNA, 13 bp, Homo sapiens
cagccaggagggg

SEQ ID NO: 3655383 - DNA, 19 bp, Homo sapiens
cagcccctggtactccccc

SEQ ID NO: 3655384 - DNA, 14 bp, Homo sapiens
cagcctggagccgt

SEQ ID NO: 3655385 - DNA, 16 bp, Homo sapiens
cagcctggagccgtgg

SEQ ID NO: 3655386 - DNA, 22 bp, Homo sapiens
cagcctggttccctctttcctg

SEQ ID NO: 3655387 - DNA, 15 bp, Homo sapiens
cagctgcttctgtgc

SEQ ID NO: 3655388 - DNA, 15 bp, Homo sapiens
cagctgtactgagtt

SEQ ID NO: 3655389 - DNA, 22 bp, Homo sapiens
cagctgtactgagttctcatcc

SEQ ID NO: 3655390 - DNA, 12 bp, Homo sapiens
caggacagctgc

SEQ ID NO: 3655391 - DNA, 14 bp, Homo sapiens
caggactctctttc

SEQ ID NO: 3655392 - DNA, 16 bp, Homo sapiens
caggactctctttctt

SEQ ID NO: 3655393 - DNA, 21 bp, Homo sapiens
caggcatgcgaatgagctggg

SEQ ID NO: 3655394 - DNA, 13 bp, Homo sapiens
cagggcctggcct

SEQ ID NO: 3655395 - DNA, 12 bp, Homo sapiens
caggtcctttcc

SEQ ID NO: 3655396 - DNA, 15 bp, Homo sapiens
catcactgctgtccc

SEQ ID NO: 3655397 - DNA, 22 bp, Homo sapiens
catccgcctctgagccaggagc

SEQ ID NO: 3655398 - DNA, 13 bp, Homo sapiens
catggcccagcct

SEQ ID NO: 3655399 - DNA, 14 bp, Homo sapiens
catggcccagcctg

SEQ ID NO: 3655400 - DNA, 19 bp, Homo sapiens
caggcatggcccagcctgg

SEQ ID NO: 3655401 - DNA, 21 bp, Homo sapiens
caggcatggcccagcctggag

SEQ ID NO: 3655402 - DNA, 17 bp, Homo sapiens
caggcttgggctccatt

SEQ ID NO: 3655403 - DNA, 21 bp, Homo sapiens
caggcttgggctccattccca

SEQ ID NO: 3655404 - DNA, 12 bp, Homo sapiens
cagggcctggcc

SEQ ID NO: 3655405 - DNA, 17 bp, Homo sapiens
cagggcctggcctggtc

SEQ ID NO: 3655406 - DNA, 14 bp, Homo sapiens
caggggacactgaa

SEQ ID NO: 3655407 - DNA, 22 bp, Homo sapiens
caggggacactgaaccttgttg

SEQ ID NO: 3655408 - DNA, 18 bp, Homo sapiens
cagtaggttgaggacagg

SEQ ID NO: 3655409 - DNA, 15 bp, Homo sapiens
catagctgagctgga

SEQ ID NO: 3655410 - DNA, 17 bp, Homo sapiens
catcactgctgtccctc

SEQ ID NO: 3655411 - DNA, 20 bp, Homo sapiens
catcactgctgtccctcctg

SEQ ID NO: 3655412 - DNA, 16 bp, Homo sapiens
catccaggtcctttcc

SEQ ID NO: 3655413 - DNA, 20 bp, Homo sapiens
catccaggtcctttccttct

SEQ ID NO: 3655414 - DNA, 15 bp, Homo sapiens
catccgcctctgagc

SEQ ID NO: 3655415 - DNA, 20 bp, Homo sapiens
catccgcctctgagccagga

SEQ ID NO: 3655416 - DNA, 19 bp, Homo sapiens
catgcgaatgagctgggcc

SEQ ID NO: 3655417 - DNA, 15 bp, Homo sapiens
catggcccagcctgg

SEQ ID NO: 3655418 - DNA, 15 bp, Homo sapiens
cattccctctcatcc

SEQ ID NO: 3655419 - DNA, 22 bp, Homo sapiens
catttgtgtttcagaaaggagt

SEQ ID NO: 3655420 - DNA, 16 bp, Homo sapiens
ccaatccctgtgtgtc

SEQ ID NO: 3655421 - DNA, 21 bp, Homo sapiens
ccaatccctgtgtgtcgttcc

SEQ ID NO: 3655422 - DNA, 15 bp, Homo sapiens
ccactaccctccctc

SEQ ID NO: 3655423 - DNA, 14 bp, Homo sapiens
ccagccaggagggg

SEQ ID NO: 3655424 - DNA, 17 bp, Homo sapiens
ccagccaggaggggctg

SEQ ID NO: 3655425 - DNA, 23 bp, Homo sapiens
ccagctgtactgagttctcatcc

SEQ ID NO: 3655426 - DNA, 15 bp, Homo sapiens
ccaggagcctcctga

SEQ ID NO: 3655427 - DNA, 14 bp, Homo sapiens
ccaggtcctttcct

SEQ ID NO: 3655428 - DNA, 16 bp, Homo sapiens
ccatagctgagctgga

SEQ ID NO: 3655429 - DNA, 13 bp, Homo sapiens
cccagcctggagc

SEQ ID NO: 3655430 - DNA, 15 bp, Homo sapiens
cccagcctggagccg

SEQ ID NO: 3655431 - DNA, 18 bp, Homo sapiens
ccctctcatccaggtcct

SEQ ID NO: 3655432 - DNA, 13 bp, Homo sapiens
ccctctttcctgt

SEQ ID NO: 3655433 - DNA, 15 bp, Homo sapiens
ccctctttcctgtgc

SEQ ID NO: 3655434 - DNA, 17 bp, Homo sapiens
ccctctttcctgtgcca

SEQ ID NO: 3655435 - DNA, 13 bp, Homo sapiens
ccgcctctgagcc

SEQ ID NO: 3655436 - DNA, 13 bp, Homo sapiens
ccgtctcctctcc

SEQ ID NO: 3655437 - DNA, 16 bp, Homo sapiens
ccgtctcctctccagc

SEQ ID NO: 3655438 - DNA, 15 bp, Homo sapiens
cctacccctgtcctg

SEQ ID NO: 3655439 - DNA, 14 bp, Homo sapiens
cctacttcctcctc

SEQ ID NO: 3655440 - DNA, 17 bp, Homo sapiens
cctacttcctcctcctc

SEQ ID NO: 3655441 - DNA, 17 bp, Homo sapiens
cctagtggggaggggcc

SEQ ID NO: 3655442 - DNA, 18 bp, Homo sapiens
cctagtggggaggggcct

SEQ ID NO: 3655443 - DNA, 22 bp, Homo sapiens
cctagtggggaggggcctggcc

SEQ ID NO: 3655444 - DNA, 16 bp, Homo sapiens
cctcctcctcctcctg

SEQ ID NO: 3655445 - DNA, 13 bp, Homo sapiens
cctcctcctcctg

SEQ ID NO: 3655446 - DNA, 14 bp, Homo sapiens
cctcctcctcctgt

SEQ ID NO: 3655447 - DNA, 15 bp, Homo sapiens
cctcctcctgttcct

SEQ ID NO: 3655448 - DNA, 13 bp, Homo sapiens
cctcctgaccctg

SEQ ID NO: 3655449 - DNA, 19 bp, Homo sapiens
cctcctgttcctgccttct

SEQ ID NO: 3655450 - DNA, 12 bp, Homo sapiens
cctctctctcac

SEQ ID NO: 3655451 - DNA, 19 bp, Homo sapiens
cctgacacaggggacactg

SEQ ID NO: 3655452 - DNA, 22 bp, Homo sapiens
cctgacacaggggacactgaac

SEQ ID NO: 3655453 - DNA, 17 bp, Homo sapiens
cctgaggggatatccct

SEQ ID NO: 3655454 - DNA, 21 bp, Homo sapiens
cctgaggggatatccctatgt

SEQ ID NO: 3655455 - DNA, 13 bp, Homo sapiens
cctggggctgggt

SEQ ID NO: 3655456 - DNA, 17 bp, Homo sapiens
cctgtgccaggactctc

SEQ ID NO: 3655457 - DNA, 21 bp, Homo sapiens
cctgtgccaggactctctttc

SEQ ID NO: 3655458 - DNA, 16 bp, Homo sapiens
cctgttcctgccttct

SEQ ID NO: 3655459 - DNA, 13 bp, Homo sapiens
cctgtttgggagg

SEQ ID NO: 3655460 - DNA, 16 bp, Homo sapiens
ccttctcgtcttcctc

SEQ ID NO: 3655461 - DNA, 18 bp, Homo sapiens
ccttctcttctatcctgc

SEQ ID NO: 3655462 - DNA, 15 bp, Homo sapiens
ccttgtgtctgttgc

SEQ ID NO: 3655463 - DNA, 14 bp, Homo sapiens
ccttgttgatgcca

SEQ ID NO: 3655464 - DNA, 19 bp, Homo sapiens
cctttccttctcgtcttcc

SEQ ID NO: 3655465 - DNA, 17 bp, Homo sapiens
cgcacttcccatttgtg

SEQ ID NO: 3655466 - DNA, 13 bp, Homo sapiens
cggcagcctggtt

SEQ ID NO: 3655467 - DNA, 16 bp, Homo sapiens
cgtctcctctccagcc

SEQ ID NO: 3655468 - DNA, 17 bp, Homo sapiens
cgtcttcctctctctca

SEQ ID NO: 3655469 - DNA, 16 bp, Homo sapiens
ctacccctgtcctggg

SEQ ID NO: 3655470 - DNA, 12 bp, Homo sapiens
ctagatggttcc

SEQ ID NO: 3655471 - DNA, 15 bp, Homo sapiens
ctagatggttccctt

SEQ ID NO: 3655472 - DNA, 18 bp, Homo sapiens
ctagtggggaggggcctg

SEQ ID NO: 3655473 - DNA, 23 bp, Homo sapiens
ctagtggggaggggcctggcctg

SEQ ID NO: 3655474 - DNA, 20 bp, Homo sapiens
ctatgtcccagcccctggta

SEQ ID NO: 3655475 - DNA, 15 bp, Homo sapiens
ctcacattccctctc

SEQ ID NO: 3655476 - DNA, 17 bp, Homo sapiens
ctcacattccctctcat

SEQ ID NO: 3655477 - DNA, 20 bp, Homo sapiens
ctcatccacagaggccaggc

SEQ ID NO: 3655478 - DNA, 19 bp, Homo sapiens
ctcatccaggtcctttcct

SEQ ID NO: 3655479 - DNA, 23 bp, Homo sapiens
ctcatccaggtcctttccttctc

SEQ ID NO: 3655480 - DNA, 18 bp, Homo sapiens
ctccattcccatcactgc

SEQ ID NO: 3655481 - DNA, 20 bp, Homo sapiens
ctccattcccatcactgctg

SEQ ID NO: 3655482 - DNA, 12 bp, Homo sapiens
ctcccccagccc

SEQ ID NO: 3655483 - DNA, 16 bp, Homo sapiens
ctcccgaatcctgagg

SEQ ID NO: 3655484 - DNA, 21 bp, Homo sapiens
ctccctcgcatccgcctctga

SEQ ID NO: 3655485 - DNA, 22 bp, Homo sapiens
ctccctcgcatccgcctctgag

SEQ ID NO: 3655486 - DNA, 19 bp, Homo sapiens
ctcctacccctgtcctggg

SEQ ID NO: 3655487 - DNA, 15 bp, Homo sapiens
ctcctcctcctcctg

SEQ ID NO: 3655488 - DNA, 13 bp, Homo sapiens
ctcctcctcctgt

SEQ ID NO: 3655489 - DNA, 15 bp, Homo sapiens
ctcctctccagccct

SEQ ID NO: 3655490 - DNA, 13 bp, Homo sapiens
ctcctgaccctgt

SEQ ID NO: 3655491 - DNA, 13 bp, Homo sapiens
ctcctgttcctgc

SEQ ID NO: 3655492 - DNA, 17 bp, Homo sapiens
ctcgcatccgcctctga

SEQ ID NO: 3655493 - DNA, 23 bp, Homo sapiens
ctcgcatccgcctctgagccagg

SEQ ID NO: 3655494 - DNA, 16 bp, Homo sapiens
ctcgtcttcctctctc

SEQ ID NO: 3655495 - DNA, 20 bp, Homo sapiens
ctctcatccaggtcctttcc

SEQ ID NO: 3655496 - DNA, 21 bp, Homo sapiens
ctctctcacctacttcctcct

SEQ ID NO: 3655497 - DNA, 13 bp, Homo sapiens
ctctctctcacct

SEQ ID NO: 3655498 - DNA, 16 bp, Homo sapiens
ctctctttcttccact

SEQ ID NO: 3655499 - DNA, 15 bp, Homo sapiens
ctcttctatcctgca

SEQ ID NO: 3655500 - DNA, 20 bp, Homo sapiens
ctctttcctgtgccaggact

SEQ ID NO: 3655501 - DNA, 20 bp, Homo sapiens
ctgaaccttgttgatgccag

SEQ ID NO: 3655502 - DNA, 14 bp, Homo sapiens
ctgacacaggggac

SEQ ID NO: 3655503 - DNA, 14 bp, Homo sapiens
ctgagccaggagcc

SEQ ID NO: 3655504 - DNA, 20 bp, Homo sapiens
ctgagccaggagcctcctga

SEQ ID NO: 3655505 - DNA, 13 bp, Homo sapiens
ctgatacagcctt

SEQ ID NO: 3655506 - DNA, 14 bp, Homo sapiens
ctgatacagcctta

SEQ ID NO: 3655507 - DNA, 15 bp, Homo sapiens
ctgcaacagcctgtt

SEQ ID NO: 3655508 - DNA, 17 bp, Homo sapiens
ctgcctcatgctctcta

SEQ ID NO: 3655509 - DNA, 18 bp, Homo sapiens
caaaagaagcccccagct

SEQ ID NO: 3655510 - DNA, 19 bp, Homo sapiens
caaaagaagcccccagcta

SEQ ID NO: 3655511 - DNA, 20 bp, Homo sapiens
caaaagcaagggaccttcat

SEQ ID NO: 3655512 - DNA, 19 bp, Homo sapiens
caaaagctgggcaggttgg

SEQ ID NO: 3655513 - DNA, 20 bp, Homo sapiens
caaaaggatctttgtggcca

SEQ ID NO: 3655514 - DNA, 15 bp, Homo sapiens
caaaaggctgagaag

SEQ ID NO: 3655515 - DNA, 18 bp, Homo sapiens
caaaaggctgagaaggaa

SEQ ID NO: 3655516 - DNA, 11 bp, Homo sapiens
caaaaggttta

SEQ ID NO: 3655517 - DNA, 15 bp, Homo sapiens
caaaaggtttattcc

SEQ ID NO: 3655518 - DNA, 12 bp, Homo sapiens
caaaatatttaa

SEQ ID NO: 3655519 - DNA, 18 bp, Homo sapiens
caaaatatttaaaaatgt

SEQ ID NO: 3655520 - DNA, 19 bp, Homo sapiens
caaaatatttaaaaatgtc

SEQ ID NO: 3655521 - DNA, 17 bp, Homo sapiens
caaaatcaagcaagcct

SEQ ID NO: 3655522 - DNA, 19 bp, Homo sapiens
caaaatcaagcaagcctct

SEQ ID NO: 3655523 - DNA, 18 bp, Homo sapiens
caaaatgctctagtgcct

SEQ ID NO: 3655524 - DNA, 15 bp, Homo sapiens
caaaattcatttcta

SEQ ID NO: 3655525 - DNA, 19 bp, Homo sapiens
caaaattcatttctaatta

SEQ ID NO: 3655526 - DNA, 13 bp, Homo sapiens
caaacaaagccag

SEQ ID NO: 3655527 - DNA, 20 bp, Homo sapiens
caaacaaagccagaagctga

SEQ ID NO: 3655528 - DNA, 14 bp, Homo sapiens
caaacagagtatgt

SEQ ID NO: 3655529 - DNA, 18 bp, Homo sapiens
caaacatgtggttaatgc

SEQ ID NO: 3655530 - DNA, 21 bp, Homo sapiens
caaaccatttttaaagtagaa

SEQ ID NO: 3655531 - DNA, 13 bp, Homo sapiens
caaaccggcaggt

SEQ ID NO: 3655532 - DNA, 23 bp, Homo sapiens
caaactgaagcagcctctcccca

SEQ ID NO: 3655533 - DNA, 14 bp, Homo sapiens
caaactgtaataca

SEQ ID NO: 3655534 - DNA, 14 bp, Homo sapiens
caaagaggcaagag

SEQ ID NO: 3655535 - DNA, 14 bp, Homo sapiens
caaagaggttttaa

SEQ ID NO: 3655536 - DNA, 20 bp, Homo sapiens
caaagatctgtcctcagcct

SEQ ID NO: 3655537 - DNA, 13 bp, Homo sapiens
caaagattgagaa

SEQ ID NO: 3655538 - DNA, 14 bp, Homo sapiens
caaagattgagaag

SEQ ID NO: 3655539 - DNA, 15 bp, Homo sapiens
caaagattgagaagc

SEQ ID NO: 3655540 - DNA, 14 bp, Homo sapiens
caaagccagaagct

SEQ ID NO: 3655541 - DNA, 16 bp, Homo sapiens
caaagccagaagctga

SEQ ID NO: 3655542 - DNA, 14 bp, Homo sapiens
caaagcccaaggga

SEQ ID NO: 3655543 - DNA, 16 bp, Homo sapiens
caaagctaggatggtt

SEQ ID NO: 3655544 - DNA, 18 bp, Homo sapiens
caaagctaggatggttct

SEQ ID NO: 3655545 - DNA, 12 bp, Homo sapiens
caaagctgagcc

SEQ ID NO: 3655546 - DNA, 17 bp, Homo sapiens
caaagctgagcctgcag

SEQ ID NO: 3655547 - DNA, 13 bp, Homo sapiens
caaagctttcctg

SEQ ID NO: 3655548 - DNA, 16 bp, Homo sapiens
caaaggagtagaaaga

SEQ ID NO: 3655549 - DNA, 20 bp, Homo sapiens
caaaggcacagtgaaggctg

SEQ ID NO: 3655550 - DNA, 13 bp, Homo sapiens
caaaggcagctgt

SEQ ID NO: 3655551 - DNA, 20 bp, Homo sapiens
caaaggcagctgtgtctgag

SEQ ID NO: 3655552 - DNA, 23 bp, Homo sapiens
caaaggcagctgtgtctgagccc

SEQ ID NO: 3655553 - DNA, 24 bp, Homo sapiens
caaaggcagctgtgtctgagccca

SEQ ID NO: 3655554 - DNA, 12 bp, Homo sapiens
caaaggcatgct

SEQ ID NO: 3655555 - DNA, 14 bp, Homo sapiens
caaaggcatgctgg

SEQ ID NO: 3655556 - DNA, 15 bp, Homo sapiens
caaaggctggtggca

SEQ ID NO: 3655557 - DNA, 15 bp, Homo sapiens
caaagtattgtaaat

SEQ ID NO: 3655558 - DNA, 17 bp, Homo sapiens
caaagtattgtaaatta

SEQ ID NO: 3655559 - DNA, 18 bp, Homo sapiens
caaatattcactggcccc

SEQ ID NO: 3655560 - DNA, 21 bp, Homo sapiens
caaatccttagatctggcatg

SEQ ID NO: 3655561 - DNA, 21 bp, Homo sapiens
caaatctcaatgaagccagct

SEQ ID NO: 3655562 - DNA, 13 bp, Homo sapiens
caaatctggaagc

SEQ ID NO: 3655563 - DNA, 15 bp, Homo sapiens
caaatggggccagat

SEQ ID NO: 3655564 - DNA, 19 bp, Homo sapiens
caaatggggccagatccag

SEQ ID NO: 3655565 - DNA, 20 bp, Homo sapiens
caaatggggccagatccagc

SEQ ID NO: 3655566 - DNA, 23 bp, Homo sapiens
caaatggggccagatccagcctg

SEQ ID NO: 3655567 - DNA, 16 bp, Homo sapiens
caaatgtgtgttcctg

SEQ ID NO: 3655568 - DNA, 15 bp, Homo sapiens
caaattatttttcct

SEQ ID NO: 3655569 - DNA, 15 bp, Homo sapiens
caaattctcctctct

SEQ ID NO: 3655570 - DNA, 14 bp, Homo sapiens
caaattcttttgaa

SEQ ID NO: 3655571 - DNA, 21 bp, Homo sapiens
caaattcttttgaattgttac

SEQ ID NO: 3655572 - DNA, 22 bp, Homo sapiens
caacaaatattcactggcccct

SEQ ID NO: 3655573 - DNA, 21 bp, Homo sapiens
caacaacatgtataatatttt

SEQ ID NO: 3655574 - DNA, 18 bp, Homo sapiens
caacaatgtgaggggtcc

SEQ ID NO: 3655575 - DNA, 18 bp, Homo sapiens
caacacatttcacttttc

SEQ ID NO: 3655576 - DNA, 20 bp, Homo sapiens
caacacctctgcacaagctg

SEQ ID NO: 3655577 - DNA, 22 bp, Homo sapiens
caacacctctgcacaagctgca

SEQ ID NO: 3655578 - DNA, 13 bp, Homo sapiens
caacagatctgga

SEQ ID NO: 3655579 - DNA, 17 bp, Homo sapiens
caacagatctggaacct

SEQ ID NO: 3655580 - DNA, 15 bp, Homo sapiens
caacaggagctggga

SEQ ID NO: 3655581 - DNA, 20 bp, Homo sapiens
caacaggcttatgaatatat

SEQ ID NO: 3655582 - DNA, 17 bp, Homo sapiens
caacatgtataatattt

SEQ ID NO: 3655583 - DNA, 14 bp, Homo sapiens
caaccactctgtgg

SEQ ID NO: 3655584 - DNA, 18 bp, Homo sapiens
caaccactctgtggccag

SEQ ID NO: 3655585 - DNA, 21 bp, Homo sapiens
caaccactctgtggccagcct

SEQ ID NO: 3655586 - DNA, 12 bp, Homo sapiens
caacccccaccc

SEQ ID NO: 3655587 - DNA, 23 bp, Homo sapiens
caacccccaccccacacttgttc

SEQ ID NO: 3655588 - DNA, 14 bp, Homo sapiens
caaccccctgtaag

SEQ ID NO: 3655589 - DNA, 19 bp, Homo sapiens
caaccccctgtaaggttcc

SEQ ID NO: 3655590 - DNA, 20 bp, Homo sapiens
caacccgtgcccctgggatc

SEQ ID NO: 3655591 - DNA, 21 bp, Homo sapiens
caacccgtgcccctgggatcc

SEQ ID NO: 3655592 - DNA, 19 bp, Homo sapiens
caacccttaccccttagcc

SEQ ID NO: 3655593 - DNA, 20 bp, Homo sapiens
caacccttaccccttagcct

SEQ ID NO: 3655594 - DNA, 18 bp, Homo sapiens
caacccttccctcacctt

SEQ ID NO: 3655595 - DNA, 14 bp, Homo sapiens
caaccttgcatcca

SEQ ID NO: 3655596 - DNA, 15 bp, Homo sapiens
caacgaggaagccct

SEQ ID NO: 3655597 - DNA, 23 bp, Homo sapiens
caacggtctcctgactggtgctg

SEQ ID NO: 3655598 - DNA, 14 bp, Homo sapiens
caacgtggcccaga

SEQ ID NO: 3655599 - DNA, 17 bp, Homo sapiens
caactacccccagctgt

SEQ ID NO: 3655600 - DNA, 20 bp, Homo sapiens
caactacccccagctgtgct

SEQ ID NO: 3655601 - DNA, 17 bp, Homo sapiens
caactattttcagatgt

SEQ ID NO: 3655602 - DNA, 16 bp, Homo sapiens
caactgcattggcttt

SEQ ID NO: 3655603 - DNA, 13 bp, Homo sapiens
caactgggcccaa

SEQ ID NO: 3655604 - DNA, 22 bp, Homo sapiens
caacttctgcctcccatgctta

SEQ ID NO: 3655605 - DNA, 15 bp, Homo sapiens
caagaaagaaacccg

SEQ ID NO: 3655606 - DNA, 13 bp, Homo sapiens
caagaagaaaaag

SEQ ID NO: 3655607 - DNA, 20 bp, Homo sapiens
caagaaggaaagatttgtga

SEQ ID NO: 3655608 - DNA, 22 bp, Homo sapiens
caagaaggggtgtttattcttc

SEQ ID NO: 3655609 - DNA, 11 bp, Homo sapiens
caagaatgtac

SEQ ID NO: 3655610 - DNA, 22 bp, Homo sapiens
caagaattgaagcaggactaaa

SEQ ID NO: 3655611 - DNA, 16 bp, Homo sapiens
caagacagatgcccca

SEQ ID NO: 3655612 - DNA, 20 bp, Homo sapiens
caagaccaagcttagtcctg

SEQ ID NO: 3655613 - DNA, 21 bp, Homo sapiens
caagaccaagcttagtcctgg

SEQ ID NO: 3655614 - DNA, 22 bp, Homo sapiens
caagaccaagcttagtcctggg

SEQ ID NO: 3655615 - DNA, 18 bp, Homo sapiens
caagagactctcctgcct

SEQ ID NO: 3655616 - DNA, 16 bp, Homo sapiens
caagagcagcctgtgg

SEQ ID NO: 3655617 - DNA, 17 bp, Homo sapiens
caagagcagcctgtggc

SEQ ID NO: 3655618 - DNA, 18 bp, Homo sapiens
caagagcagcctgtggca

SEQ ID NO: 3655619 - DNA, 20 bp, Homo sapiens
caagaggctgttcccaccag

SEQ ID NO: 3655620 - DNA, 12 bp, Homo sapiens
caagagggctgc

SEQ ID NO: 3655621 - DNA, 13 bp, Homo sapiens
caagagggctgct

SEQ ID NO: 3655622 - DNA, 14 bp, Homo sapiens
caagcagaggacca

SEQ ID NO: 3655623 - DNA, 21 bp, Homo sapiens
caagcagaggaccagggcctt

SEQ ID NO: 3655624 - DNA, 17 bp, Homo sapiens
caagcaggaagctcaga

SEQ ID NO: 3655625 - DNA, 21 bp, Homo sapiens
caagcaggaagctcagactgg

SEQ ID NO: 3655626 - DNA, 16 bp, Homo sapiens
caagcagtcgtgcctg

SEQ ID NO: 3655627 - DNA, 21 bp, Homo sapiens
caagcagtcgtgcctgtgtcc

SEQ ID NO: 3655628 - DNA, 18 bp, Homo sapiens
cactgcactccagcctgg

SEQ ID NO: 3655629 - DNA, 21 bp, Homo sapiens
cactgccttcgcttcttgcct

SEQ ID NO: 3655630 - DNA, 20 bp, Homo sapiens
cactgcgggagctctgtatg

SEQ ID NO: 3655631 - DNA, 13 bp, Homo sapiens
cactgctccttgc

SEQ ID NO: 3655632 - DNA, 14 bp, Homo sapiens
cactgctccttgct

SEQ ID NO: 3655633 - DNA, 19 bp, Homo sapiens
cactggcgaggtgcggcca

SEQ ID NO: 3655634 - DNA, 22 bp, Homo sapiens
cactggtccccaacaatgtgag

SEQ ID NO: 3655635 - DNA, 17 bp, Homo sapiens
cactgtcccttgcctca

SEQ ID NO: 3655636 - DNA, 14 bp, Homo sapiens
cactgtgaaggacc

SEQ ID NO: 3655637 - DNA, 17 bp, Homo sapiens
cactgtgaaggaccctt

SEQ ID NO: 3655638 - DNA, 18 bp, Homo sapiens
cactgtttgtttttattt

SEQ ID NO: 3655639 - DNA, 15 bp, Homo sapiens
cacttactggtagga

SEQ ID NO: 3655640 - DNA, 21 bp, Homo sapiens
cacttactggtaggaccaagc

SEQ ID NO: 3655641 - DNA, 21 bp, Homo sapiens
cacttcaaagaagctgtcttg

SEQ ID NO: 3655642 - DNA, 21 bp, Homo sapiens
cacttcagctgacttttctgt

SEQ ID NO: 3655643 - DNA, 14 bp, Homo sapiens
cacttcccaccctg

SEQ ID NO: 3655644 - DNA, 23 bp, Homo sapiens
cacttcctacaagagcagcctgt

SEQ ID NO: 3655645 - DNA, 21 bp, Homo sapiens
cacttcgggaggtcgaggcag

SEQ ID NO: 3655646 - DNA, 20 bp, Homo sapiens
cacttctgtgagacccccac

SEQ ID NO: 3655647 - DNA, 14 bp, Homo sapiens
cacttgcctcttcc

SEQ ID NO: 3655648 - DNA, 13 bp, Homo sapiens
cacttgttccagc

SEQ ID NO: 3655649 - DNA, 12 bp, Homo sapiens
cactttcaaaac

SEQ ID NO: 3655650 - DNA, 15 bp, Homo sapiens
cactttcatgcagtg

SEQ ID NO: 3655651 - DNA, 21 bp, Homo sapiens
cactttcatgcagtgctcttt

SEQ ID NO: 3655652 - DNA, 22 bp, Homo sapiens
cactttcatgcagtgctctttg

SEQ ID NO: 3655653 - DNA, 18 bp, Homo sapiens
cactttcttattctgtat

SEQ ID NO: 3655654 - DNA, 12 bp, Homo sapiens
cactttgggagg

SEQ ID NO: 3655655 - DNA, 16 bp, Homo sapiens
cactttgggaggccaa

SEQ ID NO: 3655656 - DNA, 16 bp, Homo sapiens
cagaaaattagccggg

SEQ ID NO: 3655657 - DNA, 12 bp, Homo sapiens
cagaaaggagac

SEQ ID NO: 3655658 - DNA, 14 bp, Homo sapiens
cagaacctcttccc

SEQ ID NO: 3655659 - DNA, 14 bp, Homo sapiens
cagaactcctacct

SEQ ID NO: 3655660 - DNA, 19 bp, Homo sapiens
cagaagaggttgggcttcc

SEQ ID NO: 3655661 - DNA, 22 bp, Homo sapiens
cagaagaggttgggcttccatg

SEQ ID NO: 3655662 - DNA, 14 bp, Homo sapiens
cagaagcctctggc

SEQ ID NO: 3655663 - DNA, 19 bp, Homo sapiens
cagaagcctctggctagag

SEQ ID NO: 3655664 - DNA, 16 bp, Homo sapiens
cagaagctgagcacca

SEQ ID NO: 3655665 - DNA, 18 bp, Homo sapiens
cagaagtgcccttcctgc

SEQ ID NO: 3655666 - DNA, 18 bp, Homo sapiens
cagaagtttgcactatct

SEQ ID NO: 3655667 - DNA, 22 bp, Homo sapiens
cagaagtttgcactatctttca

SEQ ID NO: 3655668 - DNA, 18 bp, Homo sapiens
cagaatggggtgcatgaa

SEQ ID NO: 3655669 - DNA, 20 bp, Homo sapiens
cagaatgtaagtgggcccac

SEQ ID NO: 3655670 - DNA, 23 bp, Homo sapiens
cagaatgtaagtgggcccacccg

SEQ ID NO: 3655671 - DNA, 21 bp, Homo sapiens
cagaatgtgataaggaaatca

SEQ ID NO: 3655672 - DNA, 17 bp, Homo sapiens
aaggagagcaagaagga

SEQ ID NO: 3655673 - DNA, 22 bp, Homo sapiens
aaggagagcaagaaggaaagat

SEQ ID NO: 3655674 - DNA, 13 bp, Homo sapiens
aaggagagcctgc

SEQ ID NO: 3655675 - DNA, 14 bp, Homo sapiens
aaggagagcctgct

SEQ ID NO: 3655676 - DNA, 11 bp, Homo sapiens
aaggagagcta

SEQ ID NO: 3655677 - DNA, 18 bp, Homo sapiens
aaggagctgctatagcct

SEQ ID NO: 3655678 - DNA, 20 bp, Homo sapiens
aaggagctgctatagcctgg

SEQ ID NO: 3655679 - DNA, 18 bp, Homo sapiens
aaggaggaagagaaaaaa

SEQ ID NO: 3655680 - DNA, 15 bp, Homo sapiens
aaggagggagatgga

SEQ ID NO: 3655681 - DNA, 19 bp, Homo sapiens
aaggaggggaaaaaaatgt

SEQ ID NO: 3655682 - DNA, 13 bp, Homo sapiens
aaggatcatctga

SEQ ID NO: 3655683 - DNA, 22 bp, Homo sapiens
aaggcacctataaaacaggtca

SEQ ID NO: 3655684 - DNA, 22 bp, Homo sapiens
aaggcagcgtgccgagccagca

SEQ ID NO: 3655685 - DNA, 18 bp, Homo sapiens
aaggcagctgtgtctgag

SEQ ID NO: 3655686 - DNA, 19 bp, Homo sapiens
aaggcaggaagggaagcgt

SEQ ID NO: 3655687 - DNA, 15 bp, Homo sapiens
aaggcagggctcctc

SEQ ID NO: 3655688 - DNA, 16 bp, Homo sapiens
aaggcagggctcctcc

SEQ ID NO: 3655689 - DNA, 22 bp, Homo sapiens
aaggcatgctggagtacccagc

SEQ ID NO: 3655690 - DNA, 20 bp, Homo sapiens
aaggccagagtggcctggcc

SEQ ID NO: 3655691 - DNA, 19 bp, Homo sapiens
aaggccagctggcagcaga

SEQ ID NO: 3655692 - DNA, 14 bp, Homo sapiens
aaggccccttccac

SEQ ID NO: 3655693 - DNA, 12 bp, Homo sapiens
aaggctgagaag

SEQ ID NO: 3655694 - DNA, 19 bp, Homo sapiens
aaggctgaggaaaggccag

SEQ ID NO: 3655695 - DNA, 20 bp, Homo sapiens
aaggctgaggaaaggccagc

SEQ ID NO: 3655696 - DNA, 16 bp, Homo sapiens
aaggctgggggaagaa

SEQ ID NO: 3655697 - DNA, 17 bp, Homo sapiens
aaggcttgttgtgcttt

SEQ ID NO: 3655698 - DNA, 19 bp, Homo sapiens
aaggcttgttgtgctttta

SEQ ID NO: 3655699 - DNA, 20 bp, Homo sapiens
aaggcttgttgtgcttttag

SEQ ID NO: 3655700 - DNA, 18 bp, Homo sapiens
aagggagctatcaggaac

SEQ ID NO: 3655701 - DNA, 21 bp, Homo sapiens
aagggcaggaaggagagcctg

SEQ ID NO: 3655702 - DNA, 17 bp, Homo sapiens
aagggccagagccaggg

SEQ ID NO: 3655703 - DNA, 15 bp, Homo sapiens
aagggcgtggctctg

SEQ ID NO: 3655704 - DNA, 22 bp, Homo sapiens
aagggcgtggctctgggtgggc

SEQ ID NO: 3655705 - DNA, 18 bp, Homo sapiens
aaggggcgtctgttcccc

SEQ ID NO: 3655706 - DNA, 13 bp, Homo sapiens
aaggggcttcagg

SEQ ID NO: 3655707 - DNA, 20 bp, Homo sapiens
aaggggtgctgtgaggcttg

SEQ ID NO: 3655708 - DNA, 17 bp, Homo sapiens
aagggtttgtggctggg

SEQ ID NO: 3655709 - DNA, 14 bp, Homo sapiens
aaggtaggaagaga

SEQ ID NO: 3655710 - DNA, 17 bp, Homo sapiens
aaggtaggaagagaggt

SEQ ID NO: 3655711 - DNA, 14 bp, Homo sapiens
aaggtgatttcaga

SEQ ID NO: 3655712 - DNA, 15 bp, Homo sapiens
aaggtgcggggagaa

SEQ ID NO: 3655713 - DNA, 13 bp, Homo sapiens
aaggttgtattgc

SEQ ID NO: 3655714 - DNA, 15 bp, Homo sapiens
aaggtttaggctggt

SEQ ID NO: 3655715 - DNA, 17 bp, Homo sapiens
aagtaaaggtcagtttt

SEQ ID NO: 3655716 - DNA, 20 bp, Homo sapiens
aagtaacctctacaggcatt

SEQ ID NO: 3655717 - DNA, 14 bp, Homo sapiens
aagtatcacttttc

SEQ ID NO: 3655718 - DNA, 15 bp, Homo sapiens
aagtattgtaaatta

SEQ ID NO: 3655719 - DNA, 21 bp, Homo sapiens
aagtattgtaaattatatttg

SEQ ID NO: 3655720 - DNA, 21 bp, Homo sapiens
aagtcaagtgaaaaaggagga

SEQ ID NO: 3655721 - DNA, 15 bp, Homo sapiens
aagtcagctccagct

SEQ ID NO: 3655722 - DNA, 18 bp, Homo sapiens
aagtccaattttaattta

SEQ ID NO: 3655723 - DNA, 18 bp, Homo sapiens
aagtccccaggccccagg

SEQ ID NO: 3655724 - DNA, 22 bp, Homo sapiens
aagtccccaggccccaggaagc

SEQ ID NO: 3655725 - DNA, 15 bp, Homo sapiens
aagtctcagaagagg

SEQ ID NO: 3655726 - DNA, 15 bp, Homo sapiens
aagtcttttttttcc

SEQ ID NO: 3655727 - DNA, 23 bp, Homo sapiens
aagtgattttcattgtaaatatt

SEQ ID NO: 3655728 - DNA, 15 bp, Homo sapiens
aagtgcatgcattga

SEQ ID NO: 3655729 - DNA, 19 bp, Homo sapiens
aagtgcatgcattgagctg

SEQ ID NO: 3655730 - DNA, 23 bp, Homo sapiens
aagtgcatgcattgagctgcctc

SEQ ID NO: 3655731 - DNA, 19 bp, Homo sapiens
aagtgcctagactgttact

SEQ ID NO: 3655732 - DNA, 11 bp, Homo sapiens
aagtgctggga

SEQ ID NO: 3655733 - DNA, 11 bp, Homo sapiens
aagttaagaat

SEQ ID NO: 3655734 - DNA, 12 bp, Homo sapiens
aagttatatttc

SEQ ID NO: 3655735 - DNA, 13 bp, Homo sapiens
aagttatatttca

SEQ ID NO: 3655736 - DNA, 17 bp, Homo sapiens
aagttcatgctttgttc

SEQ ID NO: 3655737 - DNA, 17 bp, Homo sapiens
aagttgaggggagcatg

SEQ ID NO: 3655738 - DNA, 19 bp, Homo sapiens
aagttgaggggagcatgct

SEQ ID NO: 3655739 - DNA, 20 bp, Homo sapiens
aagttgaggggagcatgctt

SEQ ID NO: 3655740 - DNA, 21 bp, Homo sapiens
aagtttgcactatctttcagc

SEQ ID NO: 3655741 - DNA, 13 bp, Homo sapiens
aagttttcttgtt

SEQ ID NO: 3655742 - DNA, 23 bp, Homo sapiens
aagttttcttgtttctgcatctt

SEQ ID NO: 3655743 - DNA, 12 bp, Homo sapiens
aagtttttttgc

SEQ ID NO: 3655744 - DNA, 23 bp, Homo sapiens
aataaaaacattgcctttgaatg

SEQ ID NO: 3655745 - DNA, 14 bp, Homo sapiens
aataaaaaccaaga

SEQ ID NO: 3655746 - DNA, 11 bp, Homo sapiens
aataaaaaggc

SEQ ID NO: 3655747 - DNA, 13 bp, Homo sapiens
aataaaaaggcac

SEQ ID NO: 3655748 - DNA, 12 bp, Homo sapiens
aataaaagaaca

SEQ ID NO: 3655749 - DNA, 13 bp, Homo sapiens
aataaaagaacat

SEQ ID NO: 3655750 - DNA, 17 bp, Homo sapiens
aataaaagaacatgctt

SEQ ID NO: 3655751 - DNA, 23 bp, Homo sapiens
aataaaattaaagctgaaaactg

SEQ ID NO: 3655752 - DNA, 16 bp, Homo sapiens
aataaaattacacagt

SEQ ID NO: 3655753 - DNA, 17 bp, Homo sapiens
aataaatctgacccagt

SEQ ID NO: 3655754 - DNA, 18 bp, Homo sapiens
aataaatttatatgaaaa

SEQ ID NO: 3655755 - DNA, 18 bp, Homo sapiens
aataacctcaaagtgact

SEQ ID NO: 3655756 - DNA, 20 bp, Homo sapiens
aataactggaacaaattatt

SEQ ID NO: 3655757 - DNA, 16 bp, Homo sapiens
aataatactgctgaga

SEQ ID NO: 3655758 - DNA, 18 bp, Homo sapiens
aataatatttcaagtgcc

SEQ ID NO: 3655759 - DNA, 19 bp, Homo sapiens
aataatatttcaagtgcct

SEQ ID NO: 3655760 - DNA, 14 bp, Homo sapiens
aatacaaaaatttg

SEQ ID NO: 3655761 - DNA, 13 bp, Homo sapiens
aatacaaatgtta

SEQ ID NO: 3655762 - DNA, 15 bp, Homo sapiens
aatacagtacaggca

SEQ ID NO: 3655763 - DNA, 17 bp, Homo sapiens
aatacagtacaggcagc

SEQ ID NO: 3655764 - DNA, 20 bp, Homo sapiens
aataccagagccttcaagtg

SEQ ID NO: 3655765 - DNA, 23 bp, Homo sapiens
aataccagagccttcaagtgcca

SEQ ID NO: 3655766 - DNA, 22 bp, Homo sapiens
aatactctaccctcttagaaaa

SEQ ID NO: 3655767 - DNA, 13 bp, Homo sapiens
aatactgctgaga

SEQ ID NO: 3655768 - DNA, 17 bp, Homo sapiens
aatactttttctaatga

SEQ ID NO: 3655769 - DNA, 15 bp, Homo sapiens
aataggatttttaga

SEQ ID NO: 3655770 - DNA, 13 bp, Homo sapiens
aatatatgtattt

SEQ ID NO: 3655771 - DNA, 14 bp, Homo sapiens
aatatatgtatttt

SEQ ID NO: 3655772 - DNA, 20 bp, Homo sapiens
aatatcaaatgcagtatatt

SEQ ID NO: 3655773 - DNA, 22 bp, Homo sapiens
aatatccaggtgtgcccctcca

SEQ ID NO: 3655774 - DNA, 15 bp, Homo sapiens
aatatctaaagttat

SEQ ID NO: 3655775 - DNA, 12 bp, Homo sapiens
aatatgtaccaa

SEQ ID NO: 3655776 - DNA, 15 bp, Homo sapiens
aatatgtaccaagaa

SEQ ID NO: 3655777 - DNA, 16 bp, Homo sapiens
aatattatgctgcttt

SEQ ID NO: 3655778 - DNA, 21 bp, Homo sapiens
aatattcccttttaggtgagg

SEQ ID NO: 3655779 - DNA, 17 bp, Homo sapiens
aatattttatctttcct

SEQ ID NO: 3655780 - DNA, 23 bp, Homo sapiens
aatattttctctgtacttttcat

SEQ ID NO: 3655781 - DNA, 21 bp, Homo sapiens
aatcaacttgcttatcaactt

SEQ ID NO: 3655782 - DNA, 15 bp, Homo sapiens
aatcaagtctgttta

SEQ ID NO: 3655783 - DNA, 22 bp, Homo sapiens
aatcaatgctataactatgttg

SEQ ID NO: 3655784 - DNA, 18 bp, Homo sapiens
aatcaccacaaactgtaa

SEQ ID NO: 3655785 - DNA, 13 bp, Homo sapiens
aatcacccaatcc

SEQ ID NO: 3655786 - DNA, 16 bp, Homo sapiens
aatcagaatttttaga

SEQ ID NO: 3655787 - DNA, 12 bp, Homo sapiens
aatcagactctt

SEQ ID NO: 3655788 - DNA, 18 bp, Homo sapiens
aatcagcctgctccagct

SEQ ID NO: 3655789 - DNA, 22 bp, Homo sapiens
aatcaggcctgatgagggggaa

SEQ ID NO: 3655790 - DNA, 17 bp, Homo sapiens
aatcagtgacatctgat

SEQ ID NO: 3655791 - DNA, 23 bp, Homo sapiens
aatcagttgtttaataatttaca

SEQ ID NO: 3655792 - DNA, 15 bp, Homo sapiens
aatcatcattattat

SEQ ID NO: 3655793 - DNA, 14 bp, Homo sapiens
aatcattccttaga

SEQ ID NO: 3655794 - DNA, 14 bp, Homo sapiens
aatcatttgtttac

SEQ ID NO: 3655795 - DNA, 17 bp, Homo sapiens
aatccaggcagatccag

SEQ ID NO: 3655796 - DNA, 22 bp, Homo sapiens
aatccaggcagatccaggacta

SEQ ID NO: 3655797 - DNA, 14 bp, Homo sapiens
aatcctacagtgaa

SEQ ID NO: 3655798 - DNA, 21 bp, Homo sapiens
aatcctggagagggtattttt

SEQ ID NO: 3655799 - DNA, 18 bp, Homo sapiens
aatcggctggggactgct

SEQ ID NO: 3655800 - DNA, 17 bp, Homo sapiens
aatctcagctcactgtg

SEQ ID NO: 3655801 - DNA, 21 bp, Homo sapiens
aatctcagttgattttctgga

SEQ ID NO: 3655802 - DNA, 13 bp, Homo sapiens
aatctctgtgcct

SEQ ID NO: 3655803 - DNA, 18 bp, Homo sapiens
aatctggcttagtgccac

SEQ ID NO: 3655804 - DNA, 23 bp, Homo sapiens
aatctggcttctggccaggaagc

SEQ ID NO: 3655805 - DNA, 19 bp, Homo sapiens
aatctgtcaagagtagtta

SEQ ID NO: 3655806 - DNA, 20 bp, Homo sapiens
aatctgttatgtactagtgt

SEQ ID NO: 3655807 - DNA, 23 bp, Homo sapiens
aatcttaagtaccaatgggaagc

SEQ ID NO: 3655808 - DNA, 13 bp, Homo sapiens
aatgaagccagct

SEQ ID NO: 3655809 - DNA, 22 bp, Homo sapiens
aatgaatctttgactgaagccg

SEQ ID NO: 3655810 - DNA, 17 bp, Homo sapiens
aatgaattcctagaatt

SEQ ID NO: 3655811 - DNA, 16 bp, Homo sapiens
aatgaggagagaaaat

SEQ ID NO: 3655812 - DNA, 22 bp, Homo sapiens
aatgaggagagaaaatatatgt

SEQ ID NO: 3655813 - DNA, 21 bp, Homo sapiens
aatgatgatcctaggcatttg

SEQ ID NO: 3655814 - DNA, 22 bp, Homo sapiens
aatgcagcagggatgccctgga

SEQ ID NO: 3655815 - DNA, 19 bp, Homo sapiens
aatgccaagcacttctttt

SEQ ID NO: 3655816 - DNA, 19 bp, Homo sapiens
aatgccggttaaattccat

SEQ ID NO: 3655817 - DNA, 16 bp, Homo sapiens
aatggaaattttgcta

SEQ ID NO: 3655818 - DNA, 17 bp, Homo sapiens
aatggagctttctgtat

SEQ ID NO: 3655819 - DNA, 20 bp, Homo sapiens
aatggcatgagaaatacaaa

SEQ ID NO: 3655820 - DNA, 23 bp, Homo sapiens
aatggcatgagaaatacaaaaat

SEQ ID NO: 3655821 - DNA, 18 bp, Homo sapiens
aatggcccggcccctcct

SEQ ID NO: 3655822 - DNA, 14 bp, Homo sapiens
aatgggacctgtgg

SEQ ID NO: 3655823 - DNA, 21 bp, Homo sapiens
aatggtccgctttcctggagc

SEQ ID NO: 3655824 - DNA, 23 bp, Homo sapiens
aatggtgcgtgaaggctctcaga

SEQ ID NO: 3655825 - DNA, 17 bp, Homo sapiens
aatggtgttatttgaaa

SEQ ID NO: 3655826 - DNA, 23 bp, Homo sapiens
aatggtttgaatataaacactat

SEQ ID NO: 3655827 - DNA, 19 bp, Homo sapiens
aatggtttgcaaggaagcc

SEQ ID NO: 3655828 - DNA, 16 bp, Homo sapiens
aatggtttgtcctgat

SEQ ID NO: 3655829 - DNA, 17 bp, Homo sapiens
aatggtttttaaatttt

SEQ ID NO: 3655830 - DNA, 21 bp, Homo sapiens
aatggtttttaaattttgtaa

SEQ ID NO: 3655831 - DNA, 13 bp, Homo sapiens
aatgtaaacattt

SEQ ID NO: 3655832 - DNA, 14 bp, Homo sapiens
aatgtaaacatttt

SEQ ID NO: 3655833 - DNA, 15 bp, Homo sapiens
aatgtacagacatat

SEQ ID NO: 3655834 - DNA, 17 bp, Homo sapiens
aatgtacagttgaaata

SEQ ID NO: 3655835 - DNA, 19 bp, Homo sapiens
aatgtacttgtttctctgt

SEQ ID NO: 3655836 - DNA, 15 bp, Homo sapiens
aatgtcatatactgc

SEQ ID NO: 3655837 - DNA, 21 bp, Homo sapiens
aatgtcctccagaagcctctg

SEQ ID NO: 3655838 - DNA, 17 bp, Homo sapiens
aatgtgaaaagaaaaat

SEQ ID NO: 3655839 - DNA, 19 bp, Homo sapiens
aatgtgaaaagaaaaatga

SEQ ID NO: 3655840 - DNA, 18 bp, Homo sapiens
aatgtgtgttcctgcttt

SEQ ID NO: 3655841 - DNA, 17 bp, Homo sapiens
aatgtgttttgtacatg

SEQ ID NO: 3655842 - DNA, 22 bp, Homo sapiens
aatgttaattttttggtacaaa

SEQ ID NO: 3655843 - DNA, 16 bp, Homo sapiens
aatgtttaaacatttt

SEQ ID NO: 3655844 - DNA, 17 bp, Homo sapiens
aatgttttaaatgtaca

SEQ ID NO: 3655845 - DNA, 22 bp, Homo sapiens
aatgttttctttgcaaagtatt

SEQ ID NO: 3655846 - DNA, 15 bp, Homo sapiens
aatgtttttctgcca

SEQ ID NO: 3655847 - DNA, 14 bp, Homo sapiens
aattaaaacacttt

SEQ ID NO: 3655848 - DNA, 21 bp, Homo sapiens
aattaaaatggatgccttgaa

SEQ ID NO: 3655849 - DNA, 12 bp, Homo sapiens
aattaacactgc

SEQ ID NO: 3655850 - DNA, 15 bp, Homo sapiens
aattagccaagtgtg

SEQ ID NO: 3655851 - DNA, 14 bp, Homo sapiens
aattatactacttt

SEQ ID NO: 3655852 - DNA, 13 bp, Homo sapiens
aattatatttgtg

SEQ ID NO: 3655853 - DNA, 22 bp, Homo sapiens
aattatatttgtgctatagtat

SEQ ID NO: 3655854 - DNA, 16 bp, Homo sapiens
aattcagcaaaccatt

SEQ ID NO: 3655855 - DNA, 22 bp, Homo sapiens
aattcagcccaccagccacctc

SEQ ID NO: 3655856 - DNA, 17 bp, Homo sapiens
aattccatatgctccag

SEQ ID NO: 3655857 - DNA, 17 bp, Homo sapiens
aattcctctttgctttg

SEQ ID NO: 3655858 - DNA, 10 bp, Homo sapiens
aattcctgga

SEQ ID NO: 3655859 - DNA, 11 bp, Homo sapiens
aattcctggaa

SEQ ID NO: 3655860 - DNA, 12 bp, Homo sapiens
aattcctggaac

SEQ ID NO: 3655861 - DNA, 17 bp, Homo sapiens
aattcctggaacctgga

SEQ ID NO: 3655862 - DNA, 22 bp, Homo sapiens
aattctagctttgagcttaaga

SEQ ID NO: 3655863 - DNA, 12 bp, Homo sapiens
aattctcctgga

SEQ ID NO: 3655864 - DNA, 13 bp, Homo sapiens
aattctcctggag

SEQ ID NO: 3655865 - DNA, 19 bp, Homo sapiens
aattctgtttttaatgcta

SEQ ID NO: 3655866 - DNA, 22 bp, Homo sapiens
aattctgtttttaatgctattt

SEQ ID NO: 3655867 - DNA, 18 bp, Homo sapiens
aattcttaaaaaattgaa

SEQ ID NO: 3655868 - DNA, 14 bp, Homo sapiens
aattgactgccctc

SEQ ID NO: 3655869 - DNA, 10 bp, Homo sapiens
aattgctttg

SEQ ID NO: 3655870 - DNA, 16 bp, Homo sapiens
aattgctttgccaaaa

SEQ ID NO: 3655871 - DNA, 20 bp, Homo sapiens
aattgctttgccaaaatacc

SEQ ID NO: 3655872 - DNA, 21 bp, Homo sapiens
aattgctttgccaaaatacca

SEQ ID NO: 3655873 - DNA, 17 bp, Homo sapiens
aattgtactaaagccaa

SEQ ID NO: 3655874 - DNA, 12 bp, Homo sapiens
aatttaaagcaa

SEQ ID NO: 3655875 - DNA, 21 bp, Homo sapiens
aatttagaaactaattgactt

SEQ ID NO: 3655876 - DNA, 14 bp, Homo sapiens
aatttatatgaaaa

SEQ ID NO: 3655877 - DNA, 15 bp, Homo sapiens
aatttattgtctgtc

SEQ ID NO: 3655878 - DNA, 13 bp, Homo sapiens
aatttcagactcc

SEQ ID NO: 3655879 - DNA, 21 bp, Homo sapiens
aatttccacaaaatctgtcca

SEQ ID NO: 3655880 - DNA, 12 bp, Homo sapiens
aatttcccagga

SEQ ID NO: 3655881 - DNA, 23 bp, Homo sapiens
acagtgagcttggaaaggaccag

SEQ ID NO: 3655882 - DNA, 13 bp, Homo sapiens
acagtgggagcca

SEQ ID NO: 3655883 - DNA, 15 bp, Homo sapiens
acagtgggagccagg

SEQ ID NO: 3655884 - DNA, 13 bp, Homo sapiens
acagttacataat

SEQ ID NO: 3655885 - DNA, 13 bp, Homo sapiens
acagttctgtcat

SEQ ID NO: 3655886 - DNA, 19 bp, Homo sapiens
acagttctttgggccagac

SEQ ID NO: 3655887 - DNA, 21 bp, Homo sapiens
acagttctttgggccagacat

SEQ ID NO: 3655888 - DNA, 21 bp, Homo sapiens
acataatgggccactgaaatc

SEQ ID NO: 3655889 - DNA, 22 bp, Homo sapiens
acataatgggccactgaaatct

SEQ ID NO: 3655890 - DNA, 23 bp, Homo sapiens
acataatgggccactgaaatctg

SEQ ID NO: 3655891 - DNA, 17 bp, Homo sapiens
acataatggggtcctgg

SEQ ID NO: 3655892 - DNA, 16 bp, Homo sapiens
acataattcactctga

SEQ ID NO: 3655893 - DNA, 20 bp, Homo sapiens
acatacagaattactgtaac

SEQ ID NO: 3655894 - DNA, 17 bp, Homo sapiens
acatacttgaagggcca

SEQ ID NO: 3655895 - DNA, 19 bp, Homo sapiens
acatacttgaagggccaga

SEQ ID NO: 3655896 - DNA, 23 bp, Homo sapiens
acatacttgaagggccagagcca

SEQ ID NO: 3655897 - DNA, 22 bp, Homo sapiens
acatagcttgataaagggccaa

SEQ ID NO: 3655898 - DNA, 19 bp, Homo sapiens
acatagtattcatgactat

SEQ ID NO: 3655899 - DNA, 16 bp, Homo sapiens
acatatatatatataa

SEQ ID NO: 3655900 - DNA, 17 bp, Homo sapiens
acatatatatatataac

SEQ ID NO: 3655901 - DNA, 14 bp, Homo sapiens
acatatatattaca

SEQ ID NO: 3655902 - DNA, 15 bp, Homo sapiens
acatatttaatgttt

SEQ ID NO: 3655903 - DNA, 17 bp, Homo sapiens
acatatttaatgtttta

SEQ ID NO: 3655904 - DNA, 20 bp, Homo sapiens
acatatttaatgttttaaat

SEQ ID NO: 3655905 - DNA, 14 bp, Homo sapiens
acatcacagggtgg

SEQ ID NO: 3655906 - DNA, 19 bp, Homo sapiens
acatcacagggtgggcctc

SEQ ID NO: 3655907 - DNA, 21 bp, Homo sapiens
acatcattactataagaactt

SEQ ID NO: 3655908 - DNA, 17 bp, Homo sapiens
acatccctgccagctct

SEQ ID NO: 3655909 - DNA, 16 bp, Homo sapiens
acatccgcgtgtgcct

SEQ ID NO: 3655910 - DNA, 23 bp, Homo sapiens
acatccgcgtgtgcctgtgtgcg

SEQ ID NO: 3655911 - DNA, 15 bp, Homo sapiens
acatctaagcctgaa

SEQ ID NO: 3655912 - DNA, 23 bp, Homo sapiens
acatctatgtgtatgttgacttt

SEQ ID NO: 3655913 - DNA, 15 bp, Homo sapiens
acatgcagcccatgc

SEQ ID NO: 3655914 - DNA, 22 bp, Homo sapiens
acatgcagcccatgcccacctg

SEQ ID NO: 3655915 - DNA, 14 bp, Homo sapiens
acatgcataagaaa

SEQ ID NO: 3655916 - DNA, 13 bp, Homo sapiens
acatgtaatttga

SEQ ID NO: 3655917 - DNA, 14 bp, Homo sapiens
acatgtataatatt

SEQ ID NO: 3655918 - DNA, 19 bp, Homo sapiens
acatgtataatatttttaa

SEQ ID NO: 3655919 - DNA, 16 bp, Homo sapiens
acatgtggggccaggt

SEQ ID NO: 3655920 - DNA, 20 bp, Homo sapiens
acatgttgggaaacttggct

SEQ ID NO: 3655921 - DNA, 23 bp, Homo sapiens
acattaaaaaaaatcatcattat

SEQ ID NO: 3655922 - DNA, 14 bp, Homo sapiens
acattagaagacaa

SEQ ID NO: 3655923 - DNA, 20 bp, Homo sapiens
acattagaagacaattgaca

SEQ ID NO: 3655924 - DNA, 15 bp, Homo sapiens
acattccaactcgta

SEQ ID NO: 3655925 - DNA, 22 bp, Homo sapiens
acattcttggcttaatcatttt

SEQ ID NO: 3655926 - DNA, 16 bp, Homo sapiens
acattgattcagcctg

SEQ ID NO: 3655927 - DNA, 17 bp, Homo sapiens
acattgccaaaaaggat

SEQ ID NO: 3655928 - DNA, 22 bp, Homo sapiens
acattggcacctaatccaggca

SEQ ID NO: 3655929 - DNA, 19 bp, Homo sapiens
acattgtctcctatatatt

SEQ ID NO: 3655930 - DNA, 17 bp, Homo sapiens
acattgtttgctgctat

SEQ ID NO: 3655931 - DNA, 18 bp, Homo sapiens
acattgtttgctgctatt

SEQ ID NO: 3655932 - DNA, 16 bp, Homo sapiens
acatttcacttttctg

SEQ ID NO: 3655933 - DNA, 17 bp, Homo sapiens
acatttcacttttctgt

SEQ ID NO: 3655934 - DNA, 14 bp, Homo sapiens
acatttccaagctg

SEQ ID NO: 3655935 - DNA, 23 bp, Homo sapiens
acatttctctaactcctgccatt

SEQ ID NO: 3655936 - DNA, 17 bp, Homo sapiens
acatttgatgcatgtct

SEQ ID NO: 3655937 - DNA, 20 bp, Homo sapiens
acatttgatgcatgtctttt

SEQ ID NO: 3655938 - DNA, 22 bp, Homo sapiens
acatttgatgcatgtcttttaa

SEQ ID NO: 3655939 - DNA, 22 bp, Homo sapiens
acattttcagaaatattcatga

SEQ ID NO: 3655940 - DNA, 19 bp, Homo sapiens
acatttttgtctgtcctac

SEQ ID NO: 3655941 - DNA, 21 bp, Homo sapiens
acatttttgtggttttgagaa

SEQ ID NO: 3655942 - DNA, 22 bp, Homo sapiens
acatttttgtggttttgagaaa

SEQ ID NO: 3655943 - DNA, 17 bp, Homo sapiens
accaaaagaatttgcac

SEQ ID NO: 3655944 - DNA, 23 bp, Homo sapiens
accaaagtgtcttttgacatttt

SEQ ID NO: 3655945 - DNA, 22 bp, Homo sapiens
accaaatcacccaatcccagtt

SEQ ID NO: 3655946 - DNA, 14 bp, Homo sapiens
accaactgggccca

SEQ ID NO: 3655947 - DNA, 11 bp, Homo sapiens
accaagaagat

SEQ ID NO: 3655948 - DNA, 18 bp, Homo sapiens
accaagcttagtcctggg

SEQ ID NO: 3655949 - DNA, 20 bp, Homo sapiens
accaagcttagtcctgggag

SEQ ID NO: 3655950 - DNA, 14 bp, Homo sapiens
accacaaactgtaa

SEQ ID NO: 3655951 - DNA, 16 bp, Homo sapiens
accacaagcctgagaa

SEQ ID NO: 3655952 - DNA, 17 bp, Homo sapiens
accacaagcctgagaac

SEQ ID NO: 3655953 - DNA, 14 bp, Homo sapiens
accaccaaaaacaa

SEQ ID NO: 3655954 - DNA, 16 bp, Homo sapiens
accaccaagccaaggg

SEQ ID NO: 3655955 - DNA, 22 bp, Homo sapiens
accaccacggccaccactgcag

SEQ ID NO: 3655956 - DNA, 18 bp, Homo sapiens
accaccccaacaaaccat

SEQ ID NO: 3655957 - DNA, 13 bp, Homo sapiens
accacctacccct

SEQ ID NO: 3655958 - DNA, 19 bp, Homo sapiens
accacgcccgtcctgcctg

SEQ ID NO: 3655959 - DNA, 20 bp, Homo sapiens
accacgcccgtcctgcctgt

SEQ ID NO: 3655960 - DNA, 21 bp, Homo sapiens
accacgcccgtcctgcctgtg

SEQ ID NO: 3655961 - DNA, 20 bp, Homo sapiens
accacggccggctaattttt

SEQ ID NO: 3655962 - DNA, 22 bp, Homo sapiens
accacgggacatcacagggtgg

SEQ ID NO: 3655963 - DNA, 17 bp, Homo sapiens
accactacatgcagccc

SEQ ID NO: 3655964 - DNA, 14 bp, Homo sapiens
accactcgtgcatc

SEQ ID NO: 3655965 - DNA, 21 bp, Homo sapiens
accactcgtgcatccctgaga

SEQ ID NO: 3655966 - DNA, 22 bp, Homo sapiens
accactctgtggccagcctggc

SEQ ID NO: 3655967 - DNA, 12 bp, Homo sapiens
accactggaagc

SEQ ID NO: 3655968 - DNA, 14 bp, Homo sapiens
accactggaagcag

SEQ ID NO: 3655969 - DNA, 19 bp, Homo sapiens
accactggaagcaggatgg

SEQ ID NO: 3655970 - DNA, 17 bp, Homo sapiens
accagacacccaggact

SEQ ID NO: 3655971 - DNA, 17 bp, Homo sapiens
accagcagcgcctttcc

SEQ ID NO: 3655972 - DNA, 15 bp, Homo sapiens
accagcattcctttt

SEQ ID NO: 3655973 - DNA, 17 bp, Homo sapiens
accagcattccttttga

SEQ ID NO: 3655974 - DNA, 11 bp, Homo sapiens
accagccagcg

SEQ ID NO: 3655975 - DNA, 14 bp, Homo sapiens
accagccgtgagca

SEQ ID NO: 3655976 - DNA, 22 bp, Homo sapiens
accagccgtgagcatgtttgga

SEQ ID NO: 3655977 - DNA, 15 bp, Homo sapiens
accagcctggccaac

SEQ ID NO: 3655978 - DNA, 15 bp, Homo sapiens
accagctcaggacag

SEQ ID NO: 3655979 - DNA, 16 bp, Homo sapiens
accagctcaggacaga

SEQ ID NO: 3655980 - DNA, 14 bp, Homo sapiens
accaggactccctc

SEQ ID NO: 3655981 - DNA, 18 bp, Homo sapiens
accaggactccctcctca

SEQ ID NO: 3655982 - DNA, 20 bp, Homo sapiens
accaggagaaccactacatg

SEQ ID NO: 3655983 - DNA, 14 bp, Homo sapiens
accaggatagagac

SEQ ID NO: 3655984 - DNA, 19 bp, Homo sapiens
accaggatagagactggaa

SEQ ID NO: 3655985 - DNA, 19 bp, Homo sapiens
accaggcaacttgggaact

SEQ ID NO: 3655986 - DNA, 22 bp, Homo sapiens
accagggcaaggccccttccac

SEQ ID NO: 3655987 - DNA, 16 bp, Homo sapiens
accaggggccctacct

SEQ ID NO: 3655988 - DNA, 21 bp, Homo sapiens
accaggggccctacctgggga

SEQ ID NO: 3655989 - DNA, 14 bp, Homo sapiens
accaggggtttctc

SEQ ID NO: 3655990 - DNA, 23 bp, Homo sapiens
accaggtgcctttcaaatttaga

SEQ ID NO: 3655991 - DNA, 20 bp, Homo sapiens
accaggttacctcactttta

SEQ ID NO: 3655992 - DNA, 13 bp, Homo sapiens
accatcactgagt

SEQ ID NO: 3655993 - DNA, 22 bp, Homo sapiens
accatgattaaccacttcagct

SEQ ID NO: 3655994 - DNA, 20 bp, Homo sapiens
accatgcccgactaattttt

SEQ ID NO: 3655995 - DNA, 17 bp, Homo sapiens
accatgcctcactaatt

SEQ ID NO: 3655996 - DNA, 18 bp, Homo sapiens
accatgggtgtggatggc

SEQ ID NO: 3655997 - DNA, 19 bp, Homo sapiens
accatgggtgtggatggca

SEQ ID NO: 3655998 - DNA, 17 bp, Homo sapiens
aatttcccaggaccctg

SEQ ID NO: 3655999 - DNA, 21 bp, Homo sapiens
aatttcccaggaccctgaagg

SEQ ID NO: 3656000 - DNA, 21 bp, Homo sapiens
aatttctgtgttgccaagctc

SEQ ID NO: 3656001 - DNA, 21 bp, Homo sapiens
aatttgatagtattgtgcata

SEQ ID NO: 3656002 - DNA, 23 bp, Homo sapiens
aatttgggctaaaacttagaaaa

SEQ ID NO: 3656003 - DNA, 15 bp, Homo sapiens
aatttggtctgtata

SEQ ID NO: 3656004 - DNA, 12 bp, Homo sapiens
aattttgcaatg

SEQ ID NO: 3656005 - DNA, 14 bp, Homo sapiens
aatttttaatgatg

SEQ ID NO: 3656006 - DNA, 13 bp, Homo sapiens
aatttttagaaag

SEQ ID NO: 3656007 - DNA, 17 bp, Homo sapiens
aatttttgtattatttt

SEQ ID NO: 3656008 - DNA, 15 bp, Homo sapiens
aattttttggtacaa

SEQ ID NO: 3656009 - DNA, 14 bp, Homo sapiens
acaaaaaatgtttt

SEQ ID NO: 3656010 - DNA, 11 bp, Homo sapiens
acaaaaaccaa

SEQ ID NO: 3656011 - DNA, 14 bp, Homo sapiens
acaaactcttcagt

SEQ ID NO: 3656012 - DNA, 14 bp, Homo sapiens
acaaagattgagaa

SEQ ID NO: 3656013 - DNA, 16 bp, Homo sapiens
acaaagattgagaagc

SEQ ID NO: 3656014 - DNA, 11 bp, Homo sapiens
acaaagccaga

SEQ ID NO: 3656015 - DNA, 20 bp, Homo sapiens
acaaagccagaagctgagca

SEQ ID NO: 3656016 - DNA, 19 bp, Homo sapiens
acaaaggcagctgtgtctg

SEQ ID NO: 3656017 - DNA, 22 bp, Homo sapiens
acaaaggcagctgtgtctgagc

SEQ ID NO: 3656018 - DNA, 15 bp, Homo sapiens
acaaaggcatgctgg

SEQ ID NO: 3656019 - DNA, 17 bp, Homo sapiens
acaaaggcatgctggag

SEQ ID NO: 3656020 - DNA, 14 bp, Homo sapiens
acaaagtgctggga

SEQ ID NO: 3656021 - DNA, 20 bp, Homo sapiens
acaaatggagctttctgtat

SEQ ID NO: 3656022 - DNA, 14 bp, Homo sapiens
acaaattatttttg

SEQ ID NO: 3656023 - DNA, 23 bp, Homo sapiens
acaaatttttcaaatcattcctt

SEQ ID NO: 3656024 - DNA, 22 bp, Homo sapiens
acaacagagtgaaaaatcttaa

SEQ ID NO: 3656025 - DNA, 16 bp, Homo sapiens
acaactattttcagat

SEQ ID NO: 3656026 - DNA, 20 bp, Homo sapiens
acaactattttcagatgtga

SEQ ID NO: 3656027 - DNA, 15 bp, Homo sapiens
acaacttgtatttcc

SEQ ID NO: 3656028 - DNA, 17 bp, Homo sapiens
acaacttgtatttccaa

SEQ ID NO: 3656029 - DNA, 20 bp, Homo sapiens
acaagagcagcctgtggcat

SEQ ID NO: 3656030 - DNA, 22 bp, Homo sapiens
acaagcacctagtaagtgcctg

SEQ ID NO: 3656031 - DNA, 12 bp, Homo sapiens
acaagccaagaa

SEQ ID NO: 3656032 - DNA, 17 bp, Homo sapiens
acaagcctgagaactga

SEQ ID NO: 3656033 - DNA, 19 bp, Homo sapiens
acaagctgcaccctcaggc

SEQ ID NO: 3656034 - DNA, 23 bp, Homo sapiens
acaagctgcaccctcaggcaggt

SEQ ID NO: 3656035 - DNA, 22 bp, Homo sapiens
acaaggatagatgctggcccag

SEQ ID NO: 3656036 - DNA, 21 bp, Homo sapiens
acaagtcctggatgttgtgtg

SEQ ID NO: 3656037 - DNA, 17 bp, Homo sapiens
acaagtgccgcaaattg

SEQ ID NO: 3656038 - DNA, 20 bp, Homo sapiens
acaataatatttcaagtgcc

SEQ ID NO: 3656039 - DNA, 21 bp, Homo sapiens
acaataatatttcaagtgcct

SEQ ID NO: 3656040 - DNA, 16 bp, Homo sapiens
acaatctgagcacgct

SEQ ID NO: 3656041 - DNA, 18 bp, Homo sapiens
acaatctggaagaaaaaa

SEQ ID NO: 3656042 - DNA, 19 bp, Homo sapiens
acaatctggcttagtgcca

SEQ ID NO: 3656043 - DNA, 22 bp, Homo sapiens
acaatgatcctgtattcagaca

SEQ ID NO: 3656044 - DNA, 18 bp, Homo sapiens
acaatggcagaacaggtg

SEQ ID NO: 3656045 - DNA, 21 bp, Homo sapiens
acaattctgtttttaatgcta

SEQ ID NO: 3656046 - DNA, 13 bp, Homo sapiens
acaatttaaagca

SEQ ID NO: 3656047 - DNA, 14 bp, Homo sapiens
acaatttaaagcaa

SEQ ID NO: 3656048 - DNA, 14 bp, Homo sapiens
acacaaacacacac

SEQ ID NO: 3656049 - DNA, 10 bp, Homo sapiens
acacacacaa

SEQ ID NO: 3656050 - DNA, 11 bp, Homo sapiens
acacacacaca

SEQ ID NO: 3656051 - DNA, 15 bp, Homo sapiens
acacacacacacaaa

SEQ ID NO: 3656052 - DNA, 14 bp, Homo sapiens
acacacacacacac

SEQ ID NO: 3656053 - DNA, 13 bp, Homo sapiens
acacaccattttg

SEQ ID NO: 3656054 - DNA, 15 bp, Homo sapiens
acacataccctcttc

SEQ ID NO: 3656055 - DNA, 16 bp, Homo sapiens
acacatatatattaca

SEQ ID NO: 3656056 - DNA, 13 bp, Homo sapiens
acacatatgaggg

SEQ ID NO: 3656057 - DNA, 17 bp, Homo sapiens
acacatatgagggggaa

SEQ ID NO: 3656058 - DNA, 22 bp, Homo sapiens
acaccaggatagagactggaac

SEQ ID NO: 3656059 - DNA, 14 bp, Homo sapiens
acaccgccatcctc

SEQ ID NO: 3656060 - DNA, 17 bp, Homo sapiens
acaccgccatcctctgc

SEQ ID NO: 3656061 - DNA, 22 bp, Homo sapiens
acacctcagttcccttggcctc

SEQ ID NO: 3656062 - DNA, 21 bp, Homo sapiens
acacgcgggcgcgatcccaca

SEQ ID NO: 3656063 - DNA, 15 bp, Homo sapiens
acacggacactcaaa

SEQ ID NO: 3656064 - DNA, 20 bp, Homo sapiens
acactaaaggaggaggagcc

SEQ ID NO: 3656065 - DNA, 21 bp, Homo sapiens
acactcaaaagctgggcaggt

SEQ ID NO: 3656066 - DNA, 22 bp, Homo sapiens
acactcagtgggctgtttctgc

SEQ ID NO: 3656067 - DNA, 23 bp, Homo sapiens
acactgcttgtgtttttaactca

SEQ ID NO: 3656068 - DNA, 15 bp, Homo sapiens
acacttatcttctgg

SEQ ID NO: 3656069 - DNA, 16 bp, Homo sapiens
acacttatcttctgga

SEQ ID NO: 3656070 - DNA, 19 bp, Homo sapiens
acacttcttacgcaatgct

SEQ ID NO: 3656071 - DNA, 20 bp, Homo sapiens
acacttcttacgcaatgctt

SEQ ID NO: 3656072 - DNA, 21 bp, Homo sapiens
acactttcatgcagtgctctt

SEQ ID NO: 3656073 - DNA, 18 bp, Homo sapiens
acagaaaagacaaacagt

SEQ ID NO: 3656074 - DNA, 14 bp, Homo sapiens
acagaacactgtct

SEQ ID NO: 3656075 - DNA, 16 bp, Homo sapiens
acagaagaaggcagca

SEQ ID NO: 3656076 - DNA, 17 bp, Homo sapiens
acagaagtttgcactat

SEQ ID NO: 3656077 - DNA, 22 bp, Homo sapiens
acagaattactgtaactgatta

SEQ ID NO: 3656078 - DNA, 18 bp, Homo sapiens
acagaattttatggtgca

SEQ ID NO: 3656079 - DNA, 20 bp, Homo sapiens
acagacacgagccacctcac

SEQ ID NO: 3656080 - DNA, 14 bp, Homo sapiens
acagacagaatata

SEQ ID NO: 3656081 - DNA, 14 bp, Homo sapiens
acagacatatttaa

SEQ ID NO: 3656082 - DNA, 17 bp, Homo sapiens
acagacattctgccagg

SEQ ID NO: 3656083 - DNA, 18 bp, Homo sapiens
acagacccctcgcaactg

SEQ ID NO: 3656084 - DNA, 17 bp, Homo sapiens
acagaggccccagcctc

SEQ ID NO: 3656085 - DNA, 20 bp, Homo sapiens
acagagggaagaaaagagct

SEQ ID NO: 3656086 - DNA, 14 bp, Homo sapiens
acagatctggaacc

SEQ ID NO: 3656087 - DNA, 21 bp, Homo sapiens
acagatggaaaaactgaggct

SEQ ID NO: 3656088 - DNA, 20 bp, Homo sapiens
acagattgggcggggcttct

SEQ ID NO: 3656089 - DNA, 20 bp, Homo sapiens
acagatttaatacagtttat

SEQ ID NO: 3656090 - DNA, 23 bp, Homo sapiens
acagcaaggtgtggaggctcctg

SEQ ID NO: 3656091 - DNA, 12 bp, Homo sapiens
acagccccaccc

SEQ ID NO: 3656092 - DNA, 22 bp, Homo sapiens
acagcctcttctgtcccaagtc

SEQ ID NO: 3656093 - DNA, 23 bp, Homo sapiens
acagcctcttctgtcccaagtct

SEQ ID NO: 3656094 - DNA, 13 bp, Homo sapiens
acagcctcttttt

SEQ ID NO: 3656095 - DNA, 15 bp, Homo sapiens
acagcggaggtgtgg

SEQ ID NO: 3656096 - DNA, 16 bp, Homo sapiens
acagctatgggagccc

SEQ ID NO: 3656097 - DNA, 23 bp, Homo sapiens
acagctgctcctagagggagggg

SEQ ID NO: 3656098 - DNA, 15 bp, Homo sapiens
acagcttcagccagg

SEQ ID NO: 3656099 - DNA, 22 bp, Homo sapiens
acagcttcccctctctcctcct

SEQ ID NO: 3656100 - DNA, 17 bp, Homo sapiens
acagcttgacctgaggc

SEQ ID NO: 3656101 - DNA, 13 bp, Homo sapiens
acaggaggcaggc

SEQ ID NO: 3656102 - DNA, 20 bp, Homo sapiens
acaggatgtgtttgctttct

SEQ ID NO: 3656103 - DNA, 22 bp, Homo sapiens
acaggatgtgtttgctttctga

SEQ ID NO: 3656104 - DNA, 22 bp, Homo sapiens
acaggcatgggtgcaaggaaaa

SEQ ID NO: 3656105 - DNA, 17 bp, Homo sapiens
acaggcgggaggaggtg

SEQ ID NO: 3656106 - DNA, 14 bp, Homo sapiens
acaggctggcgggg

SEQ ID NO: 3656107 - DNA, 20 bp, Homo sapiens
acagggaacattggagctga

SEQ ID NO: 3656108 - DNA, 14 bp, Homo sapiens
acagggtctgctct

SEQ ID NO: 3656109 - DNA, 15 bp, Homo sapiens
acagggtctgctctt

SEQ ID NO: 3656110 - DNA, 23 bp, Homo sapiens
acaggtgaaagtttttctgaaag

SEQ ID NO: 3656111 - DNA, 13 bp, Homo sapiens
acaggtgtgagcc

SEQ ID NO: 3656112 - DNA, 18 bp, Homo sapiens
acagtacaggcagcacag

SEQ ID NO: 3656113 - DNA, 16 bp, Homo sapiens
acagtctggagaaggt

SEQ ID NO: 3656114 - DNA, 22 bp, Homo sapiens
acagtgaaatgagcagccctta

SEQ ID NO: 3656115 - DNA, 19 bp, Homo sapiens
acagtgaagacagaagttt

SEQ ID NO: 3656116 - DNA, 18 bp, Homo sapiens
agcagcctctccccaggt

SEQ ID NO: 3656117 - DNA, 20 bp, Homo sapiens
agcagcctctccccaggtcc

SEQ ID NO: 3656118 - DNA, 21 bp, Homo sapiens
agcagcctctccccaggtcca

SEQ ID NO: 3656119 - DNA, 14 bp, Homo sapiens
agcagcctgtggca

SEQ ID NO: 3656120 - DNA, 20 bp, Homo sapiens
agcagctcaaaggcacagtg

SEQ ID NO: 3656121 - DNA, 14 bp, Homo sapiens
agcagcttccagat

SEQ ID NO: 3656122 - DNA, 16 bp, Homo sapiens
agcagcttccagattg

SEQ ID NO: 3656123 - DNA, 14 bp, Homo sapiens
agcaggaagctcag

SEQ ID NO: 3656124 - DNA, 13 bp, Homo sapiens
agcaggactccca

SEQ ID NO: 3656125 - DNA, 14 bp, Homo sapiens
agcaggactcccac

SEQ ID NO: 3656126 - DNA, 21 bp, Homo sapiens
agcagggaaaatgcagcaggg

SEQ ID NO: 3656127 - DNA, 19 bp, Homo sapiens
agcagggaattcctggggt

SEQ ID NO: 3656128 - DNA, 20 bp, Homo sapiens
agcagggagggcttctgcca

SEQ ID NO: 3656129 - DNA, 22 bp, Homo sapiens
agcagggatgccctggaggtgg

SEQ ID NO: 3656130 - DNA, 20 bp, Homo sapiens
agcagggattaacctctgca

SEQ ID NO: 3656131 - DNA, 14 bp, Homo sapiens
agcagtcgtgcctg

SEQ ID NO: 3656132 - DNA, 17 bp, Homo sapiens
agcagtgagcactgaaa

SEQ ID NO: 3656133 - DNA, 15 bp, Homo sapiens
agcatacttctagga

SEQ ID NO: 3656134 - DNA, 13 bp, Homo sapiens
agcatactttgta

SEQ ID NO: 3656135 - DNA, 14 bp, Homo sapiens
agcatactttgtaa

SEQ ID NO: 3656136 - DNA, 14 bp, Homo sapiens
agcatcacagaatg

SEQ ID NO: 3656137 - DNA, 22 bp, Homo sapiens
agcatcagggttaagaagactt

SEQ ID NO: 3656138 - DNA, 23 bp, Homo sapiens
agcatcttgggggggtggccgct

SEQ ID NO: 3656139 - DNA, 19 bp, Homo sapiens
agcatgcttccctgcagct

SEQ ID NO: 3656140 - DNA, 22 bp, Homo sapiens
agcatgcttccctgcagctgac

SEQ ID NO: 3656141 - DNA, 20 bp, Homo sapiens
agcattaagctgttcctgtt

SEQ ID NO: 3656142 - DNA, 19 bp, Homo sapiens
agcattatgatgtgggtca

SEQ ID NO: 3656143 - DNA, 15 bp, Homo sapiens
agcattttgctaaat

SEQ ID NO: 3656144 - DNA, 22 bp, Homo sapiens
agcattttgctaaatgtgaatg

SEQ ID NO: 3656145 - DNA, 23 bp, Homo sapiens
agccaagctccttgggaggcccc

SEQ ID NO: 3656146 - DNA, 19 bp, Homo sapiens
agccaagggaacctgtgtc

SEQ ID NO: 3656147 - DNA, 22 bp, Homo sapiens
agccaatggcccggcccctcct

SEQ ID NO: 3656148 - DNA, 24 bp, Homo sapiens
agccacaccaggatagagactgga

SEQ ID NO: 3656149 - DNA, 14 bp, Homo sapiens
agccaccccgggct

SEQ ID NO: 3656150 - DNA, 23 bp, Homo sapiens
agccaccccgggctctctgctgt

SEQ ID NO: 3656151 - DNA, 17 bp, Homo sapiens
agccactccccggcatg

SEQ ID NO: 3656152 - DNA, 14 bp, Homo sapiens
agccactctatgag

SEQ ID NO: 3656153 - DNA, 22 bp, Homo sapiens
agccagaacttgaccctgagct

SEQ ID NO: 3656154 - DNA, 11 bp, Homo sapiens
agccagaggct

SEQ ID NO: 3656155 - DNA, 14 bp, Homo sapiens
agccagaggctggg

SEQ ID NO: 3656156 - DNA, 18 bp, Homo sapiens
agccagatttgtcttttt

SEQ ID NO: 3656157 - DNA, 15 bp, Homo sapiens
agccagcacctggca

SEQ ID NO: 3656158 - DNA, 23 bp, Homo sapiens
agccagcacctggcatcgcacca

SEQ ID NO: 3656159 - DNA, 15 bp, Homo sapiens
agccagctcacagtg

SEQ ID NO: 3656160 - DNA, 21 bp, Homo sapiens
agccagctcacagtgctgtgt

SEQ ID NO: 3656161 - DNA, 23 bp, Homo sapiens
agccagctcacagtgctgtgtgc

SEQ ID NO: 3656162 - DNA, 20 bp, Homo sapiens
agccaggaatttcccaggac

SEQ ID NO: 3656163 - DNA, 19 bp, Homo sapiens
agccagtgacctgaggaag

SEQ ID NO: 3656164 - DNA, 18 bp, Homo sapiens
agccatgctggaaaataa

SEQ ID NO: 3656165 - DNA, 13 bp, Homo sapiens
agcccaaagaagg

SEQ ID NO: 3656166 - DNA, 13 bp, Homo sapiens
agcccaaattctc

SEQ ID NO: 3656167 - DNA, 13 bp, Homo sapiens
agcccaacccttc

SEQ ID NO: 3656168 - DNA, 16 bp, Homo sapiens
agcccaagattcttca

SEQ ID NO: 3656169 - DNA, 24 bp, Homo sapiens
agcccaaggtgctgatgtcaaagt

SEQ ID NO: 3656170 - DNA, 15 bp, Homo sapiens
agcccacccctcaac

SEQ ID NO: 3656171 - DNA, 23 bp, Homo sapiens
agcccacccctcaacacctctgc

SEQ ID NO: 3656172 - DNA, 12 bp, Homo sapiens
agcccaccctgc

SEQ ID NO: 3656173 - DNA, 14 bp, Homo sapiens
agcccactgtcctg

SEQ ID NO: 3656174 - DNA, 15 bp, Homo sapiens
agcccactgtcctgg

SEQ ID NO: 3656175 - DNA, 19 bp, Homo sapiens
agcccactgtcctgggcct

SEQ ID NO: 3656176 - DNA, 20 bp, Homo sapiens
agcccactgtcctgggcctg

SEQ ID NO: 3656177 - DNA, 21 bp, Homo sapiens
agcccagacagcaaggtgtgg

SEQ ID NO: 3656178 - DNA, 11 bp, Homo sapiens
agcccagagac

SEQ ID NO: 3656179 - DNA, 18 bp, Homo sapiens
agcccagggagcggaaag

SEQ ID NO: 3656180 - DNA, 22 bp, Homo sapiens
agcccagggagcggaaagcagc

SEQ ID NO: 3656181 - DNA, 18 bp, Homo sapiens
agcccagtagaccttgtt

SEQ ID NO: 3656182 - DNA, 16 bp, Homo sapiens
agccccacccaggagg

SEQ ID NO: 3656183 - DNA, 20 bp, Homo sapiens
agccccacccaggagggagg

SEQ ID NO: 3656184 - DNA, 20 bp, Homo sapiens
agccccagggtcttccctac

SEQ ID NO: 3656185 - DNA, 19 bp, Homo sapiens
agcccctcctccctgccct

SEQ ID NO: 3656186 - DNA, 13 bp, Homo sapiens
agcccctctggtc

SEQ ID NO: 3656187 - DNA, 16 bp, Homo sapiens
agcccctctggtcgct

SEQ ID NO: 3656188 - DNA, 13 bp, Homo sapiens
agcccctcttccc

SEQ ID NO: 3656189 - DNA, 21 bp, Homo sapiens
agccgacaccttttttcaaca

SEQ ID NO: 3656190 - DNA, 20 bp, Homo sapiens
agccgagattgcaccactgc

SEQ ID NO: 3656191 - DNA, 21 bp, Homo sapiens
agccgccatgctcctggccca

SEQ ID NO: 3656192 - DNA, 20 bp, Homo sapiens
agccgccattgccaccagga

SEQ ID NO: 3656193 - DNA, 16 bp, Homo sapiens
agccggcacagggtct

SEQ ID NO: 3656194 - DNA, 20 bp, Homo sapiens
agccggggactcccaggctg

SEQ ID NO: 3656195 - DNA, 15 bp, Homo sapiens
agccgggggctggcc

SEQ ID NO: 3656196 - DNA, 19 bp, Homo sapiens
agcctatcaggtgcccctc

SEQ ID NO: 3656197 - DNA, 13 bp, Homo sapiens
agcctccctgaag

SEQ ID NO: 3656198 - DNA, 16 bp, Homo sapiens
agcctccctgaagcct

SEQ ID NO: 3656199 - DNA, 14 bp, Homo sapiens
agcctcctccagcc

SEQ ID NO: 3656200 - DNA, 18 bp, Homo sapiens
agcctctccccaggtcca

SEQ ID NO: 3656201 - DNA, 23 bp, Homo sapiens
agcctctccccaggtccagctct

SEQ ID NO: 3656202 - DNA, 23 bp, Homo sapiens
agcctctcgtcccgtccctccct

SEQ ID NO: 3656203 - DNA, 23 bp, Homo sapiens
agcctctgaaaaccaatgttctc

SEQ ID NO: 3656204 - DNA, 19 bp, Homo sapiens
agcctctggaatgcatggg

SEQ ID NO: 3656205 - DNA, 20 bp, Homo sapiens
agcctctggctagaggccag

SEQ ID NO: 3656206 - DNA, 19 bp, Homo sapiens
agcctcttctgtcccaagt

SEQ ID NO: 3656207 - DNA, 13 bp, Homo sapiens
agcctgaggtccc

SEQ ID NO: 3656208 - DNA, 14 bp, Homo sapiens
agcctgaggtcccc

SEQ ID NO: 3656209 - DNA, 14 bp, Homo sapiens
agcctgctccagct

SEQ ID NO: 3656210 - DNA, 15 bp, Homo sapiens
agcctgctccagctg

SEQ ID NO: 3656211 - DNA, 22 bp, Homo sapiens
agcctgctccagctgttcagct

SEQ ID NO: 3656212 - DNA, 12 bp, Homo sapiens
agcctggccaga

SEQ ID NO: 3656213 - DNA, 14 bp, Homo sapiens
agcctggccagaca

SEQ ID NO: 3656214 - DNA, 18 bp, Homo sapiens
agcctgggcaatgtgata

SEQ ID NO: 3656215 - DNA, 17 bp, Homo sapiens
agcctgggcagccaggc

SEQ ID NO: 3656216 - DNA, 10 bp, Homo sapiens
agcctggggt

SEQ ID NO: 3656217 - DNA, 15 bp, Homo sapiens
agcctggggtctgga

SEQ ID NO: 3656218 - DNA, 23 bp, Homo sapiens
agcctggggtggggtcatgccct

SEQ ID NO: 3656219 - DNA, 11 bp, Homo sapiens
agcctgtggca

SEQ ID NO: 3656220 - DNA, 14 bp, Homo sapiens
agcctgtggcatct

SEQ ID NO: 3656221 - DNA, 16 bp, Homo sapiens
agcctgttacaggaat

SEQ ID NO: 3656222 - DNA, 15 bp, Homo sapiens
agccttgccagagat

SEQ ID NO: 3656223 - DNA, 17 bp, Homo sapiens
agccttgccagagatcc

SEQ ID NO: 3656224 - DNA, 17 bp, Homo sapiens
agcgactccgttggcca

SEQ ID NO: 3656225 - DNA, 19 bp, Homo sapiens
agcgactccgttggccact

SEQ ID NO: 3656226 - DNA, 21 bp, Homo sapiens
agcgactccgttggccactcc

SEQ ID NO: 3656227 - DNA, 16 bp, Homo sapiens
agcgatctctccactg

SEQ ID NO: 3656228 - DNA, 23 bp, Homo sapiens
agcgcctccatccaaggccaggt

SEQ ID NO: 3656229 - DNA, 15 bp, Homo sapiens
agcgcctgcccctcc

SEQ ID NO: 3656230 - DNA, 19 bp, Homo sapiens
agcgcctgcccctcccaga

SEQ ID NO: 3656231 - DNA, 17 bp, Homo sapiens
agcgcctttcccaactc

SEQ ID NO: 3656232 - DNA, 13 bp, Homo sapiens
agcggaaagcagc

SEQ ID NO: 3656233 - DNA, 14 bp, Homo sapiens
agcggaggtgtgga

SEQ ID NO: 3656234 - DNA, 12 bp, Homo sapiens
agcaccacccta

SEQ ID NO: 3656235 - DNA, 17 bp, Homo sapiens
agcaccgaggggccttt

SEQ ID NO: 3656236 - DNA, 18 bp, Homo sapiens
agcactacaccttgcctt

SEQ ID NO: 3656237 - DNA, 14 bp, Homo sapiens
agcactgccaccag

SEQ ID NO: 3656238 - DNA, 15 bp, Homo sapiens
agcactttgcaagga

SEQ ID NO: 3656239 - DNA, 15 bp, Homo sapiens
agcagaaatctagaa

SEQ ID NO: 3656240 - DNA, 21 bp, Homo sapiens
agcagaggacagtctggagaa

SEQ ID NO: 3656241 - DNA, 22 bp, Homo sapiens
agcagaggacagtctggagaag

SEQ ID NO: 3656242 - DNA, 14 bp, Homo sapiens
agcagaggaccagg

SEQ ID NO: 3656243 - DNA, 12 bp, Homo sapiens
agcagaggaggg

SEQ ID NO: 3656244 - DNA, 21 bp, Homo sapiens
agcagatgcaaagaggcaaga

SEQ ID NO: 3656245 - DNA, 15 bp, Homo sapiens
agcagcaaattttca

SEQ ID NO: 3656246 - DNA, 22 bp, Homo sapiens
agcagccaagctccttgggagg

SEQ ID NO: 3656247 - DNA, 15 bp, Homo sapiens
agcagcccttacagt

SEQ ID NO: 3656248 - DNA, 15 bp, Homo sapiens
agcagcctctcccca

SEQ ID NO: 3656249 - DNA, 13 bp, Homo sapiens
agagactgtgcca

SEQ ID NO: 3656250 - DNA, 13 bp, Homo sapiens
agagagaaaaaaa

SEQ ID NO: 3656251 - DNA, 17 bp, Homo sapiens
agagatgctaaaattct

SEQ ID NO: 3656252 - DNA, 12 bp, Homo sapiens
agagattataac

SEQ ID NO: 3656253 - DNA, 15 bp, Homo sapiens
agagattataacaaa

SEQ ID NO: 3656254 - DNA, 17 bp, Homo sapiens
agagattgtttttagag

SEQ ID NO: 3656255 - DNA, 12 bp, Homo sapiens
agagcaagaagg

SEQ ID NO: 3656256 - DNA, 21 bp, Homo sapiens
agagcaagaaggaaagatttg

SEQ ID NO: 3656257 - DNA, 12 bp, Homo sapiens
agagcactgcca

SEQ ID NO: 3656258 - DNA, 22 bp, Homo sapiens
agagcagggattaacctctgca

SEQ ID NO: 3656259 - DNA, 20 bp, Homo sapiens
agaaacacactgaggcaggg

SEQ ID NO: 3656260 - DNA, 22 bp, Homo sapiens
agaaacacactgaggcagggaa

SEQ ID NO: 3656261 - DNA, 21 bp, Homo sapiens
agaaacccgacagagggaaga

SEQ ID NO: 3656262 - DNA, 15 bp, Homo sapiens
agaaacctactgccc

SEQ ID NO: 3656263 - DNA, 17 bp, Homo sapiens
agaaactaattgacttt

SEQ ID NO: 3656264 - DNA, 20 bp, Homo sapiens
agtcctgtgaatgccactgc

SEQ ID NO: 3656265 - DNA, 14 bp, Homo sapiens
agtcgccctacaga

SEQ ID NO: 3656266 - DNA, 14 bp, Homo sapiens
agtcgtgcctgtgt

SEQ ID NO: 3656267 - DNA, 18 bp, Homo sapiens
agtcgtggggtgtgctgg

SEQ ID NO: 3656268 - DNA, 20 bp, Homo sapiens
agtcgtggggtgtgctggga

SEQ ID NO: 3656269 - DNA, 20 bp, Homo sapiens
agtctagatggctcctctca

SEQ ID NO: 3656270 - DNA, 16 bp, Homo sapiens
agtctcagttctcttg

SEQ ID NO: 3656271 - DNA, 16 bp, Homo sapiens
agtctgaacagctgta

SEQ ID NO: 3656272 - DNA, 21 bp, Homo sapiens
agtctgaagcagatgcaaaga

SEQ ID NO: 3656273 - DNA, 14 bp, Homo sapiens
agtctggagaaggt

SEQ ID NO: 3656274 - DNA, 14 bp, Homo sapiens
agtctgtctcagga

SEQ ID NO: 3656275 - DNA, 14 bp, Homo sapiens
agtctgtggatcag

SEQ ID NO: 3656276 - DNA, 16 bp, Homo sapiens
agtcttttttttcctg

SEQ ID NO: 3656277 - DNA, 15 bp, Homo sapiens
agtgaaatgagcagc

SEQ ID NO: 3656278 - DNA, 20 bp, Homo sapiens
agtgaacttgggccactgtg

SEQ ID NO: 3656279 - DNA, 15 bp, Homo sapiens
agtgaagacagaagt

SEQ ID NO: 3656280 - DNA, 19 bp, Homo sapiens
agtgaatgctgggactcag

SEQ ID NO: 3656281 - DNA, 14 bp, Homo sapiens
agtgacaaaataga

SEQ ID NO: 3656282 - DNA, 13 bp, Homo sapiens
agtgacaaaccat

SEQ ID NO: 3656283 - DNA, 20 bp, Homo sapiens
agtgacacaatctcagctca

SEQ ID NO: 3656284 - DNA, 20 bp, Homo sapiens
agtgacacccaagagggctg

SEQ ID NO: 3656285 - DNA, 17 bp, Homo sapiens
agtgacagacaggctct

SEQ ID NO: 3656286 - DNA, 20 bp, Homo sapiens
agtgacatctgattggcaga

SEQ ID NO: 3656287 - DNA, 17 bp, Homo sapiens
agtgaccgactcattta

SEQ ID NO: 3656288 - DNA, 16 bp, Homo sapiens
agtgacctgaggaagc

SEQ ID NO: 3656289 - DNA, 14 bp, Homo sapiens
agtgacctgtttat

SEQ ID NO: 3656290 - DNA, 15 bp, Homo sapiens
agtgactaatggcat

SEQ ID NO: 3656291 - DNA, 15 bp, Homo sapiens
agtgatgtgtttaca

SEQ ID NO: 3656292 - DNA, 20 bp, Homo sapiens
agtgcaataaatctgaccca

SEQ ID NO: 3656293 - DNA, 21 bp, Homo sapiens
agtgcaataaatctgacccag

SEQ ID NO: 3656294 - DNA, 22 bp, Homo sapiens
agtgcaataaatctgacccagt

SEQ ID NO: 3656295 - DNA, 20 bp, Homo sapiens
agtgcagaatgtaagtgggc

SEQ ID NO: 3656296 - DNA, 23 bp, Homo sapiens
agtgcagaatgtaagtgggccca

SEQ ID NO: 3656297 - DNA, 16 bp, Homo sapiens
agtgcagcagaggaca

SEQ ID NO: 3656298 - DNA, 21 bp, Homo sapiens
agtgcagcaggttaagaattt

SEQ ID NO: 3656299 - DNA, 18 bp, Homo sapiens
agtgcatgcattgagctg

SEQ ID NO: 3656300 - DNA, 21 bp, Homo sapiens
agtgcatgcattgagctgcct

SEQ ID NO: 3656301 - DNA, 17 bp, Homo sapiens
agtgcatggtggccaga

SEQ ID NO: 3656302 - DNA, 21 bp, Homo sapiens
agtgcatttgtgctagaaatt

SEQ ID NO: 3656303 - DNA, 14 bp, Homo sapiens
agtgcatttttgta

SEQ ID NO: 3656304 - DNA, 19 bp, Homo sapiens
agtgccaacttcccctcta

SEQ ID NO: 3656305 - DNA, 21 bp, Homo sapiens
agtgccacccacctttgccac

SEQ ID NO: 3656306 - DNA, 22 bp, Homo sapiens
agtgccacccacctttgccaca

SEQ ID NO: 3656307 - DNA, 14 bp, Homo sapiens
agtgcctagactgt

SEQ ID NO: 3656308 - DNA, 17 bp, Homo sapiens
agtgctggatttgatga

SEQ ID NO: 3656309 - DNA, 20 bp, Homo sapiens
agtgctgggattacaggtgt

SEQ ID NO: 3656310 - DNA, 18 bp, Homo sapiens
agtggaaaaatagcctgc

SEQ ID NO: 3656311 - DNA, 19 bp, Homo sapiens
agtggaaaaatagcctgcc

SEQ ID NO: 3656312 - DNA, 22 bp, Homo sapiens
agtggaggttaaggctgaggaa

SEQ ID NO: 3656313 - DNA, 18 bp, Homo sapiens
agtggcaggggacaggag

SEQ ID NO: 3656314 - DNA, 22 bp, Homo sapiens
agtggccactaagcagaggagg

SEQ ID NO: 3656315 - DNA, 18 bp, Homo sapiens
agtggcctggccaggagc

SEQ ID NO: 3656316 - DNA, 22 bp, Homo sapiens
agtggcctggccaggagctctt

SEQ ID NO: 3656317 - DNA, 19 bp, Homo sapiens
agtggcgtgggagccagcc

SEQ ID NO: 3656318 - DNA, 19 bp, Homo sapiens
agtggctggtccagggcta

SEQ ID NO: 3656319 - DNA, 16 bp, Homo sapiens
agtgggccagtcctgg

SEQ ID NO: 3656320 - DNA, 18 bp, Homo sapiens
agtgggggatcacagcct

SEQ ID NO: 3656321 - DNA, 15 bp, Homo sapiens
agtgtaagtgaatta

SEQ ID NO: 3656322 - DNA, 17 bp, Homo sapiens
agtgtgcactaaggggc

SEQ ID NO: 3656323 - DNA, 20 bp, Homo sapiens
agtgtgcctgaagtcccaga

SEQ ID NO: 3656324 - DNA, 15 bp, Homo sapiens
agtgtggggagggca

SEQ ID NO: 3656325 - DNA, 12 bp, Homo sapiens
agtgttgaaggg

SEQ ID NO: 3656326 - DNA, 12 bp, Homo sapiens
agtgtttgaaaa

SEQ ID NO: 3656327 - DNA, 18 bp, Homo sapiens
agtgttttatgagaaagc

SEQ ID NO: 3656328 - DNA, 18 bp, Homo sapiens
agttaagacaacaggcat

SEQ ID NO: 3656329 - DNA, 17 bp, Homo sapiens
agttcagcaccacccta

SEQ ID NO: 3656330 - DNA, 16 bp, Homo sapiens
agttcaggaacccttc

SEQ ID NO: 3656331 - DNA, 17 bp, Homo sapiens
agttcgagaccagcctg

SEQ ID NO: 3656332 - DNA, 19 bp, Homo sapiens
agttcgagaccagcctggc

SEQ ID NO: 3656333 - DNA, 14 bp, Homo sapiens
agttctcttgcttt

SEQ ID NO: 3656334 - DNA, 15 bp, Homo sapiens
agttctcttgctttc

SEQ ID NO: 3656335 - DNA, 12 bp, Homo sapiens
agttcttcctgc

SEQ ID NO: 3656336 - DNA, 13 bp, Homo sapiens
agttcttcctgca

SEQ ID NO: 3656337 - DNA, 22 bp, Homo sapiens
agttcttcctgcaaccactctg

SEQ ID NO: 3656338 - DNA, 17 bp, Homo sapiens
agttctttgggccagac

SEQ ID NO: 3656339 - DNA, 18 bp, Homo sapiens
agttctttgggccagaca

SEQ ID NO: 3656340 - DNA, 14 bp, Homo sapiens
agttgattcagctc

SEQ ID NO: 3656341 - DNA, 15 bp, Homo sapiens
agttgattcagctct

SEQ ID NO: 3656342 - DNA, 23 bp, Homo sapiens
agttgattcagctctgcaagaat

SEQ ID NO: 3656343 - DNA, 23 bp, Homo sapiens
agttgctatttttgtaaagtttc

SEQ ID NO: 3656344 - DNA, 19 bp, Homo sapiens
agttggagttttttgtacc

SEQ ID NO: 3656345 - DNA, 13 bp, Homo sapiens
agttggcttctaa

SEQ ID NO: 3656346 - DNA, 20 bp, Homo sapiens
agtttaggccttggcttgat

SEQ ID NO: 3656347 - DNA, 20 bp, Homo sapiens
agtttatttttaaagataga

SEQ ID NO: 3656348 - DNA, 18 bp, Homo sapiens
agtttgagatcagcctgg

SEQ ID NO: 3656349 - DNA, 19 bp, Homo sapiens
agtttgtcgctcatgtgtg

SEQ ID NO: 3656350 - DNA, 21 bp, Homo sapiens
agtttgtgtgttgtctcttga

SEQ ID NO: 3656351 - DNA, 16 bp, Homo sapiens
agttttcagaacctct

SEQ ID NO: 3656352 - DNA, 20 bp, Homo sapiens
agttttccatggcaggaagg

SEQ ID NO: 3656353 - DNA, 21 bp, Homo sapiens
agtttttaacaatctaacaat

SEQ ID NO: 3656354 - DNA, 12 bp, Homo sapiens
agtttttctgaa

SEQ ID NO: 3656355 - DNA, 16 bp, Homo sapiens
agttttttgttttaca

SEQ ID NO: 3656356 - DNA, 12 bp, Homo sapiens
agtttttttgct

SEQ ID NO: 3656357 - DNA, 19 bp, Homo sapiens
ataaacagtctaaagaaga

SEQ ID NO: 3656358 - DNA, 22 bp, Homo sapiens
ataaactttaatataaagtagt

SEQ ID NO: 3656359 - DNA, 19 bp, Homo sapiens
ataaagatgatattaagaa

SEQ ID NO: 3656360 - DNA, 14 bp, Homo sapiens
ataaagcacagctg

SEQ ID NO: 3656361 - DNA, 21 bp, Homo sapiens
ataaattcctctttgctttgc

SEQ ID NO: 3656362 - DNA, 21 bp, Homo sapiens
ataacaactatttttgttgtt

SEQ ID NO: 3656363 - DNA, 17 bp, Homo sapiens
ataactttgactttctt

SEQ ID NO: 3656364 - DNA, 16 bp, Homo sapiens
ataagaactttgagct

SEQ ID NO: 3656365 - DNA, 20 bp, Homo sapiens
ataaggaaatcaacttgctt

SEQ ID NO: 3656366 - DNA, 19 bp, Homo sapiens
ataatacagtatctcaggg

SEQ ID NO: 3656367 - DNA, 21 bp, Homo sapiens
ataatactgctgagatacata

SEQ ID NO: 3656368 - DNA, 23 bp, Homo sapiens
ataatatattctatttttatact

SEQ ID NO: 3656369 - DNA, 20 bp, Homo sapiens
ataatatttttaattaaata

SEQ ID NO: 3656370 - DNA, 20 bp, Homo sapiens
ataatgttgtatttaatttt

SEQ ID NO: 3656371 - DNA, 23 bp, Homo sapiens
ataattgctttgccaaaatacca

SEQ ID NO: 3656372 - DNA, 17 bp, Homo sapiens
atacagaggcaactgca

SEQ ID NO: 3656373 - DNA, 21 bp, Homo sapiens
atacagtttatttttaaagat

SEQ ID NO: 3656374 - DNA, 12 bp, Homo sapiens
atacatacagaa

SEQ ID NO: 3656375 - DNA, 13 bp, Homo sapiens
ataccacaagcct

SEQ ID NO: 3656376 - DNA, 19 bp, Homo sapiens
ataccagagccttcaagtg

SEQ ID NO: 3656377 - DNA, 21 bp, Homo sapiens
atacctcctccctaatgctca

SEQ ID NO: 3656378 - DNA, 17 bp, Homo sapiens
ataccttgaaaggcagg

SEQ ID NO: 3656379 - DNA, 20 bp, Homo sapiens
atacgctactataaagagaa

SEQ ID NO: 3656380 - DNA, 14 bp, Homo sapiens
atacggggtcttgc

SEQ ID NO: 3656381 - DNA, 15 bp, Homo sapiens
atacggggtcttgct

SEQ ID NO: 3656382 - DNA, 22 bp, Homo sapiens
atactattaaaaaggtttacag

SEQ ID NO: 3656383 - DNA, 22 bp, Homo sapiens
atactcttcctatttttgtagt

SEQ ID NO: 3656384 - DNA, 14 bp, Homo sapiens
atactgatttaatt

SEQ ID NO: 3656385 - DNA, 12 bp, Homo sapiens
atactgctgaga

SEQ ID NO: 3656386 - DNA, 21 bp, Homo sapiens
atactgctgagatacatacag

SEQ ID NO: 3656387 - DNA, 20 bp, Homo sapiens
atactgcttggagctgagca

SEQ ID NO: 3656388 - DNA, 21 bp, Homo sapiens
atactgcttggagctgagcaa

SEQ ID NO: 3656389 - DNA, 20 bp, Homo sapiens
atacttgaagggccagagcc

SEQ ID NO: 3656390 - DNA, 13 bp, Homo sapiens
atactttttctaa

SEQ ID NO: 3656391 - DNA, 10 bp, Homo sapiens
atagaaaaat

SEQ ID NO: 3656392 - DNA, 23 bp, Homo sapiens
atagaaaaattcagcaaaccatt

SEQ ID NO: 3656393 - DNA, 15 bp, Homo sapiens
atagaaaagttatta

SEQ ID NO: 3656394 - DNA, 13 bp, Homo sapiens
atagatctccagc

SEQ ID NO: 3656395 - DNA, 19 bp, Homo sapiens
atagatctccagcgtcagc

SEQ ID NO: 3656396 - DNA, 16 bp, Homo sapiens
atagatgctggcccag

SEQ ID NO: 3656397 - DNA, 20 bp, Homo sapiens
atagatgctggcccagggcc

SEQ ID NO: 3656398 - DNA, 15 bp, Homo sapiens
atagcctgaggtccc

SEQ ID NO: 3656399 - DNA, 18 bp, Homo sapiens
atagcctgcctcttctct

SEQ ID NO: 3656400 - DNA, 18 bp, Homo sapiens
ataggaaaacaataattt

SEQ ID NO: 3656401 - DNA, 20 bp, Homo sapiens
ataggacctttccaccacag

SEQ ID NO: 3656402 - DNA, 23 bp, Homo sapiens
ataggacctttccaccacagcca

SEQ ID NO: 3656403 - DNA, 16 bp, Homo sapiens
ataggcttttgttctt

SEQ ID NO: 3656404 - DNA, 16 bp, Homo sapiens
ataggtctctttgctt

SEQ ID NO: 3656405 - DNA, 14 bp, Homo sapiens
atagtcttttgctt

SEQ ID NO: 3656406 - DNA, 22 bp, Homo sapiens
atagtttctttattttgtgtaa

SEQ ID NO: 3656407 - DNA, 15 bp, Homo sapiens
atataaacactatat

SEQ ID NO: 3656408 - DNA, 13 bp, Homo sapiens
atataacatatat

SEQ ID NO: 3656409 - DNA, 19 bp, Homo sapiens
atatacttaagaatacaca

SEQ ID NO: 3656410 - DNA, 18 bp, Homo sapiens
atataggaaaacaataat

SEQ ID NO: 3656411 - DNA, 20 bp, Homo sapiens
atataggaaaacaataattt

SEQ ID NO: 3656412 - DNA, 14 bp, Homo sapiens
atatatacatatat

SEQ ID NO: 3656413 - DNA, 15 bp, Homo sapiens
atatatatctatata

SEQ ID NO: 3656414 - DNA, 12 bp, Homo sapiens
atatatgtattt

SEQ ID NO: 3656415 - DNA, 17 bp, Homo sapiens
atatattacaagggata

SEQ ID NO: 3656416 - DNA, 20 bp, Homo sapiens
atatatttaagcaacatctt

SEQ ID NO: 3656417 - DNA, 18 bp, Homo sapiens
atatatttattttattct

SEQ ID NO: 3656418 - DNA, 13 bp, Homo sapiens
atatcaaatgcag

SEQ ID NO: 3656419 - DNA, 21 bp, Homo sapiens
atatcaaatgcagtatatttc

SEQ ID NO: 3656420 - DNA, 16 bp, Homo sapiens
atatcagtgacagttg

SEQ ID NO: 3656421 - DNA, 15 bp, Homo sapiens
atatccaggtgtgcc

SEQ ID NO: 3656422 - DNA, 15 bp, Homo sapiens
atatctaaagttata

SEQ ID NO: 3656423 - DNA, 18 bp, Homo sapiens
atctgattggcagatgag

SEQ ID NO: 3656424 - DNA, 11 bp, Homo sapiens
atctgcccctc

SEQ ID NO: 3656425 - DNA, 11 bp, Homo sapiens
atctggaaccc

SEQ ID NO: 3656426 - DNA, 14 bp, Homo sapiens
atctggaacccaga

SEQ ID NO: 3656427 - DNA, 23 bp, Homo sapiens
atctggaacccagactcagacat

SEQ ID NO: 3656428 - DNA, 21 bp, Homo sapiens
atctggaacctcagcctggcc

SEQ ID NO: 3656429 - DNA, 22 bp, Homo sapiens
atctggaacctcagcctggcca

SEQ ID NO: 3656430 - DNA, 20 bp, Homo sapiens
atctggcttctggccaggaa

SEQ ID NO: 3656431 - DNA, 16 bp, Homo sapiens
atctgggtaagaagaa

SEQ ID NO: 3656432 - DNA, 17 bp, Homo sapiens
atctgggtaagaagaaa

SEQ ID NO: 3656433 - DNA, 19 bp, Homo sapiens
atctgggtaagaagaaagc

SEQ ID NO: 3656434 - DNA, 23 bp, Homo sapiens
atctgggtaagaagaaagcaaaa

SEQ ID NO: 3656435 - DNA, 17 bp, Homo sapiens
atctggtcccttgcagc

SEQ ID NO: 3656436 - DNA, 22 bp, Homo sapiens
atctgtcaagagtagttatata

SEQ ID NO: 3656437 - DNA, 18 bp, Homo sapiens
atctgtccaaaggaggct

SEQ ID NO: 3656438 - DNA, 23 bp, Homo sapiens
atctgtccaaaggaggctggcag

SEQ ID NO: 3656439 - DNA, 14 bp, Homo sapiens
atctgtcctcagcc

SEQ ID NO: 3656440 - DNA, 13 bp, Homo sapiens
atctgtgccccat

SEQ ID NO: 3656441 - DNA, 16 bp, Homo sapiens
atctgttcccttcctc

SEQ ID NO: 3656442 - DNA, 17 bp, Homo sapiens
atctgttcccttcctct

SEQ ID NO: 3656443 - DNA, 17 bp, Homo sapiens
atcttaagtaccaatgg

SEQ ID NO: 3656444 - DNA, 18 bp, Homo sapiens
atcttagatgtttcacac

SEQ ID NO: 3656445 - DNA, 22 bp, Homo sapiens
atcttccgtggtcagagtgcca

SEQ ID NO: 3656446 - DNA, 19 bp, Homo sapiens
atcttgaccaagcaggaag

SEQ ID NO: 3656447 - DNA, 16 bp, Homo sapiens
atcttgcacacacttt

SEQ ID NO: 3656448 - DNA, 18 bp, Homo sapiens
atcttgcacacactttca

SEQ ID NO: 3656449 - DNA, 15 bp, Homo sapiens
atcttgcttccctaa

SEQ ID NO: 3656450 - DNA, 14 bp, Homo sapiens
atcttggtttgcct

SEQ ID NO: 3656451 - DNA, 14 bp, Homo sapiens
atctttacatctat

SEQ ID NO: 3656452 - DNA, 13 bp, Homo sapiens
atctttgccttgg

SEQ ID NO: 3656453 - DNA, 20 bp, Homo sapiens
atctttgccttgggctgctc

SEQ ID NO: 3656454 - DNA, 14 bp, Homo sapiens
atctttgtggccaa

SEQ ID NO: 3656455 - DNA, 11 bp, Homo sapiens
atcttttgaac

SEQ ID NO: 3656456 - DNA, 17 bp, Homo sapiens
atgaaaaatatttctga

SEQ ID NO: 3656457 - DNA, 20 bp, Homo sapiens
atgaaagtctagaaataaaa

SEQ ID NO: 3656458 - DNA, 12 bp, Homo sapiens
atgaagccagct

SEQ ID NO: 3656459 - DNA, 14 bp, Homo sapiens
atgaataacattta

SEQ ID NO: 3656460 - DNA, 16 bp, Homo sapiens
atgaataacatttaaa

SEQ ID NO: 3656461 - DNA, 14 bp, Homo sapiens
atgaatctttgact

SEQ ID NO: 3656462 - DNA, 17 bp, Homo sapiens
atgaatctttgactgaa

SEQ ID NO: 3656463 - DNA, 16 bp, Homo sapiens
atgaattcctagaatt

SEQ ID NO: 3656464 - DNA, 17 bp, Homo sapiens
atgacaaaaaatgtttt

SEQ ID NO: 3656465 - DNA, 17 bp, Homo sapiens
atgaccttctaggaagc

SEQ ID NO: 3656466 - DNA, 15 bp, Homo sapiens
atgactttttataaa

SEQ ID NO: 3656467 - DNA, 14 bp, Homo sapiens
atgagaaactgcat

SEQ ID NO: 3656468 - DNA, 12 bp, Homo sapiens
atgagatgctgg

SEQ ID NO: 3656469 - DNA, 19 bp, Homo sapiens
atgagatgctggcttgggc

SEQ ID NO: 3656470 - DNA, 20 bp, Homo sapiens
atgagcagcccttacagtat

SEQ ID NO: 3656471 - DNA, 14 bp, Homo sapiens
atgagcctggcaag

SEQ ID NO: 3656472 - DNA, 16 bp, Homo sapiens
atgagcgctactcttg

SEQ ID NO: 3656473 - DNA, 18 bp, Homo sapiens
atgagggggaattcctgg

SEQ ID NO: 3656474 - DNA, 18 bp, Homo sapiens
atgagttaactgtgaaat

SEQ ID NO: 3656475 - DNA, 20 bp, Homo sapiens
atgatccctgtgttgtctct

SEQ ID NO: 3656476 - DNA, 20 bp, Homo sapiens
atgatcctgtattcagacag

SEQ ID NO: 3656477 - DNA, 17 bp, Homo sapiens
atgcaaaaaattcttta

SEQ ID NO: 3656478 - DNA, 15 bp, Homo sapiens
atgcaaagaggcaag

SEQ ID NO: 3656479 - DNA, 14 bp, Homo sapiens
atgcaaggaccagg

SEQ ID NO: 3656480 - DNA, 15 bp, Homo sapiens
atgcaaggaccagga

SEQ ID NO: 3656481 - DNA, 18 bp, Homo sapiens
atgcactgtgaaggaccc

SEQ ID NO: 3656482 - DNA, 15 bp, Homo sapiens
atgcagcccatgccc

SEQ ID NO: 3656483 - DNA, 21 bp, Homo sapiens
atgcagcccatgcccacctgc

SEQ ID NO: 3656484 - DNA, 20 bp, Homo sapiens
atgcaggtggatctccttga

SEQ ID NO: 3656485 - DNA, 20 bp, Homo sapiens
atgcatctgtttattctata

SEQ ID NO: 3656486 - DNA, 18 bp, Homo sapiens
atgcatggtgccccagga

SEQ ID NO: 3656487 - DNA, 20 bp, Homo sapiens
atgcattgagctgcctccag

SEQ ID NO: 3656488 - DNA, 23 bp, Homo sapiens
atgcattgagctgcctccagcct

SEQ ID NO: 3656489 - DNA, 14 bp, Homo sapiens
atgccatgatgcct

SEQ ID NO: 3656490 - DNA, 18 bp, Homo sapiens
atgccatggacagaagaa

SEQ ID NO: 3656491 - DNA, 19 bp, Homo sapiens
atgccatggacagaagaag

SEQ ID NO: 3656492 - DNA, 15 bp, Homo sapiens
atgccccagagctgt

SEQ ID NO: 3656493 - DNA, 14 bp, Homo sapiens
atgccctggaggtg

SEQ ID NO: 3656494 - DNA, 22 bp, Homo sapiens
atgccgtggattgcacgtggcc

SEQ ID NO: 3656495 - DNA, 13 bp, Homo sapiens
atgcctcttaaat

SEQ ID NO: 3656496 - DNA, 24 bp, Homo sapiens
atgcctgtagctttcctggtccct

SEQ ID NO: 3656497 - DNA, 13 bp, Homo sapiens
atgcgccccctcc

SEQ ID NO: 3656498 - DNA, 18 bp, Homo sapiens
atgcgccccctccgccct

SEQ ID NO: 3656499 - DNA, 16 bp, Homo sapiens
atgcggcccaggatgg

SEQ ID NO: 3656500 - DNA, 21 bp, Homo sapiens
atgcgggccagtgctccagcc

SEQ ID NO: 3656501 - DNA, 23 bp, Homo sapiens
atgctaaaggttgtattgcatat

SEQ ID NO: 3656502 - DNA, 18 bp, Homo sapiens
atgctaatttaaagagac

SEQ ID NO: 3656503 - DNA, 15 bp, Homo sapiens
atgctatgcaaaaaa

SEQ ID NO: 3656504 - DNA, 14 bp, Homo sapiens
atgctccaggatct

SEQ ID NO: 3656505 - DNA, 14 bp, Homo sapiens
atgctccctcccct

SEQ ID NO: 3656506 - DNA, 16 bp, Homo sapiens
atgctctagtgccttc

SEQ ID NO: 3656507 - DNA, 22 bp, Homo sapiens
atgctctcactgtttgttttta

SEQ ID NO: 3656508 - DNA, 21 bp, Homo sapiens
atgctcttgaccttgtagaga

SEQ ID NO: 3656509 - DNA, 15 bp, Homo sapiens
atgctgctttaacag

SEQ ID NO: 3656510 - DNA, 19 bp, Homo sapiens
atgctgctttaacagtgga

SEQ ID NO: 3656511 - DNA, 17 bp, Homo sapiens
atgctggaacctgcaaa

SEQ ID NO: 3656512 - DNA, 18 bp, Homo sapiens
atgctggaacctgcaaaa

SEQ ID NO: 3656513 - DNA, 21 bp, Homo sapiens
atgctggagtacccagcctat

SEQ ID NO: 3656514 - DNA, 23 bp, Homo sapiens
atgctggagtacccagcctatca

SEQ ID NO: 3656515 - DNA, 15 bp, Homo sapiens
atgctggcccagggc

SEQ ID NO: 3656516 - DNA, 19 bp, Homo sapiens
atgctggcccagggcccag

SEQ ID NO: 3656517 - DNA, 18 bp, Homo sapiens
atgctggtggaaagatag

SEQ ID NO: 3656518 - DNA, 23 bp, Homo sapiens
atgctgtcatggtcctttctgga

SEQ ID NO: 3656519 - DNA, 14 bp, Homo sapiens
atgcttccctgcag

SEQ ID NO: 3656520 - DNA, 16 bp, Homo sapiens
atgcttccctgcagct

SEQ ID NO: 3656521 - DNA, 13 bp, Homo sapiens
atgcttctcactg

SEQ ID NO: 3656522 - DNA, 16 bp, Homo sapiens
atgctttgaaacagaa

SEQ ID NO: 3656523 - DNA, 17 bp, Homo sapiens
atgctttgaaacagaaa

SEQ ID NO: 3656524 - DNA, 18 bp, Homo sapiens
atgctttgaaacagaaaa

SEQ ID NO: 3656525 - DNA, 14 bp, Homo sapiens
atggaaaaataaca

SEQ ID NO: 3656526 - DNA, 17 bp, Homo sapiens
atggaaaatcagtgaca

SEQ ID NO: 3656527 - DNA, 16 bp, Homo sapiens
atggaaccgcaggaag

SEQ ID NO: 3656528 - DNA, 14 bp, Homo sapiens
atggaagtgggcca

SEQ ID NO: 3656529 - DNA, 20 bp, Homo sapiens
atggactatctgtctggtgg

SEQ ID NO: 3656530 - DNA, 15 bp, Homo sapiens
atggagctttctgta

SEQ ID NO: 3656531 - DNA, 12 bp, Homo sapiens
atggaggcctgt

SEQ ID NO: 3656532 - DNA, 15 bp, Homo sapiens
atggaggcctgtcct

SEQ ID NO: 3656533 - DNA, 12 bp, Homo sapiens
atggagtattct

SEQ ID NO: 3656534 - DNA, 14 bp, Homo sapiens
atggagtcatcttg

SEQ ID NO: 3656535 - DNA, 18 bp, Homo sapiens
atggatttccagccaaag

SEQ ID NO: 3656536 - DNA, 18 bp, Homo sapiens
atggcaaaggaaggtgga

SEQ ID NO: 3656537 - DNA, 23 bp, Homo sapiens
atggcacagcccaaagaaggaaa

SEQ ID NO: 3656538 - DNA, 15 bp, Homo sapiens
atggcatgagaaata

SEQ ID NO: 3656539 - DNA, 17 bp, Homo sapiens
atggcatgagaaataca

SEQ ID NO: 3656540 - DNA, 18 bp, Homo sapiens
atggccagcgcccctcag

SEQ ID NO: 3656541 - DNA, 14 bp, Homo sapiens
atggccccagcaca

SEQ ID NO: 3656542 - DNA, 21 bp, Homo sapiens
atatctaaagttatatttcag

SEQ ID NO: 3656543 - DNA, 18 bp, Homo sapiens
atatctatatatataatt

SEQ ID NO: 3656544 - DNA, 16 bp, Homo sapiens
atatctctatttgaga

SEQ ID NO: 3656545 - DNA, 23 bp, Homo sapiens
atatcttggcctaaacctcagtt

SEQ ID NO: 3656546 - DNA, 17 bp, Homo sapiens
atatgtatttttatata

SEQ ID NO: 3656547 - DNA, 15 bp, Homo sapiens
atattaactacagaa

SEQ ID NO: 3656548 - DNA, 18 bp, Homo sapiens
atattaatgtacttgttt

SEQ ID NO: 3656549 - DNA, 16 bp, Homo sapiens
atattatgagatgctg

SEQ ID NO: 3656550 - DNA, 17 bp, Homo sapiens
atatttaaaaatgtctt

SEQ ID NO: 3656551 - DNA, 19 bp, Homo sapiens
atatttaaccccacacagc

SEQ ID NO: 3656552 - DNA, 20 bp, Homo sapiens
atatttaatgttttaaatgt

SEQ ID NO: 3656553 - DNA, 14 bp, Homo sapiens
atatttacgtatga

SEQ ID NO: 3656554 - DNA, 12 bp, Homo sapiens
atatttcaagtg

SEQ ID NO: 3656555 - DNA, 15 bp, Homo sapiens
atatttcaagtgcct

SEQ ID NO: 3656556 - DNA, 15 bp, Homo sapiens
atatttcagatgtaa

SEQ ID NO: 3656557 - DNA, 18 bp, Homo sapiens
atatttcagatgtaatgt

SEQ ID NO: 3656558 - DNA, 20 bp, Homo sapiens
atatttcagatgtaatgttt

SEQ ID NO: 3656559 - DNA, 10 bp, Homo sapiens
atatttctga

SEQ ID NO: 3656560 - DNA, 11 bp, Homo sapiens
atattttaatt

SEQ ID NO: 3656561 - DNA, 13 bp, Homo sapiens
atattttctctgt

SEQ ID NO: 3656562 - DNA, 23 bp, Homo sapiens
atattttttaaaaaacacttgaa

SEQ ID NO: 3656563 - DNA, 22 bp, Homo sapiens
atcaaacccggcggtcccctcc

SEQ ID NO: 3656564 - DNA, 17 bp, Homo sapiens
atcaaatgcagtatatt

SEQ ID NO: 3656565 - DNA, 15 bp, Homo sapiens
atcaacttaaaagtc

SEQ ID NO: 3656566 - DNA, 13 bp, Homo sapiens
atcaatcaaaccc

SEQ ID NO: 3656567 - DNA, 14 bp, Homo sapiens
atcacagcttcagc

SEQ ID NO: 3656568 - DNA, 22 bp, Homo sapiens
atcacagcttcagccaggagct

SEQ ID NO: 3656569 - DNA, 18 bp, Homo sapiens
atcacagggttgggccca

SEQ ID NO: 3656570 - DNA, 14 bp, Homo sapiens
atcacagtctcagt

SEQ ID NO: 3656571 - DNA, 23 bp, Homo sapiens
atcaccacaaactgtaatacaat

SEQ ID NO: 3656572 - DNA, 18 bp, Homo sapiens
atcacccaatcccagttc

SEQ ID NO: 3656573 - DNA, 15 bp, Homo sapiens
atcacctcattctga

SEQ ID NO: 3656574 - DNA, 20 bp, Homo sapiens
atcaccttaggcagggaagt

SEQ ID NO: 3656575 - DNA, 15 bp, Homo sapiens
atcactgagttttcc

SEQ ID NO: 3656576 - DNA, 16 bp, Homo sapiens
atcactgagttttcca

SEQ ID NO: 3656577 - DNA, 17 bp, Homo sapiens
atcactgagttttccat

SEQ ID NO: 3656578 - DNA, 18 bp, Homo sapiens
atcactgagttttccatg

SEQ ID NO: 3656579 - DNA, 14 bp, Homo sapiens
atcacttacatttt

SEQ ID NO: 3656580 - DNA, 15 bp, Homo sapiens
atcacttacattttt

SEQ ID NO: 3656581 - DNA, 13 bp, Homo sapiens
atcagcaaaaaag

SEQ ID NO: 3656582 - DNA, 19 bp, Homo sapiens
atcagcctgctccagctgt

SEQ ID NO: 3656583 - DNA, 13 bp, Homo sapiens
atcaggtggggag

SEQ ID NO: 3656584 - DNA, 16 bp, Homo sapiens
atcagtaggatatact

SEQ ID NO: 3656585 - DNA, 22 bp, Homo sapiens
atcagtttgctagcagaaatct

SEQ ID NO: 3656586 - DNA, 14 bp, Homo sapiens
atcatattattatc

SEQ ID NO: 3656587 - DNA, 14 bp, Homo sapiens
atcatcattattat

SEQ ID NO: 3656588 - DNA, 16 bp, Homo sapiens
atcatgttgatcatgt

SEQ ID NO: 3656589 - DNA, 19 bp, Homo sapiens
atcatgttgatcatgtact

SEQ ID NO: 3656590 - DNA, 13 bp, Homo sapiens
atcattctccttg

SEQ ID NO: 3656591 - DNA, 20 bp, Homo sapiens
atcattgatgatcactgtga

SEQ ID NO: 3656592 - DNA, 13 bp, Homo sapiens
atcattttccccc

SEQ ID NO: 3656593 - DNA, 15 bp, Homo sapiens
atcattttcccccca

SEQ ID NO: 3656594 - DNA, 22 bp, Homo sapiens
atccaaaagaagcccccagcta

SEQ ID NO: 3656595 - DNA, 20 bp, Homo sapiens
atccaatgggtttttccctg

SEQ ID NO: 3656596 - DNA, 12 bp, Homo sapiens
atccagcctggg

SEQ ID NO: 3656597 - DNA, 19 bp, Homo sapiens
atccagctacaggagagat

SEQ ID NO: 3656598 - DNA, 20 bp, Homo sapiens
atccaggagataattgtttc

SEQ ID NO: 3656599 - DNA, 14 bp, Homo sapiens
atccaggcagatcc

SEQ ID NO: 3656600 - DNA, 16 bp, Homo sapiens
atccaggcagatccag

SEQ ID NO: 3656601 - DNA, 13 bp, Homo sapiens
atccagggacaga

SEQ ID NO: 3656602 - DNA, 16 bp, Homo sapiens
atccagggacagaggc

SEQ ID NO: 3656603 - DNA, 21 bp, Homo sapiens
atccagggacagaggccccag

SEQ ID NO: 3656604 - DNA, 18 bp, Homo sapiens
atcccagttcttcctgca

SEQ ID NO: 3656605 - DNA, 14 bp, Homo sapiens
atcccatttaaaaa

SEQ ID NO: 3656606 - DNA, 15 bp, Homo sapiens
atccccccatcttgc

SEQ ID NO: 3656607 - DNA, 17 bp, Homo sapiens
atccccccatcttgctt

SEQ ID NO: 3656608 - DNA, 18 bp, Homo sapiens
atccccgcagtgtgcact

SEQ ID NO: 3656609 - DNA, 21 bp, Homo sapiens
atcccggctccagagcaggaa

SEQ ID NO: 3656610 - DNA, 14 bp, Homo sapiens
atccctacccccta

SEQ ID NO: 3656611 - DNA, 18 bp, Homo sapiens
atccctcccccccatgca

SEQ ID NO: 3656612 - DNA, 22 bp, Homo sapiens
atccctcccccccatgcactgt

SEQ ID NO: 3656613 - DNA, 22 bp, Homo sapiens
atccctttgtctgtcaatcaca

SEQ ID NO: 3656614 - DNA, 23 bp, Homo sapiens
atccctttgtctgtcaatcacag

SEQ ID NO: 3656615 - DNA, 16 bp, Homo sapiens
atccgcgtgtgcctgt

SEQ ID NO: 3656616 - DNA, 23 bp, Homo sapiens
atcctaagactaacaaaggcagc

SEQ ID NO: 3656617 - DNA, 13 bp, Homo sapiens
atcctaatgaatg

SEQ ID NO: 3656618 - DNA, 19 bp, Homo sapiens
atcctaatgaatgcataaa

SEQ ID NO: 3656619 - DNA, 13 bp, Homo sapiens
atcctacagtgaa

SEQ ID NO: 3656620 - DNA, 21 bp, Homo sapiens
atcctaggcatttgctgaata

SEQ ID NO: 3656621 - DNA, 23 bp, Homo sapiens
atcctcatttggggtagctagag

SEQ ID NO: 3656622 - DNA, 15 bp, Homo sapiens
atcctccagcaggga

SEQ ID NO: 3656623 - DNA, 15 bp, Homo sapiens
atcctccgtccagcc

SEQ ID NO: 3656624 - DNA, 12 bp, Homo sapiens
atcctctgcctc

SEQ ID NO: 3656625 - DNA, 15 bp, Homo sapiens
atcctctttttccaa

SEQ ID NO: 3656626 - DNA, 14 bp, Homo sapiens
atcctggaggtctt

SEQ ID NO: 3656627 - DNA, 19 bp, Homo sapiens
atcctggaggtcttttcta

SEQ ID NO: 3656628 - DNA, 20 bp, Homo sapiens
atcctggctgtcgagaaaca

SEQ ID NO: 3656629 - DNA, 22 bp, Homo sapiens
atcctgggtggtctgcaggcag

SEQ ID NO: 3656630 - DNA, 16 bp, Homo sapiens
atcctgtattcagaca

SEQ ID NO: 3656631 - DNA, 20 bp, Homo sapiens
atcctgtattcagacagatg

SEQ ID NO: 3656632 - DNA, 18 bp, Homo sapiens
atcctgtttgtatgaaat

SEQ ID NO: 3656633 - DNA, 14 bp, Homo sapiens
atccttagatctgg

SEQ ID NO: 3656634 - DNA, 18 bp, Homo sapiens
atccttagatctggcatg

SEQ ID NO: 3656635 - DNA, 17 bp, Homo sapiens
atcgcaccattctgact

SEQ ID NO: 3656636 - DNA, 13 bp, Homo sapiens
atcgtctaaactt

SEQ ID NO: 3656637 - DNA, 15 bp, Homo sapiens
atctaacaataatat

SEQ ID NO: 3656638 - DNA, 12 bp, Homo sapiens
atctagccagcc

SEQ ID NO: 3656639 - DNA, 19 bp, Homo sapiens
atctagccagcccctcttc

SEQ ID NO: 3656640 - DNA, 21 bp, Homo sapiens
atctagccagcccctcttccc

SEQ ID NO: 3656641 - DNA, 16 bp, Homo sapiens
atctagtcacaaagac

SEQ ID NO: 3656642 - DNA, 17 bp, Homo sapiens
atctatggtcgggagac

SEQ ID NO: 3656643 - DNA, 23 bp, Homo sapiens
atctcagaaccttgtcccagcca

SEQ ID NO: 3656644 - DNA, 20 bp, Homo sapiens
atctcagctcactgtgacct

SEQ ID NO: 3656645 - DNA, 15 bp, Homo sapiens
atctcaggtctgaat

SEQ ID NO: 3656646 - DNA, 21 bp, Homo sapiens
atctcagttgattttctggat

SEQ ID NO: 3656647 - DNA, 19 bp, Homo sapiens
atctcccgaagtcctctgt

SEQ ID NO: 3656648 - DNA, 22 bp, Homo sapiens
atctccctggagaagcaccagc

SEQ ID NO: 3656649 - DNA, 20 bp, Homo sapiens
atctcctcgcaagctgggta

SEQ ID NO: 3656650 - DNA, 11 bp, Homo sapiens
atctcctggaa

SEQ ID NO: 3656651 - DNA, 23 bp, Homo sapiens
atctcctggaacactatagagaa

SEQ ID NO: 3656652 - DNA, 14 bp, Homo sapiens
atctctccactgtg

SEQ ID NO: 3656653 - DNA, 14 bp, Homo sapiens
atctctctgcccaa

SEQ ID NO: 3656654 - DNA, 18 bp, Homo sapiens
atctctgtgccttcgtct

SEQ ID NO: 3656655 - DNA, 17 bp, Homo sapiens
atctctttcacattgtt

SEQ ID NO: 3656656 - DNA, 16 bp, Homo sapiens
atctgaccagcagcgc

SEQ ID NO: 3656657 - DNA, 13 bp, Homo sapiens
atctgacccagtg

SEQ ID NO: 3656658 - DNA, 18 bp, Homo sapiens
atctgacccagtgccccc

SEQ ID NO: 3656659 - DNA, 20 bp, Homo sapiens
atctgacccagtgcccccac

SEQ ID NO: 3656660 - DNA, 21 bp, Homo sapiens
atctgagaaactctacatgta

SEQ ID NO: 3656661 - DNA, 18 bp, Homo sapiens
atggccccagcacagctt

SEQ ID NO: 3656662 - DNA, 16 bp, Homo sapiens
atggcccggcccctcc

SEQ ID NO: 3656663 - DNA, 19 bp, Homo sapiens
atggcccggcccctcctga

SEQ ID NO: 3656664 - DNA, 16 bp, Homo sapiens
atggcctcagctgcct

SEQ ID NO: 3656665 - DNA, 17 bp, Homo sapiens
atggcctcagctgcctc

SEQ ID NO: 3656666 - DNA, 18 bp, Homo sapiens
atggcctcagctgcctca

SEQ ID NO: 3656667 - DNA, 21 bp, Homo sapiens
atggcctcagctgcctcactt

SEQ ID NO: 3656668 - DNA, 17 bp, Homo sapiens
atggcctcatgtggctg

SEQ ID NO: 3656669 - DNA, 20 bp, Homo sapiens
atggcctcatgtggctggaa

SEQ ID NO: 3656670 - DNA, 15 bp, Homo sapiens
atggcgacactaaag

SEQ ID NO: 3656671 - DNA, 14 bp, Homo sapiens
atggctcagggtgg

SEQ ID NO: 3656672 - DNA, 12 bp, Homo sapiens
atggctcctctc

SEQ ID NO: 3656673 - DNA, 22 bp, Homo sapiens
atgggagccccagggtcttccc

SEQ ID NO: 3656674 - DNA, 17 bp, Homo sapiens
atgggattctggacagg

SEQ ID NO: 3656675 - DNA, 19 bp, Homo sapiens
atgggccactgaaatctgt

SEQ ID NO: 3656676 - DNA, 14 bp, Homo sapiens
atgggcccctggca

SEQ ID NO: 3656677 - DNA, 16 bp, Homo sapiens
atgggcccctggcact

SEQ ID NO: 3656678 - DNA, 14 bp, Homo sapiens
atgggccggccccc

SEQ ID NO: 3656679 - DNA, 11 bp, Homo sapiens
atggggaggga

SEQ ID NO: 3656680 - DNA, 12 bp, Homo sapiens
atggggatgcag

SEQ ID NO: 3656681 - DNA, 20 bp, Homo sapiens
atggggcagagcttctcctg

SEQ ID NO: 3656682 - DNA, 21 bp, Homo sapiens
atggggcatcctctttttcca

SEQ ID NO: 3656683 - DNA, 16 bp, Homo sapiens
atggggtcctggccat

SEQ ID NO: 3656684 - DNA, 17 bp, Homo sapiens
atggggtcctggccatc

SEQ ID NO: 3656685 - DNA, 16 bp, Homo sapiens
atgggtgcaaggaaaa

SEQ ID NO: 3656686 - DNA, 17 bp, Homo sapiens
atggtatatatacatat

SEQ ID NO: 3656687 - DNA, 19 bp, Homo sapiens
atggtatatatacatatat

SEQ ID NO: 3656688 - DNA, 17 bp, Homo sapiens
atggtcctttctggaag

SEQ ID NO: 3656689 - DNA, 14 bp, Homo sapiens
atggtgatgaaatg

SEQ ID NO: 3656690 - DNA, 16 bp, Homo sapiens
atggtgatgaaatgta

SEQ ID NO: 3656691 - DNA, 17 bp, Homo sapiens
atggtgccccaggacca

SEQ ID NO: 3656692 - DNA, 15 bp, Homo sapiens
atggtgcgtgaaggc

SEQ ID NO: 3656693 - DNA, 14 bp, Homo sapiens
atggttaccatggg

SEQ ID NO: 3656694 - DNA, 13 bp, Homo sapiens
atggttctgtgac

SEQ ID NO: 3656695 - DNA, 18 bp, Homo sapiens
atggtttgcaaggaagcc

SEQ ID NO: 3656696 - DNA, 16 bp, Homo sapiens
atggtttttaaatttt

SEQ ID NO: 3656697 - DNA, 21 bp, Homo sapiens
atggtttttaaattttgtaat

SEQ ID NO: 3656698 - DNA, 14 bp, Homo sapiens
atgtaaagccatgc

SEQ ID NO: 3656699 - DNA, 21 bp, Homo sapiens
atgtaatgttttctttgcaaa

SEQ ID NO: 3656700 - DNA, 18 bp, Homo sapiens
atgtactagtgttctgtt

SEQ ID NO: 3656701 - DNA, 19 bp, Homo sapiens
atgtacttgtttctctgtt

SEQ ID NO: 3656702 - DNA, 15 bp, Homo sapiens
atgtcaaagtgtaac

SEQ ID NO: 3656703 - DNA, 16 bp, Homo sapiens
atgtcaatttctgtgt

SEQ ID NO: 3656704 - DNA, 19 bp, Homo sapiens
atgtcaatttctgtgttgc

SEQ ID NO: 3656705 - DNA, 21 bp, Homo sapiens
atgtccagcaccttgtgcctg

SEQ ID NO: 3656706 - DNA, 22 bp, Homo sapiens
atgtccagcaccttgtgcctgg

SEQ ID NO: 3656707 - DNA, 13 bp, Homo sapiens
atgtccctccaac

SEQ ID NO: 3656708 - DNA, 17 bp, Homo sapiens
atgtccctccaacacag

SEQ ID NO: 3656709 - DNA, 20 bp, Homo sapiens
atgtcctccagaagcctctg

SEQ ID NO: 3656710 - DNA, 22 bp, Homo sapiens
atgtcctccagaagcctctggc

SEQ ID NO: 3656711 - DNA, 14 bp, Homo sapiens
atgtcttttaaaat

SEQ ID NO: 3656712 - DNA, 16 bp, Homo sapiens
atgtgcatagtttctt

SEQ ID NO: 3656713 - DNA, 16 bp, Homo sapiens
atgtgggtcaaggaat

SEQ ID NO: 3656714 - DNA, 15 bp, Homo sapiens
atgtgtctcccaggt

SEQ ID NO: 3656715 - DNA, 23 bp, Homo sapiens
atgtgtctcccaggtgcatttct

SEQ ID NO: 3656716 - DNA, 23 bp, Homo sapiens
atgtgtgttcctgcttttctaat

SEQ ID NO: 3656717 - DNA, 21 bp, Homo sapiens
atgtgtttacatttactgaaa

SEQ ID NO: 3656718 - DNA, 16 bp, Homo sapiens
atgtgtttgctttctg

SEQ ID NO: 3656719 - DNA, 20 bp, Homo sapiens
atgttaattttttggtacaa

SEQ ID NO: 3656720 - DNA, 19 bp, Homo sapiens
atgttcagcactgtccctt

SEQ ID NO: 3656721 - DNA, 23 bp, Homo sapiens
atgttggccaccaggtgcctttc

SEQ ID NO: 3656722 - DNA, 20 bp, Homo sapiens
atgtttataaatcttatgct

SEQ ID NO: 3656723 - DNA, 19 bp, Homo sapiens
atgtttccagcagaagaca

SEQ ID NO: 3656724 - DNA, 24 bp, Homo sapiens
atgtttccagcagaagacaaaaag

SEQ ID NO: 3656725 - DNA, 15 bp, Homo sapiens
atgtttgtggcctca

SEQ ID NO: 3656726 - DNA, 12 bp, Homo sapiens
atgttttaaaga

SEQ ID NO: 3656727 - DNA, 18 bp, Homo sapiens
atgttttctttgcaaagt

SEQ ID NO: 3656728 - DNA, 21 bp, Homo sapiens
atgttttctttgcaaagtatt

SEQ ID NO: 3656729 - DNA, 17 bp, Homo sapiens
atgtttttgtgtatttg

SEQ ID NO: 3656730 - DNA, 12 bp, Homo sapiens
attaaaatggat

SEQ ID NO: 3656731 - DNA, 18 bp, Homo sapiens
attaaccacttcagctga

SEQ ID NO: 3656732 - DNA, 13 bp, Homo sapiens
attaacctctgca

SEQ ID NO: 3656733 - DNA, 15 bp, Homo sapiens
attaactacagaaaa

SEQ ID NO: 3656734 - DNA, 22 bp, Homo sapiens
attaactgagtagctctcctga

SEQ ID NO: 3656735 - DNA, 14 bp, Homo sapiens
attaagaactgctg

SEQ ID NO: 3656736 - DNA, 22 bp, Homo sapiens
attaagctgttcctgttcagta

SEQ ID NO: 3656737 - DNA, 12 bp, Homo sapiens
attaaggaacat

SEQ ID NO: 3656738 - DNA, 13 bp, Homo sapiens
attaagttcttta

SEQ ID NO: 3656739 - DNA, 19 bp, Homo sapiens
attaatatctcctggaaca

SEQ ID NO: 3656740 - DNA, 20 bp, Homo sapiens
attaatatggggatgcagca

SEQ ID NO: 3656741 - DNA, 19 bp, Homo sapiens
attaatattaactacagaa

SEQ ID NO: 3656742 - DNA, 13 bp, Homo sapiens
attaattgctttg

SEQ ID NO: 3656743 - DNA, 15 bp, Homo sapiens
attacaattttatct

SEQ ID NO: 3656744 - DNA, 19 bp, Homo sapiens
attacctgccaattgctac

SEQ ID NO: 3656745 - DNA, 20 bp, Homo sapiens
attacctgccaattgctacc

SEQ ID NO: 3656746 - DNA, 22 bp, Homo sapiens
attactcccaggatcagcagaa

SEQ ID NO: 3656747 - DNA, 21 bp, Homo sapiens
attagaagacaattgacaaca

SEQ ID NO: 3656748 - DNA, 12 bp, Homo sapiens
attagaatgccg

SEQ ID NO: 3656749 - DNA, 13 bp, Homo sapiens
attagagaagaga

SEQ ID NO: 3656750 - DNA, 20 bp, Homo sapiens
attagccatgcaacatggat

SEQ ID NO: 3656751 - DNA, 15 bp, Homo sapiens
attaggtcttgctgg

SEQ ID NO: 3656752 - DNA, 20 bp, Homo sapiens
attatatttgacatgggtat

SEQ ID NO: 3656753 - DNA, 19 bp, Homo sapiens
attatatttgtgctatagt

SEQ ID NO: 3656754 - DNA, 13 bp, Homo sapiens
attatttgcagtc

SEQ ID NO: 3656755 - DNA, 14 bp, Homo sapiens
attcaaaatattta

SEQ ID NO: 3656756 - DNA, 22 bp, Homo sapiens
attcaaaatatttaaaaatgtc

SEQ ID NO: 3656757 - DNA, 21 bp, Homo sapiens
attcaagaatgccagtagaaa

SEQ ID NO: 3656758 - DNA, 22 bp, Homo sapiens
attcaataaaatactattcttt

SEQ ID NO: 3656759 - DNA, 18 bp, Homo sapiens
attcagcagcaaattttc

SEQ ID NO: 3656760 - DNA, 14 bp, Homo sapiens
attcagcctgtttg

SEQ ID NO: 3656761 - DNA, 11 bp, Homo sapiens
attcaggctgc

SEQ ID NO: 3656762 - DNA, 18 bp, Homo sapiens
attcagtaactgtcaggc

SEQ ID NO: 3656763 - DNA, 17 bp, Homo sapiens
attcatctctctttaat

SEQ ID NO: 3656764 - DNA, 13 bp, Homo sapiens
attcatgactatg

SEQ ID NO: 3656765 - DNA, 14 bp, Homo sapiens
attccagcccctct

SEQ ID NO: 3656766 - DNA, 14 bp, Homo sapiens
attccattttggaa

SEQ ID NO: 3656767 - DNA, 22 bp, Homo sapiens
attccccaccctgaaagccctg

SEQ ID NO: 3656768 - DNA, 17 bp, Homo sapiens
attccgcaccctgccta

SEQ ID NO: 3656769 - DNA, 18 bp, Homo sapiens
attccgcaccctgcctac

SEQ ID NO: 3656770 - DNA, 22 bp, Homo sapiens
attccggaaactagtgtacatt

SEQ ID NO: 3656771 - DNA, 13 bp, Homo sapiens
attcctctttgct

SEQ ID NO: 3656772 - DNA, 16 bp, Homo sapiens
attctgataatgctca

SEQ ID NO: 3656773 - DNA, 22 bp, Homo sapiens
attctggacaggatgtgtttgc

SEQ ID NO: 3656774 - DNA, 19 bp, Homo sapiens
attctggttccagggtccc

SEQ ID NO: 3656775 - DNA, 21 bp, Homo sapiens
attcttacaaacatgtggtta

SEQ ID NO: 3656776 - DNA, 22 bp, Homo sapiens
attcttcttccaacgtggccca

SEQ ID NO: 3656777 - DNA, 18 bp, Homo sapiens
attcttggcttaatcatt

SEQ ID NO: 3656778 - DNA, 16 bp, Homo sapiens
attcttttgaattgtt

SEQ ID NO: 3656779 - DNA, 22 bp, Homo sapiens
attgaagctcgtgacaagtgcc

SEQ ID NO: 3656780 - DNA, 18 bp, Homo sapiens
attgaaggatcatctgaa

SEQ ID NO: 3656781 - DNA, 14 bp, Homo sapiens
attgacagctttgc

SEQ ID NO: 3656782 - DNA, 16 bp, Homo sapiens
attgacagctttgctg

SEQ ID NO: 3656783 - DNA, 19 bp, Homo sapiens
attgaccaagtgatgtgtt

SEQ ID NO: 3656784 - DNA, 11 bp, Homo sapiens
attgagaagcc

SEQ ID NO: 3656785 - DNA, 13 bp, Homo sapiens
attgagctgcctc

SEQ ID NO: 3656786 - DNA, 19 bp, Homo sapiens
attgagctgcctccagcct

SEQ ID NO: 3656787 - DNA, 20 bp, Homo sapiens
attgatcattttccccccac

SEQ ID NO: 3656788 - DNA, 21 bp, Homo sapiens
attgatcattttccccccact

SEQ ID NO: 3656789 - DNA, 21 bp, Homo sapiens
attgatgtggccctggctgcc

SEQ ID NO: 3656790 - DNA, 15 bp, Homo sapiens
attgcacgtggcctc

SEQ ID NO: 3656791 - DNA, 17 bp, Homo sapiens
attgcactccagcctgg

SEQ ID NO: 3656792 - DNA, 14 bp, Homo sapiens
attgccaccaggag

SEQ ID NO: 3656793 - DNA, 22 bp, Homo sapiens
attgcctctactttgattctga

SEQ ID NO: 3656794 - DNA, 22 bp, Homo sapiens
attgcctttgaatgttaatttt

SEQ ID NO: 3656795 - DNA, 13 bp, Homo sapiens
attgcgctgctac

SEQ ID NO: 3656796 - DNA, 17 bp, Homo sapiens
attgctgtgtgtcccag

SEQ ID NO: 3656797 - DNA, 19 bp, Homo sapiens
attgctgtgtgtcccaggc

SEQ ID NO: 3656798 - DNA, 14 bp, Homo sapiens
attgcttgagctca

SEQ ID NO: 3656799 - DNA, 10 bp, Homo sapiens
attgctttga

SEQ ID NO: 3656800 - DNA, 14 bp, Homo sapiens
attgctttgccaaa

SEQ ID NO: 3656801 - DNA, 15 bp, Homo sapiens
attgctttgccaaaa

SEQ ID NO: 3656802 - DNA, 14 bp, Homo sapiens
attgctttgtgact

SEQ ID NO: 3656803 - DNA, 17 bp, Homo sapiens
attgctttgtgacttct

SEQ ID NO: 3656804 - DNA, 20 bp, Homo sapiens
attggagctgactgttcttg

SEQ ID NO: 3656805 - DNA, 16 bp, Homo sapiens
attggataaagcagct

SEQ ID NO: 3656806 - DNA, 13 bp, Homo sapiens
attggcagatgag

SEQ ID NO: 3656807 - DNA, 18 bp, Homo sapiens
attggctttctctccttg

SEQ ID NO: 3656808 - DNA, 16 bp, Homo sapiens
attgggcggggcttct

SEQ ID NO: 3656809 - DNA, 22 bp, Homo sapiens
attgggcggggcttctcttggg

SEQ ID NO: 3656810 - DNA, 15 bp, Homo sapiens
attgtaaattatatt

SEQ ID NO: 3656811 - DNA, 20 bp, Homo sapiens
attgtaagtgaagtaaaact

SEQ ID NO: 3656812 - DNA, 19 bp, Homo sapiens
attgtacacaccttatatt

SEQ ID NO: 3656813 - DNA, 15 bp, Homo sapiens
attgtactaaagcca

SEQ ID NO: 3656814 - DNA, 23 bp, Homo sapiens
attgtccctctgccccatcctcc

SEQ ID NO: 3656815 - DNA, 21 bp, Homo sapiens
attgtctgtctacatttctgc

SEQ ID NO: 3656816 - DNA, 19 bp, Homo sapiens
attgtttcaaaataaaaac

SEQ ID NO: 3656817 - DNA, 12 bp, Homo sapiens
atttaaaaatgt

SEQ ID NO: 3656818 - DNA, 16 bp, Homo sapiens
atttaaaaatgtcttg

SEQ ID NO: 3656819 - DNA, 17 bp, Homo sapiens
atttaatgttttaaatg

SEQ ID NO: 3656820 - DNA, 18 bp, Homo sapiens
atttaatgttttaaatgt

SEQ ID NO: 3656821 - DNA, 20 bp, Homo sapiens
atttaatgttttaaatgtac

SEQ ID NO: 3656822 - DNA, 14 bp, Homo sapiens
atttacagaacaaa

SEQ ID NO: 3656823 - DNA, 18 bp, Homo sapiens
atttagaaactaattgac

SEQ ID NO: 3656824 - DNA, 14 bp, Homo sapiens
atttagtaaatgtt

SEQ ID NO: 3656825 - DNA, 22 bp, Homo sapiens
atttatactttgcaatccaaat

SEQ ID NO: 3656826 - DNA, 13 bp, Homo sapiens
atttatgggcccc

SEQ ID NO: 3656827 - DNA, 22 bp, Homo sapiens
atttatgtgtgaggagctgctg

SEQ ID NO: 3656828 - DNA, 17 bp, Homo sapiens
atttattaattgctttg

SEQ ID NO: 3656829 - DNA, 22 bp, Homo sapiens
atttattgcagaggatgttcat

SEQ ID NO: 3656830 - DNA, 17 bp, Homo sapiens
atttattgtctgtctac

SEQ ID NO: 3656831 - DNA, 15 bp, Homo sapiens
atttatttaattttc

SEQ ID NO: 3656832 - DNA, 19 bp, Homo sapiens
atttattttattctatgta

SEQ ID NO: 3656833 - DNA, 14 bp, Homo sapiens
atttcaagtgccta

SEQ ID NO: 3656834 - DNA, 13 bp, Homo sapiens
atttcaattgctt

SEQ ID NO: 3656835 - DNA, 15 bp, Homo sapiens
atttcaattgctttg

SEQ ID NO: 3656836 - DNA, 18 bp, Homo sapiens
atttcagatgtaatgttt

SEQ ID NO: 3656837 - DNA, 19 bp, Homo sapiens
atttcagatgtaatgtttt

SEQ ID NO: 3656838 - DNA, 23 bp, Homo sapiens
atttcagttcagcggttgaggag

SEQ ID NO: 3656839 - DNA, 17 bp, Homo sapiens
atttcattagccatgca

SEQ ID NO: 3656840 - DNA, 21 bp, Homo sapiens
atttccaaacctggttcatat

SEQ ID NO: 3656841 - DNA, 17 bp, Homo sapiens
atttccagccaaagcct

SEQ ID NO: 3656842 - DNA, 16 bp, Homo sapiens
atttcccaggaccctg

SEQ ID NO: 3656843 - DNA, 21 bp, Homo sapiens
atttctataaatagatgctgt

SEQ ID NO: 3656844 - DNA, 22 bp, Homo sapiens
atttctcagggaagtaagatgt

SEQ ID NO: 3656845 - DNA, 17 bp, Homo sapiens
atttctgaactgttaca

SEQ ID NO: 3656846 - DNA, 19 bp, Homo sapiens
atttcttcgttctttttaa

SEQ ID NO: 3656847 - DNA, 16 bp, Homo sapiens
atttcttggtttatgt

SEQ ID NO: 3656848 - DNA, 16 bp, Homo sapiens
atttcttgtgttctgt

SEQ ID NO: 3656849 - DNA, 19 bp, Homo sapiens
atttcttgtgttctgtaga

SEQ ID NO: 3656850 - DNA, 21 bp, Homo sapiens
atttcttgtgttctgtagact

SEQ ID NO: 3656851 - DNA, 14 bp, Homo sapiens
atttgactaatttt

SEQ ID NO: 3656852 - DNA, 17 bp, Homo sapiens
atttgactaattttaca

SEQ ID NO: 3656853 - DNA, 16 bp, Homo sapiens
atttgattaacatttg

SEQ ID NO: 3656854 - DNA, 10 bp, Homo sapiens
atttgcagtc

SEQ ID NO: 3656855 - DNA, 19 bp, Homo sapiens
atttgggcctgctccagac

SEQ ID NO: 3656856 - DNA, 22 bp, Homo sapiens
atttgggcctgctccagacctg

SEQ ID NO: 3656857 - DNA, 21 bp, Homo sapiens
atttggggtagctagaggaac

SEQ ID NO: 3656858 - DNA, 17 bp, Homo sapiens
atttgggttctgcctgc

SEQ ID NO: 3656859 - DNA, 22 bp, Homo sapiens
atttgtctttttgttgtaaaac

SEQ ID NO: 3656860 - DNA, 18 bp, Homo sapiens
atttgtgctatagtattt

SEQ ID NO: 3656861 - DNA, 18 bp, Homo sapiens
atttgtgtaatatgaaat

SEQ ID NO: 3656862 - DNA, 20 bp, Homo sapiens
attttaactgccaatcctta

SEQ ID NO: 3656863 - DNA, 20 bp, Homo sapiens
attttaatagggaatatatc

SEQ ID NO: 3656864 - DNA, 15 bp, Homo sapiens
attttaatttagtaa

SEQ ID NO: 3656865 - DNA, 20 bp, Homo sapiens
attttaatttagtaaatgtt

SEQ ID NO: 3656866 - DNA, 20 bp, Homo sapiens
attttatgccttttatttct

SEQ ID NO: 3656867 - DNA, 14 bp, Homo sapiens
attttatggtgcat

SEQ ID NO: 3656868 - DNA, 17 bp, Homo sapiens
attttatttatttaatt

SEQ ID NO: 3656869 - DNA, 14 bp, Homo sapiens
attttcacagcttt

SEQ ID NO: 3656870 - DNA, 15 bp, Homo sapiens
attttcagagtgaca

SEQ ID NO: 3656871 - DNA, 12 bp, Homo sapiens
attttcagcatt

SEQ ID NO: 3656872 - DNA, 19 bp, Homo sapiens
attttcagcattaagctgt

SEQ ID NO: 3656873 - DNA, 17 bp, Homo sapiens
attttccaaatgtaata

SEQ ID NO: 3656874 - DNA, 22 bp, Homo sapiens
attttccccccactctccccac

SEQ ID NO: 3656875 - DNA, 14 bp, Homo sapiens
attttctctgtact

SEQ ID NO: 3656876 - DNA, 20 bp, Homo sapiens
attttggagagtttcctgaa

SEQ ID NO: 3656877 - DNA, 22 bp, Homo sapiens
attttggagagtttcctgaaac

SEQ ID NO: 3656878 - DNA, 12 bp, Homo sapiens
attttgtaatga

SEQ ID NO: 3656879 - DNA, 21 bp, Homo sapiens
attttgtttttgtcttaaaaa

SEQ ID NO: 3656880 - DNA, 22 bp, Homo sapiens
attttgtttttgtcttaaaaag

SEQ ID NO: 3656881 - DNA, 14 bp, Homo sapiens
atttttaaagtaga

SEQ ID NO: 3656882 - DNA, 21 bp, Homo sapiens
atttttagaattaaaaaagca

SEQ ID NO: 3656883 - DNA, 21 bp, Homo sapiens
atttttatataatatctaaag

SEQ ID NO: 3656884 - DNA, 10 bp, Homo sapiens
atttttccta

SEQ ID NO: 3656885 - DNA, 17 bp, Homo sapiens
atttttgtaaagtttcc

SEQ ID NO: 3656886 - DNA, 19 bp, Homo sapiens
atttttgtaaatgtgtaca

SEQ ID NO: 3656887 - DNA, 21 bp, Homo sapiens
attttttatgatcaaggtgaa

SEQ ID NO: 3656888 - DNA, 13 bp, Homo sapiens
caaaaaacatgag

SEQ ID NO: 3656889 - DNA, 14 bp, Homo sapiens
caaaaaattcttta

SEQ ID NO: 3656890 - DNA, 18 bp, Homo sapiens
caaaaaattctttagaga

SEQ ID NO: 3656891 - DNA, 14 bp, Homo sapiens
caaaaagacaaaca

SEQ ID NO: 3656892 - DNA, 14 bp, Homo sapiens
caaaaatagctggg

SEQ ID NO: 3656893 - DNA, 15 bp, Homo sapiens
caaaacactatgtat

SEQ ID NO: 3656894 - DNA, 18 bp, Homo sapiens
caaaacgagggggtcagc

SEQ ID NO: 3656895 - DNA, 15 bp, Homo sapiens
caaaacgatgaagtt

SEQ ID NO: 3656896 - DNA, 21 bp, Homo sapiens
caaaacggttttactgcagct

SEQ ID NO: 3656897 - DNA, 16 bp, Homo sapiens
caagccaagcagccaa

SEQ ID NO: 3656898 - DNA, 19 bp, Homo sapiens
caagccaagcagccaagct

SEQ ID NO: 3656899 - DNA, 21 bp, Homo sapiens
caagccaagggaacctgtgtc

SEQ ID NO: 3656900 - DNA, 23 bp, Homo sapiens
caagccaagggaacctgtgtccg

SEQ ID NO: 3656901 - DNA, 13 bp, Homo sapiens
caagccagaggct

SEQ ID NO: 3656902 - DNA, 15 bp, Homo sapiens
caagccagaggctgg

SEQ ID NO: 3656903 - DNA, 14 bp, Homo sapiens
caagctccaagccc

SEQ ID NO: 3656904 - DNA, 19 bp, Homo sapiens
caagctccaagccccatct

SEQ ID NO: 3656905 - DNA, 22 bp, Homo sapiens
caagctcctcctccctgcatct

SEQ ID NO: 3656906 - DNA, 17 bp, Homo sapiens
caagctccttgggaggc

SEQ ID NO: 3656907 - DNA, 21 bp, Homo sapiens
caagctgcaccctcaggcagg

SEQ ID NO: 3656908 - DNA, 22 bp, Homo sapiens
caagctgcaccctcaggcaggt

SEQ ID NO: 3656909 - DNA, 19 bp, Homo sapiens
caagctgtgctgggaagcc

SEQ ID NO: 3656910 - DNA, 22 bp, Homo sapiens
caagctgtgctgggaagcccgg

SEQ ID NO: 3656911 - DNA, 15 bp, Homo sapiens
caagcttagtcctgg

SEQ ID NO: 3656912 - DNA, 23 bp, Homo sapiens
caagcttagtcctgggagaggac

SEQ ID NO: 3656913 - DNA, 21 bp, Homo sapiens
caaggaccaggactccctcct

SEQ ID NO: 3656914 - DNA, 14 bp, Homo sapiens
caaggacttcctgt

SEQ ID NO: 3656915 - DNA, 22 bp, Homo sapiens
caaggacttcctgtccagctcc

SEQ ID NO: 3656916 - DNA, 20 bp, Homo sapiens
caaggatagatgctggccca

SEQ ID NO: 3656917 - DNA, 18 bp, Homo sapiens
caaggccagagtggcctg

SEQ ID NO: 3656918 - DNA, 19 bp, Homo sapiens
caaggccagagtggcctgg

SEQ ID NO: 3656919 - DNA, 21 bp, Homo sapiens
caaggccagagtggcctggcc

SEQ ID NO: 3656920 - DNA, 14 bp, Homo sapiens
caaggccccttcca

SEQ ID NO: 3656921 - DNA, 18 bp, Homo sapiens
caaggccccttccacggg

SEQ ID NO: 3656922 - DNA, 16 bp, Homo sapiens
caaggcggtgcttgat

SEQ ID NO: 3656923 - DNA, 13 bp, Homo sapiens
caaggctggcagg

SEQ ID NO: 3656924 - DNA, 16 bp, Homo sapiens
caagggaacctgtgtc

SEQ ID NO: 3656925 - DNA, 14 bp, Homo sapiens
caagggatttgagg

SEQ ID NO: 3656926 - DNA, 18 bp, Homo sapiens
caaggggaatcagaactc

SEQ ID NO: 3656927 - DNA, 15 bp, Homo sapiens
caaggtgatttcaga

SEQ ID NO: 3656928 - DNA, 21 bp, Homo sapiens
caaggtgatttcagactgcag

SEQ ID NO: 3656929 - DNA, 19 bp, Homo sapiens
caaggtgcggggagaagaa

SEQ ID NO: 3656930 - DNA, 15 bp, Homo sapiens
caaggtgctgatgtc

SEQ ID NO: 3656931 - DNA, 12 bp, Homo sapiens
caaggtgggagg

SEQ ID NO: 3656932 - DNA, 15 bp, Homo sapiens
caaggtgtggaggct

SEQ ID NO: 3656933 - DNA, 18 bp, Homo sapiens
caaggtgtggaggctcct

SEQ ID NO: 3656934 - DNA, 13 bp, Homo sapiens
caagtcaagtgaa

SEQ ID NO: 3656935 - DNA, 14 bp, Homo sapiens
caagtcacaaagag

SEQ ID NO: 3656936 - DNA, 14 bp, Homo sapiens
caagtgagaccctg

SEQ ID NO: 3656937 - DNA, 12 bp, Homo sapiens
caagtgccaaac

SEQ ID NO: 3656938 - DNA, 15 bp, Homo sapiens
caagtgccaaacaga

SEQ ID NO: 3656939 - DNA, 16 bp, Homo sapiens
caagtgccagggctgg

SEQ ID NO: 3656940 - DNA, 18 bp, Homo sapiens
caagtgccgcaaattgta

SEQ ID NO: 3656941 - DNA, 21 bp, Homo sapiens
caagtgcctagactgttactt

SEQ ID NO: 3656942 - DNA, 18 bp, Homo sapiens
caagtgctgaacagtgga

SEQ ID NO: 3656943 - DNA, 14 bp, Homo sapiens
caagtttatatata

SEQ ID NO: 3656944 - DNA, 15 bp, Homo sapiens
caagtttatatatat

SEQ ID NO: 3656945 - DNA, 20 bp, Homo sapiens
caataaaatttttttaaagt

SEQ ID NO: 3656946 - DNA, 21 bp, Homo sapiens
caataagtacttatctttatt

SEQ ID NO: 3656947 - DNA, 17 bp, Homo sapiens
caataatatttcaagtg

SEQ ID NO: 3656948 - DNA, 18 bp, Homo sapiens
caataatatttcaagtgc

SEQ ID NO: 3656949 - DNA, 16 bp, Homo sapiens
caatagatctccagcg

SEQ ID NO: 3656950 - DNA, 22 bp, Homo sapiens
caatatagaaaaataaaaatct

SEQ ID NO: 3656951 - DNA, 17 bp, Homo sapiens
caatattcgctgtgtca

SEQ ID NO: 3656952 - DNA, 16 bp, Homo sapiens
caatattttccatgaa

SEQ ID NO: 3656953 - DNA, 20 bp, Homo sapiens
caatattttccatgaaaatg

SEQ ID NO: 3656954 - DNA, 15 bp, Homo sapiens
caatcacagtctcag

SEQ ID NO: 3656955 - DNA, 21 bp, Homo sapiens
caatcccagttcttcctgcaa

SEQ ID NO: 3656956 - DNA, 22 bp, Homo sapiens
caatcccagttcttcctgcaac

SEQ ID NO: 3656957 - DNA, 19 bp, Homo sapiens
caatctaacaataatattt

SEQ ID NO: 3656958 - DNA, 20 bp, Homo sapiens
caatctagtaatgtctaagt

SEQ ID NO: 3656959 - DNA, 17 bp, Homo sapiens
caatctggaagaaaaaa

SEQ ID NO: 3656960 - DNA, 20 bp, Homo sapiens
caatctggcttagtgccacc

SEQ ID NO: 3656961 - DNA, 12 bp, Homo sapiens
caatctgtgggc

SEQ ID NO: 3656962 - DNA, 21 bp, Homo sapiens
caatgaagccagctcacagtg

SEQ ID NO: 3656963 - DNA, 19 bp, Homo sapiens
caatgatcctgtattcaga

SEQ ID NO: 3656964 - DNA, 18 bp, Homo sapiens
caatgcttctagagtttt

SEQ ID NO: 3656965 - DNA, 21 bp, Homo sapiens
caatgctttgcccctgagaca

SEQ ID NO: 3656966 - DNA, 18 bp, Homo sapiens
caatggcttactccagga

SEQ ID NO: 3656967 - DNA, 17 bp, Homo sapiens
caatggggtccacttcc

SEQ ID NO: 3656968 - DNA, 13 bp, Homo sapiens
caatggtttgcaa

SEQ ID NO: 3656969 - DNA, 18 bp, Homo sapiens
caatggtttgcaaggaag

SEQ ID NO: 3656970 - DNA, 19 bp, Homo sapiens
caatggtttgcaaggaagc

SEQ ID NO: 3656971 - DNA, 16 bp, Homo sapiens
caatggtttttaaatt

SEQ ID NO: 3656972 - DNA, 17 bp, Homo sapiens
caatggtttttaaattt

SEQ ID NO: 3656973 - DNA, 22 bp, Homo sapiens
caatgtgaaaagaaaaatgagc

SEQ ID NO: 3656974 - DNA, 16 bp, Homo sapiens
caattatagtttgaca

SEQ ID NO: 3656975 - DNA, 17 bp, Homo sapiens
caattcttacaaacatg

SEQ ID NO: 3656976 - DNA, 20 bp, Homo sapiens
caattgaaggatcatctgaa

SEQ ID NO: 3656977 - DNA, 12 bp, Homo sapiens
caatttaaagca

SEQ ID NO: 3656978 - DNA, 13 bp, Homo sapiens
caatttaaagcaa

SEQ ID NO: 3656979 - DNA, 14 bp, Homo sapiens
caatttcagactcc

SEQ ID NO: 3656980 - DNA, 12 bp, Homo sapiens
caatttcctggc

SEQ ID NO: 3656981 - DNA, 13 bp, Homo sapiens
cacaaaacagcct

SEQ ID NO: 3656982 - DNA, 12 bp, Homo sapiens
cacaaagcccaa

SEQ ID NO: 3656983 - DNA, 14 bp, Homo sapiens
cacaaagcccaagg

SEQ ID NO: 3656984 - DNA, 15 bp, Homo sapiens
cacaagcctgagaac

SEQ ID NO: 3656985 - DNA, 22 bp, Homo sapiens
cacaaggacttcctgtccagct

SEQ ID NO: 3656986 - DNA, 14 bp, Homo sapiens
cacaagtggtggta

SEQ ID NO: 3656987 - DNA, 21 bp, Homo sapiens
cacaagtggtggtaaccctgg

SEQ ID NO: 3656988 - DNA, 21 bp, Homo sapiens
cacaatattcaatcaaaattt

SEQ ID NO: 3656989 - DNA, 16 bp, Homo sapiens
cacacaaaggcatgct

SEQ ID NO: 3656990 - DNA, 21 bp, Homo sapiens
cacacaaaggcatgctggagt

SEQ ID NO: 3656991 - DNA, 13 bp, Homo sapiens
cacacacaaacct

SEQ ID NO: 3656992 - DNA, 9 bp, Homo sapiens
cacacacac

SEQ ID NO: 3656993 - DNA, 14 bp, Homo sapiens
cacacacacacaaa

SEQ ID NO: 3656994 - DNA, 13 bp, Homo sapiens
cacacacacacac

SEQ ID NO: 3656995 - DNA, 13 bp, Homo sapiens
cacacacacccgc

SEQ ID NO: 3656996 - DNA, 18 bp, Homo sapiens
cacacagatacacacaca

SEQ ID NO: 3656997 - DNA, 19 bp, Homo sapiens
cacacaggggccacccggg

SEQ ID NO: 3656998 - DNA, 19 bp, Homo sapiens
cacacccaaagctgagcct

SEQ ID NO: 3656999 - DNA, 15 bp, Homo sapiens
cacaccgccatcctc

SEQ ID NO: 3657000 - DNA, 21 bp, Homo sapiens
cacaccgccatcctctgcctc

SEQ ID NO: 3657001 - DNA, 18 bp, Homo sapiens
cacacctcagttcccttg

SEQ ID NO: 3657002 - DNA, 22 bp, Homo sapiens
cacacctgtaatcccagcactt

SEQ ID NO: 3657003 - DNA, 16 bp, Homo sapiens
cacacctgtagcactt

SEQ ID NO: 3657004 - DNA, 21 bp, Homo sapiens
cacactaacctgggttccctt

SEQ ID NO: 3657005 - DNA, 14 bp, Homo sapiens
cacactccatcagc

SEQ ID NO: 3657006 - DNA, 22 bp, Homo sapiens
cacacttctgtgagacccccac

SEQ ID NO: 3657007 - DNA, 23 bp, Homo sapiens
cacagaaaagaaagttcatgctt

SEQ ID NO: 3657008 - DNA, 18 bp, Homo sapiens
cacagacattctgccagg

SEQ ID NO: 3657009 - DNA, 22 bp, Homo sapiens
cacagagctttggtctgtgtgt

SEQ ID NO: 3657010 - DNA, 20 bp, Homo sapiens
cacagcggaggtgtggagcc

SEQ ID NO: 3657011 - DNA, 20 bp, Homo sapiens
cacagctacttggtttgtgt

SEQ ID NO: 3657012 - DNA, 14 bp, Homo sapiens
cacagcttcagcca

SEQ ID NO: 3657013 - DNA, 14 bp, Homo sapiens
cacagcttcccctc

SEQ ID NO: 3657014 - DNA, 23 bp, Homo sapiens
cacagcttcccctctctcctcct

SEQ ID NO: 3657015 - DNA, 18 bp, Homo sapiens
cacagctttgaggaacat

SEQ ID NO: 3657016 - DNA, 15 bp, Homo sapiens
cacaggaggcaggca

SEQ ID NO: 3657017 - DNA, 13 bp, Homo sapiens
cacaggccctccc

SEQ ID NO: 3657018 - DNA, 15 bp, Homo sapiens
cacagggtgttggaa

SEQ ID NO: 3657019 - DNA, 18 bp, Homo sapiens
cacaggtctttcctaagg

SEQ ID NO: 3657020 - DNA, 20 bp, Homo sapiens
cacaggtctttcctaaggct

SEQ ID NO: 3657021 - DNA, 18 bp, Homo sapiens
cacagtgggagccagggc

SEQ ID NO: 3657022 - DNA, 19 bp, Homo sapiens
cacagtgggagccagggct

SEQ ID NO: 3657023 - DNA, 23 bp, Homo sapiens
cacagttctttgggccagacatg

SEQ ID NO: 3657024 - DNA, 13 bp, Homo sapiens
cacatatgagggg

SEQ ID NO: 3657025 - DNA, 19 bp, Homo sapiens
cacatccgcgtgtgcctgt

SEQ ID NO: 3657026 - DNA, 14 bp, Homo sapiens
cacatcctccgtcc

SEQ ID NO: 3657027 - DNA, 13 bp, Homo sapiens
cacatctaagcct

SEQ ID NO: 3657028 - DNA, 22 bp, Homo sapiens
cacatctaagcctgaaggggcg

SEQ ID NO: 3657029 - DNA, 16 bp, Homo sapiens
cacatgtccagcacct

SEQ ID NO: 3657030 - DNA, 12 bp, Homo sapiens
cacatgtttcct

SEQ ID NO: 3657031 - DNA, 15 bp, Homo sapiens
cacatgtttcctcta

SEQ ID NO: 3657032 - DNA, 18 bp, Homo sapiens
cacattgtttgctgctat

SEQ ID NO: 3657033 - DNA, 12 bp, Homo sapiens
cacatttcactt

SEQ ID NO: 3657034 - DNA, 12 bp, Homo sapiens
caccaaaaacaa

SEQ ID NO: 3657035 - DNA, 13 bp, Homo sapiens
caccaagccaagg

SEQ ID NO: 3657036 - DNA, 21 bp, Homo sapiens
caccaattggataaagcagct

SEQ ID NO: 3657037 - DNA, 13 bp, Homo sapiens
caccacagccagc

SEQ ID NO: 3657038 - DNA, 17 bp, Homo sapiens
caccacagccagcacct

SEQ ID NO: 3657039 - DNA, 12 bp, Homo sapiens
caccactgcagc

SEQ ID NO: 3657040 - DNA, 13 bp, Homo sapiens
caccactggaagc

SEQ ID NO: 3657041 - DNA, 24 bp, Homo sapiens
caccactggaagcaggatggagct

SEQ ID NO: 3657042 - DNA, 12 bp, Homo sapiens
caccagcagcct

SEQ ID NO: 3657043 - DNA, 15 bp, Homo sapiens
caccagcagcctgga

SEQ ID NO: 3657044 - DNA, 18 bp, Homo sapiens
caccagccacctcatccc

SEQ ID NO: 3657045 - DNA, 22 bp, Homo sapiens
caccaggatagagactggaaca

SEQ ID NO: 3657046 - DNA, 14 bp, Homo sapiens
caccaggctgctca

SEQ ID NO: 3657047 - DNA, 21 bp, Homo sapiens
caccaggctgctcagggctgg

SEQ ID NO: 3657048 - DNA, 14 bp, Homo sapiens
caccatctttctga

SEQ ID NO: 3657049 - DNA, 20 bp, Homo sapiens
caccatgttggccaggctgg

SEQ ID NO: 3657050 - DNA, 21 bp, Homo sapiens
cacccaaaccggcaggtgcga

SEQ ID NO: 3657051 - DNA, 18 bp, Homo sapiens
cacccaaagctgagcctg

SEQ ID NO: 3657052 - DNA, 14 bp, Homo sapiens
cacccaagagggct

SEQ ID NO: 3657053 - DNA, 23 bp, Homo sapiens
cacccaatcccagttcttcctgc

SEQ ID NO: 3657054 - DNA, 23 bp, Homo sapiens
cacccacctccctgcctccagga

SEQ ID NO: 3657055 - DNA, 22 bp, Homo sapiens
cacccacctttgccacaaagct

SEQ ID NO: 3657056 - DNA, 14 bp, Homo sapiens
cacccagagggagt

SEQ ID NO: 3657057 - DNA, 22 bp, Homo sapiens
cacccatgcaagcagaggacca

SEQ ID NO: 3657058 - DNA, 12 bp, Homo sapiens
caccccacactt

SEQ ID NO: 3657059 - DNA, 15 bp, Homo sapiens
caccccatgccaaag

SEQ ID NO: 3657060 - DNA, 17 bp, Homo sapiens
caccccatgccaaagct

SEQ ID NO: 3657061 - DNA, 12 bp, Homo sapiens
cacccccatggc

SEQ ID NO: 3657062 - DNA, 16 bp, Homo sapiens
cacccccttctctgct

SEQ ID NO: 3657063 - DNA, 20 bp, Homo sapiens
cacccctcaacacctctgca

SEQ ID NO: 3657064 - DNA, 15 bp, Homo sapiens
caccccttcctcagc

SEQ ID NO: 3657065 - DNA, 19 bp, Homo sapiens
caccccttcctcagcctgg

SEQ ID NO: 3657066 - DNA, 15 bp, Homo sapiens
cacccggctgcagag

SEQ ID NO: 3657067 - DNA, 21 bp, Homo sapiens
cacccggctgcagaggccaga

SEQ ID NO: 3657068 - DNA, 13 bp, Homo sapiens
caccctgcctgcc

SEQ ID NO: 3657069 - DNA, 12 bp, Homo sapiens
caccctgcctta

SEQ ID NO: 3657070 - DNA, 20 bp, Homo sapiens
caccctgctgctggtgcaca

SEQ ID NO: 3657071 - DNA, 21 bp, Homo sapiens
caccctgggccctgggctgga

SEQ ID NO: 3657072 - DNA, 23 bp, Homo sapiens
caccctgggccctgggctggaat

SEQ ID NO: 3657073 - DNA, 14 bp, Homo sapiens
caccctgtcttctt

SEQ ID NO: 3657074 - DNA, 22 bp, Homo sapiens
caccctttgctgtgaggctgtc

SEQ ID NO: 3657075 - DNA, 22 bp, Homo sapiens
caccggatcctgggtggtctgc

SEQ ID NO: 3657076 - DNA, 20 bp, Homo sapiens
cacctaatccaggcagatcc

SEQ ID NO: 3657077 - DNA, 17 bp, Homo sapiens
cacctcagttcccttgg

SEQ ID NO: 3657078 - DNA, 19 bp, Homo sapiens
cacctcagttcccttggcc

SEQ ID NO: 3657079 - DNA, 14 bp, Homo sapiens
cacctccctgcctc

SEQ ID NO: 3657080 - DNA, 17 bp, Homo sapiens
cacctccctgcctccag

SEQ ID NO: 3657081 - DNA, 15 bp, Homo sapiens
cacctcctgctgggc

SEQ ID NO: 3657082 - DNA, 16 bp, Homo sapiens
cacctcttggctttgt

SEQ ID NO: 3657083 - DNA, 16 bp, Homo sapiens
cacctgaccaggggcc

SEQ ID NO: 3657084 - DNA, 23 bp, Homo sapiens
cacctgaccaggggccctacctg

SEQ ID NO: 3657085 - DNA, 23 bp, Homo sapiens
cacctggcatcgcaccattctga

SEQ ID NO: 3657086 - DNA, 10 bp, Homo sapiens
cacctggggt

SEQ ID NO: 3657087 - DNA, 20 bp, Homo sapiens
cacctggggtgtgggaggcc

SEQ ID NO: 3657088 - DNA, 16 bp, Homo sapiens
cacctgtaatcccagc

SEQ ID NO: 3657089 - DNA, 14 bp, Homo sapiens
caccttaggcaggg

SEQ ID NO: 3657090 - DNA, 17 bp, Homo sapiens
caccttaggcagggaag

SEQ ID NO: 3657091 - DNA, 18 bp, Homo sapiens
caccttaggcagggaagt

SEQ ID NO: 3657092 - DNA, 22 bp, Homo sapiens
caccttggacatcctcctccca

SEQ ID NO: 3657093 - DNA, 12 bp, Homo sapiens
cacgagccacct

SEQ ID NO: 3657094 - DNA, 13 bp, Homo sapiens
cacgcaagtgcca

SEQ ID NO: 3657095 - DNA, 15 bp, Homo sapiens
cacgcacctcccatc

SEQ ID NO: 3657096 - DNA, 15 bp, Homo sapiens
cacgcccgtcctgcc

SEQ ID NO: 3657097 - DNA, 15 bp, Homo sapiens
cacgcgggggccttg

SEQ ID NO: 3657098 - DNA, 14 bp, Homo sapiens
cacgcgtatttaca

SEQ ID NO: 3657099 - DNA, 17 bp, Homo sapiens
cacgcgtgccgtggcac

SEQ ID NO: 3657100 - DNA, 22 bp, Homo sapiens
cacggaagagccttgcggaagg

SEQ ID NO: 3657101 - DNA, 23 bp, Homo sapiens
cacggagtcgtggggtgtgctgg

SEQ ID NO: 3657102 - DNA, 20 bp, Homo sapiens
cacggcaggacaacgaggaa

SEQ ID NO: 3657103 - DNA, 21 bp, Homo sapiens
cacgggggctgtggctctggg

SEQ ID NO: 3657104 - DNA, 12 bp, Homo sapiens
cacgtggcctct

SEQ ID NO: 3657105 - DNA, 17 bp, Homo sapiens
cacgtggcctcttgagc

SEQ ID NO: 3657106 - DNA, 18 bp, Homo sapiens
cacgtggcctcttgagca

SEQ ID NO: 3657107 - DNA, 14 bp, Homo sapiens
cactaagcagagga

SEQ ID NO: 3657108 - DNA, 15 bp, Homo sapiens
cactaatacaccagg

SEQ ID NO: 3657109 - DNA, 18 bp, Homo sapiens
cactaatttttgtattat

SEQ ID NO: 3657110 - DNA, 21 bp, Homo sapiens
cactacatgcagcccatgccc

SEQ ID NO: 3657111 - DNA, 23 bp, Homo sapiens
cactacatgcagcccatgcccac

SEQ ID NO: 3657112 - DNA, 16 bp, Homo sapiens
cactagacaagccaga

SEQ ID NO: 3657113 - DNA, 17 bp, Homo sapiens
cactagacaagccagaa

SEQ ID NO: 3657114 - DNA, 21 bp, Homo sapiens
cactagacaagccagaacttg

SEQ ID NO: 3657115 - DNA, 22 bp, Homo sapiens
cactaggtaggcttctacctgc

SEQ ID NO: 3657116 - DNA, 19 bp, Homo sapiens
cactcaaaagctgggcagg

SEQ ID NO: 3657117 - DNA, 11 bp, Homo sapiens
cactcaaggcg

SEQ ID NO: 3657118 - DNA, 16 bp, Homo sapiens
cactcactaggccccc

SEQ ID NO: 3657119 - DNA, 21 bp, Homo sapiens
cactcgggtttctctgtggct

SEQ ID NO: 3657120 - DNA, 15 bp, Homo sapiens
cactctccccacact

SEQ ID NO: 3657121 - DNA, 13 bp, Homo sapiens
cactctgcttctc

SEQ ID NO: 3657122 - DNA, 21 bp, Homo sapiens
cactctgcttctctgacttct

SEQ ID NO: 3657123 - DNA, 15 bp, Homo sapiens
cactctgtggccagc

SEQ ID NO: 3657124 - DNA, 16 bp, Homo sapiens
cactctgtggccagcc

SEQ ID NO: 3657125 - DNA, 21 bp, Homo sapiens
cactctgtggccagcctggca

SEQ ID NO: 3657126 - DNA, 13 bp, Homo sapiens
cactgaccagaac

SEQ ID NO: 3657127 - DNA, 16 bp, Homo sapiens
cactgaccatccactc

SEQ ID NO: 3657128 - DNA, 17 bp, Homo sapiens
cactgactagagtgatg

SEQ ID NO: 3657129 - DNA, 17 bp, Homo sapiens
cactgaggcagggaagt

SEQ ID NO: 3657130 - DNA, 18 bp, Homo sapiens
cactgaggcagggaagtc

SEQ ID NO: 3657131 - DNA, 15 bp, Homo sapiens
cactgagttttccat

SEQ ID NO: 3657132 - DNA, 21 bp, Homo sapiens
cactgcaaaccgccacctccc

SEQ ID NO: 3657133 - DNA, 12 bp, Homo sapiens
cactgcactcca

SEQ ID NO: 3657134 - DNA, 15 bp, Homo sapiens
gatgtcaatttctgt

SEQ ID NO: 3657135 - DNA, 22 bp, Homo sapiens
gatgtgtttacatttactgaaa

SEQ ID NO: 3657136 - DNA, 18 bp, Homo sapiens
gatgtgtttgctttctga

SEQ ID NO: 3657137 - DNA, 21 bp, Homo sapiens
gatgttacaagtttatatata

SEQ ID NO: 3657138 - DNA, 19 bp, Homo sapiens
gatgttcagcactgtccct

SEQ ID NO: 3657139 - DNA, 16 bp, Homo sapiens
gatgtttgtggcctca

SEQ ID NO: 3657140 - DNA, 18 bp, Homo sapiens
gattaaccacttcagctg

SEQ ID NO: 3657141 - DNA, 14 bp, Homo sapiens
gattaacctctgca

SEQ ID NO: 3657142 - DNA, 17 bp, Homo sapiens
gattaacctctgcacta

SEQ ID NO: 3657143 - DNA, 18 bp, Homo sapiens
gattaatatggggatgca

SEQ ID NO: 3657144 - DNA, 14 bp, Homo sapiens
gattaggtcttgct

SEQ ID NO: 3657145 - DNA, 20 bp, Homo sapiens
gattaggtcttgctggaaga

SEQ ID NO: 3657146 - DNA, 15 bp, Homo sapiens
gattcaaaatattta

SEQ ID NO: 3657147 - DNA, 21 bp, Homo sapiens
gattcaccctgtccaaactgc

SEQ ID NO: 3657148 - DNA, 13 bp, Homo sapiens
gattcaggctgct

SEQ ID NO: 3657149 - DNA, 17 bp, Homo sapiens
gattccccatctcaggc

SEQ ID NO: 3657150 - DNA, 15 bp, Homo sapiens
gattccgcaccctgc

SEQ ID NO: 3657151 - DNA, 18 bp, Homo sapiens
gattccgcaccctgccta

SEQ ID NO: 3657152 - DNA, 19 bp, Homo sapiens
gattctgataatgctcact

SEQ ID NO: 3657153 - DNA, 15 bp, Homo sapiens
gattgcacgtggcct

SEQ ID NO: 3657154 - DNA, 16 bp, Homo sapiens
gattgcacgtggcctc

SEQ ID NO: 3657155 - DNA, 17 bp, Homo sapiens
gattgcacgtggcctct

SEQ ID NO: 3657156 - DNA, 20 bp, Homo sapiens
gattgcacgtggcctcttga

SEQ ID NO: 3657157 - DNA, 23 bp, Homo sapiens
gattgcacgtggcctcttgagca

SEQ ID NO: 3657158 - DNA, 22 bp, Homo sapiens
gattgcgtggaattgtgctgag

SEQ ID NO: 3657159 - DNA, 18 bp, Homo sapiens
gattgggcggggcttctc

SEQ ID NO: 3657160 - DNA, 20 bp, Homo sapiens
gattgggcggggcttctctt

SEQ ID NO: 3657161 - DNA, 22 bp, Homo sapiens
gattttaatagggaatatatct

SEQ ID NO: 3657162 - DNA, 22 bp, Homo sapiens
gattttcacagctttgaggaac

SEQ ID NO: 3657163 - DNA, 12 bp, Homo sapiens
gcaaaaaaatta

SEQ ID NO: 3657164 - DNA, 11 bp, Homo sapiens
gcaaaaaatac

SEQ ID NO: 3657165 - DNA, 12 bp, Homo sapiens
gcaaaaaatact

SEQ ID NO: 3657166 - DNA, 14 bp, Homo sapiens
gcaaaaaggcagga

SEQ ID NO: 3657167 - DNA, 15 bp, Homo sapiens
gcaaaagatgcttct

SEQ ID NO: 3657168 - DNA, 16 bp, Homo sapiens
gcaaaagatgcttctc

SEQ ID NO: 3657169 - DNA, 21 bp, Homo sapiens
gcaaaaggatctttgtggcca

SEQ ID NO: 3657170 - DNA, 19 bp, Homo sapiens
gcaaaatcaagcaagcctc

SEQ ID NO: 3657171 - DNA, 19 bp, Homo sapiens
gcaaagatctgtcctcagc

SEQ ID NO: 3657172 - DNA, 21 bp, Homo sapiens
gcaaagatctgtcctcagcct

SEQ ID NO: 3657173 - DNA, 21 bp, Homo sapiens
gcaaagcaaaaggctgagaag

SEQ ID NO: 3657174 - DNA, 15 bp, Homo sapiens
gcaaaggaaggtgga

SEQ ID NO: 3657175 - DNA, 20 bp, Homo sapiens
gcaaaggaaggtggatggcc

SEQ ID NO: 3657176 - DNA, 18 bp, Homo sapiens
gcaaagtattgtaaatta

SEQ ID NO: 3657177 - DNA, 12 bp, Homo sapiens
gcaacagatctg

SEQ ID NO: 3657178 - DNA, 18 bp, Homo sapiens
gcaacagatctggaacct

SEQ ID NO: 3657179 - DNA, 22 bp, Homo sapiens
gcaacagatctggaacctcagc

SEQ ID NO: 3657180 - DNA, 13 bp, Homo sapiens
gcaacatcttttt

SEQ ID NO: 3657181 - DNA, 16 bp, Homo sapiens
gcaacatggatatgta

SEQ ID NO: 3657182 - DNA, 18 bp, Homo sapiens
gcaaccactctgtggcca

SEQ ID NO: 3657183 - DNA, 19 bp, Homo sapiens
gcaaccactctgtggccag

SEQ ID NO: 3657184 - DNA, 22 bp, Homo sapiens
gcaaccactctgtggccagcct

SEQ ID NO: 3657185 - DNA, 21 bp, Homo sapiens
gcaacccttaccccttagcct

SEQ ID NO: 3657186 - DNA, 14 bp, Homo sapiens
gcaacctacccagc

SEQ ID NO: 3657187 - DNA, 22 bp, Homo sapiens
gcaactcaaggactttgcagcc

SEQ ID NO: 3657188 - DNA, 15 bp, Homo sapiens
gcaagaaggaaagat

SEQ ID NO: 3657189 - DNA, 15 bp, Homo sapiens
gcaagccctgttgac

SEQ ID NO: 3657190 - DNA, 22 bp, Homo sapiens
gcaagctgccgaaccaaaagaa

SEQ ID NO: 3657191 - DNA, 15 bp, Homo sapiens
gcaaggccccttcca

SEQ ID NO: 3657192 - DNA, 14 bp, Homo sapiens
gcaaggtgtggagg

SEQ ID NO: 3657193 - DNA, 17 bp, Homo sapiens
gcaaggtgtggaggctc

SEQ ID NO: 3657194 - DNA, 22 bp, Homo sapiens
gcaaggtttaggctggtggccc

SEQ ID NO: 3657195 - DNA, 12 bp, Homo sapiens
gcaagtgaggcc

SEQ ID NO: 3657196 - DNA, 17 bp, Homo sapiens
gcaagtgttcactgctc

SEQ ID NO: 3657197 - DNA, 16 bp, Homo sapiens
gcaataaatctgaccc

SEQ ID NO: 3657198 - DNA, 21 bp, Homo sapiens
gcaataaatctgacccagtgc

SEQ ID NO: 3657199 - DNA, 19 bp, Homo sapiens
gcaattctctttcttttac

SEQ ID NO: 3657200 - DNA, 14 bp, Homo sapiens
gcaatttcctggcc

SEQ ID NO: 3657201 - DNA, 18 bp, Homo sapiens
gcaatttcctggccctcc

SEQ ID NO: 3657202 - DNA, 20 bp, Homo sapiens
gcacaaaatgatggcagtgg

SEQ ID NO: 3657203 - DNA, 19 bp, Homo sapiens
gcacaactttaagaggaca

SEQ ID NO: 3657204 - DNA, 24 bp, Homo sapiens
gcacaccgccatcctctgcctcaa

SEQ ID NO: 3657205 - DNA, 23 bp, Homo sapiens
gcacactcagtgggctgtttctg

SEQ ID NO: 3657206 - DNA, 22 bp, Homo sapiens
gcacactgagtttgaacacaga

SEQ ID NO: 3657207 - DNA, 12 bp, Homo sapiens
gcacagaatatg

SEQ ID NO: 3657208 - DNA, 23 bp, Homo sapiens
gcacagctgtagtggggttctag

SEQ ID NO: 3657209 - DNA, 14 bp, Homo sapiens
gcacagcttgacct

SEQ ID NO: 3657210 - DNA, 20 bp, Homo sapiens
gcacagcttgacctgaggct

SEQ ID NO: 3657211 - DNA, 21 bp, Homo sapiens
gcacagcttgacctgaggctg

SEQ ID NO: 3657212 - DNA, 16 bp, Homo sapiens
gcacaggaggcaggca

SEQ ID NO: 3657213 - DNA, 23 bp, Homo sapiens
gcacagggtctgctctttctctg

SEQ ID NO: 3657214 - DNA, 19 bp, Homo sapiens
gcacatgcctgtagtccca

SEQ ID NO: 3657215 - DNA, 12 bp, Homo sapiens
gcacatgtttcc

SEQ ID NO: 3657216 - DNA, 19 bp, Homo sapiens
gcaccactgcactccagcc

SEQ ID NO: 3657217 - DNA, 20 bp, Homo sapiens
gcaccactgcactccagcct

SEQ ID NO: 3657218 - DNA, 22 bp, Homo sapiens
gcaccactgcactccagcctgg

SEQ ID NO: 3657219 - DNA, 16 bp, Homo sapiens
gcaccagacacccagg

SEQ ID NO: 3657220 - DNA, 18 bp, Homo sapiens
gcaccagacacccaggac

SEQ ID NO: 3657221 - DNA, 18 bp, Homo sapiens
gcaccagcaattctcttt

SEQ ID NO: 3657222 - DNA, 16 bp, Homo sapiens
gcaccaggggtttctc

SEQ ID NO: 3657223 - DNA, 19 bp, Homo sapiens
gcaccaggggtttctcgca

SEQ ID NO: 3657224 - DNA, 12 bp, Homo sapiens
gcaccataactt

SEQ ID NO: 3657225 - DNA, 23 bp, Homo sapiens
gcaccattctgactcggtttctc

SEQ ID NO: 3657226 - DNA, 20 bp, Homo sapiens
gcaccccaaagctttcctgc

SEQ ID NO: 3657227 - DNA, 14 bp, Homo sapiens
gcaccccgctgcgg

SEQ ID NO: 3657228 - DNA, 16 bp, Homo sapiens
gcaccctcaggcaggt

SEQ ID NO: 3657229 - DNA, 19 bp, Homo sapiens
gcaccctgcctacgccagg

SEQ ID NO: 3657230 - DNA, 20 bp, Homo sapiens
gcaccctgcctacgccagga

SEQ ID NO: 3657231 - DNA, 14 bp, Homo sapiens
gcacctcccatcct

SEQ ID NO: 3657232 - DNA, 13 bp, Homo sapiens
gcacctcttggct

SEQ ID NO: 3657233 - DNA, 14 bp, Homo sapiens
gcacctcttggctt

SEQ ID NO: 3657234 - DNA, 15 bp, Homo sapiens
gcacctcttggcttt

SEQ ID NO: 3657235 - DNA, 13 bp, Homo sapiens
gcacggctctggg

SEQ ID NO: 3657236 - DNA, 16 bp, Homo sapiens
gcacggctctggggta

SEQ ID NO: 3657237 - DNA, 15 bp, Homo sapiens
gcacgtggagagctg

SEQ ID NO: 3657238 - DNA, 13 bp, Homo sapiens
gcacgtggcctct

SEQ ID NO: 3657239 - DNA, 14 bp, Homo sapiens
gcacgtggcctctt

SEQ ID NO: 3657240 - DNA, 19 bp, Homo sapiens
gcacgtggcctcttgagca

SEQ ID NO: 3657241 - DNA, 17 bp, Homo sapiens
gcactacaccttgcctt

SEQ ID NO: 3657242 - DNA, 18 bp, Homo sapiens
gcactactgacatgtggg

SEQ ID NO: 3657243 - DNA, 18 bp, Homo sapiens
gcactaggtaggcttcta

SEQ ID NO: 3657244 - DNA, 18 bp, Homo sapiens
gcactccatccagctaca

SEQ ID NO: 3657245 - DNA, 11 bp, Homo sapiens
gcactgaaaca

SEQ ID NO: 3657246 - DNA, 23 bp, Homo sapiens
gcactgtcccttgcctcaatgcc

SEQ ID NO: 3657247 - DNA, 14 bp, Homo sapiens
gcactgtgaaggac

SEQ ID NO: 3657248 - DNA, 16 bp, Homo sapiens
gcactgtgaaggaccc

SEQ ID NO: 3657249 - DNA, 18 bp, Homo sapiens
gcactgtgaaggaccctt

SEQ ID NO: 3657250 - DNA, 14 bp, Homo sapiens
gcctcatgtggctg

SEQ ID NO: 3657251 - DNA, 16 bp, Homo sapiens
gcctcatgtggctgga

SEQ ID NO: 3657252 - DNA, 12 bp, Homo sapiens
gcctccagcctg

SEQ ID NO: 3657253 - DNA, 18 bp, Homo sapiens
gcctccagcctggtggcc

SEQ ID NO: 3657254 - DNA, 19 bp, Homo sapiens
gcctccaggaaccacacca

SEQ ID NO: 3657255 - DNA, 17 bp, Homo sapiens
gcctccaggtgcagagg

SEQ ID NO: 3657256 - DNA, 14 bp, Homo sapiens
gcctcccacgactg

SEQ ID NO: 3657257 - DNA, 21 bp, Homo sapiens
gcctcccacgactgcccggca

SEQ ID NO: 3657258 - DNA, 21 bp, Homo sapiens
gcctcccataattgctttgcc

SEQ ID NO: 3657259 - DNA, 16 bp, Homo sapiens
gcctccccacctccag

SEQ ID NO: 3657260 - DNA, 17 bp, Homo sapiens
gcctccccacctccagg

SEQ ID NO: 3657261 - DNA, 18 bp, Homo sapiens
gcctccccacctccaggc

SEQ ID NO: 3657262 - DNA, 16 bp, Homo sapiens
gcctccctctctcttc

SEQ ID NO: 3657263 - DNA, 11 bp, Homo sapiens
gcctccctgaa

SEQ ID NO: 3657264 - DNA, 22 bp, Homo sapiens
gcctccctgaaaatgtttttct

SEQ ID NO: 3657265 - DNA, 13 bp, Homo sapiens
gcctccctgaagc

SEQ ID NO: 3657266 - DNA, 17 bp, Homo sapiens
gcctccttaggagtggg

SEQ ID NO: 3657267 - DNA, 14 bp, Homo sapiens
gcctcgcatcctat

SEQ ID NO: 3657268 - DNA, 22 bp, Homo sapiens
gcctctccccaggtccagctct

SEQ ID NO: 3657269 - DNA, 23 bp, Homo sapiens
gcctctccccaggtccagctctg

SEQ ID NO: 3657270 - DNA, 13 bp, Homo sapiens
gcctctggctaga

SEQ ID NO: 3657271 - DNA, 19 bp, Homo sapiens
gcctctgtcttctggactg

SEQ ID NO: 3657272 - DNA, 14 bp, Homo sapiens
gcctctgtgctgtg

SEQ ID NO: 3657273 - DNA, 17 bp, Homo sapiens
gcctctgtgctgtgtgt

SEQ ID NO: 3657274 - DNA, 18 bp, Homo sapiens
gcctctgtgctgtgtgtg

SEQ ID NO: 3657275 - DNA, 12 bp, Homo sapiens
gcctcttctcta

SEQ ID NO: 3657276 - DNA, 16 bp, Homo sapiens
gcctgaaagaggctga

SEQ ID NO: 3657277 - DNA, 14 bp, Homo sapiens
gcctgagggtgggc

SEQ ID NO: 3657278 - DNA, 20 bp, Homo sapiens
gcctgatgagatttttaaaa

SEQ ID NO: 3657279 - DNA, 20 bp, Homo sapiens
gcctgatgctccctcccctg

SEQ ID NO: 3657280 - DNA, 16 bp, Homo sapiens
gcctgcagaatttggg

SEQ ID NO: 3657281 - DNA, 12 bp, Homo sapiens
gcctgcagggaa

SEQ ID NO: 3657282 - DNA, 20 bp, Homo sapiens
gcctgcagggaagccccaca

SEQ ID NO: 3657283 - DNA, 13 bp, Homo sapiens
gcctgcagggcca

SEQ ID NO: 3657284 - DNA, 21 bp, Homo sapiens
gcctgcagggccatggctcag

SEQ ID NO: 3657285 - DNA, 21 bp, Homo sapiens
gcctgcataggctccttcctg

SEQ ID NO: 3657286 - DNA, 14 bp, Homo sapiens
gcctgcccctccca

SEQ ID NO: 3657287 - DNA, 16 bp, Homo sapiens
gcctgctccagacctg

SEQ ID NO: 3657288 - DNA, 17 bp, Homo sapiens
gcctgctccagacctga

SEQ ID NO: 3657289 - DNA, 21 bp, Homo sapiens
gcctgctccagacctgatcct

SEQ ID NO: 3657290 - DNA, 13 bp, Homo sapiens
gcctggactgcta

SEQ ID NO: 3657291 - DNA, 15 bp, Homo sapiens
gcctggactttcctg

SEQ ID NO: 3657292 - DNA, 17 bp, Homo sapiens
gcctggagacttagggc

SEQ ID NO: 3657293 - DNA, 18 bp, Homo sapiens
gcctggagatcctcctgc

SEQ ID NO: 3657294 - DNA, 22 bp, Homo sapiens
gcctggcatcagtttaggcctt

SEQ ID NO: 3657295 - DNA, 14 bp, Homo sapiens
gcctggccaggagc

SEQ ID NO: 3657296 - DNA, 17 bp, Homo sapiens
gcctggccaggcagatc

SEQ ID NO: 3657297 - DNA, 14 bp, Homo sapiens
gcctggcccgggaa

SEQ ID NO: 3657298 - DNA, 19 bp, Homo sapiens
gcctggcgacagagcgaga

SEQ ID NO: 3657299 - DNA, 18 bp, Homo sapiens
gcctgggccgctgccacg

SEQ ID NO: 3657300 - DNA, 14 bp, Homo sapiens
gcctggggtggggt

SEQ ID NO: 3657301 - DNA, 13 bp, Homo sapiens
gcctggtgcagtg

SEQ ID NO: 3657302 - DNA, 12 bp, Homo sapiens
gcctggtggccc

SEQ ID NO: 3657303 - DNA, 20 bp, Homo sapiens
gcctgtaatcccagcacttt

SEQ ID NO: 3657304 - DNA, 20 bp, Homo sapiens
gcctgtaatcctagcacttt

SEQ ID NO: 3657305 - DNA, 15 bp, Homo sapiens
gcctgtccacagccc

SEQ ID NO: 3657306 - DNA, 15 bp, Homo sapiens
gcctgtccagcctgg

SEQ ID NO: 3657307 - DNA, 17 bp, Homo sapiens
gcctgtccagcctgggc

SEQ ID NO: 3657308 - DNA, 20 bp, Homo sapiens
gcctgtcctgacctgtctca

SEQ ID NO: 3657309 - DNA, 14 bp, Homo sapiens
gcctgtgccacccc

SEQ ID NO: 3657310 - DNA, 22 bp, Homo sapiens
gcctgtgccaccccttcctcag

SEQ ID NO: 3657311 - DNA, 22 bp, Homo sapiens
gcctgtggcatctttgccttgg

SEQ ID NO: 3657312 - DNA, 15 bp, Homo sapiens
gcctgtggctgtcgg

SEQ ID NO: 3657313 - DNA, 14 bp, Homo sapiens
gcctgtgtctttaa

SEQ ID NO: 3657314 - DNA, 17 bp, Homo sapiens
gccttcaagtgccaaac

SEQ ID NO: 3657315 - DNA, 19 bp, Homo sapiens
gccttcgtctttcccatgg

SEQ ID NO: 3657316 - DNA, 15 bp, Homo sapiens
gccttctaaaggtgt

SEQ ID NO: 3657317 - DNA, 23 bp, Homo sapiens
gccttcttttgggggtcaacagt

SEQ ID NO: 3657318 - DNA, 14 bp, Homo sapiens
gccttgaataataa

SEQ ID NO: 3657319 - DNA, 15 bp, Homo sapiens
gccttgagttccagt

SEQ ID NO: 3657320 - DNA, 14 bp, Homo sapiens
gccttgccagagat

SEQ ID NO: 3657321 - DNA, 17 bp, Homo sapiens
gccttgctgtttgtcct

SEQ ID NO: 3657322 - DNA, 22 bp, Homo sapiens
gccttgctgtttgtcctgagat

SEQ ID NO: 3657323 - DNA, 16 bp, Homo sapiens
gccttgggctgctcct

SEQ ID NO: 3657324 - DNA, 18 bp, Homo sapiens
gccttgggctgctcctca

SEQ ID NO: 3657325 - DNA, 17 bp, Homo sapiens
gcctttgatcaggtggg

SEQ ID NO: 3657326 - DNA, 13 bp, Homo sapiens
gcctttggcttca

SEQ ID NO: 3657327 - DNA, 14 bp, Homo sapiens
gcctttgttctggg

SEQ ID NO: 3657328 - DNA, 16 bp, Homo sapiens
gccttttatttcttaa

SEQ ID NO: 3657329 - DNA, 22 bp, Homo sapiens
gccttttctggcaccgcagttt

SEQ ID NO: 3657330 - DNA, 15 bp, Homo sapiens
gcgaaggtcccacag

SEQ ID NO: 3657331 - DNA, 16 bp, Homo sapiens
gcgaaggtcccacagc

SEQ ID NO: 3657332 - DNA, 23 bp, Homo sapiens
gcgaccctgggggcacaggaggc

SEQ ID NO: 3657333 - DNA, 17 bp, Homo sapiens
gcgactttctgcctgga

SEQ ID NO: 3657334 - DNA, 16 bp, Homo sapiens
gcgagtcgggtcccca

SEQ ID NO: 3657335 - DNA, 22 bp, Homo sapiens
gcgccccctccgccctgccact

SEQ ID NO: 3657336 - DNA, 15 bp, Homo sapiens
gcgccgtctccaggg

SEQ ID NO: 3657337 - DNA, 19 bp, Homo sapiens
gcgcctccatccaaggcca

SEQ ID NO: 3657338 - DNA, 16 bp, Homo sapiens
gcgcctgcccctccca

SEQ ID NO: 3657339 - DNA, 17 bp, Homo sapiens
gcgcctgcccctcccag

SEQ ID NO: 3657340 - DNA, 14 bp, Homo sapiens
gcgcctttcccaac

SEQ ID NO: 3657341 - DNA, 15 bp, Homo sapiens
gcgcctttcccaact

SEQ ID NO: 3657342 - DNA, 21 bp, Homo sapiens
gcgcgatcccacacaggctgg

SEQ ID NO: 3657343 - DNA, 13 bp, Homo sapiens
gcgctcagggcca

SEQ ID NO: 3657344 - DNA, 22 bp, Homo sapiens
gcgctcagggccatgctgaggc

SEQ ID NO: 3657345 - DNA, 23 bp, Homo sapiens
gcgctctttaatttgttgtagat

SEQ ID NO: 3657346 - DNA, 18 bp, Homo sapiens
gcgctgtttttgttgtgt

SEQ ID NO: 3657347 - DNA, 21 bp, Homo sapiens
gcgctgtttttgttgtgtgtg

SEQ ID NO: 3657348 - DNA, 15 bp, Homo sapiens
gcgcttgctggccag

SEQ ID NO: 3657349 - DNA, 21 bp, Homo sapiens
gcggaggtgtggagccgaggc

SEQ ID NO: 3657350 - DNA, 19 bp, Homo sapiens
gcggcaggggcctggagat

SEQ ID NO: 3657351 - DNA, 14 bp, Homo sapiens
gcggcgggcggctg

SEQ ID NO: 3657352 - DNA, 13 bp, Homo sapiens
gcggctccccctg

SEQ ID NO: 3657353 - DNA, 17 bp, Homo sapiens
gcggctccccctggacg

SEQ ID NO: 3657354 - DNA, 21 bp, Homo sapiens
gcgggagccatgcgccccctc

SEQ ID NO: 3657355 - DNA, 18 bp, Homo sapiens
gcgggcaggttctgcctg

SEQ ID NO: 3657356 - DNA, 18 bp, Homo sapiens
gcgggccctgcctgaggg

SEQ ID NO: 3657357 - DNA, 19 bp, Homo sapiens
gcgggcggctgggtctgtg

SEQ ID NO: 3657358 - DNA, 21 bp, Homo sapiens
gcggggcactaggtaggcttc

SEQ ID NO: 3657359 - DNA, 18 bp, Homo sapiens
gcggggcgccccaagagc

SEQ ID NO: 3657360 - DNA, 15 bp, Homo sapiens
gcggggctcctcctg

SEQ ID NO: 3657361 - DNA, 20 bp, Homo sapiens
gcggggctcctcctgaagga

SEQ ID NO: 3657362 - DNA, 21 bp, Homo sapiens
gcggggctctaggatggggca

SEQ ID NO: 3657363 - DNA, 14 bp, Homo sapiens
gcggtttcctggtg

SEQ ID NO: 3657364 - DNA, 20 bp, Homo sapiens
gcgtagcgtgcccgtgtgca

SEQ ID NO: 3657365 - DNA, 20 bp, Homo sapiens
gcgtagctctcaaatgtgtg

SEQ ID NO: 3657366 - DNA, 14 bp, Homo sapiens
gcgtagttccctgg

SEQ ID NO: 3657367 - DNA, 22 bp, Homo sapiens
gctgtgaggcttgcccaggagc

SEQ ID NO: 3657368 - DNA, 24 bp, Homo sapiens
gctgtgaggcttgcccaggagcaa

SEQ ID NO: 3657369 - DNA, 19 bp, Homo sapiens
gctgtgcaacggtctcctg

SEQ ID NO: 3657370 - DNA, 18 bp, Homo sapiens
gctgtggctctgggtggg

SEQ ID NO: 3657371 - DNA, 14 bp, Homo sapiens
gctgtgtctgagcc

SEQ ID NO: 3657372 - DNA, 19 bp, Homo sapiens
gctgtgtctgagcccaacc

SEQ ID NO: 3657373 - DNA, 14 bp, Homo sapiens
gctgtgtgtcccag

SEQ ID NO: 3657374 - DNA, 14 bp, Homo sapiens
gctgttagagaaat

SEQ ID NO: 3657375 - DNA, 21 bp, Homo sapiens
gctgttattatatttgacatg

SEQ ID NO: 3657376 - DNA, 16 bp, Homo sapiens
gctgttttcctccctt

SEQ ID NO: 3657377 - DNA, 21 bp, Homo sapiens
gctgttttcctcccttctgct

SEQ ID NO: 3657378 - DNA, 22 bp, Homo sapiens
gctgttttcctcccttctgcta

SEQ ID NO: 3657379 - DNA, 15 bp, Homo sapiens
gcttaatcattttca

SEQ ID NO: 3657380 - DNA, 14 bp, Homo sapiens
gcttagtcctggga

SEQ ID NO: 3657381 - DNA, 14 bp, Homo sapiens
gcttagtttgtgtg

SEQ ID NO: 3657382 - DNA, 20 bp, Homo sapiens
gcttagtttgtgtgttgtct

SEQ ID NO: 3657383 - DNA, 20 bp, Homo sapiens
gcttatggtaccagatgcag

SEQ ID NO: 3657384 - DNA, 18 bp, Homo sapiens
gcttatttcatctgttct

SEQ ID NO: 3657385 - DNA, 19 bp, Homo sapiens
gcttatttttctgtgaata

SEQ ID NO: 3657386 - DNA, 17 bp, Homo sapiens
gcttcacggaagagcct

SEQ ID NO: 3657387 - DNA, 12 bp, Homo sapiens
gcttccatgcct

SEQ ID NO: 3657388 - DNA, 22 bp, Homo sapiens
gcttccatgcctgtagctttcc

SEQ ID NO: 3657389 - DNA, 15 bp, Homo sapiens
gcttccctgcagctg

SEQ ID NO: 3657390 - DNA, 22 bp, Homo sapiens
gcttcctcattccttgtcttga

SEQ ID NO: 3657391 - DNA, 14 bp, Homo sapiens
gcttcctcccaaca

SEQ ID NO: 3657392 - DNA, 13 bp, Homo sapiens
gcttctacctgca

SEQ ID NO: 3657393 - DNA, 16 bp, Homo sapiens
gcttctacctgcaggc

SEQ ID NO: 3657394 - DNA, 17 bp, Homo sapiens
gcttctcactgccatgc

SEQ ID NO: 3657395 - DNA, 12 bp, Homo sapiens
gcttctcctgac

SEQ ID NO: 3657396 - DNA, 11 bp, Homo sapiens
gcttctcctgc

SEQ ID NO: 3657397 - DNA, 14 bp, Homo sapiens
gcttctctgacttc

SEQ ID NO: 3657398 - DNA, 20 bp, Homo sapiens
gcttctctgacttctgcctg

SEQ ID NO: 3657399 - DNA, 21 bp, Homo sapiens
gcttctctgacttctgcctgg

SEQ ID NO: 3657400 - DNA, 22 bp, Homo sapiens
gcttctctgacttctgcctgga

SEQ ID NO: 3657401 - DNA, 12 bp, Homo sapiens
gcttctgcagga

SEQ ID NO: 3657402 - DNA, 17 bp, Homo sapiens
gcttctggaatttgttc

SEQ ID NO: 3657403 - DNA, 15 bp, Homo sapiens
gcttctggccaggaa

SEQ ID NO: 3657404 - DNA, 17 bp, Homo sapiens
gcttctggccaggaagc

SEQ ID NO: 3657405 - DNA, 18 bp, Homo sapiens
gcttctggccaggaagct

SEQ ID NO: 3657406 - DNA, 11 bp, Homo sapiens
gcttcttggct

SEQ ID NO: 3657407 - DNA, 24 bp, Homo sapiens
gcttgatggaagtgggccagtcct

SEQ ID NO: 3657408 - DNA, 14 bp, Homo sapiens
gcttgcccaggagc

SEQ ID NO: 3657409 - DNA, 16 bp, Homo sapiens
gcttgcctgcagggcc

SEQ ID NO: 3657410 - DNA, 14 bp, Homo sapiens
gcttggagctgagc

SEQ ID NO: 3657411 - DNA, 15 bp, Homo sapiens
gcttggagctgagca

SEQ ID NO: 3657412 - DNA, 22 bp, Homo sapiens
gcttgggaaaggtggtgtttct

SEQ ID NO: 3657413 - DNA, 16 bp, Homo sapiens
gcttggggctcacaca

SEQ ID NO: 3657414 - DNA, 20 bp, Homo sapiens
gcttggggctcacacacctg

SEQ ID NO: 3657415 - DNA, 16 bp, Homo sapiens
gcttgtcccctcctca

SEQ ID NO: 3657416 - DNA, 15 bp, Homo sapiens
gctttcccacttccc

SEQ ID NO: 3657417 - DNA, 21 bp, Homo sapiens
gctttcccacttcccaccctg

SEQ ID NO: 3657418 - DNA, 19 bp, Homo sapiens
gctttcctgccccaggcct

SEQ ID NO: 3657419 - DNA, 16 bp, Homo sapiens
gctttcctggtccctc

SEQ ID NO: 3657420 - DNA, 14 bp, Homo sapiens
gctttctctccttg

SEQ ID NO: 3657421 - DNA, 15 bp, Homo sapiens
gctttctgccatcta

SEQ ID NO: 3657422 - DNA, 18 bp, Homo sapiens
gctttctgctcagcttct

SEQ ID NO: 3657423 - DNA, 14 bp, Homo sapiens
gctttgcatttctt

SEQ ID NO: 3657424 - DNA, 18 bp, Homo sapiens
gctttgcatttcttgtgt

SEQ ID NO: 3657425 - DNA, 17 bp, Homo sapiens
gctttgccaaaatacca

SEQ ID NO: 3657426 - DNA, 21 bp, Homo sapiens
gctttgccaaaataccagagc

SEQ ID NO: 3657427 - DNA, 12 bp, Homo sapiens
gctttgctgctg

SEQ ID NO: 3657428 - DNA, 19 bp, Homo sapiens
gctttgctttctgctcagc

SEQ ID NO: 3657429 - DNA, 14 bp, Homo sapiens
gctttgtctgtcgt

SEQ ID NO: 3657430 - DNA, 23 bp, Homo sapiens
gctttgtgacttcttcttctttg

SEQ ID NO: 3657431 - DNA, 12 bp, Homo sapiens
gcttttccctgg

SEQ ID NO: 3657432 - DNA, 13 bp, Homo sapiens
gcttttccctggg

SEQ ID NO: 3657433 - DNA, 15 bp, Homo sapiens
gcttttccctgggtg

SEQ ID NO: 3657434 - DNA, 16 bp, Homo sapiens
gcttttccctgggtgg

SEQ ID NO: 3657435 - DNA, 22 bp, Homo sapiens
gcttttccttggggcaggcagt

SEQ ID NO: 3657436 - DNA, 23 bp, Homo sapiens
gcttttccttggggcaggcagtg

SEQ ID NO: 3657437 - DNA, 11 bp, Homo sapiens
gcttttggcaa

SEQ ID NO: 3657438 - DNA, 20 bp, Homo sapiens
gctttttccaaatgcttcta

SEQ ID NO: 3657439 - DNA, 17 bp, Homo sapiens
gcttttttgttttggct

SEQ ID NO: 3657440 - DNA, 13 bp, Homo sapiens
ggaaaaaaatgtt

SEQ ID NO: 3657441 - DNA, 22 bp, Homo sapiens
ggaaaacttgcagctaaggagg

SEQ ID NO: 3657442 - DNA, 20 bp, Homo sapiens
ggaaaatcagtgacatctga

SEQ ID NO: 3657443 - DNA, 22 bp, Homo sapiens
ggaaagcagctcaaaggcacag

SEQ ID NO: 3657444 - DNA, 16 bp, Homo sapiens
ggaaatcaacttgctt

SEQ ID NO: 3657445 - DNA, 21 bp, Homo sapiens
ggaacactagacaagccagaa

SEQ ID NO: 3657446 - DNA, 17 bp, Homo sapiens
ggaacactatagagaac

SEQ ID NO: 3657447 - DNA, 19 bp, Homo sapiens
ggaacagctatgggagccc

SEQ ID NO: 3657448 - DNA, 17 bp, Homo sapiens
ggaacataaatcttaat

SEQ ID NO: 3657449 - DNA, 11 bp, Homo sapiens
ggaacccagac

SEQ ID NO: 3657450 - DNA, 15 bp, Homo sapiens
ggaacccagactcag

SEQ ID NO: 3657451 - DNA, 15 bp, Homo sapiens
ggaaccgcaggaagc

SEQ ID NO: 3657452 - DNA, 17 bp, Homo sapiens
ggaaccgcaggaagctg

SEQ ID NO: 3657453 - DNA, 16 bp, Homo sapiens
ggaacctcagcctggc

SEQ ID NO: 3657454 - DNA, 22 bp, Homo sapiens
ggaacctcagcctggccagaca

SEQ ID NO: 3657455 - DNA, 12 bp, Homo sapiens
ggaacctggacc

SEQ ID NO: 3657456 - DNA, 19 bp, Homo sapiens
ggaacctggaccccagcct

SEQ ID NO: 3657457 - DNA, 13 bp, Homo sapiens
ggaactcagatcc

SEQ ID NO: 3657458 - DNA, 15 bp, Homo sapiens
ggaactcagatccag

SEQ ID NO: 3657459 - DNA, 17 bp, Homo sapiens
ggaactcagatccaggg

SEQ ID NO: 3657460 - DNA, 15 bp, Homo sapiens
ggaactggagggtga

SEQ ID NO: 3657461 - DNA, 18 bp, Homo sapiens
ggaagagaggtccagccc

SEQ ID NO: 3657462 - DNA, 22 bp, Homo sapiens
ggaagatcctgcgggtggggct

SEQ ID NO: 3657463 - DNA, 22 bp, Homo sapiens
ggaagcaccccatgccaaagct

SEQ ID NO: 3657464 - DNA, 17 bp, Homo sapiens
ggaagcaggatggagct

SEQ ID NO: 3657465 - DNA, 13 bp, Homo sapiens
ggaagccccacat

SEQ ID NO: 3657466 - DNA, 19 bp, Homo sapiens
ggaagcccggactgaccaa

SEQ ID NO: 3657467 - DNA, 16 bp, Homo sapiens
ggaagccgtgccctgc

SEQ ID NO: 3657468 - DNA, 14 bp, Homo sapiens
ggaaggagagcctg

SEQ ID NO: 3657469 - DNA, 15 bp, Homo sapiens
ggaagggcaggaagg

SEQ ID NO: 3657470 - DNA, 18 bp, Homo sapiens
ggaaggggcccgtgggag

SEQ ID NO: 3657471 - DNA, 22 bp, Homo sapiens
ggaaggggtgctgtgaggcttg

SEQ ID NO: 3657472 - DNA, 18 bp, Homo sapiens
ggaagggtttgtggctgg

SEQ ID NO: 3657473 - DNA, 14 bp, Homo sapiens
ggaaggttccatga

SEQ ID NO: 3657474 - DNA, 16 bp, Homo sapiens
ggaagtgggccagtcc

SEQ ID NO: 3657475 - DNA, 18 bp, Homo sapiens
ggaagtgggccagtcctg

SEQ ID NO: 3657476 - DNA, 20 bp, Homo sapiens
ggaagtgggccagtcctggt

SEQ ID NO: 3657477 - DNA, 21 bp, Homo sapiens
ggaagttttgtggaggagctc

SEQ ID NO: 3657478 - DNA, 20 bp, Homo sapiens
ggaatcccggctccagagca

SEQ ID NO: 3657479 - DNA, 15 bp, Homo sapiens
ggaatggcacagccc

SEQ ID NO: 3657480 - DNA, 20 bp, Homo sapiens
ggaattcatctctctttaat

SEQ ID NO: 3657481 - DNA, 19 bp, Homo sapiens
ggaattcctggaacctgga

SEQ ID NO: 3657482 - DNA, 10 bp, Homo sapiens
ggaattgaaa

SEQ ID NO: 3657483 - DNA, 15 bp, Homo sapiens
ggaatttcccaggac

SEQ ID NO: 3657484 - DNA, 22 bp, Homo sapiens
agctggatctccattctctcag

SEQ ID NO: 3657485 - DNA, 16 bp, Homo sapiens
agctggcagcagagtg

SEQ ID NO: 3657486 - DNA, 12 bp, Homo sapiens
agctggcaggag

SEQ ID NO: 3657487 - DNA, 19 bp, Homo sapiens
agctggctctgagcgcctc

SEQ ID NO: 3657488 - DNA, 23 bp, Homo sapiens
agctggctctgagcgcctccatc

SEQ ID NO: 3657489 - DNA, 13 bp, Homo sapiens
agctggctgacta

SEQ ID NO: 3657490 - DNA, 16 bp, Homo sapiens
agctgggcagaaggcc

SEQ ID NO: 3657491 - DNA, 18 bp, Homo sapiens
agctgggcagaaggccaa

SEQ ID NO: 3657492 - DNA, 21 bp, Homo sapiens
agctgggcccgacatggctcc

SEQ ID NO: 3657493 - DNA, 22 bp, Homo sapiens
agctgggcccgacatggctccg

SEQ ID NO: 3657494 - DNA, 22 bp, Homo sapiens
agctggggatccctccccccca

SEQ ID NO: 3657495 - DNA, 20 bp, Homo sapiens
agctgggggtgggccaggct

SEQ ID NO: 3657496 - DNA, 20 bp, Homo sapiens
agctgggttggaaaacagta

SEQ ID NO: 3657497 - DNA, 14 bp, Homo sapiens
agctggtgcccgga

SEQ ID NO: 3657498 - DNA, 18 bp, Homo sapiens
agctgtcacaacttgtgt

SEQ ID NO: 3657499 - DNA, 14 bp, Homo sapiens
agctgtcccttgct

SEQ ID NO: 3657500 - DNA, 12 bp, Homo sapiens
agctgtcttgga

SEQ ID NO: 3657501 - DNA, 16 bp, Homo sapiens
agctgtgctgggaagc

SEQ ID NO: 3657502 - DNA, 21 bp, Homo sapiens
agctgtgctgggaagcccgga

SEQ ID NO: 3657503 - DNA, 19 bp, Homo sapiens
agctgtgcttatggtacca

SEQ ID NO: 3657504 - DNA, 22 bp, Homo sapiens
agctgtgcttatggtaccagat

SEQ ID NO: 3657505 - DNA, 13 bp, Homo sapiens
agctgtgtctgag

SEQ ID NO: 3657506 - DNA, 16 bp, Homo sapiens
agctgtgtctgagccc

SEQ ID NO: 3657507 - DNA, 18 bp, Homo sapiens
agctgttactgtcttcag

SEQ ID NO: 3657508 - DNA, 19 bp, Homo sapiens
agctgttactgtcttcagt

SEQ ID NO: 3657509 - DNA, 15 bp, Homo sapiens
agctgttagttgctg

SEQ ID NO: 3657510 - DNA, 13 bp, Homo sapiens
agctgttcagctg

SEQ ID NO: 3657511 - DNA, 14 bp, Homo sapiens
agctgttcagctgg

SEQ ID NO: 3657512 - DNA, 18 bp, Homo sapiens
agctgttcctgttcagta

SEQ ID NO: 3657513 - DNA, 20 bp, Homo sapiens
agctgtttatggcctcagct

SEQ ID NO: 3657514 - DNA, 21 bp, Homo sapiens
agctgtttatggcctcagctg

SEQ ID NO: 3657515 - DNA, 20 bp, Homo sapiens
agcttaaaggggctagagtg

SEQ ID NO: 3657516 - DNA, 14 bp, Homo sapiens
agcttagtcctggg

SEQ ID NO: 3657517 - DNA, 18 bp, Homo sapiens
agcttagtgagcagtgag

SEQ ID NO: 3657518 - DNA, 17 bp, Homo sapiens
agcttctcctgaccagg

SEQ ID NO: 3657519 - DNA, 22 bp, Homo sapiens
agcttgtccaacccgaggcccg

SEQ ID NO: 3657520 - DNA, 22 bp, Homo sapiens
agctttcctgccccaggcctga

SEQ ID NO: 3657521 - DNA, 16 bp, Homo sapiens
agctttgaaaattcag

SEQ ID NO: 3657522 - DNA, 12 bp, Homo sapiens
agctttgaggaa

SEQ ID NO: 3657523 - DNA, 16 bp, Homo sapiens
agcttttaaaccctat

SEQ ID NO: 3657524 - DNA, 15 bp, Homo sapiens
aggaaaggccagctg

SEQ ID NO: 3657525 - DNA, 24 bp, Homo sapiens
aggaaaggccagctggcagcagag

SEQ ID NO: 3657526 - DNA, 14 bp, Homo sapiens
aggaagagaaaaaa

SEQ ID NO: 3657527 - DNA, 14 bp, Homo sapiens
aggaagcccctgag

SEQ ID NO: 3657528 - DNA, 21 bp, Homo sapiens
aggaagcccctgagtcctgag

SEQ ID NO: 3657529 - DNA, 17 bp, Homo sapiens
aggaagctcagactggt

SEQ ID NO: 3657530 - DNA, 22 bp, Homo sapiens
aggaagctttggtgagaacctg

SEQ ID NO: 3657531 - DNA, 17 bp, Homo sapiens
aggaaggagagcctgct

SEQ ID NO: 3657532 - DNA, 21 bp, Homo sapiens
aggaaggcttgttgtgctttt

SEQ ID NO: 3657533 - DNA, 13 bp, Homo sapiens
aggaagggaagcg

SEQ ID NO: 3657534 - DNA, 17 bp, Homo sapiens
aggaaggggtgctgtga

SEQ ID NO: 3657535 - DNA, 23 bp, Homo sapiens
aggaaggggtgctgtgaggcttg

SEQ ID NO: 3657536 - DNA, 15 bp, Homo sapiens
aggaaggtggatggc

SEQ ID NO: 3657537 - DNA, 15 bp, Homo sapiens
aggaatattttccaa

SEQ ID NO: 3657538 - DNA, 16 bp, Homo sapiens
aggaatcccggctcca

SEQ ID NO: 3657539 - DNA, 15 bp, Homo sapiens
aggaatttcccagga

SEQ ID NO: 3657540 - DNA, 21 bp, Homo sapiens
aggaatttcccaggaccctga

SEQ ID NO: 3657541 - DNA, 18 bp, Homo sapiens
aggacaacgaggaagccc

SEQ ID NO: 3657542 - DNA, 20 bp, Homo sapiens
aggacaggcgggaggaggtg

SEQ ID NO: 3657543 - DNA, 16 bp, Homo sapiens
aggacagtctggagaa

SEQ ID NO: 3657544 - DNA, 17 bp, Homo sapiens
aggacagtctggagaag

SEQ ID NO: 3657545 - DNA, 20 bp, Homo sapiens
aggacagtctggagaaggta

SEQ ID NO: 3657546 - DNA, 20 bp, Homo sapiens
aggacataatggggtcctgg

SEQ ID NO: 3657547 - DNA, 19 bp, Homo sapiens
aggaccaagcatcttgggg

SEQ ID NO: 3657548 - DNA, 13 bp, Homo sapiens
aggaccagctcag

SEQ ID NO: 3657549 - DNA, 24 bp, Homo sapiens
aggaccagctcaggacagatgcca

SEQ ID NO: 3657550 - DNA, 12 bp, Homo sapiens
aggaccaggact

SEQ ID NO: 3657551 - DNA, 20 bp, Homo sapiens
aggaccagggccttttctgg

SEQ ID NO: 3657552 - DNA, 15 bp, Homo sapiens
aggaccctgaagggg

SEQ ID NO: 3657553 - DNA, 13 bp, Homo sapiens
aggacccttccct

SEQ ID NO: 3657554 - DNA, 22 bp, Homo sapiens
aggacccttcccttgagccctc

SEQ ID NO: 3657555 - DNA, 21 bp, Homo sapiens
aggacctttccaccacagcca

SEQ ID NO: 3657556 - DNA, 14 bp, Homo sapiens
aggactacaggtat

SEQ ID NO: 3657557 - DNA, 20 bp, Homo sapiens
aggactatatttgggcctgc

SEQ ID NO: 3657558 - DNA, 14 bp, Homo sapiens
aggactcccaccta

SEQ ID NO: 3657559 - DNA, 20 bp, Homo sapiens
aggacttcctgtccagctcc

SEQ ID NO: 3657560 - DNA, 18 bp, Homo sapiens
aggactttgaggcaagtg

SEQ ID NO: 3657561 - DNA, 23 bp, Homo sapiens
aggactttgaggcaagtgtgggc

SEQ ID NO: 3657562 - DNA, 19 bp, Homo sapiens
aggagaaccaaatctggaa

SEQ ID NO: 3657563 - DNA, 14 bp, Homo sapiens
aggagaagccagga

SEQ ID NO: 3657564 - DNA, 15 bp, Homo sapiens
aggagagaaaatata

SEQ ID NO: 3657565 - DNA, 13 bp, Homo sapiens
aggagagcctgct

SEQ ID NO: 3657566 - DNA, 20 bp, Homo sapiens
aggagagcctgctgcatggg

SEQ ID NO: 3657567 - DNA, 18 bp, Homo sapiens
aggagaggggcacagggt

SEQ ID NO: 3657568 - DNA, 19 bp, Homo sapiens
aggagctcttcaggcctcc

SEQ ID NO: 3657569 - DNA, 13 bp, Homo sapiens
aggagctgcagtt

SEQ ID NO: 3657570 - DNA, 19 bp, Homo sapiens
aggagctgctatagcctgg

SEQ ID NO: 3657571 - DNA, 13 bp, Homo sapiens
aggagctgctggc

SEQ ID NO: 3657572 - DNA, 20 bp, Homo sapiens
aggaggcaggcatggccctg

SEQ ID NO: 3657573 - DNA, 19 bp, Homo sapiens
aggaggcggggctctagga

SEQ ID NO: 3657574 - DNA, 21 bp, Homo sapiens
aggaggcgtctcgggagagga

SEQ ID NO: 3657575 - DNA, 20 bp, Homo sapiens
aggagggccctacctgattg

SEQ ID NO: 3657576 - DNA, 17 bp, Homo sapiens
aggaggggaaaaaaatg

SEQ ID NO: 3657577 - DNA, 21 bp, Homo sapiens
aggagttcaggaacccttctc

SEQ ID NO: 3657578 - DNA, 23 bp, Homo sapiens
aggagttcagggtcatagcatgc

SEQ ID NO: 3657579 - DNA, 19 bp, Homo sapiens
aggatagatgctggcccag

SEQ ID NO: 3657580 - DNA, 21 bp, Homo sapiens
aggatagatgctggcccaggg

SEQ ID NO: 3657581 - DNA, 22 bp, Homo sapiens
aggatagatgctggcccagggc

SEQ ID NO: 3657582 - DNA, 13 bp, Homo sapiens
aggatcatctgaa

SEQ ID NO: 3657583 - DNA, 18 bp, Homo sapiens
aggatcccctccaagcct

SEQ ID NO: 3657584 - DNA, 21 bp, Homo sapiens
aggatctcttgagcctgggag

SEQ ID NO: 3657585 - DNA, 16 bp, Homo sapiens
aggatctttgtggcca

SEQ ID NO: 3657586 - DNA, 17 bp, Homo sapiens
aggatctttgtggccaa

SEQ ID NO: 3657587 - DNA, 18 bp, Homo sapiens
aggatctttgtggccaag

SEQ ID NO: 3657588 - DNA, 13 bp, Homo sapiens
aggatcttttgaa

SEQ ID NO: 3657589 - DNA, 18 bp, Homo sapiens
aggatggctttgaatgcg

SEQ ID NO: 3657590 - DNA, 12 bp, Homo sapiens
aggatggggcac

SEQ ID NO: 3657591 - DNA, 16 bp, Homo sapiens
aggatggttctgtgac

SEQ ID NO: 3657592 - DNA, 19 bp, Homo sapiens
aggcaaatgtttaaacatt

SEQ ID NO: 3657593 - DNA, 19 bp, Homo sapiens
aggcaactgcattggcttt

SEQ ID NO: 3657594 - DNA, 17 bp, Homo sapiens
aaagcaaaaggctgaga

SEQ ID NO: 3657595 - DNA, 23 bp, Homo sapiens
aaagcaacaaagattgagaagcc

SEQ ID NO: 3657596 - DNA, 11 bp, Homo sapiens
aaagcaagtgt

SEQ ID NO: 3657597 - DNA, 18 bp, Homo sapiens
aaagcagctcaaaggcac

SEQ ID NO: 3657598 - DNA, 14 bp, Homo sapiens
aaagccagaagctg

SEQ ID NO: 3657599 - DNA, 18 bp, Homo sapiens
aaagcccaagggatctgg

SEQ ID NO: 3657600 - DNA, 17 bp, Homo sapiens
aaagcctctgtgctgca

SEQ ID NO: 3657601 - DNA, 14 bp, Homo sapiens
aaagcctgaagggc

SEQ ID NO: 3657602 - DNA, 18 bp, Homo sapiens
aaagccttcttttggggg

SEQ ID NO: 3657603 - DNA, 18 bp, Homo sapiens
aaagctatttatgggccc

SEQ ID NO: 3657604 - DNA, 19 bp, Homo sapiens
aaagctgacattgccaaaa

SEQ ID NO: 3657605 - DNA, 17 bp, Homo sapiens
aaaggaacggcttcctc

SEQ ID NO: 3657606 - DNA, 17 bp, Homo sapiens
aaaggaagggtggcttt

SEQ ID NO: 3657607 - DNA, 21 bp, Homo sapiens
aaaggagagctagcagcaggg

SEQ ID NO: 3657608 - DNA, 13 bp, Homo sapiens
aaaggaggctggc

SEQ ID NO: 3657609 - DNA, 14 bp, Homo sapiens
aaaggaggctggca

SEQ ID NO: 3657610 - DNA, 13 bp, Homo sapiens
aaaggatctcctt

SEQ ID NO: 3657611 - DNA, 10 bp, Homo sapiens
aaaggcagcg

SEQ ID NO: 3657612 - DNA, 17 bp, Homo sapiens
aaaggcagcgtgccgag

SEQ ID NO: 3657613 - DNA, 12 bp, Homo sapiens
aaaggcagctgt

SEQ ID NO: 3657614 - DNA, 19 bp, Homo sapiens
aaaggcagctgtgtctgag

SEQ ID NO: 3657615 - DNA, 19 bp, Homo sapiens
aaaggcaggaagggaagcg

SEQ ID NO: 3657616 - DNA, 12 bp, Homo sapiens
aaaggccagctg

SEQ ID NO: 3657617 - DNA, 18 bp, Homo sapiens
aaagggagctatcaggaa

SEQ ID NO: 3657618 - DNA, 23 bp, Homo sapiens
aaaggggtcggctgaccatgctc

SEQ ID NO: 3657619 - DNA, 19 bp, Homo sapiens
aaaggttgctgtttcacaa

SEQ ID NO: 3657620 - DNA, 15 bp, Homo sapiens
aaaggtttacagaat

SEQ ID NO: 3657621 - DNA, 20 bp, Homo sapiens
aaagtagaagagggttttag

SEQ ID NO: 3657622 - DNA, 17 bp, Homo sapiens
aaagtatcacttttctg

SEQ ID NO: 3657623 - DNA, 14 bp, Homo sapiens
aaagtattgtaaat

SEQ ID NO: 3657624 - DNA, 21 bp, Homo sapiens
aaagtattttggggtatatta

SEQ ID NO: 3657625 - DNA, 19 bp, Homo sapiens
aaagtccaattttaattta

SEQ ID NO: 3657626 - DNA, 14 bp, Homo sapiens
aaagtgcatttttg

SEQ ID NO: 3657627 - DNA, 12 bp, Homo sapiens
aaagtgctggga

SEQ ID NO: 3657628 - DNA, 13 bp, Homo sapiens
aaagtggaaaaat

SEQ ID NO: 3657629 - DNA, 13 bp, Homo sapiens
aaagttatatttc

SEQ ID NO: 3657630 - DNA, 24 bp, Homo sapiens
aaagttatatttcagatgtaatgt

SEQ ID NO: 3657631 - DNA, 10 bp, Homo sapiens
aaagtttccg

SEQ ID NO: 3657632 - DNA, 19 bp, Homo sapiens
aaataacaactatttttgt

SEQ ID NO: 3657633 - DNA, 20 bp, Homo sapiens
aaataactggaacaaattat

SEQ ID NO: 3657634 - DNA, 11 bp, Homo sapiens
aaatacaaaaa

SEQ ID NO: 3657635 - DNA, 15 bp, Homo sapiens
aaataccacaagcct

SEQ ID NO: 3657636 - DNA, 19 bp, Homo sapiens
aaataccacaagcctgaga

SEQ ID NO: 3657637 - DNA, 18 bp, Homo sapiens
aaatactttttctaatga

SEQ ID NO: 3657638 - DNA, 14 bp, Homo sapiens
aaatagaaaagtta

SEQ ID NO: 3657639 - DNA, 15 bp, Homo sapiens
aaatagaaaagttat

SEQ ID NO: 3657640 - DNA, 12 bp, Homo sapiens
aaatatccaggt

SEQ ID NO: 3657641 - DNA, 16 bp, Homo sapiens
aaatatgtcctggggt

SEQ ID NO: 3657642 - DNA, 15 bp, Homo sapiens
aaatattttctattt

SEQ ID NO: 3657643 - DNA, 17 bp, Homo sapiens
aaatattttctatttta

SEQ ID NO: 3657644 - DNA, 18 bp, Homo sapiens
aaatcaacttgcttatca

SEQ ID NO: 3657645 - DNA, 19 bp, Homo sapiens
aaatcagcctgctccagct

SEQ ID NO: 3657646 - DNA, 21 bp, Homo sapiens
aaatcagcctgctccagctgt

SEQ ID NO: 3657647 - DNA, 23 bp, Homo sapiens
aaatcatgttgatcatgtacttt

SEQ ID NO: 3657648 - DNA, 15 bp, Homo sapiens
aaatcctacagtgaa

SEQ ID NO: 3657649 - DNA, 21 bp, Homo sapiens
aaatccttagatctggcatgt

SEQ ID NO: 3657650 - DNA, 14 bp, Homo sapiens
aaatctgacccagt

SEQ ID NO: 3657651 - DNA, 20 bp, Homo sapiens
aaatctgacccagtgccccc

SEQ ID NO: 3657652 - DNA, 21 bp, Homo sapiens
aaatctggcttctggccagga

SEQ ID NO: 3657653 - DNA, 20 bp, Homo sapiens
aaatctgtcaagagtagtta

SEQ ID NO: 3657654 - DNA, 15 bp, Homo sapiens
aaatctgttctaaca

SEQ ID NO: 3657655 - DNA, 16 bp, Homo sapiens
aaatgcaacaacatgt

SEQ ID NO: 3657656 - DNA, 22 bp, Homo sapiens
aaatgccctcttctcgtgcctc

SEQ ID NO: 3657657 - DNA, 13 bp, Homo sapiens
aaatgcctcttaa

SEQ ID NO: 3657658 - DNA, 14 bp, Homo sapiens
aaatgcctcttaaa

SEQ ID NO: 3657659 - DNA, 23 bp, Homo sapiens
aaatgctgctttttctcaaaatg

SEQ ID NO: 3657660 - DNA, 11 bp, Homo sapiens
aaatgcttcta

SEQ ID NO: 3657661 - DNA, 14 bp, Homo sapiens
aaatggaaattttg

SEQ ID NO: 3657662 - DNA, 23 bp, Homo sapiens
aaatggatgccttgaataataag

SEQ ID NO: 3657663 - DNA, 13 bp, Homo sapiens
aaatggggccaga

SEQ ID NO: 3657664 - DNA, 19 bp, Homo sapiens
aaatgtacagacatattta

SEQ ID NO: 3657665 - DNA, 20 bp, Homo sapiens
aaatgtacagacatatttaa

SEQ ID NO: 3657666 - DNA, 18 bp, Homo sapiens
aaatgtatgattacatca

SEQ ID NO: 3657667 - DNA, 24 bp, Homo sapiens
aaatgtctagttgtaacaccatga

SEQ ID NO: 3657668 - DNA, 16 bp, Homo sapiens
aaatgtttttctgcca

SEQ ID NO: 3657669 - DNA, 13 bp, Homo sapiens
aaattaaagctga

SEQ ID NO: 3657670 - DNA, 21 bp, Homo sapiens
aaattaacactgcttgtgttt

SEQ ID NO: 3657671 - DNA, 17 bp, Homo sapiens
aaattaagatgttcaga

SEQ ID NO: 3657672 - DNA, 13 bp, Homo sapiens
aaattacaatttt

SEQ ID NO: 3657673 - DNA, 15 bp, Homo sapiens
aaattatatatttat

SEQ ID NO: 3657674 - DNA, 22 bp, Homo sapiens
aaattatatatttattttattc

SEQ ID NO: 3657675 - DNA, 22 bp, Homo sapiens
aaattatatttgtgctatagta

SEQ ID NO: 3657676 - DNA, 12 bp, Homo sapiens
aaattcatttct

SEQ ID NO: 3657677 - DNA, 20 bp, Homo sapiens
aaattcctctttgctttgct

SEQ ID NO: 3657678 - DNA, 14 bp, Homo sapiens
aaattctcctggag

SEQ ID NO: 3657679 - DNA, 21 bp, Homo sapiens
aaattcttctaattgctgtgt

SEQ ID NO: 3657680 - DNA, 11 bp, Homo sapiens
aaattctttag

SEQ ID NO: 3657681 - DNA, 15 bp, Homo sapiens
aaattgtaccttttt

SEQ ID NO: 3657682 - DNA, 16 bp, Homo sapiens
aaatttgactaatttt

SEQ ID NO: 3657683 - DNA, 17 bp, Homo sapiens
aaatttgactaatttta

SEQ ID NO: 3657684 - DNA, 18 bp, Homo sapiens
aaatttgactaattttac

SEQ ID NO: 3657685 - DNA, 12 bp, Homo sapiens
aaattttgtaat

SEQ ID NO: 3657686 - DNA, 20 bp, Homo sapiens
aacaaaaaccaaatgtttat

SEQ ID NO: 3657687 - DNA, 24 bp, Homo sapiens
aacaaaatttgactaattttacat

SEQ ID NO: 3657688 - DNA, 14 bp, Homo sapiens
aacaaactcttcag

SEQ ID NO: 3657689 - DNA, 12 bp, Homo sapiens
aacaaaggcagc

SEQ ID NO: 3657690 - DNA, 18 bp, Homo sapiens
aacaaaggcagctgtgtc

SEQ ID NO: 3657691 - DNA, 20 bp, Homo sapiens
aacaaaggcagctgtgtctg

SEQ ID NO: 3657692 - DNA, 22 bp, Homo sapiens
aacaaatggagctttctgtata

SEQ ID NO: 3657693 - DNA, 13 bp, Homo sapiens
aacaacatgtata

SEQ ID NO: 3657694 - DNA, 18 bp, Homo sapiens
aacaagccaagaaagatg

SEQ ID NO: 3657695 - DNA, 22 bp, Homo sapiens
aacaagcctgaccctgtaaaat

SEQ ID NO: 3657696 - DNA, 15 bp, Homo sapiens
aacaatctaacaata

SEQ ID NO: 3657697 - DNA, 19 bp, Homo sapiens
aacaatctaacaataatat

SEQ ID NO: 3657698 - DNA, 17 bp, Homo sapiens
aacaatggagtattctc

SEQ ID NO: 3657699 - DNA, 19 bp, Homo sapiens
aacacaaacgggctcagca

SEQ ID NO: 3657700 - DNA, 20 bp, Homo sapiens
aacacacagatacacacaca

SEQ ID NO: 3657701 - DNA, 21 bp, Homo sapiens
aacacactgaggcagggaagt

SEQ ID NO: 3657702 - DNA, 18 bp, Homo sapiens
aacactaactatgcatgg

SEQ ID NO: 3657703 - DNA, 21 bp, Homo sapiens
aacactatatggcagtgtctt

SEQ ID NO: 3657704 - DNA, 21 bp, Homo sapiens
aacactccccattaacagatg

SEQ ID NO: 3657705 - DNA, 16 bp, Homo sapiens
aacactgtcttgaaga

SEQ ID NO: 3657706 - DNA, 17 bp, Homo sapiens
aacacttatcttctgga

SEQ ID NO: 3657707 - DNA, 11 bp, Homo sapiens
aacacttccag

SEQ ID NO: 3657708 - DNA, 21 bp, Homo sapiens
aacagatctggaacctcagcc

SEQ ID NO: 3657709 - DNA, 16 bp, Homo sapiens
aacagcctctttttga

SEQ ID NO: 3657710 - DNA, 18 bp, Homo sapiens
aacagctatgggagcccc

SEQ ID NO: 3657711 - DNA, 21 bp, Homo sapiens
aatgcaatgtaagcatacttt

SEQ ID NO: 3657712 - DNA, 13 bp, Homo sapiens
aatgcataaaatg

SEQ ID NO: 3657713 - DNA, 14 bp, Homo sapiens
aatgccaagcactt

SEQ ID NO: 3657714 - DNA, 22 bp, Homo sapiens
aatgccactgccttcgcttctt

SEQ ID NO: 3657715 - DNA, 11 bp, Homo sapiens
aatgccctctt

SEQ ID NO: 3657716 - DNA, 23 bp, Homo sapiens
aatgcctcttaaattatatattt

SEQ ID NO: 3657717 - DNA, 12 bp, Homo sapiens
aatgcgctcttt

SEQ ID NO: 3657718 - DNA, 19 bp, Homo sapiens
aatgctaatttaaagagac

SEQ ID NO: 3657719 - DNA, 22 bp, Homo sapiens
aatgctgtattagtcacagaga

SEQ ID NO: 3657720 - DNA, 17 bp, Homo sapiens
aatggaaattttgctat

SEQ ID NO: 3657721 - DNA, 22 bp, Homo sapiens
aatggatgccttgaataataag

SEQ ID NO: 3657722 - DNA, 15 bp, Homo sapiens
aatggcctcatgtgg

SEQ ID NO: 3657723 - DNA, 20 bp, Homo sapiens
aatggcctcatgtggctgga

SEQ ID NO: 3657724 - DNA, 22 bp, Homo sapiens
aatggcctcatgtggctggaag

SEQ ID NO: 3657725 - DNA, 17 bp, Homo sapiens
aatggctgtaatcattt

SEQ ID NO: 3657726 - DNA, 12 bp, Homo sapiens
aatggggccaga

SEQ ID NO: 3657727 - DNA, 22 bp, Homo sapiens
aatggggccagatccagcctgg

SEQ ID NO: 3657728 - DNA, 17 bp, Homo sapiens
aatggggtcctggccat

SEQ ID NO: 3657729 - DNA, 18 bp, Homo sapiens
aatggtttgcaaggaagc

SEQ ID NO: 3657730 - DNA, 15 bp, Homo sapiens
aatgtaaagccatgc

SEQ ID NO: 3657731 - DNA, 16 bp, Homo sapiens
aatgtaagcatacttt

SEQ ID NO: 3657732 - DNA, 21 bp, Homo sapiens
aatgtacagacatatttaact

SEQ ID NO: 3657733 - DNA, 16 bp, Homo sapiens
aatgtacagttgaaat

SEQ ID NO: 3657734 - DNA, 19 bp, Homo sapiens
aatgtaggcttagtttgtg

SEQ ID NO: 3657735 - DNA, 19 bp, Homo sapiens
aatgtatgtaggagctgca

SEQ ID NO: 3657736 - DNA, 23 bp, Homo sapiens
aatgtcctccagaagcctctggc

SEQ ID NO: 3657737 - DNA, 22 bp, Homo sapiens
aatgtctagttgtaacaccatg

SEQ ID NO: 3657738 - DNA, 14 bp, Homo sapiens
aatgtgtgttcctg

SEQ ID NO: 3657739 - DNA, 20 bp, Homo sapiens
aatgttaattttttggtaca

SEQ ID NO: 3657740 - DNA, 23 bp, Homo sapiens
aatgttatcttatactgtacaat

SEQ ID NO: 3657741 - DNA, 21 bp, Homo sapiens
aatgttctctcttctccacct

SEQ ID NO: 3657742 - DNA, 17 bp, Homo sapiens
aatgttgtatttaattt

SEQ ID NO: 3657743 - DNA, 15 bp, Homo sapiens
aatgttttaaatgta

SEQ ID NO: 3657744 - DNA, 19 bp, Homo sapiens
aatgttttaaatgtacaga

SEQ ID NO: 3657745 - DNA, 21 bp, Homo sapiens
aatgtttttctgccagggagc

SEQ ID NO: 3657746 - DNA, 16 bp, Homo sapiens
aattaaaagtcttttt

SEQ ID NO: 3657747 - DNA, 13 bp, Homo sapiens
aattaaaatggat

SEQ ID NO: 3657748 - DNA, 22 bp, Homo sapiens
aattaagttagggaatggcaca

SEQ ID NO: 3657749 - DNA, 19 bp, Homo sapiens
aattacaattttatctgtt

SEQ ID NO: 3657750 - DNA, 16 bp, Homo sapiens
aattatagtttgacag

SEQ ID NO: 3657751 - DNA, 20 bp, Homo sapiens
aattatatttgtgctatagt

SEQ ID NO: 3657752 - DNA, 12 bp, Homo sapiens
aattcatttcta

SEQ ID NO: 3657753 - DNA, 13 bp, Homo sapiens
aattcatttctaa

SEQ ID NO: 3657754 - DNA, 14 bp, Homo sapiens
aattcctagaatta

SEQ ID NO: 3657755 - DNA, 15 bp, Homo sapiens
aattctcctggaggt

SEQ ID NO: 3657756 - DNA, 20 bp, Homo sapiens
aattctctgtggaatgaata

SEQ ID NO: 3657757 - DNA, 18 bp, Homo sapiens
aattctgtttttctaggc

SEQ ID NO: 3657758 - DNA, 17 bp, Homo sapiens
aattcttacaaacatgt

SEQ ID NO: 3657759 - DNA, 18 bp, Homo sapiens
aattcttgtaatttttat

SEQ ID NO: 3657760 - DNA, 17 bp, Homo sapiens
aattcttttgaattgtt

SEQ ID NO: 3657761 - DNA, 16 bp, Homo sapiens
aattgaccaagtgatg

SEQ ID NO: 3657762 - DNA, 22 bp, Homo sapiens
aattgatcattttccccccact

SEQ ID NO: 3657763 - DNA, 20 bp, Homo sapiens
aattgcaaaaacatagaaat

SEQ ID NO: 3657764 - DNA, 20 bp, Homo sapiens
aattgcagataactttgact

SEQ ID NO: 3657765 - DNA, 15 bp, Homo sapiens
aattgctttgccaaa

SEQ ID NO: 3657766 - DNA, 18 bp, Homo sapiens
aattgctttgccaaaata

SEQ ID NO: 3657767 - DNA, 23 bp, Homo sapiens
aattgctttgtgacttcttcttc

SEQ ID NO: 3657768 - DNA, 22 bp, Homo sapiens
aattgttgaacaggtgtttttc

SEQ ID NO: 3657769 - DNA, 14 bp, Homo sapiens
aattgtttagaaat

SEQ ID NO: 3657770 - DNA, 19 bp, Homo sapiens
aatttacaggttcttaggc

SEQ ID NO: 3657771 - DNA, 13 bp, Homo sapiens
aatttagaaacta

SEQ ID NO: 3657772 - DNA, 19 bp, Homo sapiens
aatttagaaactaattgac

SEQ ID NO: 3657773 - DNA, 14 bp, Homo sapiens
aatttagtaaatgt

SEQ ID NO: 3657774 - DNA, 17 bp, Homo sapiens
aatttattaattgcttt

SEQ ID NO: 3657775 - DNA, 19 bp, Homo sapiens
aatttattaattgctttga

SEQ ID NO: 3657776 - DNA, 19 bp, Homo sapiens
aatttattgtctgtctaca

SEQ ID NO: 3657777 - DNA, 17 bp, Homo sapiens
aatttatttagttttta

SEQ ID NO: 3657778 - DNA, 14 bp, Homo sapiens
aatttcccaggacc

SEQ ID NO: 3657779 - DNA, 22 bp, Homo sapiens
aatttctttttttcctttttaa

SEQ ID NO: 3657780 - DNA, 16 bp, Homo sapiens
aatttgactaatttta

SEQ ID NO: 3657781 - DNA, 22 bp, Homo sapiens
aatttgcacatcttggctatgt

SEQ ID NO: 3657782 - DNA, 22 bp, Homo sapiens
aattttaacttttaaggttgaa

SEQ ID NO: 3657783 - DNA, 22 bp, Homo sapiens
aattttctggaaaatgcttctt

SEQ ID NO: 3657784 - DNA, 17 bp, Homo sapiens
aattttgacttaatgtg

SEQ ID NO: 3657785 - DNA, 16 bp, Homo sapiens
aattttgagattaaga

SEQ ID NO: 3657786 - DNA, 12 bp, Homo sapiens
aatttttgtatt

SEQ ID NO: 3657787 - DNA, 16 bp, Homo sapiens
acaaaaagcataaaaa

SEQ ID NO: 3657788 - DNA, 10 bp, Homo sapiens
acaaaaataa

SEQ ID NO: 3657789 - DNA, 12 bp, Homo sapiens
acaaaaataaat

SEQ ID NO: 3657790 - DNA, 14 bp, Homo sapiens
acaaaaataaattt

SEQ ID NO: 3657791 - DNA, 16 bp, Homo sapiens
acaaaaatactcagat

SEQ ID NO: 3657792 - DNA, 14 bp, Homo sapiens
acaaaactgcattt

SEQ ID NO: 3657793 - DNA, 16 bp, Homo sapiens
acaaaactgcatttca

SEQ ID NO: 3657794 - DNA, 15 bp, Homo sapiens
acaaacgggctcagc

SEQ ID NO: 3657795 - DNA, 20 bp, Homo sapiens
acaaactcttcagttaattc

SEQ ID NO: 3657796 - DNA, 19 bp, Homo sapiens
acaaactgtaatacaatga

SEQ ID NO: 3657797 - DNA, 12 bp, Homo sapiens
acaaagaacctt

SEQ ID NO: 3657798 - DNA, 17 bp, Homo sapiens
acaaagagatgtccttg

SEQ ID NO: 3657799 - DNA, 18 bp, Homo sapiens
acaaagattgagaagcca

SEQ ID NO: 3657800 - DNA, 22 bp, Homo sapiens
acaaagctaggatggttctgtg

SEQ ID NO: 3657801 - DNA, 13 bp, Homo sapiens
acaaaggcagctg

SEQ ID NO: 3657802 - DNA, 21 bp, Homo sapiens
acaaaggcagctgtgtctgag

SEQ ID NO: 3657803 - DNA, 14 bp, Homo sapiens
acaaaggcatgctg

SEQ ID NO: 3657804 - DNA, 19 bp, Homo sapiens
acaaatattcactggcccc

SEQ ID NO: 3657805 - DNA, 18 bp, Homo sapiens
acaaatgtaaacattttc

SEQ ID NO: 3657806 - DNA, 23 bp, Homo sapiens
acaacagttacataattcactct

SEQ ID NO: 3657807 - DNA, 14 bp, Homo sapiens
acaactatttttgt

SEQ ID NO: 3657808 - DNA, 18 bp, Homo sapiens
acaagagcagcctgtggc

SEQ ID NO: 3657809 - DNA, 22 bp, Homo sapiens
acaagccagaacttgaccctga

SEQ ID NO: 3657810 - DNA, 13 bp, Homo sapiens
acaagcctgagaa

SEQ ID NO: 3657811 - DNA, 13 bp, Homo sapiens
acaagctgcaccc

SEQ ID NO: 3657812 - DNA, 22 bp, Homo sapiens
acaagctgcaccctcaggcagg

SEQ ID NO: 3657813 - DNA, 17 bp, Homo sapiens
acaaggatagatgctgg

SEQ ID NO: 3657814 - DNA, 21 bp, Homo sapiens
acaaggatagatgctggccca

SEQ ID NO: 3657815 - DNA, 16 bp, Homo sapiens
acaaggtctttaaagt

SEQ ID NO: 3657816 - DNA, 18 bp, Homo sapiens
acaagtgattttcattgt

SEQ ID NO: 3657817 - DNA, 16 bp, Homo sapiens
acaagtttatatatat

SEQ ID NO: 3657818 - DNA, 12 bp, Homo sapiens
acaataatttta

SEQ ID NO: 3657819 - DNA, 12 bp, Homo sapiens
acaatctaacaa

SEQ ID NO: 3657820 - DNA, 21 bp, Homo sapiens
acaatctaacaataatatttc

SEQ ID NO: 3657821 - DNA, 22 bp, Homo sapiens
acaatctaacaataatatttca

SEQ ID NO: 3657822 - DNA, 23 bp, Homo sapiens
acaatctcagctcactgtgacct

SEQ ID NO: 3657823 - DNA, 12 bp, Homo sapiens
acaatctgagca

SEQ ID NO: 3657824 - DNA, 20 bp, Homo sapiens
acaatgatcctgtattcaga

SEQ ID NO: 3657825 - DNA, 16 bp, Homo sapiens
acaatggtttttaaat

SEQ ID NO: 3657826 - DNA, 22 bp, Homo sapiens
acaatgtcatatactgccatgt

SEQ ID NO: 3657827 - DNA, 18 bp, Homo sapiens
acatgcataagaaatgta

SEQ ID NO: 3657828 - DNA, 14 bp, Homo sapiens
acatgccacaagga

SEQ ID NO: 3657829 - DNA, 16 bp, Homo sapiens
acatgggtattttata

SEQ ID NO: 3657830 - DNA, 21 bp, Homo sapiens
acatgtaactatttcttcaga

SEQ ID NO: 3657831 - DNA, 11 bp, Homo sapiens
acatgtttcct

SEQ ID NO: 3657832 - DNA, 16 bp, Homo sapiens
acatgtttcctctagt

SEQ ID NO: 3657833 - DNA, 21 bp, Homo sapiens
acattaaaggcataaatgact

SEQ ID NO: 3657834 - DNA, 19 bp, Homo sapiens
acattactctgcctctgta

SEQ ID NO: 3657835 - DNA, 23 bp, Homo sapiens
acattcttggcttaatcattttc

SEQ ID NO: 3657836 - DNA, 23 bp, Homo sapiens
acattgccaaaaaggatacataa

SEQ ID NO: 3657837 - DNA, 18 bp, Homo sapiens
acattgcctttgaatgtt

SEQ ID NO: 3657838 - DNA, 14 bp, Homo sapiens
acattgtacttaaa

SEQ ID NO: 3657839 - DNA, 15 bp, Homo sapiens
acatttaaattccac

SEQ ID NO: 3657840 - DNA, 13 bp, Homo sapiens
acatttactgaaa

SEQ ID NO: 3657841 - DNA, 15 bp, Homo sapiens
acatttccaagctgt

SEQ ID NO: 3657842 - DNA, 14 bp, Homo sapiens
acatttctctaact

SEQ ID NO: 3657843 - DNA, 18 bp, Homo sapiens
acattttaaaaacataga

SEQ ID NO: 3657844 - DNA, 23 bp, Homo sapiens
acattttaaaaacatagaaaaat

SEQ ID NO: 3657845 - DNA, 13 bp, Homo sapiens
acatttttgtctg

SEQ ID NO: 3657846 - DNA, 23 bp, Homo sapiens
acatttttgtggttttgagaaag

SEQ ID NO: 3657847 - DNA, 12 bp, Homo sapiens
acattttttaaa

SEQ ID NO: 3657848 - DNA, 18 bp, Homo sapiens
accaaactgttaaatgtg

SEQ ID NO: 3657849 - DNA, 19 bp, Homo sapiens
accaaagtgtcttttgaca

SEQ ID NO: 3657850 - DNA, 21 bp, Homo sapiens
accaaagtgtcttttgacatt

SEQ ID NO: 3657851 - DNA, 20 bp, Homo sapiens
accaaatcacccaatcccag

SEQ ID NO: 3657852 - DNA, 13 bp, Homo sapiens
accaaatctggaa

SEQ ID NO: 3657853 - DNA, 18 bp, Homo sapiens
accaaatgtttattttct

SEQ ID NO: 3657854 - DNA, 13 bp, Homo sapiens
accaagcaggaag

SEQ ID NO: 3657855 - DNA, 14 bp, Homo sapiens
accaagcaggaagc

SEQ ID NO: 3657856 - DNA, 15 bp, Homo sapiens
accaagcaggaagct

SEQ ID NO: 3657857 - DNA, 14 bp, Homo sapiens
accaagcatcttgg

SEQ ID NO: 3657858 - DNA, 13 bp, Homo sapiens
accaatgggaagc

SEQ ID NO: 3657859 - DNA, 19 bp, Homo sapiens
accaatgggaagcagggaa

SEQ ID NO: 3657860 - DNA, 15 bp, Homo sapiens
accacaagcctgaga

SEQ ID NO: 3657861 - DNA, 11 bp, Homo sapiens
accacacaaag

SEQ ID NO: 3657862 - DNA, 16 bp, Homo sapiens
accacagccagcacct

SEQ ID NO: 3657863 - DNA, 14 bp, Homo sapiens
accacatcctccgt

SEQ ID NO: 3657864 - DNA, 23 bp, Homo sapiens
accacgcccgtcctgcctgtggc

SEQ ID NO: 3657865 - DNA, 17 bp, Homo sapiens
accactctgtggccagc

SEQ ID NO: 3657866 - DNA, 19 bp, Homo sapiens
accactctgtggccagcct

SEQ ID NO: 3657867 - DNA, 20 bp, Homo sapiens
accactctgtggccagcctg

SEQ ID NO: 3657868 - DNA, 17 bp, Homo sapiens
accactgcactccagcc

SEQ ID NO: 3657869 - DNA, 20 bp, Homo sapiens
accactttcttattctgtat

SEQ ID NO: 3657870 - DNA, 13 bp, Homo sapiens
accagaagggaaa

SEQ ID NO: 3657871 - DNA, 15 bp, Homo sapiens
accagacacccagga

SEQ ID NO: 3657872 - DNA, 18 bp, Homo sapiens
accagagccttcaagtgc

SEQ ID NO: 3657873 - DNA, 14 bp, Homo sapiens
accagatgcagctc

SEQ ID NO: 3657874 - DNA, 13 bp, Homo sapiens
accagcagcctgg

SEQ ID NO: 3657875 - DNA, 12 bp, Homo sapiens
accagcctggcc

SEQ ID NO: 3657876 - DNA, 22 bp, Homo sapiens
accagcgtgtgactactccccc

SEQ ID NO: 3657877 - DNA, 15 bp, Homo sapiens
accaggactccctcc

SEQ ID NO: 3657878 - DNA, 18 bp, Homo sapiens
accaggagaaccactaca

SEQ ID NO: 3657879 - DNA, 19 bp, Homo sapiens
accaggagaaccactacat

SEQ ID NO: 3657880 - DNA, 13 bp, Homo sapiens
accaggctgtgtc

SEQ ID NO: 3657881 - DNA, 19 bp, Homo sapiens
accagggcaaggccccttc

SEQ ID NO: 3657882 - DNA, 13 bp, Homo sapiens
accagggcctttt

SEQ ID NO: 3657883 - DNA, 23 bp, Homo sapiens
accagggccttttctggcaccgc

SEQ ID NO: 3657884 - DNA, 16 bp, Homo sapiens
accaggggtttctcgc

SEQ ID NO: 3657885 - DNA, 22 bp, Homo sapiens
accaggtgcctttcaaatttag

SEQ ID NO: 3657886 - DNA, 15 bp, Homo sapiens
accagtccccccacc

SEQ ID NO: 3657887 - DNA, 15 bp, Homo sapiens
accatactgagggac

SEQ ID NO: 3657888 - DNA, 16 bp, Homo sapiens
accatatgaacatata

SEQ ID NO: 3657889 - DNA, 13 bp, Homo sapiens
accatctttctga

SEQ ID NO: 3657890 - DNA, 17 bp, Homo sapiens
accatctttctgattcc

SEQ ID NO: 3657891 - DNA, 23 bp, Homo sapiens
accatgattaaccacttcagctg

SEQ ID NO: 3657892 - DNA, 19 bp, Homo sapiens
accatgctcatctgctggt

SEQ ID NO: 3657893 - DNA, 14 bp, Homo sapiens
accatgtacatagc

SEQ ID NO: 3657894 - DNA, 13 bp, Homo sapiens
accattaaccaga

SEQ ID NO: 3657895 - DNA, 24 bp, Homo sapiens
accattctgactcggtttctccaa

SEQ ID NO: 3657896 - DNA, 18 bp, Homo sapiens
acccaaagctgagcctgc

SEQ ID NO: 3657897 - DNA, 23 bp, Homo sapiens
acccaacggccctgcagccagct

SEQ ID NO: 3657898 - DNA, 20 bp, Homo sapiens
acccaagtatacaataaagt

SEQ ID NO: 3657899 - DNA, 14 bp, Homo sapiens
acccaatcccagtt

SEQ ID NO: 3657900 - DNA, 15 bp, Homo sapiens
acccacaatctgagc

SEQ ID NO: 3657901 - DNA, 16 bp, Homo sapiens
acccacaatctgagca

SEQ ID NO: 3657902 - DNA, 22 bp, Homo sapiens
acccaccactggaagcaggatg

SEQ ID NO: 3657903 - DNA, 15 bp, Homo sapiens
acccagactcagaca

SEQ ID NO: 3657904 - DNA, 23 bp, Homo sapiens
acccagcgggcaggttctgcctg

SEQ ID NO: 3657905 - DNA, 15 bp, Homo sapiens
acccagcgtggcctc

SEQ ID NO: 3657906 - DNA, 23 bp, Homo sapiens
acccaggaggcagaggttgcagt

SEQ ID NO: 3657907 - DNA, 20 bp, Homo sapiens
acccaggctggagtgcagtg

SEQ ID NO: 3657908 - DNA, 12 bp, Homo sapiens
acccagtgcaga

SEQ ID NO: 3657909 - DNA, 15 bp, Homo sapiens
acccagtgcccccac

SEQ ID NO: 3657910 - DNA, 22 bp, Homo sapiens
acccatctgcacccccctgggc

SEQ ID NO: 3657911 - DNA, 13 bp, Homo sapiens
acccatctgtagt

SEQ ID NO: 3657912 - DNA, 16 bp, Homo sapiens
accccaagaccaagct

SEQ ID NO: 3657913 - DNA, 21 bp, Homo sapiens
accccacacttgttccagctc

SEQ ID NO: 3657914 - DNA, 18 bp, Homo sapiens
accccatctctacaaaaa

SEQ ID NO: 3657915 - DNA, 17 bp, Homo sapiens
acccccacacctcagtt

SEQ ID NO: 3657916 - DNA, 12 bp, Homo sapiens
acccccacccca

SEQ ID NO: 3657917 - DNA, 16 bp, Homo sapiens
acccccaccccacact

SEQ ID NO: 3657918 - DNA, 15 bp, Homo sapiens
acccccctgggctga

SEQ ID NO: 3657919 - DNA, 17 bp, Homo sapiens
accccgcagacaccttg

SEQ ID NO: 3657920 - DNA, 15 bp, Homo sapiens
accccgggctctctg

SEQ ID NO: 3657921 - DNA, 20 bp, Homo sapiens
acccctcaacacctctgcac

SEQ ID NO: 3657922 - DNA, 16 bp, Homo sapiens
accccttagcctccct

SEQ ID NO: 3657923 - DNA, 17 bp, Homo sapiens
accccttcctcagcctg

SEQ ID NO: 3657924 - DNA, 18 bp, Homo sapiens
accccttcctcagcctgg

SEQ ID NO: 3657925 - DNA, 20 bp, Homo sapiens
acccggcccatatccctggt

SEQ ID NO: 3657926 - DNA, 22 bp, Homo sapiens
accctacttcattttcagagtg

SEQ ID NO: 3657927 - DNA, 23 bp, Homo sapiens
accctacttcattttcagagtga

SEQ ID NO: 3657928 - DNA, 22 bp, Homo sapiens
accctagtcccttcccctccct

SEQ ID NO: 3657929 - DNA, 19 bp, Homo sapiens
accctattgctgcttgagg

SEQ ID NO: 3657930 - DNA, 14 bp, Homo sapiens
accctcaggcaggt

SEQ ID NO: 3657931 - DNA, 20 bp, Homo sapiens
accctccagtgctggatttg

SEQ ID NO: 3657932 - DNA, 15 bp, Homo sapiens
accctcctgctgagc

SEQ ID NO: 3657933 - DNA, 18 bp, Homo sapiens
accctcctgctgagctgc

SEQ ID NO: 3657934 - DNA, 20 bp, Homo sapiens
accctcctgctgagctgccc

SEQ ID NO: 3657935 - DNA, 14 bp, Homo sapiens
accctctttgctga

SEQ ID NO: 3657936 - DNA, 16 bp, Homo sapiens
accctgaaagccctga

SEQ ID NO: 3657937 - DNA, 12 bp, Homo sapiens
accctgaagggg

SEQ ID NO: 3657938 - DNA, 18 bp, Homo sapiens
accctgaaggggccatga

SEQ ID NO: 3657939 - DNA, 22 bp, Homo sapiens
accctgagctgaccagccgtga

SEQ ID NO: 3657940 - DNA, 17 bp, Homo sapiens
accctgcctacgccagg

SEQ ID NO: 3657941 - DNA, 19 bp, Homo sapiens
accctgtccaaactgccta

SEQ ID NO: 3657942 - DNA, 12 bp, Homo sapiens
acccttggcctg

SEQ ID NO: 3657943 - DNA, 22 bp, Homo sapiens
accctttgctgtgaggctgtcc

SEQ ID NO: 3657944 - DNA, 17 bp, Homo sapiens
atataatatctaaagtt

SEQ ID NO: 3657945 - DNA, 20 bp, Homo sapiens
atataatatctaaagttata

SEQ ID NO: 3657946 - DNA, 14 bp, Homo sapiens
atatacatatatat

SEQ ID NO: 3657947 - DNA, 17 bp, Homo sapiens
atatactgcttgtcatc

SEQ ID NO: 3657948 - DNA, 18 bp, Homo sapiens
atatataacatatatgga

SEQ ID NO: 3657949 - DNA, 14 bp, Homo sapiens
atatatactattaa

SEQ ID NO: 3657950 - DNA, 11 bp, Homo sapiens
atatatataat

SEQ ID NO: 3657951 - DNA, 17 bp, Homo sapiens
atatatctctatttgag

SEQ ID NO: 3657952 - DNA, 10 bp, Homo sapiens
atatatgtat

SEQ ID NO: 3657953 - DNA, 13 bp, Homo sapiens
atatatttaagca

SEQ ID NO: 3657954 - DNA, 22 bp, Homo sapiens
atatatttattttattctatgt

SEQ ID NO: 3657955 - DNA, 17 bp, Homo sapiens
atatatttctattatta

SEQ ID NO: 3657956 - DNA, 23 bp, Homo sapiens
atatatttctattattaattgca

SEQ ID NO: 3657957 - DNA, 13 bp, Homo sapiens
atatattttaatt

SEQ ID NO: 3657958 - DNA, 12 bp, Homo sapiens
atatcaaatgca

SEQ ID NO: 3657959 - DNA, 13 bp, Homo sapiens
atatcctgcttga

SEQ ID NO: 3657960 - DNA, 16 bp, Homo sapiens
atatctaaagttatat

SEQ ID NO: 3657961 - DNA, 19 bp, Homo sapiens
atatctaaagttatatttc

SEQ ID NO: 3657962 - DNA, 20 bp, Homo sapiens
atatctaaagttatatttca

SEQ ID NO: 3657963 - DNA, 15 bp, Homo sapiens
atatctatatatata

SEQ ID NO: 3657964 - DNA, 17 bp, Homo sapiens
atatctatatatataat

SEQ ID NO: 3657965 - DNA, 13 bp, Homo sapiens
atatctctatttg

SEQ ID NO: 3657966 - DNA, 13 bp, Homo sapiens
atatgaacatata

SEQ ID NO: 3657967 - DNA, 20 bp, Homo sapiens
atatgatttaaatcagccgt

SEQ ID NO: 3657968 - DNA, 20 bp, Homo sapiens
atatggaaaaaatgtatgtg

SEQ ID NO: 3657969 - DNA, 14 bp, Homo sapiens
atatggtatatata

SEQ ID NO: 3657970 - DNA, 15 bp, Homo sapiens
atatggtatatatac

SEQ ID NO: 3657971 - DNA, 11 bp, Homo sapiens
atatgtaccaa

SEQ ID NO: 3657972 - DNA, 11 bp, Homo sapiens
atatgtcctgg

SEQ ID NO: 3657973 - DNA, 23 bp, Homo sapiens
atatgttaagcagctaaattttc

SEQ ID NO: 3657974 - DNA, 12 bp, Homo sapiens
atattaatgtac

SEQ ID NO: 3657975 - DNA, 12 bp, Homo sapiens
atattatgctgc

SEQ ID NO: 3657976 - DNA, 13 bp, Homo sapiens
atattatgctgct

SEQ ID NO: 3657977 - DNA, 14 bp, Homo sapiens
atattatgctgctt

SEQ ID NO: 3657978 - DNA, 19 bp, Homo sapiens
atattggacaaagaacctt

SEQ ID NO: 3657979 - DNA, 15 bp, Homo sapiens
atatttaaaaatgtc

SEQ ID NO: 3657980 - DNA, 18 bp, Homo sapiens
atatttaaaaatgtcttg

SEQ ID NO: 3657981 - DNA, 18 bp, Homo sapiens
atatttaagcaacatctt

SEQ ID NO: 3657982 - DNA, 23 bp, Homo sapiens
atatttcaagtgcctagactgtt

SEQ ID NO: 3657983 - DNA, 19 bp, Homo sapiens
atatttcagatgtaatgtt

SEQ ID NO: 3657984 - DNA, 21 bp, Homo sapiens
atatttcagatgtaatgtttt

SEQ ID NO: 3657985 - DNA, 21 bp, Homo sapiens
atatttgtgaatataatttta

SEQ ID NO: 3657986 - DNA, 22 bp, Homo sapiens
atatttgtgctatagtatttga

SEQ ID NO: 3657987 - DNA, 13 bp, Homo sapiens
atattttctattt

SEQ ID NO: 3657988 - DNA, 14 bp, Homo sapiens
atattttctatttt

SEQ ID NO: 3657989 - DNA, 20 bp, Homo sapiens
atcaaagaggttttaaaaaa

SEQ ID NO: 3657990 - DNA, 19 bp, Homo sapiens
atcaaatgcagtatatttc

SEQ ID NO: 3657991 - DNA, 17 bp, Homo sapiens
atcaacaataaaatttt

SEQ ID NO: 3657992 - DNA, 19 bp, Homo sapiens
atcaagcttagtgagcagt

SEQ ID NO: 3657993 - DNA, 18 bp, Homo sapiens
atcaaggccttattggaa

SEQ ID NO: 3657994 - DNA, 22 bp, Homo sapiens
atcaaggccttattggaaagca

SEQ ID NO: 3657995 - DNA, 13 bp, Homo sapiens
atcaagtctgttt

SEQ ID NO: 3657996 - DNA, 22 bp, Homo sapiens
atcaagttggcttctaatcaaa

SEQ ID NO: 3657997 - DNA, 20 bp, Homo sapiens
atcaattaactgagtagctc

SEQ ID NO: 3657998 - DNA, 18 bp, Homo sapiens
atcacacttctgtgagac

SEQ ID NO: 3657999 - DNA, 13 bp, Homo sapiens
atcacagcctctg

SEQ ID NO: 3658000 - DNA, 21 bp, Homo sapiens
atcacagcctctgaaaaccaa

SEQ ID NO: 3658001 - DNA, 18 bp, Homo sapiens
atcacagcttcagccagg

SEQ ID NO: 3658002 - DNA, 20 bp, Homo sapiens
atcacagggttgggcccaga

SEQ ID NO: 3658003 - DNA, 23 bp, Homo sapiens
atcacagggttgggcccagatct

SEQ ID NO: 3658004 - DNA, 17 bp, Homo sapiens
atcacagtctcagttct

SEQ ID NO: 3658005 - DNA, 13 bp, Homo sapiens
atcaccagacagg

SEQ ID NO: 3658006 - DNA, 16 bp, Homo sapiens
atcacccaatcccagt

SEQ ID NO: 3658007 - DNA, 17 bp, Homo sapiens
atcacccaatcccagtt

SEQ ID NO: 3658008 - DNA, 16 bp, Homo sapiens
atcacctcattctgaa

SEQ ID NO: 3658009 - DNA, 18 bp, Homo sapiens
atcacctcattctgaacc

SEQ ID NO: 3658010 - DNA, 18 bp, Homo sapiens
atcaccttaggcagggaa

SEQ ID NO: 3658011 - DNA, 16 bp, Homo sapiens
atcactgcacctcttt

SEQ ID NO: 3658012 - DNA, 12 bp, Homo sapiens
atcagcaaaaaa

SEQ ID NO: 3658013 - DNA, 17 bp, Homo sapiens
atcagcctgctccagct

SEQ ID NO: 3658014 - DNA, 18 bp, Homo sapiens
atcagcctgctccagctg

SEQ ID NO: 3658015 - DNA, 20 bp, Homo sapiens
atcagcctgctccagctgtt

SEQ ID NO: 3658016 - DNA, 14 bp, Homo sapiens
atcaggtgcccctc

SEQ ID NO: 3658017 - DNA, 16 bp, Homo sapiens
atcaggtgcccctctt

SEQ ID NO: 3658018 - DNA, 16 bp, Homo sapiens
atcatcattattatta

SEQ ID NO: 3658019 - DNA, 19 bp, Homo sapiens
atcatctaattctctgtgg

SEQ ID NO: 3658020 - DNA, 23 bp, Homo sapiens
atcatctgaaggggcaaattctt

SEQ ID NO: 3658021 - DNA, 17 bp, Homo sapiens
atcatgtactttttagt

SEQ ID NO: 3658022 - DNA, 14 bp, Homo sapiens
atcattgatgatca

SEQ ID NO: 3658023 - DNA, 14 bp, Homo sapiens
atcattttcccccc

SEQ ID NO: 3658024 - DNA, 13 bp, Homo sapiens
atccaaaagaagc

SEQ ID NO: 3658025 - DNA, 19 bp, Homo sapiens
atccaaaagaagcccccag

SEQ ID NO: 3658026 - DNA, 22 bp, Homo sapiens
atccaatgctcaagaaacaact

SEQ ID NO: 3658027 - DNA, 21 bp, Homo sapiens
atccacccctgcgtcgagctg

SEQ ID NO: 3658028 - DNA, 22 bp, Homo sapiens
atccacccctgcgtcgagctgg

SEQ ID NO: 3658029 - DNA, 16 bp, Homo sapiens
atccactctaccctcc

SEQ ID NO: 3658030 - DNA, 17 bp, Homo sapiens
atccagctacaggagag

SEQ ID NO: 3658031 - DNA, 15 bp, Homo sapiens
atccagctaccacca

SEQ ID NO: 3658032 - DNA, 23 bp, Homo sapiens
atccaggactatatttgggcctg

SEQ ID NO: 3658033 - DNA, 19 bp, Homo sapiens
atccaggcagatccaggac

SEQ ID NO: 3658034 - DNA, 20 bp, Homo sapiens
atccagggacagaggcccca

SEQ ID NO: 3658035 - DNA, 12 bp, Homo sapiens
atcccacacagg

SEQ ID NO: 3658036 - DNA, 15 bp, Homo sapiens
atcccatttaaaaaa

SEQ ID NO: 3658037 - DNA, 21 bp, Homo sapiens
atccccaggggtcccagccac

SEQ ID NO: 3658038 - DNA, 20 bp, Homo sapiens
atccccccatcttgcttccc

SEQ ID NO: 3658039 - DNA, 15 bp, Homo sapiens
atcccctgtagagtg

SEQ ID NO: 3658040 - DNA, 14 bp, Homo sapiens
atcccggctccaga

SEQ ID NO: 3658041 - DNA, 21 bp, Homo sapiens
atccctaccccctaagagcca

SEQ ID NO: 3658042 - DNA, 21 bp, Homo sapiens
atccctcccccccatgcactg

SEQ ID NO: 3658043 - DNA, 15 bp, Homo sapiens
atccctgccagctct

SEQ ID NO: 3658044 - DNA, 16 bp, Homo sapiens
atccgagggcccctct

SEQ ID NO: 3658045 - DNA, 13 bp, Homo sapiens
atccgcctggccc

SEQ ID NO: 3658046 - DNA, 14 bp, Homo sapiens
atccgcctggcccg

SEQ ID NO: 3658047 - DNA, 14 bp, Homo sapiens
atcctaagggaaga

SEQ ID NO: 3658048 - DNA, 12 bp, Homo sapiens
atcctaatgaat

SEQ ID NO: 3658049 - DNA, 21 bp, Homo sapiens
atcctagcacttgtctcagga

SEQ ID NO: 3658050 - DNA, 12 bp, Homo sapiens
atcctatgctta

SEQ ID NO: 3658051 - DNA, 11 bp, Homo sapiens
atcctccagca

SEQ ID NO: 3658052 - DNA, 14 bp, Homo sapiens
atcctcctgttctg

SEQ ID NO: 3658053 - DNA, 17 bp, Homo sapiens
atcctggaggcccagtt

SEQ ID NO: 3658054 - DNA, 21 bp, Homo sapiens
atcctggaggtcttttctagt

SEQ ID NO: 3658055 - DNA, 23 bp, Homo sapiens
atcctgggtggtctgcaggcagg

SEQ ID NO: 3658056 - DNA, 18 bp, Homo sapiens
atcctgtattcagacaga

SEQ ID NO: 3658057 - DNA, 21 bp, Homo sapiens
atcctgtattcagacagatga

SEQ ID NO: 3658058 - DNA, 19 bp, Homo sapiens
atcctgtttgtatgaaatt

SEQ ID NO: 3658059 - DNA, 17 bp, Homo sapiens
atcctttacgtgtttaa

SEQ ID NO: 3658060 - DNA, 23 bp, Homo sapiens
atcgatgggggagtctgaagcag

SEQ ID NO: 3658061 - DNA, 20 bp, Homo sapiens
caatggggcggggcttctct

SEQ ID NO: 3658062 - DNA, 23 bp, Homo sapiens
caatgggtttttccctgtacagt

SEQ ID NO: 3658063 - DNA, 20 bp, Homo sapiens
caatggtttgcaaggaagcc

SEQ ID NO: 3658064 - DNA, 18 bp, Homo sapiens
caatggtttttaaatttt

SEQ ID NO: 3658065 - DNA, 23 bp, Homo sapiens
caatggtttttaaattttgtaat

SEQ ID NO: 3658066 - DNA, 19 bp, Homo sapiens
caatgtgaaaagaaaaatg

SEQ ID NO: 3658067 - DNA, 20 bp, Homo sapiens
caatgtgaggggtccctagc

SEQ ID NO: 3658068 - DNA, 17 bp, Homo sapiens
caatgtgataaaacccc

SEQ ID NO: 3658069 - DNA, 20 bp, Homo sapiens
caatgtgtggctgaagactt

SEQ ID NO: 3658070 - DNA, 23 bp, Homo sapiens
caattctgtttttaatgctattt

SEQ ID NO: 3658071 - DNA, 18 bp, Homo sapiens
caattcttacaaacatgt

SEQ ID NO: 3658072 - DNA, 21 bp, Homo sapiens
caattgctttgtgacttcttc

SEQ ID NO: 3658073 - DNA, 17 bp, Homo sapiens
caatttccaagagctga

SEQ ID NO: 3658074 - DNA, 20 bp, Homo sapiens
caatttctgtgttgccaagc

SEQ ID NO: 3658075 - DNA, 18 bp, Homo sapiens
caattttaatttagtaaa

SEQ ID NO: 3658076 - DNA, 15 bp, Homo sapiens
caattttatctgttt

SEQ ID NO: 3658077 - DNA, 15 bp, Homo sapiens
cacaaaatctgtcca

SEQ ID NO: 3658078 - DNA, 17 bp, Homo sapiens
cacaaagactccttcgt

SEQ ID NO: 3658079 - DNA, 19 bp, Homo sapiens
cacaaaggcatgctggagt

SEQ ID NO: 3658080 - DNA, 23 bp, Homo sapiens
cacaagctgcaccctcaggcagg

SEQ ID NO: 3658081 - DNA, 12 bp, Homo sapiens
cacaaggacttc

SEQ ID NO: 3658082 - DNA, 14 bp, Homo sapiens
cacaaggacttcct

SEQ ID NO: 3658083 - DNA, 17 bp, Homo sapiens
cacaaggatagatgctg

SEQ ID NO: 3658084 - DNA, 22 bp, Homo sapiens
cacaaggatagatgctggccca

SEQ ID NO: 3658085 - DNA, 19 bp, Homo sapiens
cacaatctcagctcactgt

SEQ ID NO: 3658086 - DNA, 14 bp, Homo sapiens
cacaatctgagcac

SEQ ID NO: 3658087 - DNA, 17 bp, Homo sapiens
cacaatctgagcacgct

SEQ ID NO: 3658088 - DNA, 20 bp, Homo sapiens
cacaatctggcttagtgcca

SEQ ID NO: 3658089 - DNA, 17 bp, Homo sapiens
cacacaaaggcatgctg

SEQ ID NO: 3658090 - DNA, 19 bp, Homo sapiens
cacacaaaggcatgctgga

SEQ ID NO: 3658091 - DNA, 20 bp, Homo sapiens
cacacaaaggcatgctggag

SEQ ID NO: 3658092 - DNA, 10 bp, Homo sapiens
cacacacaca

SEQ ID NO: 3658093 - DNA, 11 bp, Homo sapiens
cacacacacac

SEQ ID NO: 3658094 - DNA, 13 bp, Homo sapiens
cacacacacacaa

SEQ ID NO: 3658095 - DNA, 14 bp, Homo sapiens
cacacacacacaca

SEQ ID NO: 3658096 - DNA, 13 bp, Homo sapiens
cacacacctgtag

SEQ ID NO: 3658097 - DNA, 19 bp, Homo sapiens
cacacagcacttcaaagaa

SEQ ID NO: 3658098 - DNA, 16 bp, Homo sapiens
cacaccacatctaagc

SEQ ID NO: 3658099 - DNA, 14 bp, Homo sapiens
cacaccaggataga

SEQ ID NO: 3658100 - DNA, 14 bp, Homo sapiens
cacacccaaagctg

SEQ ID NO: 3658101 - DNA, 15 bp, Homo sapiens
cacacccaaagctga

SEQ ID NO: 3658102 - DNA, 12 bp, Homo sapiens
cacaccgccatc

SEQ ID NO: 3658103 - DNA, 14 bp, Homo sapiens
cacaccgccatcct

SEQ ID NO: 3658104 - DNA, 18 bp, Homo sapiens
cacaccgccatcctctgc

SEQ ID NO: 3658105 - DNA, 19 bp, Homo sapiens
cacaccgtcaggtactcct

SEQ ID NO: 3658106 - DNA, 17 bp, Homo sapiens
cacacctcagttccctt

SEQ ID NO: 3658107 - DNA, 21 bp, Homo sapiens
cacacctcagttcccttggcc

SEQ ID NO: 3658108 - DNA, 22 bp, Homo sapiens
cacacggacactcaaaagctgg

SEQ ID NO: 3658109 - DNA, 15 bp, Homo sapiens
cacactccatcagct

SEQ ID NO: 3658110 - DNA, 16 bp, Homo sapiens
cacactgaggcaggga

SEQ ID NO: 3658111 - DNA, 18 bp, Homo sapiens
cacactgaggcagggaag

SEQ ID NO: 3658112 - DNA, 15 bp, Homo sapiens
cacacttctgtgaga

SEQ ID NO: 3658113 - DNA, 16 bp, Homo sapiens
cacacttgttccagct

SEQ ID NO: 3658114 - DNA, 19 bp, Homo sapiens
cacacttgttccagctctt

SEQ ID NO: 3658115 - DNA, 20 bp, Homo sapiens
cacacttgttccagctcttt

SEQ ID NO: 3658116 - DNA, 22 bp, Homo sapiens
cacagagacccccggaacaagc

SEQ ID NO: 3658117 - DNA, 16 bp, Homo sapiens
cacagatacacacaca

SEQ ID NO: 3658118 - DNA, 19 bp, Homo sapiens
cacagatcacagcttcagc

SEQ ID NO: 3658119 - DNA, 20 bp, Homo sapiens
cacagccagcacctggcatc

SEQ ID NO: 3658120 - DNA, 19 bp, Homo sapiens
cacagcccaaagaaggaaa

SEQ ID NO: 3658121 - DNA, 13 bp, Homo sapiens
cacagccctgaga

SEQ ID NO: 3658122 - DNA, 21 bp, Homo sapiens
cacagcggaggtgtggagccg

SEQ ID NO: 3658123 - DNA, 21 bp, Homo sapiens
cacagcggagtctgtcctgtg

SEQ ID NO: 3658124 - DNA, 14 bp, Homo sapiens
cacagctgtagtgg

SEQ ID NO: 3658125 - DNA, 16 bp, Homo sapiens
cacagcttcccctctc

SEQ ID NO: 3658126 - DNA, 20 bp, Homo sapiens
cacagcttgacctgaggctg

SEQ ID NO: 3658127 - DNA, 21 bp, Homo sapiens
cacagcttgacctgaggctgt

SEQ ID NO: 3658128 - DNA, 22 bp, Homo sapiens
cacagcttgacctgaggctgtg

SEQ ID NO: 3658129 - DNA, 15 bp, Homo sapiens
cacagctttgaggaa

SEQ ID NO: 3658130 - DNA, 15 bp, Homo sapiens
cacagggtctgctct

SEQ ID NO: 3658131 - DNA, 19 bp, Homo sapiens
cacagggtctgctctttct

SEQ ID NO: 3658132 - DNA, 23 bp, Homo sapiens
cacagggtctgctctttctctgc

SEQ ID NO: 3658133 - DNA, 16 bp, Homo sapiens
cacagggttgggccca

SEQ ID NO: 3658134 - DNA, 15 bp, Homo sapiens
cacagtctcagttct

SEQ ID NO: 3658135 - DNA, 14 bp, Homo sapiens
cacatatatattac

SEQ ID NO: 3658136 - DNA, 22 bp, Homo sapiens
cacatccgcgtgtgcctgtgtg

SEQ ID NO: 3658137 - DNA, 18 bp, Homo sapiens
cacatcctccgtccagcc

SEQ ID NO: 3658138 - DNA, 18 bp, Homo sapiens
cacatggctatgttttag

SEQ ID NO: 3658139 - DNA, 14 bp, Homo sapiens
cacatgtttcctct

SEQ ID NO: 3658140 - DNA, 13 bp, Homo sapiens
cacattcttggct

SEQ ID NO: 3658141 - DNA, 19 bp, Homo sapiens
cacattgtttgctgctatt

SEQ ID NO: 3658142 - DNA, 14 bp, Homo sapiens
caccaagggatctg

SEQ ID NO: 3658143 - DNA, 21 bp, Homo sapiens
caccacatcctccgtccagcc

SEQ ID NO: 3658144 - DNA, 16 bp, Homo sapiens
caccaccccaacaaac

SEQ ID NO: 3658145 - DNA, 18 bp, Homo sapiens
caccacggccaccactgc

SEQ ID NO: 3658146 - DNA, 14 bp, Homo sapiens
caccagacacccag

SEQ ID NO: 3658147 - DNA, 15 bp, Homo sapiens
caccagacacccagg

SEQ ID NO: 3658148 - DNA, 16 bp, Homo sapiens
caccagacacccagga

SEQ ID NO: 3658149 - DNA, 18 bp, Homo sapiens
caccagacacccaggact

SEQ ID NO: 3658150 - DNA, 19 bp, Homo sapiens
caccagacacccaggactt

SEQ ID NO: 3658151 - DNA, 11 bp, Homo sapiens
caccagccagc

SEQ ID NO: 3658152 - DNA, 14 bp, Homo sapiens
caccaggccacctc

SEQ ID NO: 3658153 - DNA, 19 bp, Homo sapiens
caccaggccacctccccag

SEQ ID NO: 3658154 - DNA, 22 bp, Homo sapiens
cacccaaagctgagcctgcagg

SEQ ID NO: 3658155 - DNA, 16 bp, Homo sapiens
cacccaagagggctgc

SEQ ID NO: 3658156 - DNA, 17 bp, Homo sapiens
cacccaatcccagttct

SEQ ID NO: 3658157 - DNA, 15 bp, Homo sapiens
cacccacctccctgc

SEQ ID NO: 3658158 - DNA, 21 bp, Homo sapiens
cacccacctccctgcctccag

SEQ ID NO: 3658159 - DNA, 19 bp, Homo sapiens
cacccatgcaagcagagga

SEQ ID NO: 3658160 - DNA, 19 bp, Homo sapiens
caccccaaagctttcctgc

SEQ ID NO: 3658161 - DNA, 17 bp, Homo sapiens
caccccaacacttccag

SEQ ID NO: 3658162 - DNA, 13 bp, Homo sapiens
cacccccctgggc

SEQ ID NO: 3658163 - DNA, 22 bp, Homo sapiens
cacccccttctctgctccacca

SEQ ID NO: 3658164 - DNA, 15 bp, Homo sapiens
caccccgggctctct

SEQ ID NO: 3658165 - DNA, 18 bp, Homo sapiens
caccccgggctctctgct

SEQ ID NO: 3658166 - DNA, 18 bp, Homo sapiens
cacccctgggggctctca

SEQ ID NO: 3658167 - DNA, 11 bp, Homo sapiens
caccccttcct

SEQ ID NO: 3658168 - DNA, 20 bp, Homo sapiens
caccccttcctcagcctggg

SEQ ID NO: 3658169 - DNA, 22 bp, Homo sapiens
caccccttcctcagcctggggt

SEQ ID NO: 3658170 - DNA, 21 bp, Homo sapiens
cacccggtgggacccccgtgg

SEQ ID NO: 3658171 - DNA, 18 bp, Homo sapiens
caccctagtcccttcccc

SEQ ID NO: 3658172 - DNA, 20 bp, Homo sapiens
caccctagtcccttcccctc

SEQ ID NO: 3658173 - DNA, 21 bp, Homo sapiens
caccctgcctacgccaggaga

SEQ ID NO: 3658174 - DNA, 18 bp, Homo sapiens
caccctgccttatcttgc

SEQ ID NO: 3658175 - DNA, 19 bp, Homo sapiens
caccctgccttatcttgca

SEQ ID NO: 3658176 - DNA, 17 bp, Homo sapiens
caccctgctgctggtgc

SEQ ID NO: 3658177 - DNA, 12 bp, Homo sapiens
caggagctcttc

SEQ ID NO: 3658178 - DNA, 15 bp, Homo sapiens
caggagctcttcagg

SEQ ID NO: 3658179 - DNA, 18 bp, Homo sapiens
caggagctcttcaggcct

SEQ ID NO: 3658180 - DNA, 20 bp, Homo sapiens
caggagctcttcaggcctcc

SEQ ID NO: 3658181 - DNA, 15 bp, Homo sapiens
caggaggcaggcatg

SEQ ID NO: 3658182 - DNA, 18 bp, Homo sapiens
caggaggcaggcatggcc

SEQ ID NO: 3658183 - DNA, 21 bp, Homo sapiens
caggaggcaggcatggccctg

SEQ ID NO: 3658184 - DNA, 16 bp, Homo sapiens
caggagggccctacct

SEQ ID NO: 3658185 - DNA, 18 bp, Homo sapiens
caggagtccactttgttt

SEQ ID NO: 3658186 - DNA, 23 bp, Homo sapiens
caggagttcgagaccagcctggc

SEQ ID NO: 3658187 - DNA, 14 bp, Homo sapiens
caggatagagactg

SEQ ID NO: 3658188 - DNA, 16 bp, Homo sapiens
caggatagagactgga

SEQ ID NO: 3658189 - DNA, 16 bp, Homo sapiens
caggatctttgactga

SEQ ID NO: 3658190 - DNA, 17 bp, Homo sapiens
caggatctttgactgaa

SEQ ID NO: 3658191 - DNA, 13 bp, Homo sapiens
caggatggggagg

SEQ ID NO: 3658192 - DNA, 18 bp, Homo sapiens
caggatggggaggggctc

SEQ ID NO: 3658193 - DNA, 18 bp, Homo sapiens
caggatgtgtttgctttc

SEQ ID NO: 3658194 - DNA, 14 bp, Homo sapiens
caggcacggtttgg

SEQ ID NO: 3658195 - DNA, 13 bp, Homo sapiens
caggcagatccag

SEQ ID NO: 3658196 - DNA, 17 bp, Homo sapiens
caggcagatccaggact

SEQ ID NO: 3658197 - DNA, 18 bp, Homo sapiens
caggcagatctgtgcccc

SEQ ID NO: 3658198 - DNA, 21 bp, Homo sapiens
caggcagatctgtgccccatg

SEQ ID NO: 3658199 - DNA, 18 bp, Homo sapiens
caggcaggaagggcagga

SEQ ID NO: 3658200 - DNA, 19 bp, Homo sapiens
caggcaggaagggcaggaa

SEQ ID NO: 3658201 - DNA, 12 bp, Homo sapiens
caggcagggaga

SEQ ID NO: 3658202 - DNA, 23 bp, Homo sapiens
caggcagggctgactctaggtgc

SEQ ID NO: 3658203 - DNA, 18 bp, Homo sapiens
caggcatggccctgggcg

SEQ ID NO: 3658204 - DNA, 17 bp, Homo sapiens
caggcatggtggcccac

SEQ ID NO: 3658205 - DNA, 15 bp, Homo sapiens
caggccaaccctcct

SEQ ID NO: 3658206 - DNA, 12 bp, Homo sapiens
caggccacctcc

SEQ ID NO: 3658207 - DNA, 20 bp, Homo sapiens
caggccacctccccagcatt

SEQ ID NO: 3658208 - DNA, 22 bp, Homo sapiens
caggccctccctgttccccaga

SEQ ID NO: 3658209 - DNA, 14 bp, Homo sapiens
caggccctggcctc

SEQ ID NO: 3658210 - DNA, 20 bp, Homo sapiens
caggccctggcctcccctgc

SEQ ID NO: 3658211 - DNA, 22 bp, Homo sapiens
caggccctggcctcccctgcca

SEQ ID NO: 3658212 - DNA, 23 bp, Homo sapiens
caggcctccctctctcttctgct

SEQ ID NO: 3658213 - DNA, 23 bp, Homo sapiens
caggcctgaaagaggctgaggcc

SEQ ID NO: 3658214 - DNA, 23 bp, Homo sapiens
caggcggggcgccccaagagccc

SEQ ID NO: 3658215 - DNA, 18 bp, Homo sapiens
caggctccaatggggcgg

SEQ ID NO: 3658216 - DNA, 19 bp, Homo sapiens
caggctcccagggacacct

SEQ ID NO: 3658217 - DNA, 23 bp, Homo sapiens
caggctcccagggacacctggga

SEQ ID NO: 3658218 - DNA, 12 bp, Homo sapiens
caggctcttagc

SEQ ID NO: 3658219 - DNA, 21 bp, Homo sapiens
caggctcttagcagcttccag

SEQ ID NO: 3658220 - DNA, 15 bp, Homo sapiens
caggctgaaaacaat

SEQ ID NO: 3658221 - DNA, 22 bp, Homo sapiens
caggctgccaaggccagagtgg

SEQ ID NO: 3658222 - DNA, 18 bp, Homo sapiens
caggctgctcagggctgg

SEQ ID NO: 3658223 - DNA, 12 bp, Homo sapiens
caggctgcttgg

SEQ ID NO: 3658224 - DNA, 18 bp, Homo sapiens
caggctggagagcactgc

SEQ ID NO: 3658225 - DNA, 20 bp, Homo sapiens
caggctggagtgcagtgaca

SEQ ID NO: 3658226 - DNA, 14 bp, Homo sapiens
caggctggccagtc

SEQ ID NO: 3658227 - DNA, 16 bp, Homo sapiens
caggctggccagtcca

SEQ ID NO: 3658228 - DNA, 22 bp, Homo sapiens
caggctgtgtttggctttcagg

SEQ ID NO: 3658229 - DNA, 13 bp, Homo sapiens
caggctttcccac

SEQ ID NO: 3658230 - DNA, 15 bp, Homo sapiens
cagggaagccccaca

SEQ ID NO: 3658231 - DNA, 17 bp, Homo sapiens
cagggaagccccacatg

SEQ ID NO: 3658232 - DNA, 21 bp, Homo sapiens
cagggaagtgtaagaaacaca

SEQ ID NO: 3658233 - DNA, 23 bp, Homo sapiens
cagggacagaggccccagcctcc

SEQ ID NO: 3658234 - DNA, 16 bp, Homo sapiens
cagggacccctgccct

SEQ ID NO: 3658235 - DNA, 17 bp, Homo sapiens
cagggacttcgcagagg

SEQ ID NO: 3658236 - DNA, 19 bp, Homo sapiens
cagggacttcgcagaggca

SEQ ID NO: 3658237 - DNA, 12 bp, Homo sapiens
cagggagaagct

SEQ ID NO: 3658238 - DNA, 22 bp, Homo sapiens
cagggagacggtttccagggag

SEQ ID NO: 3658239 - DNA, 23 bp, Homo sapiens
cagggagacggtttccagggagg

SEQ ID NO: 3658240 - DNA, 17 bp, Homo sapiens
cagggagcggaaagcag

SEQ ID NO: 3658241 - DNA, 16 bp, Homo sapiens
cagggagctgggcccg

SEQ ID NO: 3658242 - DNA, 22 bp, Homo sapiens
cagggaggggccggccctgtgt

SEQ ID NO: 3658243 - DNA, 17 bp, Homo sapiens
cagggaggtggctgggt

SEQ ID NO: 3658244 - DNA, 21 bp, Homo sapiens
cagggatgccctggaggtggc

SEQ ID NO: 3658245 - DNA, 23 bp, Homo sapiens
cagggatgccctggaggtggctg

SEQ ID NO: 3658246 - DNA, 14 bp, Homo sapiens
cagggccatgctga

SEQ ID NO: 3658247 - DNA, 18 bp, Homo sapiens
cagggccatggctcaggg

SEQ ID NO: 3658248 - DNA, 22 bp, Homo sapiens
cagggccatggctcagggtggt

SEQ ID NO: 3658249 - DNA, 15 bp, Homo sapiens
cagggcccagagccc

SEQ ID NO: 3658250 - DNA, 22 bp, Homo sapiens
cagggcccctcaccctgcctta

SEQ ID NO: 3658251 - DNA, 22 bp, Homo sapiens
cagggctcctccctggagctag

SEQ ID NO: 3658252 - DNA, 11 bp, Homo sapiens
cagggctcctg

SEQ ID NO: 3658253 - DNA, 15 bp, Homo sapiens
cagggcttctcctgc

SEQ ID NO: 3658254 - DNA, 16 bp, Homo sapiens
cagggcttctcctgcg

SEQ ID NO: 3658255 - DNA, 15 bp, Homo sapiens
caggggactcagccc

SEQ ID NO: 3658256 - DNA, 12 bp, Homo sapiens
caggggcctgga

SEQ ID NO: 3658257 - DNA, 19 bp, Homo sapiens
caggggctgcttcctcctg

SEQ ID NO: 3658258 - DNA, 15 bp, Homo sapiens
caggggggtgaggag

SEQ ID NO: 3658259 - DNA, 21 bp, Homo sapiens
caggggtcagtgcagcagagg

SEQ ID NO: 3658260 - DNA, 15 bp, Homo sapiens
cagggtccctctgtg

SEQ ID NO: 3658261 - DNA, 16 bp, Homo sapiens
cagggtccctctgtgt

SEQ ID NO: 3658262 - DNA, 21 bp, Homo sapiens
cagggtctctaccatcccctg

SEQ ID NO: 3658263 - DNA, 17 bp, Homo sapiens
cagggtctgctctttct

SEQ ID NO: 3658264 - DNA, 20 bp, Homo sapiens
cagggtctgctctttctctg

SEQ ID NO: 3658265 - DNA, 23 bp, Homo sapiens
cagggtctgctctttctctgcca

SEQ ID NO: 3658266 - DNA, 20 bp, Homo sapiens
cagggtgggcctcggcccct

SEQ ID NO: 3658267 - DNA, 23 bp, Homo sapiens
cagggtgggcctcggcccctccc

SEQ ID NO: 3658268 - DNA, 22 bp, Homo sapiens
cagggtggtctcttcttggggc

SEQ ID NO: 3658269 - DNA, 15 bp, Homo sapiens
cagggttaagaagac

SEQ ID NO: 3658270 - DNA, 14 bp, Homo sapiens
cagggttgggccca

SEQ ID NO: 3658271 - DNA, 16 bp, Homo sapiens
cagggttgggcccaga

SEQ ID NO: 3658272 - DNA, 14 bp, Homo sapiens
caggtagctgcccc

SEQ ID NO: 3658273 - DNA, 13 bp, Homo sapiens
caggtccagctct

SEQ ID NO: 3658274 - DNA, 16 bp, Homo sapiens
caggtccagctctgtg

SEQ ID NO: 3658275 - DNA, 20 bp, Homo sapiens
caggtccagctctgtgggcc

SEQ ID NO: 3658276 - DNA, 21 bp, Homo sapiens
caggtctttcctaaggctgca

SEQ ID NO: 3658277 - DNA, 18 bp, Homo sapiens
caggtgaaagtttttctg

SEQ ID NO: 3658278 - DNA, 12 bp, Homo sapiens
caggtgcagagg

SEQ ID NO: 3658279 - DNA, 18 bp, Homo sapiens
caggtgcccctcttccaa

SEQ ID NO: 3658280 - DNA, 21 bp, Homo sapiens
caggtgcctttcaaatttaga

SEQ ID NO: 3658281 - DNA, 14 bp, Homo sapiens
caggtgctcccctg

SEQ ID NO: 3658282 - DNA, 17 bp, Homo sapiens
caggtggatctccttga

SEQ ID NO: 3658283 - DNA, 18 bp, Homo sapiens
caggtggatctccttgag

SEQ ID NO: 3658284 - DNA, 13 bp, Homo sapiens
caggtggttttta

SEQ ID NO: 3658285 - DNA, 13 bp, Homo sapiens
caggtgtgcccct

SEQ ID NO: 3658286 - DNA, 14 bp, Homo sapiens
caggtgtgcccctc

SEQ ID NO: 3658287 - DNA, 21 bp, Homo sapiens
caggttggtgggggcctcggt

SEQ ID NO: 3658288 - DNA, 21 bp, Homo sapiens
cagtaacgcgtcttcctgagt

SEQ ID NO: 3658289 - DNA, 20 bp, Homo sapiens
cagtaattaatatctcctgg

SEQ ID NO: 3658290 - DNA, 22 bp, Homo sapiens
cagtaattaatatctcctggaa

SEQ ID NO: 3658291 - DNA, 14 bp, Homo sapiens
cagtacaggcagca

SEQ ID NO: 3658292 - DNA, 21 bp, Homo sapiens
cagtactcctccctgggggcg

SEQ ID NO: 3658293 - DNA, 21 bp, Homo sapiens
ccacctccaggctttcccact

SEQ ID NO: 3658294 - DNA, 17 bp, Homo sapiens
ccacctcccacaaagga

SEQ ID NO: 3658295 - DNA, 16 bp, Homo sapiens
ccacctccctgcctcc

SEQ ID NO: 3658296 - DNA, 17 bp, Homo sapiens
ccacctgaccaggggcc

SEQ ID NO: 3658297 - DNA, 16 bp, Homo sapiens
ccacctgcccatcaca

SEQ ID NO: 3658298 - DNA, 22 bp, Homo sapiens
ccacctgtcaaacaaagccaga

SEQ ID NO: 3658299 - DNA, 17 bp, Homo sapiens
ccacgcccgtcctgcct

SEQ ID NO: 3658300 - DNA, 22 bp, Homo sapiens
ccacgcccgtcctgcctgtggc

SEQ ID NO: 3658301 - DNA, 18 bp, Homo sapiens
ccacgcgggggccttgag

SEQ ID NO: 3658302 - DNA, 15 bp, Homo sapiens
ccacgcgtgccgtgg

SEQ ID NO: 3658303 - DNA, 20 bp, Homo sapiens
ccacgcgtgccgtggcacca

SEQ ID NO: 3658304 - DNA, 20 bp, Homo sapiens
ccacggcgttgtacctgtag

SEQ ID NO: 3658305 - DNA, 20 bp, Homo sapiens
ccacgggacatcacagggtg

SEQ ID NO: 3658306 - DNA, 13 bp, Homo sapiens
ccactaagcagag

SEQ ID NO: 3658307 - DNA, 15 bp, Homo sapiens
ccactacctcctttc

SEQ ID NO: 3658308 - DNA, 20 bp, Homo sapiens
ccactccgagaggtgggcca

SEQ ID NO: 3658309 - DNA, 21 bp, Homo sapiens
ccactctaccctcccaccccc

SEQ ID NO: 3658310 - DNA, 13 bp, Homo sapiens
ccactctccccac

SEQ ID NO: 3658311 - DNA, 17 bp, Homo sapiens
ccactctccccacacta

SEQ ID NO: 3658312 - DNA, 13 bp, Homo sapiens
ccactctgcttct

SEQ ID NO: 3658313 - DNA, 22 bp, Homo sapiens
ccactctgtggccagcctggca

SEQ ID NO: 3658314 - DNA, 11 bp, Homo sapiens
ccactgagctg

SEQ ID NO: 3658315 - DNA, 13 bp, Homo sapiens
ccactgagctggc

SEQ ID NO: 3658316 - DNA, 15 bp, Homo sapiens
ccactgagctggctg

SEQ ID NO: 3658317 - DNA, 16 bp, Homo sapiens
ccactgcacccaccca

SEQ ID NO: 3658318 - DNA, 23 bp, Homo sapiens
ccactgcactccagcctgggtga

SEQ ID NO: 3658319 - DNA, 19 bp, Homo sapiens
ccactgcataccaacctgg

SEQ ID NO: 3658320 - DNA, 14 bp, Homo sapiens
ccactgccttcgct

SEQ ID NO: 3658321 - DNA, 12 bp, Homo sapiens
ccactggggaaa

SEQ ID NO: 3658322 - DNA, 20 bp, Homo sapiens
ccactggtccccaacaatgt

SEQ ID NO: 3658323 - DNA, 13 bp, Homo sapiens
ccacttgcctctt

SEQ ID NO: 3658324 - DNA, 22 bp, Homo sapiens
ccactttgtttcgtggggaggt

SEQ ID NO: 3658325 - DNA, 17 bp, Homo sapiens
ccagaacacactccatc

SEQ ID NO: 3658326 - DNA, 22 bp, Homo sapiens
ccagaacacactccatcagctt

SEQ ID NO: 3658327 - DNA, 19 bp, Homo sapiens
ccagaagcctctggctaga

SEQ ID NO: 3658328 - DNA, 23 bp, Homo sapiens
ccagaagtttgagatcagcctgg

SEQ ID NO: 3658329 - DNA, 23 bp, Homo sapiens
ccagacagcaaggtgtggaggct

SEQ ID NO: 3658330 - DNA, 21 bp, Homo sapiens
ccagacctgatcctggaggcc

SEQ ID NO: 3658331 - DNA, 20 bp, Homo sapiens
ccagagaaaggggagcccac

SEQ ID NO: 3658332 - DNA, 20 bp, Homo sapiens
ccagagacatacttgaaggg

SEQ ID NO: 3658333 - DNA, 22 bp, Homo sapiens
ccagagacatacttgaagggcc

SEQ ID NO: 3658334 - DNA, 22 bp, Homo sapiens
ccagagccaggggggtgaggag

SEQ ID NO: 3658335 - DNA, 23 bp, Homo sapiens
ccagagccaggggggtgaggagc

SEQ ID NO: 3658336 - DNA, 11 bp, Homo sapiens
ccagagcccag

SEQ ID NO: 3658337 - DNA, 17 bp, Homo sapiens
ccagagccttcaagtgc

SEQ ID NO: 3658338 - DNA, 13 bp, Homo sapiens
ccagagctgctgg

SEQ ID NO: 3658339 - DNA, 21 bp, Homo sapiens
ccagaggagagctgctgggcc

SEQ ID NO: 3658340 - DNA, 19 bp, Homo sapiens
ccagaggcccccagcccag

SEQ ID NO: 3658341 - DNA, 12 bp, Homo sapiens
ccagaggctggg

SEQ ID NO: 3658342 - DNA, 16 bp, Homo sapiens
ccagaggctgggttca

SEQ ID NO: 3658343 - DNA, 19 bp, Homo sapiens
ccagagtggcctggccagg

SEQ ID NO: 3658344 - DNA, 23 bp, Homo sapiens
ccagagtggcctggccaggagct

SEQ ID NO: 3658345 - DNA, 12 bp, Homo sapiens
ccagattcttca

SEQ ID NO: 3658346 - DNA, 23 bp, Homo sapiens
ccagatttgtctttttgttgtaa

SEQ ID NO: 3658347 - DNA, 23 bp, Homo sapiens
ccagcaagaggaaggggtgctgt

SEQ ID NO: 3658348 - DNA, 21 bp, Homo sapiens
ccagcaattctctttctttta

SEQ ID NO: 3658349 - DNA, 15 bp, Homo sapiens
ccagcaccttgtgcc

SEQ ID NO: 3658350 - DNA, 12 bp, Homo sapiens
ccagcagcctgg

SEQ ID NO: 3658351 - DNA, 14 bp, Homo sapiens
ccagcagcctggac

SEQ ID NO: 3658352 - DNA, 14 bp, Homo sapiens
ccagcattccagcc

SEQ ID NO: 3658353 - DNA, 16 bp, Homo sapiens
ccagcattccagcccc

SEQ ID NO: 3658354 - DNA, 18 bp, Homo sapiens
ccagcattccagcccctc

SEQ ID NO: 3658355 - DNA, 20 bp, Homo sapiens
ccagcattccagcccctctg

SEQ ID NO: 3658356 - DNA, 20 bp, Homo sapiens
ccagcatttagctggccaca

SEQ ID NO: 3658357 - DNA, 15 bp, Homo sapiens
ccagccaaagcctcc

SEQ ID NO: 3658358 - DNA, 19 bp, Homo sapiens
ccagccaaagcctcctcca

SEQ ID NO: 3658359 - DNA, 19 bp, Homo sapiens
ccagccagtgacctgagga

SEQ ID NO: 3658360 - DNA, 20 bp, Homo sapiens
ccagccagtgacctgaggaa

SEQ ID NO: 3658361 - DNA, 23 bp, Homo sapiens
ccagccagtgacctgaggaagcg

SEQ ID NO: 3658362 - DNA, 14 bp, Homo sapiens
ccagccatgtctgc

SEQ ID NO: 3658363 - DNA, 19 bp, Homo sapiens
ccagcccagggctcctgca

SEQ ID NO: 3658364 - DNA, 15 bp, Homo sapiens
ccagccccacccagg

SEQ ID NO: 3658365 - DNA, 15 bp, Homo sapiens
ccagccccccaggct

SEQ ID NO: 3658366 - DNA, 13 bp, Homo sapiens
ccagcccctctgg

SEQ ID NO: 3658367 - DNA, 15 bp, Homo sapiens
ccagcccctctggtc

SEQ ID NO: 3658368 - DNA, 17 bp, Homo sapiens
ccagcccctctggtcgc

SEQ ID NO: 3658369 - DNA, 23 bp, Homo sapiens
ccagcccctctggtcgctcctgc

SEQ ID NO: 3658370 - DNA, 15 bp, Homo sapiens
ccagcccctcttccc

SEQ ID NO: 3658371 - DNA, 19 bp, Homo sapiens
ccagccgccatgctcctgg

SEQ ID NO: 3658372 - DNA, 20 bp, Homo sapiens
ccagccgccattgccaccag

SEQ ID NO: 3658373 - DNA, 13 bp, Homo sapiens
ccagcctccctga

SEQ ID NO: 3658374 - DNA, 13 bp, Homo sapiens
ccagcctggcatc

SEQ ID NO: 3658375 - DNA, 23 bp, Homo sapiens
ccagcctgggcagccaggctgcc

SEQ ID NO: 3658376 - DNA, 13 bp, Homo sapiens
ccagcctggtggc

SEQ ID NO: 3658377 - DNA, 16 bp, Homo sapiens
ccagcctggtggccca

SEQ ID NO: 3658378 - DNA, 19 bp, Homo sapiens
ccagcctggtggcccagct

SEQ ID NO: 3658379 - DNA, 20 bp, Homo sapiens
ccagccttggtgggggagcc

SEQ ID NO: 3658380 - DNA, 21 bp, Homo sapiens
ccagcgatctctccactgtgc

SEQ ID NO: 3658381 - DNA, 18 bp, Homo sapiens
ccagcgcccctcagcctc

SEQ ID NO: 3658382 - DNA, 20 bp, Homo sapiens
ccagcgcccctcagcctctg

SEQ ID NO: 3658383 - DNA, 22 bp, Homo sapiens
ccagcgcccctcagcctctgcc

SEQ ID NO: 3658384 - DNA, 16 bp, Homo sapiens
ccagcggtttcctggt

SEQ ID NO: 3658385 - DNA, 23 bp, Homo sapiens
ccagcgtcagctgctccctggca

SEQ ID NO: 3658386 - DNA, 20 bp, Homo sapiens
ccagctccaacctgcaaaga

SEQ ID NO: 3658387 - DNA, 22 bp, Homo sapiens
ccagctccaaggggaatcagaa

SEQ ID NO: 3658388 - DNA, 19 bp, Homo sapiens
ccagctctggaggggaggg

SEQ ID NO: 3658389 - DNA, 15 bp, Homo sapiens
ccagctctgtgggcc

SEQ ID NO: 3658390 - DNA, 21 bp, Homo sapiens
ccagctctgtgggccctaccc

SEQ ID NO: 3658391 - DNA, 22 bp, Homo sapiens
ccagctctgtgggccctaccct

SEQ ID NO: 3658392 - DNA, 13 bp, Homo sapiens
ccagctgcactga

SEQ ID NO: 3658393 - DNA, 16 bp, Homo sapiens
ccagctgggttggaaa

SEQ ID NO: 3658394 - DNA, 15 bp, Homo sapiens
ccagctgtgcttatg

SEQ ID NO: 3658395 - DNA, 16 bp, Homo sapiens
ccagctgttcagctgg

SEQ ID NO: 3658396 - DNA, 17 bp, Homo sapiens
ccagctgttcagctggt

SEQ ID NO: 3658397 - DNA, 11 bp, Homo sapiens
ccaggaagccg

SEQ ID NO: 3658398 - DNA, 15 bp, Homo sapiens
ccaggaagccgtgcc

SEQ ID NO: 3658399 - DNA, 20 bp, Homo sapiens
ccaggaagccgtgccctgcc

SEQ ID NO: 3658400 - DNA, 15 bp, Homo sapiens
ccaggaagctttggt

SEQ ID NO: 3658401 - DNA, 21 bp, Homo sapiens
ccaggaatttcccaggaccct

SEQ ID NO: 3658402 - DNA, 22 bp, Homo sapiens
ccaggaatttcccaggaccctg

SEQ ID NO: 3658403 - DNA, 23 bp, Homo sapiens
ccaggaatttcccaggaccctga

SEQ ID NO: 3658404 - DNA, 14 bp, Homo sapiens
ccaggaccagctca

SEQ ID NO: 3658405 - DNA, 15 bp, Homo sapiens
ccaggaccagctcag

SEQ ID NO: 3658406 - DNA, 17 bp, Homo sapiens
ccaggaccagctcagga

SEQ ID NO: 3658407 - DNA, 20 bp, Homo sapiens
ccaggaccagctcaggacag

SEQ ID NO: 3658408 - DNA, 22 bp, Homo sapiens
ccaggacccaccactggaagca

SEQ ID NO: 3658409 - DNA, 22 bp, Homo sapiens
ccccaacaaaccatccagtgac

SEQ ID NO: 3658410 - DNA, 20 bp, Homo sapiens
ccccaactacccccagctgt

SEQ ID NO: 3658411 - DNA, 15 bp, Homo sapiens
ccccaaggagggaga

SEQ ID NO: 3658412 - DNA, 13 bp, Homo sapiens
ccccacaatctgg

SEQ ID NO: 3658413 - DNA, 14 bp, Homo sapiens
ccccaccccacact

SEQ ID NO: 3658414 - DNA, 12 bp, Homo sapiens
ccccacccctgg

SEQ ID NO: 3658415 - DNA, 20 bp, Homo sapiens
ccccacccctgggggctctc

SEQ ID NO: 3658416 - DNA, 14 bp, Homo sapiens
ccccaccctgggcc

SEQ ID NO: 3658417 - DNA, 20 bp, Homo sapiens
ccccaccctgggccctgggc

SEQ ID NO: 3658418 - DNA, 15 bp, Homo sapiens
ccccactgaccagaa

SEQ ID NO: 3658419 - DNA, 21 bp, Homo sapiens
ccccacttgcctcttccttga

SEQ ID NO: 3658420 - DNA, 22 bp, Homo sapiens
ccccagagctgtttatggcctc

SEQ ID NO: 3658421 - DNA, 23 bp, Homo sapiens
ccccagagctgtttatggcctca

SEQ ID NO: 3658422 - DNA, 16 bp, Homo sapiens
ccccagcccagagaca

SEQ ID NO: 3658423 - DNA, 12 bp, Homo sapiens
ccccagcccagg

SEQ ID NO: 3658424 - DNA, 14 bp, Homo sapiens
ccccagcccagggc

SEQ ID NO: 3658425 - DNA, 15 bp, Homo sapiens
ccccagcccagggct

SEQ ID NO: 3658426 - DNA, 12 bp, Homo sapiens
ccccagccttgg

SEQ ID NO: 3658427 - DNA, 13 bp, Homo sapiens
ccccagccttggt

SEQ ID NO: 3658428 - DNA, 12 bp, Homo sapiens
ccccaggaagcc

SEQ ID NO: 3658429 - DNA, 11 bp, Homo sapiens
ccccaggacca

SEQ ID NO: 3658430 - DNA, 18 bp, Homo sapiens
ccccaggccccaggaagc

SEQ ID NO: 3658431 - DNA, 22 bp, Homo sapiens
ccccaggccccgcccgtctctg

SEQ ID NO: 3658432 - DNA, 21 bp, Homo sapiens
ccccaggcctgaaagaggctg

SEQ ID NO: 3658433 - DNA, 17 bp, Homo sapiens
ccccatctcaggccaga

SEQ ID NO: 3658434 - DNA, 19 bp, Homo sapiens
ccccatgcactgtgaagga

SEQ ID NO: 3658435 - DNA, 23 bp, Homo sapiens
ccccatgcactgtgaaggaccct

SEQ ID NO: 3658436 - DNA, 22 bp, Homo sapiens
ccccatgcctgtccagcctggg

SEQ ID NO: 3658437 - DNA, 24 bp, Homo sapiens
ccccatgcctgtccagcctgggca

SEQ ID NO: 3658438 - DNA, 13 bp, Homo sapiens
cccccagcccagg

SEQ ID NO: 3658439 - DNA, 14 bp, Homo sapiens
cccccagcccaggg

SEQ ID NO: 3658440 - DNA, 21 bp, Homo sapiens
cccccagcccagggctcctgc

SEQ ID NO: 3658441 - DNA, 21 bp, Homo sapiens
cccccagctaagaacctggaa

SEQ ID NO: 3658442 - DNA, 20 bp, Homo sapiens
cccccaggctgcccagagct

SEQ ID NO: 3658443 - DNA, 12 bp, Homo sapiens
ccccccacccct

SEQ ID NO: 3658444 - DNA, 13 bp, Homo sapiens
ccccccacccctg

SEQ ID NO: 3658445 - DNA, 19 bp, Homo sapiens
ccccctgtaaggttccatc

SEQ ID NO: 3658446 - DNA, 15 bp, Homo sapiens
cccccttctctgctc

SEQ ID NO: 3658447 - DNA, 22 bp, Homo sapiens
cccccttctctgctccaccaca

SEQ ID NO: 3658448 - DNA, 16 bp, Homo sapiens
ccccgactgtgctgct

SEQ ID NO: 3658449 - DNA, 23 bp, Homo sapiens
ccccggcatgagactcagtgcag

SEQ ID NO: 3658450 - DNA, 15 bp, Homo sapiens
ccccgggctctctgc

SEQ ID NO: 3658451 - DNA, 14 bp, Homo sapiens
ccccgtttctggtg

SEQ ID NO: 3658452 - DNA, 15 bp, Homo sapiens
cccctcaacacctct

SEQ ID NO: 3658453 - DNA, 21 bp, Homo sapiens
cccctcagcctctgccactgt

SEQ ID NO: 3658454 - DNA, 23 bp, Homo sapiens
cccctcatggcgggactggagaa

SEQ ID NO: 3658455 - DNA, 21 bp, Homo sapiens
cccctcccacacccaaagctg

SEQ ID NO: 3658456 - DNA, 11 bp, Homo sapiens
cccctcccaga

SEQ ID NO: 3658457 - DNA, 13 bp, Homo sapiens
cccctcccagaac

SEQ ID NO: 3658458 - DNA, 21 bp, Homo sapiens
cccctcccccaacccccaccc

SEQ ID NO: 3658459 - DNA, 23 bp, Homo sapiens
cccctctaactggacagcctctt

SEQ ID NO: 3658460 - DNA, 20 bp, Homo sapiens
cccctctccaagcgcctggc

SEQ ID NO: 3658461 - DNA, 20 bp, Homo sapiens
cccctcttccaaaggcagcg

SEQ ID NO: 3658462 - DNA, 22 bp, Homo sapiens
cccctcttccaaaggcagcgtg

SEQ ID NO: 3658463 - DNA, 12 bp, Homo sapiens
cccctgctgctt

SEQ ID NO: 3658464 - DNA, 14 bp, Homo sapiens
cccctggacagagg

SEQ ID NO: 3658465 - DNA, 16 bp, Homo sapiens
cccctggacagaggcg

SEQ ID NO: 3658466 - DNA, 17 bp, Homo sapiens
ccccttcctcagcctgg

SEQ ID NO: 3658467 - DNA, 19 bp, Homo sapiens
ccccttcctcagcctgggg

SEQ ID NO: 3658468 - DNA, 13 bp, Homo sapiens
ccccttcctggcc

SEQ ID NO: 3658469 - DNA, 13 bp, Homo sapiens
cccggactgacca

SEQ ID NO: 3658470 - DNA, 14 bp, Homo sapiens
cccggactgaccaa

SEQ ID NO: 3658471 - DNA, 19 bp, Homo sapiens
cccggagattggacggcct

SEQ ID NO: 3658472 - DNA, 14 bp, Homo sapiens
cccggagctggagg

SEQ ID NO: 3658473 - DNA, 21 bp, Homo sapiens
cccggctgcagaggccagagg

SEQ ID NO: 3658474 - DNA, 15 bp, Homo sapiens
cccgtcctgcctgtg

SEQ ID NO: 3658475 - DNA, 15 bp, Homo sapiens
cccgtgcccctggga

SEQ ID NO: 3658476 - DNA, 20 bp, Homo sapiens
ccctacagttgaaaaacagc

SEQ ID NO: 3658477 - DNA, 13 bp, Homo sapiens
ccctacctcaggc

SEQ ID NO: 3658478 - DNA, 22 bp, Homo sapiens
ccctacctgattggtgcaaccc

SEQ ID NO: 3658479 - DNA, 23 bp, Homo sapiens
ccctacctgattggtgcaaccct

SEQ ID NO: 3658480 - DNA, 21 bp, Homo sapiens
ccctacctggggaaagcctga

SEQ ID NO: 3658481 - DNA, 20 bp, Homo sapiens
ccctagcagcccaccctgct

SEQ ID NO: 3658482 - DNA, 17 bp, Homo sapiens
ccctagtcccttcccct

SEQ ID NO: 3658483 - DNA, 22 bp, Homo sapiens
ccctagtcccttcccctccctg

SEQ ID NO: 3658484 - DNA, 17 bp, Homo sapiens
ccctattggtaaagaat

SEQ ID NO: 3658485 - DNA, 16 bp, Homo sapiens
ccctcaacacctctgc

SEQ ID NO: 3658486 - DNA, 16 bp, Homo sapiens
ccctcaccctgcctta

SEQ ID NO: 3658487 - DNA, 21 bp, Homo sapiens
ccctcaccttggcaccagaca

SEQ ID NO: 3658488 - DNA, 23 bp, Homo sapiens
ccctcaccttggcaccagacacc

SEQ ID NO: 3658489 - DNA, 14 bp, Homo sapiens
ccctcagcctctgc

SEQ ID NO: 3658490 - DNA, 12 bp, Homo sapiens
ccctccaagtca

SEQ ID NO: 3658491 - DNA, 19 bp, Homo sapiens
ccctccagaacacggctca

SEQ ID NO: 3658492 - DNA, 18 bp, Homo sapiens
ccctcccccccatgcact

SEQ ID NO: 3658493 - DNA, 20 bp, Homo sapiens
ccctcccccccatgcactgt

SEQ ID NO: 3658494 - DNA, 14 bp, Homo sapiens
ccctccctggctcc

SEQ ID NO: 3658495 - DNA, 16 bp, Homo sapiens
ccctccgccaggcgag

SEQ ID NO: 3658496 - DNA, 14 bp, Homo sapiens
ccctccgccattct

SEQ ID NO: 3658497 - DNA, 23 bp, Homo sapiens
ccctccgtggcatcaccttaggc

SEQ ID NO: 3658498 - DNA, 13 bp, Homo sapiens
ccctcctcacctc

SEQ ID NO: 3658499 - DNA, 16 bp, Homo sapiens
ccctcctcacctctgg

SEQ ID NO: 3658500 - DNA, 14 bp, Homo sapiens
ccctcctctcccat

SEQ ID NO: 3658501 - DNA, 20 bp, Homo sapiens
ccctcctgattaaggcgtgg

SEQ ID NO: 3658502 - DNA, 22 bp, Homo sapiens
ccctcgggtctccccacctgca

SEQ ID NO: 3658503 - DNA, 20 bp, Homo sapiens
ccctcgtcccatccagctac

SEQ ID NO: 3658504 - DNA, 19 bp, Homo sapiens
ccctctctcttctgctcca

SEQ ID NO: 3658505 - DNA, 18 bp, Homo sapiens
ccctctgccccatcctcc

SEQ ID NO: 3658506 - DNA, 23 bp, Homo sapiens
ccctctgccccgccctccttccc

SEQ ID NO: 3658507 - DNA, 19 bp, Homo sapiens
ccctctggtcgctcctgcc

SEQ ID NO: 3658508 - DNA, 23 bp, Homo sapiens
ccctgaaaatgtttttctgccag

SEQ ID NO: 3658509 - DNA, 24 bp, Homo sapiens
ccctgaaaatgtttttctgccagg

SEQ ID NO: 3658510 - DNA, 15 bp, Homo sapiens
ccctgaaagccctga

SEQ ID NO: 3658511 - DNA, 16 bp, Homo sapiens
ccctgagacaaatgga

SEQ ID NO: 3658512 - DNA, 14 bp, Homo sapiens
ccctgagctgacca

SEQ ID NO: 3658513 - DNA, 13 bp, Homo sapiens
ccctgagggcgga

SEQ ID NO: 3658514 - DNA, 20 bp, Homo sapiens
ccctgagggcggagcgcctc

SEQ ID NO: 3658515 - DNA, 18 bp, Homo sapiens
ccctgaggtgaaagggag

SEQ ID NO: 3658516 - DNA, 20 bp, Homo sapiens
ccctgaggtgaaagggagct

SEQ ID NO: 3658517 - DNA, 16 bp, Homo sapiens
ccctgcagctgaccgg

SEQ ID NO: 3658518 - DNA, 18 bp, Homo sapiens
ccctgcatctgaccagca

SEQ ID NO: 3658519 - DNA, 17 bp, Homo sapiens
ccctgccaagtctcaga

SEQ ID NO: 3658520 - DNA, 15 bp, Homo sapiens
ccctgccaccaggcc

SEQ ID NO: 3658521 - DNA, 15 bp, Homo sapiens
ccctgcccgggctcc

SEQ ID NO: 3658522 - DNA, 17 bp, Homo sapiens
ccctgcccgggctccca

SEQ ID NO: 3658523 - DNA, 15 bp, Homo sapiens
ccctgccctggtcca

SEQ ID NO: 3658524 - DNA, 13 bp, Homo sapiens
ccctgctgctggt

SEQ ID NO: 3658525 - DNA, 18 bp, Homo sapiens
cctgggaaccgccctcct

SEQ ID NO: 3658526 - DNA, 17 bp, Homo sapiens
cctgggagaggacaggg

SEQ ID NO: 3658527 - DNA, 22 bp, Homo sapiens
cctgggagaggacagggacttc

SEQ ID NO: 3658528 - DNA, 17 bp, Homo sapiens
cctgggatccgagggcc

SEQ ID NO: 3658529 - DNA, 21 bp, Homo sapiens
cctgggatccgagggcccctc

SEQ ID NO: 3658530 - DNA, 19 bp, Homo sapiens
cctgggcagccaggctgcc

SEQ ID NO: 3658531 - DNA, 23 bp, Homo sapiens
cctgggcagccaggctgccaagg

SEQ ID NO: 3658532 - DNA, 14 bp, Homo sapiens
cctgggccctgggc

SEQ ID NO: 3658533 - DNA, 15 bp, Homo sapiens
cctgggccctgggct

SEQ ID NO: 3658534 - DNA, 20 bp, Homo sapiens
cctgggctggaatcaggaat

SEQ ID NO: 3658535 - DNA, 18 bp, Homo sapiens
cctggggacggggctccc

SEQ ID NO: 3658536 - DNA, 19 bp, Homo sapiens
cctggggacggggctcccc

SEQ ID NO: 3658537 - DNA, 15 bp, Homo sapiens
cctgggggcacagga

SEQ ID NO: 3658538 - DNA, 23 bp, Homo sapiens
cctgggggcacaggaggcaggca

SEQ ID NO: 3658539 - DNA, 22 bp, Homo sapiens
cctgggggcagaactcctacct

SEQ ID NO: 3658540 - DNA, 13 bp, Homo sapiens
cctgggggctctc

SEQ ID NO: 3658541 - DNA, 14 bp, Homo sapiens
cctgggggctctca

SEQ ID NO: 3658542 - DNA, 15 bp, Homo sapiens
cctgggggtggggct

SEQ ID NO: 3658543 - DNA, 14 bp, Homo sapiens
cctggggtaaagta

SEQ ID NO: 3658544 - DNA, 15 bp, Homo sapiens
cctggggtggggtca

SEQ ID NO: 3658545 - DNA, 20 bp, Homo sapiens
cctgggtggagcaggactcc

SEQ ID NO: 3658546 - DNA, 14 bp, Homo sapiens
cctgggtggtctgc

SEQ ID NO: 3658547 - DNA, 18 bp, Homo sapiens
cctgggtggtctgcaggc

SEQ ID NO: 3658548 - DNA, 19 bp, Homo sapiens
cctgggtggtctgcaggca

SEQ ID NO: 3658549 - DNA, 22 bp, Homo sapiens
cctgggtggtctgcaggcaggg

SEQ ID NO: 3658550 - DNA, 20 bp, Homo sapiens
cctgggtgtccccgctgctg

SEQ ID NO: 3658551 - DNA, 21 bp, Homo sapiens
cctgggtgtccccgctgctgt

SEQ ID NO: 3658552 - DNA, 13 bp, Homo sapiens
cctgggttccctt

SEQ ID NO: 3658553 - DNA, 17 bp, Homo sapiens
cctgggttgcagacagg

SEQ ID NO: 3658554 - DNA, 14 bp, Homo sapiens
cctggtggcccagc

SEQ ID NO: 3658555 - DNA, 21 bp, Homo sapiens
cctggtggttgctgttttcct

SEQ ID NO: 3658556 - DNA, 16 bp, Homo sapiens
cctggttcatatttat

SEQ ID NO: 3658557 - DNA, 14 bp, Homo sapiens
cctggttgcctcat

SEQ ID NO: 3658558 - DNA, 17 bp, Homo sapiens
cctggttgtctgaaccc

SEQ ID NO: 3658559 - DNA, 20 bp, Homo sapiens
cctggttgtctgaacccagg

SEQ ID NO: 3658560 - DNA, 18 bp, Homo sapiens
cctgtaatcccagcactt

SEQ ID NO: 3658561 - DNA, 20 bp, Homo sapiens
cctgtaatcctagcactttg

SEQ ID NO: 3658562 - DNA, 21 bp, Homo sapiens
cctgtacagtagattttccaa

SEQ ID NO: 3658563 - DNA, 23 bp, Homo sapiens
cctgtagagtgggagctgagtgg

SEQ ID NO: 3658564 - DNA, 15 bp, Homo sapiens
cctgtagcacttact

SEQ ID NO: 3658565 - DNA, 18 bp, Homo sapiens
cctgtagctttcctggtc

SEQ ID NO: 3658566 - DNA, 20 bp, Homo sapiens
cctgtatatttgtaaagcta

SEQ ID NO: 3658567 - DNA, 19 bp, Homo sapiens
cctgtcaaacaaagccaga

SEQ ID NO: 3658568 - DNA, 23 bp, Homo sapiens
cctgtcaaacaaagccagaagct

SEQ ID NO: 3658569 - DNA, 22 bp, Homo sapiens
cctgtccagcctgggcagccag

SEQ ID NO: 3658570 - DNA, 13 bp, Homo sapiens
cctgtccagctcc

SEQ ID NO: 3658571 - DNA, 14 bp, Homo sapiens
cctgtccagctcca

SEQ ID NO: 3658572 - DNA, 16 bp, Homo sapiens
cctgtctagagaggga

SEQ ID NO: 3658573 - DNA, 17 bp, Homo sapiens
cctgtctagagagggag

SEQ ID NO: 3658574 - DNA, 13 bp, Homo sapiens
cctgtcttcttaa

SEQ ID NO: 3658575 - DNA, 22 bp, Homo sapiens
cctgtgaatgccactgccttcg

SEQ ID NO: 3658576 - DNA, 18 bp, Homo sapiens
cctgtggcatctttgcct

SEQ ID NO: 3658577 - DNA, 15 bp, Homo sapiens
cctgtggccccaccc

SEQ ID NO: 3658578 - DNA, 22 bp, Homo sapiens
cctgtggcgccgtctccagggg

SEQ ID NO: 3658579 - DNA, 13 bp, Homo sapiens
cctgtgtccatgc

SEQ ID NO: 3658580 - DNA, 22 bp, Homo sapiens
cctgtgtctttaaatgctgctt

SEQ ID NO: 3658581 - DNA, 14 bp, Homo sapiens
cctgtgtgattgac

SEQ ID NO: 3658582 - DNA, 19 bp, Homo sapiens
cctgtgtgattgacagctt

SEQ ID NO: 3658583 - DNA, 10 bp, Homo sapiens
cctgtgtgca

SEQ ID NO: 3658584 - DNA, 12 bp, Homo sapiens
cctgtgtgcagg

SEQ ID NO: 3658585 - DNA, 13 bp, Homo sapiens
cctgtgtgcaggt

SEQ ID NO: 3658586 - DNA, 20 bp, Homo sapiens
cctgtgttgtctctagagca

SEQ ID NO: 3658587 - DNA, 12 bp, Homo sapiens
cctgttctgaaa

SEQ ID NO: 3658588 - DNA, 16 bp, Homo sapiens
cctgttctgaaacctt

SEQ ID NO: 3658589 - DNA, 19 bp, Homo sapiens
cctgttgacacaggtcttt

SEQ ID NO: 3658590 - DNA, 14 bp, Homo sapiens
cctgtttgaaagta

SEQ ID NO: 3658591 - DNA, 20 bp, Homo sapiens
ccttacctcggtgccttcct

SEQ ID NO: 3658592 - DNA, 14 bp, Homo sapiens
ccttagatctggca

SEQ ID NO: 3658593 - DNA, 15 bp, Homo sapiens
ccttaggcagggaag

SEQ ID NO: 3658594 - DNA, 16 bp, Homo sapiens
ccttaggcagggaagt

SEQ ID NO: 3658595 - DNA, 12 bp, Homo sapiens
ccttcacaaagc

SEQ ID NO: 3658596 - DNA, 16 bp, Homo sapiens
ccttccaacaggagct

SEQ ID NO: 3658597 - DNA, 19 bp, Homo sapiens
ccttccaacaggagctggg

SEQ ID NO: 3658598 - DNA, 22 bp, Homo sapiens
ccttccacgggggctgtggctc

SEQ ID NO: 3658599 - DNA, 14 bp, Homo sapiens
ccttccagaaaaca

SEQ ID NO: 3658600 - DNA, 19 bp, Homo sapiens
ccttccatccctaccccct

SEQ ID NO: 3658601 - DNA, 24 bp, Homo sapiens
ccttccctcaccttggcaccagac

SEQ ID NO: 3658602 - DNA, 14 bp, Homo sapiens
ccttcctcagcctg

SEQ ID NO: 3658603 - DNA, 16 bp, Homo sapiens
ccttcctcagcctggg

SEQ ID NO: 3658604 - DNA, 11 bp, Homo sapiens
ccttcctggcc

SEQ ID NO: 3658605 - DNA, 14 bp, Homo sapiens
ccttctaggaagct

SEQ ID NO: 3658606 - DNA, 20 bp, Homo sapiens
ccttctagggttattgcatt

SEQ ID NO: 3658607 - DNA, 23 bp, Homo sapiens
ccttctcctacttagggaagaaa

SEQ ID NO: 3658608 - DNA, 13 bp, Homo sapiens
ccttctctgctcc

SEQ ID NO: 3658609 - DNA, 20 bp, Homo sapiens
ccttctctgctccaccacat

SEQ ID NO: 3658610 - DNA, 12 bp, Homo sapiens
ccttctgtccaa

SEQ ID NO: 3658611 - DNA, 22 bp, Homo sapiens
ccttgaagaactgcaggccctg

SEQ ID NO: 3658612 - DNA, 20 bp, Homo sapiens
ccttgagttgattcagctct

SEQ ID NO: 3658613 - DNA, 19 bp, Homo sapiens
ccttgatttaaacacacag

SEQ ID NO: 3658614 - DNA, 17 bp, Homo sapiens
ccttgcagttcagcacc

SEQ ID NO: 3658615 - DNA, 22 bp, Homo sapiens
ccttgcagttcagcaccaccct

SEQ ID NO: 3658616 - DNA, 16 bp, Homo sapiens
ccttgccagagatcca

SEQ ID NO: 3658617 - DNA, 16 bp, Homo sapiens
ccttgcttgcctgcag

SEQ ID NO: 3658618 - DNA, 18 bp, Homo sapiens
ccttgcttgcctgcaggg

SEQ ID NO: 3658619 - DNA, 18 bp, Homo sapiens
ccttgctttctcttctaa

SEQ ID NO: 3658620 - DNA, 16 bp, Homo sapiens
ccttggacatcctcct

SEQ ID NO: 3658621 - DNA, 17 bp, Homo sapiens
ccttggacatcctcctc

SEQ ID NO: 3658622 - DNA, 12 bp, Homo sapiens
ccttggaggcca

SEQ ID NO: 3658623 - DNA, 11 bp, Homo sapiens
ccttggcctca

SEQ ID NO: 3658624 - DNA, 23 bp, Homo sapiens
ccttggcctttcctggaagccag

SEQ ID NO: 3658625 - DNA, 13 bp, Homo sapiens
ccttggcttgtta

SEQ ID NO: 3658626 - DNA, 19 bp, Homo sapiens
ccttgggaggccccactgg

SEQ ID NO: 3658627 - DNA, 20 bp, Homo sapiens
ccttgggaggccccactggg

SEQ ID NO: 3658628 - DNA, 17 bp, Homo sapiens
ccttgggctgctcctca

SEQ ID NO: 3658629 - DNA, 18 bp, Homo sapiens
ccttgggctgctcctcat

SEQ ID NO: 3658630 - DNA, 21 bp, Homo sapiens
ccttggtgggggagcctctgg

SEQ ID NO: 3658631 - DNA, 15 bp, Homo sapiens
ccttgtcccagccag

SEQ ID NO: 3658632 - DNA, 11 bp, Homo sapiens
ccttgtgcctg

SEQ ID NO: 3658633 - DNA, 13 bp, Homo sapiens
ccttgtgcctggg

SEQ ID NO: 3658634 - DNA, 20 bp, Homo sapiens
ccttgtgtcaagacatttct

SEQ ID NO: 3658635 - DNA, 18 bp, Homo sapiens
ccttgttacttctgaggt

SEQ ID NO: 3658636 - DNA, 21 bp, Homo sapiens
cctttaagcctgcattcttaa

SEQ ID NO: 3658637 - DNA, 20 bp, Homo sapiens
cctttagaaactcaaaaact

SEQ ID NO: 3658638 - DNA, 13 bp, Homo sapiens
cctttcaaagctt

SEQ ID NO: 3658639 - DNA, 22 bp, Homo sapiens
cctttcaaatttagaaactaat

SEQ ID NO: 3658640 - DNA, 15 bp, Homo sapiens
cctttcctccgcctg

SEQ ID NO: 3658641 - DNA, 13 bp, Homo sapiens
ctcagcctggggt

SEQ ID NO: 3658642 - DNA, 17 bp, Homo sapiens
ctcagccttcagacaga

SEQ ID NO: 3658643 - DNA, 12 bp, Homo sapiens
ctcagctgcctc

SEQ ID NO: 3658644 - DNA, 14 bp, Homo sapiens
ctcagctgcctcac

SEQ ID NO: 3658645 - DNA, 23 bp, Homo sapiens
ctcaggagtttgagaccaacctg

SEQ ID NO: 3658646 - DNA, 13 bp, Homo sapiens
ctcaggccagagc

SEQ ID NO: 3658647 - DNA, 16 bp, Homo sapiens
ctcaggccagagccaa

SEQ ID NO: 3658648 - DNA, 18 bp, Homo sapiens
ctcaggccagagccaagg

SEQ ID NO: 3658649 - DNA, 20 bp, Homo sapiens
ctcagggccatgctgaggcc

SEQ ID NO: 3658650 - DNA, 16 bp, Homo sapiens
ctcagggtggtctctt

SEQ ID NO: 3658651 - DNA, 14 bp, Homo sapiens
ctcaggtgttgcca

SEQ ID NO: 3658652 - DNA, 15 bp, Homo sapiens
ctcaggtgttgccaa

SEQ ID NO: 3658653 - DNA, 21 bp, Homo sapiens
ctcagtactttggaggcccct

SEQ ID NO: 3658654 - DNA, 10 bp, Homo sapiens
ctcagtgcag

SEQ ID NO: 3658655 - DNA, 15 bp, Homo sapiens
ctcagtgcagatgga

SEQ ID NO: 3658656 - DNA, 14 bp, Homo sapiens
ctcagtgcatttgt

SEQ ID NO: 3658657 - DNA, 16 bp, Homo sapiens
ctcagtgcatttgtgc

SEQ ID NO: 3658658 - DNA, 17 bp, Homo sapiens
ctcagtgcatttgtgct

SEQ ID NO: 3658659 - DNA, 18 bp, Homo sapiens
ctcagtgggctgtttctg

SEQ ID NO: 3658660 - DNA, 14 bp, Homo sapiens
ctcagttcccttgg

SEQ ID NO: 3658661 - DNA, 15 bp, Homo sapiens
ctcatatcagtttgc

SEQ ID NO: 3658662 - DNA, 18 bp, Homo sapiens
ctcatcaacttaaaagtc

SEQ ID NO: 3658663 - DNA, 13 bp, Homo sapiens
ctcatccccaggg

SEQ ID NO: 3658664 - DNA, 14 bp, Homo sapiens
ctcatccccagggg

SEQ ID NO: 3658665 - DNA, 22 bp, Homo sapiens
ctcatccccaggggtcccagcc

SEQ ID NO: 3658666 - DNA, 12 bp, Homo sapiens
ctcatccgcctg

SEQ ID NO: 3658667 - DNA, 12 bp, Homo sapiens
ctcatctgctgg

SEQ ID NO: 3658668 - DNA, 13 bp, Homo sapiens
ctcatctgctggt

SEQ ID NO: 3658669 - DNA, 14 bp, Homo sapiens
ctcatctgctggtc

SEQ ID NO: 3658670 - DNA, 21 bp, Homo sapiens
ctcattagcattttgctaaat

SEQ ID NO: 3658671 - DNA, 18 bp, Homo sapiens
ctcatttacaactgaaac

SEQ ID NO: 3658672 - DNA, 15 bp, Homo sapiens
ctcatttgggggcgt

SEQ ID NO: 3658673 - DNA, 22 bp, Homo sapiens
ctccaaactgaagcagcctctc

SEQ ID NO: 3658674 - DNA, 23 bp, Homo sapiens
ctccaaactgaagcagcctctcc

SEQ ID NO: 3658675 - DNA, 23 bp, Homo sapiens
ctccaaatctcaatgaagccagc

SEQ ID NO: 3658676 - DNA, 17 bp, Homo sapiens
ctccaagccccatcttc

SEQ ID NO: 3658677 - DNA, 18 bp, Homo sapiens
ctccaatggggcggggct

SEQ ID NO: 3658678 - DNA, 13 bp, Homo sapiens
ctccaccacatcc

SEQ ID NO: 3658679 - DNA, 16 bp, Homo sapiens
ctccacccttggcctg

SEQ ID NO: 3658680 - DNA, 16 bp, Homo sapiens
ctccactctgcttctc

SEQ ID NO: 3658681 - DNA, 20 bp, Homo sapiens
ctccactctgcttctctgac

SEQ ID NO: 3658682 - DNA, 18 bp, Homo sapiens
ctccactgccatgtaccc

SEQ ID NO: 3658683 - DNA, 15 bp, Homo sapiens
ctccagaagcctctg

SEQ ID NO: 3658684 - DNA, 21 bp, Homo sapiens
ctccagaagcctctggctaga

SEQ ID NO: 3658685 - DNA, 11 bp, Homo sapiens
ctccagcctgg

SEQ ID NO: 3658686 - DNA, 12 bp, Homo sapiens
ctccagcctggt

SEQ ID NO: 3658687 - DNA, 16 bp, Homo sapiens
ctccagcctggtggcc

SEQ ID NO: 3658688 - DNA, 18 bp, Homo sapiens
ctccagcctggtggccca

SEQ ID NO: 3658689 - DNA, 19 bp, Homo sapiens
ctccagcctggtggcccag

SEQ ID NO: 3658690 - DNA, 22 bp, Homo sapiens
ctccagcctggtggcccagcta

SEQ ID NO: 3658691 - DNA, 18 bp, Homo sapiens
ctccagcgtcagctgctc

SEQ ID NO: 3658692 - DNA, 19 bp, Homo sapiens
ctccagcgtcagctgctcc

SEQ ID NO: 3658693 - DNA, 23 bp, Homo sapiens
ctccagcgtcagctgctccctgg

SEQ ID NO: 3658694 - DNA, 19 bp, Homo sapiens
ctccagctgttcagctggt

SEQ ID NO: 3658695 - DNA, 13 bp, Homo sapiens
ctccaggccctcc

SEQ ID NO: 3658696 - DNA, 14 bp, Homo sapiens
ctccaggggctgct

SEQ ID NO: 3658697 - DNA, 21 bp, Homo sapiens
ctccaggggctgcttcctcct

SEQ ID NO: 3658698 - DNA, 22 bp, Homo sapiens
ctccaggggctgcttcctcctg

SEQ ID NO: 3658699 - DNA, 13 bp, Homo sapiens
ctccaggtgcaga

SEQ ID NO: 3658700 - DNA, 14 bp, Homo sapiens
ctccaggtgcagag

SEQ ID NO: 3658701 - DNA, 16 bp, Homo sapiens
ctccagtgctggattt

SEQ ID NO: 3658702 - DNA, 14 bp, Homo sapiens
ctccatccaaggcc

SEQ ID NO: 3658703 - DNA, 15 bp, Homo sapiens
ctcccaaagaggccc

SEQ ID NO: 3658704 - DNA, 11 bp, Homo sapiens
ctcccaagctg

SEQ ID NO: 3658705 - DNA, 22 bp, Homo sapiens
ctcccacccccttctctgctcc

SEQ ID NO: 3658706 - DNA, 17 bp, Homo sapiens
ctcccacccggctgcag

SEQ ID NO: 3658707 - DNA, 16 bp, Homo sapiens
ctcccagaacacactc

SEQ ID NO: 3658708 - DNA, 24 bp, Homo sapiens
ctcccagaacacactccatcagct

SEQ ID NO: 3658709 - DNA, 18 bp, Homo sapiens
ctcccaggctggagagca

SEQ ID NO: 3658710 - DNA, 22 bp, Homo sapiens
ctcccataattgctttgccaaa

SEQ ID NO: 3658711 - DNA, 21 bp, Homo sapiens
ctcccatgaccatactgaggg

SEQ ID NO: 3658712 - DNA, 15 bp, Homo sapiens
ctcccattcctgaag

SEQ ID NO: 3658713 - DNA, 19 bp, Homo sapiens
ctccccagcattccagccc

SEQ ID NO: 3658714 - DNA, 23 bp, Homo sapiens
ctccccagcattccagcccctct

SEQ ID NO: 3658715 - DNA, 23 bp, Homo sapiens
ctccccaggtccagctctggagg

SEQ ID NO: 3658716 - DNA, 13 bp, Homo sapiens
ctcccccccatgc

SEQ ID NO: 3658717 - DNA, 18 bp, Homo sapiens
ctcccccccatgcactgt

SEQ ID NO: 3658718 - DNA, 20 bp, Homo sapiens
ctcccccccatgcactgtga

SEQ ID NO: 3658719 - DNA, 21 bp, Homo sapiens
ctcccccccatgcactgtgaa

SEQ ID NO: 3658720 - DNA, 22 bp, Homo sapiens
ctccccgtgtcctctccctgcc

SEQ ID NO: 3658721 - DNA, 12 bp, Homo sapiens
ctcccctggaca

SEQ ID NO: 3658722 - DNA, 22 bp, Homo sapiens
ctccccttgatttaaacacaca

SEQ ID NO: 3658723 - DNA, 13 bp, Homo sapiens
ctccctaccacct

SEQ ID NO: 3658724 - DNA, 21 bp, Homo sapiens
ctccctatactgcttggagct

SEQ ID NO: 3658725 - DNA, 16 bp, Homo sapiens
ctccctcccctgccct

SEQ ID NO: 3658726 - DNA, 18 bp, Homo sapiens
ctccctcccctgccctgg

SEQ ID NO: 3658727 - DNA, 21 bp, Homo sapiens
ctccctcccctgccctggtcc

SEQ ID NO: 3658728 - DNA, 14 bp, Homo sapiens
ctccctcctcacct

SEQ ID NO: 3658729 - DNA, 17 bp, Homo sapiens
ctccctcctcacctctg

SEQ ID NO: 3658730 - DNA, 23 bp, Homo sapiens
ctccctgaaaatgtttttctgcc

SEQ ID NO: 3658731 - DNA, 14 bp, Homo sapiens
ctccctgagggcgg

SEQ ID NO: 3658732 - DNA, 20 bp, Homo sapiens
ctccctgcatctgaccagca

SEQ ID NO: 3658733 - DNA, 22 bp, Homo sapiens
ctccctgcatctgaccagcagc

SEQ ID NO: 3658734 - DNA, 23 bp, Homo sapiens
ctccctgcatctgaccagcagcg

SEQ ID NO: 3658735 - DNA, 22 bp, Homo sapiens
ctccctgccaagtctcagaaga

SEQ ID NO: 3658736 - DNA, 20 bp, Homo sapiens
ctccctggagaagcaccagc

SEQ ID NO: 3658737 - DNA, 12 bp, Homo sapiens
ctccctggagct

SEQ ID NO: 3658738 - DNA, 14 bp, Homo sapiens
ctccctggagctag

SEQ ID NO: 3658739 - DNA, 14 bp, Homo sapiens
ctccctggctccca

SEQ ID NO: 3658740 - DNA, 21 bp, Homo sapiens
ctccctggggacggggctccc

SEQ ID NO: 3658741 - DNA, 22 bp, Homo sapiens
ctccctggggacggggctcccc

SEQ ID NO: 3658742 - DNA, 13 bp, Homo sapiens
ctccctgggggcg

SEQ ID NO: 3658743 - DNA, 22 bp, Homo sapiens
ctccctgggggcgggactcctc

SEQ ID NO: 3658744 - DNA, 17 bp, Homo sapiens
ctccctttcttccctac

SEQ ID NO: 3658745 - DNA, 14 bp, Homo sapiens
ctccgccctgccac

SEQ ID NO: 3658746 - DNA, 16 bp, Homo sapiens
ctccgccctgccactc

SEQ ID NO: 3658747 - DNA, 19 bp, Homo sapiens
ctccggcctctgcctttgc

SEQ ID NO: 3658748 - DNA, 16 bp, Homo sapiens
ctccgttagctcctgt

SEQ ID NO: 3658749 - DNA, 21 bp, Homo sapiens
ctccgttagctcctgtggccc

SEQ ID NO: 3658750 - DNA, 13 bp, Homo sapiens
ctcctacctgaag

SEQ ID NO: 3658751 - DNA, 21 bp, Homo sapiens
ctcctacctgaaggcagggct

SEQ ID NO: 3658752 - DNA, 11 bp, Homo sapiens
ctcctacctgg

SEQ ID NO: 3658753 - DNA, 14 bp, Homo sapiens
ctcctacctggggg

SEQ ID NO: 3658754 - DNA, 16 bp, Homo sapiens
ctcctacctgggggca

SEQ ID NO: 3658755 - DNA, 15 bp, Homo sapiens
ctcctagagggaggg

SEQ ID NO: 3658756 - DNA, 18 bp, Homo sapiens
ctcctatatatttctatt

SEQ ID NO: 3658757 - DNA, 18 bp, Homo sapiens
ctcctcacctctggactg

SEQ ID NO: 3658758 - DNA, 16 bp, Homo sapiens
ctgagttttccatggc

SEQ ID NO: 3658759 - DNA, 17 bp, Homo sapiens
ctgatcctggaggccca

SEQ ID NO: 3658760 - DNA, 19 bp, Homo sapiens
ctgatcctggaggcccagt

SEQ ID NO: 3658761 - DNA, 20 bp, Homo sapiens
ctgatctgatgcaagcaaga

SEQ ID NO: 3658762 - DNA, 17 bp, Homo sapiens
ctgatgagatttttaaa

SEQ ID NO: 3658763 - DNA, 14 bp, Homo sapiens
ctgatgctccctcc

SEQ ID NO: 3658764 - DNA, 18 bp, Homo sapiens
ctgatgctccctcccctg

SEQ ID NO: 3658765 - DNA, 19 bp, Homo sapiens
ctgatgctccctcccctgc

SEQ ID NO: 3658766 - DNA, 21 bp, Homo sapiens
ctgatgctccctcccctgccc

SEQ ID NO: 3658767 - DNA, 22 bp, Homo sapiens
ctgatgctccctcccctgccct

SEQ ID NO: 3658768 - DNA, 23 bp, Homo sapiens
ctgatgctccctcccctgccctg

SEQ ID NO: 3658769 - DNA, 14 bp, Homo sapiens
ctgatgctgcccct

SEQ ID NO: 3658770 - DNA, 22 bp, Homo sapiens
ctgatgggaaaactgccaatat

SEQ ID NO: 3658771 - DNA, 18 bp, Homo sapiens
ctgatgtcaatttctgtg

SEQ ID NO: 3658772 - DNA, 19 bp, Homo sapiens
ctgatgtcaatttctgtgt

SEQ ID NO: 3658773 - DNA, 16 bp, Homo sapiens
ctgattacctgccaat

SEQ ID NO: 3658774 - DNA, 19 bp, Homo sapiens
ctgattccgcaccctgcct

SEQ ID NO: 3658775 - DNA, 15 bp, Homo sapiens
ctgattggcagatga

SEQ ID NO: 3658776 - DNA, 20 bp, Homo sapiens
ctgatttaggagaagccagg

SEQ ID NO: 3658777 - DNA, 13 bp, Homo sapiens
ctgcaaaatctgt

SEQ ID NO: 3658778 - DNA, 22 bp, Homo sapiens
ctgcaaacaccaacatgttggg

SEQ ID NO: 3658779 - DNA, 22 bp, Homo sapiens
ctgcaaccactctgtggccagc

SEQ ID NO: 3658780 - DNA, 19 bp, Homo sapiens
ctgcaacttgtaaatgtgg

SEQ ID NO: 3658781 - DNA, 18 bp, Homo sapiens
ctgcaagaattgaagcag

SEQ ID NO: 3658782 - DNA, 18 bp, Homo sapiens
ctgcaaggtttaggctgg

SEQ ID NO: 3658783 - DNA, 13 bp, Homo sapiens
ctgcacaagctgc

SEQ ID NO: 3658784 - DNA, 14 bp, Homo sapiens
ctgcacaagctgca

SEQ ID NO: 3658785 - DNA, 13 bp, Homo sapiens
ctgcactccagcc

SEQ ID NO: 3658786 - DNA, 15 bp, Homo sapiens
ctgcactccagcctg

SEQ ID NO: 3658787 - DNA, 17 bp, Homo sapiens
ctgcactccagcctggg

SEQ ID NO: 3658788 - DNA, 20 bp, Homo sapiens
ctgcactccagcctgggtga

SEQ ID NO: 3658789 - DNA, 15 bp, Homo sapiens
ctgcactgatgctgc

SEQ ID NO: 3658790 - DNA, 22 bp, Homo sapiens
ctgcagcaccgaggggcctttg

SEQ ID NO: 3658791 - DNA, 12 bp, Homo sapiens
ctgcagccagct

SEQ ID NO: 3658792 - DNA, 12 bp, Homo sapiens
ctgcagctttgt

SEQ ID NO: 3658793 - DNA, 23 bp, Homo sapiens
ctgcaggaatcccggctccagag

SEQ ID NO: 3658794 - DNA, 14 bp, Homo sapiens
ctgcaggaatcttt

SEQ ID NO: 3658795 - DNA, 15 bp, Homo sapiens
ctgcaggccctggcc

SEQ ID NO: 3658796 - DNA, 21 bp, Homo sapiens
ctgcaggccctggcctcccct

SEQ ID NO: 3658797 - DNA, 22 bp, Homo sapiens
ctgcaggcggggctcctcctga

SEQ ID NO: 3658798 - DNA, 11 bp, Homo sapiens
ctgcagggcca

SEQ ID NO: 3658799 - DNA, 19 bp, Homo sapiens
ctgcagggccatggctcag

SEQ ID NO: 3658800 - DNA, 20 bp, Homo sapiens
ctgcagggccatggctcagg

SEQ ID NO: 3658801 - DNA, 21 bp, Homo sapiens
ctgcagggccatggctcaggg

SEQ ID NO: 3658802 - DNA, 14 bp, Homo sapiens
ctgcagtcacagct

SEQ ID NO: 3658803 - DNA, 19 bp, Homo sapiens
ctgcagttcttgtggaaga

SEQ ID NO: 3658804 - DNA, 20 bp, Homo sapiens
ctgcataagtgaaaatctta

SEQ ID NO: 3658805 - DNA, 15 bp, Homo sapiens
ctgcataccaacctg

SEQ ID NO: 3658806 - DNA, 18 bp, Homo sapiens
ctgcataggctccttcct

SEQ ID NO: 3658807 - DNA, 18 bp, Homo sapiens
ctgcatctgaccagcagc

SEQ ID NO: 3658808 - DNA, 13 bp, Homo sapiens
ctgcatctgtctg

SEQ ID NO: 3658809 - DNA, 17 bp, Homo sapiens
ctgcatgtctactcagc

SEQ ID NO: 3658810 - DNA, 20 bp, Homo sapiens
ctgcattcttaacaaactct

SEQ ID NO: 3658811 - DNA, 13 bp, Homo sapiens
ctgcattggcttt

SEQ ID NO: 3658812 - DNA, 22 bp, Homo sapiens
ctgccaaaatgctctagtgcct

SEQ ID NO: 3658813 - DNA, 21 bp, Homo sapiens
ctgccaaggccagagtggcct

SEQ ID NO: 3658814 - DNA, 18 bp, Homo sapiens
ctgccaccaggccacctc

SEQ ID NO: 3658815 - DNA, 15 bp, Homo sapiens
ctgccacccacctcc

SEQ ID NO: 3658816 - DNA, 18 bp, Homo sapiens
ctgccacccacctccctg

SEQ ID NO: 3658817 - DNA, 23 bp, Homo sapiens
ctgccactgtgaaccggctccca

SEQ ID NO: 3658818 - DNA, 19 bp, Homo sapiens
ctgccagcggtttcctggt

SEQ ID NO: 3658819 - DNA, 12 bp, Homo sapiens
ctgccagctgca

SEQ ID NO: 3658820 - DNA, 13 bp, Homo sapiens
ctgccagctgcac

SEQ ID NO: 3658821 - DNA, 23 bp, Homo sapiens
ctgccaggacccaccactggaag

SEQ ID NO: 3658822 - DNA, 21 bp, Homo sapiens
ctgccaggcccccaagcctgc

SEQ ID NO: 3658823 - DNA, 21 bp, Homo sapiens
ctgccagtgacagacaggctc

SEQ ID NO: 3658824 - DNA, 23 bp, Homo sapiens
ctgccagtgacagacaggctctt

SEQ ID NO: 3658825 - DNA, 23 bp, Homo sapiens
ctgccatctcacctcctgctggg

SEQ ID NO: 3658826 - DNA, 14 bp, Homo sapiens
ctgccatgccagct

SEQ ID NO: 3658827 - DNA, 17 bp, Homo sapiens
ctgccatgccagcttat

SEQ ID NO: 3658828 - DNA, 19 bp, Homo sapiens
ctgccattgggaccctcca

SEQ ID NO: 3658829 - DNA, 23 bp, Homo sapiens
ctgccattgggaccctccagtgc

SEQ ID NO: 3658830 - DNA, 16 bp, Homo sapiens
ctgccatttctgagat

SEQ ID NO: 3658831 - DNA, 12 bp, Homo sapiens
ctgcccacctgt

SEQ ID NO: 3658832 - DNA, 17 bp, Homo sapiens
ctgcccagagctgctgg

SEQ ID NO: 3658833 - DNA, 21 bp, Homo sapiens
ctgcccagagctgctggtctc

SEQ ID NO: 3658834 - DNA, 13 bp, Homo sapiens
ctgcccagcccct

SEQ ID NO: 3658835 - DNA, 16 bp, Homo sapiens
ctgcccaggcactgca

SEQ ID NO: 3658836 - DNA, 22 bp, Homo sapiens
ctgcccatcacagggttgggcc

SEQ ID NO: 3658837 - DNA, 12 bp, Homo sapiens
ctgccccaggcc

SEQ ID NO: 3658838 - DNA, 13 bp, Homo sapiens
ctgccccaggcct

SEQ ID NO: 3658839 - DNA, 16 bp, Homo sapiens
ctgccccatcctccag

SEQ ID NO: 3658840 - DNA, 19 bp, Homo sapiens
ctgccccggagctggagga

SEQ ID NO: 3658841 - DNA, 13 bp, Homo sapiens
ctgcccctcccag

SEQ ID NO: 3658842 - DNA, 14 bp, Homo sapiens
ctgcccctcccaga

SEQ ID NO: 3658843 - DNA, 13 bp, Homo sapiens
ctgcccctccccc

SEQ ID NO: 3658844 - DNA, 22 bp, Homo sapiens
ctgcccctcccccaacccccac

SEQ ID NO: 3658845 - DNA, 13 bp, Homo sapiens
ctgcccctgctgc

SEQ ID NO: 3658846 - DNA, 15 bp, Homo sapiens
ctgcccctgctgctt

SEQ ID NO: 3658847 - DNA, 22 bp, Homo sapiens
ctgccccttcctttaaaaaact

SEQ ID NO: 3658848 - DNA, 13 bp, Homo sapiens
ctgcccgggctcc

SEQ ID NO: 3658849 - DNA, 14 bp, Homo sapiens
ctgcccgggctccc

SEQ ID NO: 3658850 - DNA, 20 bp, Homo sapiens
ctgccctggtccagggaagc

SEQ ID NO: 3658851 - DNA, 21 bp, Homo sapiens
ctgccctggtccagggaagct

SEQ ID NO: 3658852 - DNA, 23 bp, Homo sapiens
ctgccctggtccagggaagctgg

SEQ ID NO: 3658853 - DNA, 15 bp, Homo sapiens
ctgcccttgtcccac

SEQ ID NO: 3658854 - DNA, 17 bp, Homo sapiens
ctgcccttgtcccactc

SEQ ID NO: 3658855 - DNA, 21 bp, Homo sapiens
ctgccggccctggggctaggc

SEQ ID NO: 3658856 - DNA, 20 bp, Homo sapiens
ctgcctcagcctccctggta

SEQ ID NO: 3658857 - DNA, 16 bp, Homo sapiens
ctgcctccagcctggt

SEQ ID NO: 3658858 - DNA, 17 bp, Homo sapiens
ctgcctccagcctggtg

SEQ ID NO: 3658859 - DNA, 19 bp, Homo sapiens
ctgcctccagcctggtggc

SEQ ID NO: 3658860 - DNA, 13 bp, Homo sapiens
ctgcctccaggaa

SEQ ID NO: 3658861 - DNA, 13 bp, Homo sapiens
ctgcctcttctct

SEQ ID NO: 3658862 - DNA, 14 bp, Homo sapiens
ctgcctcttctcta

SEQ ID NO: 3658863 - DNA, 19 bp, Homo sapiens
ctgcctctttccctaggaa

SEQ ID NO: 3658864 - DNA, 15 bp, Homo sapiens
ctgcctgagggtggg

SEQ ID NO: 3658865 - DNA, 15 bp, Homo sapiens
ctgcctgccagctgc

SEQ ID NO: 3658866 - DNA, 12 bp, Homo sapiens
ctgcctgctttg

SEQ ID NO: 3658867 - DNA, 13 bp, Homo sapiens
ctgcctgctttgg

SEQ ID NO: 3658868 - DNA, 22 bp, Homo sapiens
ctgcctggagacttagggcacc

SEQ ID NO: 3658869 - DNA, 12 bp, Homo sapiens
ctgcctggccag

SEQ ID NO: 3658870 - DNA, 12 bp, Homo sapiens
ctgcctgtggcg

SEQ ID NO: 3658871 - DNA, 17 bp, Homo sapiens
ctgccttcgcttcttgc

SEQ ID NO: 3658872 - DNA, 15 bp, Homo sapiens
ctgcgaccctggggg

SEQ ID NO: 3658873 - DNA, 14 bp, Homo sapiens
ctgcgactttctgc

SEQ ID NO: 3658874 - DNA, 17 bp, Homo sapiens
ctgcgactttctgcctg

SEQ ID NO: 3658875 - DNA, 23 bp, Homo sapiens
cttgccagagatccaaaagaagc

SEQ ID NO: 3658876 - DNA, 13 bp, Homo sapiens
cttgcccaggagc

SEQ ID NO: 3658877 - DNA, 14 bp, Homo sapiens
cttgcccaggagca

SEQ ID NO: 3658878 - DNA, 17 bp, Homo sapiens
cttgcctcaatgccagt

SEQ ID NO: 3658879 - DNA, 21 bp, Homo sapiens
cttgcctccaggtgcagaggt

SEQ ID NO: 3658880 - DNA, 16 bp, Homo sapiens
cttgcctcttccttga

SEQ ID NO: 3658881 - DNA, 20 bp, Homo sapiens
cttgcctgcagggccatggc

SEQ ID NO: 3658882 - DNA, 19 bp, Homo sapiens
cttgctggaagacagagaa

SEQ ID NO: 3658883 - DNA, 20 bp, Homo sapiens
cttgctggaagacagagaaa

SEQ ID NO: 3658884 - DNA, 13 bp, Homo sapiens
cttgcttccctaa

SEQ ID NO: 3658885 - DNA, 13 bp, Homo sapiens
cttgctttcacat

SEQ ID NO: 3658886 - DNA, 15 bp, Homo sapiens
cttggaaaggaccag

SEQ ID NO: 3658887 - DNA, 15 bp, Homo sapiens
cttggacatcctcct

SEQ ID NO: 3658888 - DNA, 13 bp, Homo sapiens
cttggaggacagt

SEQ ID NO: 3658889 - DNA, 16 bp, Homo sapiens
cttggaggacagtggg

SEQ ID NO: 3658890 - DNA, 14 bp, Homo sapiens
cttggagggaagcc

SEQ ID NO: 3658891 - DNA, 18 bp, Homo sapiens
cttggatgggacattttt

SEQ ID NO: 3658892 - DNA, 19 bp, Homo sapiens
cttggcaccagacacccag

SEQ ID NO: 3658893 - DNA, 19 bp, Homo sapiens
cttggcctaaacctcagtt

SEQ ID NO: 3658894 - DNA, 12 bp, Homo sapiens
cttggcctcaga

SEQ ID NO: 3658895 - DNA, 17 bp, Homo sapiens
cttggcctgtctcatcc

SEQ ID NO: 3658896 - DNA, 16 bp, Homo sapiens
cttggcctttcctgga

SEQ ID NO: 3658897 - DNA, 21 bp, Homo sapiens
cttggctcgaatctctgtgcc

SEQ ID NO: 3658898 - DNA, 15 bp, Homo sapiens
cttgggaggccccac

SEQ ID NO: 3658899 - DNA, 18 bp, Homo sapiens
cttgggcagagctggctc

SEQ ID NO: 3658900 - DNA, 19 bp, Homo sapiens
cttgggcagagctggctct

SEQ ID NO: 3658901 - DNA, 14 bp, Homo sapiens
cttgggctgctcct

SEQ ID NO: 3658902 - DNA, 22 bp, Homo sapiens
cttggggagttaagacctggca

SEQ ID NO: 3658903 - DNA, 16 bp, Homo sapiens
cttggggcccagtgca

SEQ ID NO: 3658904 - DNA, 17 bp, Homo sapiens
cttggggcccagtgcat

SEQ ID NO: 3658905 - DNA, 19 bp, Homo sapiens
cttggggcccagtgcatgg

SEQ ID NO: 3658906 - DNA, 22 bp, Homo sapiens
cttggggggctgaggtgggagg

SEQ ID NO: 3658907 - DNA, 23 bp, Homo sapiens
cttggggggctgaggtgggagga

SEQ ID NO: 3658908 - DNA, 14 bp, Homo sapiens
cttgggggggtggc

SEQ ID NO: 3658909 - DNA, 19 bp, Homo sapiens
cttgggggggtggccgctg

SEQ ID NO: 3658910 - DNA, 17 bp, Homo sapiens
cttgggtcccagggaag

SEQ ID NO: 3658911 - DNA, 15 bp, Homo sapiens
cttggtgggggagcc

SEQ ID NO: 3658912 - DNA, 19 bp, Homo sapiens
cttggtgggggagcctctg

SEQ ID NO: 3658913 - DNA, 16 bp, Homo sapiens
cttggtttatgtcttg

SEQ ID NO: 3658914 - DNA, 18 bp, Homo sapiens
cttgtaaagactgtagaa

SEQ ID NO: 3658915 - DNA, 22 bp, Homo sapiens
cttgtcatagactcctttgcta

SEQ ID NO: 3658916 - DNA, 22 bp, Homo sapiens
cttgtccagttcaaataagaaa

SEQ ID NO: 3658917 - DNA, 14 bp, Homo sapiens
cttgtcccagccag

SEQ ID NO: 3658918 - DNA, 20 bp, Homo sapiens
cttgtctggcaaaagaaaaa

SEQ ID NO: 3658919 - DNA, 13 bp, Homo sapiens
cttgtggaagaca

SEQ ID NO: 3658920 - DNA, 19 bp, Homo sapiens
cttgtggaagacacttgct

SEQ ID NO: 3658921 - DNA, 21 bp, Homo sapiens
cttgtggaagacacttgctga

SEQ ID NO: 3658922 - DNA, 18 bp, Homo sapiens
cttgtgtcaagacatttc

SEQ ID NO: 3658923 - DNA, 21 bp, Homo sapiens
cttgtgtcaagacatttctct

SEQ ID NO: 3658924 - DNA, 18 bp, Homo sapiens
cttgttaaagagcactgg

SEQ ID NO: 3658925 - DNA, 14 bp, Homo sapiens
cttgttacttctga

SEQ ID NO: 3658926 - DNA, 17 bp, Homo sapiens
cttgttacttctgaggt

SEQ ID NO: 3658927 - DNA, 13 bp, Homo sapiens
ctttaaaagagag

SEQ ID NO: 3658928 - DNA, 16 bp, Homo sapiens
ctttaaaagagagaga

SEQ ID NO: 3658929 - DNA, 21 bp, Homo sapiens
ctttaaaagagagagagagaa

SEQ ID NO: 3658930 - DNA, 19 bp, Homo sapiens
ctttaaaatgtaaagccat

SEQ ID NO: 3658931 - DNA, 21 bp, Homo sapiens
ctttaaaatgtaaagccatgc

SEQ ID NO: 3658932 - DNA, 14 bp, Homo sapiens
ctttaaatgctgct

SEQ ID NO: 3658933 - DNA, 14 bp, Homo sapiens
ctttaacagtggag

SEQ ID NO: 3658934 - DNA, 18 bp, Homo sapiens
ctttaaccttgtataaat

SEQ ID NO: 3658935 - DNA, 12 bp, Homo sapiens
ctttaagaaaaa

SEQ ID NO: 3658936 - DNA, 20 bp, Homo sapiens
ctttacatctatgtgtatgt

SEQ ID NO: 3658937 - DNA, 21 bp, Homo sapiens
ctttacgtgtttaaaaaaaag

SEQ ID NO: 3658938 - DNA, 19 bp, Homo sapiens
ctttagaaagctgacattg

SEQ ID NO: 3658939 - DNA, 13 bp, Homo sapiens
ctttagagatgct

SEQ ID NO: 3658940 - DNA, 19 bp, Homo sapiens
ctttagagattataacaaa

SEQ ID NO: 3658941 - DNA, 22 bp, Homo sapiens
ctttaggagatttattttttgg

SEQ ID NO: 3658942 - DNA, 12 bp, Homo sapiens
ctttatcacctc

SEQ ID NO: 3658943 - DNA, 17 bp, Homo sapiens
ctttatcacctcattct

SEQ ID NO: 3658944 - DNA, 15 bp, Homo sapiens
ctttatttgtattac

SEQ ID NO: 3658945 - DNA, 12 bp, Homo sapiens
ctttcaaagctt

SEQ ID NO: 3658946 - DNA, 15 bp, Homo sapiens
ctttcagtacttttt

SEQ ID NO: 3658947 - DNA, 21 bp, Homo sapiens
ctttcagtacttttttaaata

SEQ ID NO: 3658948 - DNA, 14 bp, Homo sapiens
ctttcatgcagtgc

SEQ ID NO: 3658949 - DNA, 18 bp, Homo sapiens
ctttccaaatgcccagct

SEQ ID NO: 3658950 - DNA, 17 bp, Homo sapiens
ctttccaccacagccag

SEQ ID NO: 3658951 - DNA, 15 bp, Homo sapiens
ctttcccatcttaaa

SEQ ID NO: 3658952 - DNA, 16 bp, Homo sapiens
ctttcccatggggagg

SEQ ID NO: 3658953 - DNA, 10 bp, Homo sapiens
ctttcctgcc

SEQ ID NO: 3658954 - DNA, 16 bp, Homo sapiens
ctttcctggaagccag

SEQ ID NO: 3658955 - DNA, 12 bp, Homo sapiens
ctttcctggagc

SEQ ID NO: 3658956 - DNA, 13 bp, Homo sapiens
ctttcctggagcc

SEQ ID NO: 3658957 - DNA, 13 bp, Homo sapiens
ctttctctgccag

SEQ ID NO: 3658958 - DNA, 12 bp, Homo sapiens
ctttctgcctgg

SEQ ID NO: 3658959 - DNA, 17 bp, Homo sapiens
ctttctgctcagcttct

SEQ ID NO: 3658960 - DNA, 13 bp, Homo sapiens
ctttgaatgttaa

SEQ ID NO: 3658961 - DNA, 22 bp, Homo sapiens
ctttgaatttcttgatttttca

SEQ ID NO: 3658962 - DNA, 12 bp, Homo sapiens
ctttgactgaaa

SEQ ID NO: 3658963 - DNA, 14 bp, Homo sapiens
ctttgactttcttc

SEQ ID NO: 3658964 - DNA, 22 bp, Homo sapiens
ctttgatacagtcaacaagcct

SEQ ID NO: 3658965 - DNA, 21 bp, Homo sapiens
ctttgcaaagtattgtaaatt

SEQ ID NO: 3658966 - DNA, 15 bp, Homo sapiens
ctttgcaatccaaat

SEQ ID NO: 3658967 - DNA, 21 bp, Homo sapiens
ctttgcagctgcccagcccct

SEQ ID NO: 3658968 - DNA, 15 bp, Homo sapiens
ctttgccaaaatacc

SEQ ID NO: 3658969 - DNA, 22 bp, Homo sapiens
ctttgccaaaataccagagcct

SEQ ID NO: 3658970 - DNA, 14 bp, Homo sapiens
ctttgcccacaatg

SEQ ID NO: 3658971 - DNA, 16 bp, Homo sapiens
ctttgccttgggctgc

SEQ ID NO: 3658972 - DNA, 19 bp, Homo sapiens
ctttgccttgggctgctcc

SEQ ID NO: 3658973 - DNA, 22 bp, Homo sapiens
ctttgccttgggctgctcctca

SEQ ID NO: 3658974 - DNA, 17 bp, Homo sapiens
ctttgctttctgctcag

SEQ ID NO: 3658975 - DNA, 21 bp, Homo sapiens
ctttgctttctgctcagcttc

SEQ ID NO: 3658976 - DNA, 21 bp, Homo sapiens
ctttggggcttttacaccagt

SEQ ID NO: 3658977 - DNA, 21 bp, Homo sapiens
ctttgtagctaacagtgaaga

SEQ ID NO: 3658978 - DNA, 23 bp, Homo sapiens
ctttgtataatcccacccacctc

SEQ ID NO: 3658979 - DNA, 14 bp, Homo sapiens
ctttgtatattaca

SEQ ID NO: 3658980 - DNA, 16 bp, Homo sapiens
ctttgtgacttcttct

SEQ ID NO: 3658981 - DNA, 14 bp, Homo sapiens
ctttgtggccaagg

SEQ ID NO: 3658982 - DNA, 18 bp, Homo sapiens
ctttgtggccaaggagct

SEQ ID NO: 3658983 - DNA, 15 bp, Homo sapiens
ctttgttcagcctgc

SEQ ID NO: 3658984 - DNA, 18 bp, Homo sapiens
ctttgtttgttgtcagct

SEQ ID NO: 3658985 - DNA, 15 bp, Homo sapiens
cttttaatcctggct

SEQ ID NO: 3658986 - DNA, 20 bp, Homo sapiens
cttttataggtgagaaaaaa

SEQ ID NO: 3658987 - DNA, 19 bp, Homo sapiens
cttttccactccattgtcg

SEQ ID NO: 3658988 - DNA, 13 bp, Homo sapiens
cttttccctgggt

SEQ ID NO: 3658989 - DNA, 15 bp, Homo sapiens
cttttccctgggtgg

SEQ ID NO: 3658990 - DNA, 16 bp, Homo sapiens
cttttccctgggtgga

SEQ ID NO: 3658991 - DNA, 15 bp, Homo sapiens
cttttcccttgcttc

SEQ ID NO: 3658992 - DNA, 19 bp, Homo sapiens
gagaggacaatactggggt

SEQ ID NO: 3658993 - DNA, 17 bp, Homo sapiens
gagaggccaaaggctgg

SEQ ID NO: 3658994 - DNA, 16 bp, Homo sapiens
gagaggccctctggag

SEQ ID NO: 3658995 - DNA, 20 bp, Homo sapiens
gagaggccctctggagtggc

SEQ ID NO: 3658996 - DNA, 23 bp, Homo sapiens
gagaggccctctggagtggccac

SEQ ID NO: 3658997 - DNA, 21 bp, Homo sapiens
gagagtgtcttcacggcagga

SEQ ID NO: 3658998 - DNA, 14 bp, Homo sapiens
gagatcagcctggg

SEQ ID NO: 3658999 - DNA, 21 bp, Homo sapiens
gagatccaaaagaagccccca

SEQ ID NO: 3659000 - DNA, 13 bp, Homo sapiens
gagatcctgatag

SEQ ID NO: 3659001 - DNA, 18 bp, Homo sapiens
gagatgcaccaccaagcc

SEQ ID NO: 3659002 - DNA, 21 bp, Homo sapiens
gagatgcaccaccaagccaag

SEQ ID NO: 3659003 - DNA, 23 bp, Homo sapiens
gagatggatcaatcaaacccggc

SEQ ID NO: 3659004 - DNA, 14 bp, Homo sapiens
gagatggggtgggg

SEQ ID NO: 3659005 - DNA, 23 bp, Homo sapiens
gagatgtccttgtaatattccct

SEQ ID NO: 3659006 - DNA, 14 bp, Homo sapiens
gagattcagactgt

SEQ ID NO: 3659007 - DNA, 17 bp, Homo sapiens
gagattggacggcctga

SEQ ID NO: 3659008 - DNA, 20 bp, Homo sapiens
gagcactgggtcatatggaa

SEQ ID NO: 3659009 - DNA, 11 bp, Homo sapiens
gagcagcctgt

SEQ ID NO: 3659010 - DNA, 15 bp, Homo sapiens
gagcagcctgtggca

SEQ ID NO: 3659011 - DNA, 14 bp, Homo sapiens
gagcagtggctggt

SEQ ID NO: 3659012 - DNA, 12 bp, Homo sapiens
gagcatcacaga

SEQ ID NO: 3659013 - DNA, 13 bp, Homo sapiens
gagcatcacagaa

SEQ ID NO: 3659014 - DNA, 22 bp, Homo sapiens
gagccaatggcccggcccctcc

SEQ ID NO: 3659015 - DNA, 24 bp, Homo sapiens
gagcccactgtcctgggcctgcag

SEQ ID NO: 3659016 - DNA, 14 bp, Homo sapiens
gagcccagctccaa

SEQ ID NO: 3659017 - DNA, 13 bp, Homo sapiens
gagccccagggtc

SEQ ID NO: 3659018 - DNA, 24 bp, Homo sapiens
gagccccagggtcttccctacctc

SEQ ID NO: 3659019 - DNA, 15 bp, Homo sapiens
gagcctctggaatgc

SEQ ID NO: 3659020 - DNA, 13 bp, Homo sapiens
gagcctgcaggga

SEQ ID NO: 3659021 - DNA, 15 bp, Homo sapiens
gagcctggcaagaat

SEQ ID NO: 3659022 - DNA, 13 bp, Homo sapiens
gagccttcaagtg

SEQ ID NO: 3659023 - DNA, 18 bp, Homo sapiens
gagccttcaagtgccaaa

SEQ ID NO: 3659024 - DNA, 16 bp, Homo sapiens
gagcgaaaacaggaga

SEQ ID NO: 3659025 - DNA, 15 bp, Homo sapiens
gagcgcctgcccctc

SEQ ID NO: 3659026 - DNA, 22 bp, Homo sapiens
gagcgcctgcccctcccagaac

SEQ ID NO: 3659027 - DNA, 16 bp, Homo sapiens
gagcggaaagcagctc

SEQ ID NO: 3659028 - DNA, 12 bp, Homo sapiens
gagctccactct

SEQ ID NO: 3659029 - DNA, 17 bp, Homo sapiens
gagctgaggcaattcta

SEQ ID NO: 3659030 - DNA, 18 bp, Homo sapiens
gagctgcccctgctgctt

SEQ ID NO: 3659031 - DNA, 13 bp, Homo sapiens
gagctgcctccag

SEQ ID NO: 3659032 - DNA, 16 bp, Homo sapiens
gagctgcctccagcct

SEQ ID NO: 3659033 - DNA, 22 bp, Homo sapiens
gagctgctggtctcatttgggg

SEQ ID NO: 3659034 - DNA, 13 bp, Homo sapiens
gagctggctctga

SEQ ID NO: 3659035 - DNA, 15 bp, Homo sapiens
gagctgggaaggttc

SEQ ID NO: 3659036 - DNA, 16 bp, Homo sapiens
gagctgggatcctaag

SEQ ID NO: 3659037 - DNA, 19 bp, Homo sapiens
gagctgggcagaaggccaa

SEQ ID NO: 3659038 - DNA, 13 bp, Homo sapiens
gagctgggcccga

SEQ ID NO: 3659039 - DNA, 16 bp, Homo sapiens
gagctggtgcccggag

SEQ ID NO: 3659040 - DNA, 16 bp, Homo sapiens
gagctgtttatggcct

SEQ ID NO: 3659041 - DNA, 17 bp, Homo sapiens
gagctgtttatggcctc

SEQ ID NO: 3659042 - DNA, 18 bp, Homo sapiens
gagctgtttatggcctca

SEQ ID NO: 3659043 - DNA, 22 bp, Homo sapiens
gagctgtttatggcctcagctg

SEQ ID NO: 3659044 - DNA, 13 bp, Homo sapiens
gagcttctcctga

SEQ ID NO: 3659045 - DNA, 22 bp, Homo sapiens
gagctttctgctatcaaagagg

SEQ ID NO: 3659046 - DNA, 14 bp, Homo sapiens
gaggaaactcagag

SEQ ID NO: 3659047 - DNA, 14 bp, Homo sapiens
gaggaaaggccagc

SEQ ID NO: 3659048 - DNA, 23 bp, Homo sapiens
gaggaaaggccagctggcagcag

SEQ ID NO: 3659049 - DNA, 20 bp, Homo sapiens
gaggaaggggtgctgtgagg

SEQ ID NO: 3659050 - DNA, 20 bp, Homo sapiens
gaggacaggcgggaggaggt

SEQ ID NO: 3659051 - DNA, 20 bp, Homo sapiens
gaggacataatggggtcctg

SEQ ID NO: 3659052 - DNA, 12 bp, Homo sapiens
gaggagctgctg

SEQ ID NO: 3659053 - DNA, 13 bp, Homo sapiens
gaggagctgctgg

SEQ ID NO: 3659054 - DNA, 13 bp, Homo sapiens
gaggatctcttga

SEQ ID NO: 3659055 - DNA, 22 bp, Homo sapiens
gaggcagggaagtccccaggcc

SEQ ID NO: 3659056 - DNA, 17 bp, Homo sapiens
gaggccaaggtgggagg

SEQ ID NO: 3659057 - DNA, 20 bp, Homo sapiens
gaggccagccccacccagga

SEQ ID NO: 3659058 - DNA, 14 bp, Homo sapiens
gaggccatgtgcat

SEQ ID NO: 3659059 - DNA, 20 bp, Homo sapiens
gaggcccagttcaccctgat

SEQ ID NO: 3659060 - DNA, 13 bp, Homo sapiens
gaggccccagcct

SEQ ID NO: 3659061 - DNA, 23 bp, Homo sapiens
gaggccccagcctccctgaagcc

SEQ ID NO: 3659062 - DNA, 12 bp, Homo sapiens
gaggccccaggg

SEQ ID NO: 3659063 - DNA, 15 bp, Homo sapiens
gaggcccccagccca

SEQ ID NO: 3659064 - DNA, 16 bp, Homo sapiens
gaggcccccagcccag

SEQ ID NO: 3659065 - DNA, 19 bp, Homo sapiens
gaggcccccagcccagggc

SEQ ID NO: 3659066 - DNA, 22 bp, Homo sapiens
gaggcccctatgtagtccgtgc

SEQ ID NO: 3659067 - DNA, 23 bp, Homo sapiens
gaggccctcccaaagaggcccgc

SEQ ID NO: 3659068 - DNA, 16 bp, Homo sapiens
gaggcctgcgaccctg

SEQ ID NO: 3659069 - DNA, 20 bp, Homo sapiens
gaggcctgcgaccctggggg

SEQ ID NO: 3659070 - DNA, 18 bp, Homo sapiens
gaggcctggactttcctg

SEQ ID NO: 3659071 - DNA, 19 bp, Homo sapiens
gaggcctggactttcctgc

SEQ ID NO: 3659072 - DNA, 20 bp, Homo sapiens
gaggcctggactttcctgca

SEQ ID NO: 3659073 - DNA, 16 bp, Homo sapiens
gaggcctgggccgctg

SEQ ID NO: 3659074 - DNA, 22 bp, Homo sapiens
gaggcctgggccgctgccacgt

SEQ ID NO: 3659075 - DNA, 16 bp, Homo sapiens
gaggcggggctctagg

SEQ ID NO: 3659076 - DNA, 16 bp, Homo sapiens
gaggctgaggcaagag

SEQ ID NO: 3659077 - DNA, 16 bp, Homo sapiens
gaggctgaggcctgga

SEQ ID NO: 3659078 - DNA, 13 bp, Homo sapiens
gaggctggcaggt

SEQ ID NO: 3659079 - DNA, 12 bp, Homo sapiens
gaggctgtcctg

SEQ ID NO: 3659080 - DNA, 14 bp, Homo sapiens
gaggcttcttcctg

SEQ ID NO: 3659081 - DNA, 16 bp, Homo sapiens
gaggcttcttcctgga

SEQ ID NO: 3659082 - DNA, 14 bp, Homo sapiens
gaggctttccatgg

SEQ ID NO: 3659083 - DNA, 17 bp, Homo sapiens
gagggaccaactgggcc

SEQ ID NO: 3659084 - DNA, 20 bp, Homo sapiens
gagggacggccaagaatgta

SEQ ID NO: 3659085 - DNA, 12 bp, Homo sapiens
gagggagatgga

SEQ ID NO: 3659086 - DNA, 11 bp, Homo sapiens
gagggaggccc

SEQ ID NO: 3659087 - DNA, 20 bp, Homo sapiens
gagggcacaccgccatcctc

SEQ ID NO: 3659088 - DNA, 21 bp, Homo sapiens
gagggcacaccgccatcctct

SEQ ID NO: 3659089 - DNA, 18 bp, Homo sapiens
gagggcagactggggcat

SEQ ID NO: 3659090 - DNA, 21 bp, Homo sapiens
gagggcagactggggcatcct

SEQ ID NO: 3659091 - DNA, 19 bp, Homo sapiens
gagggcggcaggggcctgg

SEQ ID NO: 3659092 - DNA, 16 bp, Homo sapiens
gaggggaaggggcggt

SEQ ID NO: 3659093 - DNA, 17 bp, Homo sapiens
gaggggcatctgcccct

SEQ ID NO: 3659094 - DNA, 22 bp, Homo sapiens
gaggggcatctgcccctccccc

SEQ ID NO: 3659095 - DNA, 19 bp, Homo sapiens
gaggggcctaggcctcagc

SEQ ID NO: 3659096 - DNA, 23 bp, Homo sapiens
gaggggcctaggcctcagccaga

SEQ ID NO: 3659097 - DNA, 21 bp, Homo sapiens
gagggggctatagctacagga

SEQ ID NO: 3659098 - DNA, 17 bp, Homo sapiens
gagggtcctggctcctg

SEQ ID NO: 3659099 - DNA, 15 bp, Homo sapiens
gagggtgagaggaag

SEQ ID NO: 3659100 - DNA, 12 bp, Homo sapiens
gaggtccagccc

SEQ ID NO: 3659101 - DNA, 22 bp, Homo sapiens
gaggtccagccccccaggctgc

SEQ ID NO: 3659102 - DNA, 20 bp, Homo sapiens
gaggtggctgagcccctgtc

SEQ ID NO: 3659103 - DNA, 11 bp, Homo sapiens
gaggtgggagg

SEQ ID NO: 3659104 - DNA, 13 bp, Homo sapiens
gaggttgcagtgt

SEQ ID NO: 3659105 - DNA, 12 bp, Homo sapiens
gaggttgggctt

SEQ ID NO: 3659106 - DNA, 13 bp, Homo sapiens
gaggtttgggggg

SEQ ID NO: 3659107 - DNA, 19 bp, Homo sapiens
gagtcgtggggtgtgctgg

SEQ ID NO: 3659108 - DNA, 18 bp, Homo sapiens
gagtctaatagtctttgc

SEQ ID NO: 3659109 - DNA, 22 bp, Homo sapiens
gccaggacccaccactggaagc

SEQ ID NO: 3659110 - DNA, 22 bp, Homo sapiens
gccaggagaagttgaggggagc

SEQ ID NO: 3659111 - DNA, 22 bp, Homo sapiens
gccaggagctgggcagaaggcc

SEQ ID NO: 3659112 - DNA, 21 bp, Homo sapiens
gccaggcagatctgtgcccca

SEQ ID NO: 3659113 - DNA, 19 bp, Homo sapiens
gccaggcaggcgggcgcca

SEQ ID NO: 3659114 - DNA, 23 bp, Homo sapiens
gccaggcccccaagcctgcagtc

SEQ ID NO: 3659115 - DNA, 22 bp, Homo sapiens
gccaggcggggcgccccaagag

SEQ ID NO: 3659116 - DNA, 18 bp, Homo sapiens
gccagggaactggcctgc

SEQ ID NO: 3659117 - DNA, 21 bp, Homo sapiens
gccaggggaaaatcagcctgc

SEQ ID NO: 3659118 - DNA, 20 bp, Homo sapiens
gccaggggggtgaggagctg

SEQ ID NO: 3659119 - DNA, 21 bp, Homo sapiens
gccaggggggtgaggagctgg

SEQ ID NO: 3659120 - DNA, 22 bp, Homo sapiens
gccaggggggtgaggagctggg

SEQ ID NO: 3659121 - DNA, 21 bp, Homo sapiens
gccaggtcaccctttgctgtg

SEQ ID NO: 3659122 - DNA, 18 bp, Homo sapiens
gccagtcaagaagaaaaa

SEQ ID NO: 3659123 - DNA, 19 bp, Homo sapiens
gccagtccaccctgcctgc

SEQ ID NO: 3659124 - DNA, 20 bp, Homo sapiens
gccagtccaggctgccgtgg

SEQ ID NO: 3659125 - DNA, 17 bp, Homo sapiens
gccagtcctgcctggcc

SEQ ID NO: 3659126 - DNA, 16 bp, Homo sapiens
gccatctagccagccc

SEQ ID NO: 3659127 - DNA, 19 bp, Homo sapiens
gccatctcacctcctgctg

SEQ ID NO: 3659128 - DNA, 21 bp, Homo sapiens
gccatctcacctcctgctggg

SEQ ID NO: 3659129 - DNA, 13 bp, Homo sapiens
gccatgatgcctc

SEQ ID NO: 3659130 - DNA, 15 bp, Homo sapiens
gccatgatgcctctg

SEQ ID NO: 3659131 - DNA, 18 bp, Homo sapiens
gccatgatgcctctgtct

SEQ ID NO: 3659132 - DNA, 21 bp, Homo sapiens
gccatgatggcaacagatctg

SEQ ID NO: 3659133 - DNA, 23 bp, Homo sapiens
gccatgatggcaacagatctgga

SEQ ID NO: 3659134 - DNA, 18 bp, Homo sapiens
gccatgccagcttatctc

SEQ ID NO: 3659135 - DNA, 14 bp, Homo sapiens
gccatgctcctggc

SEQ ID NO: 3659136 - DNA, 18 bp, Homo sapiens
gccatgctgaggcctggg

SEQ ID NO: 3659137 - DNA, 23 bp, Homo sapiens
gccatggctcagggtggtctctt

SEQ ID NO: 3659138 - DNA, 15 bp, Homo sapiens
gccatgtactagttt

SEQ ID NO: 3659139 - DNA, 17 bp, Homo sapiens
gccatgtactagtttta

SEQ ID NO: 3659140 - DNA, 19 bp, Homo sapiens
gccatgtactcaagtacca

SEQ ID NO: 3659141 - DNA, 19 bp, Homo sapiens
gccatgtgcatagtttctt

SEQ ID NO: 3659142 - DNA, 20 bp, Homo sapiens
gccatgtgcatagtttcttt

SEQ ID NO: 3659143 - DNA, 20 bp, Homo sapiens
gccattcttctggtgctact

SEQ ID NO: 3659144 - DNA, 15 bp, Homo sapiens
gccatttctcaggga

SEQ ID NO: 3659145 - DNA, 18 bp, Homo sapiens
gccatttctcagggaagt

SEQ ID NO: 3659146 - DNA, 16 bp, Homo sapiens
gccatttctgaactgt

SEQ ID NO: 3659147 - DNA, 14 bp, Homo sapiens
gcccaacccttcta

SEQ ID NO: 3659148 - DNA, 20 bp, Homo sapiens
gcccaagacagatgccccag

SEQ ID NO: 3659149 - DNA, 17 bp, Homo sapiens
gcccaagccagaggctg

SEQ ID NO: 3659150 - DNA, 18 bp, Homo sapiens
gcccaagccagaggctgg

SEQ ID NO: 3659151 - DNA, 15 bp, Homo sapiens
gcccaagggatctgg

SEQ ID NO: 3659152 - DNA, 21 bp, Homo sapiens
gcccaccagccacctcatccc

SEQ ID NO: 3659153 - DNA, 15 bp, Homo sapiens
gcccacccctcaaca

SEQ ID NO: 3659154 - DNA, 20 bp, Homo sapiens
gcccaccctgctgctggtgc

SEQ ID NO: 3659155 - DNA, 21 bp, Homo sapiens
gcccaccctgctgctggtgca

SEQ ID NO: 3659156 - DNA, 13 bp, Homo sapiens
gcccacctgccca

SEQ ID NO: 3659157 - DNA, 15 bp, Homo sapiens
gcccacctgcccatc

SEQ ID NO: 3659158 - DNA, 15 bp, Homo sapiens
gcccagagaagccaa

SEQ ID NO: 3659159 - DNA, 10 bp, Homo sapiens
gcccagagac

SEQ ID NO: 3659160 - DNA, 18 bp, Homo sapiens
gcccagagcccagctcca

SEQ ID NO: 3659161 - DNA, 13 bp, Homo sapiens
gcccagagctgct

SEQ ID NO: 3659162 - DNA, 11 bp, Homo sapiens
gcccagcccct

SEQ ID NO: 3659163 - DNA, 19 bp, Homo sapiens
gcccagcccctcctccctg

SEQ ID NO: 3659164 - DNA, 12 bp, Homo sapiens
gcccagctccaa

SEQ ID NO: 3659165 - DNA, 20 bp, Homo sapiens
gcccaggctggagtgcagtg

SEQ ID NO: 3659166 - DNA, 17 bp, Homo sapiens
gcccagggagcggaaag

SEQ ID NO: 3659167 - DNA, 21 bp, Homo sapiens
gcccagggagcggaaagcagc

SEQ ID NO: 3659168 - DNA, 14 bp, Homo sapiens
gcccagggcccaga

SEQ ID NO: 3659169 - DNA, 16 bp, Homo sapiens
gcccagggcccagagc

SEQ ID NO: 3659170 - DNA, 20 bp, Homo sapiens
gcccagggcccagagcccag

SEQ ID NO: 3659171 - DNA, 23 bp, Homo sapiens
gcccagggcccagagcccagctc

SEQ ID NO: 3659172 - DNA, 14 bp, Homo sapiens
gcccagggctcctg

SEQ ID NO: 3659173 - DNA, 16 bp, Homo sapiens
gcccagggctcctgca

SEQ ID NO: 3659174 - DNA, 15 bp, Homo sapiens
gcccagtagaccttg

SEQ ID NO: 3659175 - DNA, 12 bp, Homo sapiens
gcccagtgcatg

SEQ ID NO: 3659176 - DNA, 13 bp, Homo sapiens
gcccatcacaggg

SEQ ID NO: 3659177 - DNA, 21 bp, Homo sapiens
gcccatcccccacctgccagc

SEQ ID NO: 3659178 - DNA, 13 bp, Homo sapiens
gcccatgcccacc

SEQ ID NO: 3659179 - DNA, 19 bp, Homo sapiens
gcccatgcccacctgccca

SEQ ID NO: 3659180 - DNA, 15 bp, Homo sapiens
gccccaagagcccaa

SEQ ID NO: 3659181 - DNA, 22 bp, Homo sapiens
gccccaccctgggccctgggct

SEQ ID NO: 3659182 - DNA, 15 bp, Homo sapiens
gccccactggggaaa

SEQ ID NO: 3659183 - DNA, 22 bp, Homo sapiens
gccccagagctgtttatggcct

SEQ ID NO: 3659184 - DNA, 16 bp, Homo sapiens
gccccagcctccctga

SEQ ID NO: 3659185 - DNA, 18 bp, Homo sapiens
gccccagcctccctgaag

SEQ ID NO: 3659186 - DNA, 19 bp, Homo sapiens
gccccaggaccagctcagg

SEQ ID NO: 3659187 - DNA, 15 bp, Homo sapiens
gccccaggcctgaaa

SEQ ID NO: 3659188 - DNA, 16 bp, Homo sapiens
gccccatcagctccag

SEQ ID NO: 3659189 - DNA, 17 bp, Homo sapiens
gcccccaaccccaagac

SEQ ID NO: 3659190 - DNA, 14 bp, Homo sapiens
gcccccaagcctgc

SEQ ID NO: 3659191 - DNA, 21 bp, Homo sapiens
gcccccagctaagaacctgga

SEQ ID NO: 3659192 - DNA, 23 bp, Homo sapiens
gccccccaggctgcccagagctg

SEQ ID NO: 3659193 - DNA, 16 bp, Homo sapiens
gcccccccccacccct

SEQ ID NO: 3659194 - DNA, 20 bp, Homo sapiens
gccccctccgccctgccact

SEQ ID NO: 3659195 - DNA, 14 bp, Homo sapiens
gcccccttcctggc

SEQ ID NO: 3659196 - DNA, 18 bp, Homo sapiens
gccccgtctgaccccagc

SEQ ID NO: 3659197 - DNA, 21 bp, Homo sapiens
gccccgtctgaccccagccca

SEQ ID NO: 3659198 - DNA, 22 bp, Homo sapiens
gccccgtctgaccccagcccag

SEQ ID NO: 3659199 - DNA, 15 bp, Homo sapiens
gcccctcagagactg

SEQ ID NO: 3659200 - DNA, 16 bp, Homo sapiens
gcccctcagcctctgc

SEQ ID NO: 3659201 - DNA, 15 bp, Homo sapiens
gcccctcccccaacc

SEQ ID NO: 3659202 - DNA, 18 bp, Homo sapiens
gcccctcttccaaaggca

SEQ ID NO: 3659203 - DNA, 23 bp, Homo sapiens
gcccctcttccaaaggcagcgtg

SEQ ID NO: 3659204 - DNA, 14 bp, Homo sapiens
gcccctcttcccca

SEQ ID NO: 3659205 - DNA, 22 bp, Homo sapiens
gcccctgctgcttaagtgcatg

SEQ ID NO: 3659206 - DNA, 17 bp, Homo sapiens
gcccctggcactcttgt

SEQ ID NO: 3659207 - DNA, 18 bp, Homo sapiens
gcccctgtctagagaggg

SEQ ID NO: 3659208 - DNA, 19 bp, Homo sapiens
gccccttccaaatgtccct

SEQ ID NO: 3659209 - DNA, 15 bp, Homo sapiens
gccccttccacgggg

SEQ ID NO: 3659210 - DNA, 16 bp, Homo sapiens
gcccgacatggctccg

SEQ ID NO: 3659211 - DNA, 19 bp, Homo sapiens
gcccgacatggctccggcc

SEQ ID NO: 3659212 - DNA, 24 bp, Homo sapiens
gcccgacatggctccggcctctgc

SEQ ID NO: 3659213 - DNA, 15 bp, Homo sapiens
gcccggactgaccaa

SEQ ID NO: 3659214 - DNA, 19 bp, Homo sapiens
gcccggagattggacggcc

SEQ ID NO: 3659215 - DNA, 22 bp, Homo sapiens
gcccggagattggacggcctga

SEQ ID NO: 3659216 - DNA, 22 bp, Homo sapiens
gcccgggaatgaatggggaggc

SEQ ID NO: 3659217 - DNA, 13 bp, Homo sapiens
gcccgtcctgcct

SEQ ID NO: 3659218 - DNA, 16 bp, Homo sapiens
gcccgtcctgcctgtg

SEQ ID NO: 3659219 - DNA, 15 bp, Homo sapiens
gccctaccctcctgc

SEQ ID NO: 3659220 - DNA, 21 bp, Homo sapiens
gccctaccctcctgctgagct

SEQ ID NO: 3659221 - DNA, 23 bp, Homo sapiens
gccctaccctcctgctgagctgc

SEQ ID NO: 3659222 - DNA, 24 bp, Homo sapiens
gccctaccctcctgctgagctgcc

SEQ ID NO: 3659223 - DNA, 12 bp, Homo sapiens
gccctacctggg

SEQ ID NO: 3659224 - DNA, 20 bp, Homo sapiens
gctgttttcctcccttctgc

SEQ ID NO: 3659225 - DNA, 14 bp, Homo sapiens
gctgtttttgttgt

SEQ ID NO: 3659226 - DNA, 15 bp, Homo sapiens
gctgtttttgttgtg

SEQ ID NO: 3659227 - DNA, 16 bp, Homo sapiens
gcttaatcattttcat

SEQ ID NO: 3659228 - DNA, 16 bp, Homo sapiens
gcttagagaggacaat

SEQ ID NO: 3659229 - DNA, 15 bp, Homo sapiens
gcttagtcctgggag

SEQ ID NO: 3659230 - DNA, 16 bp, Homo sapiens
gcttatggtaccagat

SEQ ID NO: 3659231 - DNA, 15 bp, Homo sapiens
gcttatttttctgtg

SEQ ID NO: 3659232 - DNA, 14 bp, Homo sapiens
gcttcaaactgaga

SEQ ID NO: 3659233 - DNA, 18 bp, Homo sapiens
gcttcacggaagagcctt

SEQ ID NO: 3659234 - DNA, 14 bp, Homo sapiens
gcttcccctctctc

SEQ ID NO: 3659235 - DNA, 16 bp, Homo sapiens
gcttcccctctctcct

SEQ ID NO: 3659236 - DNA, 14 bp, Homo sapiens
gcttccctaatcta

SEQ ID NO: 3659237 - DNA, 16 bp, Homo sapiens
gcttccctgcagctga

SEQ ID NO: 3659238 - DNA, 12 bp, Homo sapiens
gcttcctcctgg

SEQ ID NO: 3659239 - DNA, 13 bp, Homo sapiens
gcttcctcctgga

SEQ ID NO: 3659240 - DNA, 12 bp, Homo sapiens
gcttctacctgc

SEQ ID NO: 3659241 - DNA, 23 bp, Homo sapiens
gcttctacctgcaggcggggctc

SEQ ID NO: 3659242 - DNA, 13 bp, Homo sapiens
gcttctccctggg

SEQ ID NO: 3659243 - DNA, 23 bp, Homo sapiens
gcttctccctggggacggggctc

SEQ ID NO: 3659244 - DNA, 14 bp, Homo sapiens
gcttctcctgcggg

SEQ ID NO: 3659245 - DNA, 17 bp, Homo sapiens
gcttctcctgcgggggc

SEQ ID NO: 3659246 - DNA, 13 bp, Homo sapiens
gcttctctgactt

SEQ ID NO: 3659247 - DNA, 17 bp, Homo sapiens
gcttctctgacttctgc

SEQ ID NO: 3659248 - DNA, 18 bp, Homo sapiens
gcttctctgacttctgcc

SEQ ID NO: 3659249 - DNA, 23 bp, Homo sapiens
gcttctctgggaccaggctccaa

SEQ ID NO: 3659250 - DNA, 13 bp, Homo sapiens
gcttcttcctgga

SEQ ID NO: 3659251 - DNA, 15 bp, Homo sapiens
gcttcttcctggatg

SEQ ID NO: 3659252 - DNA, 18 bp, Homo sapiens
gcttcttgcctctgtgct

SEQ ID NO: 3659253 - DNA, 14 bp, Homo sapiens
gcttgagctcagga

SEQ ID NO: 3659254 - DNA, 20 bp, Homo sapiens
gcttgatagaaatgccaagc

SEQ ID NO: 3659255 - DNA, 22 bp, Homo sapiens
gcttgatgggattctggacagg

SEQ ID NO: 3659256 - DNA, 14 bp, Homo sapiens
gcttgcctgcaggg

SEQ ID NO: 3659257 - DNA, 15 bp, Homo sapiens
gcttgcctgcagggc

SEQ ID NO: 3659258 - DNA, 11 bp, Homo sapiens
gcttgctggcc

SEQ ID NO: 3659259 - DNA, 21 bp, Homo sapiens
gcttgtccaacccgaggcccg

SEQ ID NO: 3659260 - DNA, 19 bp, Homo sapiens
gcttgtcccctcctcactc

SEQ ID NO: 3659261 - DNA, 22 bp, Homo sapiens
gcttgtcccctcctcactccct

SEQ ID NO: 3659262 - DNA, 13 bp, Homo sapiens
gcttgttgtgctt

SEQ ID NO: 3659263 - DNA, 21 bp, Homo sapiens
gcttgtttgctcacctggggt

SEQ ID NO: 3659264 - DNA, 13 bp, Homo sapiens
gctttcagggagg

SEQ ID NO: 3659265 - DNA, 12 bp, Homo sapiens
gctttcctgccc

SEQ ID NO: 3659266 - DNA, 15 bp, Homo sapiens
gctttcctggtccct

SEQ ID NO: 3659267 - DNA, 12 bp, Homo sapiens
gctttgcagtgc

SEQ ID NO: 3659268 - DNA, 22 bp, Homo sapiens
gctttgcatttcttgtgttctg

SEQ ID NO: 3659269 - DNA, 23 bp, Homo sapiens
gctttgccaaaataccagagcct

SEQ ID NO: 3659270 - DNA, 19 bp, Homo sapiens
gctttgctgctgaaggctc

SEQ ID NO: 3659271 - DNA, 18 bp, Homo sapiens
gctttgctttctgctcag

SEQ ID NO: 3659272 - DNA, 17 bp, Homo sapiens
gctttggtgagaacctg

SEQ ID NO: 3659273 - DNA, 21 bp, Homo sapiens
gctttgtttgttgtcagctga

SEQ ID NO: 3659274 - DNA, 19 bp, Homo sapiens
gcttttaacagagtctgaa

SEQ ID NO: 3659275 - DNA, 21 bp, Homo sapiens
gcttttctaatggatatttta

SEQ ID NO: 3659276 - DNA, 12 bp, Homo sapiens
ggaaaaaaatgt

SEQ ID NO: 3659277 - DNA, 13 bp, Homo sapiens
ggaaaaatagcct

SEQ ID NO: 3659278 - DNA, 20 bp, Homo sapiens
ggaaaaggcagggagcgagg

SEQ ID NO: 3659279 - DNA, 19 bp, Homo sapiens
ggaaaatcagcctgctcca

SEQ ID NO: 3659280 - DNA, 23 bp, Homo sapiens
ggaaaatcagcctgctccagctg

SEQ ID NO: 3659281 - DNA, 20 bp, Homo sapiens
ggaaagatttgtgaactgga

SEQ ID NO: 3659282 - DNA, 15 bp, Homo sapiens
ggaaagcagctcaaa

SEQ ID NO: 3659283 - DNA, 20 bp, Homo sapiens
ggaacagctatgggagcccc

SEQ ID NO: 3659284 - DNA, 23 bp, Homo sapiens
ggaacagctatgggagccccagg

SEQ ID NO: 3659285 - DNA, 13 bp, Homo sapiens
ggaacccagactc

SEQ ID NO: 3659286 - DNA, 18 bp, Homo sapiens
ggaaccgcaggaagctgc

SEQ ID NO: 3659287 - DNA, 15 bp, Homo sapiens
ggaaccgccctcctg

SEQ ID NO: 3659288 - DNA, 12 bp, Homo sapiens
ggaacctcagcc

SEQ ID NO: 3659289 - DNA, 21 bp, Homo sapiens
ggaacctcagcctggccagac

SEQ ID NO: 3659290 - DNA, 15 bp, Homo sapiens
ggaacggcttcctca

SEQ ID NO: 3659291 - DNA, 20 bp, Homo sapiens
ggaactcagatccagggaca

SEQ ID NO: 3659292 - DNA, 22 bp, Homo sapiens
ggaacttggggagttaagacct

SEQ ID NO: 3659293 - DNA, 14 bp, Homo sapiens
ggaagaaaagagct

SEQ ID NO: 3659294 - DNA, 14 bp, Homo sapiens
ggaagaaagcaaca

SEQ ID NO: 3659295 - DNA, 22 bp, Homo sapiens
ggaagacaatgtgaaaagaaaa

SEQ ID NO: 3659296 - DNA, 22 bp, Homo sapiens
ggaagacagagaaaacttgcct

SEQ ID NO: 3659297 - DNA, 13 bp, Homo sapiens
ggaagcaccccat

SEQ ID NO: 3659298 - DNA, 19 bp, Homo sapiens
ggaagcagggaattcctgg

SEQ ID NO: 3659299 - DNA, 14 bp, Homo sapiens
ggaagcccggactg

SEQ ID NO: 3659300 - DNA, 21 bp, Homo sapiens
ggaagcgtgaaggccgagaag

SEQ ID NO: 3659301 - DNA, 13 bp, Homo sapiens
ggaagctgctccg

SEQ ID NO: 3659302 - DNA, 15 bp, Homo sapiens
ggaagctgctccgtg

SEQ ID NO: 3659303 - DNA, 13 bp, Homo sapiens
ggaaggagagcct

SEQ ID NO: 3659304 - DNA, 15 bp, Homo sapiens
ggaaggagagcctgc

SEQ ID NO: 3659305 - DNA, 17 bp, Homo sapiens
ggaaggctgagaggaga

SEQ ID NO: 3659306 - DNA, 12 bp, Homo sapiens
ggaagggaagcg

SEQ ID NO: 3659307 - DNA, 21 bp, Homo sapiens
ggaagtccccaggccccagga

SEQ ID NO: 3659308 - DNA, 23 bp, Homo sapiens
ggaagtccccaggccccaggaag

SEQ ID NO: 3659309 - DNA, 13 bp, Homo sapiens
ggaagtgggccag

SEQ ID NO: 3659310 - DNA, 19 bp, Homo sapiens
ggaagtgggccagtcctgg

SEQ ID NO: 3659311 - DNA, 21 bp, Homo sapiens
ggaataacttttacacgacca

SEQ ID NO: 3659312 - DNA, 17 bp, Homo sapiens
ggaatcccggctccaga

SEQ ID NO: 3659313 - DNA, 13 bp, Homo sapiens
ggaattcctggaa

SEQ ID NO: 3659314 - DNA, 14 bp, Homo sapiens
ggaattcctggaac

SEQ ID NO: 3659315 - DNA, 14 bp, Homo sapiens
ggaatttcccagga

SEQ ID NO: 3659316 - DNA, 18 bp, Homo sapiens
ggaatttcccaggaccct

SEQ ID NO: 3659317 - DNA, 19 bp, Homo sapiens
ggacacctgggagaaatct

SEQ ID NO: 3659318 - DNA, 17 bp, Homo sapiens
ggacagaggccccagcc

SEQ ID NO: 3659319 - DNA, 18 bp, Homo sapiens
ggacagaggccccagcct

SEQ ID NO: 3659320 - DNA, 15 bp, Homo sapiens
ggacagaggcggggc

SEQ ID NO: 3659321 - DNA, 14 bp, Homo sapiens
ggacagccccaccc

SEQ ID NO: 3659322 - DNA, 20 bp, Homo sapiens
ggacagcctcttctgtccca

SEQ ID NO: 3659323 - DNA, 21 bp, Homo sapiens
ggacagcctcttctgtcccaa

SEQ ID NO: 3659324 - DNA, 17 bp, Homo sapiens
ggacaggatgtgtttgc

SEQ ID NO: 3659325 - DNA, 18 bp, Homo sapiens
ggacaggatgtgtttgct

SEQ ID NO: 3659326 - DNA, 19 bp, Homo sapiens
ggacagggcttctcctgcg

SEQ ID NO: 3659327 - DNA, 19 bp, Homo sapiens
ggacagtgctgttgaagat

SEQ ID NO: 3659328 - DNA, 16 bp, Homo sapiens
ggacatcctcctccca

SEQ ID NO: 3659329 - DNA, 13 bp, Homo sapiens
ggaccagctcagg

SEQ ID NO: 3659330 - DNA, 19 bp, Homo sapiens
ggaccagctcaggacagat

SEQ ID NO: 3659331 - DNA, 15 bp, Homo sapiens
ggaccaggactccct

SEQ ID NO: 3659332 - DNA, 12 bp, Homo sapiens
ggaccagggcct

SEQ ID NO: 3659333 - DNA, 18 bp, Homo sapiens
ggacccagcgggcaggtt

SEQ ID NO: 3659334 - DNA, 11 bp, Homo sapiens
ggacccagtgc

SEQ ID NO: 3659335 - DNA, 22 bp, Homo sapiens
ggacccccgtggggcagggagc

SEQ ID NO: 3659336 - DNA, 21 bp, Homo sapiens
ggacccttcccttgagccctc

SEQ ID NO: 3659337 - DNA, 22 bp, Homo sapiens
ggacctaaatggcctcatgtgg

SEQ ID NO: 3659338 - DNA, 23 bp, Homo sapiens
ggacctcaggtgagaagcagagg

SEQ ID NO: 3659339 - DNA, 18 bp, Homo sapiens
ggacctttccaccacagc

SEQ ID NO: 3659340 - DNA, 12 bp, Homo sapiens
ggacggccaaga

SEQ ID NO: 3659341 - DNA, 21 bp, Homo sapiens
gggcagtactcctccctgggg

SEQ ID NO: 3659342 - DNA, 22 bp, Homo sapiens
gggcagtactcctccctggggg

SEQ ID NO: 3659343 - DNA, 23 bp, Homo sapiens
gggcagtactcctccctgggggc

SEQ ID NO: 3659344 - DNA, 23 bp, Homo sapiens
gggcattgatggggaaggaggct

SEQ ID NO: 3659345 - DNA, 13 bp, Homo sapiens
gggccagagccag

SEQ ID NO: 3659346 - DNA, 15 bp, Homo sapiens
gggccagagccaggg

SEQ ID NO: 3659347 - DNA, 13 bp, Homo sapiens
gggccagatccag

SEQ ID NO: 3659348 - DNA, 17 bp, Homo sapiens
gggccagatccagcctg

SEQ ID NO: 3659349 - DNA, 19 bp, Homo sapiens
gggccagatccagcctggg

SEQ ID NO: 3659350 - DNA, 15 bp, Homo sapiens
gggccagtcctgcct

SEQ ID NO: 3659351 - DNA, 18 bp, Homo sapiens
gggccagtcctgcctggc

SEQ ID NO: 3659352 - DNA, 22 bp, Homo sapiens
gggccagtctgtggatcagaga

SEQ ID NO: 3659353 - DNA, 22 bp, Homo sapiens
gggccatgatggcaacagatct

SEQ ID NO: 3659354 - DNA, 17 bp, Homo sapiens
gggccatgctgaggcct

SEQ ID NO: 3659355 - DNA, 20 bp, Homo sapiens
gggccatgctgaggcctggg

SEQ ID NO: 3659356 - DNA, 21 bp, Homo sapiens
gggccatgctgaggcctgggc

SEQ ID NO: 3659357 - DNA, 20 bp, Homo sapiens
gggccatttggccggctctg

SEQ ID NO: 3659358 - DNA, 21 bp, Homo sapiens
gggccatttggccggctctgg

SEQ ID NO: 3659359 - DNA, 22 bp, Homo sapiens
gggccatttggccggctctggt

SEQ ID NO: 3659360 - DNA, 18 bp, Homo sapiens
gggcccaagacagatgcc

SEQ ID NO: 3659361 - DNA, 19 bp, Homo sapiens
gggcccaagacagatgccc

SEQ ID NO: 3659362 - DNA, 11 bp, Homo sapiens
gggcccagagc

SEQ ID NO: 3659363 - DNA, 13 bp, Homo sapiens
gggcccagtgcat

SEQ ID NO: 3659364 - DNA, 22 bp, Homo sapiens
gggcccctctccaagcgcctgg

SEQ ID NO: 3659365 - DNA, 23 bp, Homo sapiens
gggcccctctccaagcgcctggc

SEQ ID NO: 3659366 - DNA, 12 bp, Homo sapiens
gggcccctggca

SEQ ID NO: 3659367 - DNA, 15 bp, Homo sapiens
gggcccctggcactc

SEQ ID NO: 3659368 - DNA, 13 bp, Homo sapiens
gggcccggccagc

SEQ ID NO: 3659369 - DNA, 19 bp, Homo sapiens
gggccctaccctcctgctg

SEQ ID NO: 3659370 - DNA, 20 bp, Homo sapiens
gggccctaccctcctgctga

SEQ ID NO: 3659371 - DNA, 22 bp, Homo sapiens
gggccctaccctcctgctgagc

SEQ ID NO: 3659372 - DNA, 23 bp, Homo sapiens
gggccctaccctcctgctgagct

SEQ ID NO: 3659373 - DNA, 19 bp, Homo sapiens
gggccctacctggggaaag

SEQ ID NO: 3659374 - DNA, 12 bp, Homo sapiens
gggccctgcctg

SEQ ID NO: 3659375 - DNA, 14 bp, Homo sapiens
gggccctgcctgag

SEQ ID NO: 3659376 - DNA, 19 bp, Homo sapiens
gggccctgcctgagggtgg

SEQ ID NO: 3659377 - DNA, 14 bp, Homo sapiens
gggccctgggctgg

SEQ ID NO: 3659378 - DNA, 15 bp, Homo sapiens
gggccgctgccaccc

SEQ ID NO: 3659379 - DNA, 17 bp, Homo sapiens
gggccggcccccttcct

SEQ ID NO: 3659380 - DNA, 18 bp, Homo sapiens
gggcctcccataattgct

SEQ ID NO: 3659381 - DNA, 22 bp, Homo sapiens
gggcctcggtgtggagaagcgg

SEQ ID NO: 3659382 - DNA, 14 bp, Homo sapiens
gggcctgctccaga

SEQ ID NO: 3659383 - DNA, 17 bp, Homo sapiens
gggcctgctccagacct

SEQ ID NO: 3659384 - DNA, 18 bp, Homo sapiens
gggccttttctggcaccg

SEQ ID NO: 3659385 - DNA, 18 bp, Homo sapiens
gggcgcgatcccacacag

SEQ ID NO: 3659386 - DNA, 12 bp, Homo sapiens
gggcggctgggt

SEQ ID NO: 3659387 - DNA, 12 bp, Homo sapiens
gggcgggactcc

SEQ ID NO: 3659388 - DNA, 13 bp, Homo sapiens
gggcgggactcct

SEQ ID NO: 3659389 - DNA, 12 bp, Homo sapiens
gggcgggtccta

SEQ ID NO: 3659390 - DNA, 17 bp, Homo sapiens
gggcgtctgttccccct

SEQ ID NO: 3659391 - DNA, 13 bp, Homo sapiens
gggcgtggaggga

SEQ ID NO: 3659392 - DNA, 15 bp, Homo sapiens
gggcgtggagggagg

SEQ ID NO: 3659393 - DNA, 10 bp, Homo sapiens
gggctcagca

SEQ ID NO: 3659394 - DNA, 17 bp, Homo sapiens
gggctcctacctggggg

SEQ ID NO: 3659395 - DNA, 14 bp, Homo sapiens
gggctcctcctgaa

SEQ ID NO: 3659396 - DNA, 18 bp, Homo sapiens
gggctcctgcacttactt

SEQ ID NO: 3659397 - DNA, 22 bp, Homo sapiens
gggctcctgcacttacttgctt

SEQ ID NO: 3659398 - DNA, 22 bp, Homo sapiens
gggctctaggatggggcacggc

SEQ ID NO: 3659399 - DNA, 19 bp, Homo sapiens
gggctctgcgttggcttct

SEQ ID NO: 3659400 - DNA, 18 bp, Homo sapiens
gggctgagagaacctcac

SEQ ID NO: 3659401 - DNA, 11 bp, Homo sapiens
gggctgctcct

SEQ ID NO: 3659402 - DNA, 18 bp, Homo sapiens
gggctgcttcctcctgga

SEQ ID NO: 3659403 - DNA, 20 bp, Homo sapiens
gggctgtggctctgggtggg

SEQ ID NO: 3659404 - DNA, 14 bp, Homo sapiens
gggcttccatgcct

SEQ ID NO: 3659405 - DNA, 15 bp, Homo sapiens
gggcttctctgggac

SEQ ID NO: 3659406 - DNA, 21 bp, Homo sapiens
gggcttttccctgggtggagc

SEQ ID NO: 3659407 - DNA, 21 bp, Homo sapiens
ggggaaaatcagcctgctcca

SEQ ID NO: 3659408 - DNA, 18 bp, Homo sapiens
ggggaactcagatccagg

SEQ ID NO: 3659409 - DNA, 14 bp, Homo sapiens
ggggaaggggcggt

SEQ ID NO: 3659410 - DNA, 13 bp, Homo sapiens
ggggaattcctgg

SEQ ID NO: 3659411 - DNA, 21 bp, Homo sapiens
ggggagcatgcttccctgcag

SEQ ID NO: 3659412 - DNA, 18 bp, Homo sapiens
ggggagccaaaatctcaa

SEQ ID NO: 3659413 - DNA, 19 bp, Homo sapiens
ggggagcccactgtcctgg

SEQ ID NO: 3659414 - DNA, 15 bp, Homo sapiens
ggggagggggatccg

SEQ ID NO: 3659415 - DNA, 16 bp, Homo sapiens
ggggagtctgaagcag

SEQ ID NO: 3659416 - DNA, 21 bp, Homo sapiens
ggggatccctcccccccatgc

SEQ ID NO: 3659417 - DNA, 14 bp, Homo sapiens
ggggcacggctctg

SEQ ID NO: 3659418 - DNA, 13 bp, Homo sapiens
ggggcagagcttc

SEQ ID NO: 3659419 - DNA, 23 bp, Homo sapiens
ggggcagagcttctcctgaccag

SEQ ID NO: 3659420 - DNA, 12 bp, Homo sapiens
ggggcaggcagt

SEQ ID NO: 3659421 - DNA, 19 bp, Homo sapiens
ggggcagggagctgggccc

SEQ ID NO: 3659422 - DNA, 19 bp, Homo sapiens
ggggcagtactcctccctg

SEQ ID NO: 3659423 - DNA, 14 bp, Homo sapiens
ggggcatctgcccc

SEQ ID NO: 3659424 - DNA, 21 bp, Homo sapiens
ggggccactacctcctttcct

SEQ ID NO: 3659425 - DNA, 13 bp, Homo sapiens
ggggccagatcca

SEQ ID NO: 3659426 - DNA, 19 bp, Homo sapiens
ggggccatttggccggctc

SEQ ID NO: 3659427 - DNA, 13 bp, Homo sapiens
ggggccctacctg

SEQ ID NO: 3659428 - DNA, 14 bp, Homo sapiens
ggggccctacctgg

SEQ ID NO: 3659429 - DNA, 14 bp, Homo sapiens
ggggccgctgccac

SEQ ID NO: 3659430 - DNA, 15 bp, Homo sapiens
ggggcgggactcctc

SEQ ID NO: 3659431 - DNA, 20 bp, Homo sapiens
ggggcgtctgttcccccttc

SEQ ID NO: 3659432 - DNA, 19 bp, Homo sapiens
ggggcgtggagggaggccc

SEQ ID NO: 3659433 - DNA, 12 bp, Homo sapiens
ggggctcccctg

SEQ ID NO: 3659434 - DNA, 16 bp, Homo sapiens
ggggctcccctggaca

SEQ ID NO: 3659435 - DNA, 17 bp, Homo sapiens
ggggctcctacctgggg

SEQ ID NO: 3659436 - DNA, 18 bp, Homo sapiens
ggggctcctacctggggg

SEQ ID NO: 3659437 - DNA, 19 bp, Homo sapiens
ggggctcctcctgaaggag

SEQ ID NO: 3659438 - DNA, 19 bp, Homo sapiens
ggggctgaggtgggaggat

SEQ ID NO: 3659439 - DNA, 16 bp, Homo sapiens
ggggctgcttcctcct

SEQ ID NO: 3659440 - DNA, 18 bp, Homo sapiens
ggggctgcttcctcctgg

SEQ ID NO: 3659441 - DNA, 19 bp, Homo sapiens
ggggctgcttcctcctgga

SEQ ID NO: 3659442 - DNA, 15 bp, Homo sapiens
ggggcttctctggga

SEQ ID NO: 3659443 - DNA, 15 bp, Homo sapiens
gggggacccagtgca

SEQ ID NO: 3659444 - DNA, 17 bp, Homo sapiens
gggggatcacagcctct

SEQ ID NO: 3659445 - DNA, 15 bp, Homo sapiens
gggggcacaggaggc

SEQ ID NO: 3659446 - DNA, 22 bp, Homo sapiens
gggggctatagctacaggaagc

SEQ ID NO: 3659447 - DNA, 19 bp, Homo sapiens
ggggtcatgccctcctctc

SEQ ID NO: 3659448 - DNA, 22 bp, Homo sapiens
ggggtccctagcagcccaccct

SEQ ID NO: 3659449 - DNA, 11 bp, Homo sapiens
ggggtcctggc

SEQ ID NO: 3659450 - DNA, 13 bp, Homo sapiens
ggggtcctggcca

SEQ ID NO: 3659451 - DNA, 17 bp, Homo sapiens
ggggtctcacccatgca

SEQ ID NO: 3659452 - DNA, 21 bp, Homo sapiens
ggggtctggagttgatctgga

SEQ ID NO: 3659453 - DNA, 14 bp, Homo sapiens
ggggtgggccaggc

SEQ ID NO: 3659454 - DNA, 15 bp, Homo sapiens
gggtagctagaggaa

SEQ ID NO: 3659455 - DNA, 16 bp, Homo sapiens
gggtagctagaggaac

SEQ ID NO: 3659456 - DNA, 19 bp, Homo sapiens
gggtatttattggtcaggg

SEQ ID NO: 3659457 - DNA, 16 bp, Homo sapiens
gggtcatgccctcctc

SEQ ID NO: 3659458 - DNA, 20 bp, Homo sapiens
gtccaacccgaggcccgcat

SEQ ID NO: 3659459 - DNA, 16 bp, Homo sapiens
gtccaattttaattta

SEQ ID NO: 3659460 - DNA, 18 bp, Homo sapiens
gtccaattttaatttagt

SEQ ID NO: 3659461 - DNA, 19 bp, Homo sapiens
gtccacgcgtgccgtggca

SEQ ID NO: 3659462 - DNA, 14 bp, Homo sapiens
gtccagcctgcccc

SEQ ID NO: 3659463 - DNA, 22 bp, Homo sapiens
gtccagcctgccccggagctgg

SEQ ID NO: 3659464 - DNA, 14 bp, Homo sapiens
gtccagctccaacc

SEQ ID NO: 3659465 - DNA, 13 bp, Homo sapiens
gtccagctctgga

SEQ ID NO: 3659466 - DNA, 13 bp, Homo sapiens
gtccagggaagct

SEQ ID NO: 3659467 - DNA, 11 bp, Homo sapiens
gtccaggggat

SEQ ID NO: 3659468 - DNA, 12 bp, Homo sapiens
gtcccactcaag

SEQ ID NO: 3659469 - DNA, 18 bp, Homo sapiens
gtcccactcaagccaagc

SEQ ID NO: 3659470 - DNA, 21 bp, Homo sapiens
gtcccactcaagccaagcagc

SEQ ID NO: 3659471 - DNA, 16 bp, Homo sapiens
gtcccagccaccccgg

SEQ ID NO: 3659472 - DNA, 18 bp, Homo sapiens
gtcccagccaccccgggc

SEQ ID NO: 3659473 - DNA, 15 bp, Homo sapiens
gtcccatccagctac

SEQ ID NO: 3659474 - DNA, 22 bp, Homo sapiens
gtccccaacccgtgcccctggg

SEQ ID NO: 3659475 - DNA, 18 bp, Homo sapiens
gtccccagagaccaggct

SEQ ID NO: 3659476 - DNA, 14 bp, Homo sapiens
gtccccagttgccg

SEQ ID NO: 3659477 - DNA, 11 bp, Homo sapiens
gtccccccacc

SEQ ID NO: 3659478 - DNA, 14 bp, Homo sapiens
gtccccgctgctgt

SEQ ID NO: 3659479 - DNA, 20 bp, Homo sapiens
gtcccctcacgcaagtgcca

SEQ ID NO: 3659480 - DNA, 13 bp, Homo sapiens
gtcccgtccctcc

SEQ ID NO: 3659481 - DNA, 18 bp, Homo sapiens
gtccctagcagcccaccc

SEQ ID NO: 3659482 - DNA, 12 bp, Homo sapiens
gtccctctgccc

SEQ ID NO: 3659483 - DNA, 20 bp, Homo sapiens
gtccctctgccccatcctcc

SEQ ID NO: 3659484 - DNA, 12 bp, Homo sapiens
gtccctctgtgt

SEQ ID NO: 3659485 - DNA, 14 bp, Homo sapiens
gtccctctgtgtat

SEQ ID NO: 3659486 - DNA, 22 bp, Homo sapiens
gtccctctgtgtatttgctttt

SEQ ID NO: 3659487 - DNA, 17 bp, Homo sapiens
gtcccttcccctccctg

SEQ ID NO: 3659488 - DNA, 20 bp, Homo sapiens
gtcccttgcttgcctgcagg

SEQ ID NO: 3659489 - DNA, 17 bp, Homo sapiens
gtccgctttcctggagc

SEQ ID NO: 3659490 - DNA, 19 bp, Homo sapiens
gtccgtgggacggtgccca

SEQ ID NO: 3659491 - DNA, 16 bp, Homo sapiens
gtcctacccatccccg

SEQ ID NO: 3659492 - DNA, 13 bp, Homo sapiens
gtcctagctgtta

SEQ ID NO: 3659493 - DNA, 14 bp, Homo sapiens
gtcctcactcccag

SEQ ID NO: 3659494 - DNA, 17 bp, Homo sapiens
gtcctcactcccagtcc

SEQ ID NO: 3659495 - DNA, 18 bp, Homo sapiens
gtcctcactcccagtcca

SEQ ID NO: 3659496 - DNA, 13 bp, Homo sapiens
gtcctccagaagc

SEQ ID NO: 3659497 - DNA, 22 bp, Homo sapiens
gtcctccagaagcctctggcta

SEQ ID NO: 3659498 - DNA, 17 bp, Homo sapiens
gtcctcccaagctgtgc

SEQ ID NO: 3659499 - DNA, 19 bp, Homo sapiens
gtcctcccaagctgtgctg

SEQ ID NO: 3659500 - DNA, 20 bp, Homo sapiens
gtcctcccaagctgtgctgg

SEQ ID NO: 3659501 - DNA, 20 bp, Homo sapiens
gtcctgagatggaaaagtgt

SEQ ID NO: 3659502 - DNA, 12 bp, Homo sapiens
gtcctgagcgaa

SEQ ID NO: 3659503 - DNA, 21 bp, Homo sapiens
gtcctgagcgaaaacaggaga

SEQ ID NO: 3659504 - DNA, 13 bp, Homo sapiens
gtcctgcctggcc

SEQ ID NO: 3659505 - DNA, 19 bp, Homo sapiens
gtcctgcctggccaggcag

SEQ ID NO: 3659506 - DNA, 13 bp, Homo sapiens
gtcctgcctgtgg

SEQ ID NO: 3659507 - DNA, 22 bp, Homo sapiens
gtcctgcctgtggcgccgtctc

SEQ ID NO: 3659508 - DNA, 17 bp, Homo sapiens
gtcctggctcctgaggg

SEQ ID NO: 3659509 - DNA, 15 bp, Homo sapiens
gtcctgtacattgtg

SEQ ID NO: 3659510 - DNA, 18 bp, Homo sapiens
gtcctgtgaatgccactg

SEQ ID NO: 3659511 - DNA, 19 bp, Homo sapiens
gtcctgtgaatgccactgc

SEQ ID NO: 3659512 - DNA, 11 bp, Homo sapiens
gtcgctcctgc

SEQ ID NO: 3659513 - DNA, 15 bp, Homo sapiens
gtcgctcctgcccac

SEQ ID NO: 3659514 - DNA, 17 bp, Homo sapiens
gtcgtgcctgtgtccat

SEQ ID NO: 3659515 - DNA, 17 bp, Homo sapiens
gtcgtggggtgtgctgg

SEQ ID NO: 3659516 - DNA, 19 bp, Homo sapiens
gtcgtggggtgtgctggga

SEQ ID NO: 3659517 - DNA, 14 bp, Homo sapiens
gtctagagagggag

SEQ ID NO: 3659518 - DNA, 16 bp, Homo sapiens
gtctagatggctcctc

SEQ ID NO: 3659519 - DNA, 18 bp, Homo sapiens
gtctagatggctcctctc

SEQ ID NO: 3659520 - DNA, 20 bp, Homo sapiens
gtctagatggctcctctcag

SEQ ID NO: 3659521 - DNA, 17 bp, Homo sapiens
gtctcaaaaaaagaaaa

SEQ ID NO: 3659522 - DNA, 13 bp, Homo sapiens
gtctcacccatgc

SEQ ID NO: 3659523 - DNA, 14 bp, Homo sapiens
gtctcatccccagg

SEQ ID NO: 3659524 - DNA, 16 bp, Homo sapiens
gtctcatccccagggg

SEQ ID NO: 3659525 - DNA, 22 bp, Homo sapiens
gtctccaggggctgcttcctcc

SEQ ID NO: 3659526 - DNA, 18 bp, Homo sapiens
gtctcccaggtgcatttc

SEQ ID NO: 3659527 - DNA, 21 bp, Homo sapiens
gtctcctctctggtggctggg

SEQ ID NO: 3659528 - DNA, 23 bp, Homo sapiens
gtctcctctctggtggctgggct

SEQ ID NO: 3659529 - DNA, 20 bp, Homo sapiens
gtctcttcttggggcccagt

SEQ ID NO: 3659530 - DNA, 17 bp, Homo sapiens
gtctgaccccagcccag

SEQ ID NO: 3659531 - DNA, 21 bp, Homo sapiens
gtctgaccccagcccagacag

SEQ ID NO: 3659532 - DNA, 22 bp, Homo sapiens
gtctggactatattgggactgg

SEQ ID NO: 3659533 - DNA, 20 bp, Homo sapiens
gtctggtggccccgtttctg

SEQ ID NO: 3659534 - DNA, 16 bp, Homo sapiens
gtctgtctcaggagca

SEQ ID NO: 3659535 - DNA, 21 bp, Homo sapiens
gtctgtgtgtgtgtgtgtgcg

SEQ ID NO: 3659536 - DNA, 14 bp, Homo sapiens
gtctgttggcaggc

SEQ ID NO: 3659537 - DNA, 16 bp, Homo sapiens
gtctgttggcaggctg

SEQ ID NO: 3659538 - DNA, 18 bp, Homo sapiens
gtctgttggcaggctggc

SEQ ID NO: 3659539 - DNA, 20 bp, Homo sapiens
gtctgttggcaggctggcca

SEQ ID NO: 3659540 - DNA, 12 bp, Homo sapiens
gtcttcctgagt

SEQ ID NO: 3659541 - DNA, 19 bp, Homo sapiens
gtcttcctgagtggtgcca

SEQ ID NO: 3659542 - DNA, 12 bp, Homo sapiens
gtcttgctctgt

SEQ ID NO: 3659543 - DNA, 15 bp, Homo sapiens
gtcttgctgttgaca

SEQ ID NO: 3659544 - DNA, 19 bp, Homo sapiens
gtcttgctgttgacatatt

SEQ ID NO: 3659545 - DNA, 16 bp, Homo sapiens
gtcttgggcagagctg

SEQ ID NO: 3659546 - DNA, 20 bp, Homo sapiens
gtcttgggcagagctggctc

SEQ ID NO: 3659547 - DNA, 12 bp, Homo sapiens
gtcttttgcttt

SEQ ID NO: 3659548 - DNA, 13 bp, Homo sapiens
gtcttttgctttt

SEQ ID NO: 3659549 - DNA, 20 bp, Homo sapiens
gtgaaaaatcttaagtacca

SEQ ID NO: 3659550 - DNA, 14 bp, Homo sapiens
gtgaaaagaaaaat

SEQ ID NO: 3659551 - DNA, 22 bp, Homo sapiens
gtgaaagtgcatttttgtaaat

SEQ ID NO: 3659552 - DNA, 23 bp, Homo sapiens
gtgaaataccacaagcctgagaa

SEQ ID NO: 3659553 - DNA, 14 bp, Homo sapiens
gtgaactgcagtga

SEQ ID NO: 3659554 - DNA, 13 bp, Homo sapiens
gtgaactggaaga

SEQ ID NO: 3659555 - DNA, 18 bp, Homo sapiens
gtgaactggaagaaagca

SEQ ID NO: 3659556 - DNA, 19 bp, Homo sapiens
gtgaacttgggccactgtg

SEQ ID NO: 3659557 - DNA, 21 bp, Homo sapiens
gtgaatgatgatcctaggcat

SEQ ID NO: 3659558 - DNA, 13 bp, Homo sapiens
gtgacacaaacac

SEQ ID NO: 3659559 - DNA, 21 bp, Homo sapiens
gtgacacaaacacacacaaaa

SEQ ID NO: 3659560 - DNA, 20 bp, Homo sapiens
gtgacacccaagagggctgc

SEQ ID NO: 3659561 - DNA, 15 bp, Homo sapiens
gtgacagacaggctc

SEQ ID NO: 3659562 - DNA, 23 bp, Homo sapiens
gtgacataatatattctattttt

SEQ ID NO: 3659563 - DNA, 18 bp, Homo sapiens
gtgaccatgttttgttta

SEQ ID NO: 3659564 - DNA, 13 bp, Homo sapiens
gtgacccatctgt

SEQ ID NO: 3659565 - DNA, 16 bp, Homo sapiens
gtgacccatctgtagt

SEQ ID NO: 3659566 - DNA, 17 bp, Homo sapiens
gtgacttcttcttcttt

SEQ ID NO: 3659567 - DNA, 20 bp, Homo sapiens
gtgagaacctgggttgcaga

SEQ ID NO: 3659568 - DNA, 16 bp, Homo sapiens
gtgagacccccacacc

SEQ ID NO: 3659569 - DNA, 19 bp, Homo sapiens
gtgagagaagggccaggcc

SEQ ID NO: 3659570 - DNA, 13 bp, Homo sapiens
gtgagcatgtttg

SEQ ID NO: 3659571 - DNA, 22 bp, Homo sapiens
gtgaggatgtcactcagatgga

SEQ ID NO: 3659572 - DNA, 17 bp, Homo sapiens
gtgaggcttgcccagga

SEQ ID NO: 3659573 - DNA, 19 bp, Homo sapiens
gtgatccagggtatgacct

SEQ ID NO: 3659574 - DNA, 16 bp, Homo sapiens
gtgatgactgcttgta

SEQ ID NO: 3659575 - DNA, 19 bp, Homo sapiens
taactgattacctgccaat

SEQ ID NO: 3659576 - DNA, 21 bp, Homo sapiens
taactggacagcctcttctgt

SEQ ID NO: 3659577 - DNA, 14 bp, Homo sapiens
taactgtaaatcat

SEQ ID NO: 3659578 - DNA, 21 bp, Homo sapiens
taactgtcaggctgaaaacaa

SEQ ID NO: 3659579 - DNA, 22 bp, Homo sapiens
taactgtcaggctgaaaacaat

SEQ ID NO: 3659580 - DNA, 21 bp, Homo sapiens
taagaaacacactgaggcagg

SEQ ID NO: 3659581 - DNA, 13 bp, Homo sapiens
taagaagaaagca

SEQ ID NO: 3659582 - DNA, 17 bp, Homo sapiens
taagaattttaaatatt

SEQ ID NO: 3659583 - DNA, 15 bp, Homo sapiens
taagacaacaggcat

SEQ ID NO: 3659584 - DNA, 16 bp, Homo sapiens
taagacaacaggcatt

SEQ ID NO: 3659585 - DNA, 13 bp, Homo sapiens
taagacctggcag

SEQ ID NO: 3659586 - DNA, 18 bp, Homo sapiens
taagacctggcagctctg

SEQ ID NO: 3659587 - DNA, 15 bp, Homo sapiens
taagactaacaaagg

SEQ ID NO: 3659588 - DNA, 15 bp, Homo sapiens
taagagcagtcacaa

SEQ ID NO: 3659589 - DNA, 21 bp, Homo sapiens
taagaggacataatggggtcc

SEQ ID NO: 3659590 - DNA, 19 bp, Homo sapiens
taagatgtaaattgaagaa

SEQ ID NO: 3659591 - DNA, 21 bp, Homo sapiens
taagattccattttggaaaat

SEQ ID NO: 3659592 - DNA, 15 bp, Homo sapiens
taagcaaaagaaaaa

SEQ ID NO: 3659593 - DNA, 17 bp, Homo sapiens
taagcagaggaggggcc

SEQ ID NO: 3659594 - DNA, 16 bp, Homo sapiens
taagcagctaaatttt

SEQ ID NO: 3659595 - DNA, 22 bp, Homo sapiens
taagggcgtggctctgggtggg

SEQ ID NO: 3659596 - DNA, 21 bp, Homo sapiens
taaggtctttcagtacttttt

SEQ ID NO: 3659597 - DNA, 22 bp, Homo sapiens
taagtaacctctacaggcattt

SEQ ID NO: 3659598 - DNA, 13 bp, Homo sapiens
taagtatttctga

SEQ ID NO: 3659599 - DNA, 14 bp, Homo sapiens
taagtatttctgat

SEQ ID NO: 3659600 - DNA, 21 bp, Homo sapiens
taagtgcatgcattgagctgc

SEQ ID NO: 3659601 - DNA, 16 bp, Homo sapiens
taagtgcctgctgtat

SEQ ID NO: 3659602 - DNA, 17 bp, Homo sapiens
taagttttcttgtttct

SEQ ID NO: 3659603 - DNA, 13 bp, Homo sapiens
taataaaagaaca

SEQ ID NO: 3659604 - DNA, 19 bp, Homo sapiens
taataaagaattttattta

SEQ ID NO: 3659605 - DNA, 14 bp, Homo sapiens
taataaatgccctc

SEQ ID NO: 3659606 - DNA, 18 bp, Homo sapiens
taataaatgccctcttct

SEQ ID NO: 3659607 - DNA, 19 bp, Homo sapiens
taatactgctgagatacat

SEQ ID NO: 3659608 - DNA, 23 bp, Homo sapiens
taatactgctgagatacatacag

SEQ ID NO: 3659609 - DNA, 20 bp, Homo sapiens
taatacttgaactgttgccc

SEQ ID NO: 3659610 - DNA, 23 bp, Homo sapiens
taatagattttttcagacttgtc

SEQ ID NO: 3659611 - DNA, 14 bp, Homo sapiens
taatagggaatata

SEQ ID NO: 3659612 - DNA, 21 bp, Homo sapiens
taatataaagtagtcctgtga

SEQ ID NO: 3659613 - DNA, 14 bp, Homo sapiens
taatataaagttgg

SEQ ID NO: 3659614 - DNA, 15 bp, Homo sapiens
taatatctaaagtta

SEQ ID NO: 3659615 - DNA, 15 bp, Homo sapiens
taatatttttaatta

SEQ ID NO: 3659616 - DNA, 13 bp, Homo sapiens
taatcatgtgaaa

SEQ ID NO: 3659617 - DNA, 18 bp, Homo sapiens
taatcatgtgaaatgttt

SEQ ID NO: 3659618 - DNA, 17 bp, Homo sapiens
taatcattttcattcct

SEQ ID NO: 3659619 - DNA, 18 bp, Homo sapiens
taatccaggcagatccag

SEQ ID NO: 3659620 - DNA, 22 bp, Homo sapiens
taatccaggcagatccaggact

SEQ ID NO: 3659621 - DNA, 17 bp, Homo sapiens
taatctagatatcgact

SEQ ID NO: 3659622 - DNA, 15 bp, Homo sapiens
taatgaatgcataaa

SEQ ID NO: 3659623 - DNA, 15 bp, Homo sapiens
taatggcatgagaaa

SEQ ID NO: 3659624 - DNA, 18 bp, Homo sapiens
taatggggtcctggccat

SEQ ID NO: 3659625 - DNA, 15 bp, Homo sapiens
taatggttaagtttt

SEQ ID NO: 3659626 - DNA, 19 bp, Homo sapiens
taattaatatctcctggaa

SEQ ID NO: 3659627 - DNA, 22 bp, Homo sapiens
taattgcagataactttgactt

SEQ ID NO: 3659628 - DNA, 14 bp, Homo sapiens
taattgctgtgtgt

SEQ ID NO: 3659629 - DNA, 18 bp, Homo sapiens
taattgtactaaagccaa

SEQ ID NO: 3659630 - DNA, 23 bp, Homo sapiens
taattgtactaaagccaaacata

SEQ ID NO: 3659631 - DNA, 15 bp, Homo sapiens
taatttagtaaatgt

SEQ ID NO: 3659632 - DNA, 16 bp, Homo sapiens
taatttagtaaatgtt

SEQ ID NO: 3659633 - DNA, 17 bp, Homo sapiens
taatttagtaaatgtta

SEQ ID NO: 3659634 - DNA, 14 bp, Homo sapiens
taatttatgcagaa

SEQ ID NO: 3659635 - DNA, 19 bp, Homo sapiens
taatttattaattgctttg

SEQ ID NO: 3659636 - DNA, 17 bp, Homo sapiens
taatttttgtattattt

SEQ ID NO: 3659637 - DNA, 15 bp, Homo sapiens
tacaaaaagcataaa

SEQ ID NO: 3659638 - DNA, 22 bp, Homo sapiens
tacaaaaataaatttatatgaa

SEQ ID NO: 3659639 - DNA, 22 bp, Homo sapiens
tacaaaaatttgccaggcgtgg

SEQ ID NO: 3659640 - DNA, 18 bp, Homo sapiens
tacaacttgtatttccaa

SEQ ID NO: 3659641 - DNA, 17 bp, Homo sapiens
tacaatgtcatatactg

SEQ ID NO: 3659642 - DNA, 12 bp, Homo sapiens
tacaattttatc

SEQ ID NO: 3659643 - DNA, 20 bp, Homo sapiens
tacacaatggtttttaaatt

SEQ ID NO: 3659644 - DNA, 18 bp, Homo sapiens
tacacaccttatatttac

SEQ ID NO: 3659645 - DNA, 19 bp, Homo sapiens
tacacagtaagtcatttaa

SEQ ID NO: 3659646 - DNA, 17 bp, Homo sapiens
tacaccagcattccttt

SEQ ID NO: 3659647 - DNA, 14 bp, Homo sapiens
tacaccttgccttg

SEQ ID NO: 3659648 - DNA, 21 bp, Homo sapiens
tacacgaccatttgataggga

SEQ ID NO: 3659649 - DNA, 23 bp, Homo sapiens
tacagaattactgtaactgatta

SEQ ID NO: 3659650 - DNA, 14 bp, Homo sapiens
tacagacatattta

SEQ ID NO: 3659651 - DNA, 14 bp, Homo sapiens
tacagatgcctttt

SEQ ID NO: 3659652 - DNA, 19 bp, Homo sapiens
tacagattgggcggggctt

SEQ ID NO: 3659653 - DNA, 20 bp, Homo sapiens
tacagattgggcggggcttc

SEQ ID NO: 3659654 - DNA, 21 bp, Homo sapiens
tacagcctggtttttaagtac

SEQ ID NO: 3659655 - DNA, 15 bp, Homo sapiens
tacaggcagcacaga

SEQ ID NO: 3659656 - DNA, 17 bp, Homo sapiens
tacaggtattttcatca

SEQ ID NO: 3659657 - DNA, 16 bp, Homo sapiens
tacaggtgtgagccac

SEQ ID NO: 3659658 - DNA, 15 bp, Homo sapiens
tacagtacaggcagc

SEQ ID NO: 3659659 - DNA, 18 bp, Homo sapiens
tacagtatctcagggcct

SEQ ID NO: 3659660 - DNA, 18 bp, Homo sapiens
tacagtgaaatgagcagc

SEQ ID NO: 3659661 - DNA, 21 bp, Homo sapiens
tacagtgaaatgagcagccct

SEQ ID NO: 3659662 - DNA, 23 bp, Homo sapiens
tacagtttatttttaaagataga

SEQ ID NO: 3659663 - DNA, 14 bp, Homo sapiens
tacataaacttaaa

SEQ ID NO: 3659664 - DNA, 16 bp, Homo sapiens
tacatacaccagcatt

SEQ ID NO: 3659665 - DNA, 18 bp, Homo sapiens
tacatatatatatataac

SEQ ID NO: 3659666 - DNA, 22 bp, Homo sapiens
tacatcatgctggaacctgcaa

SEQ ID NO: 3659667 - DNA, 14 bp, Homo sapiens
tacatgcagcccat

SEQ ID NO: 3659668 - DNA, 22 bp, Homo sapiens
tacatgcagcccatgcccacct

SEQ ID NO: 3659669 - DNA, 14 bp, Homo sapiens
tacatgctggggtc

SEQ ID NO: 3659670 - DNA, 20 bp, Homo sapiens
tacatgtaactatttcttca

SEQ ID NO: 3659671 - DNA, 14 bp, Homo sapiens
tacattccaactcg

SEQ ID NO: 3659672 - DNA, 19 bp, Homo sapiens
tacatttgatgcatgtctt

SEQ ID NO: 3659673 - DNA, 17 bp, Homo sapiens
taccaatgggaagcagg

SEQ ID NO: 3659674 - DNA, 10 bp, Homo sapiens
taccacctcc

SEQ ID NO: 3659675 - DNA, 13 bp, Homo sapiens
taccagaagggaa

SEQ ID NO: 3659676 - DNA, 14 bp, Homo sapiens
taccagagactctg

SEQ ID NO: 3659677 - DNA, 19 bp, Homo sapiens
taccagaggttgtgcactg

SEQ ID NO: 3659678 - DNA, 17 bp, Homo sapiens
taccatcccctgtagag

SEQ ID NO: 3659679 - DNA, 15 bp, Homo sapiens
taccatgggtgtgga

SEQ ID NO: 3659680 - DNA, 12 bp, Homo sapiens
taccatttgtgt

SEQ ID NO: 3659681 - DNA, 23 bp, Homo sapiens
tacccaacggccctgcagccagc

SEQ ID NO: 3659682 - DNA, 17 bp, Homo sapiens
tacccatccccgcagtg

SEQ ID NO: 3659683 - DNA, 16 bp, Homo sapiens
tacccccagctgtgct

SEQ ID NO: 3659684 - DNA, 17 bp, Homo sapiens
taccctcctgctgagct

SEQ ID NO: 3659685 - DNA, 21 bp, Homo sapiens
taccctgggtgtccccgctgc

SEQ ID NO: 3659686 - DNA, 19 bp, Homo sapiens
tacctcaaccatcctggct

SEQ ID NO: 3659687 - DNA, 15 bp, Homo sapiens
tacctcaggcaggaa

SEQ ID NO: 3659688 - DNA, 22 bp, Homo sapiens
tacctgaaggcagggctcctcc

SEQ ID NO: 3659689 - DNA, 18 bp, Homo sapiens
tacctgcaggcggggctc

SEQ ID NO: 3659690 - DNA, 18 bp, Homo sapiens
tacctggggaaagcctga

SEQ ID NO: 3659691 - DNA, 21 bp, Homo sapiens
tcaggtgagaagcagaggaag

SEQ ID NO: 3659692 - DNA, 21 bp, Homo sapiens
tcaggtgcccctcttccaaag

SEQ ID NO: 3659693 - DNA, 22 bp, Homo sapiens
tcagtgacatctgattggcaga

SEQ ID NO: 3659694 - DNA, 14 bp, Homo sapiens
tcagtgcatttgtg

SEQ ID NO: 3659695 - DNA, 20 bp, Homo sapiens
tcagtgggctgtttctgctt

SEQ ID NO: 3659696 - DNA, 21 bp, Homo sapiens
tcagtgggctgtttctgctta

SEQ ID NO: 3659697 - DNA, 19 bp, Homo sapiens
tcagtgtctccccgtgtcc

SEQ ID NO: 3659698 - DNA, 17 bp, Homo sapiens
tcagttaattcttagat

SEQ ID NO: 3659699 - DNA, 17 bp, Homo sapiens
tcagttcccttggcctc

SEQ ID NO: 3659700 - DNA, 22 bp, Homo sapiens
tcagttcccttggcctcagaat

SEQ ID NO: 3659701 - DNA, 16 bp, Homo sapiens
tcagttctcttgcttt

SEQ ID NO: 3659702 - DNA, 18 bp, Homo sapiens
tcagttgattttctggat

SEQ ID NO: 3659703 - DNA, 21 bp, Homo sapiens
tcagtttaggccttggcttga

SEQ ID NO: 3659704 - DNA, 17 bp, Homo sapiens
tcagttttttgttttac

SEQ ID NO: 3659705 - DNA, 17 bp, Homo sapiens
tcagtttttttttgtat

SEQ ID NO: 3659706 - DNA, 22 bp, Homo sapiens
tcatagtagtttttacagctgt

SEQ ID NO: 3659707 - DNA, 18 bp, Homo sapiens
tcatattctaaaaccatt

SEQ ID NO: 3659708 - DNA, 12 bp, Homo sapiens
tcatccccaggg

SEQ ID NO: 3659709 - DNA, 15 bp, Homo sapiens
tcatcctgtgctcgg

SEQ ID NO: 3659710 - DNA, 13 bp, Homo sapiens
tcatctgaagggg

SEQ ID NO: 3659711 - DNA, 14 bp, Homo sapiens
tcatctgctggtcc

SEQ ID NO: 3659712 - DNA, 12 bp, Homo sapiens
tcatctgttcta

SEQ ID NO: 3659713 - DNA, 20 bp, Homo sapiens
tcatctgttctatgcttcct

SEQ ID NO: 3659714 - DNA, 23 bp, Homo sapiens
tcatcttaggttggcaaaaaggc

SEQ ID NO: 3659715 - DNA, 21 bp, Homo sapiens
tcatcttgaccaagcaggaag

SEQ ID NO: 3659716 - DNA, 15 bp, Homo sapiens
tcatggtcctttctg

SEQ ID NO: 3659717 - DNA, 22 bp, Homo sapiens
tcatgtactttttagtaatttc

SEQ ID NO: 3659718 - DNA, 20 bp, Homo sapiens
tcatgtgtgcaacagggtat

SEQ ID NO: 3659719 - DNA, 19 bp, Homo sapiens
tcatgttgatcatgtactt

SEQ ID NO: 3659720 - DNA, 23 bp, Homo sapiens
tcattattcgtagatattggaca

SEQ ID NO: 3659721 - DNA, 21 bp, Homo sapiens
tcattcagcagcaaattttca

SEQ ID NO: 3659722 - DNA, 13 bp, Homo sapiens
tcattcatcctga

SEQ ID NO: 3659723 - DNA, 20 bp, Homo sapiens
tcattccttagataccttga

SEQ ID NO: 3659724 - DNA, 14 bp, Homo sapiens
tcattccttgtctt

SEQ ID NO: 3659725 - DNA, 15 bp, Homo sapiens
tcattccttgtcttg

SEQ ID NO: 3659726 - DNA, 20 bp, Homo sapiens
tcattgccttaactggagcc

SEQ ID NO: 3659727 - DNA, 17 bp, Homo sapiens
tcattgctctccagtca

SEQ ID NO: 3659728 - DNA, 21 bp, Homo sapiens
tcattgtaaatatttgacttt

SEQ ID NO: 3659729 - DNA, 15 bp, Homo sapiens
tcatttgtttacatt

SEQ ID NO: 3659730 - DNA, 12 bp, Homo sapiens
tcattttcagag

SEQ ID NO: 3659731 - DNA, 13 bp, Homo sapiens
tcattttcagagt

SEQ ID NO: 3659732 - DNA, 14 bp, Homo sapiens
tccaaaagaagccc

SEQ ID NO: 3659733 - DNA, 19 bp, Homo sapiens
tccaaactgaagcagcctc

SEQ ID NO: 3659734 - DNA, 13 bp, Homo sapiens
tccaaaggaggct

SEQ ID NO: 3659735 - DNA, 12 bp, Homo sapiens
tccaaaggcagc

SEQ ID NO: 3659736 - DNA, 23 bp, Homo sapiens
tccaaaggcagcgtgccgagcca

SEQ ID NO: 3659737 - DNA, 23 bp, Homo sapiens
tccaaatgcttctatttatagaa

SEQ ID NO: 3659738 - DNA, 14 bp, Homo sapiens
tccaaatgtccctc

SEQ ID NO: 3659739 - DNA, 21 bp, Homo sapiens
tccaaatgtccctccaacaca

SEQ ID NO: 3659740 - DNA, 19 bp, Homo sapiens
tccaaatgtcctccagaag

SEQ ID NO: 3659741 - DNA, 20 bp, Homo sapiens
tccaaatgtcctccagaagc

SEQ ID NO: 3659742 - DNA, 22 bp, Homo sapiens
tccaacacatttcacttttctg

SEQ ID NO: 3659743 - DNA, 17 bp, Homo sapiens
tccaacaggagctggga

SEQ ID NO: 3659744 - DNA, 16 bp, Homo sapiens
tccaacccgaggcccg

SEQ ID NO: 3659745 - DNA, 23 bp, Homo sapiens
tccaacttggctgcaggaatctt

SEQ ID NO: 3659746 - DNA, 12 bp, Homo sapiens
tccaagagctga

SEQ ID NO: 3659747 - DNA, 15 bp, Homo sapiens
tccaagccccatctt

SEQ ID NO: 3659748 - DNA, 19 bp, Homo sapiens
tccaagccccatcttctaa

SEQ ID NO: 3659749 - DNA, 15 bp, Homo sapiens
tccaatggggcgggg

SEQ ID NO: 3659750 - DNA, 22 bp, Homo sapiens
tccaattataagaggatatgaa

SEQ ID NO: 3659751 - DNA, 14 bp, Homo sapiens
tccaccctgcctgc

SEQ ID NO: 3659752 - DNA, 16 bp, Homo sapiens
tccacccttggcctgt

SEQ ID NO: 3659753 - DNA, 21 bp, Homo sapiens
tccacgcgtgccgtggcacca

SEQ ID NO: 3659754 - DNA, 17 bp, Homo sapiens
tccactctaccctccca

SEQ ID NO: 3659755 - DNA, 18 bp, Homo sapiens
tccactctaccctcccac

SEQ ID NO: 3659756 - DNA, 12 bp, Homo sapiens
tccactctgctt

SEQ ID NO: 3659757 - DNA, 14 bp, Homo sapiens
tccactctgcttct

SEQ ID NO: 3659758 - DNA, 15 bp, Homo sapiens
tccactctgcttctc

SEQ ID NO: 3659759 - DNA, 24 bp, Homo sapiens
tccactctgcttctctgacttctg

SEQ ID NO: 3659760 - DNA, 12 bp, Homo sapiens
tccactgccatg

SEQ ID NO: 3659761 - DNA, 23 bp, Homo sapiens
tccactttgtttcgtggggaggt

SEQ ID NO: 3659762 - DNA, 16 bp, Homo sapiens
tccagaagcctctggc

SEQ ID NO: 3659763 - DNA, 18 bp, Homo sapiens
tccagaagcctctggcta

SEQ ID NO: 3659764 - DNA, 19 bp, Homo sapiens
tccagaagcctctggctag

SEQ ID NO: 3659765 - DNA, 11 bp, Homo sapiens
tccagacctga

SEQ ID NO: 3659766 - DNA, 19 bp, Homo sapiens
tccagacctgatcctggag

SEQ ID NO: 3659767 - DNA, 22 bp, Homo sapiens
tccagacctgatcctggaggcc

SEQ ID NO: 3659768 - DNA, 22 bp, Homo sapiens
tccagagagaaatcaggcctga

SEQ ID NO: 3659769 - DNA, 14 bp, Homo sapiens
tccagcaccttgtg

SEQ ID NO: 3659770 - DNA, 19 bp, Homo sapiens
tccagcaccttgtgcctgg

SEQ ID NO: 3659771 - DNA, 22 bp, Homo sapiens
tccagcaccttgtgcctggggt

SEQ ID NO: 3659772 - DNA, 23 bp, Homo sapiens
tccagcagaagacaaaaagacaa

SEQ ID NO: 3659773 - DNA, 12 bp, Homo sapiens
tccagcagggaa

SEQ ID NO: 3659774 - DNA, 21 bp, Homo sapiens
tccagcatttagctggccaca

SEQ ID NO: 3659775 - DNA, 17 bp, Homo sapiens
tccagccccccaggctg

SEQ ID NO: 3659776 - DNA, 16 bp, Homo sapiens
tccagcccctctggtc

SEQ ID NO: 3659777 - DNA, 18 bp, Homo sapiens
tccagcccctctggtcgc

SEQ ID NO: 3659778 - DNA, 16 bp, Homo sapiens
tccagccgccattgcc

SEQ ID NO: 3659779 - DNA, 20 bp, Homo sapiens
tccagccgccattgccacca

SEQ ID NO: 3659780 - DNA, 22 bp, Homo sapiens
tccagccgccattgccaccagg

SEQ ID NO: 3659781 - DNA, 19 bp, Homo sapiens
tccagcctgggcagccagg

SEQ ID NO: 3659782 - DNA, 23 bp, Homo sapiens
tccagcctgggcagccaggctgc

SEQ ID NO: 3659783 - DNA, 16 bp, Homo sapiens
tccagcctggtggccc

SEQ ID NO: 3659784 - DNA, 21 bp, Homo sapiens
tccagcctggtggcccagcta

SEQ ID NO: 3659785 - DNA, 22 bp, Homo sapiens
tccagcgatctctccactgtgc

SEQ ID NO: 3659786 - DNA, 21 bp, Homo sapiens
tccagctatttttatttgttt

SEQ ID NO: 3659787 - DNA, 12 bp, Homo sapiens
tccagctctgga

SEQ ID NO: 3659788 - DNA, 12 bp, Homo sapiens
tccagctctgtg

SEQ ID NO: 3659789 - DNA, 13 bp, Homo sapiens
tccagctctgtgg

SEQ ID NO: 3659790 - DNA, 17 bp, Homo sapiens
tccagctctgtgggccc

SEQ ID NO: 3659791 - DNA, 18 bp, Homo sapiens
tccagctctgtgggccct

SEQ ID NO: 3659792 - DNA, 19 bp, Homo sapiens
tccagctgggttggaaaac

SEQ ID NO: 3659793 - DNA, 17 bp, Homo sapiens
tccagctgttcagctgg

SEQ ID NO: 3659794 - DNA, 18 bp, Homo sapiens
tccaggaaccacaccaca

SEQ ID NO: 3659795 - DNA, 20 bp, Homo sapiens
tccaggactatatttgggcc

SEQ ID NO: 3659796 - DNA, 23 bp, Homo sapiens
tccaggactatatttgggcctgc

SEQ ID NO: 3659797 - DNA, 19 bp, Homo sapiens
tccaggatggggaggggct

SEQ ID NO: 3659798 - DNA, 15 bp, Homo sapiens
tccaggctgtgtttg

SEQ ID NO: 3659799 - DNA, 14 bp, Homo sapiens
tccagggaagctgg

SEQ ID NO: 3659800 - DNA, 17 bp, Homo sapiens
tccagggaagctggccg

SEQ ID NO: 3659801 - DNA, 14 bp, Homo sapiens
tccagggacagagg

SEQ ID NO: 3659802 - DNA, 19 bp, Homo sapiens
tccagggagggtatttatt

SEQ ID NO: 3659803 - DNA, 20 bp, Homo sapiens
tccagggagggtatttattg

SEQ ID NO: 3659804 - DNA, 14 bp, Homo sapiens
tccagggctagtga

SEQ ID NO: 3659805 - DNA, 23 bp, Homo sapiens
tccaggggctgcttcctcctgga

SEQ ID NO: 3659806 - DNA, 14 bp, Homo sapiens
tccaggtgcagagg

SEQ ID NO: 3659807 - DNA, 20 bp, Homo sapiens
tccaggttcaacccacagct

SEQ ID NO: 3659808 - DNA, 23 bp, Homo sapiens
tccaggttcaacccacagctact

SEQ ID NO: 3659809 - DNA, 20 bp, Homo sapiens
tccaggtttaagctgttact

SEQ ID NO: 3659810 - DNA, 15 bp, Homo sapiens
tccagtgctggattt

SEQ ID NO: 3659811 - DNA, 16 bp, Homo sapiens
tccagtgctggatttg

SEQ ID NO: 3659812 - DNA, 16 bp, Homo sapiens
tccatatgctccagga

SEQ ID NO: 3659813 - DNA, 14 bp, Homo sapiens
tccatccagctaca

SEQ ID NO: 3659814 - DNA, 14 bp, Homo sapiens
tccatctctgactt

SEQ ID NO: 3659815 - DNA, 15 bp, Homo sapiens
tccatgaaaatgcaa

SEQ ID NO: 3659816 - DNA, 22 bp, Homo sapiens
tccatgcctgtagctttcctgg

SEQ ID NO: 3659817 - DNA, 15 bp, Homo sapiens
tccatgcgctcaggg

SEQ ID NO: 3659818 - DNA, 18 bp, Homo sapiens
tccatggcaggaaggctt

SEQ ID NO: 3659819 - DNA, 17 bp, Homo sapiens
tccatgtacttgtttgc

SEQ ID NO: 3659820 - DNA, 13 bp, Homo sapiens
tccattttggaaa

SEQ ID NO: 3659821 - DNA, 21 bp, Homo sapiens
tcccaaagacctccacttgct

SEQ ID NO: 3659822 - DNA, 23 bp, Homo sapiens
tcccaaagtgctgggattacaga

SEQ ID NO: 3659823 - DNA, 14 bp, Homo sapiens
tcccaactctagct

SEQ ID NO: 3659824 - DNA, 15 bp, Homo sapiens
tcccaactctagctg

SEQ ID NO: 3659825 - DNA, 16 bp, Homo sapiens
tcccaactctagctgg

SEQ ID NO: 3659826 - DNA, 17 bp, Homo sapiens
tcccaactctagctggg

SEQ ID NO: 3659827 - DNA, 17 bp, Homo sapiens
tcccaagctgtgctggg

SEQ ID NO: 3659828 - DNA, 20 bp, Homo sapiens
tcccaagctgtgctgggaag

SEQ ID NO: 3659829 - DNA, 17 bp, Homo sapiens
tcccaagtctccagaga

SEQ ID NO: 3659830 - DNA, 18 bp, Homo sapiens
tcccaagtctccagagag

SEQ ID NO: 3659831 - DNA, 20 bp, Homo sapiens
tcccaagtctccagagagaa

SEQ ID NO: 3659832 - DNA, 18 bp, Homo sapiens
tcccaatttcagactccc

SEQ ID NO: 3659833 - DNA, 14 bp, Homo sapiens
tcccacaaaggaga

SEQ ID NO: 3659834 - DNA, 14 bp, Homo sapiens
tcccacaagtggtg

SEQ ID NO: 3659835 - DNA, 17 bp, Homo sapiens
tcccaccaggctgctca

SEQ ID NO: 3659836 - DNA, 21 bp, Homo sapiens
tcccacccccttctctgctcc

SEQ ID NO: 3659837 - DNA, 17 bp, Homo sapiens
tcccactcaagccaagc

SEQ ID NO: 3659838 - DNA, 18 bp, Homo sapiens
tcccactcaagccaagca

SEQ ID NO: 3659839 - DNA, 17 bp, Homo sapiens
tcccagaacacactcca

SEQ ID NO: 3659840 - DNA, 12 bp, Homo sapiens
tcccagccaccc

SEQ ID NO: 3659841 - DNA, 23 bp, Homo sapiens
tcccagcccaaattctcctctct

SEQ ID NO: 3659842 - DNA, 12 bp, Homo sapiens
tcccaggaccct

SEQ ID NO: 3659843 - DNA, 19 bp, Homo sapiens
tcccaggctggagtgcagt

SEQ ID NO: 3659844 - DNA, 21 bp, Homo sapiens
tcccagtaagggcgtggctct

SEQ ID NO: 3659845 - DNA, 20 bp, Homo sapiens
tcccagtccaaatgtcctcc

SEQ ID NO: 3659846 - DNA, 22 bp, Homo sapiens
tcccagtgccgagaaggaagcc

SEQ ID NO: 3659847 - DNA, 18 bp, Homo sapiens
tcccagttcttcctgcaa

SEQ ID NO: 3659848 - DNA, 17 bp, Homo sapiens
tcccatcgctggaaaac

SEQ ID NO: 3659849 - DNA, 19 bp, Homo sapiens
tcccatgatccctgtgttg

SEQ ID NO: 3659850 - DNA, 16 bp, Homo sapiens
tcccatgcctgcaacc

SEQ ID NO: 3659851 - DNA, 14 bp, Homo sapiens
tcccattggctttc

SEQ ID NO: 3659852 - DNA, 13 bp, Homo sapiens
tcccattgtccct

SEQ ID NO: 3659853 - DNA, 16 bp, Homo sapiens
tcccattgtccctctg

SEQ ID NO: 3659854 - DNA, 22 bp, Homo sapiens
tccccaacccgtgcccctggga

SEQ ID NO: 3659855 - DNA, 10 bp, Homo sapiens
tccccacact

SEQ ID NO: 3659856 - DNA, 19 bp, Homo sapiens
tccccactgtatctaggca

SEQ ID NO: 3659857 - DNA, 10 bp, Homo sapiens
tccccagaga

SEQ ID NO: 3659858 - DNA, 22 bp, Homo sapiens
tccccagagaaaggggagccca

SEQ ID NO: 3659859 - DNA, 17 bp, Homo sapiens
tccccagcccagagaca

SEQ ID NO: 3659860 - DNA, 22 bp, Homo sapiens
tccccaggggtcccagccaccc

SEQ ID NO: 3659861 - DNA, 23 bp, Homo sapiens
tccccaggtccagctctggaggg

SEQ ID NO: 3659862 - DNA, 14 bp, Homo sapiens
tccccatctcaggc

SEQ ID NO: 3659863 - DNA, 17 bp, Homo sapiens
tcccccaacccccaccc

SEQ ID NO: 3659864 - DNA, 19 bp, Homo sapiens
tcccccaacccccacccca

SEQ ID NO: 3659865 - DNA, 19 bp, Homo sapiens
tccccgcagtgtgcactaa

SEQ ID NO: 3659866 - DNA, 22 bp, Homo sapiens
tccccgcagtgtgcactaaggg

SEQ ID NO: 3659867 - DNA, 19 bp, Homo sapiens
tcccctctaactggacagc

SEQ ID NO: 3659868 - DNA, 21 bp, Homo sapiens
tcccctctaactggacagcct

SEQ ID NO: 3659869 - DNA, 21 bp, Homo sapiens
tcccctggacagaggcggggc

SEQ ID NO: 3659870 - DNA, 22 bp, Homo sapiens
tcccctggacagaggcggggct

SEQ ID NO: 3659871 - DNA, 19 bp, Homo sapiens
tcccctgtagagtgggagc

SEQ ID NO: 3659872 - DNA, 22 bp, Homo sapiens
tcccctgtagagtgggagctga

SEQ ID NO: 3659873 - DNA, 22 bp, Homo sapiens
tcccgaagtcctctgtggccag

SEQ ID NO: 3659874 - DNA, 12 bp, Homo sapiens
tcccggctccag

SEQ ID NO: 3659875 - DNA, 18 bp, Homo sapiens
tcccggctccagagcagg

SEQ ID NO: 3659876 - DNA, 22 bp, Homo sapiens
tcccgtgttgcttcaaactgag

SEQ ID NO: 3659877 - DNA, 16 bp, Homo sapiens
tccctaatctatggtc

SEQ ID NO: 3659878 - DNA, 17 bp, Homo sapiens
tccctagcagcccaccc

SEQ ID NO: 3659879 - DNA, 16 bp, Homo sapiens
tccctagtaaaaatac

SEQ ID NO: 3659880 - DNA, 15 bp, Homo sapiens
tccctatactgcttg

SEQ ID NO: 3659881 - DNA, 21 bp, Homo sapiens
tccctcaccttggcaccagac

SEQ ID NO: 3659882 - DNA, 22 bp, Homo sapiens
tccctcaccttggcaccagaca

SEQ ID NO: 3659883 - DNA, 17 bp, Homo sapiens
tccctccaacacagatc

SEQ ID NO: 3659884 - DNA, 15 bp, Homo sapiens
tccctcccctgccct

SEQ ID NO: 3659885 - DNA, 16 bp, Homo sapiens
tccctcccctgccctg

SEQ ID NO: 3659886 - DNA, 13 bp, Homo sapiens
tccctcctcacct

SEQ ID NO: 3659887 - DNA, 16 bp, Homo sapiens
tccctctctcttctgc

SEQ ID NO: 3659888 - DNA, 19 bp, Homo sapiens
tccctctctcttctgctcc

SEQ ID NO: 3659889 - DNA, 22 bp, Homo sapiens
tccctctgccccgccctccttc

SEQ ID NO: 3659890 - DNA, 15 bp, Homo sapiens
tccctgagacaggga

SEQ ID NO: 3659891 - DNA, 13 bp, Homo sapiens
tccctgagggcgg

SEQ ID NO: 3659892 - DNA, 17 bp, Homo sapiens
tccctgagggcggagcg

SEQ ID NO: 3659893 - DNA, 15 bp, Homo sapiens
tccctgcagctgacc

SEQ ID NO: 3659894 - DNA, 22 bp, Homo sapiens
tccctgcatctgaccagcagcg

SEQ ID NO: 3659895 - DNA, 16 bp, Homo sapiens
tccctgcgcctgtgat

SEQ ID NO: 3659896 - DNA, 21 bp, Homo sapiens
tccctgcgcctgtgatgctgg

SEQ ID NO: 3659897 - DNA, 14 bp, Homo sapiens
tccctggggacggg

SEQ ID NO: 3659898 - DNA, 20 bp, Homo sapiens
tccctggggacggggctccc

SEQ ID NO: 3659899 - DNA, 22 bp, Homo sapiens
tccctggggacggggctcccct

SEQ ID NO: 3659900 - DNA, 14 bp, Homo sapiens
tccctgggggcggg

SEQ ID NO: 3659901 - DNA, 15 bp, Homo sapiens
tccctgggggcggga

SEQ ID NO: 3659902 - DNA, 16 bp, Homo sapiens
tccctgggggtggggc

SEQ ID NO: 3659903 - DNA, 12 bp, Homo sapiens
tccctgggtgga

SEQ ID NO: 3659904 - DNA, 17 bp, Homo sapiens
tccctgggtggagcagg

SEQ ID NO: 3659905 - DNA, 21 bp, Homo sapiens
tccctgggtggagcaggactc

SEQ ID NO: 3659906 - DNA, 16 bp, Homo sapiens
tccctggttgcctcat

SEQ ID NO: 3659907 - DNA, 12 bp, Homo sapiens
tccctgtcccag

SEQ ID NO: 3659908 - DNA, 16 bp, Homo sapiens
tccctgttccccagag

SEQ ID NO: 3659909 - DNA, 18 bp, Homo sapiens
tccctgttccccagagaa

SEQ ID NO: 3659910 - DNA, 16 bp, Homo sapiens
tcccttcccataagct

SEQ ID NO: 3659911 - DNA, 18 bp, Homo sapiens
tcccttcctctgtgccac

SEQ ID NO: 3659912 - DNA, 14 bp, Homo sapiens
tcccttgcttgcct

SEQ ID NO: 3659913 - DNA, 23 bp, Homo sapiens
tcccttgcttgcctgcagggcca

SEQ ID NO: 3659914 - DNA, 22 bp, Homo sapiens
tcccttgtgtcaagacatttct

SEQ ID NO: 3659915 - DNA, 14 bp, Homo sapiens
tccctttccttcca

SEQ ID NO: 3659916 - DNA, 17 bp, Homo sapiens
tccctttccttccatcc

SEQ ID NO: 3659917 - DNA, 18 bp, Homo sapiens
tccctttccttccatccc

SEQ ID NO: 3659918 - DNA, 19 bp, Homo sapiens
tcccttttaatcctggctg

SEQ ID NO: 3659919 - DNA, 12 bp, Homo sapiens
tccgcaccctgc

SEQ ID NO: 3659920 - DNA, 14 bp, Homo sapiens
tccgccctgccact

SEQ ID NO: 3659921 - DNA, 15 bp, Homo sapiens
tccgccctgccactc

SEQ ID NO: 3659922 - DNA, 16 bp, Homo sapiens
tccgcctggcccggga

SEQ ID NO: 3659923 - DNA, 15 bp, Homo sapiens
tcttatactgtacaa

SEQ ID NO: 3659924 - DNA, 16 bp, Homo sapiens
tcttatactgtacaat

SEQ ID NO: 3659925 - DNA, 18 bp, Homo sapiens
tcttatactgtacaataa

SEQ ID NO: 3659926 - DNA, 14 bp, Homo sapiens
tcttcaaatgcctg

SEQ ID NO: 3659927 - DNA, 13 bp, Homo sapiens
tcttcaggcctcc

SEQ ID NO: 3659928 - DNA, 14 bp, Homo sapiens
tcttcaggcctccc

SEQ ID NO: 3659929 - DNA, 15 bp, Homo sapiens
tcttcaggcctccct

SEQ ID NO: 3659930 - DNA, 16 bp, Homo sapiens
tcttcagttaattctt

SEQ ID NO: 3659931 - DNA, 17 bp, Homo sapiens
tcttcccgaaccccaag

SEQ ID NO: 3659932 - DNA, 14 bp, Homo sapiens
tcttccctacctca

SEQ ID NO: 3659933 - DNA, 14 bp, Homo sapiens
tcttccctgggaac

SEQ ID NO: 3659934 - DNA, 14 bp, Homo sapiens
tcttcctgagtggt

SEQ ID NO: 3659935 - DNA, 18 bp, Homo sapiens
tcttcctgagtggtgcca

SEQ ID NO: 3659936 - DNA, 22 bp, Homo sapiens
tcttccttgaagaactgcaggc

SEQ ID NO: 3659937 - DNA, 19 bp, Homo sapiens
tcttcgttctttttaagtt

SEQ ID NO: 3659938 - DNA, 16 bp, Homo sapiens
tcttctaaaacttgta

SEQ ID NO: 3659939 - DNA, 13 bp, Homo sapiens
tcttctatattaa

SEQ ID NO: 3659940 - DNA, 15 bp, Homo sapiens
tcttctccttggagg

SEQ ID NO: 3659941 - DNA, 15 bp, Homo sapiens
tcttctgctccaccc

SEQ ID NO: 3659942 - DNA, 16 bp, Homo sapiens
tcttctgctccaccct

SEQ ID NO: 3659943 - DNA, 18 bp, Homo sapiens
tcttctggactggttttc

SEQ ID NO: 3659944 - DNA, 17 bp, Homo sapiens
tcttctgtcccaagtct

SEQ ID NO: 3659945 - DNA, 13 bp, Homo sapiens
tcttcttaattct

SEQ ID NO: 3659946 - DNA, 21 bp, Homo sapiens
tcttgaaaggtccaaatgttt

SEQ ID NO: 3659947 - DNA, 14 bp, Homo sapiens
tcttgaatttctga

SEQ ID NO: 3659948 - DNA, 15 bp, Homo sapiens
tcttgaatttctgac

SEQ ID NO: 3659949 - DNA, 16 bp, Homo sapiens
tcttgagcctgggagg

SEQ ID NO: 3659950 - DNA, 15 bp, Homo sapiens
tcttgcacacacttt

SEQ ID NO: 3659951 - DNA, 18 bp, Homo sapiens
tcttgcctccaggtgcag

SEQ ID NO: 3659952 - DNA, 12 bp, Homo sapiens
tcttgcctctgt

SEQ ID NO: 3659953 - DNA, 17 bp, Homo sapiens
tcttgctctgtctccca

SEQ ID NO: 3659954 - DNA, 23 bp, Homo sapiens
tcttgcttccctaatctatggtc

SEQ ID NO: 3659955 - DNA, 21 bp, Homo sapiens
tcttggaagtctgtctcagga

SEQ ID NO: 3659956 - DNA, 21 bp, Homo sapiens
tcttggcttaatcattttcat

SEQ ID NO: 3659957 - DNA, 11 bp, Homo sapiens
tcttggctttg

SEQ ID NO: 3659958 - DNA, 19 bp, Homo sapiens
tcttgggcagagctggctc

SEQ ID NO: 3659959 - DNA, 21 bp, Homo sapiens
tcttgggcagagctggctctg

SEQ ID NO: 3659960 - DNA, 19 bp, Homo sapiens
tcttgggtgggacagggct

SEQ ID NO: 3659961 - DNA, 21 bp, Homo sapiens
tcttgggtgggacagggcttc

SEQ ID NO: 3659962 - DNA, 15 bp, Homo sapiens
tcttggtttatgtct

SEQ ID NO: 3659963 - DNA, 17 bp, Homo sapiens
tcttggtttatgtcttg

SEQ ID NO: 3659964 - DNA, 18 bp, Homo sapiens
tcttggtttatgtcttgt

SEQ ID NO: 3659965 - DNA, 20 bp, Homo sapiens
tcttgtcctcattcttgcct

SEQ ID NO: 3659966 - DNA, 13 bp, Homo sapiens
tcttgtggaagac

SEQ ID NO: 3659967 - DNA, 22 bp, Homo sapiens
tcttgtggaagacacttgctga

SEQ ID NO: 3659968 - DNA, 13 bp, Homo sapiens
tcttgttgttatt

SEQ ID NO: 3659969 - DNA, 18 bp, Homo sapiens
tcttgtttctgcatcttt

SEQ ID NO: 3659970 - DNA, 23 bp, Homo sapiens
tctttaaagtgactaatggcatg

SEQ ID NO: 3659971 - DNA, 16 bp, Homo sapiens
tctttaaatgctgctt

SEQ ID NO: 3659972 - DNA, 16 bp, Homo sapiens
tctttaaccttgtata

SEQ ID NO: 3659973 - DNA, 16 bp, Homo sapiens
tctttaggagatttat

SEQ ID NO: 3659974 - DNA, 14 bp, Homo sapiens
tctttatgcttgca

SEQ ID NO: 3659975 - DNA, 23 bp, Homo sapiens
tctttcacattgtttgctgctat

SEQ ID NO: 3659976 - DNA, 21 bp, Homo sapiens
tctttcagtacttttttaaat

SEQ ID NO: 3659977 - DNA, 17 bp, Homo sapiens
tctttcctaaggctgca

SEQ ID NO: 3659978 - DNA, 11 bp, Homo sapiens
tctttctctgc

SEQ ID NO: 3659979 - DNA, 12 bp, Homo sapiens
tctttctctgcc

SEQ ID NO: 3659980 - DNA, 15 bp, Homo sapiens
tctttctctgccagt

SEQ ID NO: 3659981 - DNA, 21 bp, Homo sapiens
tctttctgattccgcaccctg

SEQ ID NO: 3659982 - DNA, 22 bp, Homo sapiens
tctttgaaatagtctgtgtgaa

SEQ ID NO: 3659983 - DNA, 22 bp, Homo sapiens
tctttgcaaagtattgtaaatt

SEQ ID NO: 3659984 - DNA, 23 bp, Homo sapiens
tctttgcaaagtattgtaaatta

SEQ ID NO: 3659985 - DNA, 15 bp, Homo sapiens
tctttgctgaagaat

SEQ ID NO: 3659986 - DNA, 18 bp, Homo sapiens
tctttgctttgctttctg

SEQ ID NO: 3659987 - DNA, 18 bp, Homo sapiens
tcttttctagtctgagct

SEQ ID NO: 3659988 - DNA, 18 bp, Homo sapiens
tcttttgcttttggcaaa

SEQ ID NO: 3659989 - DNA, 16 bp, Homo sapiens
tgaaaaaggaggaaga

SEQ ID NO: 3659990 - DNA, 15 bp, Homo sapiens
tgaaaaatcttaagt

SEQ ID NO: 3659991 - DNA, 19 bp, Homo sapiens
tgaaaagaaaaatgagcct

SEQ ID NO: 3659992 - DNA, 18 bp, Homo sapiens
tgaaaatatctgctcaaa

SEQ ID NO: 3659993 - DNA, 15 bp, Homo sapiens
tgaaaattaacactg

SEQ ID NO: 3659994 - DNA, 18 bp, Homo sapiens
tgaaaattaacactgctt

SEQ ID NO: 3659995 - DNA, 23 bp, Homo sapiens
tgaaacagaaaaatatgtaccaa

SEQ ID NO: 3659996 - DNA, 16 bp, Homo sapiens
tgaaaggaacattttt

SEQ ID NO: 3659997 - DNA, 15 bp, Homo sapiens
tgaaaggcaggaagg

SEQ ID NO: 3659998 - DNA, 20 bp, Homo sapiens
tgaaaggcaggaagggaagc

SEQ ID NO: 3659999 - DNA, 22 bp, Homo sapiens
tgaaagggagctatcaggaaca

SEQ ID NO: 3660000 - DNA, 18 bp, Homo sapiens
tgaaagttttcagaacct

SEQ ID NO: 3660001 - DNA, 23 bp, Homo sapiens
tgaaataaacagtctaaagaaga

SEQ ID NO: 3660002 - DNA, 20 bp, Homo sapiens
tgaaataactggaacaaatt

SEQ ID NO: 3660003 - DNA, 17 bp, Homo sapiens
tgaaatagtctgtgtga

SEQ ID NO: 3660004 - DNA, 17 bp, Homo sapiens
tgaaatatcctgcttga

SEQ ID NO: 3660005 - DNA, 21 bp, Homo sapiens
tgaaatctgtcaagagtagtt

SEQ ID NO: 3660006 - DNA, 12 bp, Homo sapiens
tgaaatttaatg

SEQ ID NO: 3660007 - DNA, 19 bp, Homo sapiens
tgaaattttaaaaattgtt

SEQ ID NO: 3660008 - DNA, 12 bp, Homo sapiens
tgaacccaggca

SEQ ID NO: 3660009 - DNA, 14 bp, Homo sapiens
tgaacccaggcagc

SEQ ID NO: 3660010 - DNA, 18 bp, Homo sapiens
tgaacccaggcagctggc

SEQ ID NO: 3660011 - DNA, 19 bp, Homo sapiens
tgaacccaggcagctggca

SEQ ID NO: 3660012 - DNA, 21 bp, Homo sapiens
tgaacccaggcagctggcagg

SEQ ID NO: 3660013 - DNA, 17 bp, Homo sapiens
tgaaccggctcccaccc

SEQ ID NO: 3660014 - DNA, 15 bp, Homo sapiens
tgaactggaagaaag

SEQ ID NO: 3660015 - DNA, 13 bp, Homo sapiens
tgaactgttacaa

SEQ ID NO: 3660016 - DNA, 14 bp, Homo sapiens
tgaactgttgccct

SEQ ID NO: 3660017 - DNA, 19 bp, Homo sapiens
tgaactgttgcccttctgt

SEQ ID NO: 3660018 - DNA, 21 bp, Homo sapiens
tgaacttgaaatatcctgctt

SEQ ID NO: 3660019 - DNA, 20 bp, Homo sapiens
tgaagaaccagtccccccac

SEQ ID NO: 3660020 - DNA, 22 bp, Homo sapiens
tgaagatttgaggacttgttaa

SEQ ID NO: 3660021 - DNA, 23 bp, Homo sapiens
tgaagcagatgcaaagaggcaag

SEQ ID NO: 3660022 - DNA, 23 bp, Homo sapiens
tgaagccgtgcctgtagccttgg

SEQ ID NO: 3660023 - DNA, 16 bp, Homo sapiens
tgaaggcagggctcct

SEQ ID NO: 3660024 - DNA, 17 bp, Homo sapiens
tgaaggcagggctcctc

SEQ ID NO: 3660025 - DNA, 20 bp, Homo sapiens
tgaaggcagggctcctccct

SEQ ID NO: 3660026 - DNA, 14 bp, Homo sapiens
tgaagggccagagc

SEQ ID NO: 3660027 - DNA, 15 bp, Homo sapiens
tgaagggccagagcc

SEQ ID NO: 3660028 - DNA, 19 bp, Homo sapiens
tgaagggccagagccaggg

SEQ ID NO: 3660029 - DNA, 21 bp, Homo sapiens
tgaagggcctcccagccccca

SEQ ID NO: 3660030 - DNA, 21 bp, Homo sapiens
tgaagggggtaccttaagaga

SEQ ID NO: 3660031 - DNA, 19 bp, Homo sapiens
tgaaggtgctgacggccag

SEQ ID NO: 3660032 - DNA, 20 bp, Homo sapiens
tgaaggtgctgacggccagg

SEQ ID NO: 3660033 - DNA, 14 bp, Homo sapiens
tgaagtaaaactta

SEQ ID NO: 3660034 - DNA, 15 bp, Homo sapiens
tgaagtaagcaaaga

SEQ ID NO: 3660035 - DNA, 16 bp, Homo sapiens
tgaagttatgctgtca

SEQ ID NO: 3660036 - DNA, 15 bp, Homo sapiens
tgaatataaacacta

SEQ ID NO: 3660037 - DNA, 16 bp, Homo sapiens
tgaatataaacactat

SEQ ID NO: 3660038 - DNA, 23 bp, Homo sapiens
tgaatatatttaagcaacatctt

SEQ ID NO: 3660039 - DNA, 23 bp, Homo sapiens
tgccttcgcttcttgcctctgtg

SEQ ID NO: 3660040 - DNA, 13 bp, Homo sapiens
tgccttgctgttt

SEQ ID NO: 3660041 - DNA, 20 bp, Homo sapiens
tgccttgctgtttgtcctga

SEQ ID NO: 3660042 - DNA, 12 bp, Homo sapiens
tgcctttgaatg

SEQ ID NO: 3660043 - DNA, 13 bp, Homo sapiens
tgcgaaaggatga

SEQ ID NO: 3660044 - DNA, 20 bp, Homo sapiens
tgcgcatcttgcctccaggt

SEQ ID NO: 3660045 - DNA, 14 bp, Homo sapiens
tgcgccccaggccc

SEQ ID NO: 3660046 - DNA, 23 bp, Homo sapiens
tgcgccccctccgccctgccact

SEQ ID NO: 3660047 - DNA, 21 bp, Homo sapiens
tgcgctcagggccatgctgag

SEQ ID NO: 3660048 - DNA, 17 bp, Homo sapiens
tgcggcctttggcttca

SEQ ID NO: 3660049 - DNA, 19 bp, Homo sapiens
tgcggcctttggcttcacg

SEQ ID NO: 3660050 - DNA, 15 bp, Homo sapiens
tgcgtcgagctggga

SEQ ID NO: 3660051 - DNA, 23 bp, Homo sapiens
tgcgttggcttctccctggggac

SEQ ID NO: 3660052 - DNA, 16 bp, Homo sapiens
tgctaatttaaagaga

SEQ ID NO: 3660053 - DNA, 17 bp, Homo sapiens
tgctaatttaaagagac

SEQ ID NO: 3660054 - DNA, 15 bp, Homo sapiens
tgctaccgagaaggt

SEQ ID NO: 3660055 - DNA, 14 bp, Homo sapiens
tgctacctctgaga

SEQ ID NO: 3660056 - DNA, 20 bp, Homo sapiens
tgctacctctgagaagacac

SEQ ID NO: 3660057 - DNA, 14 bp, Homo sapiens
tgctactccatgca

SEQ ID NO: 3660058 - DNA, 18 bp, Homo sapiens
tgctactccatgcagggg

SEQ ID NO: 3660059 - DNA, 14 bp, Homo sapiens
tgctagaaattttc

SEQ ID NO: 3660060 - DNA, 21 bp, Homo sapiens
tgctataactatgttgataaa

SEQ ID NO: 3660061 - DNA, 14 bp, Homo sapiens
tgctatagtatttg

SEQ ID NO: 3660062 - DNA, 15 bp, Homo sapiens
tgctatagtatttga

SEQ ID NO: 3660063 - DNA, 19 bp, Homo sapiens
tgctatccagctattttta

SEQ ID NO: 3660064 - DNA, 22 bp, Homo sapiens
tgctatgcaaaaaattctttag

SEQ ID NO: 3660065 - DNA, 20 bp, Homo sapiens
tgctatttgaacaagtgggc

SEQ ID NO: 3660066 - DNA, 12 bp, Homo sapiens
tgctatttttgt

SEQ ID NO: 3660067 - DNA, 17 bp, Homo sapiens
tgctatttttgtaaagt

SEQ ID NO: 3660068 - DNA, 13 bp, Homo sapiens
tgctcacctgggg

SEQ ID NO: 3660069 - DNA, 14 bp, Homo sapiens
tgctcacctggggt

SEQ ID NO: 3660070 - DNA, 17 bp, Homo sapiens
tgctcaggtacttgtaa

SEQ ID NO: 3660071 - DNA, 16 bp, Homo sapiens
tgctcatctgctggtc

SEQ ID NO: 3660072 - DNA, 19 bp, Homo sapiens
tgctcatgggctgtgtgat

SEQ ID NO: 3660073 - DNA, 15 bp, Homo sapiens
tgctccaccacatcc

SEQ ID NO: 3660074 - DNA, 17 bp, Homo sapiens
tgctccacccttggcct

SEQ ID NO: 3660075 - DNA, 18 bp, Homo sapiens
tgctccacccttggcctg

SEQ ID NO: 3660076 - DNA, 12 bp, Homo sapiens
tgctccagacct

SEQ ID NO: 3660077 - DNA, 21 bp, Homo sapiens
tgctccagctgttcagctggt

SEQ ID NO: 3660078 - DNA, 20 bp, Homo sapiens
tgctccctaccacctcccca

SEQ ID NO: 3660079 - DNA, 20 bp, Homo sapiens
tgctccctcccctgccctgg

SEQ ID NO: 3660080 - DNA, 14 bp, Homo sapiens
tgctcctagaggga

SEQ ID NO: 3660081 - DNA, 20 bp, Homo sapiens
tgctcctagagggaggggcc

SEQ ID NO: 3660082 - DNA, 19 bp, Homo sapiens
tgctcctggcccactgcat

SEQ ID NO: 3660083 - DNA, 12 bp, Homo sapiens
tgctccttgctg

SEQ ID NO: 3660084 - DNA, 22 bp, Homo sapiens
tgctcgcgaaggtcccacagcc

SEQ ID NO: 3660085 - DNA, 13 bp, Homo sapiens
tgctctagtgcct

SEQ ID NO: 3660086 - DNA, 16 bp, Homo sapiens
tgctctagtgccttct

SEQ ID NO: 3660087 - DNA, 12 bp, Homo sapiens
tgctctgtctcc

SEQ ID NO: 3660088 - DNA, 22 bp, Homo sapiens
tgctctgtcttctttgcccaca

SEQ ID NO: 3660089 - DNA, 23 bp, Homo sapiens
tgctctttcccccttccatctct

SEQ ID NO: 3660090 - DNA, 14 bp, Homo sapiens
tgctctttctctgc

SEQ ID NO: 3660091 - DNA, 16 bp, Homo sapiens
tgctctttctctgcca

SEQ ID NO: 3660092 - DNA, 21 bp, Homo sapiens
tgctctttgtagctaacagtg

SEQ ID NO: 3660093 - DNA, 23 bp, Homo sapiens
tgctctttgtagctaacagtgaa

SEQ ID NO: 3660094 - DNA, 18 bp, Homo sapiens
tgctgaatacagaggcaa

SEQ ID NO: 3660095 - DNA, 17 bp, Homo sapiens
tgctgacagctgctcct

SEQ ID NO: 3660096 - DNA, 20 bp, Homo sapiens
tgctgagatacatacagaat

SEQ ID NO: 3660097 - DNA, 11 bp, Homo sapiens
tgctgagctgc

SEQ ID NO: 3660098 - DNA, 21 bp, Homo sapiens
tgctgagctgcccctgctgct

SEQ ID NO: 3660099 - DNA, 14 bp, Homo sapiens
tgctgaggcctggg

SEQ ID NO: 3660100 - DNA, 16 bp, Homo sapiens
tgctgaggcctgggcc

SEQ ID NO: 3660101 - DNA, 17 bp, Homo sapiens
tgctgaggcctgggccg

SEQ ID NO: 3660102 - DNA, 23 bp, Homo sapiens
tgctgcagcaccgaggggccttt

SEQ ID NO: 3660103 - DNA, 20 bp, Homo sapiens
tgctgcttaagtgcatgcat

SEQ ID NO: 3660104 - DNA, 17 bp, Homo sapiens
tgctgctttaacagtgg

SEQ ID NO: 3660105 - DNA, 18 bp, Homo sapiens
tgctgctttaacagtgga

SEQ ID NO: 3660106 - DNA, 17 bp, Homo sapiens
tgctgcttttccttggg

SEQ ID NO: 3660107 - DNA, 20 bp, Homo sapiens
tgctgcttttccttggggca

SEQ ID NO: 3660108 - DNA, 16 bp, Homo sapiens
tgctggaagacagaga

SEQ ID NO: 3660109 - DNA, 15 bp, Homo sapiens
tgctggagtacccag

SEQ ID NO: 3660110 - DNA, 21 bp, Homo sapiens
tgctggagtacccagcctatc

SEQ ID NO: 3660111 - DNA, 20 bp, Homo sapiens
tgctggcccagggcccagag

SEQ ID NO: 3660112 - DNA, 15 bp, Homo sapiens
tgctgggagctccac

SEQ ID NO: 3660113 - DNA, 17 bp, Homo sapiens
tgctgggagctccactc

SEQ ID NO: 3660114 - DNA, 18 bp, Homo sapiens
tgctgggagctccactct

SEQ ID NO: 3660115 - DNA, 22 bp, Homo sapiens
tgctgggagctccactctgctt

SEQ ID NO: 3660116 - DNA, 19 bp, Homo sapiens
tgctgggtggttctctggg

SEQ ID NO: 3660117 - DNA, 13 bp, Homo sapiens
tgctggttttcta

SEQ ID NO: 3660118 - DNA, 14 bp, Homo sapiens
tgctgtgaggctgt

SEQ ID NO: 3660119 - DNA, 16 bp, Homo sapiens
tgctgtgaggctgtcc

SEQ ID NO: 3660120 - DNA, 19 bp, Homo sapiens
tgctgtgaggcttgcccag

SEQ ID NO: 3660121 - DNA, 20 bp, Homo sapiens
tgctgtgaggcttgcccagg

SEQ ID NO: 3660122 - DNA, 23 bp, Homo sapiens
tgctgtgcctcgcatcctatgct

SEQ ID NO: 3660123 - DNA, 15 bp, Homo sapiens
tgctgtgctgtgcta

SEQ ID NO: 3660124 - DNA, 18 bp, Homo sapiens
tgctgtgctgtgctatgg

SEQ ID NO: 3660125 - DNA, 18 bp, Homo sapiens
tgctgtgtgtcccaggca

SEQ ID NO: 3660126 - DNA, 21 bp, Homo sapiens
tgctgtgtgtcccaggcaggg

SEQ ID NO: 3660127 - DNA, 23 bp, Homo sapiens
tgctgtgtgtcccaggcagggag

SEQ ID NO: 3660128 - DNA, 13 bp, Homo sapiens
tgctgtttcacaa

SEQ ID NO: 3660129 - DNA, 19 bp, Homo sapiens
tgctgttttcctcccttct

SEQ ID NO: 3660130 - DNA, 18 bp, Homo sapiens
tgcttaataaaagaacat

SEQ ID NO: 3660131 - DNA, 18 bp, Homo sapiens
tgcttccccttttgccaa

SEQ ID NO: 3660132 - DNA, 17 bp, Homo sapiens
tgcttccctgcagctga

SEQ ID NO: 3660133 - DNA, 13 bp, Homo sapiens
tgcttcctcctgg

SEQ ID NO: 3660134 - DNA, 14 bp, Homo sapiens
tgcttcctcctgga

SEQ ID NO: 3660135 - DNA, 20 bp, Homo sapiens
tgcttctctgacttctgcct

SEQ ID NO: 3660136 - DNA, 23 bp, Homo sapiens
tgcttctctgacttctgcctgga

SEQ ID NO: 3660137 - DNA, 13 bp, Homo sapiens
tgcttgatagaaa

SEQ ID NO: 3660138 - DNA, 15 bp, Homo sapiens
tgcttgcctgcaggg

SEQ ID NO: 3660139 - DNA, 18 bp, Homo sapiens
tgcttgctcatatgcatg

SEQ ID NO: 3660140 - DNA, 15 bp, Homo sapiens
tgcttggagctgagc

SEQ ID NO: 3660141 - DNA, 17 bp, Homo sapiens
tgcttgtaggtatgtct

SEQ ID NO: 3660142 - DNA, 13 bp, Homo sapiens
tgcttgtcatctg

SEQ ID NO: 3660143 - DNA, 13 bp, Homo sapiens
tgctttaacagtg

SEQ ID NO: 3660144 - DNA, 16 bp, Homo sapiens
tgctttcagaagtgcc

SEQ ID NO: 3660145 - DNA, 17 bp, Homo sapiens
tgctttctcctcgttct

SEQ ID NO: 3660146 - DNA, 20 bp, Homo sapiens
tgctttctgctcagcttctc

SEQ ID NO: 3660147 - DNA, 16 bp, Homo sapiens
tgctttgaaacagaaa

SEQ ID NO: 3660148 - DNA, 17 bp, Homo sapiens
tgctttgccaaaatacc

SEQ ID NO: 3660149 - DNA, 21 bp, Homo sapiens
tgctttggacctaaatggcct

SEQ ID NO: 3660150 - DNA, 23 bp, Homo sapiens
tgctttggacctaaatggcctca

SEQ ID NO: 3660151 - DNA, 17 bp, Homo sapiens
tgctttttctcaaaatg

SEQ ID NO: 3660152 - DNA, 17 bp, Homo sapiens
tggaaaaataacaacta

SEQ ID NO: 3660153 - DNA, 16 bp, Homo sapiens
tggaaaagtgtccttc

SEQ ID NO: 3660154 - DNA, 15 bp, Homo sapiens
tggaaaataaatcaa

SEQ ID NO: 3660155 - DNA, 18 bp, Homo sapiens
tgtccaacccgaggcccg

SEQ ID NO: 3660156 - DNA, 14 bp, Homo sapiens
tgtccagcctgggc

SEQ ID NO: 3660157 - DNA, 22 bp, Homo sapiens
tgtccagcctgggcagccaggc

SEQ ID NO: 3660158 - DNA, 11 bp, Homo sapiens
tgtccagctcc

SEQ ID NO: 3660159 - DNA, 22 bp, Homo sapiens
tgtccatgcgctcagggccatg

SEQ ID NO: 3660160 - DNA, 17 bp, Homo sapiens
tgtcccaggcagggaga

SEQ ID NO: 3660161 - DNA, 21 bp, Homo sapiens
tgtcccctcctcactcccttc

SEQ ID NO: 3660162 - DNA, 14 bp, Homo sapiens
tgtccctctgcccc

SEQ ID NO: 3660163 - DNA, 15 bp, Homo sapiens
tgtccctctgcccca

SEQ ID NO: 3660164 - DNA, 16 bp, Homo sapiens
tgtccctctgccccat

SEQ ID NO: 3660165 - DNA, 23 bp, Homo sapiens
tgtcccttgcttgcctgcagggc

SEQ ID NO: 3660166 - DNA, 13 bp, Homo sapiens
tgtccgagctttg

SEQ ID NO: 3660167 - DNA, 14 bp, Homo sapiens
tgtccgagctttga

SEQ ID NO: 3660168 - DNA, 19 bp, Homo sapiens
tgtccgatggtatctgggt

SEQ ID NO: 3660169 - DNA, 13 bp, Homo sapiens
tgtcctcagcctt

SEQ ID NO: 3660170 - DNA, 17 bp, Homo sapiens
tgtcctcagccttgcca

SEQ ID NO: 3660171 - DNA, 20 bp, Homo sapiens
tgtcctcagccttgccagag

SEQ ID NO: 3660172 - DNA, 21 bp, Homo sapiens
tgtcctcagccttgccagaga

SEQ ID NO: 3660173 - DNA, 16 bp, Homo sapiens
tgtcctccagaagcct

SEQ ID NO: 3660174 - DNA, 19 bp, Homo sapiens
tgtcctccagaagcctctg

SEQ ID NO: 3660175 - DNA, 17 bp, Homo sapiens
tgtcctctccctgccaa

SEQ ID NO: 3660176 - DNA, 17 bp, Homo sapiens
tgtcctgacctgtctca

SEQ ID NO: 3660177 - DNA, 15 bp, Homo sapiens
tgtcctgggcctgca

SEQ ID NO: 3660178 - DNA, 13 bp, Homo sapiens
tgtcctttctaga

SEQ ID NO: 3660179 - DNA, 19 bp, Homo sapiens
tgtcctttctagagcactg

SEQ ID NO: 3660180 - DNA, 16 bp, Homo sapiens
tgtcgctcatgtgtgc

SEQ ID NO: 3660181 - DNA, 18 bp, Homo sapiens
tgtctaattaaaacactt

SEQ ID NO: 3660182 - DNA, 22 bp, Homo sapiens
tgtctactcagcatttgattaa

SEQ ID NO: 3660183 - DNA, 21 bp, Homo sapiens
tgtctcaaaaaaagaaaaaga

SEQ ID NO: 3660184 - DNA, 17 bp, Homo sapiens
tgtctcaggactctgaa

SEQ ID NO: 3660185 - DNA, 22 bp, Homo sapiens
tgtctcaggagcaccctgtctt

SEQ ID NO: 3660186 - DNA, 16 bp, Homo sapiens
tgtctcatccccaggg

SEQ ID NO: 3660187 - DNA, 18 bp, Homo sapiens
tgtctcctatatatttct

SEQ ID NO: 3660188 - DNA, 14 bp, Homo sapiens
tgtctcttgagttt

SEQ ID NO: 3660189 - DNA, 17 bp, Homo sapiens
tgtctcttgagtttgtc

SEQ ID NO: 3660190 - DNA, 16 bp, Homo sapiens
tgtctgaacccaggca

SEQ ID NO: 3660191 - DNA, 17 bp, Homo sapiens
tgtctgaacccaggcag

SEQ ID NO: 3660192 - DNA, 19 bp, Homo sapiens
tgtctgaacccaggcagct

SEQ ID NO: 3660193 - DNA, 19 bp, Homo sapiens
tgtctgagcccaacccttc

SEQ ID NO: 3660194 - DNA, 13 bp, Homo sapiens
tgtctgcatttcg

SEQ ID NO: 3660195 - DNA, 18 bp, Homo sapiens
tgtctggcaaaagaaaaa

SEQ ID NO: 3660196 - DNA, 18 bp, Homo sapiens
tgtctgtgccatttctca

SEQ ID NO: 3660197 - DNA, 22 bp, Homo sapiens
tgtctgtgccatttctcaggga

SEQ ID NO: 3660198 - DNA, 10 bp, Homo sapiens
tgtcttctta

SEQ ID NO: 3660199 - DNA, 12 bp, Homo sapiens
tgtcttggaagt

SEQ ID NO: 3660200 - DNA, 18 bp, Homo sapiens
tgtcttggaagtctgtct

SEQ ID NO: 3660201 - DNA, 12 bp, Homo sapiens
tgtcttgggcag

SEQ ID NO: 3660202 - DNA, 13 bp, Homo sapiens
tgtcttgggcaga

SEQ ID NO: 3660203 - DNA, 16 bp, Homo sapiens
tgtcttgggcagagct

SEQ ID NO: 3660204 - DNA, 15 bp, Homo sapiens
tgtcttgttcttgag

SEQ ID NO: 3660205 - DNA, 16 bp, Homo sapiens
tgtcttttaaaatgca

SEQ ID NO: 3660206 - DNA, 14 bp, Homo sapiens
tgtcttttgacatt

SEQ ID NO: 3660207 - DNA, 21 bp, Homo sapiens
tgtgaaaaaggaataaattgt

SEQ ID NO: 3660208 - DNA, 16 bp, Homo sapiens
tgtgaactggaagaaa

SEQ ID NO: 3660209 - DNA, 13 bp, Homo sapiens
tgtgaaggaccct

SEQ ID NO: 3660210 - DNA, 13 bp, Homo sapiens
tgtgaccaccacc

SEQ ID NO: 3660211 - DNA, 14 bp, Homo sapiens
tgtgaccctctttg

SEQ ID NO: 3660212 - DNA, 22 bp, Homo sapiens
tgtgagaagtgaatgctgggac

SEQ ID NO: 3660213 - DNA, 23 bp, Homo sapiens
tgtgagaagtgaatgctgggact

SEQ ID NO: 3660214 - DNA, 16 bp, Homo sapiens
tgtgagacccccacac

SEQ ID NO: 3660215 - DNA, 14 bp, Homo sapiens
tgtgaggagctgct

SEQ ID NO: 3660216 - DNA, 18 bp, Homo sapiens
tgtgaggagctgctggct

SEQ ID NO: 3660217 - DNA, 20 bp, Homo sapiens
tgtgaggagctgctggcttg

SEQ ID NO: 3660218 - DNA, 20 bp, Homo sapiens
tgtgaggcttgcccaggagc

SEQ ID NO: 3660219 - DNA, 20 bp, Homo sapiens
tgtgcaaaaaaattaaaatg

SEQ ID NO: 3660220 - DNA, 23 bp, Homo sapiens
tgtgcaaaaaaattaaaatggat

SEQ ID NO: 3660221 - DNA, 21 bp, Homo sapiens
tgtgcaacggtctcctgactg

SEQ ID NO: 3660222 - DNA, 22 bp, Homo sapiens
tgtgcacatccgcgtgtgcctg

SEQ ID NO: 3660223 - DNA, 15 bp, Homo sapiens
tgtgccaccccttcc

SEQ ID NO: 3660224 - DNA, 19 bp, Homo sapiens
tgtgccaccccttcctcag

SEQ ID NO: 3660225 - DNA, 21 bp, Homo sapiens
tgtgccacgctcctctgtttg

SEQ ID NO: 3660226 - DNA, 17 bp, Homo sapiens
tgtgccatggtgagaaa

SEQ ID NO: 3660227 - DNA, 17 bp, Homo sapiens
tgtgccatttctcaggg

SEQ ID NO: 3660228 - DNA, 15 bp, Homo sapiens
tgtgccccatgcctg

SEQ ID NO: 3660229 - DNA, 15 bp, Homo sapiens
tgtgcccctccaagt

SEQ ID NO: 3660230 - DNA, 16 bp, Homo sapiens
tgtgccccttgacaac

SEQ ID NO: 3660231 - DNA, 21 bp, Homo sapiens
tgtgcctcgcatcctatgctt

SEQ ID NO: 3660232 - DNA, 23 bp, Homo sapiens
tgtgccttcgtctttcccatggg

SEQ ID NO: 3660233 - DNA, 17 bp, Homo sapiens
tgtgctatagtatttga

SEQ ID NO: 3660234 - DNA, 18 bp, Homo sapiens
tgtgctatggtgctctgt

SEQ ID NO: 3660235 - DNA, 18 bp, Homo sapiens
tgtgctgggaagcccgga

SEQ ID NO: 3660236 - DNA, 15 bp, Homo sapiens
tgtgctgtgtgtgac

SEQ ID NO: 3660237 - DNA, 15 bp, Homo sapiens
tgtgcttcctcctgc

SEQ ID NO: 3660238 - DNA, 12 bp, Homo sapiens
tgtggagaagcg

SEQ ID NO: 3660239 - DNA, 19 bp, Homo sapiens
tgtggagccgaggcctacc

SEQ ID NO: 3660240 - DNA, 20 bp, Homo sapiens
tgtggagccgaggcctaccc

SEQ ID NO: 3660241 - DNA, 21 bp, Homo sapiens
tgtggagctccactgccatgt

SEQ ID NO: 3660242 - DNA, 16 bp, Homo sapiens
tgtggaggctcctgtg

SEQ ID NO: 3660243 - DNA, 18 bp, Homo sapiens
tgtggaggctcctgtggt

SEQ ID NO: 3660244 - DNA, 17 bp, Homo sapiens
tgtggatcagagatgca

SEQ ID NO: 3660245 - DNA, 14 bp, Homo sapiens
tgtggccaaggagc

SEQ ID NO: 3660246 - DNA, 15 bp, Homo sapiens
tgtggccaaggagct

SEQ ID NO: 3660247 - DNA, 11 bp, Homo sapiens
tgtggccagcc

SEQ ID NO: 3660248 - DNA, 12 bp, Homo sapiens
tgtggccagcct

SEQ ID NO: 3660249 - DNA, 13 bp, Homo sapiens
tgtggccagcctg

SEQ ID NO: 3660250 - DNA, 15 bp, Homo sapiens
tgtggccagcctggc

SEQ ID NO: 3660251 - DNA, 16 bp, Homo sapiens
tgtggccagcctggca

SEQ ID NO: 3660252 - DNA, 18 bp, Homo sapiens
tgtggccagcctggcatc

SEQ ID NO: 3660253 - DNA, 17 bp, Homo sapiens
tgtggccccaccctggg

SEQ ID NO: 3660254 - DNA, 19 bp, Homo sapiens
tgtggccccaccctgggcc

SEQ ID NO: 3660255 - DNA, 16 bp, Homo sapiens
tgtggccctggctgcc

SEQ ID NO: 3660256 - DNA, 19 bp, Homo sapiens
tgtggcgccgtctccaggg

SEQ ID NO: 3660257 - DNA, 12 bp, Homo sapiens
tgtggctctggg

SEQ ID NO: 3660258 - DNA, 18 bp, Homo sapiens
tgtggctgggggcaggag

SEQ ID NO: 3660259 - DNA, 19 bp, Homo sapiens
tgtgggatgttcagcactg

SEQ ID NO: 3660260 - DNA, 15 bp, Homo sapiens
tgtggggccaggtca

SEQ ID NO: 3660261 - DNA, 12 bp, Homo sapiens
tgtgggtggggc

SEQ ID NO: 3660262 - DNA, 20 bp, Homo sapiens
tgtggtagcttatcttagaa

SEQ ID NO: 3660263 - DNA, 20 bp, Homo sapiens
tgtggtagtcctcccaagct

SEQ ID NO: 3660264 - DNA, 23 bp, Homo sapiens
tgtggtcacagcggaggtgtgga

SEQ ID NO: 3660265 - DNA, 20 bp, Homo sapiens
tgtggttaatgccatggaca

SEQ ID NO: 3660266 - DNA, 16 bp, Homo sapiens
tgtgtaaaaaaaccac

SEQ ID NO: 3660267 - DNA, 20 bp, Homo sapiens
tgtgtcccatgatccctgtg

SEQ ID NO: 3660268 - DNA, 21 bp, Homo sapiens
tgtgtcccctcacgcaagtgc

SEQ ID NO: 3660269 - DNA, 13 bp, Homo sapiens
tgtgtctgagccc

SEQ ID NO: 3660270 - DNA, 16 bp, Homo sapiens
tgtgtgagactactaa

SEQ ID NO: 3660271 - DNA, 20 bp, Homo sapiens
tgtgtgaggagctgctggct

SEQ ID NO: 3660272 - DNA, 17 bp, Homo sapiens
ttgaagatttgaggact

SEQ ID NO: 3660273 - DNA, 17 bp, Homo sapiens
ttgaagggccagagcca

SEQ ID NO: 3660274 - DNA, 23 bp, Homo sapiens
ttgaaggtgctgacggccaggga

SEQ ID NO: 3660275 - DNA, 12 bp, Homo sapiens
ttgaataataag

SEQ ID NO: 3660276 - DNA, 13 bp, Homo sapiens
ttgaatcacagta

SEQ ID NO: 3660277 - DNA, 13 bp, Homo sapiens
ttgacacaggtct

SEQ ID NO: 3660278 - DNA, 19 bp, Homo sapiens
ttgacacaggtctttccta

SEQ ID NO: 3660279 - DNA, 17 bp, Homo sapiens
ttgacactgactagagt

SEQ ID NO: 3660280 - DNA, 14 bp, Homo sapiens
ttgacagaacactg

SEQ ID NO: 3660281 - DNA, 15 bp, Homo sapiens
ttgacagaacactgt

SEQ ID NO: 3660282 - DNA, 18 bp, Homo sapiens
ttgacagctttgctgctg

SEQ ID NO: 3660283 - DNA, 19 bp, Homo sapiens
ttgacagctttgctgctga

SEQ ID NO: 3660284 - DNA, 18 bp, Homo sapiens
ttgacatatttaatgttt

SEQ ID NO: 3660285 - DNA, 22 bp, Homo sapiens
ttgaccctcattctttagagat

SEQ ID NO: 3660286 - DNA, 19 bp, Homo sapiens
ttgacctgaggctgtggtc

SEQ ID NO: 3660287 - DNA, 15 bp, Homo sapiens
ttgactaattttaca

SEQ ID NO: 3660288 - DNA, 19 bp, Homo sapiens
ttgactagggattcaggct

SEQ ID NO: 3660289 - DNA, 21 bp, Homo sapiens
ttgactagggattcaggctgc

SEQ ID NO: 3660290 - DNA, 20 bp, Homo sapiens
ttgactgaagccgtgcctgt

SEQ ID NO: 3660291 - DNA, 16 bp, Homo sapiens
ttgagatcagcctggg

SEQ ID NO: 3660292 - DNA, 16 bp, Homo sapiens
ttgagcatcacagaat

SEQ ID NO: 3660293 - DNA, 11 bp, Homo sapiens
ttgagcctggg

SEQ ID NO: 3660294 - DNA, 19 bp, Homo sapiens
ttgagctgcctccagcctg

SEQ ID NO: 3660295 - DNA, 20 bp, Homo sapiens
ttgagctgcctccagcctgg

SEQ ID NO: 3660296 - DNA, 11 bp, Homo sapiens
ttgaggaacat

SEQ ID NO: 3660297 - DNA, 18 bp, Homo sapiens
ttgaggcaagtgtgggcc

SEQ ID NO: 3660298 - DNA, 17 bp, Homo sapiens
ttgaggggagcatgctt

SEQ ID NO: 3660299 - DNA, 15 bp, Homo sapiens
ttgatagaaatgcca

SEQ ID NO: 3660300 - DNA, 16 bp, Homo sapiens
ttgatagggaactggg

SEQ ID NO: 3660301 - DNA, 15 bp, Homo sapiens
ttgatcatgtacttt

SEQ ID NO: 3660302 - DNA, 17 bp, Homo sapiens
ttgatctggaacccaga

SEQ ID NO: 3660303 - DNA, 15 bp, Homo sapiens
ttgatgatcactgtg

SEQ ID NO: 3660304 - DNA, 22 bp, Homo sapiens
ttgatggaagtgggccagtcct

SEQ ID NO: 3660305 - DNA, 16 bp, Homo sapiens
ttgatggagtgtgagc

SEQ ID NO: 3660306 - DNA, 21 bp, Homo sapiens
ttgatggagtgtgagccacct

SEQ ID NO: 3660307 - DNA, 17 bp, Homo sapiens
ttgatgggattctggac

SEQ ID NO: 3660308 - DNA, 15 bp, Homo sapiens
ttgatgttacagatt

SEQ ID NO: 3660309 - DNA, 13 bp, Homo sapiens
ttgatgtttgtgg

SEQ ID NO: 3660310 - DNA, 18 bp, Homo sapiens
ttgatgtttgtggcctca

SEQ ID NO: 3660311 - DNA, 15 bp, Homo sapiens
ttgattcaaaatatt

SEQ ID NO: 3660312 - DNA, 23 bp, Homo sapiens
ttgattttcacagctttgaggaa

SEQ ID NO: 3660313 - DNA, 20 bp, Homo sapiens
ttgcaaaaactacaaccaat

SEQ ID NO: 3660314 - DNA, 12 bp, Homo sapiens
ttgcaaggaagc

SEQ ID NO: 3660315 - DNA, 13 bp, Homo sapiens
ttgcaaggaagcc

SEQ ID NO: 3660316 - DNA, 16 bp, Homo sapiens
ttgcacacactttcat

SEQ ID NO: 3660317 - DNA, 15 bp, Homo sapiens
ttgcacatcttggct

SEQ ID NO: 3660318 - DNA, 18 bp, Homo sapiens
ttgcaccactgcactcca

SEQ ID NO: 3660319 - DNA, 15 bp, Homo sapiens
ttgcacgtggcctct

SEQ ID NO: 3660320 - DNA, 11 bp, Homo sapiens
ttgcagacagg

SEQ ID NO: 3660321 - DNA, 15 bp, Homo sapiens
ttgcagcccttgtga

SEQ ID NO: 3660322 - DNA, 21 bp, Homo sapiens
ttgcagcccttgtgatgtgat

SEQ ID NO: 3660323 - DNA, 18 bp, Homo sapiens
ttgcagccggcacagggt

SEQ ID NO: 3660324 - DNA, 14 bp, Homo sapiens
ttgcagtcatagaa

SEQ ID NO: 3660325 - DNA, 13 bp, Homo sapiens
ttgcatttcttgt

SEQ ID NO: 3660326 - DNA, 16 bp, Homo sapiens
ttgccaaaataccaga

SEQ ID NO: 3660327 - DNA, 19 bp, Homo sapiens
ttgccaaaattcatttcta

SEQ ID NO: 3660328 - DNA, 14 bp, Homo sapiens
ttgccaccaggaga

SEQ ID NO: 3660329 - DNA, 13 bp, Homo sapiens
ttgcccaggagca

SEQ ID NO: 3660330 - DNA, 15 bp, Homo sapiens
ttgccgtctaggatt

SEQ ID NO: 3660331 - DNA, 22 bp, Homo sapiens
ttgccgtctaggattgggcctc

SEQ ID NO: 3660332 - DNA, 12 bp, Homo sapiens
ttgcctctactt

SEQ ID NO: 3660333 - DNA, 13 bp, Homo sapiens
ttgcctctgtgct

SEQ ID NO: 3660334 - DNA, 14 bp, Homo sapiens
ttgcctctgtgctg

SEQ ID NO: 3660335 - DNA, 13 bp, Homo sapiens
ttgcctgcagggc

SEQ ID NO: 3660336 - DNA, 16 bp, Homo sapiens
ttgcctttgaatgtta

SEQ ID NO: 3660337 - DNA, 17 bp, Homo sapiens
ttgcctttgaatgttaa

SEQ ID NO: 3660338 - DNA, 15 bp, Homo sapiens
ttgccttttaatttt

SEQ ID NO: 3660339 - DNA, 18 bp, Homo sapiens
ttgctaatgctatgcaaa

SEQ ID NO: 3660340 - DNA, 16 bp, Homo sapiens
ttgctatttttgtaaa

SEQ ID NO: 3660341 - DNA, 21 bp, Homo sapiens
ttgctcgcgcggccgtggcct

SEQ ID NO: 3660342 - DNA, 19 bp, Homo sapiens
ttgctgaatacagaggcaa

SEQ ID NO: 3660343 - DNA, 17 bp, Homo sapiens
ttgctgagtgaaggaaa

SEQ ID NO: 3660344 - DNA, 13 bp, Homo sapiens
ttgctgctgaagg

SEQ ID NO: 3660345 - DNA, 15 bp, Homo sapiens
ttgctgctgcctctt

SEQ ID NO: 3660346 - DNA, 18 bp, Homo sapiens
ttgctgcttttccttggg

SEQ ID NO: 3660347 - DNA, 11 bp, Homo sapiens
ttgctggaaga

SEQ ID NO: 3660348 - DNA, 21 bp, Homo sapiens
ttgctggagaatgcttggact

SEQ ID NO: 3660349 - DNA, 18 bp, Homo sapiens
ttgctgtgaggctgtcct

SEQ ID NO: 3660350 - DNA, 19 bp, Homo sapiens
ttgctgtgaggctgtcctg

SEQ ID NO: 3660351 - DNA, 13 bp, Homo sapiens
ttgctgtggagct

SEQ ID NO: 3660352 - DNA, 21 bp, Homo sapiens
ttgctgtggagctccactgcc

SEQ ID NO: 3660353 - DNA, 19 bp, Homo sapiens
ttgctgtgtgtcccaggca

SEQ ID NO: 3660354 - DNA, 21 bp, Homo sapiens
ttgctgttattatatttgaca

SEQ ID NO: 3660355 - DNA, 23 bp, Homo sapiens
ttgctgttattatatttgacatg

SEQ ID NO: 3660356 - DNA, 14 bp, Homo sapiens
ttgctgttttcctc

SEQ ID NO: 3660357 - DNA, 14 bp, Homo sapiens
ttgcttcaaactga

SEQ ID NO: 3660358 - DNA, 15 bp, Homo sapiens
ttgctttctgctcag

SEQ ID NO: 3660359 - DNA, 14 bp, Homo sapiens
ttgctttgccaaaa

SEQ ID NO: 3660360 - DNA, 12 bp, Homo sapiens
ttggaaaataaa

SEQ ID NO: 3660361 - DNA, 22 bp, Homo sapiens
ttggaaacattttttaaaacaa

SEQ ID NO: 3660362 - DNA, 20 bp, Homo sapiens
ttggacttcaaagcaagctg

SEQ ID NO: 3660363 - DNA, 21 bp, Homo sapiens
ttggagacttaacagcatttg

SEQ ID NO: 3660364 - DNA, 11 bp, Homo sapiens
ttggaggacag

SEQ ID NO: 3660365 - DNA, 16 bp, Homo sapiens
ttggagtgttatgtat

SEQ ID NO: 3660366 - DNA, 17 bp, Homo sapiens
ttggcaaaaaggcagga

SEQ ID NO: 3660367 - DNA, 16 bp, Homo sapiens
ttggcaatttcctggc

SEQ ID NO: 3660368 - DNA, 20 bp, Homo sapiens
ttggcaatttcctggccctc

SEQ ID NO: 3660369 - DNA, 21 bp, Homo sapiens
ttggcacctaatccaggcaga

SEQ ID NO: 3660370 - DNA, 20 bp, Homo sapiens
ttggccaccaggtgcctttc

SEQ ID NO: 3660371 - DNA, 22 bp, Homo sapiens
ttggccggctctggtggccact

SEQ ID NO: 3660372 - DNA, 15 bp, Homo sapiens
ttggcctttcctgga

SEQ ID NO: 3660373 - DNA, 18 bp, Homo sapiens
ttggcctttcctggaagc

SEQ ID NO: 3660374 - DNA, 21 bp, Homo sapiens
ttggctcgaatctctgtgcct

SEQ ID NO: 3660375 - DNA, 19 bp, Homo sapiens
ttggctgaaattctcctgg

SEQ ID NO: 3660376 - DNA, 16 bp, Homo sapiens
ttgggaaacttggctc

SEQ ID NO: 3660377 - DNA, 21 bp, Homo sapiens
ttgggcagagctggctctgag

SEQ ID NO: 3660378 - DNA, 13 bp, Homo sapiens
ttgggccagacat

SEQ ID NO: 3660379 - DNA, 21 bp, Homo sapiens
ttggggagttaagacctggca

SEQ ID NO: 3660380 - DNA, 15 bp, Homo sapiens
ttggggcccagtgca

SEQ ID NO: 3660381 - DNA, 13 bp, Homo sapiens
ttggggccctgcc

SEQ ID NO: 3660382 - DNA, 20 bp, Homo sapiens
ttgggggggtggccgctgag

SEQ ID NO: 3660383 - DNA, 21 bp, Homo sapiens
ttggggtagctagaggaacca

SEQ ID NO: 3660384 - DNA, 14 bp, Homo sapiens
ttggtacaaaaata

SEQ ID NO: 3660385 - DNA, 17 bp, Homo sapiens
ttggtcagagccactct

SEQ ID NO: 3660386 - DNA, 14 bp, Homo sapiens
ttggtgagaacctg

SEQ ID NO: 3660387 - DNA, 20 bp, Homo sapiens
ttggtgggggagcctctgga

SEQ ID NO: 3660388 - DNA, 21 bp, Homo sapiens
ttggtgtggcccatggctgtt

SEQ ID NO: 3660389 - DNA, 13 bp, Homo sapiens
tctgcctggagtg

SEQ ID NO: 3660390 - DNA, 10 bp, Homo sapiens
tctgctccac

SEQ ID NO: 3660391 - DNA, 12 bp, Homo sapiens
tctgctccaccc

SEQ ID NO: 3660392 - DNA, 18 bp, Homo sapiens
tctgctccacccttggcc

SEQ ID NO: 3660393 - DNA, 20 bp, Homo sapiens
tctgctctttctctgccagt

SEQ ID NO: 3660394 - DNA, 14 bp, Homo sapiens
tctgcttctctgac

SEQ ID NO: 3660395 - DNA, 16 bp, Homo sapiens
tctgcttctctgactt

SEQ ID NO: 3660396 - DNA, 14 bp, Homo sapiens
tctggaacccagac

SEQ ID NO: 3660397 - DNA, 15 bp, Homo sapiens
tctggaacccagact

SEQ ID NO: 3660398 - DNA, 16 bp, Homo sapiens
tctggaacccagactc

SEQ ID NO: 3660399 - DNA, 22 bp, Homo sapiens
tctggaacccagactcagacat

SEQ ID NO: 3660400 - DNA, 23 bp, Homo sapiens
tctggaacccagactcagacatt

SEQ ID NO: 3660401 - DNA, 18 bp, Homo sapiens
tctggaagtttctggtgc

SEQ ID NO: 3660402 - DNA, 19 bp, Homo sapiens
tctggacagccccaccctg

SEQ ID NO: 3660403 - DNA, 17 bp, Homo sapiens
tctggactatattggga

SEQ ID NO: 3660404 - DNA, 14 bp, Homo sapiens
tctggactggctag

SEQ ID NO: 3660405 - DNA, 14 bp, Homo sapiens
tctggaggggaggg

SEQ ID NO: 3660406 - DNA, 21 bp, Homo sapiens
tctggaggggagggggatccg

SEQ ID NO: 3660407 - DNA, 15 bp, Homo sapiens
tctggcttagtgcca

SEQ ID NO: 3660408 - DNA, 17 bp, Homo sapiens
tctggcttagtgccacc

SEQ ID NO: 3660409 - DNA, 22 bp, Homo sapiens
tctggcttagtgccacccacct

SEQ ID NO: 3660410 - DNA, 18 bp, Homo sapiens
tctggcttctggccagga

SEQ ID NO: 3660411 - DNA, 21 bp, Homo sapiens
tctggggggacccagtgcaga

SEQ ID NO: 3660412 - DNA, 15 bp, Homo sapiens
tctggggtaggctgc

SEQ ID NO: 3660413 - DNA, 22 bp, Homo sapiens
tctggggtaggctgctccctga

SEQ ID NO: 3660414 - DNA, 17 bp, Homo sapiens
tctgggtaagaagaaag

SEQ ID NO: 3660415 - DNA, 13 bp, Homo sapiens
tctggtcctaccc

SEQ ID NO: 3660416 - DNA, 16 bp, Homo sapiens
tctggtgctactccat

SEQ ID NO: 3660417 - DNA, 14 bp, Homo sapiens
tctggtggccactg

SEQ ID NO: 3660418 - DNA, 18 bp, Homo sapiens
tctggtggccactgagct

SEQ ID NO: 3660419 - DNA, 22 bp, Homo sapiens
tctggtggccactgagctggct

SEQ ID NO: 3660420 - DNA, 12 bp, Homo sapiens
tctggtggcccc

SEQ ID NO: 3660421 - DNA, 21 bp, Homo sapiens
tctggttccagggtccctctg

SEQ ID NO: 3660422 - DNA, 20 bp, Homo sapiens
tctgtaagaaacctactgcc

SEQ ID NO: 3660423 - DNA, 14 bp, Homo sapiens
tctgtacttttcat

SEQ ID NO: 3660424 - DNA, 15 bp, Homo sapiens
tctgtagtaatttat

SEQ ID NO: 3660425 - DNA, 16 bp, Homo sapiens
tctgtagtaatttatt

SEQ ID NO: 3660426 - DNA, 22 bp, Homo sapiens
tctgtagtaatttattgtctgt

SEQ ID NO: 3660427 - DNA, 13 bp, Homo sapiens
tctgtatggtcag

SEQ ID NO: 3660428 - DNA, 17 bp, Homo sapiens
tctgtcaagagtagtta

SEQ ID NO: 3660429 - DNA, 20 bp, Homo sapiens
tctgtcaagagtagttatat

SEQ ID NO: 3660430 - DNA, 22 bp, Homo sapiens
tctgtcaagagtagttatataa

SEQ ID NO: 3660431 - DNA, 16 bp, Homo sapiens
tctgtcaatcacagtc

SEQ ID NO: 3660432 - DNA, 21 bp, Homo sapiens
tctgtccaagtacttaactat

SEQ ID NO: 3660433 - DNA, 14 bp, Homo sapiens
tctgtcccaagtct

SEQ ID NO: 3660434 - DNA, 13 bp, Homo sapiens
tctgtcctgtgac

SEQ ID NO: 3660435 - DNA, 15 bp, Homo sapiens
tctgtgacccatctg

SEQ ID NO: 3660436 - DNA, 14 bp, Homo sapiens
tctgtgccccatgc

SEQ ID NO: 3660437 - DNA, 15 bp, Homo sapiens
tctgtgccccatgcc

SEQ ID NO: 3660438 - DNA, 16 bp, Homo sapiens
tctgtgccttcgtctt

SEQ ID NO: 3660439 - DNA, 17 bp, Homo sapiens
tctgtggccagcctggc

SEQ ID NO: 3660440 - DNA, 18 bp, Homo sapiens
tctgtggccagcctggca

SEQ ID NO: 3660441 - DNA, 15 bp, Homo sapiens
tctgtggccagctgc

SEQ ID NO: 3660442 - DNA, 23 bp, Homo sapiens
tctgtgggccctaccctcctgct

SEQ ID NO: 3660443 - DNA, 23 bp, Homo sapiens
tctgttcccttcctctgtgccac

SEQ ID NO: 3660444 - DNA, 15 bp, Homo sapiens
tctgttctaacatgt

SEQ ID NO: 3660445 - DNA, 15 bp, Homo sapiens
tctgttctatgcttc

SEQ ID NO: 3660446 - DNA, 13 bp, Homo sapiens
tctgtttgttatt

SEQ ID NO: 3660447 - DNA, 17 bp, Homo sapiens
tcttaaacaaatgtatg

SEQ ID NO: 3660448 - DNA, 18 bp, Homo sapiens
tcttactgttttgaggaa

SEQ ID NO: 3660449 - DNA, 13 bp, Homo sapiens
tcttagagaataa

SEQ ID NO: 3660450 - DNA, 22 bp, Homo sapiens
tcttagagaataagaataataa

SEQ ID NO: 3660451 - DNA, 22 bp, Homo sapiens
tcttagatacactaaaaatctg

SEQ ID NO: 3660452 - DNA, 21 bp, Homo sapiens
tcttatactgtacaataaaaa

SEQ ID NO: 3660453 - DNA, 17 bp, Homo sapiens
tcttattgcgctgctac

SEQ ID NO: 3660454 - DNA, 14 bp, Homo sapiens
tcttcacggcagga

SEQ ID NO: 3660455 - DNA, 23 bp, Homo sapiens
tcttcagagtttgtcatatactg

SEQ ID NO: 3660456 - DNA, 14 bp, Homo sapiens
tcttccaaaggcag

SEQ ID NO: 3660457 - DNA, 19 bp, Homo sapiens
tcttccaaaggcagcgtgc

SEQ ID NO: 3660458 - DNA, 12 bp, Homo sapiens
tcttccctggga

SEQ ID NO: 3660459 - DNA, 21 bp, Homo sapiens
tcttcctgcaaccactctgtg

SEQ ID NO: 3660460 - DNA, 22 bp, Homo sapiens
tcttcctgcaaccactctgtgg

SEQ ID NO: 3660461 - DNA, 23 bp, Homo sapiens
tcttcctgcaaccactctgtggc

SEQ ID NO: 3660462 - DNA, 21 bp, Homo sapiens
tcttccttgaagaactgcagg

SEQ ID NO: 3660463 - DNA, 18 bp, Homo sapiens
tcttccttgatgtttggg

SEQ ID NO: 3660464 - DNA, 19 bp, Homo sapiens
tcttctgccggccctgggg

SEQ ID NO: 3660465 - DNA, 11 bp, Homo sapiens
tcttctgctcc

SEQ ID NO: 3660466 - DNA, 13 bp, Homo sapiens
tcttctgctccac

SEQ ID NO: 3660467 - DNA, 19 bp, Homo sapiens
tcttctgctccacccttgg

SEQ ID NO: 3660468 - DNA, 16 bp, Homo sapiens
tcttctgtcccaagtc

SEQ ID NO: 3660469 - DNA, 20 bp, Homo sapiens
tcttcttggggcccagtgca

SEQ ID NO: 3660470 - DNA, 21 bp, Homo sapiens
tcttcttggggcccagtgcat

SEQ ID NO: 3660471 - DNA, 21 bp, Homo sapiens
tcttgaccaagcaggaagctc

SEQ ID NO: 3660472 - DNA, 22 bp, Homo sapiens
tcttgagcagtggctggtccag

SEQ ID NO: 3660473 - DNA, 13 bp, Homo sapiens
tcttgagcctggg

SEQ ID NO: 3660474 - DNA, 13 bp, Homo sapiens
tcttgagtttgtc

SEQ ID NO: 3660475 - DNA, 23 bp, Homo sapiens
tcttgcacacactttcatgcagt

SEQ ID NO: 3660476 - DNA, 15 bp, Homo sapiens
tcttgcctccaggtg

SEQ ID NO: 3660477 - DNA, 17 bp, Homo sapiens
tcttgcctccaggtgca

SEQ ID NO: 3660478 - DNA, 14 bp, Homo sapiens
tcttgcctctgtgc

SEQ ID NO: 3660479 - DNA, 19 bp, Homo sapiens
tcttgcctctgtgctgtgt

SEQ ID NO: 3660480 - DNA, 13 bp, Homo sapiens
tcttgctctgtct

SEQ ID NO: 3660481 - DNA, 18 bp, Homo sapiens
tcttgcttccctaatcta

SEQ ID NO: 3660482 - DNA, 16 bp, Homo sapiens
tcttggaagtctgtct

SEQ ID NO: 3660483 - DNA, 20 bp, Homo sapiens
tcttgggcagagctggctct

SEQ ID NO: 3660484 - DNA, 13 bp, Homo sapiens
tcttggggcccag

SEQ ID NO: 3660485 - DNA, 18 bp, Homo sapiens
tcttggggcccagtgcat

SEQ ID NO: 3660486 - DNA, 19 bp, Homo sapiens
tcttgggggggtggccgct

SEQ ID NO: 3660487 - DNA, 18 bp, Homo sapiens
tcttgtgttctgtagact

SEQ ID NO: 3660488 - DNA, 14 bp, Homo sapiens
tctttaaaagagag

SEQ ID NO: 3660489 - DNA, 15 bp, Homo sapiens
tctttaaaagagaga

SEQ ID NO: 3660490 - DNA, 17 bp, Homo sapiens
tctttaaaagagagaga

SEQ ID NO: 3660491 - DNA, 17 bp, Homo sapiens
tctttaaccttgtataa

SEQ ID NO: 3660492 - DNA, 19 bp, Homo sapiens
tctttaatttgttgtagat

SEQ ID NO: 3660493 - DNA, 12 bp, Homo sapiens
tctttagagatt

SEQ ID NO: 3660494 - DNA, 16 bp, Homo sapiens
tctttattttgtgtaa

SEQ ID NO: 3660495 - DNA, 18 bp, Homo sapiens
tctttattttgtgtaaaa

SEQ ID NO: 3660496 - DNA, 16 bp, Homo sapiens
tctttcagtacttttt

SEQ ID NO: 3660497 - DNA, 23 bp, Homo sapiens
tctttcctaaggctgcaaggttt

SEQ ID NO: 3660498 - DNA, 16 bp, Homo sapiens
tctttctctgccagtg

SEQ ID NO: 3660499 - DNA, 13 bp, Homo sapiens
tctttgactgaaa

SEQ ID NO: 3660500 - DNA, 12 bp, Homo sapiens
tctttgcaaagt

SEQ ID NO: 3660501 - DNA, 21 bp, Homo sapiens
tctttgccagtcattcagcag

SEQ ID NO: 3660502 - DNA, 11 bp, Homo sapiens
tctttgctttg

SEQ ID NO: 3660503 - DNA, 13 bp, Homo sapiens
tctttgctttgct

SEQ ID NO: 3660504 - DNA, 23 bp, Homo sapiens
tctttgctttgctttctgctcag

SEQ ID NO: 3660505 - DNA, 16 bp, Homo sapiens
tctttgggccagacat

SEQ ID NO: 3660506 - DNA, 15 bp, Homo sapiens
tgctccgccaggaag

SEQ ID NO: 3660507 - DNA, 22 bp, Homo sapiens
tgctcctgaatgaggcggagct

SEQ ID NO: 3660508 - DNA, 19 bp, Homo sapiens
tgctccttccaacaggagc

SEQ ID NO: 3660509 - DNA, 23 bp, Homo sapiens
tgctcgcgaaggtcccacagccc

SEQ ID NO: 3660510 - DNA, 14 bp, Homo sapiens
tgctctagtgcctt

SEQ ID NO: 3660511 - DNA, 20 bp, Homo sapiens
tgctcttgaccttgtagaga

SEQ ID NO: 3660512 - DNA, 18 bp, Homo sapiens
tgctctttctctgccagt

SEQ ID NO: 3660513 - DNA, 21 bp, Homo sapiens
tgctctttctctgccagtgac

SEQ ID NO: 3660514 - DNA, 14 bp, Homo sapiens
tgctgaacagtgga

SEQ ID NO: 3660515 - DNA, 18 bp, Homo sapiens
tgctgacagctgctccta

SEQ ID NO: 3660516 - DNA, 14 bp, Homo sapiens
tgctgacggccagg

SEQ ID NO: 3660517 - DNA, 17 bp, Homo sapiens
tgctgactgttttctct

SEQ ID NO: 3660518 - DNA, 18 bp, Homo sapiens
tgctgagatacatacaga

SEQ ID NO: 3660519 - DNA, 12 bp, Homo sapiens
tgctgagctgcc

SEQ ID NO: 3660520 - DNA, 13 bp, Homo sapiens
tgctgagctgccc

SEQ ID NO: 3660521 - DNA, 19 bp, Homo sapiens
tgctgagctgcccctgctg

SEQ ID NO: 3660522 - DNA, 16 bp, Homo sapiens
tgctgagtgaaggaaa

SEQ ID NO: 3660523 - DNA, 14 bp, Homo sapiens
tgctgatgtcaaag

SEQ ID NO: 3660524 - DNA, 15 bp, Homo sapiens
tgctgatgtcaaagt

SEQ ID NO: 3660525 - DNA, 16 bp, Homo sapiens
tgctgcgccccaggcc

SEQ ID NO: 3660526 - DNA, 12 bp, Homo sapiens
tgctgctggtgc

SEQ ID NO: 3660527 - DNA, 13 bp, Homo sapiens
tgctgctttaaca

SEQ ID NO: 3660528 - DNA, 18 bp, Homo sapiens
tgctggaaaataatactg

SEQ ID NO: 3660529 - DNA, 17 bp, Homo sapiens
tgctggaacctgcaaaa

SEQ ID NO: 3660530 - DNA, 13 bp, Homo sapiens
tgctggaagacag

SEQ ID NO: 3660531 - DNA, 16 bp, Homo sapiens
tgctggcccagggccc

SEQ ID NO: 3660532 - DNA, 21 bp, Homo sapiens
tgctggcccagggcccagagc

SEQ ID NO: 3660533 - DNA, 16 bp, Homo sapiens
tgctgggaagcccgga

SEQ ID NO: 3660534 - DNA, 21 bp, Homo sapiens
tgctgggagctccactctgct

SEQ ID NO: 3660535 - DNA, 16 bp, Homo sapiens
tgctgggattacagac

SEQ ID NO: 3660536 - DNA, 15 bp, Homo sapiens
tgctgtcatggtcct

SEQ ID NO: 3660537 - DNA, 13 bp, Homo sapiens
tgctgttgaagat

SEQ ID NO: 3660538 - DNA, 18 bp, Homo sapiens
tgctgttgacatatttaa

SEQ ID NO: 3660539 - DNA, 21 bp, Homo sapiens
tgctgttgacatatttaatgt

SEQ ID NO: 3660540 - DNA, 18 bp, Homo sapiens
tgctgtttcacaatacct

SEQ ID NO: 3660541 - DNA, 16 bp, Homo sapiens
tgctgttttcctccct

SEQ ID NO: 3660542 - DNA, 22 bp, Homo sapiens
tgctgttttcctcccttctgct

SEQ ID NO: 3660543 - DNA, 15 bp, Homo sapiens
tgcttaagtgcatgc

SEQ ID NO: 3660544 - DNA, 15 bp, Homo sapiens
tgcttaataaaagaa

SEQ ID NO: 3660545 - DNA, 14 bp, Homo sapiens
tgcttatggtacca

SEQ ID NO: 3660546 - DNA, 21 bp, Homo sapiens
tgcttcaaactgagacagatg

SEQ ID NO: 3660547 - DNA, 12 bp, Homo sapiens
tgcttctcactg

SEQ ID NO: 3660548 - DNA, 14 bp, Homo sapiens
tgcttctctgactt

SEQ ID NO: 3660549 - DNA, 21 bp, Homo sapiens
tgcttctctgacttctgcctg

SEQ ID NO: 3660550 - DNA, 21 bp, Homo sapiens
tgcttgaggcaactcatctta

SEQ ID NO: 3660551 - DNA, 20 bp, Homo sapiens
tgcttgatgggattctggac

SEQ ID NO: 3660552 - DNA, 22 bp, Homo sapiens
tgcttgatgggattctggacag

SEQ ID NO: 3660553 - DNA, 17 bp, Homo sapiens
tgcttggagctgagcaa

SEQ ID NO: 3660554 - DNA, 21 bp, Homo sapiens
tgcttgtcatctgcatgtcta

SEQ ID NO: 3660555 - DNA, 14 bp, Homo sapiens
tgctttctgatcaa

SEQ ID NO: 3660556 - DNA, 19 bp, Homo sapiens
tgctttctgctcagcttct

SEQ ID NO: 3660557 - DNA, 15 bp, Homo sapiens
tgctttgcccctgag

SEQ ID NO: 3660558 - DNA, 14 bp, Homo sapiens
tgctttgctttctg

SEQ ID NO: 3660559 - DNA, 19 bp, Homo sapiens
tgctttgctttctgctcag

SEQ ID NO: 3660560 - DNA, 16 bp, Homo sapiens
tgctttgtgacttctt

SEQ ID NO: 3660561 - DNA, 24 bp, Homo sapiens
tgcttttagtattttagtgaactt

SEQ ID NO: 3660562 - DNA, 20 bp, Homo sapiens
tggaaaaatagcctgcctct

SEQ ID NO: 3660563 - DNA, 21 bp, Homo sapiens
tggaaaactaagaaaattgct

SEQ ID NO: 3660564 - DNA, 18 bp, Homo sapiens
tggaaagataactaggaa

SEQ ID NO: 3660565 - DNA, 23 bp, Homo sapiens
tggaaagataactaggaaatcca

SEQ ID NO: 3660566 - DNA, 21 bp, Homo sapiens
tggaaagatagagattgtttt

SEQ ID NO: 3660567 - DNA, 22 bp, Homo sapiens
tggaacactagacaagccagaa

SEQ ID NO: 3660568 - DNA, 18 bp, Homo sapiens
tggaacactatagagaac

SEQ ID NO: 3660569 - DNA, 15 bp, Homo sapiens
tggaacccagactca

SEQ ID NO: 3660570 - DNA, 22 bp, Homo sapiens
tggaacccagactcagacattg

SEQ ID NO: 3660571 - DNA, 17 bp, Homo sapiens
tggaaccgcaggaagct

SEQ ID NO: 3660572 - DNA, 16 bp, Homo sapiens
tggaacctgcaaaaaa

SEQ ID NO: 3660573 - DNA, 14 bp, Homo sapiens
tggaacctggaccc

SEQ ID NO: 3660574 - DNA, 23 bp, Homo sapiens
tggaacctggaccccagccttgg

SEQ ID NO: 3660575 - DNA, 21 bp, Homo sapiens
tggaagatcctgcgggtgggg

SEQ ID NO: 3660576 - DNA, 20 bp, Homo sapiens
tggaagtgggccagtcctgg

SEQ ID NO: 3660577 - DNA, 21 bp, Homo sapiens
tggaagtgtgtgatctgtggg

SEQ ID NO: 3660578 - DNA, 21 bp, Homo sapiens
tggaatcagattttaacagct

SEQ ID NO: 3660579 - DNA, 22 bp, Homo sapiens
tggaatcaggaatattttccaa

SEQ ID NO: 3660580 - DNA, 16 bp, Homo sapiens
tggacagaggcggggc

SEQ ID NO: 3660581 - DNA, 14 bp, Homo sapiens
tggacagccccacc

SEQ ID NO: 3660582 - DNA, 14 bp, Homo sapiens
tggacatcctcctc

SEQ ID NO: 3660583 - DNA, 18 bp, Homo sapiens
tggacctaaatggcctca

SEQ ID NO: 3660584 - DNA, 24 bp, Homo sapiens
tggacggggcgggccctgcctgag

SEQ ID NO: 3660585 - DNA, 17 bp, Homo sapiens
tggactatattgggact

SEQ ID NO: 3660586 - DNA, 22 bp, Homo sapiens
tggactatctgtctggtggccc

SEQ ID NO: 3660587 - DNA, 13 bp, Homo sapiens
tggactggctaga

SEQ ID NO: 3660588 - DNA, 22 bp, Homo sapiens
tggactggctagagtcctcact

SEQ ID NO: 3660589 - DNA, 18 bp, Homo sapiens
tggacttcaaagcaagct

SEQ ID NO: 3660590 - DNA, 14 bp, Homo sapiens
tggactttcctgca

SEQ ID NO: 3660591 - DNA, 19 bp, Homo sapiens
tggactttcctgcaactca

SEQ ID NO: 3660592 - DNA, 23 bp, Homo sapiens
tggagaaatggtccgctttcctg

SEQ ID NO: 3660593 - DNA, 17 bp, Homo sapiens
tggagaactcctagggt

SEQ ID NO: 3660594 - DNA, 16 bp, Homo sapiens
tggagacttagggcac

SEQ ID NO: 3660595 - DNA, 17 bp, Homo sapiens
tggagagcactgccagg

SEQ ID NO: 3660596 - DNA, 16 bp, Homo sapiens
tggagaggccctctgg

SEQ ID NO: 3660597 - DNA, 14 bp, Homo sapiens
tggagatcctcctg

SEQ ID NO: 3660598 - DNA, 18 bp, Homo sapiens
tggagatcctcctgcaga

SEQ ID NO: 3660599 - DNA, 20 bp, Homo sapiens
tggagatcctcctgcagacc

SEQ ID NO: 3660600 - DNA, 20 bp, Homo sapiens
tggagcccagggagcggaaa

SEQ ID NO: 3660601 - DNA, 17 bp, Homo sapiens
tggagctccactgccat

SEQ ID NO: 3660602 - DNA, 14 bp, Homo sapiens
tggagctttctgta

SEQ ID NO: 3660603 - DNA, 15 bp, Homo sapiens
tggagctttctgtat

SEQ ID NO: 3660604 - DNA, 13 bp, Homo sapiens
tggaggacagtgg

SEQ ID NO: 3660605 - DNA, 21 bp, Homo sapiens
tggaggatcccctccaagcct

SEQ ID NO: 3660606 - DNA, 15 bp, Homo sapiens
tggaggccagccagt

SEQ ID NO: 3660607 - DNA, 12 bp, Homo sapiens
tggaggctcctg

SEQ ID NO: 3660608 - DNA, 15 bp, Homo sapiens
tggaggctcctgtgg

SEQ ID NO: 3660609 - DNA, 13 bp, Homo sapiens
tggagggaggccc

SEQ ID NO: 3660610 - DNA, 19 bp, Homo sapiens
tggagggaggccccagggg

SEQ ID NO: 3660611 - DNA, 20 bp, Homo sapiens
tggaggtcggtaggttcagc

SEQ ID NO: 3660612 - DNA, 16 bp, Homo sapiens
tggagtacccagccta

SEQ ID NO: 3660613 - DNA, 19 bp, Homo sapiens
tggagtcatcttgcacaca

SEQ ID NO: 3660614 - DNA, 14 bp, Homo sapiens
tggagtgtatgact

SEQ ID NO: 3660615 - DNA, 18 bp, Homo sapiens
tggatacatacaccagca

SEQ ID NO: 3660616 - DNA, 21 bp, Homo sapiens
tggatgaggcttcttcctgga

SEQ ID NO: 3660617 - DNA, 12 bp, Homo sapiens
tggatgccttga

SEQ ID NO: 3660618 - DNA, 21 bp, Homo sapiens
tggatggcagtgtggggaggg

SEQ ID NO: 3660619 - DNA, 16 bp, Homo sapiens
tggatgggacattttt

SEQ ID NO: 3660620 - DNA, 12 bp, Homo sapiens
tggatggggcag

SEQ ID NO: 3660621 - DNA, 18 bp, Homo sapiens
tggatgggggaactcaga

SEQ ID NO: 3660622 - DNA, 17 bp, Homo sapiens
tgtgcactaaggggccc

SEQ ID NO: 3660623 - DNA, 17 bp, Homo sapiens
tgtgcagggagggcagt

SEQ ID NO: 3660624 - DNA, 19 bp, Homo sapiens
tgtgcatagagccacgtat

SEQ ID NO: 3660625 - DNA, 17 bp, Homo sapiens
tgtgccaccatgcctca

SEQ ID NO: 3660626 - DNA, 15 bp, Homo sapiens
tgtgccatttctcag

SEQ ID NO: 3660627 - DNA, 20 bp, Homo sapiens
tgtgccatttctcagggaag

SEQ ID NO: 3660628 - DNA, 23 bp, Homo sapiens
tgtgccccttgacaactggcagg

SEQ ID NO: 3660629 - DNA, 12 bp, Homo sapiens
tgtgcctggggt

SEQ ID NO: 3660630 - DNA, 13 bp, Homo sapiens
tgtgcctttcact

SEQ ID NO: 3660631 - DNA, 20 bp, Homo sapiens
tgtgctagaaattttcaaga

SEQ ID NO: 3660632 - DNA, 21 bp, Homo sapiens
tgtgctgggagctccactctg

SEQ ID NO: 3660633 - DNA, 19 bp, Homo sapiens
tgtgctgtgctatggtgct

SEQ ID NO: 3660634 - DNA, 12 bp, Homo sapiens
tgtgctgtgtgt

SEQ ID NO: 3660635 - DNA, 19 bp, Homo sapiens
tgtgcttatggtaccagat

SEQ ID NO: 3660636 - DNA, 20 bp, Homo sapiens
tgtggaagacacttgctgag

SEQ ID NO: 3660637 - DNA, 20 bp, Homo sapiens
tgtggacaatgagtggaata

SEQ ID NO: 3660638 - DNA, 22 bp, Homo sapiens
tgtggcaaagccttcattgcct

SEQ ID NO: 3660639 - DNA, 21 bp, Homo sapiens
tgtggcatctttgccttgggc

SEQ ID NO: 3660640 - DNA, 14 bp, Homo sapiens
tgtggccagcctgg

SEQ ID NO: 3660641 - DNA, 17 bp, Homo sapiens
tgtggccagcctggcat

SEQ ID NO: 3660642 - DNA, 10 bp, Homo sapiens
tgtggcctca

SEQ ID NO: 3660643 - DNA, 13 bp, Homo sapiens
tgtggcctcagaa

SEQ ID NO: 3660644 - DNA, 18 bp, Homo sapiens
tgtggcgccgtctccagg

SEQ ID NO: 3660645 - DNA, 14 bp, Homo sapiens
tgtggctccaggcc

SEQ ID NO: 3660646 - DNA, 15 bp, Homo sapiens
tgtggctgggggcag

SEQ ID NO: 3660647 - DNA, 14 bp, Homo sapiens
tgtgggatctgagg

SEQ ID NO: 3660648 - DNA, 23 bp, Homo sapiens
tgtgggccctaccctcctgctga

SEQ ID NO: 3660649 - DNA, 19 bp, Homo sapiens
tgtggggagggcaggtcca

SEQ ID NO: 3660650 - DNA, 23 bp, Homo sapiens
tgtgggtggggcttctctgggac

SEQ ID NO: 3660651 - DNA, 14 bp, Homo sapiens
tgtggttaatgcca

SEQ ID NO: 3660652 - DNA, 15 bp, Homo sapiens
tgtggttaatgccat

SEQ ID NO: 3660653 - DNA, 12 bp, Homo sapiens
tgtggtttcatt

SEQ ID NO: 3660654 - DNA, 13 bp, Homo sapiens
tgtgtatatggta

SEQ ID NO: 3660655 - DNA, 15 bp, Homo sapiens
tgtgtatgttgactt

SEQ ID NO: 3660656 - DNA, 13 bp, Homo sapiens
tgtgtcccaggca

SEQ ID NO: 3660657 - DNA, 14 bp, Homo sapiens
tgtgtcccaggcag

SEQ ID NO: 3660658 - DNA, 19 bp, Homo sapiens
tgtgtcccatgatccctgt

SEQ ID NO: 3660659 - DNA, 17 bp, Homo sapiens
tgtgtccctcttctctt

SEQ ID NO: 3660660 - DNA, 16 bp, Homo sapiens
tgtgtctcccaggtgc

SEQ ID NO: 3660661 - DNA, 21 bp, Homo sapiens
tgtgtctgagcccaacccttc

SEQ ID NO: 3660662 - DNA, 14 bp, Homo sapiens
tgtgtgacaattct

SEQ ID NO: 3660663 - DNA, 20 bp, Homo sapiens
tgtgtgacaattctgttttt

SEQ ID NO: 3660664 - DNA, 17 bp, Homo sapiens
tgtgtgaggagctgctg

SEQ ID NO: 3660665 - DNA, 13 bp, Homo sapiens
tgtgtgatcagga

SEQ ID NO: 3660666 - DNA, 18 bp, Homo sapiens
tgtgtgattgacagcttt

SEQ ID NO: 3660667 - DNA, 22 bp, Homo sapiens
tgtgtgcaacagggtatggact

SEQ ID NO: 3660668 - DNA, 19 bp, Homo sapiens
tgtgtgtcccaggcaggga

SEQ ID NO: 3660669 - DNA, 15 bp, Homo sapiens
tgtgtgtgtgcacat

SEQ ID NO: 3660670 - DNA, 14 bp, Homo sapiens
tgtgtgtgtgtgca

SEQ ID NO: 3660671 - DNA, 14 bp, Homo sapiens
tgtgtgttcctgct

SEQ ID NO: 3660672 - DNA, 17 bp, Homo sapiens
tgtgtgttcctgctttt

SEQ ID NO: 3660673 - DNA, 14 bp, Homo sapiens
tgtgttctgtagac

SEQ ID NO: 3660674 - DNA, 17 bp, Homo sapiens
tgtgttggtgtggccca

SEQ ID NO: 3660675 - DNA, 13 bp, Homo sapiens
tgtgttgtctcta

SEQ ID NO: 3660676 - DNA, 19 bp, Homo sapiens
tgtgttgtctcttgagttt

SEQ ID NO: 3660677 - DNA, 16 bp, Homo sapiens
tgttaaagagcactgg

SEQ ID NO: 3660678 - DNA, 18 bp, Homo sapiens
tgttaagcagctaaattt

SEQ ID NO: 3660679 - DNA, 13 bp, Homo sapiens
tgttaagtgtaaa

SEQ ID NO: 3660680 - DNA, 15 bp, Homo sapiens
tgttaatttatttag

SEQ ID NO: 3660681 - DNA, 22 bp, Homo sapiens
tgttacacaatggtttttaaat

SEQ ID NO: 3660682 - DNA, 15 bp, Homo sapiens
tgttagactcatggt

SEQ ID NO: 3660683 - DNA, 14 bp, Homo sapiens
tgttagtggcaccg

SEQ ID NO: 3660684 - DNA, 13 bp, Homo sapiens
tgttatgtatttc

SEQ ID NO: 3660685 - DNA, 14 bp, Homo sapiens
tgttcacaacctgg

SEQ ID NO: 3660686 - DNA, 20 bp, Homo sapiens
tgttcactgctccttgctgc

SEQ ID NO: 3660687 - DNA, 15 bp, Homo sapiens
tgttcagcactgtcc

SEQ ID NO: 3660688 - DNA, 18 bp, Homo sapiens
tgttcagcactgtccctt

SEQ ID NO: 3660689 - DNA, 14 bp, Homo sapiens
tgttccagctcttt

SEQ ID NO: 3660690 - DNA, 15 bp, Homo sapiens
tgttctctcttctcc

SEQ ID NO: 3660691 - DNA, 16 bp, Homo sapiens
tgttctctcttctcca

SEQ ID NO: 3660692 - DNA, 16 bp, Homo sapiens
tgttctgtagactgcc

SEQ ID NO: 3660693 - DNA, 20 bp, Homo sapiens
tgttgaacaggtgtttttcc

SEQ ID NO: 3660694 - DNA, 20 bp, Homo sapiens
tgttgaagatttgaggactt

SEQ ID NO: 3660695 - DNA, 18 bp, Homo sapiens
tgttgacatatttaatgt

SEQ ID NO: 3660696 - DNA, 19 bp, Homo sapiens
tgttgacatatttaatgtt

SEQ ID NO: 3660697 - DNA, 20 bp, Homo sapiens
tgttgacatatttaatgttt

SEQ ID NO: 3660698 - DNA, 14 bp, Homo sapiens
tgttgacatgtgct

SEQ ID NO: 3660699 - DNA, 16 bp, Homo sapiens
tgttgagcatcacaga

SEQ ID NO: 3660700 - DNA, 20 bp, Homo sapiens
tgttgagcatcacagaatgt

SEQ ID NO: 3660701 - DNA, 20 bp, Homo sapiens
tgttgatcatgtacttttta

SEQ ID NO: 3660702 - DNA, 19 bp, Homo sapiens
tgttgccaaatatgtcctg

SEQ ID NO: 3660703 - DNA, 20 bp, Homo sapiens
tgttgccaaatatgtcctgg

SEQ ID NO: 3660704 - DNA, 20 bp, Homo sapiens
tgttgccaagctccaagccc

SEQ ID NO: 3660705 - DNA, 18 bp, Homo sapiens
tgttggcacatgcctgta

SEQ ID NO: 3660706 - DNA, 19 bp, Homo sapiens
tgttggttgttttttcctt

SEQ ID NO: 3660707 - DNA, 20 bp, Homo sapiens
tgttggttgttttttccttt

SEQ ID NO: 3660708 - DNA, 12 bp, Homo sapiens
tgttgtcccttc

SEQ ID NO: 3660709 - DNA, 15 bp, Homo sapiens
tgttgtgtgtgcagg

SEQ ID NO: 3660710 - DNA, 15 bp, Homo sapiens
tgtttaaaacatcat

SEQ ID NO: 3660711 - DNA, 23 bp, Homo sapiens
tgtttaaacacttatcttctgga

SEQ ID NO: 3660712 - DNA, 24 bp, Homo sapiens
tgtttaaacacttatcttctggat

SEQ ID NO: 3660713 - DNA, 22 bp, Homo sapiens
tgtttacatttgatgcatgtct

SEQ ID NO: 3660714 - DNA, 19 bp, Homo sapiens
tgtttataaatcttatgct

SEQ ID NO: 3660715 - DNA, 15 bp, Homo sapiens
tgtttatggcctcag

SEQ ID NO: 3660716 - DNA, 23 bp, Homo sapiens
tgtttatggcctcagctgcctca

SEQ ID NO: 3660717 - DNA, 20 bp, Homo sapiens
tgtttattgttgctggttat

SEQ ID NO: 3660718 - DNA, 20 bp, Homo sapiens
tgtttattttctacgtttct

SEQ ID NO: 3660719 - DNA, 16 bp, Homo sapiens
tgtttcaaaataaaaa

SEQ ID NO: 3660720 - DNA, 21 bp, Homo sapiens
tgtttccagcagaagacaaaa

SEQ ID NO: 3660721 - DNA, 13 bp, Homo sapiens
tgtttccatggtt

SEQ ID NO: 3660722 - DNA, 21 bp, Homo sapiens
tgtttcctgacattgtctcct

SEQ ID NO: 3660723 - DNA, 14 bp, Homo sapiens
tgtttcgtgaactg

SEQ ID NO: 3660724 - DNA, 22 bp, Homo sapiens
tgtttctctgttgtaagaatag

SEQ ID NO: 3660725 - DNA, 14 bp, Homo sapiens
tgtttggaaacatt

SEQ ID NO: 3660726 - DNA, 16 bp, Homo sapiens
tgtttgtaaatgcctc

SEQ ID NO: 3660727 - DNA, 17 bp, Homo sapiens
tgtttgtaaatgcctct

SEQ ID NO: 3660728 - DNA, 14 bp, Homo sapiens
tgtttgtatgaaat

SEQ ID NO: 3660729 - DNA, 14 bp, Homo sapiens
tgtttgtggcctca

SEQ ID NO: 3660730 - DNA, 15 bp, Homo sapiens
tgttttatgagaaag

SEQ ID NO: 3660731 - DNA, 19 bp, Homo sapiens
tgttttatgagaaagcctt

SEQ ID NO: 3660732 - DNA, 14 bp, Homo sapiens
tgttttcctccctt

SEQ ID NO: 3660733 - DNA, 22 bp, Homo sapiens
tgttttgaggaattcagaagtg

SEQ ID NO: 3660734 - DNA, 12 bp, Homo sapiens
tgtttttaactc

SEQ ID NO: 3660735 - DNA, 14 bp, Homo sapiens
tgtttttgttgtgt

SEQ ID NO: 3660736 - DNA, 15 bp, Homo sapiens
tgtttttgttgtgtg

SEQ ID NO: 3660737 - DNA, 14 bp, Homo sapiens
tgttttttcaaaat

SEQ ID NO: 3660738 - DNA, 23 bp, Homo sapiens
tgttttttcaaaatagaaaagtt

SEQ ID NO: 3660739 - DNA, 16 bp, Homo sapiens
ttcagatgtgaaccat

SEQ ID NO: 3660740 - DNA, 13 bp, Homo sapiens
ttcagcactgtcc

SEQ ID NO: 3660741 - DNA, 16 bp, Homo sapiens
ttcagcactgtccctt

SEQ ID NO: 3660742 - DNA, 19 bp, Homo sapiens
ttcagcagcaaattttcag

SEQ ID NO: 3660743 - DNA, 15 bp, Homo sapiens
ttcaggaacccttct

SEQ ID NO: 3660744 - DNA, 13 bp, Homo sapiens
ttcaggctgcttg

SEQ ID NO: 3660745 - DNA, 20 bp, Homo sapiens
ttcaggggactcagccctga

SEQ ID NO: 3660746 - DNA, 23 bp, Homo sapiens
ttcaggggactcagccctgaggt

SEQ ID NO: 3660747 - DNA, 20 bp, Homo sapiens
ttcagtaataaactgtgttt

SEQ ID NO: 3660748 - DNA, 19 bp, Homo sapiens
ttcagtacttttttaaata

SEQ ID NO: 3660749 - DNA, 23 bp, Homo sapiens
ttcatactccttttaagcagtga

SEQ ID NO: 3660750 - DNA, 18 bp, Homo sapiens
ttcatatttatactttgc

SEQ ID NO: 3660751 - DNA, 21 bp, Homo sapiens
ttcatcaagtagcgttggaga

SEQ ID NO: 3660752 - DNA, 23 bp, Homo sapiens
ttcatctgttctatgcttcctcg

SEQ ID NO: 3660753 - DNA, 16 bp, Homo sapiens
ttcatgcccttctgat

SEQ ID NO: 3660754 - DNA, 23 bp, Homo sapiens
ttcatgcccttctgattcccctc

SEQ ID NO: 3660755 - DNA, 16 bp, Homo sapiens
ttcatgtctgctatca

SEQ ID NO: 3660756 - DNA, 22 bp, Homo sapiens
ttcattagccatgcaacatgga

SEQ ID NO: 3660757 - DNA, 23 bp, Homo sapiens
ttcattcgtcttgttgttattga

SEQ ID NO: 3660758 - DNA, 15 bp, Homo sapiens
ttcatttctaattaa

SEQ ID NO: 3660759 - DNA, 16 bp, Homo sapiens
ttcattttcagagtga

SEQ ID NO: 3660760 - DNA, 14 bp, Homo sapiens
ttccaaaggcagcg

SEQ ID NO: 3660761 - DNA, 17 bp, Homo sapiens
ttccaacttggctgcag

SEQ ID NO: 3660762 - DNA, 11 bp, Homo sapiens
ttccacaaaat

SEQ ID NO: 3660763 - DNA, 20 bp, Homo sapiens
ttccagcatttagctggcca

SEQ ID NO: 3660764 - DNA, 20 bp, Homo sapiens
ttccagcccctctggtcgct

SEQ ID NO: 3660765 - DNA, 13 bp, Homo sapiens
ttccagcttagaa

SEQ ID NO: 3660766 - DNA, 19 bp, Homo sapiens
ttccagggtccctctgtgt

SEQ ID NO: 3660767 - DNA, 14 bp, Homo sapiens
ttccatatgctcca

SEQ ID NO: 3660768 - DNA, 17 bp, Homo sapiens
ttccatatgctccagga

SEQ ID NO: 3660769 - DNA, 21 bp, Homo sapiens
ttccatccctaccccctaaga

SEQ ID NO: 3660770 - DNA, 18 bp, Homo sapiens
ttccatcctttacgtgtt

SEQ ID NO: 3660771 - DNA, 19 bp, Homo sapiens
ttccatggcaggaaggctt

SEQ ID NO: 3660772 - DNA, 11 bp, Homo sapiens
ttcccaggacc

SEQ ID NO: 3660773 - DNA, 12 bp, Homo sapiens
ttcccaggaccc

SEQ ID NO: 3660774 - DNA, 13 bp, Homo sapiens
ttcccaggaccct

SEQ ID NO: 3660775 - DNA, 11 bp, Homo sapiens
ttccccagaga

SEQ ID NO: 3660776 - DNA, 19 bp, Homo sapiens
ttccccatctcaggccaga

SEQ ID NO: 3660777 - DNA, 13 bp, Homo sapiens
ttcccctccctgg

SEQ ID NO: 3660778 - DNA, 16 bp, Homo sapiens
ttcccctccctggctc

SEQ ID NO: 3660779 - DNA, 15 bp, Homo sapiens
ttccctattagagaa

SEQ ID NO: 3660780 - DNA, 16 bp, Homo sapiens
ttccctgcagctgacc

SEQ ID NO: 3660781 - DNA, 19 bp, Homo sapiens
ttccctgcgcctgtgatgc

SEQ ID NO: 3660782 - DNA, 20 bp, Homo sapiens
ttccctggggaaaacttgca

SEQ ID NO: 3660783 - DNA, 12 bp, Homo sapiens
ttccctgggtgg

SEQ ID NO: 3660784 - DNA, 19 bp, Homo sapiens
ttcccttcctctgtgccac

SEQ ID NO: 3660785 - DNA, 14 bp, Homo sapiens
ttcccttgagccct

SEQ ID NO: 3660786 - DNA, 23 bp, Homo sapiens
ttcccttgtgtcaagacatttct

SEQ ID NO: 3660787 - DNA, 14 bp, Homo sapiens
ttccgcaccctgcc

SEQ ID NO: 3660788 - DNA, 14 bp, Homo sapiens
ttccgtgcgtggca

SEQ ID NO: 3660789 - DNA, 15 bp, Homo sapiens
ttccgttcattgctc

SEQ ID NO: 3660790 - DNA, 13 bp, Homo sapiens
ttcctaaagaaaa

SEQ ID NO: 3660791 - DNA, 14 bp, Homo sapiens
ttcctaaggctgca

SEQ ID NO: 3660792 - DNA, 22 bp, Homo sapiens
ttcctacaagagcagcctgtgg

SEQ ID NO: 3660793 - DNA, 16 bp, Homo sapiens
ttcctatgctttgaaa

SEQ ID NO: 3660794 - DNA, 15 bp, Homo sapiens
ttcctcccttctgct

SEQ ID NO: 3660795 - DNA, 12 bp, Homo sapiens
ttcctctgtgcc

SEQ ID NO: 3660796 - DNA, 13 bp, Homo sapiens
ttcctctttgctt

SEQ ID NO: 3660797 - DNA, 15 bp, Homo sapiens
ttcctctttgctttg

SEQ ID NO: 3660798 - DNA, 16 bp, Homo sapiens
ttcctctttgctttgc

SEQ ID NO: 3660799 - DNA, 15 bp, Homo sapiens
ttcctgaagaaccag

SEQ ID NO: 3660800 - DNA, 19 bp, Homo sapiens
ttcctgaagaaccagtccc

SEQ ID NO: 3660801 - DNA, 20 bp, Homo sapiens
ttcctgcaactcaaggactt

SEQ ID NO: 3660802 - DNA, 17 bp, Homo sapiens
ttcctgccaggcatggt

SEQ ID NO: 3660803 - DNA, 18 bp, Homo sapiens
ttcctgccccaggcctga

SEQ ID NO: 3660804 - DNA, 11 bp, Homo sapiens
ttcctgctttt

SEQ ID NO: 3660805 - DNA, 13 bp, Homo sapiens
ttcctgcttttct

SEQ ID NO: 3660806 - DNA, 9 bp, Homo sapiens
ttcctggaa

SEQ ID NO: 3660807 - DNA, 11 bp, Homo sapiens
ttcctggaacc

SEQ ID NO: 3660808 - DNA, 18 bp, Homo sapiens
ttcctggaacctggaccc

SEQ ID NO: 3660809 - DNA, 17 bp, Homo sapiens
ttcctgtccagctccaa

SEQ ID NO: 3660810 - DNA, 14 bp, Homo sapiens
ttcctgtgggtggg

SEQ ID NO: 3660811 - DNA, 14 bp, Homo sapiens
ttcctgttcagtaa

SEQ ID NO: 3660812 - DNA, 19 bp, Homo sapiens
ttcctgttcagtaataaaa

SEQ ID NO: 3660813 - DNA, 21 bp, Homo sapiens
ttccttgagttgattcagctc

SEQ ID NO: 3660814 - DNA, 15 bp, Homo sapiens
ttcctttgctctttc

SEQ ID NO: 3660815 - DNA, 13 bp, Homo sapiens
ttccttttcttta

SEQ ID NO: 3660816 - DNA, 23 bp, Homo sapiens
ttccttttgaacgccccccccca

SEQ ID NO: 3660817 - DNA, 21 bp, Homo sapiens
ttcgatgggcccaattcttac

SEQ ID NO: 3660818 - DNA, 11 bp, Homo sapiens
ttcgcagaggc

SEQ ID NO: 3660819 - DNA, 15 bp, Homo sapiens
ttcgcagaggcaagc

SEQ ID NO: 3660820 - DNA, 13 bp, Homo sapiens
ttcgtggggaggt

SEQ ID NO: 3660821 - DNA, 16 bp, Homo sapiens
ttctaaacggtgacct

SEQ ID NO: 3660822 - DNA, 20 bp, Homo sapiens
ttctaaaggtgttgtccctt

SEQ ID NO: 3660823 - DNA, 15 bp, Homo sapiens
ttctagaatttatca

SEQ ID NO: 3660824 - DNA, 17 bp, Homo sapiens
ttctataaatagatgct

SEQ ID NO: 3660825 - DNA, 15 bp, Homo sapiens
ttctcagggaagtaa

SEQ ID NO: 3660826 - DNA, 22 bp, Homo sapiens
ttctcatagataagatataaat

SEQ ID NO: 3660827 - DNA, 20 bp, Homo sapiens
ttctccaaactgaagcagcc

SEQ ID NO: 3660828 - DNA, 21 bp, Homo sapiens
ttctccaagcggatgctccat

SEQ ID NO: 3660829 - DNA, 12 bp, Homo sapiens
ttctccctgggg

SEQ ID NO: 3660830 - DNA, 23 bp, Homo sapiens
ttctccctggggacggggctccc

SEQ ID NO: 3660831 - DNA, 18 bp, Homo sapiens
ttctccgttagctcctgt

SEQ ID NO: 3660832 - DNA, 22 bp, Homo sapiens
ttctccgttagctcctgtggcc

SEQ ID NO: 3660833 - DNA, 14 bp, Homo sapiens
ttctcctgaccagg

SEQ ID NO: 3660834 - DNA, 13 bp, Homo sapiens
ttctcctgcgggg

SEQ ID NO: 3660835 - DNA, 13 bp, Homo sapiens
ttctccttggagg

SEQ ID NO: 3660836 - DNA, 11 bp, Homo sapiens
ttctctgactt

SEQ ID NO: 3660837 - DNA, 12 bp, Homo sapiens
ttctctgacttc

SEQ ID NO: 3660838 - DNA, 17 bp, Homo sapiens
ttctctgacttctgcct

SEQ ID NO: 3660839 - DNA, 14 bp, Homo sapiens
ttctcttgggtggg

SEQ ID NO: 3660840 - DNA, 12 bp, Homo sapiens
ttctgaaagtgt

SEQ ID NO: 3660841 - DNA, 14 bp, Homo sapiens
ttctgaactgttac

SEQ ID NO: 3660842 - DNA, 15 bp, Homo sapiens
ttctgaactgttaca

SEQ ID NO: 3660843 - DNA, 22 bp, Homo sapiens
ttctgaactgttacaacttgta

SEQ ID NO: 3660844 - DNA, 18 bp, Homo sapiens
ttctgactcggtttctcc

SEQ ID NO: 3660845 - DNA, 20 bp, Homo sapiens
ttctgcagatcttccgtggt

SEQ ID NO: 3660846 - DNA, 15 bp, Homo sapiens
ttctgccagggagct

SEQ ID NO: 3660847 - DNA, 21 bp, Homo sapiens
ttctgccatctagccagcccc

SEQ ID NO: 3660848 - DNA, 14 bp, Homo sapiens
ttctgcctggagac

SEQ ID NO: 3660849 - DNA, 10 bp, Homo sapiens
ttctgccttt

SEQ ID NO: 3660850 - DNA, 15 bp, Homo sapiens
ttctgcctttgatgt

SEQ ID NO: 3660851 - DNA, 18 bp, Homo sapiens
ttctgctccacccttggc

SEQ ID NO: 3660852 - DNA, 17 bp, Homo sapiens
ttctggaaaatgcttct

SEQ ID NO: 3660853 - DNA, 19 bp, Homo sapiens
ttctggattagaatgccgg

SEQ ID NO: 3660854 - DNA, 15 bp, Homo sapiens
ttctggccaggaagc

SEQ ID NO: 3660855 - DNA, 22 bp, Homo sapiens
ttctggggggacccagtgcaga

SEQ ID NO: 3660856 - DNA, 23 bp, Homo sapiens
ttctggggggacccagtgcagaa

SEQ ID NO: 3660857 - DNA, 18 bp, Homo sapiens
tttttataaaatggctgt

SEQ ID NO: 3660858 - DNA, 20 bp, Homo sapiens
tttttgcacatgtttcctct

SEQ ID NO: 3660859 - DNA, 18 bp, Homo sapiens
tttttggacttcaaagca

SEQ ID NO: 3660860 - DNA, 14 bp, Homo sapiens
tttttggagtgtta

SEQ ID NO: 3660861 - DNA, 12 bp, Homo sapiens
tttttggtacaa

SEQ ID NO: 3660862 - DNA, 20 bp, Homo sapiens
tttttgtagtgacctgttta

SEQ ID NO: 3660863 - DNA, 13 bp, Homo sapiens
ttttttgtaccaa

SEQ ID NO: 3660864 - DNA, 22 bp, Homo sapiens
gcacttcgggaggtcgaggcag

SEQ ID NO: 3660865 - DNA, 16 bp, Homo sapiens
gcagaagacaaaaaga

SEQ ID NO: 3660866 - DNA, 18 bp, Homo sapiens
gcagaatgtaagtgggcc

SEQ ID NO: 3660867 - DNA, 15 bp, Homo sapiens
gcagacaccttggac

SEQ ID NO: 3660868 - DNA, 19 bp, Homo sapiens
gcagacatgtgcacttgaa

SEQ ID NO: 3660869 - DNA, 20 bp, Homo sapiens
gcagaccacgcccgtcctgc

SEQ ID NO: 3660870 - DNA, 23 bp, Homo sapiens
gcagaccacgcccgtcctgcctg

SEQ ID NO: 3660871 - DNA, 20 bp, Homo sapiens
gcagactctttatgcttgca

SEQ ID NO: 3660872 - DNA, 15 bp, Homo sapiens
gcagagctggctctg

SEQ ID NO: 3660873 - DNA, 23 bp, Homo sapiens
gcagagctggctctgagcgcctc

SEQ ID NO: 3660874 - DNA, 23 bp, Homo sapiens
gcagagcttctcctgaccagggc

SEQ ID NO: 3660875 - DNA, 19 bp, Homo sapiens
gcagaggacagtctggaga

SEQ ID NO: 3660876 - DNA, 12 bp, Homo sapiens
gcagaggccaga

SEQ ID NO: 3660877 - DNA, 19 bp, Homo sapiens
gcagagggcatcggggcca

SEQ ID NO: 3660878 - DNA, 15 bp, Homo sapiens
gcagaggtaccctgg

SEQ ID NO: 3660879 - DNA, 22 bp, Homo sapiens
gcagatcttccgtggtcagagt

SEQ ID NO: 3660880 - DNA, 15 bp, Homo sapiens
gcagatgcaaagagg

SEQ ID NO: 3660881 - DNA, 17 bp, Homo sapiens
gcagatgcaaagaggca

SEQ ID NO: 3660882 - DNA, 18 bp, Homo sapiens
gcagatgtccttgatgct

SEQ ID NO: 3660883 - DNA, 16 bp, Homo sapiens
gcagcaccgaggggcc

SEQ ID NO: 3660884 - DNA, 22 bp, Homo sapiens
gcagcagaggacagtctggaga

SEQ ID NO: 3660885 - DNA, 18 bp, Homo sapiens
gcagcagggagggcttct

SEQ ID NO: 3660886 - DNA, 15 bp, Homo sapiens
gcagcagggatgccc

SEQ ID NO: 3660887 - DNA, 13 bp, Homo sapiens
gcagccaagctcc

SEQ ID NO: 3660888 - DNA, 17 bp, Homo sapiens
gcagccaggctgccaag

SEQ ID NO: 3660889 - DNA, 18 bp, Homo sapiens
gcagcccacccctcaaca

SEQ ID NO: 3660890 - DNA, 20 bp, Homo sapiens
gcagcccaccctgctgctgg

SEQ ID NO: 3660891 - DNA, 20 bp, Homo sapiens
gcagcccatgcccacctgcc

SEQ ID NO: 3660892 - DNA, 19 bp, Homo sapiens
gcagccggcacagggtctg

SEQ ID NO: 3660893 - DNA, 16 bp, Homo sapiens
gcagcctctccccagg

SEQ ID NO: 3660894 - DNA, 20 bp, Homo sapiens
gcagcctctccccaggtcca

SEQ ID NO: 3660895 - DNA, 22 bp, Homo sapiens
gcagcctgtggcatctttgcct

SEQ ID NO: 3660896 - DNA, 18 bp, Homo sapiens
gcagcgtgccgagccagc

SEQ ID NO: 3660897 - DNA, 14 bp, Homo sapiens
gcagctcaaaggca

SEQ ID NO: 3660898 - DNA, 15 bp, Homo sapiens
gcagctcaaaggcac

SEQ ID NO: 3660899 - DNA, 20 bp, Homo sapiens
gcagctctggacagccccac

SEQ ID NO: 3660900 - DNA, 21 bp, Homo sapiens
gcagctgcccagcccctcctc

SEQ ID NO: 3660901 - DNA, 17 bp, Homo sapiens
gcagctggcaggagtgg

SEQ ID NO: 3660902 - DNA, 19 bp, Homo sapiens
gcagctggttctgcaatga

SEQ ID NO: 3660903 - DNA, 16 bp, Homo sapiens
gcagctgtgtctgagc

SEQ ID NO: 3660904 - DNA, 18 bp, Homo sapiens
gcagctgtgtctgagccc

SEQ ID NO: 3660905 - DNA, 12 bp, Homo sapiens
gcagcttccaga

SEQ ID NO: 3660906 - DNA, 13 bp, Homo sapiens
gcaggaagctgct

SEQ ID NO: 3660907 - DNA, 20 bp, Homo sapiens
gcaggaaggctgagaggaga

SEQ ID NO: 3660908 - DNA, 16 bp, Homo sapiens
gcaggaagggaagcgt

SEQ ID NO: 3660909 - DNA, 19 bp, Homo sapiens
gcaggaatcccggctccag

SEQ ID NO: 3660910 - DNA, 16 bp, Homo sapiens
gcaggactcccaccta

SEQ ID NO: 3660911 - DNA, 13 bp, Homo sapiens
gcaggcatggccc

SEQ ID NO: 3660912 - DNA, 15 bp, Homo sapiens
gcaggccctggcctc

SEQ ID NO: 3660913 - DNA, 15 bp, Homo sapiens
gcaggcggggctcct

SEQ ID NO: 3660914 - DNA, 16 bp, Homo sapiens
gcaggcggggctcctc

SEQ ID NO: 3660915 - DNA, 19 bp, Homo sapiens
gcaggcggggctcctcctg

SEQ ID NO: 3660916 - DNA, 20 bp, Homo sapiens
gcaggcggggctcctcctga

SEQ ID NO: 3660917 - DNA, 22 bp, Homo sapiens
gcaggcggggctcctcctgaag

SEQ ID NO: 3660918 - DNA, 14 bp, Homo sapiens
gcaggctcccaggg

SEQ ID NO: 3660919 - DNA, 16 bp, Homo sapiens
gcagggagggcttctg

SEQ ID NO: 3660920 - DNA, 21 bp, Homo sapiens
gcagggatgccctggaggtgg

SEQ ID NO: 3660921 - DNA, 19 bp, Homo sapiens
gcagggattaacctctgca

SEQ ID NO: 3660922 - DNA, 18 bp, Homo sapiens
gcagggctcctccctgga

SEQ ID NO: 3660923 - DNA, 19 bp, Homo sapiens
gcagggctcctccctggag

SEQ ID NO: 3660924 - DNA, 23 bp, Homo sapiens
gcagggctcctccctggagctag

SEQ ID NO: 3660925 - DNA, 16 bp, Homo sapiens
gcaggggcctggagat

SEQ ID NO: 3660926 - DNA, 20 bp, Homo sapiens
gcaggggcctggagatcctc

SEQ ID NO: 3660927 - DNA, 19 bp, Homo sapiens
gcagggtcctagaaattcc

SEQ ID NO: 3660928 - DNA, 15 bp, Homo sapiens
gcaggtccagctctg

SEQ ID NO: 3660929 - DNA, 16 bp, Homo sapiens
gcaggtggatctcctt

SEQ ID NO: 3660930 - DNA, 19 bp, Homo sapiens
gcaggttctgcctgctttg

SEQ ID NO: 3660931 - DNA, 16 bp, Homo sapiens
gcagtactcctccctg

SEQ ID NO: 3660932 - DNA, 18 bp, Homo sapiens
gcagtactcctccctggg

SEQ ID NO: 3660933 - DNA, 23 bp, Homo sapiens
gcagtactcctccctgggggcgg

SEQ ID NO: 3660934 - DNA, 17 bp, Homo sapiens
gcagtagaactccaggc

SEQ ID NO: 3660935 - DNA, 18 bp, Homo sapiens
gcagtcacaacagagtga

SEQ ID NO: 3660936 - DNA, 22 bp, Homo sapiens
gcagtcatcttgaccaagcagg

SEQ ID NO: 3660937 - DNA, 16 bp, Homo sapiens
gcagtcgtgcctgtgt

SEQ ID NO: 3660938 - DNA, 14 bp, Homo sapiens
gcagtggaggtggg

SEQ ID NO: 3660939 - DNA, 14 bp, Homo sapiens
gcagtggctggtcc

SEQ ID NO: 3660940 - DNA, 15 bp, Homo sapiens
gcagtgtggggaggg

SEQ ID NO: 3660941 - DNA, 17 bp, Homo sapiens
gcagttcagcaccaccc

SEQ ID NO: 3660942 - DNA, 16 bp, Homo sapiens
gcataaagaagaagaa

SEQ ID NO: 3660943 - DNA, 12 bp, Homo sapiens
gcataggctcct

SEQ ID NO: 3660944 - DNA, 17 bp, Homo sapiens
gcataggctccttcctg

SEQ ID NO: 3660945 - DNA, 18 bp, Homo sapiens
gcataggctccttcctgt

SEQ ID NO: 3660946 - DNA, 19 bp, Homo sapiens
gcataggctccttcctgtg

SEQ ID NO: 3660947 - DNA, 17 bp, Homo sapiens
gcatagtttctttattt

SEQ ID NO: 3660948 - DNA, 22 bp, Homo sapiens
gcatcaaccccccgactgtgct

SEQ ID NO: 3660949 - DNA, 22 bp, Homo sapiens
gcatcaccttaggcagggaagt

SEQ ID NO: 3660950 - DNA, 12 bp, Homo sapiens
gcatcagggtta

SEQ ID NO: 3660951 - DNA, 19 bp, Homo sapiens
gcatcagtttaggccttgg

SEQ ID NO: 3660952 - DNA, 21 bp, Homo sapiens
gcatcagtttaggccttggct

SEQ ID NO: 3660953 - DNA, 15 bp, Homo sapiens
gcatcctatgcttaa

SEQ ID NO: 3660954 - DNA, 16 bp, Homo sapiens
gcatcctatgcttaat

SEQ ID NO: 3660955 - DNA, 20 bp, Homo sapiens
gcatcgcaccattctgactc

SEQ ID NO: 3660956 - DNA, 17 bp, Homo sapiens
gcatctgaccagcagcg

SEQ ID NO: 3660957 - DNA, 13 bp, Homo sapiens
gcatctgtttatt

SEQ ID NO: 3660958 - DNA, 17 bp, Homo sapiens
gcatcttgcctccaggt

SEQ ID NO: 3660959 - DNA, 22 bp, Homo sapiens
gcatcttgggggggtggccgct

SEQ ID NO: 3660960 - DNA, 13 bp, Homo sapiens
gcatctttgcctt

SEQ ID NO: 3660961 - DNA, 17 bp, Homo sapiens
gcatgagaaatacaaaa

SEQ ID NO: 3660962 - DNA, 18 bp, Homo sapiens
gcatgagactcagtgcag

SEQ ID NO: 3660963 - DNA, 21 bp, Homo sapiens
gcatgagactcagtgcagatg

SEQ ID NO: 3660964 - DNA, 23 bp, Homo sapiens
gcatgatagacacatatgagggg

SEQ ID NO: 3660965 - DNA, 16 bp, Homo sapiens
gcatgcattgagctgc

SEQ ID NO: 3660966 - DNA, 20 bp, Homo sapiens
gcatgctggagtacccagcc

SEQ ID NO: 3660967 - DNA, 18 bp, Homo sapiens
gcatgcttccctgcagct

SEQ ID NO: 3660968 - DNA, 16 bp, Homo sapiens
gcatggaaaatcagtg

SEQ ID NO: 3660969 - DNA, 13 bp, Homo sapiens
gcatggccctggg

SEQ ID NO: 3660970 - DNA, 14 bp, Homo sapiens
gcatggccctgggc

SEQ ID NO: 3660971 - DNA, 20 bp, Homo sapiens
gcatggtgccccaggaccag

SEQ ID NO: 3660972 - DNA, 13 bp, Homo sapiens
gcatggtggccag

SEQ ID NO: 3660973 - DNA, 15 bp, Homo sapiens
gcatggtggccagag

SEQ ID NO: 3660974 - DNA, 13 bp, Homo sapiens
gcattaacacaaa

SEQ ID NO: 3660975 - DNA, 12 bp, Homo sapiens
gcattccagccc

SEQ ID NO: 3660976 - DNA, 16 bp, Homo sapiens
gcattccagcccctct

SEQ ID NO: 3660977 - DNA, 19 bp, Homo sapiens
gcattccagcccctctggt

SEQ ID NO: 3660978 - DNA, 22 bp, Homo sapiens
gcattcttaacaaactcttcag

SEQ ID NO: 3660979 - DNA, 12 bp, Homo sapiens
gcattgagctgc

SEQ ID NO: 3660980 - DNA, 12 bp, Homo sapiens
gccccaccctgg

SEQ ID NO: 3660981 - DNA, 20 bp, Homo sapiens
gccccaccctgggccctggg

SEQ ID NO: 3660982 - DNA, 23 bp, Homo sapiens
gccccaccctgggccctgggctg

SEQ ID NO: 3660983 - DNA, 14 bp, Homo sapiens
gccccactggggaa

SEQ ID NO: 3660984 - DNA, 13 bp, Homo sapiens
gccccagagctgt

SEQ ID NO: 3660985 - DNA, 14 bp, Homo sapiens
gccccagagctgtt

SEQ ID NO: 3660986 - DNA, 20 bp, Homo sapiens
gccccagcacagcttgacct

SEQ ID NO: 3660987 - DNA, 12 bp, Homo sapiens
gccccaggacca

SEQ ID NO: 3660988 - DNA, 24 bp, Homo sapiens
gccccaggaccagctcaggacaga

SEQ ID NO: 3660989 - DNA, 12 bp, Homo sapiens
gccccaggcctg

SEQ ID NO: 3660990 - DNA, 16 bp, Homo sapiens
gccccagggtcttccc

SEQ ID NO: 3660991 - DNA, 17 bp, Homo sapiens
gccccagggtcttccct

SEQ ID NO: 3660992 - DNA, 20 bp, Homo sapiens
gccccagggtcttccctacc

SEQ ID NO: 3660993 - DNA, 15 bp, Homo sapiens
gccccatcagctcca

SEQ ID NO: 3660994 - DNA, 17 bp, Homo sapiens
gccccatcagctccagc

SEQ ID NO: 3660995 - DNA, 18 bp, Homo sapiens
gccccatcctccagcagg

SEQ ID NO: 3660996 - DNA, 20 bp, Homo sapiens
gccccatgcctgtccagcct

SEQ ID NO: 3660997 - DNA, 23 bp, Homo sapiens
gccccatgcctgtccagcctggg

SEQ ID NO: 3660998 - DNA, 16 bp, Homo sapiens
gcccccacttgcctct

SEQ ID NO: 3660999 - DNA, 17 bp, Homo sapiens
gcccccacttgcctctt

SEQ ID NO: 3661000 - DNA, 18 bp, Homo sapiens
gcccccagcccagggctc

SEQ ID NO: 3661001 - DNA, 13 bp, Homo sapiens
gcccccttcctgg

SEQ ID NO: 3661002 - DNA, 23 bp, Homo sapiens
gccccgtctgaccccagcccaga

SEQ ID NO: 3661003 - DNA, 12 bp, Homo sapiens
gcccctcagcct

SEQ ID NO: 3661004 - DNA, 17 bp, Homo sapiens
gcccctcagcctctgcc

SEQ ID NO: 3661005 - DNA, 19 bp, Homo sapiens
gcccctcagcctctgccac

SEQ ID NO: 3661006 - DNA, 12 bp, Homo sapiens
gcccctcccagt

SEQ ID NO: 3661007 - DNA, 12 bp, Homo sapiens
gcccctccccca

SEQ ID NO: 3661008 - DNA, 14 bp, Homo sapiens
gcccctcctccctg

SEQ ID NO: 3661009 - DNA, 12 bp, Homo sapiens
gcccctcctgac

SEQ ID NO: 3661010 - DNA, 17 bp, Homo sapiens
gcccctcctgactcatc

SEQ ID NO: 3661011 - DNA, 19 bp, Homo sapiens
gcccctcctgactcatccg

SEQ ID NO: 3661012 - DNA, 22 bp, Homo sapiens
gcccctcctgactcatccgcct

SEQ ID NO: 3661013 - DNA, 20 bp, Homo sapiens
gcccctctccaagcgcctgg

SEQ ID NO: 3661014 - DNA, 18 bp, Homo sapiens
gcccctctggtcgctcct

SEQ ID NO: 3661015 - DNA, 20 bp, Homo sapiens
gcccctcttccaaaggcagc

SEQ ID NO: 3661016 - DNA, 22 bp, Homo sapiens
gcccctgagacaaatggaggcc

SEQ ID NO: 3661017 - DNA, 19 bp, Homo sapiens
gcccctgagtcctgagcga

SEQ ID NO: 3661018 - DNA, 23 bp, Homo sapiens
gcccctgctgcttaagtgcatgc

SEQ ID NO: 3661019 - DNA, 13 bp, Homo sapiens
gcccctggcactc

SEQ ID NO: 3661020 - DNA, 17 bp, Homo sapiens
gccccttaagggaaagg

SEQ ID NO: 3661021 - DNA, 11 bp, Homo sapiens
gccccttccac

SEQ ID NO: 3661022 - DNA, 19 bp, Homo sapiens
gccccttgacaactggcag

SEQ ID NO: 3661023 - DNA, 19 bp, Homo sapiens
gcccgcatgcggcccagga

SEQ ID NO: 3661024 - DNA, 14 bp, Homo sapiens
gcccgccctgcccg

SEQ ID NO: 3661025 - DNA, 21 bp, Homo sapiens
gcccggagattggacggcctg

SEQ ID NO: 3661026 - DNA, 18 bp, Homo sapiens
gcccggccagccatgtct

SEQ ID NO: 3661027 - DNA, 17 bp, Homo sapiens
gcccggcccctcctgac

SEQ ID NO: 3661028 - DNA, 15 bp, Homo sapiens
gcccgtcctgcctgt

SEQ ID NO: 3661029 - DNA, 17 bp, Homo sapiens
gcccgtcctgcctgtgg

SEQ ID NO: 3661030 - DNA, 13 bp, Homo sapiens
gccctaccctcct

SEQ ID NO: 3661031 - DNA, 14 bp, Homo sapiens
gccctaccctcctg

SEQ ID NO: 3661032 - DNA, 20 bp, Homo sapiens
gccctaccctcctgctgagc

SEQ ID NO: 3661033 - DNA, 21 bp, Homo sapiens
gccctccctgttccccagaga

SEQ ID NO: 3661034 - DNA, 23 bp, Homo sapiens
gccctccgccattctcaagccct

SEQ ID NO: 3661035 - DNA, 12 bp, Homo sapiens
gccctcctctcc

SEQ ID NO: 3661036 - DNA, 15 bp, Homo sapiens
gccctcgggtctccc

SEQ ID NO: 3661037 - DNA, 21 bp, Homo sapiens
gccctcgggtctccccacctg

SEQ ID NO: 3661038 - DNA, 18 bp, Homo sapiens
gccctctggagtggccac

SEQ ID NO: 3661039 - DNA, 20 bp, Homo sapiens
gccctctggagtggccacta

SEQ ID NO: 3661040 - DNA, 23 bp, Homo sapiens
gccctgagatgggccggccccct

SEQ ID NO: 3661041 - DNA, 14 bp, Homo sapiens
gccctgagctttct

SEQ ID NO: 3661042 - DNA, 14 bp, Homo sapiens
gccctgcagccagc

SEQ ID NO: 3661043 - DNA, 15 bp, Homo sapiens
gccctgcagccagct

SEQ ID NO: 3661044 - DNA, 20 bp, Homo sapiens
gccctgccactcactaggcc

SEQ ID NO: 3661045 - DNA, 21 bp, Homo sapiens
gccctgccactcactaggccc

SEQ ID NO: 3661046 - DNA, 18 bp, Homo sapiens
gccctgcccgggctccca

SEQ ID NO: 3661047 - DNA, 13 bp, Homo sapiens
gccctgcctgagg

SEQ ID NO: 3661048 - DNA, 15 bp, Homo sapiens
gccctgcctgagggt

SEQ ID NO: 3661049 - DNA, 19 bp, Homo sapiens
gccctgcctgagggtgggc

SEQ ID NO: 3661050 - DNA, 20 bp, Homo sapiens
gccctggaggtggctgagcc

SEQ ID NO: 3661051 - DNA, 12 bp, Homo sapiens
gccctggcctcc

SEQ ID NO: 3661052 - DNA, 20 bp, Homo sapiens
gccctggcctcccctgccac

SEQ ID NO: 3661053 - DNA, 24 bp, Homo sapiens
gccctggcctcccctgccaccagg

SEQ ID NO: 3661054 - DNA, 16 bp, Homo sapiens
gccctggctgccggca

SEQ ID NO: 3661055 - DNA, 12 bp, Homo sapiens
gccctgggctgg

SEQ ID NO: 3661056 - DNA, 13 bp, Homo sapiens
gccctgggctgga

SEQ ID NO: 3661057 - DNA, 18 bp, Homo sapiens
gccctgggctggaatcag

SEQ ID NO: 3661058 - DNA, 13 bp, Homo sapiens
gccctgtgtgcag

SEQ ID NO: 3661059 - DNA, 15 bp, Homo sapiens
gccctgtgtgcaggt

SEQ ID NO: 3661060 - DNA, 20 bp, Homo sapiens
gccctgtgtgtgtcccctca

SEQ ID NO: 3661061 - DNA, 19 bp, Homo sapiens
gcccttctgattcccctcc

SEQ ID NO: 3661062 - DNA, 16 bp, Homo sapiens
gccgagggtcctggct

SEQ ID NO: 3661063 - DNA, 18 bp, Homo sapiens
gccgagggtcctggctcc

SEQ ID NO: 3661064 - DNA, 17 bp, Homo sapiens
gccgccattgccaccag

SEQ ID NO: 3661065 - DNA, 21 bp, Homo sapiens
gccgccattgccaccaggaga

SEQ ID NO: 3661066 - DNA, 16 bp, Homo sapiens
gccgctgagtggcagg

SEQ ID NO: 3661067 - DNA, 18 bp, Homo sapiens
gccggagaggagttcagg

SEQ ID NO: 3661068 - DNA, 21 bp, Homo sapiens
gccggagaggagttcaggaac

SEQ ID NO: 3661069 - DNA, 17 bp, Homo sapiens
gccggcccccttcctgg

SEQ ID NO: 3661070 - DNA, 13 bp, Homo sapiens
gccggccctgggg

SEQ ID NO: 3661071 - DNA, 14 bp, Homo sapiens
gccggccctggggc

SEQ ID NO: 3661072 - DNA, 13 bp, Homo sapiens
gccggccctgtgt

SEQ ID NO: 3661073 - DNA, 14 bp, Homo sapiens
gccggccctgtgtg

SEQ ID NO: 3661074 - DNA, 15 bp, Homo sapiens
gccggccctgtgtgc

SEQ ID NO: 3661075 - DNA, 18 bp, Homo sapiens
gccggccctgtgtgcagg

SEQ ID NO: 3661076 - DNA, 16 bp, Homo sapiens
gccggctctggtggcc

SEQ ID NO: 3661077 - DNA, 17 bp, Homo sapiens
gccggctctggtggcca

SEQ ID NO: 3661078 - DNA, 20 bp, Homo sapiens
gccggctctggtggccactg

SEQ ID NO: 3661079 - DNA, 17 bp, Homo sapiens
gccgtcagtgctgtgct

SEQ ID NO: 3661080 - DNA, 16 bp, Homo sapiens
gccgtctccaggggct

SEQ ID NO: 3661081 - DNA, 21 bp, Homo sapiens
gccgtggattgcacgtggcct

SEQ ID NO: 3661082 - DNA, 23 bp, Homo sapiens
gccgtggggccgccgcctctttc

SEQ ID NO: 3661083 - DNA, 20 bp, Homo sapiens
gccgtgtaaccatggaccca

SEQ ID NO: 3661084 - DNA, 15 bp, Homo sapiens
gcctaaacctcagtt

SEQ ID NO: 3661085 - DNA, 17 bp, Homo sapiens
gcctaccccgcagacac

SEQ ID NO: 3661086 - DNA, 21 bp, Homo sapiens
gcctaccccgcagacaccttg

SEQ ID NO: 3661087 - DNA, 13 bp, Homo sapiens
gcctacgccagga

SEQ ID NO: 3661088 - DNA, 15 bp, Homo sapiens
gcctacgccaggaga

SEQ ID NO: 3661089 - DNA, 16 bp, Homo sapiens
gcctaggcctcagcca

SEQ ID NO: 3661090 - DNA, 22 bp, Homo sapiens
gcctatgtgcatgcagcatcta

SEQ ID NO: 3661091 - DNA, 23 bp, Homo sapiens
gcctcagaattgatcattttccc

SEQ ID NO: 3661092 - DNA, 13 bp, Homo sapiens
gcctcagccagag

SEQ ID NO: 3661093 - DNA, 15 bp, Homo sapiens
gcctcagccagagaa

SEQ ID NO: 3661094 - DNA, 14 bp, Homo sapiens
gcctcagctgcctc

SEQ ID NO: 3661095 - DNA, 15 bp, Homo sapiens
gcctcagctgcctca

SEQ ID NO: 3661096 - DNA, 20 bp, Homo sapiens
gcctcagctgcctcacttcc

SEQ ID NO: 3661097 - DNA, 20 bp, Homo sapiens
gctctgtctcccaggctgga

SEQ ID NO: 3661098 - DNA, 19 bp, Homo sapiens
gctctgtgggccctaccct

SEQ ID NO: 3661099 - DNA, 22 bp, Homo sapiens
gctctgtgggccctaccctcct

SEQ ID NO: 3661100 - DNA, 17 bp, Homo sapiens
gctcttagcagcttcca

SEQ ID NO: 3661101 - DNA, 18 bp, Homo sapiens
gctcttagcagcttccag

SEQ ID NO: 3661102 - DNA, 19 bp, Homo sapiens
gctcttctccttggaggac

SEQ ID NO: 3661103 - DNA, 21 bp, Homo sapiens
gctctttaatttgttgtagat

SEQ ID NO: 3661104 - DNA, 16 bp, Homo sapiens
gctctttctctgccag

SEQ ID NO: 3661105 - DNA, 17 bp, Homo sapiens
gctctttctctgccagt

SEQ ID NO: 3661106 - DNA, 12 bp, Homo sapiens
gctgaaaacaat

SEQ ID NO: 3661107 - DNA, 14 bp, Homo sapiens
gctgaaattctcct

SEQ ID NO: 3661108 - DNA, 17 bp, Homo sapiens
gctgaaattctcctgga

SEQ ID NO: 3661109 - DNA, 22 bp, Homo sapiens
gctgaacagtggaggaagaggg

SEQ ID NO: 3661110 - DNA, 23 bp, Homo sapiens
gctgaagtagaggggacgtgaga

SEQ ID NO: 3661111 - DNA, 22 bp, Homo sapiens
gctgaatacagaggcaactgca

SEQ ID NO: 3661112 - DNA, 13 bp, Homo sapiens
gctgaattttctg

SEQ ID NO: 3661113 - DNA, 21 bp, Homo sapiens
gctgaattttctggaaaatgc

SEQ ID NO: 3661114 - DNA, 13 bp, Homo sapiens
gctgacagctgct

SEQ ID NO: 3661115 - DNA, 15 bp, Homo sapiens
gctgacagctgctcc

SEQ ID NO: 3661116 - DNA, 21 bp, Homo sapiens
gctgaccagccgtgagcatgt

SEQ ID NO: 3661117 - DNA, 15 bp, Homo sapiens
gctgacctccacagc

SEQ ID NO: 3661118 - DNA, 16 bp, Homo sapiens
gctgacctccacagct

SEQ ID NO: 3661119 - DNA, 17 bp, Homo sapiens
gctgacctccacagctt

SEQ ID NO: 3661120 - DNA, 13 bp, Homo sapiens
gctgacggccagg

SEQ ID NO: 3661121 - DNA, 23 bp, Homo sapiens
gctgactctaggtgcccttggag

SEQ ID NO: 3661122 - DNA, 22 bp, Homo sapiens
gctgactgccaataacattctt

SEQ ID NO: 3661123 - DNA, 14 bp, Homo sapiens
gctgagagaacctc

SEQ ID NO: 3661124 - DNA, 16 bp, Homo sapiens
gctgagaggagagaga

SEQ ID NO: 3661125 - DNA, 15 bp, Homo sapiens
gctgagcctgcaggg

SEQ ID NO: 3661126 - DNA, 16 bp, Homo sapiens
gctgagctgcccctgc

SEQ ID NO: 3661127 - DNA, 17 bp, Homo sapiens
gctgagctgcccctgct

SEQ ID NO: 3661128 - DNA, 18 bp, Homo sapiens
gctgagctgcccctgctg

SEQ ID NO: 3661129 - DNA, 22 bp, Homo sapiens
gctgagctgcccctgctgctta

SEQ ID NO: 3661130 - DNA, 12 bp, Homo sapiens
gctgaggaaagg

SEQ ID NO: 3661131 - DNA, 15 bp, Homo sapiens
gctgaggcaattcta

SEQ ID NO: 3661132 - DNA, 12 bp, Homo sapiens
gctgaggcctgg

SEQ ID NO: 3661133 - DNA, 13 bp, Homo sapiens
gctgaggcctgga

SEQ ID NO: 3661134 - DNA, 16 bp, Homo sapiens
gctgagggcagactgg

SEQ ID NO: 3661135 - DNA, 14 bp, Homo sapiens
gctgaggtgggagg

SEQ ID NO: 3661136 - DNA, 12 bp, Homo sapiens
gctgagtgaagg

SEQ ID NO: 3661137 - DNA, 17 bp, Homo sapiens
gctgagtggcaggggac

SEQ ID NO: 3661138 - DNA, 14 bp, Homo sapiens
gctgatgtcaaagt

SEQ ID NO: 3661139 - DNA, 21 bp, Homo sapiens
gctgcaaggtttaggctggtg

SEQ ID NO: 3661140 - DNA, 20 bp, Homo sapiens
gctgcactgatgctgcccct

SEQ ID NO: 3661141 - DNA, 15 bp, Homo sapiens
gctgcagaggccaga

SEQ ID NO: 3661142 - DNA, 18 bp, Homo sapiens
gctgcagaggccagaggc

SEQ ID NO: 3661143 - DNA, 22 bp, Homo sapiens
gctgcagaggccagaggccccc

SEQ ID NO: 3661144 - DNA, 17 bp, Homo sapiens
gctgcaggaatctttaa

SEQ ID NO: 3661145 - DNA, 22 bp, Homo sapiens
gctgcaggaatctttaaaagat

SEQ ID NO: 3661146 - DNA, 22 bp, Homo sapiens
gctgcatggggtggggtagggc

SEQ ID NO: 3661147 - DNA, 16 bp, Homo sapiens
gctgccaaggccagag

SEQ ID NO: 3661148 - DNA, 14 bp, Homo sapiens
gctgccacccacct

SEQ ID NO: 3661149 - DNA, 21 bp, Homo sapiens
gctgccacccacctccctgcc

SEQ ID NO: 3661150 - DNA, 23 bp, Homo sapiens
gctgccatctcacctcctgctgg

SEQ ID NO: 3661151 - DNA, 12 bp, Homo sapiens
gctgcccagagc

SEQ ID NO: 3661152 - DNA, 16 bp, Homo sapiens
gctgcccagagctgct

SEQ ID NO: 3661153 - DNA, 22 bp, Homo sapiens
gctgcccagagctgctggtctc

SEQ ID NO: 3661154 - DNA, 20 bp, Homo sapiens
gctgcccagcccctcctccc

SEQ ID NO: 3661155 - DNA, 15 bp, Homo sapiens
gctgcccctgctgct

SEQ ID NO: 3661156 - DNA, 16 bp, Homo sapiens
gctgcccctgctgctt

SEQ ID NO: 3661157 - DNA, 13 bp, Homo sapiens
gctgcctccagcc

SEQ ID NO: 3661158 - DNA, 23 bp, Homo sapiens
gctgcctccagcctggtggccca

SEQ ID NO: 3661159 - DNA, 13 bp, Homo sapiens
gctgcctctttcc

SEQ ID NO: 3661160 - DNA, 14 bp, Homo sapiens
gctgcgccccaggc

SEQ ID NO: 3661161 - DNA, 17 bp, Homo sapiens
gctgcgccccaggcccc

SEQ ID NO: 3661162 - DNA, 17 bp, Homo sapiens
gctgcgcccccttcttt

SEQ ID NO: 3661163 - DNA, 23 bp, Homo sapiens
gctgcgcccccttctttgcagct

SEQ ID NO: 3661164 - DNA, 22 bp, Homo sapiens
gctgctaccgttgacttccagg

SEQ ID NO: 3661165 - DNA, 18 bp, Homo sapiens
gctgctcctagagggagg

SEQ ID NO: 3661166 - DNA, 19 bp, Homo sapiens
gctgctcctagagggaggg

SEQ ID NO: 3661167 - DNA, 21 bp, Homo sapiens
gctgctcctagagggaggggc

SEQ ID NO: 3661168 - DNA, 13 bp, Homo sapiens
gctgctcctcatg

SEQ ID NO: 3661169 - DNA, 19 bp, Homo sapiens
gctgctgacctccacagct

SEQ ID NO: 3661170 - DNA, 13 bp, Homo sapiens
gctgctgcctctt

SEQ ID NO: 3661171 - DNA, 19 bp, Homo sapiens
gctgcttaagtgcatgcat

SEQ ID NO: 3661172 - DNA, 22 bp, Homo sapiens
gctgcttaagtgcatgcattga

SEQ ID NO: 3661173 - DNA, 13 bp, Homo sapiens
gctgcttcctcct

SEQ ID NO: 3661174 - DNA, 22 bp, Homo sapiens
gctgcttttccttggggcaggc

SEQ ID NO: 3661175 - DNA, 15 bp, Homo sapiens
gctggaagacagaga

SEQ ID NO: 3661176 - DNA, 20 bp, Homo sapiens
gctggaagacagagaaaact

SEQ ID NO: 3661177 - DNA, 17 bp, Homo sapiens
gctggaagatcctgcgg

SEQ ID NO: 3661178 - DNA, 21 bp, Homo sapiens
gctggatgctccttccaacag

SEQ ID NO: 3661179 - DNA, 18 bp, Homo sapiens
gctggcaggagtggggtg

SEQ ID NO: 3661180 - DNA, 13 bp, Homo sapiens
gctggcccagggc

SEQ ID NO: 3661181 - DNA, 17 bp, Homo sapiens
gctggcccagggcccag

SEQ ID NO: 3661182 - DNA, 18 bp, Homo sapiens
gctggcccagggcccaga

SEQ ID NO: 3661183 - DNA, 19 bp, Homo sapiens
gctggcccagggcccagag

SEQ ID NO: 3661184 - DNA, 21 bp, Homo sapiens
gctggcccagggcccagagcc

SEQ ID NO: 3661185 - DNA, 20 bp, Homo sapiens
gctggccgagggtcctggct

SEQ ID NO: 3661186 - DNA, 12 bp, Homo sapiens
gctggctctgag

SEQ ID NO: 3661187 - DNA, 13 bp, Homo sapiens
gctggctctgagc

SEQ ID NO: 3661188 - DNA, 15 bp, Homo sapiens
gctggcttgggcagc

SEQ ID NO: 3661189 - DNA, 19 bp, Homo sapiens
gctgggactcagccttcag

SEQ ID NO: 3661190 - DNA, 23 bp, Homo sapiens
gctgggactcagccttcagacag

SEQ ID NO: 3661191 - DNA, 13 bp, Homo sapiens
gctgggagctcca

SEQ ID NO: 3661192 - DNA, 14 bp, Homo sapiens
gctgggagctccac

SEQ ID NO: 3661193 - DNA, 16 bp, Homo sapiens
gctgggagctccactc

SEQ ID NO: 3661194 - DNA, 21 bp, Homo sapiens
gctgggagctccactctgctt

SEQ ID NO: 3661195 - DNA, 22 bp, Homo sapiens
gctgggagctccactctgcttc

SEQ ID NO: 3661196 - DNA, 17 bp, Homo sapiens
gctgggattacaggtgt

SEQ ID NO: 3661197 - DNA, 22 bp, Homo sapiens
gctgggcccgacatggctccgg

SEQ ID NO: 3661198 - DNA, 13 bp, Homo sapiens
gctgggctgctcc

SEQ ID NO: 3661199 - DNA, 20 bp, Homo sapiens
gctgggctgctcctgaatga

SEQ ID NO: 3661200 - DNA, 19 bp, Homo sapiens
gctgggggtgggccaggct

SEQ ID NO: 3661201 - DNA, 22 bp, Homo sapiens
gctgggtggcaccagcagcctg

SEQ ID NO: 3661202 - DNA, 20 bp, Homo sapiens
gctgggtggttctctgggcc

SEQ ID NO: 3661203 - DNA, 16 bp, Homo sapiens
gctgggttcatttgtg

SEQ ID NO: 3661204 - DNA, 15 bp, Homo sapiens
gctggtccgtgggac

SEQ ID NO: 3661205 - DNA, 16 bp, Homo sapiens
gctggttctgcaatga

SEQ ID NO: 3661206 - DNA, 15 bp, Homo sapiens
gctgtaatcatttgt

SEQ ID NO: 3661207 - DNA, 23 bp, Homo sapiens
gctgtagtaggcatttttaccat

SEQ ID NO: 3661208 - DNA, 19 bp, Homo sapiens
gctgtattagtcacagaga

SEQ ID NO: 3661209 - DNA, 13 bp, Homo sapiens
gctgtcatctcag

SEQ ID NO: 3661210 - DNA, 12 bp, Homo sapiens
gctgtgaggctg

SEQ ID NO: 3661211 - DNA, 13 bp, Homo sapiens
gctgtgaggctgt

SEQ ID NO: 3661212 - DNA, 16 bp, Homo sapiens
gctgtgaggctgtcct

SEQ ID NO: 3661213 - DNA, 14 bp, Homo sapiens
agccccccaggctg

SEQ ID NO: 3661214 - DNA, 22 bp, Homo sapiens
agccccccaggctgcccagagc

SEQ ID NO: 3661215 - DNA, 13 bp, Homo sapiens
agccccgtctgac

SEQ ID NO: 3661216 - DNA, 20 bp, Homo sapiens
agccccgtctgaccccagcc

SEQ ID NO: 3661217 - DNA, 20 bp, Homo sapiens
agcccctctggtcgctcctg

SEQ ID NO: 3661218 - DNA, 17 bp, Homo sapiens
agcccctcttccccaat

SEQ ID NO: 3661219 - DNA, 20 bp, Homo sapiens
agcccctgtctagagaggga

SEQ ID NO: 3661220 - DNA, 22 bp, Homo sapiens
agcccctgtctagagagggagg

SEQ ID NO: 3661221 - DNA, 15 bp, Homo sapiens
agcccggactgacca

SEQ ID NO: 3661222 - DNA, 24 bp, Homo sapiens
agccctccgccattctcaagccct

SEQ ID NO: 3661223 - DNA, 21 bp, Homo sapiens
agccctgaggtgaaagggagc

SEQ ID NO: 3661224 - DNA, 17 bp, Homo sapiens
agccctgttgacacagg

SEQ ID NO: 3661225 - DNA, 23 bp, Homo sapiens
agccctgttgacacaggtctttc

SEQ ID NO: 3661226 - DNA, 19 bp, Homo sapiens
agccgagattgcaccactg

SEQ ID NO: 3661227 - DNA, 19 bp, Homo sapiens
agccgccattgccaccagg

SEQ ID NO: 3661228 - DNA, 22 bp, Homo sapiens
agccgccattgccaccaggaga

SEQ ID NO: 3661229 - DNA, 15 bp, Homo sapiens
agccggcacagggtc

SEQ ID NO: 3661230 - DNA, 22 bp, Homo sapiens
agccggggactcccaggctgga

SEQ ID NO: 3661231 - DNA, 22 bp, Homo sapiens
agccgggggctggccttctcct

SEQ ID NO: 3661232 - DNA, 16 bp, Homo sapiens
agccgtgcctgtagcc

SEQ ID NO: 3661233 - DNA, 22 bp, Homo sapiens
agcctcccacgactgcccggca

SEQ ID NO: 3661234 - DNA, 16 bp, Homo sapiens
agcctctccccaggtc

SEQ ID NO: 3661235 - DNA, 12 bp, Homo sapiens
agcctctgccac

SEQ ID NO: 3661236 - DNA, 14 bp, Homo sapiens
agcctctggaatgc

SEQ ID NO: 3661237 - DNA, 16 bp, Homo sapiens
agcctcttctgtccca

SEQ ID NO: 3661238 - DNA, 16 bp, Homo sapiens
agcctctttttgatac

SEQ ID NO: 3661239 - DNA, 15 bp, Homo sapiens
agcctgaggtcccct

SEQ ID NO: 3661240 - DNA, 17 bp, Homo sapiens
agcctgaggtcccctcg

SEQ ID NO: 3661241 - DNA, 23 bp, Homo sapiens
agcctgcagggaagccccacatg

SEQ ID NO: 3661242 - DNA, 16 bp, Homo sapiens
agcctgctccagctgt

SEQ ID NO: 3661243 - DNA, 14 bp, Homo sapiens
agcctggaccctgt

SEQ ID NO: 3661244 - DNA, 13 bp, Homo sapiens
agcctggcatcag

SEQ ID NO: 3661245 - DNA, 15 bp, Homo sapiens
agcctggcatcagtt

SEQ ID NO: 3661246 - DNA, 20 bp, Homo sapiens
agcctggccaacatggcgaa

SEQ ID NO: 3661247 - DNA, 22 bp, Homo sapiens
agcctggccagacacaggccct

SEQ ID NO: 3661248 - DNA, 15 bp, Homo sapiens
agcctgggcagccag

SEQ ID NO: 3661249 - DNA, 19 bp, Homo sapiens
agcctgggcagccaggctg

SEQ ID NO: 3661250 - DNA, 20 bp, Homo sapiens
agcctgggcagccaggctgc

SEQ ID NO: 3661251 - DNA, 19 bp, Homo sapiens
agcctggggtggggtcatg

SEQ ID NO: 3661252 - DNA, 20 bp, Homo sapiens
agcctggggtggggtcatgc

SEQ ID NO: 3661253 - DNA, 14 bp, Homo sapiens
agcctgggtgacaa

SEQ ID NO: 3661254 - DNA, 22 bp, Homo sapiens
agcctgggtgacagagcaagtg

SEQ ID NO: 3661255 - DNA, 16 bp, Homo sapiens
agcctggtggcccagc

SEQ ID NO: 3661256 - DNA, 17 bp, Homo sapiens
agcctggtggcccagct

SEQ ID NO: 3661257 - DNA, 16 bp, Homo sapiens
agcctgtgcaaaaaaa

SEQ ID NO: 3661258 - DNA, 21 bp, Homo sapiens
agcctgtgcaaaaaaattaaa

SEQ ID NO: 3661259 - DNA, 16 bp, Homo sapiens
agcctgtgtctttaaa

SEQ ID NO: 3661260 - DNA, 20 bp, Homo sapiens
agcctgttacaggaatgaag

SEQ ID NO: 3661261 - DNA, 18 bp, Homo sapiens
agccttcaagtgccaaac

SEQ ID NO: 3661262 - DNA, 14 bp, Homo sapiens
agccttgccagaga

SEQ ID NO: 3661263 - DNA, 19 bp, Homo sapiens
agccttgcggaaggttcta

SEQ ID NO: 3661264 - DNA, 19 bp, Homo sapiens
agccttggtgggggagcct

SEQ ID NO: 3661265 - DNA, 16 bp, Homo sapiens
agcgaccgaggccctc

SEQ ID NO: 3661266 - DNA, 16 bp, Homo sapiens
agcgactccgttggcc

SEQ ID NO: 3661267 - DNA, 20 bp, Homo sapiens
agcgactccgttggccactc

SEQ ID NO: 3661268 - DNA, 19 bp, Homo sapiens
agcgatctctccactgtgc

SEQ ID NO: 3661269 - DNA, 21 bp, Homo sapiens
agcgcccctcagcctctgcca

SEQ ID NO: 3661270 - DNA, 18 bp, Homo sapiens
agcgcctgcccctcccag

SEQ ID NO: 3661271 - DNA, 14 bp, Homo sapiens
agcggccaggcggg

SEQ ID NO: 3661272 - DNA, 13 bp, Homo sapiens
agcggctggcagc

SEQ ID NO: 3661273 - DNA, 19 bp, Homo sapiens
agcgggcaggttctgcctg

SEQ ID NO: 3661274 - DNA, 23 bp, Homo sapiens
agcgggcaggttctgcctgcttt

SEQ ID NO: 3661275 - DNA, 20 bp, Homo sapiens
agcggtgggggaggagggtt

SEQ ID NO: 3661276 - DNA, 13 bp, Homo sapiens
agcggtttcctgg

SEQ ID NO: 3661277 - DNA, 21 bp, Homo sapiens
agcgtcagctgctccctggca

SEQ ID NO: 3661278 - DNA, 15 bp, Homo sapiens
agcgtgccgagccag

SEQ ID NO: 3661279 - DNA, 23 bp, Homo sapiens
agcgtgtctgtatttatgtgtga

SEQ ID NO: 3661280 - DNA, 14 bp, Homo sapiens
agctaagaacctgg

SEQ ID NO: 3661281 - DNA, 14 bp, Homo sapiens
agctacaggaagca

SEQ ID NO: 3661282 - DNA, 13 bp, Homo sapiens
agctacaggagag

SEQ ID NO: 3661283 - DNA, 23 bp, Homo sapiens
agctactgccgtcagtgctgtgc

SEQ ID NO: 3661284 - DNA, 21 bp, Homo sapiens
agctaggatggttctgtgacc

SEQ ID NO: 3661285 - DNA, 19 bp, Homo sapiens
agctagtgtctcctctctg

SEQ ID NO: 3661286 - DNA, 18 bp, Homo sapiens
agctatagacccgaggaa

SEQ ID NO: 3661287 - DNA, 19 bp, Homo sapiens
agctatagacccgaggaaa

SEQ ID NO: 3661288 - DNA, 17 bp, Homo sapiens
agctatgggagccccag

SEQ ID NO: 3661289 - DNA, 18 bp, Homo sapiens
agctatgggagccccagg

SEQ ID NO: 3661290 - DNA, 17 bp, Homo sapiens
agctatttatgggcccc

SEQ ID NO: 3661291 - DNA, 15 bp, Homo sapiens
agctcaaaggcacag

SEQ ID NO: 3661292 - DNA, 16 bp, Homo sapiens
agctcaaaggcacagt

SEQ ID NO: 3661293 - DNA, 13 bp, Homo sapiens
agctcaggacaga

SEQ ID NO: 3661294 - DNA, 13 bp, Homo sapiens
agctccactctgc

SEQ ID NO: 3661295 - DNA, 14 bp, Homo sapiens
agctccactctgct

SEQ ID NO: 3661296 - DNA, 17 bp, Homo sapiens
agctccactctgcttct

SEQ ID NO: 3661297 - DNA, 17 bp, Homo sapiens
agctccaggatggggag

SEQ ID NO: 3661298 - DNA, 20 bp, Homo sapiens
agctccaggatggggagggg

SEQ ID NO: 3661299 - DNA, 21 bp, Homo sapiens
agctccaggatggggaggggc

SEQ ID NO: 3661300 - DNA, 22 bp, Homo sapiens
agctcctctccccagcccagag

SEQ ID NO: 3661301 - DNA, 23 bp, Homo sapiens
agctcctctccccagcccagaga

SEQ ID NO: 3661302 - DNA, 24 bp, Homo sapiens
agctcctctccccagcccagagac

SEQ ID NO: 3661303 - DNA, 13 bp, Homo sapiens
agctcctgtggcc

SEQ ID NO: 3661304 - DNA, 15 bp, Homo sapiens
agctccttgggaggc

SEQ ID NO: 3661305 - DNA, 20 bp, Homo sapiens
agctccttgggaggccccac

SEQ ID NO: 3661306 - DNA, 22 bp, Homo sapiens
agctctcaaatgtgtgttcctg

SEQ ID NO: 3661307 - DNA, 16 bp, Homo sapiens
agctctctcctccctt

SEQ ID NO: 3661308 - DNA, 20 bp, Homo sapiens
agctctggaggggaggggga

SEQ ID NO: 3661309 - DNA, 15 bp, Homo sapiens
agctctgtgggccct

SEQ ID NO: 3661310 - DNA, 23 bp, Homo sapiens
agctcttctgccggccctggggc

SEQ ID NO: 3661311 - DNA, 15 bp, Homo sapiens
agctgaacctgggta

SEQ ID NO: 3661312 - DNA, 15 bp, Homo sapiens
agctgaattttctgg

SEQ ID NO: 3661313 - DNA, 17 bp, Homo sapiens
agctgaattttctggaa

SEQ ID NO: 3661314 - DNA, 18 bp, Homo sapiens
agctgacattgccaaaaa

SEQ ID NO: 3661315 - DNA, 22 bp, Homo sapiens
agctgaccagccgtgagcatgt

SEQ ID NO: 3661316 - DNA, 19 bp, Homo sapiens
agctgagactacaagtgtg

SEQ ID NO: 3661317 - DNA, 20 bp, Homo sapiens
agctgagcaaatcaccacaa

SEQ ID NO: 3661318 - DNA, 23 bp, Homo sapiens
agctgagcctgcagggaagcccc

SEQ ID NO: 3661319 - DNA, 17 bp, Homo sapiens
agctgaggcaattctaa

SEQ ID NO: 3661320 - DNA, 13 bp, Homo sapiens
agctgcaccctca

SEQ ID NO: 3661321 - DNA, 20 bp, Homo sapiens
agctgcaccctcaggcaggt

SEQ ID NO: 3661322 - DNA, 22 bp, Homo sapiens
agctgcactgatgctgcccctc

SEQ ID NO: 3661323 - DNA, 18 bp, Homo sapiens
agctgcctccagcctggt

SEQ ID NO: 3661324 - DNA, 16 bp, Homo sapiens
agctgctatagcctgg

SEQ ID NO: 3661325 - DNA, 21 bp, Homo sapiens
agctgctatagcctggggtgg

SEQ ID NO: 3661326 - DNA, 14 bp, Homo sapiens
agctgctggcttgc

SEQ ID NO: 3661327 - DNA, 22 bp, Homo sapiens
aacagctatgggagccccaggg

SEQ ID NO: 3661328 - DNA, 23 bp, Homo sapiens
aacagctctcttcaatgacatag

SEQ ID NO: 3661329 - DNA, 19 bp, Homo sapiens
aacaggagctgggatccta

SEQ ID NO: 3661330 - DNA, 18 bp, Homo sapiens
aacaggtgttggtgacaa

SEQ ID NO: 3661331 - DNA, 12 bp, Homo sapiens
aacagtggagct

SEQ ID NO: 3661332 - DNA, 21 bp, Homo sapiens
aacagttaagacaacaggcat

SEQ ID NO: 3661333 - DNA, 18 bp, Homo sapiens
aacagttttcctatgctt

SEQ ID NO: 3661334 - DNA, 15 bp, Homo sapiens
aacataccaacatgt

SEQ ID NO: 3661335 - DNA, 12 bp, Homo sapiens
aacatatatgga

SEQ ID NO: 3661336 - DNA, 22 bp, Homo sapiens
aacattgcctttgaatgttaat

SEQ ID NO: 3661337 - DNA, 15 bp, Homo sapiens
aaccaagtcaagtga

SEQ ID NO: 3661338 - DNA, 13 bp, Homo sapiens
aaccacaccacat

SEQ ID NO: 3661339 - DNA, 21 bp, Homo sapiens
aaccacaccacatctaagcct

SEQ ID NO: 3661340 - DNA, 15 bp, Homo sapiens
aaccacctacccctg

SEQ ID NO: 3661341 - DNA, 22 bp, Homo sapiens
aaccactctgtggccagcctgg

SEQ ID NO: 3661342 - DNA, 15 bp, Homo sapiens
aaccacttcagctga

SEQ ID NO: 3661343 - DNA, 18 bp, Homo sapiens
aaccagtccccccaccct

SEQ ID NO: 3661344 - DNA, 22 bp, Homo sapiens
aaccagtccccccaccctcatt

SEQ ID NO: 3661345 - DNA, 20 bp, Homo sapiens
aaccatccagtgacaaacca

SEQ ID NO: 3661346 - DNA, 22 bp, Homo sapiens
aaccatccagtgacaaaccatc

SEQ ID NO: 3661347 - DNA, 17 bp, Homo sapiens
aaccattccatttccaa

SEQ ID NO: 3661348 - DNA, 23 bp, Homo sapiens
aaccattccatttccaagcactt

SEQ ID NO: 3661349 - DNA, 22 bp, Homo sapiens
aacccaaattacgtgtactaca

SEQ ID NO: 3661350 - DNA, 13 bp, Homo sapiens
aacccaatagttg

SEQ ID NO: 3661351 - DNA, 12 bp, Homo sapiens
aacccagactca

SEQ ID NO: 3661352 - DNA, 14 bp, Homo sapiens
aacccaggcagctg

SEQ ID NO: 3661353 - DNA, 10 bp, Homo sapiens
aacccccacc

SEQ ID NO: 3661354 - DNA, 18 bp, Homo sapiens
aacccccaccccacactt

SEQ ID NO: 3661355 - DNA, 16 bp, Homo sapiens
aacccgacagagggaa

SEQ ID NO: 3661356 - DNA, 15 bp, Homo sapiens
aaccgcaggaagctg

SEQ ID NO: 3661357 - DNA, 15 bp, Homo sapiens
aaccgccctcctgat

SEQ ID NO: 3661358 - DNA, 22 bp, Homo sapiens
aacctatttcttaaacacttgc

SEQ ID NO: 3661359 - DNA, 19 bp, Homo sapiens
aacctcacgcacctcccat

SEQ ID NO: 3661360 - DNA, 20 bp, Homo sapiens
aacctcatggagtcatcttg

SEQ ID NO: 3661361 - DNA, 15 bp, Homo sapiens
aacctctacaggcat

SEQ ID NO: 3661362 - DNA, 16 bp, Homo sapiens
aacctctacaggcatt

SEQ ID NO: 3661363 - DNA, 14 bp, Homo sapiens
aacctctctatttt

SEQ ID NO: 3661364 - DNA, 15 bp, Homo sapiens
aacctgaagtttttt

SEQ ID NO: 3661365 - DNA, 15 bp, Homo sapiens
aaccttcgtcctttt

SEQ ID NO: 3661366 - DNA, 13 bp, Homo sapiens
aaccttgtataaa

SEQ ID NO: 3661367 - DNA, 19 bp, Homo sapiens
aaccttgtataaattattc

SEQ ID NO: 3661368 - DNA, 13 bp, Homo sapiens
aaccttgtcccag

SEQ ID NO: 3661369 - DNA, 12 bp, Homo sapiens
aacgaggaagcc

SEQ ID NO: 3661370 - DNA, 21 bp, Homo sapiens
aacgagggggtcagcccaaga

SEQ ID NO: 3661371 - DNA, 19 bp, Homo sapiens
aacggagagcgcctgcccc

SEQ ID NO: 3661372 - DNA, 19 bp, Homo sapiens
aacggccctgcagccagct

SEQ ID NO: 3661373 - DNA, 20 bp, Homo sapiens
aacggggcagtactcctccc

SEQ ID NO: 3661374 - DNA, 24 bp, Homo sapiens
aacggggcagtactcctccctggg

SEQ ID NO: 3661375 - DNA, 22 bp, Homo sapiens
aactaaaaagagactgtgccat

SEQ ID NO: 3661376 - DNA, 20 bp, Homo sapiens
aactaattgactttagaaag

SEQ ID NO: 3661377 - DNA, 21 bp, Homo sapiens
aactatgatttggaaaataaa

SEQ ID NO: 3661378 - DNA, 17 bp, Homo sapiens
aactatgcatggtgccc

SEQ ID NO: 3661379 - DNA, 13 bp, Homo sapiens
aactattttcaga

SEQ ID NO: 3661380 - DNA, 14 bp, Homo sapiens
aactattttcagat

SEQ ID NO: 3661381 - DNA, 16 bp, Homo sapiens
aactattttcagatgt

SEQ ID NO: 3661382 - DNA, 21 bp, Homo sapiens
aactcaaatggggccagatcc

SEQ ID NO: 3661383 - DNA, 12 bp, Homo sapiens
aactcaatattt

SEQ ID NO: 3661384 - DNA, 21 bp, Homo sapiens
aactcaatattttccatgaaa

SEQ ID NO: 3661385 - DNA, 12 bp, Homo sapiens
aactcagatcca

SEQ ID NO: 3661386 - DNA, 11 bp, Homo sapiens
aactcctacct

SEQ ID NO: 3661387 - DNA, 12 bp, Homo sapiens
aactcctacctg

SEQ ID NO: 3661388 - DNA, 20 bp, Homo sapiens
aactcctacctgaaggcagg

SEQ ID NO: 3661389 - DNA, 21 bp, Homo sapiens
aactcgtatagcatgcatctg

SEQ ID NO: 3661390 - DNA, 12 bp, Homo sapiens
aactctagctgg

SEQ ID NO: 3661391 - DNA, 19 bp, Homo sapiens
aactctagctgggggtggg

SEQ ID NO: 3661392 - DNA, 19 bp, Homo sapiens
aactctgttgcaagtgcaa

SEQ ID NO: 3661393 - DNA, 23 bp, Homo sapiens
aactcttcagttaattcttagat

SEQ ID NO: 3661394 - DNA, 16 bp, Homo sapiens
aactgaattttgggac

SEQ ID NO: 3661395 - DNA, 19 bp, Homo sapiens
aactgaggcttagagatag

SEQ ID NO: 3661396 - DNA, 13 bp, Homo sapiens
aactgcaggccct

SEQ ID NO: 3661397 - DNA, 16 bp, Homo sapiens
aactgcaggccctggc

SEQ ID NO: 3661398 - DNA, 21 bp, Homo sapiens
aactgcaggccctggcctccc

SEQ ID NO: 3661399 - DNA, 23 bp, Homo sapiens
aactgcaggccctggcctcccct

SEQ ID NO: 3661400 - DNA, 16 bp, Homo sapiens
aactgcattggctttg

SEQ ID NO: 3661401 - DNA, 15 bp, Homo sapiens
aactgctgactgttt

SEQ ID NO: 3661402 - DNA, 14 bp, Homo sapiens
aactggacagcctc

SEQ ID NO: 3661403 - DNA, 17 bp, Homo sapiens
aactggacctgtatatt

SEQ ID NO: 3661404 - DNA, 22 bp, Homo sapiens
aactggcaggcaggctcccagg

SEQ ID NO: 3661405 - DNA, 11 bp, Homo sapiens
aactgtaaatc

SEQ ID NO: 3661406 - DNA, 12 bp, Homo sapiens
aactgtaaatca

SEQ ID NO: 3661407 - DNA, 19 bp, Homo sapiens
aactgtctttaaaagagag

SEQ ID NO: 3661408 - DNA, 15 bp, Homo sapiens
aactgtgaaatacca

SEQ ID NO: 3661409 - DNA, 22 bp, Homo sapiens
aactgtgaaataccacaagcct

SEQ ID NO: 3661410 - DNA, 18 bp, Homo sapiens
aacttctgaactttggaa

SEQ ID NO: 3661411 - DNA, 21 bp, Homo sapiens
aacttgaatttggtctgtata

SEQ ID NO: 3661412 - DNA, 23 bp, Homo sapiens
aacttgctgggtggttctctggg

SEQ ID NO: 3661413 - DNA, 18 bp, Homo sapiens
aacttggctgcaggaatc

SEQ ID NO: 3661414 - DNA, 14 bp, Homo sapiens
aacttggtcagagc

SEQ ID NO: 3661415 - DNA, 17 bp, Homo sapiens
aactttcacctcagatt

SEQ ID NO: 3661416 - DNA, 21 bp, Homo sapiens
aactttcacctcagattttct

SEQ ID NO: 3661417 - DNA, 19 bp, Homo sapiens
aagaaaaaatattttccct

SEQ ID NO: 3661418 - DNA, 12 bp, Homo sapiens
aagaaaaagcaa

SEQ ID NO: 3661419 - DNA, 18 bp, Homo sapiens
aagaaaaatgagcctggc

SEQ ID NO: 3661420 - DNA, 18 bp, Homo sapiens
aagaaacccgacagaggg

SEQ ID NO: 3661421 - DNA, 16 bp, Homo sapiens
aagaaatgtagctgaa

SEQ ID NO: 3661422 - DNA, 19 bp, Homo sapiens
aagaactgtcatgtaaaca

SEQ ID NO: 3661423 - DNA, 13 bp, Homo sapiens
aagaactttgagc

SEQ ID NO: 3661424 - DNA, 14 bp, Homo sapiens
aagaagaaaaaggt

SEQ ID NO: 3661425 - DNA, 12 bp, Homo sapiens
aagaagaaagca

SEQ ID NO: 3661426 - DNA, 13 bp, Homo sapiens
aagaagaaagcaa

SEQ ID NO: 3661427 - DNA, 14 bp, Homo sapiens
aagaagctgtcttg

SEQ ID NO: 3661428 - DNA, 22 bp, Homo sapiens
aagaagctgtcttggaagtctg

SEQ ID NO: 3661429 - DNA, 17 bp, Homo sapiens
aagaaggaaaaggcagg

SEQ ID NO: 3661430 - DNA, 16 bp, Homo sapiens
aagaaggagagcaaga

SEQ ID NO: 3661431 - DNA, 19 bp, Homo sapiens
aagaaggcagcaggtggca

SEQ ID NO: 3661432 - DNA, 23 bp, Homo sapiens
aagaaggtttcagaaagaagtgg

SEQ ID NO: 3661433 - DNA, 13 bp, Homo sapiens
aagaattctgtga

SEQ ID NO: 3661434 - DNA, 16 bp, Homo sapiens
aagaattgaagcagga

SEQ ID NO: 3661435 - DNA, 20 bp, Homo sapiens
aagacaatgtgaaaagaaaa

SEQ ID NO: 3661436 - DNA, 15 bp, Homo sapiens
aagacagagctggga

SEQ ID NO: 3661437 - DNA, 16 bp, Homo sapiens
aagacagagctgggat

SEQ ID NO: 3661438 - DNA, 17 bp, Homo sapiens
aagacagatgccccaga

SEQ ID NO: 3661439 - DNA, 17 bp, Homo sapiens
aagacctggcagctctg

SEQ ID NO: 3661440 - DNA, 13 bp, Homo sapiens
aagagaaaaaata

SEQ ID NO: 3661441 - DNA, 16 bp, Homo sapiens
aagagaagacgaaata

SEQ ID NO: 3661442 - DNA, 18 bp, Homo sapiens
aagagactctcctgcctc

SEQ ID NO: 3661443 - DNA, 15 bp, Homo sapiens
aagagactgtgccat

SEQ ID NO: 3661444 - DNA, 23 bp, Homo sapiens
accctttgctgtgaggctgtcct

SEQ ID NO: 3661445 - DNA, 23 bp, Homo sapiens
accgactcatttacaactgaaac

SEQ ID NO: 3661446 - DNA, 16 bp, Homo sapiens
accgaggccctcccaa

SEQ ID NO: 3661447 - DNA, 12 bp, Homo sapiens
accgcaggaagc

SEQ ID NO: 3661448 - DNA, 14 bp, Homo sapiens
accgcaggaagctg

SEQ ID NO: 3661449 - DNA, 19 bp, Homo sapiens
accgcaggaagctgctccg

SEQ ID NO: 3661450 - DNA, 19 bp, Homo sapiens
accgccatcctctgcctca

SEQ ID NO: 3661451 - DNA, 20 bp, Homo sapiens
accgcctccccacctccagg

SEQ ID NO: 3661452 - DNA, 15 bp, Homo sapiens
accggaaggttttta

SEQ ID NO: 3661453 - DNA, 13 bp, Homo sapiens
accggatcctggg

SEQ ID NO: 3661454 - DNA, 16 bp, Homo sapiens
accggatcctgggtgg

SEQ ID NO: 3661455 - DNA, 14 bp, Homo sapiens
accggctcccaccc

SEQ ID NO: 3661456 - DNA, 23 bp, Homo sapiens
accgggtcacacaaaggcatgct

SEQ ID NO: 3661457 - DNA, 21 bp, Homo sapiens
acctaatccaggcagatccag

SEQ ID NO: 3661458 - DNA, 15 bp, Homo sapiens
acctataaaacaggt

SEQ ID NO: 3661459 - DNA, 18 bp, Homo sapiens
acctataaaacaggtcaa

SEQ ID NO: 3661460 - DNA, 17 bp, Homo sapiens
acctcaaccatcctggc

SEQ ID NO: 3661461 - DNA, 21 bp, Homo sapiens
acctcaaccatcctggctgcg

SEQ ID NO: 3661462 - DNA, 18 bp, Homo sapiens
acctcacgcacctcccat

SEQ ID NO: 3661463 - DNA, 22 bp, Homo sapiens
acctcacgcacctcccatccta

SEQ ID NO: 3661464 - DNA, 11 bp, Homo sapiens
acctcagcctg

SEQ ID NO: 3661465 - DNA, 16 bp, Homo sapiens
acctcagcctggccag

SEQ ID NO: 3661466 - DNA, 12 bp, Homo sapiens
acctcaggcagg

SEQ ID NO: 3661467 - DNA, 22 bp, Homo sapiens
acctcagttattacatgtaatt

SEQ ID NO: 3661468 - DNA, 22 bp, Homo sapiens
acctcagttcccttggcctcag

SEQ ID NO: 3661469 - DNA, 18 bp, Homo sapiens
acctcatggagtcatctt

SEQ ID NO: 3661470 - DNA, 15 bp, Homo sapiens
acctccacagcttcc

SEQ ID NO: 3661471 - DNA, 23 bp, Homo sapiens
acctcctttcctatctttacatc

SEQ ID NO: 3661472 - DNA, 19 bp, Homo sapiens
acctcggtgccttcctctt

SEQ ID NO: 3661473 - DNA, 17 bp, Homo sapiens
acctctacaggcattta

SEQ ID NO: 3661474 - DNA, 16 bp, Homo sapiens
acctctctatttttaa

SEQ ID NO: 3661475 - DNA, 13 bp, Homo sapiens
acctctgagaaga

SEQ ID NO: 3661476 - DNA, 16 bp, Homo sapiens
acctctggactggcta

SEQ ID NO: 3661477 - DNA, 23 bp, Homo sapiens
acctctggactggctagagtcct

SEQ ID NO: 3661478 - DNA, 18 bp, Homo sapiens
acctgaaggcagggctcc

SEQ ID NO: 3661479 - DNA, 19 bp, Homo sapiens
acctgaaggcagggctcct

SEQ ID NO: 3661480 - DNA, 22 bp, Homo sapiens
acctgaaggcagggctcctccc

SEQ ID NO: 3661481 - DNA, 22 bp, Homo sapiens
acctgaccaggggccctacctg

SEQ ID NO: 3661482 - DNA, 14 bp, Homo sapiens
acctgaggctgtgg

SEQ ID NO: 3661483 - DNA, 22 bp, Homo sapiens
acctgatcctggaggcccagtt

SEQ ID NO: 3661484 - DNA, 15 bp, Homo sapiens
acctgcaaaaaatac

SEQ ID NO: 3661485 - DNA, 17 bp, Homo sapiens
acctgcaggcggggctc

SEQ ID NO: 3661486 - DNA, 19 bp, Homo sapiens
acctgcaggcggggctcct

SEQ ID NO: 3661487 - DNA, 21 bp, Homo sapiens
acctgcaggcggggctcctcc

SEQ ID NO: 3661488 - DNA, 17 bp, Homo sapiens
acctggcagctctggac

SEQ ID NO: 3661489 - DNA, 17 bp, Homo sapiens
acctggggaaagcctga

SEQ ID NO: 3661490 - DNA, 16 bp, Homo sapiens
acctgggggcagaact

SEQ ID NO: 3661491 - DNA, 17 bp, Homo sapiens
acctgggttccctttcc

SEQ ID NO: 3661492 - DNA, 18 bp, Homo sapiens
acctgggttgcagacagg

SEQ ID NO: 3661493 - DNA, 19 bp, Homo sapiens
acctgtcaaacaaagccag

SEQ ID NO: 3661494 - DNA, 14 bp, Homo sapiens
acctgttgagcatc

SEQ ID NO: 3661495 - DNA, 19 bp, Homo sapiens
acctgttgagcatcacaga

SEQ ID NO: 3661496 - DNA, 20 bp, Homo sapiens
acctgttgagcatcacagaa

SEQ ID NO: 3661497 - DNA, 15 bp, Homo sapiens
accttaggcagggaa

SEQ ID NO: 3661498 - DNA, 16 bp, Homo sapiens
accttaggcagggaag

SEQ ID NO: 3661499 - DNA, 19 bp, Homo sapiens
accttctgcctttgatgtt

SEQ ID NO: 3661500 - DNA, 14 bp, Homo sapiens
accttggcaccaga

SEQ ID NO: 3661501 - DNA, 18 bp, Homo sapiens
accttggcaccagacacc

SEQ ID NO: 3661502 - DNA, 19 bp, Homo sapiens
accttgtataaattattca

SEQ ID NO: 3661503 - DNA, 17 bp, Homo sapiens
accttgtcccagccagt

SEQ ID NO: 3661504 - DNA, 14 bp, Homo sapiens
accttgtgcctggg

SEQ ID NO: 3661505 - DNA, 17 bp, Homo sapiens
accttgttacttctgag

SEQ ID NO: 3661506 - DNA, 22 bp, Homo sapiens
acctttaagaattttaaatatt

SEQ ID NO: 3661507 - DNA, 14 bp, Homo sapiens
acctttcaaagctt

SEQ ID NO: 3661508 - DNA, 18 bp, Homo sapiens
acctttccaccacagcca

SEQ ID NO: 3661509 - DNA, 13 bp, Homo sapiens
acgcaagtgccag

SEQ ID NO: 3661510 - DNA, 13 bp, Homo sapiens
acgcacctcccat

SEQ ID NO: 3661511 - DNA, 15 bp, Homo sapiens
acgcacctcccatcc

SEQ ID NO: 3661512 - DNA, 23 bp, Homo sapiens
acgccaggggaaaatcagcctgc

SEQ ID NO: 3661513 - DNA, 14 bp, Homo sapiens
acgcccccccccac

SEQ ID NO: 3661514 - DNA, 23 bp, Homo sapiens
acgcccccccccacccctggggg

SEQ ID NO: 3661515 - DNA, 20 bp, Homo sapiens
acgcctgtgccaccccttcc

SEQ ID NO: 3661516 - DNA, 16 bp, Homo sapiens
acgcgtgccgtggcac

SEQ ID NO: 3661517 - DNA, 19 bp, Homo sapiens
acgctactataaagagaag

SEQ ID NO: 3661518 - DNA, 15 bp, Homo sapiens
acggaagagccttgc

SEQ ID NO: 3661519 - DNA, 19 bp, Homo sapiens
acggacactcaaaagctgg

SEQ ID NO: 3661520 - DNA, 18 bp, Homo sapiens
acggcctgatgctccctc

SEQ ID NO: 3661521 - DNA, 19 bp, Homo sapiens
acggggcagtactcctccc

SEQ ID NO: 3661522 - DNA, 23 bp, Homo sapiens
acggggcgggccctgcctgaggg

SEQ ID NO: 3661523 - DNA, 14 bp, Homo sapiens
acggggctcccctg

SEQ ID NO: 3661524 - DNA, 19 bp, Homo sapiens
acggggctcccctggacag

SEQ ID NO: 3661525 - DNA, 22 bp, Homo sapiens
acggggctcccctggacagagg

SEQ ID NO: 3661526 - DNA, 20 bp, Homo sapiens
acgggggctgtggctctggg

SEQ ID NO: 3661527 - DNA, 13 bp, Homo sapiens
acggggtcttgct

SEQ ID NO: 3661528 - DNA, 14 bp, Homo sapiens
acggtgcccaagcc

SEQ ID NO: 3661529 - DNA, 21 bp, Homo sapiens
acggtggtcggtgggaccctg

SEQ ID NO: 3661530 - DNA, 15 bp, Homo sapiens
acggtttccagggag

SEQ ID NO: 3661531 - DNA, 15 bp, Homo sapiens
acggttttactgcag

SEQ ID NO: 3661532 - DNA, 13 bp, Homo sapiens
acgtgacacaaac

SEQ ID NO: 3661533 - DNA, 19 bp, Homo sapiens
acgtgacacaaacacacac

SEQ ID NO: 3661534 - DNA, 14 bp, Homo sapiens
acgtgagagaaggg

SEQ ID NO: 3661535 - DNA, 14 bp, Homo sapiens
acgtgagagtgtct

SEQ ID NO: 3661536 - DNA, 20 bp, Homo sapiens
acgtgatcctctcacctcag

SEQ ID NO: 3661537 - DNA, 14 bp, Homo sapiens
acgtggagagctgg

SEQ ID NO: 3661538 - DNA, 15 bp, Homo sapiens
acgtggagagctggt

SEQ ID NO: 3661539 - DNA, 16 bp, Homo sapiens
acgtggagagctggtg

SEQ ID NO: 3661540 - DNA, 18 bp, Homo sapiens
acgtggagagctggtgcc

SEQ ID NO: 3661541 - DNA, 18 bp, Homo sapiens
acgtgtactacaatttaa

SEQ ID NO: 3661542 - DNA, 15 bp, Homo sapiens
acgttaccaggcagg

SEQ ID NO: 3661543 - DNA, 19 bp, Homo sapiens
acgttggagaagcccgtgt

SEQ ID NO: 3661544 - DNA, 10 bp, Homo sapiens
acgtttcttt

SEQ ID NO: 3661545 - DNA, 12 bp, Homo sapiens
acgtttctttaa

SEQ ID NO: 3661546 - DNA, 21 bp, Homo sapiens
acgtttctttaaccttgtata

SEQ ID NO: 3661547 - DNA, 17 bp, Homo sapiens
acgttttttcctcagtg

SEQ ID NO: 3661548 - DNA, 18 bp, Homo sapiens
acgttttttcctcagtgc

SEQ ID NO: 3661549 - DNA, 19 bp, Homo sapiens
actaaataagaaaataaca

SEQ ID NO: 3661550 - DNA, 14 bp, Homo sapiens
actaagcagaggag

SEQ ID NO: 3661551 - DNA, 22 bp, Homo sapiens
actaaggggcccggccagccat

SEQ ID NO: 3661552 - DNA, 13 bp, Homo sapiens
actaatggcatga

SEQ ID NO: 3661553 - DNA, 16 bp, Homo sapiens
actaatggcatgagaa

SEQ ID NO: 3661554 - DNA, 15 bp, Homo sapiens
actaattttacatgt

SEQ ID NO: 3661555 - DNA, 13 bp, Homo sapiens
actacaagtcagc

SEQ ID NO: 3661556 - DNA, 17 bp, Homo sapiens
actacaatttaaagcaa

SEQ ID NO: 3661557 - DNA, 22 bp, Homo sapiens
actacaatttaaagcaaaggag

SEQ ID NO: 3661558 - DNA, 18 bp, Homo sapiens
actacggaactgcacact

SEQ ID NO: 3661559 - DNA, 21 bp, Homo sapiens
actacggaactgcacactcag

SEQ ID NO: 3661560 - DNA, 20 bp, Homo sapiens
atcggctggggactgctacc

SEQ ID NO: 3661561 - DNA, 15 bp, Homo sapiens
atcggggccatttgg

SEQ ID NO: 3661562 - DNA, 14 bp, Homo sapiens
atctaaagttatat

SEQ ID NO: 3661563 - DNA, 16 bp, Homo sapiens
atctaaagttatattt

SEQ ID NO: 3661564 - DNA, 18 bp, Homo sapiens
atctaaagttatatttca

SEQ ID NO: 3661565 - DNA, 19 bp, Homo sapiens
atctaacaataatatttca

SEQ ID NO: 3661566 - DNA, 20 bp, Homo sapiens
atctaacaataatatttcaa

SEQ ID NO: 3661567 - DNA, 23 bp, Homo sapiens
atctaacaataatatttcaagtg

SEQ ID NO: 3661568 - DNA, 12 bp, Homo sapiens
atctagaagact

SEQ ID NO: 3661569 - DNA, 18 bp, Homo sapiens
atctcaatgaagccagct

SEQ ID NO: 3661570 - DNA, 17 bp, Homo sapiens
atctcacctcctgctgg

SEQ ID NO: 3661571 - DNA, 21 bp, Homo sapiens
atctcacctcctgctgggcag

SEQ ID NO: 3661572 - DNA, 14 bp, Homo sapiens
atctcaggtctgaa

SEQ ID NO: 3661573 - DNA, 18 bp, Homo sapiens
atctcccgaagtcctctg

SEQ ID NO: 3661574 - DNA, 18 bp, Homo sapiens
atctctgtactttgcttg

SEQ ID NO: 3661575 - DNA, 14 bp, Homo sapiens
atctctgtgccttc

SEQ ID NO: 3661576 - DNA, 23 bp, Homo sapiens
atctgaaggggcaaattcttttg

SEQ ID NO: 3661577 - DNA, 20 bp, Homo sapiens
atctgaccagcagcgccttt

SEQ ID NO: 3661578 - DNA, 14 bp, Homo sapiens
atctgacccagtgc

SEQ ID NO: 3661579 - DNA, 21 bp, Homo sapiens
atctgacccagtgcccccact

SEQ ID NO: 3661580 - DNA, 14 bp, Homo sapiens
atctgattggcaga

SEQ ID NO: 3661581 - DNA, 18 bp, Homo sapiens
atctgcacccccctgggc

SEQ ID NO: 3661582 - DNA, 16 bp, Homo sapiens
atctggaacccagact

SEQ ID NO: 3661583 - DNA, 21 bp, Homo sapiens
atctggaagccaaaatgtagg

SEQ ID NO: 3661584 - DNA, 13 bp, Homo sapiens
atctgtagtaatt

SEQ ID NO: 3661585 - DNA, 22 bp, Homo sapiens
atctgtagtaatttattgtctg

SEQ ID NO: 3661586 - DNA, 23 bp, Homo sapiens
atctgtagtaatttattgtctgt

SEQ ID NO: 3661587 - DNA, 16 bp, Homo sapiens
atctgtcctcagcctt

SEQ ID NO: 3661588 - DNA, 19 bp, Homo sapiens
atctgttcccttcctctgt

SEQ ID NO: 3661589 - DNA, 16 bp, Homo sapiens
atctgttctatgcttc

SEQ ID NO: 3661590 - DNA, 19 bp, Homo sapiens
atctgttctatgcttcctc

SEQ ID NO: 3661591 - DNA, 20 bp, Homo sapiens
atctgttctatgcttcctcg

SEQ ID NO: 3661592 - DNA, 15 bp, Homo sapiens
atcttaaatttctaa

SEQ ID NO: 3661593 - DNA, 21 bp, Homo sapiens
atcttacaacaggcttatgaa

SEQ ID NO: 3661594 - DNA, 22 bp, Homo sapiens
atcttgaccaagcaggaagctc

SEQ ID NO: 3661595 - DNA, 21 bp, Homo sapiens
atcttgcctccaggtgcagag

SEQ ID NO: 3661596 - DNA, 14 bp, Homo sapiens
atcttgcttcccta

SEQ ID NO: 3661597 - DNA, 16 bp, Homo sapiens
atcttgggggggtggc

SEQ ID NO: 3661598 - DNA, 20 bp, Homo sapiens
atctttaaaagatgctttta

SEQ ID NO: 3661599 - DNA, 17 bp, Homo sapiens
atctttgactgaaaaaa

SEQ ID NO: 3661600 - DNA, 22 bp, Homo sapiens
atctttgccttgggctgctcct

SEQ ID NO: 3661601 - DNA, 15 bp, Homo sapiens
atctttgtggccaag

SEQ ID NO: 3661602 - DNA, 16 bp, Homo sapiens
atctttgtggccaagg

SEQ ID NO: 3661603 - DNA, 14 bp, Homo sapiens
atgaaataaaatta

SEQ ID NO: 3661604 - DNA, 17 bp, Homo sapiens
atgaacatatatttttt

SEQ ID NO: 3661605 - DNA, 20 bp, Homo sapiens
atgaacattagaaaaatagc

SEQ ID NO: 3661606 - DNA, 16 bp, Homo sapiens
atgaactaaaaagaga

SEQ ID NO: 3661607 - DNA, 22 bp, Homo sapiens
atgaagatgtttcaaaaaatct

SEQ ID NO: 3661608 - DNA, 17 bp, Homo sapiens
atgaaggtttctgaaaa

SEQ ID NO: 3661609 - DNA, 17 bp, Homo sapiens
atgaataacatttaaat

SEQ ID NO: 3661610 - DNA, 18 bp, Homo sapiens
atgaataacatttaaatt

SEQ ID NO: 3661611 - DNA, 19 bp, Homo sapiens
atgaataacatttaaattc

SEQ ID NO: 3661612 - DNA, 23 bp, Homo sapiens
atgaatatatttaagcaacatct

SEQ ID NO: 3661613 - DNA, 17 bp, Homo sapiens
atgaccatactgaggga

SEQ ID NO: 3661614 - DNA, 18 bp, Homo sapiens
atgaccttctaggaagct

SEQ ID NO: 3661615 - DNA, 13 bp, Homo sapiens
atgactttttata

SEQ ID NO: 3661616 - DNA, 18 bp, Homo sapiens
atgactttttataaaatg

SEQ ID NO: 3661617 - DNA, 11 bp, Homo sapiens
atgagaaactg

SEQ ID NO: 3661618 - DNA, 16 bp, Homo sapiens
atgagactcagtgcag

SEQ ID NO: 3661619 - DNA, 16 bp, Homo sapiens
atgagatttttaaaaa

SEQ ID NO: 3661620 - DNA, 22 bp, Homo sapiens
atgagcttatttcaaaaggaag

SEQ ID NO: 3661621 - DNA, 17 bp, Homo sapiens
atgaggagagaaaatat

SEQ ID NO: 3661622 - DNA, 15 bp, Homo sapiens
atgaggcttcttcct

SEQ ID NO: 3661623 - DNA, 16 bp, Homo sapiens
atgaggcttcttcctg

SEQ ID NO: 3661624 - DNA, 22 bp, Homo sapiens
atgaggcttcttcctggatggg

SEQ ID NO: 3661625 - DNA, 13 bp, Homo sapiens
atgaggctttcca

SEQ ID NO: 3661626 - DNA, 14 bp, Homo sapiens
atgagttggacttc

SEQ ID NO: 3661627 - DNA, 17 bp, Homo sapiens
atgagttggacttcagt

SEQ ID NO: 3661628 - DNA, 20 bp, Homo sapiens
atgataagttcctttccttt

SEQ ID NO: 3661629 - DNA, 15 bp, Homo sapiens
atgatcactgtgaaa

SEQ ID NO: 3661630 - DNA, 18 bp, Homo sapiens
atgatccctgtgttgtct

SEQ ID NO: 3661631 - DNA, 17 bp, Homo sapiens
atgatgacaaaaaatgt

SEQ ID NO: 3661632 - DNA, 19 bp, Homo sapiens
atgatgtgggtcaaggaat

SEQ ID NO: 3661633 - DNA, 19 bp, Homo sapiens
atgattaaccacttcagct

SEQ ID NO: 3661634 - DNA, 20 bp, Homo sapiens
atgattaaccacttcagctg

SEQ ID NO: 3661635 - DNA, 21 bp, Homo sapiens
atgattaaccacttcagctga

SEQ ID NO: 3661636 - DNA, 14 bp, Homo sapiens
atgcaacaacatgt

SEQ ID NO: 3661637 - DNA, 14 bp, Homo sapiens
atgcaagcagagga

SEQ ID NO: 3661638 - DNA, 22 bp, Homo sapiens
atgcaagcagaggaccagggcc

SEQ ID NO: 3661639 - DNA, 23 bp, Homo sapiens
atgcaagcagaggaccagggcct

SEQ ID NO: 3661640 - DNA, 24 bp, Homo sapiens
atgcaatgtaagcatactttgtaa

SEQ ID NO: 3661641 - DNA, 14 bp, Homo sapiens
atgcaccaccaagc

SEQ ID NO: 3661642 - DNA, 21 bp, Homo sapiens
atgcaccaccaagccaaggga

SEQ ID NO: 3661643 - DNA, 12 bp, Homo sapiens
atgcagaatgtt

SEQ ID NO: 3661644 - DNA, 19 bp, Homo sapiens
atgcagcagggatgccctg

SEQ ID NO: 3661645 - DNA, 20 bp, Homo sapiens
atgcagcagggatgccctgg

SEQ ID NO: 3661646 - DNA, 21 bp, Homo sapiens
atgcaggtggatctccttgag

SEQ ID NO: 3661647 - DNA, 14 bp, Homo sapiens
atgcagtgctcttt

SEQ ID NO: 3661648 - DNA, 19 bp, Homo sapiens
atgcatggtgccccaggac

SEQ ID NO: 3661649 - DNA, 22 bp, Homo sapiens
atgcatggtgccccaggaccag

SEQ ID NO: 3661650 - DNA, 12 bp, Homo sapiens
atgcattgagct

SEQ ID NO: 3661651 - DNA, 18 bp, Homo sapiens
atgcattgagctgcctcc

SEQ ID NO: 3661652 - DNA, 21 bp, Homo sapiens
atgcattgagctgcctccagc

SEQ ID NO: 3661653 - DNA, 14 bp, Homo sapiens
atgccactgccttc

SEQ ID NO: 3661654 - DNA, 18 bp, Homo sapiens
atgccactgccttcgctt

SEQ ID NO: 3661655 - DNA, 17 bp, Homo sapiens
atgccatggacagaaga

SEQ ID NO: 3661656 - DNA, 19 bp, Homo sapiens
atgcccacctgcccatcac

SEQ ID NO: 3661657 - DNA, 15 bp, Homo sapiens
atgccctggaggtgg

SEQ ID NO: 3661658 - DNA, 20 bp, Homo sapiens
atgccggttaaattccatat

SEQ ID NO: 3661659 - DNA, 16 bp, Homo sapiens
atgcctgtccagcctg

SEQ ID NO: 3661660 - DNA, 18 bp, Homo sapiens
atgcctgtccagcctggg

SEQ ID NO: 3661661 - DNA, 23 bp, Homo sapiens
atgccttgaataataagcaggat

SEQ ID NO: 3661662 - DNA, 16 bp, Homo sapiens
atgccttttttgtagt

SEQ ID NO: 3661663 - DNA, 13 bp, Homo sapiens
atgctatttgaac

SEQ ID NO: 3661664 - DNA, 15 bp, Homo sapiens
atgctatttgaacaa

SEQ ID NO: 3661665 - DNA, 18 bp, Homo sapiens
atgctccctcccctgccc

SEQ ID NO: 3661666 - DNA, 19 bp, Homo sapiens
atgctccctcccctgccct

SEQ ID NO: 3661667 - DNA, 19 bp, Homo sapiens
atgctcctggcccactgca

SEQ ID NO: 3661668 - DNA, 17 bp, Homo sapiens
atgctctagtgccttct

SEQ ID NO: 3661669 - DNA, 14 bp, Homo sapiens
atgctgaggcctgg

SEQ ID NO: 3661670 - DNA, 18 bp, Homo sapiens
atgctgaggcctgggccg

SEQ ID NO: 3661671 - DNA, 22 bp, Homo sapiens
atgctgaggcctgggccgctgc

SEQ ID NO: 3661672 - DNA, 20 bp, Homo sapiens
atgctgctatatccactgtc

SEQ ID NO: 3661673 - DNA, 22 bp, Homo sapiens
atgctgctttaacagtggagct

SEQ ID NO: 3661674 - DNA, 23 bp, Homo sapiens
atgctggaacctgcaaaaaatac

SEQ ID NO: 3661675 - DNA, 20 bp, Homo sapiens
atgctggagtacccagccta

SEQ ID NO: 3661676 - DNA, 22 bp, Homo sapiens
caaccactctgtggccagcctg

SEQ ID NO: 3661677 - DNA, 14 bp, Homo sapiens
caaccactggtctg

SEQ ID NO: 3661678 - DNA, 22 bp, Homo sapiens
caaccactggtctgtagggatt

SEQ ID NO: 3661679 - DNA, 16 bp, Homo sapiens
caaccaggcacctctt

SEQ ID NO: 3661680 - DNA, 13 bp, Homo sapiens
caacccccacccc

SEQ ID NO: 3661681 - DNA, 16 bp, Homo sapiens
caacccgaggcccgca

SEQ ID NO: 3661682 - DNA, 17 bp, Homo sapiens
caacccgtgcccctggg

SEQ ID NO: 3661683 - DNA, 22 bp, Homo sapiens
caacccttctaaacggtgacct

SEQ ID NO: 3661684 - DNA, 16 bp, Homo sapiens
caacctcgctgagggc

SEQ ID NO: 3661685 - DNA, 12 bp, Homo sapiens
caacgaggaagc

SEQ ID NO: 3661686 - DNA, 20 bp, Homo sapiens
caacggaggcctgcgaccct

SEQ ID NO: 3661687 - DNA, 18 bp, Homo sapiens
caacggccctgcagccag

SEQ ID NO: 3661688 - DNA, 19 bp, Homo sapiens
caacggccctgcagccagc

SEQ ID NO: 3661689 - DNA, 13 bp, Homo sapiens
caacgtggcccag

SEQ ID NO: 3661690 - DNA, 19 bp, Homo sapiens
caactacccccagctgtgc

SEQ ID NO: 3661691 - DNA, 18 bp, Homo sapiens
caactatgatttggaaaa

SEQ ID NO: 3661692 - DNA, 22 bp, Homo sapiens
caactatgatttggaaaataaa

SEQ ID NO: 3661693 - DNA, 23 bp, Homo sapiens
caactcagtccctaaaaacacag

SEQ ID NO: 3661694 - DNA, 19 bp, Homo sapiens
caactgctggggagacaaa

SEQ ID NO: 3661695 - DNA, 12 bp, Homo sapiens
caactggcaggc

SEQ ID NO: 3661696 - DNA, 11 bp, Homo sapiens
caacttattaa

SEQ ID NO: 3661697 - DNA, 13 bp, Homo sapiens
caagacagatgcc

SEQ ID NO: 3661698 - DNA, 18 bp, Homo sapiens
caagactctttggacact

SEQ ID NO: 3661699 - DNA, 14 bp, Homo sapiens
caagagcagcctgt

SEQ ID NO: 3661700 - DNA, 12 bp, Homo sapiens
caagagctgagg

SEQ ID NO: 3661701 - DNA, 17 bp, Homo sapiens
caagagggctgcttccc

SEQ ID NO: 3661702 - DNA, 20 bp, Homo sapiens
caagagtctaatagtctttg

SEQ ID NO: 3661703 - DNA, 13 bp, Homo sapiens
caagcaagaaaca

SEQ ID NO: 3661704 - DNA, 14 bp, Homo sapiens
caagcacttctttt

SEQ ID NO: 3661705 - DNA, 14 bp, Homo sapiens
caagcagccaagct

SEQ ID NO: 3661706 - DNA, 22 bp, Homo sapiens
caagcagccaagctccttggga

SEQ ID NO: 3661707 - DNA, 13 bp, Homo sapiens
caagcaggaagct

SEQ ID NO: 3661708 - DNA, 14 bp, Homo sapiens
caagcaggaagctc

SEQ ID NO: 3661709 - DNA, 16 bp, Homo sapiens
caagcaggaagctcag

SEQ ID NO: 3661710 - DNA, 15 bp, Homo sapiens
caagcagtcgtgcct

SEQ ID NO: 3661711 - DNA, 19 bp, Homo sapiens
caagcagtcgtgcctgtgt

SEQ ID NO: 3661712 - DNA, 20 bp, Homo sapiens
caagcagtcgtgcctgtgtc

SEQ ID NO: 3661713 - DNA, 22 bp, Homo sapiens
caagcatggaaaatcagtgaca

SEQ ID NO: 3661714 - DNA, 14 bp, Homo sapiens
caagccaagcagcc

SEQ ID NO: 3661715 - DNA, 21 bp, Homo sapiens
caagccaagcagccaagctcc

SEQ ID NO: 3661716 - DNA, 22 bp, Homo sapiens
caagccaagggaacctgtgtcc

SEQ ID NO: 3661717 - DNA, 16 bp, Homo sapiens
caagccagaggctggg

SEQ ID NO: 3661718 - DNA, 19 bp, Homo sapiens
caagcctgtgcaaaaaaat

SEQ ID NO: 3661719 - DNA, 14 bp, Homo sapiens
caagctcctcctcc

SEQ ID NO: 3661720 - DNA, 22 bp, Homo sapiens
caagctccttgggaggccccac

SEQ ID NO: 3661721 - DNA, 14 bp, Homo sapiens
caagctgcaccctc

SEQ ID NO: 3661722 - DNA, 12 bp, Homo sapiens
caagctgtgctg

SEQ ID NO: 3661723 - DNA, 16 bp, Homo sapiens
caagcttagtcctggg

SEQ ID NO: 3661724 - DNA, 17 bp, Homo sapiens
caagcttgtccaacccg

SEQ ID NO: 3661725 - DNA, 13 bp, Homo sapiens
caaggaccaggac

SEQ ID NO: 3661726 - DNA, 14 bp, Homo sapiens
caaggaccaggact

SEQ ID NO: 3661727 - DNA, 15 bp, Homo sapiens
caaggaccaggactc

SEQ ID NO: 3661728 - DNA, 16 bp, Homo sapiens
caaggaccaggactcc

SEQ ID NO: 3661729 - DNA, 19 bp, Homo sapiens
caaggacttcctgtccagc

SEQ ID NO: 3661730 - DNA, 16 bp, Homo sapiens
caaggatagatgctgg

SEQ ID NO: 3661731 - DNA, 22 bp, Homo sapiens
caaggatagatgctggcccagg

SEQ ID NO: 3661732 - DNA, 14 bp, Homo sapiens
caaggccagagtgg

SEQ ID NO: 3661733 - DNA, 22 bp, Homo sapiens
caaggccagagtggcctggcca

SEQ ID NO: 3661734 - DNA, 13 bp, Homo sapiens
caaggccccttcc

SEQ ID NO: 3661735 - DNA, 22 bp, Homo sapiens
caaggccttattggaaagcagt

SEQ ID NO: 3661736 - DNA, 13 bp, Homo sapiens
caaggcggtgctt

SEQ ID NO: 3661737 - DNA, 21 bp, Homo sapiens
caaggctcttctccttggagg

SEQ ID NO: 3661738 - DNA, 22 bp, Homo sapiens
caaggctcttctccttggagga

SEQ ID NO: 3661739 - DNA, 12 bp, Homo sapiens
caaggctgcagt

SEQ ID NO: 3661740 - DNA, 15 bp, Homo sapiens
caaggctgcagtgag

SEQ ID NO: 3661741 - DNA, 17 bp, Homo sapiens
caagggatctggtccta

SEQ ID NO: 3661742 - DNA, 21 bp, Homo sapiens
caagggatctggtcctaccca

SEQ ID NO: 3661743 - DNA, 13 bp, Homo sapiens
caaggtctttaaa

SEQ ID NO: 3661744 - DNA, 21 bp, Homo sapiens
caaggtgctgatgtcaaagtg

SEQ ID NO: 3661745 - DNA, 22 bp, Homo sapiens
caaggtgtggaggctcctgtgg

SEQ ID NO: 3661746 - DNA, 17 bp, Homo sapiens
caaggtttaggctggtg

SEQ ID NO: 3661747 - DNA, 20 bp, Homo sapiens
caaggtttaggctggtggcc

SEQ ID NO: 3661748 - DNA, 21 bp, Homo sapiens
caaggtttaggctggtggccc

SEQ ID NO: 3661749 - DNA, 24 bp, Homo sapiens
caaggtttaggctggtggcccagg

SEQ ID NO: 3661750 - DNA, 14 bp, Homo sapiens
caagtaccaccaag

SEQ ID NO: 3661751 - DNA, 21 bp, Homo sapiens
caagtacttaactatctgttc

SEQ ID NO: 3661752 - DNA, 22 bp, Homo sapiens
caagtacttaactatctgttcc

SEQ ID NO: 3661753 - DNA, 14 bp, Homo sapiens
caagtagcacactg

SEQ ID NO: 3661754 - DNA, 19 bp, Homo sapiens
caagtcctggatgttgtgt

SEQ ID NO: 3661755 - DNA, 22 bp, Homo sapiens
caagtgaaaaaggaggaagaga

SEQ ID NO: 3661756 - DNA, 23 bp, Homo sapiens
caagtgaaaaaggaggaagagaa

SEQ ID NO: 3661757 - DNA, 19 bp, Homo sapiens
caagtgaccgactcattta

SEQ ID NO: 3661758 - DNA, 21 bp, Homo sapiens
caagtgaccgactcatttaca

SEQ ID NO: 3661759 - DNA, 22 bp, Homo sapiens
caagtgaggccggagaggagtt

SEQ ID NO: 3661760 - DNA, 17 bp, Homo sapiens
caagtgattttcattgt

SEQ ID NO: 3661761 - DNA, 14 bp, Homo sapiens
caagtgcacggggc

SEQ ID NO: 3661762 - DNA, 18 bp, Homo sapiens
caagtgccaaacagagta

SEQ ID NO: 3661763 - DNA, 15 bp, Homo sapiens
caagtgcctagactg

SEQ ID NO: 3661764 - DNA, 17 bp, Homo sapiens
caagtgcctagactgtt

SEQ ID NO: 3661765 - DNA, 20 bp, Homo sapiens
caagtgctgaacagtggagg

SEQ ID NO: 3661766 - DNA, 22 bp, Homo sapiens
caagtgtgtgccaccatgcctc

SEQ ID NO: 3661767 - DNA, 16 bp, Homo sapiens
caagtgttcacaacct

SEQ ID NO: 3661768 - DNA, 13 bp, Homo sapiens
caagtgttcactg

SEQ ID NO: 3661769 - DNA, 18 bp, Homo sapiens
caagtgttcactgctcct

SEQ ID NO: 3661770 - DNA, 17 bp, Homo sapiens
caagttgaagactttgt

SEQ ID NO: 3661771 - DNA, 19 bp, Homo sapiens
caagttgaagactttgttt

SEQ ID NO: 3661772 - DNA, 18 bp, Homo sapiens
caagttggatgcggccat

SEQ ID NO: 3661773 - DNA, 20 bp, Homo sapiens
caataaaaacattgcctttg

SEQ ID NO: 3661774 - DNA, 18 bp, Homo sapiens
caataaatctgacccagt

SEQ ID NO: 3661775 - DNA, 21 bp, Homo sapiens
caataatatttcaagtgccta

SEQ ID NO: 3661776 - DNA, 17 bp, Homo sapiens
caatacagtacaggcag

SEQ ID NO: 3661777 - DNA, 18 bp, Homo sapiens
caatacagtacaggcagc

SEQ ID NO: 3661778 - DNA, 19 bp, Homo sapiens
caatacagtacaggcagca

SEQ ID NO: 3661779 - DNA, 19 bp, Homo sapiens
caatattttccatgaaaat

SEQ ID NO: 3661780 - DNA, 15 bp, Homo sapiens
caatcaagtctgttt

SEQ ID NO: 3661781 - DNA, 15 bp, Homo sapiens
caatccaaataaaga

SEQ ID NO: 3661782 - DNA, 14 bp, Homo sapiens
caatcccagttctt

SEQ ID NO: 3661783 - DNA, 20 bp, Homo sapiens
caatcccagttcttcctgca

SEQ ID NO: 3661784 - DNA, 14 bp, Homo sapiens
caatccttaaatat

SEQ ID NO: 3661785 - DNA, 17 bp, Homo sapiens
caatctaacaataatat

SEQ ID NO: 3661786 - DNA, 11 bp, Homo sapiens
caatctgagca

SEQ ID NO: 3661787 - DNA, 16 bp, Homo sapiens
caatctggaagaaaaa

SEQ ID NO: 3661788 - DNA, 18 bp, Homo sapiens
caatctggcttagtgcca

SEQ ID NO: 3661789 - DNA, 14 bp, Homo sapiens
caatgaagccagct

SEQ ID NO: 3661790 - DNA, 15 bp, Homo sapiens
caatggagtattctc

SEQ ID NO: 3661791 - DNA, 19 bp, Homo sapiens
caatggggcggggcttctc

SEQ ID NO: 3661792 - DNA, 15 bp, Homo sapiens
cagcagcaaattttc

SEQ ID NO: 3661793 - DNA, 19 bp, Homo sapiens
cagcagcctggaccctgtg

SEQ ID NO: 3661794 - DNA, 24 bp, Homo sapiens
cagcagggaaaatgcagcagggat

SEQ ID NO: 3661795 - DNA, 18 bp, Homo sapiens
cagcagggagggcttctg

SEQ ID NO: 3661796 - DNA, 16 bp, Homo sapiens
cagcagggatgccctg

SEQ ID NO: 3661797 - DNA, 17 bp, Homo sapiens
cagcatagaagtaactt

SEQ ID NO: 3661798 - DNA, 23 bp, Homo sapiens
cagcatcagggttaagaagactt

SEQ ID NO: 3661799 - DNA, 21 bp, Homo sapiens
cagcattccagcccctctggt

SEQ ID NO: 3661800 - DNA, 12 bp, Homo sapiens
cagccaggagct

SEQ ID NO: 3661801 - DNA, 22 bp, Homo sapiens
cagccaggagctgggcagaagg

SEQ ID NO: 3661802 - DNA, 12 bp, Homo sapiens
cagccaggctgc

SEQ ID NO: 3661803 - DNA, 16 bp, Homo sapiens
cagccaggctgccaag

SEQ ID NO: 3661804 - DNA, 22 bp, Homo sapiens
cagccaggctgccaaggccaga

SEQ ID NO: 3661805 - DNA, 17 bp, Homo sapiens
cagcccaaagaaggaaa

SEQ ID NO: 3661806 - DNA, 17 bp, Homo sapiens
cagcccaagattcttca

SEQ ID NO: 3661807 - DNA, 17 bp, Homo sapiens
cagcccaccagccacct

SEQ ID NO: 3661808 - DNA, 15 bp, Homo sapiens
cagcccacccctcaa

SEQ ID NO: 3661809 - DNA, 18 bp, Homo sapiens
cagcccaccctgctgctg

SEQ ID NO: 3661810 - DNA, 17 bp, Homo sapiens
cagcccagacagcaagg

SEQ ID NO: 3661811 - DNA, 19 bp, Homo sapiens
cagcccatgcccacctgcc

SEQ ID NO: 3661812 - DNA, 11 bp, Homo sapiens
cagccccaccc

SEQ ID NO: 3661813 - DNA, 21 bp, Homo sapiens
cagccccacccaggagggagg

SEQ ID NO: 3661814 - DNA, 18 bp, Homo sapiens
cagccgccattgccacca

SEQ ID NO: 3661815 - DNA, 18 bp, Homo sapiens
cagccggcacagggtctg

SEQ ID NO: 3661816 - DNA, 23 bp, Homo sapiens
cagccggcacagggtctgctctt

SEQ ID NO: 3661817 - DNA, 14 bp, Homo sapiens
cagccgtgagcatg

SEQ ID NO: 3661818 - DNA, 15 bp, Homo sapiens
cagcctatcaggtgc

SEQ ID NO: 3661819 - DNA, 12 bp, Homo sapiens
cagcctccctga

SEQ ID NO: 3661820 - DNA, 16 bp, Homo sapiens
cagcctccctgaagcc

SEQ ID NO: 3661821 - DNA, 17 bp, Homo sapiens
cagcctccctgaagcct

SEQ ID NO: 3661822 - DNA, 14 bp, Homo sapiens
cagcctctccccag

SEQ ID NO: 3661823 - DNA, 19 bp, Homo sapiens
cagcctctccccaggtcca

SEQ ID NO: 3661824 - DNA, 23 bp, Homo sapiens
cagcctctccccaggtccagctc

SEQ ID NO: 3661825 - DNA, 17 bp, Homo sapiens
cagcctgctccagctgt

SEQ ID NO: 3661826 - DNA, 15 bp, Homo sapiens
cagcctggaccctgt

SEQ ID NO: 3661827 - DNA, 14 bp, Homo sapiens
cagcctggccagac

SEQ ID NO: 3661828 - DNA, 20 bp, Homo sapiens
cagcctggccagacacaggc

SEQ ID NO: 3661829 - DNA, 19 bp, Homo sapiens
cagcctgggcagccaggct

SEQ ID NO: 3661830 - DNA, 19 bp, Homo sapiens
cagcctggggtctggagtt

SEQ ID NO: 3661831 - DNA, 15 bp, Homo sapiens
cagcctggtggccca

SEQ ID NO: 3661832 - DNA, 16 bp, Homo sapiens
cagcctggtggcccag

SEQ ID NO: 3661833 - DNA, 20 bp, Homo sapiens
cagccttggtgggggagcct

SEQ ID NO: 3661834 - DNA, 22 bp, Homo sapiens
cagccttggtgggggagcctct

SEQ ID NO: 3661835 - DNA, 24 bp, Homo sapiens
cagccttggtgggggagcctctgg

SEQ ID NO: 3661836 - DNA, 14 bp, Homo sapiens
cagcctttgggaaa

SEQ ID NO: 3661837 - DNA, 20 bp, Homo sapiens
cagcgatctctccactgtgc

SEQ ID NO: 3661838 - DNA, 21 bp, Homo sapiens
cagcgcccctcagcctctgcc

SEQ ID NO: 3661839 - DNA, 22 bp, Homo sapiens
cagcgcctttcccaactctagc

SEQ ID NO: 3661840 - DNA, 13 bp, Homo sapiens
cagcgggcaggtt

SEQ ID NO: 3661841 - DNA, 15 bp, Homo sapiens
cagcggtttcctggt

SEQ ID NO: 3661842 - DNA, 13 bp, Homo sapiens
cagcgtgccgagc

SEQ ID NO: 3661843 - DNA, 23 bp, Homo sapiens
cagcgtgccgagccagcaagagg

SEQ ID NO: 3661844 - DNA, 14 bp, Homo sapiens
cagctaagaacctg

SEQ ID NO: 3661845 - DNA, 19 bp, Homo sapiens
cagctaagaacctggaact

SEQ ID NO: 3661846 - DNA, 23 bp, Homo sapiens
cagctaccaccacggccaccact

SEQ ID NO: 3661847 - DNA, 19 bp, Homo sapiens
cagctactcgggaggctga

SEQ ID NO: 3661848 - DNA, 23 bp, Homo sapiens
cagctatgggagccccagggtct

SEQ ID NO: 3661849 - DNA, 19 bp, Homo sapiens
cagctattaccacacttgg

SEQ ID NO: 3661850 - DNA, 12 bp, Homo sapiens
cagctcaggaca

SEQ ID NO: 3661851 - DNA, 14 bp, Homo sapiens
cagctccaacctgc

SEQ ID NO: 3661852 - DNA, 23 bp, Homo sapiens
cagctccaacctgcaaagatctg

SEQ ID NO: 3661853 - DNA, 14 bp, Homo sapiens
cagctccattttct

SEQ ID NO: 3661854 - DNA, 21 bp, Homo sapiens
cagctctggacagccccaccc

SEQ ID NO: 3661855 - DNA, 11 bp, Homo sapiens
cagctctggag

SEQ ID NO: 3661856 - DNA, 18 bp, Homo sapiens
cagctctggaggggaggg

SEQ ID NO: 3661857 - DNA, 15 bp, Homo sapiens
cagctctgtgggccc

SEQ ID NO: 3661858 - DNA, 19 bp, Homo sapiens
cagctgagggtgagtgggt

SEQ ID NO: 3661859 - DNA, 14 bp, Homo sapiens
cagctgcctcactt

SEQ ID NO: 3661860 - DNA, 12 bp, Homo sapiens
cagctgctccta

SEQ ID NO: 3661861 - DNA, 19 bp, Homo sapiens
cagctgctcctagagggag

SEQ ID NO: 3661862 - DNA, 17 bp, Homo sapiens
cagctggaattatgctg

SEQ ID NO: 3661863 - DNA, 14 bp, Homo sapiens
cagctggcagcaga

SEQ ID NO: 3661864 - DNA, 16 bp, Homo sapiens
cagctgggttggaaaa

SEQ ID NO: 3661865 - DNA, 24 bp, Homo sapiens
cagctgtcccttgcttgcctgcag

SEQ ID NO: 3661866 - DNA, 16 bp, Homo sapiens
cagctgtgtctgagcc

SEQ ID NO: 3661867 - DNA, 18 bp, Homo sapiens
cagctgtgtctgagccca

SEQ ID NO: 3661868 - DNA, 21 bp, Homo sapiens
cagctgtgtctgagcccaacc

SEQ ID NO: 3661869 - DNA, 23 bp, Homo sapiens
cagctgtgtctgagcccaaccct

SEQ ID NO: 3661870 - DNA, 15 bp, Homo sapiens
cagctgttcagctgg

SEQ ID NO: 3661871 - DNA, 19 bp, Homo sapiens
cagctgttcagctggttga

SEQ ID NO: 3661872 - DNA, 16 bp, Homo sapiens
cagcttctcctgtgtg

SEQ ID NO: 3661873 - DNA, 22 bp, Homo sapiens
cagcttgacctgaggctgtggt

SEQ ID NO: 3661874 - DNA, 23 bp, Homo sapiens
cagcttgacctgaggctgtggtc

SEQ ID NO: 3661875 - DNA, 16 bp, Homo sapiens
cagctttgaggaacat

SEQ ID NO: 3661876 - DNA, 19 bp, Homo sapiens
cagctttgaggaacatgca

SEQ ID NO: 3661877 - DNA, 12 bp, Homo sapiens
cagctttgctgc

SEQ ID NO: 3661878 - DNA, 13 bp, Homo sapiens
cagctttgctgct

SEQ ID NO: 3661879 - DNA, 12 bp, Homo sapiens
cagctttgtttg

SEQ ID NO: 3661880 - DNA, 14 bp, Homo sapiens
caggaacagctatg

SEQ ID NO: 3661881 - DNA, 22 bp, Homo sapiens
caggaacagctatgggagcccc

SEQ ID NO: 3661882 - DNA, 19 bp, Homo sapiens
caggaaccacaccacatct

SEQ ID NO: 3661883 - DNA, 17 bp, Homo sapiens
caggaagcaccccatgc

SEQ ID NO: 3661884 - DNA, 14 bp, Homo sapiens
caggaagggaagcg

SEQ ID NO: 3661885 - DNA, 15 bp, Homo sapiens
caggaagggaagcgt

SEQ ID NO: 3661886 - DNA, 17 bp, Homo sapiens
caggaatattttccaaa

SEQ ID NO: 3661887 - DNA, 15 bp, Homo sapiens
caggaatcttaaggt

SEQ ID NO: 3661888 - DNA, 21 bp, Homo sapiens
caggaatttcccaggaccctg

SEQ ID NO: 3661889 - DNA, 18 bp, Homo sapiens
caggacaacgaggaagcc

SEQ ID NO: 3661890 - DNA, 19 bp, Homo sapiens
caggacaacgaggaagccc

SEQ ID NO: 3661891 - DNA, 14 bp, Homo sapiens
caggacagatgcca

SEQ ID NO: 3661892 - DNA, 17 bp, Homo sapiens
caggacagatgccacac

SEQ ID NO: 3661893 - DNA, 13 bp, Homo sapiens
caggaccagctca

SEQ ID NO: 3661894 - DNA, 16 bp, Homo sapiens
caggacccaccactgg

SEQ ID NO: 3661895 - DNA, 19 bp, Homo sapiens
caggacccaccactggaag

SEQ ID NO: 3661896 - DNA, 22 bp, Homo sapiens
caggacccaccactggaagcag

SEQ ID NO: 3661897 - DNA, 15 bp, Homo sapiens
caggaccctgaaggg

SEQ ID NO: 3661898 - DNA, 20 bp, Homo sapiens
caggactatatttgggcctg

SEQ ID NO: 3661899 - DNA, 14 bp, Homo sapiens
caggactccctcct

SEQ ID NO: 3661900 - DNA, 15 bp, Homo sapiens
caggactccctcctc

SEQ ID NO: 3661901 - DNA, 17 bp, Homo sapiens
caggactccctcctcac

SEQ ID NO: 3661902 - DNA, 19 bp, Homo sapiens
caggactccctcctcacct

SEQ ID NO: 3661903 - DNA, 19 bp, Homo sapiens
caggactttgaggcaagtg

SEQ ID NO: 3661904 - DNA, 13 bp, Homo sapiens
caggagcaagtga

SEQ ID NO: 3661905 - DNA, 19 bp, Homo sapiens
caggagcaagtgaggccgg

SEQ ID NO: 3661906 - DNA, 20 bp, Homo sapiens
caggagcaagtgaggccgga

SEQ ID NO: 3661907 - DNA, 18 bp, Homo sapiens
caggagcaccctgtcttc

SEQ ID NO: 3661908 - DNA, 15 bp, Homo sapiens
catttcggtggctag

SEQ ID NO: 3661909 - DNA, 23 bp, Homo sapiens
catttctagaacatccctgccag

SEQ ID NO: 3661910 - DNA, 18 bp, Homo sapiens
catttctgaactgttaca

SEQ ID NO: 3661911 - DNA, 20 bp, Homo sapiens
catttgatgcatgtctttta

SEQ ID NO: 3661912 - DNA, 17 bp, Homo sapiens
catttgattaacatttg

SEQ ID NO: 3661913 - DNA, 18 bp, Homo sapiens
catttggccggctctggt

SEQ ID NO: 3661914 - DNA, 17 bp, Homo sapiens
catttggggtagctaga

SEQ ID NO: 3661915 - DNA, 16 bp, Homo sapiens
catttgtgctagaaat

SEQ ID NO: 3661916 - DNA, 20 bp, Homo sapiens
catttgtgctagaaattttc

SEQ ID NO: 3661917 - DNA, 13 bp, Homo sapiens
catttgttaaaat

SEQ ID NO: 3661918 - DNA, 13 bp, Homo sapiens
cattttaaaaaca

SEQ ID NO: 3661919 - DNA, 12 bp, Homo sapiens
cattttcagagt

SEQ ID NO: 3661920 - DNA, 17 bp, Homo sapiens
cattttccccccactct

SEQ ID NO: 3661921 - DNA, 20 bp, Homo sapiens
cattttcttattgcgctgct

SEQ ID NO: 3661922 - DNA, 18 bp, Homo sapiens
cattttgctaaatgtgaa

SEQ ID NO: 3661923 - DNA, 21 bp, Homo sapiens
cattttgctaaatgtgaatga

SEQ ID NO: 3661924 - DNA, 24 bp, Homo sapiens
cattttgctaaatgtgaatgatga

SEQ ID NO: 3661925 - DNA, 21 bp, Homo sapiens
cattttgtaagttatgtttta

SEQ ID NO: 3661926 - DNA, 18 bp, Homo sapiens
catttttaccatcactga

SEQ ID NO: 3661927 - DNA, 13 bp, Homo sapiens
catttttgtaaat

SEQ ID NO: 3661928 - DNA, 16 bp, Homo sapiens
catttttgtctgtcct

SEQ ID NO: 3661929 - DNA, 17 bp, Homo sapiens
ccaaaataccagagcct

SEQ ID NO: 3661930 - DNA, 16 bp, Homo sapiens
ccaaaatctcaagaaa

SEQ ID NO: 3661931 - DNA, 13 bp, Homo sapiens
ccaaaccggcagg

SEQ ID NO: 3661932 - DNA, 16 bp, Homo sapiens
ccaaaccggcaggtgc

SEQ ID NO: 3661933 - DNA, 14 bp, Homo sapiens
ccaaactgcctaag

SEQ ID NO: 3661934 - DNA, 19 bp, Homo sapiens
ccaaactgcctaagccctc

SEQ ID NO: 3661935 - DNA, 21 bp, Homo sapiens
ccaaacttctgaactttggaa

SEQ ID NO: 3661936 - DNA, 15 bp, Homo sapiens
ccaaagagtgatagt

SEQ ID NO: 3661937 - DNA, 22 bp, Homo sapiens
ccaaagcctcctccagccgcca

SEQ ID NO: 3661938 - DNA, 14 bp, Homo sapiens
ccaaagctgagcct

SEQ ID NO: 3661939 - DNA, 15 bp, Homo sapiens
ccaaagctgagcctg

SEQ ID NO: 3661940 - DNA, 13 bp, Homo sapiens
ccaaagctttcct

SEQ ID NO: 3661941 - DNA, 14 bp, Homo sapiens
ccaaagctttcctg

SEQ ID NO: 3661942 - DNA, 15 bp, Homo sapiens
ccaaagctttcctgc

SEQ ID NO: 3661943 - DNA, 12 bp, Homo sapiens
ccaaaggaggct

SEQ ID NO: 3661944 - DNA, 17 bp, Homo sapiens
ccaaaggaggctggcag

SEQ ID NO: 3661945 - DNA, 15 bp, Homo sapiens
ccaaaggctggtggc

SEQ ID NO: 3661946 - DNA, 16 bp, Homo sapiens
ccaaataaagataacc

SEQ ID NO: 3661947 - DNA, 15 bp, Homo sapiens
ccaaatcacccaatc

SEQ ID NO: 3661948 - DNA, 19 bp, Homo sapiens
ccaaatcacccaatcccag

SEQ ID NO: 3661949 - DNA, 14 bp, Homo sapiens
ccaacacatttcac

SEQ ID NO: 3661950 - DNA, 16 bp, Homo sapiens
ccaacccccaccccac

SEQ ID NO: 3661951 - DNA, 17 bp, Homo sapiens
ccaacctgcaaagatct

SEQ ID NO: 3661952 - DNA, 18 bp, Homo sapiens
ccaacctgcaaagatctg

SEQ ID NO: 3661953 - DNA, 19 bp, Homo sapiens
ccaacctgcaaagatctgt

SEQ ID NO: 3661954 - DNA, 15 bp, Homo sapiens
ccaagaaagatgtat

SEQ ID NO: 3661955 - DNA, 22 bp, Homo sapiens
ccaagaacggcttggcagccag

SEQ ID NO: 3661956 - DNA, 18 bp, Homo sapiens
ccaagaatgtacgtccag

SEQ ID NO: 3661957 - DNA, 22 bp, Homo sapiens
ccaagaccaagcttagtcctgg

SEQ ID NO: 3661958 - DNA, 19 bp, Homo sapiens
ccaagcactttcagtccaa

SEQ ID NO: 3661959 - DNA, 12 bp, Homo sapiens
ccaagcagccaa

SEQ ID NO: 3661960 - DNA, 16 bp, Homo sapiens
ccaagcagccaagctc

SEQ ID NO: 3661961 - DNA, 20 bp, Homo sapiens
ccaagccaagggaacctgtg

SEQ ID NO: 3661962 - DNA, 15 bp, Homo sapiens
ccaagctccaagccc

SEQ ID NO: 3661963 - DNA, 22 bp, Homo sapiens
ccaagctccttgggaggcccca

SEQ ID NO: 3661964 - DNA, 20 bp, Homo sapiens
ccaagctgtgctgggaagcc

SEQ ID NO: 3661965 - DNA, 12 bp, Homo sapiens
ccaaggagctgc

SEQ ID NO: 3661966 - DNA, 13 bp, Homo sapiens
ccaaggagctgct

SEQ ID NO: 3661967 - DNA, 14 bp, Homo sapiens
ccaaggagctgcta

SEQ ID NO: 3661968 - DNA, 22 bp, Homo sapiens
ccaaggctcttctccttggagg

SEQ ID NO: 3661969 - DNA, 16 bp, Homo sapiens
ccaagggaacctgtgt

SEQ ID NO: 3661970 - DNA, 17 bp, Homo sapiens
ccaagggaacctgtgtc

SEQ ID NO: 3661971 - DNA, 13 bp, Homo sapiens
ccaagggatctgg

SEQ ID NO: 3661972 - DNA, 21 bp, Homo sapiens
ccaagggatctggtcctaccc

SEQ ID NO: 3661973 - DNA, 14 bp, Homo sapiens
ccaaggtgctgatg

SEQ ID NO: 3661974 - DNA, 20 bp, Homo sapiens
ccaaggtgggtagatcacga

SEQ ID NO: 3661975 - DNA, 22 bp, Homo sapiens
ccaatagttgttgattggcagg

SEQ ID NO: 3661976 - DNA, 21 bp, Homo sapiens
ccaatggggcggggcttctct

SEQ ID NO: 3661977 - DNA, 20 bp, Homo sapiens
ccaatgggtttttccctgta

SEQ ID NO: 3661978 - DNA, 20 bp, Homo sapiens
ccaatgttctctcttctcca

SEQ ID NO: 3661979 - DNA, 18 bp, Homo sapiens
ccaattcttacaaacatg

SEQ ID NO: 3661980 - DNA, 23 bp, Homo sapiens
ccaattttaatttagtaaatgtt

SEQ ID NO: 3661981 - DNA, 22 bp, Homo sapiens
ccacaaagctaggatggttctg

SEQ ID NO: 3661982 - DNA, 17 bp, Homo sapiens
ccacaactattttcaga

SEQ ID NO: 3661983 - DNA, 17 bp, Homo sapiens
ccacaaggacttcctgt

SEQ ID NO: 3661984 - DNA, 20 bp, Homo sapiens
ccacaagtgccgcaaattgt

SEQ ID NO: 3661985 - DNA, 13 bp, Homo sapiens
ccacaatctggct

SEQ ID NO: 3661986 - DNA, 21 bp, Homo sapiens
ccacaatctggcttagtgcca

SEQ ID NO: 3661987 - DNA, 20 bp, Homo sapiens
ccacacaaggatagatgctg

SEQ ID NO: 3661988 - DNA, 14 bp, Homo sapiens
ccacacaggctggc

SEQ ID NO: 3661989 - DNA, 21 bp, Homo sapiens
ccacacttgttccagctcttt

SEQ ID NO: 3661990 - DNA, 15 bp, Homo sapiens
ccacagccagcacct

SEQ ID NO: 3661991 - DNA, 17 bp, Homo sapiens
ccacagccagcacctgg

SEQ ID NO: 3661992 - DNA, 13 bp, Homo sapiens
ccacagcccctta

SEQ ID NO: 3661993 - DNA, 13 bp, Homo sapiens
ccacagccctgag

SEQ ID NO: 3661994 - DNA, 17 bp, Homo sapiens
ccacagcgtgggaactc

SEQ ID NO: 3661995 - DNA, 22 bp, Homo sapiens
ccacatctaagcctgaaggggc

SEQ ID NO: 3661996 - DNA, 23 bp, Homo sapiens
ccacatctaagcctgaaggggcg

SEQ ID NO: 3661997 - DNA, 14 bp, Homo sapiens
ccaccaaaaacaaa

SEQ ID NO: 3661998 - DNA, 14 bp, Homo sapiens
ccaccacagccagc

SEQ ID NO: 3661999 - DNA, 20 bp, Homo sapiens
ccaccacagccagcacctgg

SEQ ID NO: 3662000 - DNA, 19 bp, Homo sapiens
ccaccaggagaaccactac

SEQ ID NO: 3662001 - DNA, 20 bp, Homo sapiens
ccaccaggctgctcagggct

SEQ ID NO: 3662002 - DNA, 16 bp, Homo sapiens
ccaccaggtgcctttc

SEQ ID NO: 3662003 - DNA, 12 bp, Homo sapiens
ccacccacctga

SEQ ID NO: 3662004 - DNA, 15 bp, Homo sapiens
ccacccacctgacca

SEQ ID NO: 3662005 - DNA, 12 bp, Homo sapiens
ccacccaggagg

SEQ ID NO: 3662006 - DNA, 12 bp, Homo sapiens
ccaccccacact

SEQ ID NO: 3662007 - DNA, 20 bp, Homo sapiens
ccaccccgggctctctgctg

SEQ ID NO: 3662008 - DNA, 13 bp, Homo sapiens
ccacccctccaga

SEQ ID NO: 3662009 - DNA, 21 bp, Homo sapiens
ccacccctgcgtcgagctggg

SEQ ID NO: 3662010 - DNA, 20 bp, Homo sapiens
ccacccctgggggctctcat

SEQ ID NO: 3662011 - DNA, 15 bp, Homo sapiens
ccaccccttcctcag

SEQ ID NO: 3662012 - DNA, 21 bp, Homo sapiens
ccaccccttcctcagcctggg

SEQ ID NO: 3662013 - DNA, 13 bp, Homo sapiens
ccaccctgcctgc

SEQ ID NO: 3662014 - DNA, 14 bp, Homo sapiens
ccaccctgctgctg

SEQ ID NO: 3662015 - DNA, 18 bp, Homo sapiens
ccaccctgctgctggtgc

SEQ ID NO: 3662016 - DNA, 21 bp, Homo sapiens
ccaccctgctgctggtgcaca

SEQ ID NO: 3662017 - DNA, 13 bp, Homo sapiens
ccaccctgggccc

SEQ ID NO: 3662018 - DNA, 16 bp, Homo sapiens
ccaccctgggccctgg

SEQ ID NO: 3662019 - DNA, 17 bp, Homo sapiens
ccaccctgggccctggg

SEQ ID NO: 3662020 - DNA, 22 bp, Homo sapiens
ccaccctgggccctgggctgga

SEQ ID NO: 3662021 - DNA, 12 bp, Homo sapiens
ccacccttggcc

SEQ ID NO: 3662022 - DNA, 14 bp, Homo sapiens
ccacccttggcctg

SEQ ID NO: 3662023 - DNA, 19 bp, Homo sapiens
ccacctcacctagcctgat

SEQ ID NO: 3662024 - DNA, 16 bp, Homo sapiens
ccacctcatccccaac

SEQ ID NO: 3662025 - DNA, 15 bp, Homo sapiens
ccctggacagaggcg

SEQ ID NO: 3662026 - DNA, 23 bp, Homo sapiens
ccctggacagaggcggggctaca

SEQ ID NO: 3662027 - DNA, 14 bp, Homo sapiens
ccctggagaagcac

SEQ ID NO: 3662028 - DNA, 18 bp, Homo sapiens
ccctggagaagcaccagc

SEQ ID NO: 3662029 - DNA, 13 bp, Homo sapiens
ccctggaggtggc

SEQ ID NO: 3662030 - DNA, 14 bp, Homo sapiens
ccctggctgccggc

SEQ ID NO: 3662031 - DNA, 18 bp, Homo sapiens
ccctgggatccgagggcc

SEQ ID NO: 3662032 - DNA, 16 bp, Homo sapiens
ccctgggccctgggct

SEQ ID NO: 3662033 - DNA, 13 bp, Homo sapiens
ccctgggctgaga

SEQ ID NO: 3662034 - DNA, 21 bp, Homo sapiens
ccctgggggcacaggaggcag

SEQ ID NO: 3662035 - DNA, 11 bp, Homo sapiens
ccctgggggcg

SEQ ID NO: 3662036 - DNA, 13 bp, Homo sapiens
ccctgggggcggg

SEQ ID NO: 3662037 - DNA, 14 bp, Homo sapiens
ccctgggggtgggg

SEQ ID NO: 3662038 - DNA, 17 bp, Homo sapiens
ccctgggtggagcagga

SEQ ID NO: 3662039 - DNA, 21 bp, Homo sapiens
ccctgggtggagcaggactcc

SEQ ID NO: 3662040 - DNA, 20 bp, Homo sapiens
ccctgggtgtccccgctgct

SEQ ID NO: 3662041 - DNA, 22 bp, Homo sapiens
ccctgtaaggttccatccaccc

SEQ ID NO: 3662042 - DNA, 20 bp, Homo sapiens
ccctgtctagagagggaggc

SEQ ID NO: 3662043 - DNA, 20 bp, Homo sapiens
ccctgtctcaaaaaaagaaa

SEQ ID NO: 3662044 - DNA, 15 bp, Homo sapiens
ccctgtgttgtctct

SEQ ID NO: 3662045 - DNA, 17 bp, Homo sapiens
ccctgtgttgtctctag

SEQ ID NO: 3662046 - DNA, 14 bp, Homo sapiens
ccctgttccccaga

SEQ ID NO: 3662047 - DNA, 17 bp, Homo sapiens
cccttaccccttagcct

SEQ ID NO: 3662048 - DNA, 15 bp, Homo sapiens
cccttacctgtgacc

SEQ ID NO: 3662049 - DNA, 22 bp, Homo sapiens
cccttacctgtgaccctctttg

SEQ ID NO: 3662050 - DNA, 20 bp, Homo sapiens
cccttcacaaagcccaaggg

SEQ ID NO: 3662051 - DNA, 18 bp, Homo sapiens
cccttccaaatgtccctc

SEQ ID NO: 3662052 - DNA, 22 bp, Homo sapiens
cccttccaaatgtccctccaac

SEQ ID NO: 3662053 - DNA, 17 bp, Homo sapiens
cccttcccctccctggc

SEQ ID NO: 3662054 - DNA, 19 bp, Homo sapiens
cccttcccctccctggctc

SEQ ID NO: 3662055 - DNA, 19 bp, Homo sapiens
cccttcccttgagccctct

SEQ ID NO: 3662056 - DNA, 17 bp, Homo sapiens
cccttcctctgtgccac

SEQ ID NO: 3662057 - DNA, 19 bp, Homo sapiens
cccttcctctgtgccacgc

SEQ ID NO: 3662058 - DNA, 22 bp, Homo sapiens
cccttcctgctgcgcagttctc

SEQ ID NO: 3662059 - DNA, 23 bp, Homo sapiens
cccttctctgctccaccacatcc

SEQ ID NO: 3662060 - DNA, 12 bp, Homo sapiens
cccttgaactct

SEQ ID NO: 3662061 - DNA, 17 bp, Homo sapiens
cccttgacaactggcag

SEQ ID NO: 3662062 - DNA, 17 bp, Homo sapiens
cccttgagccctctatg

SEQ ID NO: 3662063 - DNA, 19 bp, Homo sapiens
cccttgatttaaacacaca

SEQ ID NO: 3662064 - DNA, 19 bp, Homo sapiens
cccttgcagctagttttct

SEQ ID NO: 3662065 - DNA, 18 bp, Homo sapiens
cccttgcttgcctgcagg

SEQ ID NO: 3662066 - DNA, 14 bp, Homo sapiens
cccttggcctcaga

SEQ ID NO: 3662067 - DNA, 19 bp, Homo sapiens
cccttggcctgtctcatcc

SEQ ID NO: 3662068 - DNA, 15 bp, Homo sapiens
cccttgtcccactca

SEQ ID NO: 3662069 - DNA, 13 bp, Homo sapiens
ccgacatggctcc

SEQ ID NO: 3662070 - DNA, 13 bp, Homo sapiens
ccgagaaggttta

SEQ ID NO: 3662071 - DNA, 21 bp, Homo sapiens
ccgagaggtgggccagtctgt

SEQ ID NO: 3662072 - DNA, 19 bp, Homo sapiens
ccgagattgcaccactgca

SEQ ID NO: 3662073 - DNA, 16 bp, Homo sapiens
ccgagggtcctggctc

SEQ ID NO: 3662074 - DNA, 18 bp, Homo sapiens
ccgatagagggacggcca

SEQ ID NO: 3662075 - DNA, 13 bp, Homo sapiens
ccgattcaccctg

SEQ ID NO: 3662076 - DNA, 15 bp, Homo sapiens
ccgcagacaccttgg

SEQ ID NO: 3662077 - DNA, 16 bp, Homo sapiens
ccgcagacaccttgga

SEQ ID NO: 3662078 - DNA, 13 bp, Homo sapiens
ccgcaggaagctg

SEQ ID NO: 3662079 - DNA, 19 bp, Homo sapiens
ccgcaggaagctgctccgt

SEQ ID NO: 3662080 - DNA, 14 bp, Homo sapiens
ccgccaggaaggcc

SEQ ID NO: 3662081 - DNA, 20 bp, Homo sapiens
ccgccattctcaagccctgc

SEQ ID NO: 3662082 - DNA, 21 bp, Homo sapiens
ccgccattctcaagccctgca

SEQ ID NO: 3662083 - DNA, 15 bp, Homo sapiens
ccgccattgccacca

SEQ ID NO: 3662084 - DNA, 19 bp, Homo sapiens
ccgccattgccaccaggag

SEQ ID NO: 3662085 - DNA, 13 bp, Homo sapiens
ccgccctgccact

SEQ ID NO: 3662086 - DNA, 15 bp, Homo sapiens
ccgccctgccactca

SEQ ID NO: 3662087 - DNA, 21 bp, Homo sapiens
ccgccctgtgtgtgtcccctc

SEQ ID NO: 3662088 - DNA, 12 bp, Homo sapiens
ccgctgccaccc

SEQ ID NO: 3662089 - DNA, 14 bp, Homo sapiens
ccgctgctgtgcaa

SEQ ID NO: 3662090 - DNA, 13 bp, Homo sapiens
ccgctttcctgga

SEQ ID NO: 3662091 - DNA, 15 bp, Homo sapiens
ccgctttcctggagc

SEQ ID NO: 3662092 - DNA, 13 bp, Homo sapiens
ccggactgaccaa

SEQ ID NO: 3662093 - DNA, 17 bp, Homo sapiens
ccggcagttctgggtgc

SEQ ID NO: 3662094 - DNA, 17 bp, Homo sapiens
ccggcccatatccctgg

SEQ ID NO: 3662095 - DNA, 14 bp, Homo sapiens
ccggcccccttcct

SEQ ID NO: 3662096 - DNA, 17 bp, Homo sapiens
ccggcccccttcctggc

SEQ ID NO: 3662097 - DNA, 15 bp, Homo sapiens
ccggcccctcctgac

SEQ ID NO: 3662098 - DNA, 12 bp, Homo sapiens
ccggccctgggg

SEQ ID NO: 3662099 - DNA, 14 bp, Homo sapiens
ccggccctgtgtgc

SEQ ID NO: 3662100 - DNA, 20 bp, Homo sapiens
ccggccgcggctccccctgg

SEQ ID NO: 3662101 - DNA, 12 bp, Homo sapiens
ccggctccagag

SEQ ID NO: 3662102 - DNA, 18 bp, Homo sapiens
ccggctctggtggccact

SEQ ID NO: 3662103 - DNA, 15 bp, Homo sapiens
ccgggctcccacacc

SEQ ID NO: 3662104 - DNA, 19 bp, Homo sapiens
ccggggactcccaggctgg

SEQ ID NO: 3662105 - DNA, 17 bp, Homo sapiens
ccgtatctccctggaga

SEQ ID NO: 3662106 - DNA, 17 bp, Homo sapiens
ccgtcaggtactcctgc

SEQ ID NO: 3662107 - DNA, 22 bp, Homo sapiens
ccgtcaggtactcctgccaggg

SEQ ID NO: 3662108 - DNA, 20 bp, Homo sapiens
ccgtctccaggggctgcttc

SEQ ID NO: 3662109 - DNA, 17 bp, Homo sapiens
ccgtctctgctctgctc

SEQ ID NO: 3662110 - DNA, 18 bp, Homo sapiens
ccgtgctgacagctgctc

SEQ ID NO: 3662111 - DNA, 20 bp, Homo sapiens
ccgtgcttgtttgctcacct

SEQ ID NO: 3662112 - DNA, 23 bp, Homo sapiens
ccgtgcttgtttgctcacctggg

SEQ ID NO: 3662113 - DNA, 23 bp, Homo sapiens
ccgtggctgttgacgcacctgtg

SEQ ID NO: 3662114 - DNA, 23 bp, Homo sapiens
ccgtggggcagggagctgggccc

SEQ ID NO: 3662115 - DNA, 19 bp, Homo sapiens
ccgtgtcctctccctgcca

SEQ ID NO: 3662116 - DNA, 22 bp, Homo sapiens
ccgtgtgagaagtgaatgctgg

SEQ ID NO: 3662117 - DNA, 14 bp, Homo sapiens
ccgttagctcctgt

SEQ ID NO: 3662118 - DNA, 15 bp, Homo sapiens
ccgttagctcctgtg

SEQ ID NO: 3662119 - DNA, 17 bp, Homo sapiens
ccgttagctcctgtggc

SEQ ID NO: 3662120 - DNA, 18 bp, Homo sapiens
ccgttagctcctgtggcc

SEQ ID NO: 3662121 - DNA, 20 bp, Homo sapiens
cctaaacggggcagtactcc

SEQ ID NO: 3662122 - DNA, 22 bp, Homo sapiens
cctaaacggggcagtactcctc

SEQ ID NO: 3662123 - DNA, 20 bp, Homo sapiens
cctaaagaaaaatatcttgg

SEQ ID NO: 3662124 - DNA, 21 bp, Homo sapiens
cctaagatctcggtttgccaa

SEQ ID NO: 3662125 - DNA, 22 bp, Homo sapiens
cctaaggctgcaaggtttaggc

SEQ ID NO: 3662126 - DNA, 14 bp, Homo sapiens
cctaatccaggcag

SEQ ID NO: 3662127 - DNA, 15 bp, Homo sapiens
cctaatccaggcaga

SEQ ID NO: 3662128 - DNA, 19 bp, Homo sapiens
cctaatccaggcagatcca

SEQ ID NO: 3662129 - DNA, 20 bp, Homo sapiens
cctaatctatggtcgggaga

SEQ ID NO: 3662130 - DNA, 17 bp, Homo sapiens
cctacaagagcagcctg

SEQ ID NO: 3662131 - DNA, 11 bp, Homo sapiens
cctacagtgaa

SEQ ID NO: 3662132 - DNA, 12 bp, Homo sapiens
cctacagtgaaa

SEQ ID NO: 3662133 - DNA, 22 bp, Homo sapiens
cctacagttgaaaaacagctga

SEQ ID NO: 3662134 - DNA, 20 bp, Homo sapiens
cctaccccgcagacaccttg

SEQ ID NO: 3662135 - DNA, 19 bp, Homo sapiens
cctaccctcctgctgagct

SEQ ID NO: 3662136 - DNA, 20 bp, Homo sapiens
cctaccctcctgctgagctg

SEQ ID NO: 3662137 - DNA, 22 bp, Homo sapiens
cctacctgaaggcagggctcct

SEQ ID NO: 3662138 - DNA, 17 bp, Homo sapiens
cctacttagggaagaaa

SEQ ID NO: 3662139 - DNA, 19 bp, Homo sapiens
cctacttagggaagaaaaa

SEQ ID NO: 3662140 - DNA, 20 bp, Homo sapiens
cctacttagggaagaaaaag

SEQ ID NO: 3662141 - DNA, 17 bp, Homo sapiens
cctttcctccgcctgtc

SEQ ID NO: 3662142 - DNA, 12 bp, Homo sapiens
cctttcctggaa

SEQ ID NO: 3662143 - DNA, 13 bp, Homo sapiens
cctttctggaagt

SEQ ID NO: 3662144 - DNA, 20 bp, Homo sapiens
cctttctggaagtttctggt

SEQ ID NO: 3662145 - DNA, 18 bp, Homo sapiens
cctttgaatgttaatttt

SEQ ID NO: 3662146 - DNA, 11 bp, Homo sapiens
cctttggcttc

SEQ ID NO: 3662147 - DNA, 15 bp, Homo sapiens
ccttttctggcaccg

SEQ ID NO: 3662148 - DNA, 17 bp, Homo sapiens
cgaaggtcccacagccc

SEQ ID NO: 3662149 - DNA, 19 bp, Homo sapiens
cgacttgtttttgcacatg

SEQ ID NO: 3662150 - DNA, 13 bp, Homo sapiens
cgactttctgcct

SEQ ID NO: 3662151 - DNA, 14 bp, Homo sapiens
cgactttctgcctg

SEQ ID NO: 3662152 - DNA, 15 bp, Homo sapiens
cgactttctgcctgg

SEQ ID NO: 3662153 - DNA, 13 bp, Homo sapiens
cgagaccagcctg

SEQ ID NO: 3662154 - DNA, 18 bp, Homo sapiens
cgagacttggtttcaaaa

SEQ ID NO: 3662155 - DNA, 19 bp, Homo sapiens
cgagaggccaaaggctggt

SEQ ID NO: 3662156 - DNA, 19 bp, Homo sapiens
cgagaggtgggccagtctg

SEQ ID NO: 3662157 - DNA, 20 bp, Homo sapiens
cgagaggtgggccagtctgt

SEQ ID NO: 3662158 - DNA, 22 bp, Homo sapiens
cgagaggtgggccagtctgtgg

SEQ ID NO: 3662159 - DNA, 16 bp, Homo sapiens
cgagctgggaaggttc

SEQ ID NO: 3662160 - DNA, 22 bp, Homo sapiens
cgaggggcctttgttctggggg

SEQ ID NO: 3662161 - DNA, 15 bp, Homo sapiens
cgagggtcctggctc

SEQ ID NO: 3662162 - DNA, 23 bp, Homo sapiens
cgagggtcctggctcctgagggg

SEQ ID NO: 3662163 - DNA, 19 bp, Homo sapiens
cgatactgcgactttctgc

SEQ ID NO: 3662164 - DNA, 21 bp, Homo sapiens
cgatgggcccaattcttacaa

SEQ ID NO: 3662165 - DNA, 17 bp, Homo sapiens
cgatgttattagatgtt

SEQ ID NO: 3662166 - DNA, 13 bp, Homo sapiens
cgattttgtctac

SEQ ID NO: 3662167 - DNA, 15 bp, Homo sapiens
cgcaccattctgact

SEQ ID NO: 3662168 - DNA, 12 bp, Homo sapiens
cgcacctcccat

SEQ ID NO: 3662169 - DNA, 16 bp, Homo sapiens
cgcacctcccatccta

SEQ ID NO: 3662170 - DNA, 23 bp, Homo sapiens
cgcacttcgggaggtcgaggcag

SEQ ID NO: 3662171 - DNA, 12 bp, Homo sapiens
cgcaggaagctg

SEQ ID NO: 3662172 - DNA, 23 bp, Homo sapiens
cgcagtgtgcactaaggggcccg

SEQ ID NO: 3662173 - DNA, 15 bp, Homo sapiens
cgcataggacctttc

SEQ ID NO: 3662174 - DNA, 12 bp, Homo sapiens
cgccaaggctgg

SEQ ID NO: 3662175 - DNA, 16 bp, Homo sapiens
cgccaaggctggggga

SEQ ID NO: 3662176 - DNA, 23 bp, Homo sapiens
cgccaaggctgggggaagaagct

SEQ ID NO: 3662177 - DNA, 14 bp, Homo sapiens
cgccaggagaagtt

SEQ ID NO: 3662178 - DNA, 22 bp, Homo sapiens
cgccaggggaaaatcagcctgc

SEQ ID NO: 3662179 - DNA, 18 bp, Homo sapiens
cgccattctcaagccctg

SEQ ID NO: 3662180 - DNA, 22 bp, Homo sapiens
cgccctcctgattaaggcgtgg

SEQ ID NO: 3662181 - DNA, 12 bp, Homo sapiens
cgccctgccact

SEQ ID NO: 3662182 - DNA, 19 bp, Homo sapiens
cgccctgtgtgtgtcccct

SEQ ID NO: 3662183 - DNA, 23 bp, Homo sapiens
cgcctgacaaccactggtctgta

SEQ ID NO: 3662184 - DNA, 15 bp, Homo sapiens
cgcctgcccctccca

SEQ ID NO: 3662185 - DNA, 12 bp, Homo sapiens
cgcctggcccgg

SEQ ID NO: 3662186 - DNA, 14 bp, Homo sapiens
cgcctggcccggga

SEQ ID NO: 3662187 - DNA, 16 bp, Homo sapiens
cgcctgtgatgctggg

SEQ ID NO: 3662188 - DNA, 16 bp, Homo sapiens
cgcgatcccacacagg

SEQ ID NO: 3662189 - DNA, 14 bp, Homo sapiens
cgcgcttgctggcc

SEQ ID NO: 3662190 - DNA, 16 bp, Homo sapiens
cgcgcttgctggccag

SEQ ID NO: 3662191 - DNA, 13 bp, Homo sapiens
cgcgtcttcctga

SEQ ID NO: 3662192 - DNA, 14 bp, Homo sapiens
cgcgtcttcctgag

SEQ ID NO: 3662193 - DNA, 16 bp, Homo sapiens
cgcgtcttcctgagtg

SEQ ID NO: 3662194 - DNA, 17 bp, Homo sapiens
cgcgtgccgtggcacca

SEQ ID NO: 3662195 - DNA, 21 bp, Homo sapiens
cgctaatcccgattcaccctg

SEQ ID NO: 3662196 - DNA, 22 bp, Homo sapiens
cgctcagggccatgctgaggcc

SEQ ID NO: 3662197 - DNA, 18 bp, Homo sapiens
cgctctttaatttgttgt

SEQ ID NO: 3662198 - DNA, 14 bp, Homo sapiens
cgctgagtggcagg

SEQ ID NO: 3662199 - DNA, 20 bp, Homo sapiens
cgctgagtggcaggggacag

SEQ ID NO: 3662200 - DNA, 20 bp, Homo sapiens
cgctgccacccacctccctg

SEQ ID NO: 3662201 - DNA, 19 bp, Homo sapiens
cgctgcccacctgccggcc

SEQ ID NO: 3662202 - DNA, 16 bp, Homo sapiens
cgctgtcctttctaga

SEQ ID NO: 3662203 - DNA, 15 bp, Homo sapiens
cgcttcttgcctctg

SEQ ID NO: 3662204 - DNA, 18 bp, Homo sapiens
cgcttcttgcctctgtgc

SEQ ID NO: 3662205 - DNA, 22 bp, Homo sapiens
cgcttcttgcctctgtgctgtg

SEQ ID NO: 3662206 - DNA, 13 bp, Homo sapiens
cgctttcctggag

SEQ ID NO: 3662207 - DNA, 14 bp, Homo sapiens
cgctttcctggagc

SEQ ID NO: 3662208 - DNA, 12 bp, Homo sapiens
cggaaagcagct

SEQ ID NO: 3662209 - DNA, 16 bp, Homo sapiens
cggagaggagttcagg

SEQ ID NO: 3662210 - DNA, 19 bp, Homo sapiens
cggagattggacggcctga

SEQ ID NO: 3662211 - DNA, 15 bp, Homo sapiens
cggaggccgaggcca

SEQ ID NO: 3662212 - DNA, 17 bp, Homo sapiens
cggatagttgctatttt

SEQ ID NO: 3662213 - DNA, 16 bp, Homo sapiens
cggatgggcacacaca

SEQ ID NO: 3662214 - DNA, 18 bp, Homo sapiens
cggcacagggtctgctct

SEQ ID NO: 3662215 - DNA, 17 bp, Homo sapiens
cggcaggggcctggaga

SEQ ID NO: 3662216 - DNA, 21 bp, Homo sapiens
cggcagtattgaagctcgtga

SEQ ID NO: 3662217 - DNA, 20 bp, Homo sapiens
cggcagttctgggtgctccc

SEQ ID NO: 3662218 - DNA, 21 bp, Homo sapiens
cggcagttctgggtgctccct

SEQ ID NO: 3662219 - DNA, 14 bp, Homo sapiens
cggccaagaatgta

SEQ ID NO: 3662220 - DNA, 15 bp, Homo sapiens
cggccagccatgtct

SEQ ID NO: 3662221 - DNA, 16 bp, Homo sapiens
cggccagggagaagct

SEQ ID NO: 3662222 - DNA, 22 bp, Homo sapiens
cggcccctcctgactcatccgc

SEQ ID NO: 3662223 - DNA, 16 bp, Homo sapiens
cggcccgtggctgttg

SEQ ID NO: 3662224 - DNA, 12 bp, Homo sapiens
cggccctggggc

SEQ ID NO: 3662225 - DNA, 20 bp, Homo sapiens
cggccgcccctcctcgtgaa

SEQ ID NO: 3662226 - DNA, 23 bp, Homo sapiens
cggcctgatgctccctcccctgc

SEQ ID NO: 3662227 - DNA, 13 bp, Homo sapiens
cggctctggggta

SEQ ID NO: 3662228 - DNA, 15 bp, Homo sapiens
cggctctggtggcca

SEQ ID NO: 3662229 - DNA, 22 bp, Homo sapiens
cggctctggtggccactgagct

SEQ ID NO: 3662230 - DNA, 14 bp, Homo sapiens
cggctgaccatgct

SEQ ID NO: 3662231 - DNA, 15 bp, Homo sapiens
cggctgaccatgctc

SEQ ID NO: 3662232 - DNA, 15 bp, Homo sapiens
cggctgcagaggcca

SEQ ID NO: 3662233 - DNA, 23 bp, Homo sapiens
cggctggcagcccacccctcaac

SEQ ID NO: 3662234 - DNA, 16 bp, Homo sapiens
cggctggggactgcta

SEQ ID NO: 3662235 - DNA, 22 bp, Homo sapiens
cgggacatcacagggtgggcct

SEQ ID NO: 3662236 - DNA, 18 bp, Homo sapiens
cgggactcctccctgggg

SEQ ID NO: 3662237 - DNA, 12 bp, Homo sapiens
cgggagacagca

SEQ ID NO: 3662238 - DNA, 18 bp, Homo sapiens
cgggagctctgtatggtc

SEQ ID NO: 3662239 - DNA, 20 bp, Homo sapiens
cgggaggcagaggttgcagt

SEQ ID NO: 3662240 - DNA, 21 bp, Homo sapiens
cgggaggtttggggggcatca

SEQ ID NO: 3662241 - DNA, 18 bp, Homo sapiens
cgggccagtgctccagcc

SEQ ID NO: 3662242 - DNA, 15 bp, Homo sapiens
cgggctcagcaaaag

SEQ ID NO: 3662243 - DNA, 19 bp, Homo sapiens
cgggctcagcaaaagatgc

SEQ ID NO: 3662244 - DNA, 21 bp, Homo sapiens
cggggagaagaagcggccagg

SEQ ID NO: 3662245 - DNA, 21 bp, Homo sapiens
cggggcactaggtaggcttct

SEQ ID NO: 3662246 - DNA, 21 bp, Homo sapiens
cggggccatttggccggctct

SEQ ID NO: 3662247 - DNA, 23 bp, Homo sapiens
cggggccatttggccggctctgg

SEQ ID NO: 3662248 - DNA, 15 bp, Homo sapiens
cggggcgccccaaga

SEQ ID NO: 3662249 - DNA, 14 bp, Homo sapiens
cggggcgggccctg

SEQ ID NO: 3662250 - DNA, 13 bp, Homo sapiens
cggggctcccctg

SEQ ID NO: 3662251 - DNA, 23 bp, Homo sapiens
cggggctcccctggacagaggcg

SEQ ID NO: 3662252 - DNA, 14 bp, Homo sapiens
cggggtcttgctct

SEQ ID NO: 3662253 - DNA, 19 bp, Homo sapiens
cggggtcttgctctgtctc

SEQ ID NO: 3662254 - DNA, 17 bp, Homo sapiens
cgggtcacacaaaggca

SEQ ID NO: 3662255 - DNA, 21 bp, Homo sapiens
cgggtcctagctgttagggac

SEQ ID NO: 3662256 - DNA, 22 bp, Homo sapiens
cgggtgggactcttccctggga

SEQ ID NO: 3662257 - DNA, 18 bp, Homo sapiens
cggtaggttcagccaagg

SEQ ID NO: 3662258 - DNA, 21 bp, Homo sapiens
ctcctcatccccacaatctgg

SEQ ID NO: 3662259 - DNA, 22 bp, Homo sapiens
ctcctccagccgccatgctcct

SEQ ID NO: 3662260 - DNA, 20 bp, Homo sapiens
ctcctcccacccggctgcag

SEQ ID NO: 3662261 - DNA, 22 bp, Homo sapiens
ctcctccctaatgctcaccttt

SEQ ID NO: 3662262 - DNA, 16 bp, Homo sapiens
ctcctccctgcatctg

SEQ ID NO: 3662263 - DNA, 16 bp, Homo sapiens
ctcctccctggagcta

SEQ ID NO: 3662264 - DNA, 21 bp, Homo sapiens
ctcctccctgggggcgggact

SEQ ID NO: 3662265 - DNA, 19 bp, Homo sapiens
ctcctccctgggggtgggg

SEQ ID NO: 3662266 - DNA, 15 bp, Homo sapiens
ctcctcctccctgca

SEQ ID NO: 3662267 - DNA, 23 bp, Homo sapiens
ctcctcctgaaggaggcggggct

SEQ ID NO: 3662268 - DNA, 14 bp, Homo sapiens
ctcctcgcaagctg

SEQ ID NO: 3662269 - DNA, 21 bp, Homo sapiens
ctcctctcccattgtccctct

SEQ ID NO: 3662270 - DNA, 23 bp, Homo sapiens
ctcctctccccagcccagagaca

SEQ ID NO: 3662271 - DNA, 12 bp, Homo sapiens
ctcctctctggt

SEQ ID NO: 3662272 - DNA, 14 bp, Homo sapiens
ctcctctgtttgtt

SEQ ID NO: 3662273 - DNA, 16 bp, Homo sapiens
ctcctgaaggaggcgg

SEQ ID NO: 3662274 - DNA, 23 bp, Homo sapiens
ctcctgaaggaggcggggctcta

SEQ ID NO: 3662275 - DNA, 23 bp, Homo sapiens
ctcctgaatgaggcggagctcca

SEQ ID NO: 3662276 - DNA, 15 bp, Homo sapiens
ctcctgaccagggca

SEQ ID NO: 3662277 - DNA, 17 bp, Homo sapiens
ctcctgactcatccgcc

SEQ ID NO: 3662278 - DNA, 21 bp, Homo sapiens
ctcctgactcatccgcctggc

SEQ ID NO: 3662279 - DNA, 14 bp, Homo sapiens
ctcctgcagaccac

SEQ ID NO: 3662280 - DNA, 24 bp, Homo sapiens
ctcctgccagggaactggcctgct

SEQ ID NO: 3662281 - DNA, 13 bp, Homo sapiens
ctcctgctgagct

SEQ ID NO: 3662282 - DNA, 18 bp, Homo sapiens
ctcctggcccactgcatc

SEQ ID NO: 3662283 - DNA, 10 bp, Homo sapiens
ctcctgtggt

SEQ ID NO: 3662284 - DNA, 16 bp, Homo sapiens
ctcctgtggtagtcct

SEQ ID NO: 3662285 - DNA, 20 bp, Homo sapiens
ctcctgtggtagtcctccca

SEQ ID NO: 3662286 - DNA, 14 bp, Homo sapiens
ctccttccaacagg

SEQ ID NO: 3662287 - DNA, 22 bp, Homo sapiens
ctccttcccattggctttctct

SEQ ID NO: 3662288 - DNA, 19 bp, Homo sapiens
ctccttcctgtgggtgggg

SEQ ID NO: 3662289 - DNA, 15 bp, Homo sapiens
ctccttgagatcctg

SEQ ID NO: 3662290 - DNA, 16 bp, Homo sapiens
ctcctttcctatcttt

SEQ ID NO: 3662291 - DNA, 13 bp, Homo sapiens
ctccttttttccc

SEQ ID NO: 3662292 - DNA, 18 bp, Homo sapiens
ctcgaatctctgtgcctt

SEQ ID NO: 3662293 - DNA, 14 bp, Homo sapiens
ctcgcaagctgggt

SEQ ID NO: 3662294 - DNA, 19 bp, Homo sapiens
ctcgcataggacctttcca

SEQ ID NO: 3662295 - DNA, 23 bp, Homo sapiens
ctcgcatcctatgcttaataaaa

SEQ ID NO: 3662296 - DNA, 12 bp, Homo sapiens
ctcgctgagggc

SEQ ID NO: 3662297 - DNA, 22 bp, Homo sapiens
ctcgctgagggcagactggggc

SEQ ID NO: 3662298 - DNA, 18 bp, Homo sapiens
ctcgctgtcctttctaga

SEQ ID NO: 3662299 - DNA, 17 bp, Homo sapiens
ctcgggtttctctgtgg

SEQ ID NO: 3662300 - DNA, 11 bp, Homo sapiens
ctcggtgcctt

SEQ ID NO: 3662301 - DNA, 14 bp, Homo sapiens
ctcggtgggagcca

SEQ ID NO: 3662302 - DNA, 23 bp, Homo sapiens
ctcggtgtggagaagcggctggc

SEQ ID NO: 3662303 - DNA, 22 bp, Homo sapiens
ctcggtttgccaaaattcattt

SEQ ID NO: 3662304 - DNA, 15 bp, Homo sapiens
ctcgtcccatccagc

SEQ ID NO: 3662305 - DNA, 17 bp, Homo sapiens
ctcgtgcatccctgaga

SEQ ID NO: 3662306 - DNA, 14 bp, Homo sapiens
ctcgtggctgtcaa

SEQ ID NO: 3662307 - DNA, 15 bp, Homo sapiens
ctcgttcttatttaa

SEQ ID NO: 3662308 - DNA, 13 bp, Homo sapiens
ctctacaaaaagc

SEQ ID NO: 3662309 - DNA, 18 bp, Homo sapiens
ctctaccctcccaccccc

SEQ ID NO: 3662310 - DNA, 22 bp, Homo sapiens
ctctaccctcccacccccttct

SEQ ID NO: 3662311 - DNA, 17 bp, Homo sapiens
ctctacttaatccaatg

SEQ ID NO: 3662312 - DNA, 18 bp, Homo sapiens
ctctactttgattctgat

SEQ ID NO: 3662313 - DNA, 15 bp, Homo sapiens
ctctaggatggggca

SEQ ID NO: 3662314 - DNA, 13 bp, Homo sapiens
ctctagttctttg

SEQ ID NO: 3662315 - DNA, 18 bp, Homo sapiens
ctctagttctttgttcat

SEQ ID NO: 3662316 - DNA, 13 bp, Homo sapiens
ctctcacctcagc

SEQ ID NO: 3662317 - DNA, 18 bp, Homo sapiens
ctctccaagcgcctggct

SEQ ID NO: 3662318 - DNA, 16 bp, Homo sapiens
ctctcccattgtccct

SEQ ID NO: 3662319 - DNA, 17 bp, Homo sapiens
ctctccccagcccagag

SEQ ID NO: 3662320 - DNA, 18 bp, Homo sapiens
ctctccccagcccagaga

SEQ ID NO: 3662321 - DNA, 15 bp, Homo sapiens
ctctccccaggtcca

SEQ ID NO: 3662322 - DNA, 16 bp, Homo sapiens
ctctccccaggtccag

SEQ ID NO: 3662323 - DNA, 20 bp, Homo sapiens
ctctccccaggtccagctct

SEQ ID NO: 3662324 - DNA, 15 bp, Homo sapiens
ctctccctgccaagt

SEQ ID NO: 3662325 - DNA, 18 bp, Homo sapiens
ctctctaaaagtgtccac

SEQ ID NO: 3662326 - DNA, 13 bp, Homo sapiens
ctctctcctccct

SEQ ID NO: 3662327 - DNA, 20 bp, Homo sapiens
ctctctcctcctgcccacct

SEQ ID NO: 3662328 - DNA, 15 bp, Homo sapiens
ctctcttctgctcca

SEQ ID NO: 3662329 - DNA, 17 bp, Homo sapiens
ctctcttctgctccacc

SEQ ID NO: 3662330 - DNA, 19 bp, Homo sapiens
ctctgaccgaaacagcgct

SEQ ID NO: 3662331 - DNA, 14 bp, Homo sapiens
ctctgacttctgcc

SEQ ID NO: 3662332 - DNA, 13 bp, Homo sapiens
ctctgagaagaca

SEQ ID NO: 3662333 - DNA, 17 bp, Homo sapiens
ctctgagtatctcctcg

SEQ ID NO: 3662334 - DNA, 15 bp, Homo sapiens
ctctgcacaagctgc

SEQ ID NO: 3662335 - DNA, 19 bp, Homo sapiens
ctctgcacaagctgcaccc

SEQ ID NO: 3662336 - DNA, 22 bp, Homo sapiens
ctctgcactactgacatgtggg

SEQ ID NO: 3662337 - DNA, 14 bp, Homo sapiens
ctctgccagtgaca

SEQ ID NO: 3662338 - DNA, 15 bp, Homo sapiens
ctctgccagtgacag

SEQ ID NO: 3662339 - DNA, 20 bp, Homo sapiens
ctctgccagtgacagacagg

SEQ ID NO: 3662340 - DNA, 22 bp, Homo sapiens
ctctgccccatcctccagcagg

SEQ ID NO: 3662341 - DNA, 16 bp, Homo sapiens
ctctgcgttggcttct

SEQ ID NO: 3662342 - DNA, 20 bp, Homo sapiens
ctctgcgttggcttctccct

SEQ ID NO: 3662343 - DNA, 23 bp, Homo sapiens
ctctgcgttggcttctccctggg

SEQ ID NO: 3662344 - DNA, 15 bp, Homo sapiens
ctctgctccaccaca

SEQ ID NO: 3662345 - DNA, 18 bp, Homo sapiens
ctctgctccaccacatcc

SEQ ID NO: 3662346 - DNA, 19 bp, Homo sapiens
ctctgctccaccacatcct

SEQ ID NO: 3662347 - DNA, 13 bp, Homo sapiens
ctctgctctgctc

SEQ ID NO: 3662348 - DNA, 12 bp, Homo sapiens
ctctgcttctct

SEQ ID NO: 3662349 - DNA, 14 bp, Homo sapiens
ctctgcttctctga

SEQ ID NO: 3662350 - DNA, 15 bp, Homo sapiens
ctctgctttggaaat

SEQ ID NO: 3662351 - DNA, 15 bp, Homo sapiens
ctctggaggggaggg

SEQ ID NO: 3662352 - DNA, 20 bp, Homo sapiens
ctctggagtggccactaagc

SEQ ID NO: 3662353 - DNA, 16 bp, Homo sapiens
ctctgggaccaggctc

SEQ ID NO: 3662354 - DNA, 17 bp, Homo sapiens
ctctgggaccaggctcc

SEQ ID NO: 3662355 - DNA, 18 bp, Homo sapiens
ctctgggatttatgctca

SEQ ID NO: 3662356 - DNA, 16 bp, Homo sapiens
ctctgggcctcagttt

SEQ ID NO: 3662357 - DNA, 17 bp, Homo sapiens
ctctggggtaggctgct

SEQ ID NO: 3662358 - DNA, 11 bp, Homo sapiens
ctctgggtggg

SEQ ID NO: 3662359 - DNA, 15 bp, Homo sapiens
ctctgggtgggcggg

SEQ ID NO: 3662360 - DNA, 23 bp, Homo sapiens
ctctgggtgggcgtggcctgcat

SEQ ID NO: 3662361 - DNA, 17 bp, Homo sapiens
ctctggtggctgggctg

SEQ ID NO: 3662362 - DNA, 19 bp, Homo sapiens
ctctgtctacttgctcagg

SEQ ID NO: 3662363 - DNA, 15 bp, Homo sapiens
ctctgtctcccaggc

SEQ ID NO: 3662364 - DNA, 13 bp, Homo sapiens
ctctgtcttctgg

SEQ ID NO: 3662365 - DNA, 17 bp, Homo sapiens
ctctgtcttctggactg

SEQ ID NO: 3662366 - DNA, 13 bp, Homo sapiens
ctctgtgccttcg

SEQ ID NO: 3662367 - DNA, 13 bp, Homo sapiens
ctctgtggccagc

SEQ ID NO: 3662368 - DNA, 14 bp, Homo sapiens
ctctgtggccagcc

SEQ ID NO: 3662369 - DNA, 17 bp, Homo sapiens
ctctgtggccagcctgg

SEQ ID NO: 3662370 - DNA, 19 bp, Homo sapiens
ctctgtggccagcctggca

SEQ ID NO: 3662371 - DNA, 23 bp, Homo sapiens
ctctgtggccagcctggcatcag

SEQ ID NO: 3662372 - DNA, 16 bp, Homo sapiens
ctctgtggccagctgc

SEQ ID NO: 3662373 - DNA, 17 bp, Homo sapiens
ctctgtggccagctgca

SEQ ID NO: 3662374 - DNA, 13 bp, Homo sapiens
ctctgtgggccct

SEQ ID NO: 3662375 - DNA, 19 bp, Homo sapiens
ctgcgactttctgcctgga

SEQ ID NO: 3662376 - DNA, 15 bp, Homo sapiens
ctgcgccccaggccc

SEQ ID NO: 3662377 - DNA, 13 bp, Homo sapiens
ctgcgggtggggc

SEQ ID NO: 3662378 - DNA, 22 bp, Homo sapiens
ctgcgtgccagtcaagaagaaa

SEQ ID NO: 3662379 - DNA, 23 bp, Homo sapiens
ctgcgttggcttctccctgggga

SEQ ID NO: 3662380 - DNA, 18 bp, Homo sapiens
ctgctacctttcaaagct

SEQ ID NO: 3662381 - DNA, 15 bp, Homo sapiens
ctgctatcattattc

SEQ ID NO: 3662382 - DNA, 14 bp, Homo sapiens
ctgctcagaggcct

SEQ ID NO: 3662383 - DNA, 16 bp, Homo sapiens
ctgctcagaggccttg

SEQ ID NO: 3662384 - DNA, 20 bp, Homo sapiens
ctgctcagaggccttgctgt

SEQ ID NO: 3662385 - DNA, 15 bp, Homo sapiens
ctgctcagcttctcc

SEQ ID NO: 3662386 - DNA, 13 bp, Homo sapiens
ctgctccaccaca

SEQ ID NO: 3662387 - DNA, 16 bp, Homo sapiens
ctgctccaccacatcc

SEQ ID NO: 3662388 - DNA, 12 bp, Homo sapiens
ctgctccaccct

SEQ ID NO: 3662389 - DNA, 21 bp, Homo sapiens
ctgctccagacctgatcctgg

SEQ ID NO: 3662390 - DNA, 12 bp, Homo sapiens
ctgctccctgag

SEQ ID NO: 3662391 - DNA, 13 bp, Homo sapiens
ctgctccctgagg

SEQ ID NO: 3662392 - DNA, 14 bp, Homo sapiens
ctgctccctgaggg

SEQ ID NO: 3662393 - DNA, 21 bp, Homo sapiens
ctgctcctagagggaggggcc

SEQ ID NO: 3662394 - DNA, 12 bp, Homo sapiens
ctgctccttgct

SEQ ID NO: 3662395 - DNA, 19 bp, Homo sapiens
ctgctcgcgaaggtcccac

SEQ ID NO: 3662396 - DNA, 13 bp, Homo sapiens
ctgctctgctcag

SEQ ID NO: 3662397 - DNA, 21 bp, Homo sapiens
ctgctctttctctgccagtga

SEQ ID NO: 3662398 - DNA, 19 bp, Homo sapiens
ctgctgacctccacagctt

SEQ ID NO: 3662399 - DNA, 18 bp, Homo sapiens
ctgctgactgttttctct

SEQ ID NO: 3662400 - DNA, 20 bp, Homo sapiens
ctgctgagctgcccctgctg

SEQ ID NO: 3662401 - DNA, 22 bp, Homo sapiens
ctgctgagctgcccctgctgct

SEQ ID NO: 3662402 - DNA, 17 bp, Homo sapiens
ctgctgcctctttccct

SEQ ID NO: 3662403 - DNA, 20 bp, Homo sapiens
ctgctgcctctttccctagg

SEQ ID NO: 3662404 - DNA, 21 bp, Homo sapiens
ctgctgcttaagtgcatgcat

SEQ ID NO: 3662405 - DNA, 18 bp, Homo sapiens
ctgctgggccccgagcca

SEQ ID NO: 3662406 - DNA, 15 bp, Homo sapiens
ctgctggtgcacagc

SEQ ID NO: 3662407 - DNA, 16 bp, Homo sapiens
ctgcttatttcatctg

SEQ ID NO: 3662408 - DNA, 13 bp, Homo sapiens
ctgcttcctcctg

SEQ ID NO: 3662409 - DNA, 19 bp, Homo sapiens
ctgcttctctgacttctgc

SEQ ID NO: 3662410 - DNA, 21 bp, Homo sapiens
ctgcttctctgacttctgcct

SEQ ID NO: 3662411 - DNA, 20 bp, Homo sapiens
ctgcttgaggcaactcatct

SEQ ID NO: 3662412 - DNA, 21 bp, Homo sapiens
ctgcttgaggcaactcatctt

SEQ ID NO: 3662413 - DNA, 22 bp, Homo sapiens
ctgcttgaggcaactcatctta

SEQ ID NO: 3662414 - DNA, 21 bp, Homo sapiens
ctgcttgatgggattctggac

SEQ ID NO: 3662415 - DNA, 23 bp, Homo sapiens
ctgcttgatgggattctggacag

SEQ ID NO: 3662416 - DNA, 16 bp, Homo sapiens
ctgcttggagctgagc

SEQ ID NO: 3662417 - DNA, 17 bp, Homo sapiens
ctgcttggagctgagca

SEQ ID NO: 3662418 - DNA, 22 bp, Homo sapiens
ctgctttaacagtggagctgaa

SEQ ID NO: 3662419 - DNA, 13 bp, Homo sapiens
ctgctttggaaat

SEQ ID NO: 3662420 - DNA, 23 bp, Homo sapiens
ctggaaaataatactgctgagat

SEQ ID NO: 3662421 - DNA, 15 bp, Homo sapiens
ctggaaaatgcttct

SEQ ID NO: 3662422 - DNA, 19 bp, Homo sapiens
ctggaacaaattatttttg

SEQ ID NO: 3662423 - DNA, 23 bp, Homo sapiens
ctggaacactagacaagccagaa

SEQ ID NO: 3662424 - DNA, 16 bp, Homo sapiens
ctggaacccagactca

SEQ ID NO: 3662425 - DNA, 18 bp, Homo sapiens
ctggaacctcagcctggc

SEQ ID NO: 3662426 - DNA, 22 bp, Homo sapiens
ctggaacctcagcctggccaga

SEQ ID NO: 3662427 - DNA, 14 bp, Homo sapiens
ctggaacctggacc

SEQ ID NO: 3662428 - DNA, 21 bp, Homo sapiens
ctggaacctggaccccagcct

SEQ ID NO: 3662429 - DNA, 22 bp, Homo sapiens
ctggaacctggaccccagcctt

SEQ ID NO: 3662430 - DNA, 12 bp, Homo sapiens
ctggaagaaaaa

SEQ ID NO: 3662431 - DNA, 18 bp, Homo sapiens
ctggaagatcctgcgggt

SEQ ID NO: 3662432 - DNA, 22 bp, Homo sapiens
ctggaagcaggatggagctgac

SEQ ID NO: 3662433 - DNA, 22 bp, Homo sapiens
ctggaagccaaaatgtaggctt

SEQ ID NO: 3662434 - DNA, 17 bp, Homo sapiens
ctggaaggggcccgtgg

SEQ ID NO: 3662435 - DNA, 19 bp, Homo sapiens
ctggaaggggcccgtggga

SEQ ID NO: 3662436 - DNA, 19 bp, Homo sapiens
ctggacagaggcggggcta

SEQ ID NO: 3662437 - DNA, 14 bp, Homo sapiens
ctggacagcctctt

SEQ ID NO: 3662438 - DNA, 13 bp, Homo sapiens
ctggaccccagcc

SEQ ID NO: 3662439 - DNA, 15 bp, Homo sapiens
ctggaccccagcctt

SEQ ID NO: 3662440 - DNA, 16 bp, Homo sapiens
ctggaccccagccttg

SEQ ID NO: 3662441 - DNA, 15 bp, Homo sapiens
ctggaccctgtggat

SEQ ID NO: 3662442 - DNA, 16 bp, Homo sapiens
ctggacggggcgggcc

SEQ ID NO: 3662443 - DNA, 15 bp, Homo sapiens
ctggactggctagag

SEQ ID NO: 3662444 - DNA, 21 bp, Homo sapiens
ctggagacttagggcaccagg

SEQ ID NO: 3662445 - DNA, 18 bp, Homo sapiens
ctggagagcactgccagg

SEQ ID NO: 3662446 - DNA, 12 bp, Homo sapiens
ctggaggcccag

SEQ ID NO: 3662447 - DNA, 14 bp, Homo sapiens
ctggaggcccagtt

SEQ ID NO: 3662448 - DNA, 21 bp, Homo sapiens
ctggaggcccagttcaccctg

SEQ ID NO: 3662449 - DNA, 15 bp, Homo sapiens
ctggagtacccagcc

SEQ ID NO: 3662450 - DNA, 17 bp, Homo sapiens
ctggagtacccagccta

SEQ ID NO: 3662451 - DNA, 18 bp, Homo sapiens
ctggagtacccagcctat

SEQ ID NO: 3662452 - DNA, 19 bp, Homo sapiens
ctggagtacccagcctatc

SEQ ID NO: 3662453 - DNA, 14 bp, Homo sapiens
ctggagtggccact

SEQ ID NO: 3662454 - DNA, 18 bp, Homo sapiens
ctggagttgatctggaac

SEQ ID NO: 3662455 - DNA, 20 bp, Homo sapiens
ctggagttgatctggaaccc

SEQ ID NO: 3662456 - DNA, 22 bp, Homo sapiens
ctggagttgatctggaacccag

SEQ ID NO: 3662457 - DNA, 20 bp, Homo sapiens
ctggatctccattctctcag

SEQ ID NO: 3662458 - DNA, 12 bp, Homo sapiens
ctggatggggca

SEQ ID NO: 3662459 - DNA, 20 bp, Homo sapiens
ctggatggggcagagcttct

SEQ ID NO: 3662460 - DNA, 23 bp, Homo sapiens
ctggatggggcagagcttctcct

SEQ ID NO: 3662461 - DNA, 21 bp, Homo sapiens
ctggcaaaaggatctttgtgg

SEQ ID NO: 3662462 - DNA, 19 bp, Homo sapiens
ctggcatcagtttaggcct

SEQ ID NO: 3662463 - DNA, 21 bp, Homo sapiens
ctggcatcagtttaggccttg

SEQ ID NO: 3662464 - DNA, 23 bp, Homo sapiens
ctggcatcagtttaggccttggc

SEQ ID NO: 3662465 - DNA, 22 bp, Homo sapiens
ctggcatcgcaccattctgact

SEQ ID NO: 3662466 - DNA, 18 bp, Homo sapiens
ctggccaacatggcgaaa

SEQ ID NO: 3662467 - DNA, 17 bp, Homo sapiens
ctggccaacatggtaaa

SEQ ID NO: 3662468 - DNA, 13 bp, Homo sapiens
ctggccagacaca

SEQ ID NO: 3662469 - DNA, 17 bp, Homo sapiens
ctggccaggagctcttc

SEQ ID NO: 3662470 - DNA, 22 bp, Homo sapiens
ctggccaggagctcttcaggcc

SEQ ID NO: 3662471 - DNA, 13 bp, Homo sapiens
ctggccaggcaga

SEQ ID NO: 3662472 - DNA, 22 bp, Homo sapiens
ctggccagtccaccctgcctgc

SEQ ID NO: 3662473 - DNA, 16 bp, Homo sapiens
ctggccagtccaggct

SEQ ID NO: 3662474 - DNA, 18 bp, Homo sapiens
ctggccagtccaggctgc

SEQ ID NO: 3662475 - DNA, 19 bp, Homo sapiens
ctggccagtccaggctgcc

SEQ ID NO: 3662476 - DNA, 22 bp, Homo sapiens
ctggccagtccaggctgccgtg

SEQ ID NO: 3662477 - DNA, 13 bp, Homo sapiens
ctggcccactgca

SEQ ID NO: 3662478 - DNA, 15 bp, Homo sapiens
ctggcccactgcatc

SEQ ID NO: 3662479 - DNA, 12 bp, Homo sapiens
ctggcccagggc

SEQ ID NO: 3662480 - DNA, 17 bp, Homo sapiens
ctggcccagggcccaga

SEQ ID NO: 3662481 - DNA, 21 bp, Homo sapiens
ctggccgagggtcctggctcc

SEQ ID NO: 3662482 - DNA, 18 bp, Homo sapiens
ctggcctcccctgccacc

SEQ ID NO: 3662483 - DNA, 21 bp, Homo sapiens
ctggcctcccctgccaccagg

SEQ ID NO: 3662484 - DNA, 22 bp, Homo sapiens
ctggcgaggtgcggccaccacc

SEQ ID NO: 3662485 - DNA, 16 bp, Homo sapiens
ctggctagagtcctca

SEQ ID NO: 3662486 - DNA, 17 bp, Homo sapiens
ctggctagagtcctcac

SEQ ID NO: 3662487 - DNA, 20 bp, Homo sapiens
ctggctagagtcctcactcc

SEQ ID NO: 3662488 - DNA, 21 bp, Homo sapiens
ctggctagagtcctcactccc

SEQ ID NO: 3662489 - DNA, 12 bp, Homo sapiens
ctggctctgagc

SEQ ID NO: 3662490 - DNA, 21 bp, Homo sapiens
ctggctctgagcgcctccatc

SEQ ID NO: 3662491 - DNA, 12 bp, Homo sapiens
cttactaggaag

SEQ ID NO: 3662492 - DNA, 14 bp, Homo sapiens
cttactccaggaga

SEQ ID NO: 3662493 - DNA, 20 bp, Homo sapiens
cttagaaaaaccaccaccat

SEQ ID NO: 3662494 - DNA, 18 bp, Homo sapiens
cttagaacctttctgtgt

SEQ ID NO: 3662495 - DNA, 13 bp, Homo sapiens
cttagagaataag

SEQ ID NO: 3662496 - DNA, 21 bp, Homo sapiens
cttagataccttgaaaggcag

SEQ ID NO: 3662497 - DNA, 21 bp, Homo sapiens
cttagatctggcatgttagcc

SEQ ID NO: 3662498 - DNA, 16 bp, Homo sapiens
cttagcagcttccaga

SEQ ID NO: 3662499 - DNA, 14 bp, Homo sapiens
cttagggaagaaaa

SEQ ID NO: 3662500 - DNA, 15 bp, Homo sapiens
cttagggaagaaaaa

SEQ ID NO: 3662501 - DNA, 20 bp, Homo sapiens
cttagggaagaaaaagcaag

SEQ ID NO: 3662502 - DNA, 21 bp, Homo sapiens
cttaggttggcaaaaaggcag

SEQ ID NO: 3662503 - DNA, 12 bp, Homo sapiens
cttagtcctggg

SEQ ID NO: 3662504 - DNA, 13 bp, Homo sapiens
cttagtgagcagt

SEQ ID NO: 3662505 - DNA, 17 bp, Homo sapiens
cttagtttgtgtgttgt

SEQ ID NO: 3662506 - DNA, 19 bp, Homo sapiens
cttatactgtacaataaaa

SEQ ID NO: 3662507 - DNA, 19 bp, Homo sapiens
cttatagatgcaaagtatt

SEQ ID NO: 3662508 - DNA, 16 bp, Homo sapiens
cttatcttctggatta

SEQ ID NO: 3662509 - DNA, 14 bp, Homo sapiens
cttatcttgtttca

SEQ ID NO: 3662510 - DNA, 22 bp, Homo sapiens
cttattaccctgattgaatgtg

SEQ ID NO: 3662511 - DNA, 12 bp, Homo sapiens
cttattctgtat

SEQ ID NO: 3662512 - DNA, 13 bp, Homo sapiens
cttattctgtatc

SEQ ID NO: 3662513 - DNA, 16 bp, Homo sapiens
cttattgcgctgctac

SEQ ID NO: 3662514 - DNA, 18 bp, Homo sapiens
cttcaaagaagctgtctt

SEQ ID NO: 3662515 - DNA, 13 bp, Homo sapiens
cttcaaatgcctg

SEQ ID NO: 3662516 - DNA, 12 bp, Homo sapiens
cttcaagtgcca

SEQ ID NO: 3662517 - DNA, 19 bp, Homo sapiens
cttcacggaagagccttgc

SEQ ID NO: 3662518 - DNA, 17 bp, Homo sapiens
cttcacggcaggacaac

SEQ ID NO: 3662519 - DNA, 15 bp, Homo sapiens
cttcaggcctccctc

SEQ ID NO: 3662520 - DNA, 20 bp, Homo sapiens
cttcagggttctaacctttc

SEQ ID NO: 3662521 - DNA, 16 bp, Homo sapiens
cttcagtaagccgtga

SEQ ID NO: 3662522 - DNA, 23 bp, Homo sapiens
cttcatggatgggggaactcaga

SEQ ID NO: 3662523 - DNA, 22 bp, Homo sapiens
cttcattctccttgttgttggt

SEQ ID NO: 3662524 - DNA, 16 bp, Homo sapiens
cttccaacacatttca

SEQ ID NO: 3662525 - DNA, 15 bp, Homo sapiens
cttccacgggggctg

SEQ ID NO: 3662526 - DNA, 19 bp, Homo sapiens
cttccacgggggctgtggc

SEQ ID NO: 3662527 - DNA, 14 bp, Homo sapiens
cttccatccctacc

SEQ ID NO: 3662528 - DNA, 16 bp, Homo sapiens
cttccatccctacccc

SEQ ID NO: 3662529 - DNA, 19 bp, Homo sapiens
cttccatccctacccccta

SEQ ID NO: 3662530 - DNA, 17 bp, Homo sapiens
cttccatctagtcacaa

SEQ ID NO: 3662531 - DNA, 11 bp, Homo sapiens
cttccatgcct

SEQ ID NO: 3662532 - DNA, 14 bp, Homo sapiens
cttccatgcctgta

SEQ ID NO: 3662533 - DNA, 17 bp, Homo sapiens
cttccatgcctgtagct

SEQ ID NO: 3662534 - DNA, 19 bp, Homo sapiens
cttcccaccctgcccctca

SEQ ID NO: 3662535 - DNA, 16 bp, Homo sapiens
cttccccacaggtgaa

SEQ ID NO: 3662536 - DNA, 12 bp, Homo sapiens
cttccctaatct

SEQ ID NO: 3662537 - DNA, 17 bp, Homo sapiens
cttccctacagttgaaa

SEQ ID NO: 3662538 - DNA, 13 bp, Homo sapiens
cttccctacctca

SEQ ID NO: 3662539 - DNA, 13 bp, Homo sapiens
cttccctgcagct

SEQ ID NO: 3662540 - DNA, 16 bp, Homo sapiens
cttccctgcagctgac

SEQ ID NO: 3662541 - DNA, 18 bp, Homo sapiens
cttccctgcagctgaccg

SEQ ID NO: 3662542 - DNA, 12 bp, Homo sapiens
cttccctgggaa

SEQ ID NO: 3662543 - DNA, 21 bp, Homo sapiens
cttccgtggtcagagtgccac

SEQ ID NO: 3662544 - DNA, 22 bp, Homo sapiens
cttcctacaagagcagcctgtg

SEQ ID NO: 3662545 - DNA, 15 bp, Homo sapiens
cttcctcagcctggg

SEQ ID NO: 3662546 - DNA, 16 bp, Homo sapiens
cttcctcagcctgggg

SEQ ID NO: 3662547 - DNA, 14 bp, Homo sapiens
cttcctcctggaaa

SEQ ID NO: 3662548 - DNA, 21 bp, Homo sapiens
cttcctgcaaccactctgtgg

SEQ ID NO: 3662549 - DNA, 15 bp, Homo sapiens
cttcctggatggggc

SEQ ID NO: 3662550 - DNA, 19 bp, Homo sapiens
cttcctggatggggcagag

SEQ ID NO: 3662551 - DNA, 18 bp, Homo sapiens
cttcctgtccagctccaa

SEQ ID NO: 3662552 - DNA, 19 bp, Homo sapiens
cttcctgtgggtggggctt

SEQ ID NO: 3662553 - DNA, 15 bp, Homo sapiens
cttcctttaaaaaac

SEQ ID NO: 3662554 - DNA, 16 bp, Homo sapiens
cttcgcagaggcaagc

SEQ ID NO: 3662555 - DNA, 20 bp, Homo sapiens
cttcgggaggtcgaggcagg

SEQ ID NO: 3662556 - DNA, 15 bp, Homo sapiens
cttcgttctttttaa

SEQ ID NO: 3662557 - DNA, 15 bp, Homo sapiens
cttctaattgctgtg

SEQ ID NO: 3662558 - DNA, 17 bp, Homo sapiens
cttctagaaccaggcaa

SEQ ID NO: 3662559 - DNA, 14 bp, Homo sapiens
cttctctgacttct

SEQ ID NO: 3662560 - DNA, 16 bp, Homo sapiens
cttctctgacttctgc

SEQ ID NO: 3662561 - DNA, 17 bp, Homo sapiens
cttctctgacttctgcc

SEQ ID NO: 3662562 - DNA, 15 bp, Homo sapiens
cttctctgctccacc

SEQ ID NO: 3662563 - DNA, 16 bp, Homo sapiens
cttctctgctccacca

SEQ ID NO: 3662564 - DNA, 12 bp, Homo sapiens
cttctctgggac

SEQ ID NO: 3662565 - DNA, 14 bp, Homo sapiens
cttctctgggacca

SEQ ID NO: 3662566 - DNA, 18 bp, Homo sapiens
cttctctgggaccaggct

SEQ ID NO: 3662567 - DNA, 17 bp, Homo sapiens
cttctgaactttggaag

SEQ ID NO: 3662568 - DNA, 15 bp, Homo sapiens
cttctgattcccctc

SEQ ID NO: 3662569 - DNA, 18 bp, Homo sapiens
cttctgattcccctccac

SEQ ID NO: 3662570 - DNA, 15 bp, Homo sapiens
cttctgcccttgcca

SEQ ID NO: 3662571 - DNA, 17 bp, Homo sapiens
cttctgccggccctggg

SEQ ID NO: 3662572 - DNA, 11 bp, Homo sapiens
cttctgctact

SEQ ID NO: 3662573 - DNA, 12 bp, Homo sapiens
cttctgctccac

SEQ ID NO: 3662574 - DNA, 14 bp, Homo sapiens
cttctgctccaccc

SEQ ID NO: 3662575 - DNA, 19 bp, Homo sapiens
cttctgctccacccttggc

SEQ ID NO: 3662576 - DNA, 21 bp, Homo sapiens
cttctgctccacccttggcct

SEQ ID NO: 3662577 - DNA, 16 bp, Homo sapiens
cttctggaatttgttc

SEQ ID NO: 3662578 - DNA, 22 bp, Homo sapiens
cttctggccaggaagctttggt

SEQ ID NO: 3662579 - DNA, 19 bp, Homo sapiens
cttctggtgctactccatg

SEQ ID NO: 3662580 - DNA, 19 bp, Homo sapiens
cttctgtcccaagtctcca

SEQ ID NO: 3662581 - DNA, 21 bp, Homo sapiens
cttctgtgagacccccacacc

SEQ ID NO: 3662582 - DNA, 16 bp, Homo sapiens
cttcttcatattctaa

SEQ ID NO: 3662583 - DNA, 17 bp, Homo sapiens
cttcttgcctctgtgct

SEQ ID NO: 3662584 - DNA, 19 bp, Homo sapiens
cttcttggggcccagtgca

SEQ ID NO: 3662585 - DNA, 21 bp, Homo sapiens
cttcttggggcccagtgcatg

SEQ ID NO: 3662586 - DNA, 23 bp, Homo sapiens
cttcttggggcccagtgcatggt

SEQ ID NO: 3662587 - DNA, 18 bp, Homo sapiens
cttgaaatatcctgcttg

SEQ ID NO: 3662588 - DNA, 12 bp, Homo sapiens
cttgaagaactg

SEQ ID NO: 3662589 - DNA, 20 bp, Homo sapiens
cttgaagaactgcaggccct

SEQ ID NO: 3662590 - DNA, 14 bp, Homo sapiens
cttgaagggccaga

SEQ ID NO: 3662591 - DNA, 15 bp, Homo sapiens
cttgaagggccagag

SEQ ID NO: 3662592 - DNA, 17 bp, Homo sapiens
cttgaagggccagagcc

SEQ ID NO: 3662593 - DNA, 13 bp, Homo sapiens
cttgaatttctga

SEQ ID NO: 3662594 - DNA, 16 bp, Homo sapiens
cttgacagaacactgt

SEQ ID NO: 3662595 - DNA, 23 bp, Homo sapiens
cttgaccaagcaggaagctcaga

SEQ ID NO: 3662596 - DNA, 14 bp, Homo sapiens
cttgaccctgagct

SEQ ID NO: 3662597 - DNA, 17 bp, Homo sapiens
cttgacctgaggctgtg

SEQ ID NO: 3662598 - DNA, 15 bp, Homo sapiens
cttgaccttgtagag

SEQ ID NO: 3662599 - DNA, 16 bp, Homo sapiens
cttgagcccaggagtt

SEQ ID NO: 3662600 - DNA, 15 bp, Homo sapiens
cttgagcctgggagg

SEQ ID NO: 3662601 - DNA, 18 bp, Homo sapiens
cttgagttgattcagctc

SEQ ID NO: 3662602 - DNA, 12 bp, Homo sapiens
cttgagtttgtc

SEQ ID NO: 3662603 - DNA, 16 bp, Homo sapiens
cttgataaagggccaa

SEQ ID NO: 3662604 - DNA, 19 bp, Homo sapiens
cttgatggaagtgggccag

SEQ ID NO: 3662605 - DNA, 20 bp, Homo sapiens
cttgatggaagtgggccagt

SEQ ID NO: 3662606 - DNA, 19 bp, Homo sapiens
cttgatgggattctggaca

SEQ ID NO: 3662607 - DNA, 19 bp, Homo sapiens
cttgatttaaacacacaga

SEQ ID NO: 3662608 - DNA, 23 bp, Homo sapiens
cttgcacacactttcatgcagtg

SEQ ID NO: 3662609 - DNA, 22 bp, Homo sapiens
gaagctcctctccccagcccag

SEQ ID NO: 3662610 - DNA, 14 bp, Homo sapiens
gaagctttggtgag

SEQ ID NO: 3662611 - DNA, 18 bp, Homo sapiens
gaaggaaaaggcagggag

SEQ ID NO: 3662612 - DNA, 19 bp, Homo sapiens
gaaggagagcaagaaggaa

SEQ ID NO: 3662613 - DNA, 20 bp, Homo sapiens
gaaggagagcaagaaggaaa

SEQ ID NO: 3662614 - DNA, 19 bp, Homo sapiens
gaaggcagggctcctccct

SEQ ID NO: 3662615 - DNA, 20 bp, Homo sapiens
gaaggcagggctcctccctg

SEQ ID NO: 3662616 - DNA, 17 bp, Homo sapiens
gaaggccgagaagcaag

SEQ ID NO: 3662617 - DNA, 18 bp, Homo sapiens
gaaggccgagaagcaaga

SEQ ID NO: 3662618 - DNA, 12 bp, Homo sapiens
gaaggctgtcct

SEQ ID NO: 3662619 - DNA, 20 bp, Homo sapiens
gaaggcttgttgtgctttta

SEQ ID NO: 3662620 - DNA, 23 bp, Homo sapiens
gaagggaggttcacctgcagcga

SEQ ID NO: 3662621 - DNA, 23 bp, Homo sapiens
gaagggcaggaaggagagcctgc

SEQ ID NO: 3662622 - DNA, 16 bp, Homo sapiens
gaagggccagagccag

SEQ ID NO: 3662623 - DNA, 17 bp, Homo sapiens
gaagggccagagccagg

SEQ ID NO: 3662624 - DNA, 16 bp, Homo sapiens
gaagggccagtcctgc

SEQ ID NO: 3662625 - DNA, 18 bp, Homo sapiens
gaagggccagtcctgcct

SEQ ID NO: 3662626 - DNA, 22 bp, Homo sapiens
gaagggccagtcctgcctggcc

SEQ ID NO: 3662627 - DNA, 17 bp, Homo sapiens
gaaggtcccacagccct

SEQ ID NO: 3662628 - DNA, 21 bp, Homo sapiens
gaaggtgctgacggccaggga

SEQ ID NO: 3662629 - DNA, 22 bp, Homo sapiens
gaaggtggatggccccagcaca

SEQ ID NO: 3662630 - DNA, 16 bp, Homo sapiens
gaagtccccaggcccc

SEQ ID NO: 3662631 - DNA, 12 bp, Homo sapiens
gaagtcctctgt

SEQ ID NO: 3662632 - DNA, 11 bp, Homo sapiens
gaagtgggcca

SEQ ID NO: 3662633 - DNA, 16 bp, Homo sapiens
gaagtgggccagtcct

SEQ ID NO: 3662634 - DNA, 18 bp, Homo sapiens
gaagtgggccagtcctgg

SEQ ID NO: 3662635 - DNA, 19 bp, Homo sapiens
gaagtgggccagtcctggt

SEQ ID NO: 3662636 - DNA, 15 bp, Homo sapiens
gaagtggggacagag

SEQ ID NO: 3662637 - DNA, 17 bp, Homo sapiens
gaagttgaagtttagga

SEQ ID NO: 3662638 - DNA, 20 bp, Homo sapiens
gaagtttgagatcagcctgg

SEQ ID NO: 3662639 - DNA, 23 bp, Homo sapiens
gaataataagcaggatgttggcc

SEQ ID NO: 3662640 - DNA, 20 bp, Homo sapiens
gaataggcattaacacaaag

SEQ ID NO: 3662641 - DNA, 23 bp, Homo sapiens
gaatagtctagatggctcctctc

SEQ ID NO: 3662642 - DNA, 14 bp, Homo sapiens
gaatattttatctt

SEQ ID NO: 3662643 - DNA, 13 bp, Homo sapiens
gaatcagaactca

SEQ ID NO: 3662644 - DNA, 19 bp, Homo sapiens
gaatcccggctccagagca

SEQ ID NO: 3662645 - DNA, 14 bp, Homo sapiens
gaatcggctgggga

SEQ ID NO: 3662646 - DNA, 14 bp, Homo sapiens
gaatctctgtgcct

SEQ ID NO: 3662647 - DNA, 23 bp, Homo sapiens
gaatcttggtttgccttccagaa

SEQ ID NO: 3662648 - DNA, 22 bp, Homo sapiens
gaatgccactgccttcgcttct

SEQ ID NO: 3662649 - DNA, 14 bp, Homo sapiens
gaatgctgggactc

SEQ ID NO: 3662650 - DNA, 17 bp, Homo sapiens
gaatgctgggactcagc

SEQ ID NO: 3662651 - DNA, 18 bp, Homo sapiens
gaatgctgggactcagcc

SEQ ID NO: 3662652 - DNA, 19 bp, Homo sapiens
gaatgctgggactcagcct

SEQ ID NO: 3662653 - DNA, 19 bp, Homo sapiens
gaatgtgataaggaaatca

SEQ ID NO: 3662654 - DNA, 14 bp, Homo sapiens
gaattaaaaaagca

SEQ ID NO: 3662655 - DNA, 17 bp, Homo sapiens
gaattagatttctatag

SEQ ID NO: 3662656 - DNA, 19 bp, Homo sapiens
gaattatttttttaaagtg

SEQ ID NO: 3662657 - DNA, 16 bp, Homo sapiens
gaatttcccaggaccc

SEQ ID NO: 3662658 - DNA, 17 bp, Homo sapiens
gaatttcccaggaccct

SEQ ID NO: 3662659 - DNA, 16 bp, Homo sapiens
gaatttcttgattttt

SEQ ID NO: 3662660 - DNA, 20 bp, Homo sapiens
gaattttctggaaaatgctt

SEQ ID NO: 3662661 - DNA, 22 bp, Homo sapiens
gaattttctttttaataaaaag

SEQ ID NO: 3662662 - DNA, 18 bp, Homo sapiens
gacaaaaaatgttttaaa

SEQ ID NO: 3662663 - DNA, 23 bp, Homo sapiens
gacaaacagtagagaacagcaaa

SEQ ID NO: 3662664 - DNA, 16 bp, Homo sapiens
gacaaatgtaaacatt

SEQ ID NO: 3662665 - DNA, 12 bp, Homo sapiens
gacaactggcag

SEQ ID NO: 3662666 - DNA, 13 bp, Homo sapiens
gacaactggcagg

SEQ ID NO: 3662667 - DNA, 17 bp, Homo sapiens
gacaactggcaggcagg

SEQ ID NO: 3662668 - DNA, 13 bp, Homo sapiens
gacaagcatggaa

SEQ ID NO: 3662669 - DNA, 16 bp, Homo sapiens
gacaagtgattttcat

SEQ ID NO: 3662670 - DNA, 20 bp, Homo sapiens
gacaagtgctgaacagtgga

SEQ ID NO: 3662671 - DNA, 18 bp, Homo sapiens
gacaatgtgaaaagaaaa

SEQ ID NO: 3662672 - DNA, 19 bp, Homo sapiens
gacaatgtgaaaagaaaaa

SEQ ID NO: 3662673 - DNA, 12 bp, Homo sapiens
gacacccagagg

SEQ ID NO: 3662674 - DNA, 13 bp, Homo sapiens
gacacccaggact

SEQ ID NO: 3662675 - DNA, 12 bp, Homo sapiens
gacacctgggag

SEQ ID NO: 3662676 - DNA, 14 bp, Homo sapiens
gacagaacactgtc

SEQ ID NO: 3662677 - DNA, 15 bp, Homo sapiens
gacagaacactgtct

SEQ ID NO: 3662678 - DNA, 13 bp, Homo sapiens
gacagaagaaggc

SEQ ID NO: 3662679 - DNA, 14 bp, Homo sapiens
gacagacaggctct

SEQ ID NO: 3662680 - DNA, 21 bp, Homo sapiens
gacagagcaagtgagaccctg

SEQ ID NO: 3662681 - DNA, 13 bp, Homo sapiens
gacagaggcccca

SEQ ID NO: 3662682 - DNA, 14 bp, Homo sapiens
gacagaggcggggc

SEQ ID NO: 3662683 - DNA, 15 bp, Homo sapiens
gacagaggcggggct

SEQ ID NO: 3662684 - DNA, 19 bp, Homo sapiens
gacagagggaagaaaagag

SEQ ID NO: 3662685 - DNA, 19 bp, Homo sapiens
gacagatctctgctttgga

SEQ ID NO: 3662686 - DNA, 16 bp, Homo sapiens
gacagatgaggctttc

SEQ ID NO: 3662687 - DNA, 15 bp, Homo sapiens
gacagccccaccctg

SEQ ID NO: 3662688 - DNA, 19 bp, Homo sapiens
gacaggatgtgtttgcttt

SEQ ID NO: 3662689 - DNA, 17 bp, Homo sapiens
gacaggctcttagcagc

SEQ ID NO: 3662690 - DNA, 13 bp, Homo sapiens
gacagggcttctc

SEQ ID NO: 3662691 - DNA, 14 bp, Homo sapiens
gacagggcttctcc

SEQ ID NO: 3662692 - DNA, 16 bp, Homo sapiens
gacagggcttctcctg

SEQ ID NO: 3662693 - DNA, 15 bp, Homo sapiens
gacagtctggagaag

SEQ ID NO: 3662694 - DNA, 17 bp, Homo sapiens
gacagtgctgttgaaga

SEQ ID NO: 3662695 - DNA, 22 bp, Homo sapiens
gacataatggggtcctggccat

SEQ ID NO: 3662696 - DNA, 14 bp, Homo sapiens
gacatacacaaatg

SEQ ID NO: 3662697 - DNA, 15 bp, Homo sapiens
gacatacttgaaggg

SEQ ID NO: 3662698 - DNA, 17 bp, Homo sapiens
gacatacttgaagggcc

SEQ ID NO: 3662699 - DNA, 23 bp, Homo sapiens
gacatacttgaagggccagagcc

SEQ ID NO: 3662700 - DNA, 15 bp, Homo sapiens
gacatatttaactgg

SEQ ID NO: 3662701 - DNA, 16 bp, Homo sapiens
gacatatttaatgttt

SEQ ID NO: 3662702 - DNA, 17 bp, Homo sapiens
gacatatttaatgtttt

SEQ ID NO: 3662703 - DNA, 20 bp, Homo sapiens
gacatatttaatgttttaaa

SEQ ID NO: 3662704 - DNA, 15 bp, Homo sapiens
gacatcctcctccca

SEQ ID NO: 3662705 - DNA, 18 bp, Homo sapiens
gacatcctcctcccaccc

SEQ ID NO: 3662706 - DNA, 23 bp, Homo sapiens
gacatctgattggcagatgagct

SEQ ID NO: 3662707 - DNA, 23 bp, Homo sapiens
gacattggcacctaatccaggca

SEQ ID NO: 3662708 - DNA, 22 bp, Homo sapiens
gacatttctctaactcctgcca

SEQ ID NO: 3662709 - DNA, 16 bp, Homo sapiens
gacatttttgtctgtc

SEQ ID NO: 3662710 - DNA, 13 bp, Homo sapiens
gaccaactgggcc

SEQ ID NO: 3662711 - DNA, 12 bp, Homo sapiens
gaccaagcagga

SEQ ID NO: 3662712 - DNA, 16 bp, Homo sapiens
gaccaagcaggaagct

SEQ ID NO: 3662713 - DNA, 20 bp, Homo sapiens
gaccaagcatcttggggggg

SEQ ID NO: 3662714 - DNA, 18 bp, Homo sapiens
gaccacaaaacttttcta

SEQ ID NO: 3662715 - DNA, 22 bp, Homo sapiens
gaccaccaccccaacaaaccat

SEQ ID NO: 3662716 - DNA, 17 bp, Homo sapiens
gaccacgcccgtcctgc

SEQ ID NO: 3662717 - DNA, 19 bp, Homo sapiens
gaccacgcccgtcctgcct

SEQ ID NO: 3662718 - DNA, 22 bp, Homo sapiens
gaccacgcccgtcctgcctgtg

SEQ ID NO: 3662719 - DNA, 13 bp, Homo sapiens
gaccagcagcgcc

SEQ ID NO: 3662720 - DNA, 14 bp, Homo sapiens
gaccagcagcgcct

SEQ ID NO: 3662721 - DNA, 16 bp, Homo sapiens
gaccagcagcgccttt

SEQ ID NO: 3662722 - DNA, 20 bp, Homo sapiens
gaccagcagcgcctttccca

SEQ ID NO: 3662723 - DNA, 23 bp, Homo sapiens
gaccagcagcgcctttcccaact

SEQ ID NO: 3662724 - DNA, 22 bp, Homo sapiens
gaccagcctggccaacatggta

SEQ ID NO: 3662725 - DNA, 18 bp, Homo sapiens
gattttacatgtggccca

SEQ ID NO: 3662726 - DNA, 21 bp, Homo sapiens
gattttcacagctttgaggaa

SEQ ID NO: 3662727 - DNA, 13 bp, Homo sapiens
gattttccaaatg

SEQ ID NO: 3662728 - DNA, 17 bp, Homo sapiens
gatttttaaaaaatatt

SEQ ID NO: 3662729 - DNA, 21 bp, Homo sapiens
gcaaaaaaattaaaatggatg

SEQ ID NO: 3662730 - DNA, 20 bp, Homo sapiens
gcaaaaaatactttttctaa

SEQ ID NO: 3662731 - DNA, 12 bp, Homo sapiens
gcaaaagaaaaa

SEQ ID NO: 3662732 - DNA, 23 bp, Homo sapiens
gcaaaaggatctttgtggccaag

SEQ ID NO: 3662733 - DNA, 13 bp, Homo sapiens
gcaaagaggcaag

SEQ ID NO: 3662734 - DNA, 15 bp, Homo sapiens
gcaaagtattgtaaa

SEQ ID NO: 3662735 - DNA, 17 bp, Homo sapiens
gcaaagtattgtaaatt

SEQ ID NO: 3662736 - DNA, 17 bp, Homo sapiens
gcaaatgtttaaacatt

SEQ ID NO: 3662737 - DNA, 12 bp, Homo sapiens
gcaaattctttt

SEQ ID NO: 3662738 - DNA, 17 bp, Homo sapiens
gcaacaaagattgagaa

SEQ ID NO: 3662739 - DNA, 14 bp, Homo sapiens
gcaacagatctgga

SEQ ID NO: 3662740 - DNA, 22 bp, Homo sapiens
gcaacagggtatggactatctg

SEQ ID NO: 3662741 - DNA, 15 bp, Homo sapiens
gcaaccactctgtgg

SEQ ID NO: 3662742 - DNA, 24 bp, Homo sapiens
gcaaccactctgtggccagcctgg

SEQ ID NO: 3662743 - DNA, 18 bp, Homo sapiens
gcaacctacccagcgtgg

SEQ ID NO: 3662744 - DNA, 19 bp, Homo sapiens
gcaacctacctgttgagca

SEQ ID NO: 3662745 - DNA, 22 bp, Homo sapiens
gcaaccttgcatccatctgggc

SEQ ID NO: 3662746 - DNA, 14 bp, Homo sapiens
gcaactcatcttag

SEQ ID NO: 3662747 - DNA, 17 bp, Homo sapiens
gcaagaattgaagcagg

SEQ ID NO: 3662748 - DNA, 19 bp, Homo sapiens
gcaagagtgtggaggctga

SEQ ID NO: 3662749 - DNA, 18 bp, Homo sapiens
gcaagcaagaaacactgg

SEQ ID NO: 3662750 - DNA, 21 bp, Homo sapiens
gcaagcagaggaccagggcct

SEQ ID NO: 3662751 - DNA, 23 bp, Homo sapiens
gcaagccctgttgacacaggtct

SEQ ID NO: 3662752 - DNA, 14 bp, Homo sapiens
gcaaggaccaggac

SEQ ID NO: 3662753 - DNA, 22 bp, Homo sapiens
gcaagggcacaagtcctggatg

SEQ ID NO: 3662754 - DNA, 20 bp, Homo sapiens
gcaaggtgtggaggctcctg

SEQ ID NO: 3662755 - DNA, 21 bp, Homo sapiens
gcaaggtgtggaggctcctgt

SEQ ID NO: 3662756 - DNA, 23 bp, Homo sapiens
gcaaggtgtggaggctcctgtgg

SEQ ID NO: 3662757 - DNA, 20 bp, Homo sapiens
gcaaggtttaggctggtggc

SEQ ID NO: 3662758 - DNA, 23 bp, Homo sapiens
gcaaggtttaggctggtggccca

SEQ ID NO: 3662759 - DNA, 18 bp, Homo sapiens
gcaagtctgagggtctgg

SEQ ID NO: 3662760 - DNA, 13 bp, Homo sapiens
gcaagtgttcact

SEQ ID NO: 3662761 - DNA, 23 bp, Homo sapiens
gcaatctccccttgatttaaaca

SEQ ID NO: 3662762 - DNA, 17 bp, Homo sapiens
gcacactgagtttgaac

SEQ ID NO: 3662763 - DNA, 19 bp, Homo sapiens
gcacagcttgacctgaggc

SEQ ID NO: 3662764 - DNA, 22 bp, Homo sapiens
gcacaggaggcaggcatggccc

SEQ ID NO: 3662765 - DNA, 13 bp, Homo sapiens
gcaccaccaagcc

SEQ ID NO: 3662766 - DNA, 23 bp, Homo sapiens
gcaccacgggacatcacagggtg

SEQ ID NO: 3662767 - DNA, 14 bp, Homo sapiens
gcaccagacaccca

SEQ ID NO: 3662768 - DNA, 13 bp, Homo sapiens
gcaccagcagcct

SEQ ID NO: 3662769 - DNA, 12 bp, Homo sapiens
gcaccagccagc

SEQ ID NO: 3662770 - DNA, 13 bp, Homo sapiens
gcaccagccagcg

SEQ ID NO: 3662771 - DNA, 18 bp, Homo sapiens
gcaccaggcgctgcccac

SEQ ID NO: 3662772 - DNA, 17 bp, Homo sapiens
gcaccattctgactcgg

SEQ ID NO: 3662773 - DNA, 17 bp, Homo sapiens
gcaccccaaagctttcc

SEQ ID NO: 3662774 - DNA, 14 bp, Homo sapiens
gcacccccctgggc

SEQ ID NO: 3662775 - DNA, 15 bp, Homo sapiens
gcaccttgtgcctgg

SEQ ID NO: 3662776 - DNA, 18 bp, Homo sapiens
gcaccttgtgcctggggt

SEQ ID NO: 3662777 - DNA, 19 bp, Homo sapiens
gcaccttgtgcctggggtg

SEQ ID NO: 3662778 - DNA, 15 bp, Homo sapiens
gcacgtggcctcttg

SEQ ID NO: 3662779 - DNA, 17 bp, Homo sapiens
gcacgtggcctcttgag

SEQ ID NO: 3662780 - DNA, 20 bp, Homo sapiens
gcactaggtaggcttctacc

SEQ ID NO: 3662781 - DNA, 18 bp, Homo sapiens
gcactatctttcagctcc

SEQ ID NO: 3662782 - DNA, 11 bp, Homo sapiens
gcactgtgaag

SEQ ID NO: 3662783 - DNA, 17 bp, Homo sapiens
gcactgtgaaggaccct

SEQ ID NO: 3662784 - DNA, 22 bp, Homo sapiens
gcacttactggtaggaccaagc

SEQ ID NO: 3662785 - DNA, 13 bp, Homo sapiens
gcactttgtaaat

SEQ ID NO: 3662786 - DNA, 14 bp, Homo sapiens
gcactttgtaaatt

SEQ ID NO: 3662787 - DNA, 14 bp, Homo sapiens
gcagaaatctagaa

SEQ ID NO: 3662788 - DNA, 19 bp, Homo sapiens
gcagaactaccaggtggca

SEQ ID NO: 3662789 - DNA, 14 bp, Homo sapiens
gcagaactcctacc

SEQ ID NO: 3662790 - DNA, 14 bp, Homo sapiens
gcagagctggctct

SEQ ID NO: 3662791 - DNA, 12 bp, Homo sapiens
gcagagcttctc

SEQ ID NO: 3662792 - DNA, 14 bp, Homo sapiens
gcagagcttctcct

SEQ ID NO: 3662793 - DNA, 17 bp, Homo sapiens
gcagagcttctcctgac

SEQ ID NO: 3662794 - DNA, 19 bp, Homo sapiens
gcagagcttctcctgacca

SEQ ID NO: 3662795 - DNA, 14 bp, Homo sapiens
gcagaggaccaggg

SEQ ID NO: 3662796 - DNA, 16 bp, Homo sapiens
gcagaggaccagggcc

SEQ ID NO: 3662797 - DNA, 12 bp, Homo sapiens
gcagaggagggg

SEQ ID NO: 3662798 - DNA, 15 bp, Homo sapiens
gcagaggaggggccg

SEQ ID NO: 3662799 - DNA, 16 bp, Homo sapiens
gcagaggatgttcata

SEQ ID NO: 3662800 - DNA, 16 bp, Homo sapiens
gcagaggtaccctggg

SEQ ID NO: 3662801 - DNA, 20 bp, Homo sapiens
gcagatctgtgccccatgcc

SEQ ID NO: 3662802 - DNA, 22 bp, Homo sapiens
gcagatctgtgccccatgcctg

SEQ ID NO: 3662803 - DNA, 16 bp, Homo sapiens
gcagatgcaaagaggc

SEQ ID NO: 3662804 - DNA, 19 bp, Homo sapiens
gcagatgcaaagaggcaag

SEQ ID NO: 3662805 - DNA, 20 bp, Homo sapiens
gcagcaccgaggggcctttg

SEQ ID NO: 3662806 - DNA, 19 bp, Homo sapiens
gcagcagggagggcttctg

SEQ ID NO: 3662807 - DNA, 20 bp, Homo sapiens
gcagcagggagggcttctgc

SEQ ID NO: 3662808 - DNA, 19 bp, Homo sapiens
gcagcagggatgccctgga

SEQ ID NO: 3662809 - DNA, 17 bp, Homo sapiens
gcagccaagctccttgg

SEQ ID NO: 3662810 - DNA, 12 bp, Homo sapiens
gcagccaggctg

SEQ ID NO: 3662811 - DNA, 13 bp, Homo sapiens
gcagcccatgccc

SEQ ID NO: 3662812 - DNA, 15 bp, Homo sapiens
gcagcccatgcccac

SEQ ID NO: 3662813 - DNA, 17 bp, Homo sapiens
gcagcccatgcccacct

SEQ ID NO: 3662814 - DNA, 18 bp, Homo sapiens
gcagccggcacagggtct

SEQ ID NO: 3662815 - DNA, 16 bp, Homo sapiens
gcagcctgtggcatct

SEQ ID NO: 3662816 - DNA, 14 bp, Homo sapiens
gcagcgagggcgga

SEQ ID NO: 3662817 - DNA, 15 bp, Homo sapiens
gcagcgcctttccca

SEQ ID NO: 3662818 - DNA, 17 bp, Homo sapiens
gcagctcaaaggcacag

SEQ ID NO: 3662819 - DNA, 19 bp, Homo sapiens
gcagctcaggttgtagtgg

SEQ ID NO: 3662820 - DNA, 23 bp, Homo sapiens
gcagctggcaggagtggggtggt

SEQ ID NO: 3662821 - DNA, 15 bp, Homo sapiens
gcagctgtcccttgc

SEQ ID NO: 3662822 - DNA, 22 bp, Homo sapiens
gcagctgtcccttgcttgcctg

SEQ ID NO: 3662823 - DNA, 14 bp, Homo sapiens
gcagctgtgtctga

SEQ ID NO: 3662824 - DNA, 15 bp, Homo sapiens
gcagctgtgtctgag

SEQ ID NO: 3662825 - DNA, 17 bp, Homo sapiens
gcagctgtgtctgagcc

SEQ ID NO: 3662826 - DNA, 21 bp, Homo sapiens
gcagctgtgtctgagcccaac

SEQ ID NO: 3662827 - DNA, 16 bp, Homo sapiens
gcaggaagctgctccg

SEQ ID NO: 3662828 - DNA, 12 bp, Homo sapiens
gcaggaaggaga

SEQ ID NO: 3662829 - DNA, 13 bp, Homo sapiens
gcaggaaggagag

SEQ ID NO: 3662830 - DNA, 15 bp, Homo sapiens
gcaggaaggagagcc

SEQ ID NO: 3662831 - DNA, 17 bp, Homo sapiens
gcaggaaggagagcctg

SEQ ID NO: 3662832 - DNA, 15 bp, Homo sapiens
gcaggaagggaagcg

SEQ ID NO: 3662833 - DNA, 17 bp, Homo sapiens
gcaggacaacgaggaag

SEQ ID NO: 3662834 - DNA, 16 bp, Homo sapiens
gcaggatgctcagtga

SEQ ID NO: 3662835 - DNA, 15 bp, Homo sapiens
gcaggcaggctccca

SEQ ID NO: 3662836 - DNA, 17 bp, Homo sapiens
gcaggcaggctcccagg

SEQ ID NO: 3662837 - DNA, 15 bp, Homo sapiens
gcaggcatggccctg

SEQ ID NO: 3662838 - DNA, 14 bp, Homo sapiens
gcaggcggggctcc

SEQ ID NO: 3662839 - DNA, 18 bp, Homo sapiens
gcaggcggggctcctcct

SEQ ID NO: 3662840 - DNA, 12 bp, Homo sapiens
gcaggctggcca

SEQ ID NO: 3662841 - DNA, 18 bp, Homo sapiens
gcagggaagccccacatg

SEQ ID NO: 3662842 - DNA, 17 bp, Homo sapiens
gccctacctggggaaag

SEQ ID NO: 3662843 - DNA, 21 bp, Homo sapiens
gccctacctggggaaagcctg

SEQ ID NO: 3662844 - DNA, 13 bp, Homo sapiens
gccctcccaaaga

SEQ ID NO: 3662845 - DNA, 22 bp, Homo sapiens
gccctccctgttccccagagaa

SEQ ID NO: 3662846 - DNA, 14 bp, Homo sapiens
gccctcctctccca

SEQ ID NO: 3662847 - DNA, 20 bp, Homo sapiens
gccctcctctcccattgtcc

SEQ ID NO: 3662848 - DNA, 14 bp, Homo sapiens
gccctctggagtgg

SEQ ID NO: 3662849 - DNA, 22 bp, Homo sapiens
gccctctggagtggccactaag

SEQ ID NO: 3662850 - DNA, 12 bp, Homo sapiens
gccctcttctcg

SEQ ID NO: 3662851 - DNA, 13 bp, Homo sapiens
gccctgccactca

SEQ ID NO: 3662852 - DNA, 15 bp, Homo sapiens
gccctgcccgggctc

SEQ ID NO: 3662853 - DNA, 20 bp, Homo sapiens
gccctgcccgggctcccaca

SEQ ID NO: 3662854 - DNA, 15 bp, Homo sapiens
gccctgccctggcag

SEQ ID NO: 3662855 - DNA, 14 bp, Homo sapiens
gccctgcctgaggg

SEQ ID NO: 3662856 - DNA, 15 bp, Homo sapiens
gccctggaggtggct

SEQ ID NO: 3662857 - DNA, 18 bp, Homo sapiens
gccctggaggtggctgag

SEQ ID NO: 3662858 - DNA, 17 bp, Homo sapiens
gccctggtccagggaag

SEQ ID NO: 3662859 - DNA, 23 bp, Homo sapiens
gccctggtccagggaagctggcc

SEQ ID NO: 3662860 - DNA, 20 bp, Homo sapiens
gccctgttgacacaggtctt

SEQ ID NO: 3662861 - DNA, 21 bp, Homo sapiens
gcccttctgattcccctccac

SEQ ID NO: 3662862 - DNA, 13 bp, Homo sapiens
gcccttctgtcca

SEQ ID NO: 3662863 - DNA, 21 bp, Homo sapiens
gcccttgcagttcagcaccac

SEQ ID NO: 3662864 - DNA, 22 bp, Homo sapiens
gcccttgcagttcagcaccacc

SEQ ID NO: 3662865 - DNA, 16 bp, Homo sapiens
gcccttggaggccagc

SEQ ID NO: 3662866 - DNA, 14 bp, Homo sapiens
gccgagaagcaaga

SEQ ID NO: 3662867 - DNA, 18 bp, Homo sapiens
gccgagattgcaccactg

SEQ ID NO: 3662868 - DNA, 22 bp, Homo sapiens
gccgatagagggacggccaaga

SEQ ID NO: 3662869 - DNA, 22 bp, Homo sapiens
gccgcaaattgtaccttttttg

SEQ ID NO: 3662870 - DNA, 16 bp, Homo sapiens
gccgccattgccacca

SEQ ID NO: 3662871 - DNA, 12 bp, Homo sapiens
gccgctgccacc

SEQ ID NO: 3662872 - DNA, 22 bp, Homo sapiens
gccggacccggaggccgaggcc

SEQ ID NO: 3662873 - DNA, 12 bp, Homo sapiens
gccggccctggg

SEQ ID NO: 3662874 - DNA, 17 bp, Homo sapiens
gccggccctgtgtgcag

SEQ ID NO: 3662875 - DNA, 16 bp, Homo sapiens
gccgggacccagggcc

SEQ ID NO: 3662876 - DNA, 21 bp, Homo sapiens
gccgggcgcggtggctcacgc

SEQ ID NO: 3662877 - DNA, 20 bp, Homo sapiens
gccggggactcccaggctgg

SEQ ID NO: 3662878 - DNA, 21 bp, Homo sapiens
gccggggactcccaggctgga

SEQ ID NO: 3662879 - DNA, 18 bp, Homo sapiens
gccgggggctggccttct

SEQ ID NO: 3662880 - DNA, 14 bp, Homo sapiens
gccgtctccagggg

SEQ ID NO: 3662881 - DNA, 23 bp, Homo sapiens
gccgtctccaggggctgcttcct

SEQ ID NO: 3662882 - DNA, 22 bp, Homo sapiens
gccgtggattgcacgtggcctc

SEQ ID NO: 3662883 - DNA, 20 bp, Homo sapiens
gccgtggggccgccgcctct

SEQ ID NO: 3662884 - DNA, 14 bp, Homo sapiens
gcctaccccgcaga

SEQ ID NO: 3662885 - DNA, 15 bp, Homo sapiens
gcctagactgttact

SEQ ID NO: 3662886 - DNA, 18 bp, Homo sapiens
gcctaggcctcagccaga

SEQ ID NO: 3662887 - DNA, 20 bp, Homo sapiens
gcctaggcctcagccagaga

SEQ ID NO: 3662888 - DNA, 14 bp, Homo sapiens
gcctcaatgccagt

SEQ ID NO: 3662889 - DNA, 14 bp, Homo sapiens
gcctcagccagaga

SEQ ID NO: 3662890 - DNA, 13 bp, Homo sapiens
gcctccagcctgg

SEQ ID NO: 3662891 - DNA, 17 bp, Homo sapiens
gcctccagcctggtggc

SEQ ID NO: 3662892 - DNA, 22 bp, Homo sapiens
gcctccagcctggtggcccagc

SEQ ID NO: 3662893 - DNA, 18 bp, Homo sapiens
gcctccaggtgcagaggt

SEQ ID NO: 3662894 - DNA, 19 bp, Homo sapiens
gcctcccctgccaccaggc

SEQ ID NO: 3662895 - DNA, 21 bp, Homo sapiens
gcctccctctctcttctgctc

SEQ ID NO: 3662896 - DNA, 22 bp, Homo sapiens
gcctccctctctcttctgctcc

SEQ ID NO: 3662897 - DNA, 21 bp, Homo sapiens
gcctctcgtcccgtccctccc

SEQ ID NO: 3662898 - DNA, 12 bp, Homo sapiens
gcctctggctag

SEQ ID NO: 3662899 - DNA, 18 bp, Homo sapiens
gcctctggctagaggcca

SEQ ID NO: 3662900 - DNA, 21 bp, Homo sapiens
gcctctggctagaggccagcc

SEQ ID NO: 3662901 - DNA, 18 bp, Homo sapiens
gcctctgtcttctggact

SEQ ID NO: 3662902 - DNA, 17 bp, Homo sapiens
gcctcttctgtcccaag

SEQ ID NO: 3662903 - DNA, 20 bp, Homo sapiens
gcctcttctgtcccaagtct

SEQ ID NO: 3662904 - DNA, 19 bp, Homo sapiens
gcctcttgagcagtggctg

SEQ ID NO: 3662905 - DNA, 21 bp, Homo sapiens
gcctcttgagcagtggctggt

SEQ ID NO: 3662906 - DNA, 19 bp, Homo sapiens
gcctgaagggcctcccagc

SEQ ID NO: 3662907 - DNA, 22 bp, Homo sapiens
gcctgaaggggcgtctgttccc

SEQ ID NO: 3662908 - DNA, 15 bp, Homo sapiens
gcctgagggtgggct

SEQ ID NO: 3662909 - DNA, 14 bp, Homo sapiens
gcctgatgctccct

SEQ ID NO: 3662910 - DNA, 16 bp, Homo sapiens
gcctgatgctccctcc

SEQ ID NO: 3662911 - DNA, 16 bp, Homo sapiens
gcctgcataggctcct

SEQ ID NO: 3662912 - DNA, 17 bp, Homo sapiens
gcctgcataggctcctt

SEQ ID NO: 3662913 - DNA, 18 bp, Homo sapiens
gcctgccagctgcactga

SEQ ID NO: 3662914 - DNA, 18 bp, Homo sapiens
gcctgcccctcccagaac

SEQ ID NO: 3662915 - DNA, 15 bp, Homo sapiens
gcctgcgaccctggg

SEQ ID NO: 3662916 - DNA, 16 bp, Homo sapiens
gcctgcgaccctgggg

SEQ ID NO: 3662917 - DNA, 13 bp, Homo sapiens
gcctgctccagac

SEQ ID NO: 3662918 - DNA, 14 bp, Homo sapiens
gcctgctccagacc

SEQ ID NO: 3662919 - DNA, 18 bp, Homo sapiens
gcctgctgcatggggtgg

SEQ ID NO: 3662920 - DNA, 20 bp, Homo sapiens
gcctgctgcgccccaggccc

SEQ ID NO: 3662921 - DNA, 16 bp, Homo sapiens
gcctggactttcctgc

SEQ ID NO: 3662922 - DNA, 18 bp, Homo sapiens
gcctggactttcctgcaa

SEQ ID NO: 3662923 - DNA, 19 bp, Homo sapiens
gcctggagacttagggcac

SEQ ID NO: 3662924 - DNA, 23 bp, Homo sapiens
gcctggagacttagggcaccagg

SEQ ID NO: 3662925 - DNA, 16 bp, Homo sapiens
gcctggagatcctcct

SEQ ID NO: 3662926 - DNA, 17 bp, Homo sapiens
gcctggagatcctcctg

SEQ ID NO: 3662927 - DNA, 19 bp, Homo sapiens
gcctggagatcctcctgca

SEQ ID NO: 3662928 - DNA, 24 bp, Homo sapiens
gcctggagtgtatgactgcacatg

SEQ ID NO: 3662929 - DNA, 17 bp, Homo sapiens
gcctggccagacacagg

SEQ ID NO: 3662930 - DNA, 19 bp, Homo sapiens
gcctggccaggagctcttc

SEQ ID NO: 3662931 - DNA, 13 bp, Homo sapiens
gcctggctttgga

SEQ ID NO: 3662932 - DNA, 22 bp, Homo sapiens
gcctgggaggtcaaggctgcag

SEQ ID NO: 3662933 - DNA, 18 bp, Homo sapiens
gcctgggcagccaggctg

SEQ ID NO: 3662934 - DNA, 20 bp, Homo sapiens
gcctgggcagccaggctgcc

SEQ ID NO: 3662935 - DNA, 23 bp, Homo sapiens
gcctgggcagccaggctgccaag

SEQ ID NO: 3662936 - DNA, 14 bp, Homo sapiens
gcctggggtctgga

SEQ ID NO: 3662937 - DNA, 22 bp, Homo sapiens
gcctggggtgttagtggcaccg

SEQ ID NO: 3662938 - DNA, 19 bp, Homo sapiens
gcctgtagctttcctggtc

SEQ ID NO: 3662939 - DNA, 14 bp, Homo sapiens
gcctgtccagcctg

SEQ ID NO: 3662940 - DNA, 17 bp, Homo sapiens
gcctgtctcatccccag

SEQ ID NO: 3662941 - DNA, 22 bp, Homo sapiens
gcctgtctcatccccaggggtc

SEQ ID NO: 3662942 - DNA, 23 bp, Homo sapiens
gcctgtggctgtcggtgggactc

SEQ ID NO: 3662943 - DNA, 13 bp, Homo sapiens
gcctgtgtcttta

SEQ ID NO: 3662944 - DNA, 19 bp, Homo sapiens
gccttaaaattacttggct

SEQ ID NO: 3662945 - DNA, 22 bp, Homo sapiens
gccttattggaaagcagtcccc

SEQ ID NO: 3662946 - DNA, 12 bp, Homo sapiens
gccttcaagtgc

SEQ ID NO: 3662947 - DNA, 15 bp, Homo sapiens
gccttcaagtgccaa

SEQ ID NO: 3662948 - DNA, 17 bp, Homo sapiens
gccttcgcttcttgcct

SEQ ID NO: 3662949 - DNA, 21 bp, Homo sapiens
gccttcgcttcttgcctctgt

SEQ ID NO: 3662950 - DNA, 12 bp, Homo sapiens
gccttgccagag

SEQ ID NO: 3662951 - DNA, 19 bp, Homo sapiens
gccttgctgtttgtcctga

SEQ ID NO: 3662952 - DNA, 22 bp, Homo sapiens
gccttgggctgctcctcatggt

SEQ ID NO: 3662953 - DNA, 15 bp, Homo sapiens
gccttggtgggggag

SEQ ID NO: 3662954 - DNA, 23 bp, Homo sapiens
gccttggtgggggagcctctgga

SEQ ID NO: 3662955 - DNA, 20 bp, Homo sapiens
gcctttatcaagcttagtga

SEQ ID NO: 3662956 - DNA, 15 bp, Homo sapiens
gcctttcaaatttag

SEQ ID NO: 3662957 - DNA, 12 bp, Homo sapiens
gcctttcctgga

SEQ ID NO: 3662958 - DNA, 18 bp, Homo sapiens
ggcaggacaacgaggaag

SEQ ID NO: 3662959 - DNA, 21 bp, Homo sapiens
ggcaggacaacgaggaagccc

SEQ ID NO: 3662960 - DNA, 13 bp, Homo sapiens
ggcaggagtgggg

SEQ ID NO: 3662961 - DNA, 18 bp, Homo sapiens
ggcaggcaggctcccagg

SEQ ID NO: 3662962 - DNA, 15 bp, Homo sapiens
ggcaggcatggccct

SEQ ID NO: 3662963 - DNA, 17 bp, Homo sapiens
ggcaggcatggccctgg

SEQ ID NO: 3662964 - DNA, 18 bp, Homo sapiens
ggcaggcatggccctggg

SEQ ID NO: 3662965 - DNA, 17 bp, Homo sapiens
ggcaggctggccagtcc

SEQ ID NO: 3662966 - DNA, 20 bp, Homo sapiens
ggcaggctggccagtccagg

SEQ ID NO: 3662967 - DNA, 17 bp, Homo sapiens
ggcagggagctgggccc

SEQ ID NO: 3662968 - DNA, 21 bp, Homo sapiens
ggcagggctcctccctggagc

SEQ ID NO: 3662969 - DNA, 17 bp, Homo sapiens
ggcaggggcctggagat

SEQ ID NO: 3662970 - DNA, 12 bp, Homo sapiens
ggcagggtccta

SEQ ID NO: 3662971 - DNA, 15 bp, Homo sapiens
ggcaggtccagctct

SEQ ID NO: 3662972 - DNA, 16 bp, Homo sapiens
ggcaggtccagctctg

SEQ ID NO: 3662973 - DNA, 15 bp, Homo sapiens
ggcagtactcctccc

SEQ ID NO: 3662974 - DNA, 21 bp, Homo sapiens
ggcagtagaactccaggccct

SEQ ID NO: 3662975 - DNA, 21 bp, Homo sapiens
ggcagttctgggtgctcccta

SEQ ID NO: 3662976 - DNA, 18 bp, Homo sapiens
ggcatcaccttaggcagg

SEQ ID NO: 3662977 - DNA, 18 bp, Homo sapiens
ggcatcgcaccattctga

SEQ ID NO: 3662978 - DNA, 18 bp, Homo sapiens
ggcatctgcccctccccc

SEQ ID NO: 3662979 - DNA, 19 bp, Homo sapiens
ggcatctgcccctccccca

SEQ ID NO: 3662980 - DNA, 17 bp, Homo sapiens
ggcatctttgccttggg

SEQ ID NO: 3662981 - DNA, 13 bp, Homo sapiens
ggcatgctggagt

SEQ ID NO: 3662982 - DNA, 23 bp, Homo sapiens
ggcattgatggggaaggaggctg

SEQ ID NO: 3662983 - DNA, 13 bp, Homo sapiens
ggcatttcacaaa

SEQ ID NO: 3662984 - DNA, 23 bp, Homo sapiens
ggccaaagtgccggtgagaccca

SEQ ID NO: 3662985 - DNA, 15 bp, Homo sapiens
ggccaaggagctgct

SEQ ID NO: 3662986 - DNA, 16 bp, Homo sapiens
ggccaaggagctgcta

SEQ ID NO: 3662987 - DNA, 12 bp, Homo sapiens
ggccacatggcg

SEQ ID NO: 3662988 - DNA, 20 bp, Homo sapiens
ggccactaagcagaggaggg

SEQ ID NO: 3662989 - DNA, 15 bp, Homo sapiens
ggccactgagctggc

SEQ ID NO: 3662990 - DNA, 16 bp, Homo sapiens
ggccagacacaggccc

SEQ ID NO: 3662991 - DNA, 18 bp, Homo sapiens
ggccagacatgccacaag

SEQ ID NO: 3662992 - DNA, 14 bp, Homo sapiens
ggccagagccaagg

SEQ ID NO: 3662993 - DNA, 14 bp, Homo sapiens
ggccagagccaggg

SEQ ID NO: 3662994 - DNA, 16 bp, Homo sapiens
ggccagaggcccccag

SEQ ID NO: 3662995 - DNA, 19 bp, Homo sapiens
ggccagaggcccccagccc

SEQ ID NO: 3662996 - DNA, 22 bp, Homo sapiens
ggccagaggcccccagcccagg

SEQ ID NO: 3662997 - DNA, 17 bp, Homo sapiens
ggccagatccagcctgg

SEQ ID NO: 3662998 - DNA, 14 bp, Homo sapiens
ggccagccatgtct

SEQ ID NO: 3662999 - DNA, 13 bp, Homo sapiens
ggccagccccacc

SEQ ID NO: 3663000 - DNA, 15 bp, Homo sapiens
ggccagccccaccca

SEQ ID NO: 3663001 - DNA, 21 bp, Homo sapiens
ggccagcgcccctcagcctct

SEQ ID NO: 3663002 - DNA, 15 bp, Homo sapiens
ggccaggcagatctg

SEQ ID NO: 3663003 - DNA, 16 bp, Homo sapiens
ggccagggagaagctc

SEQ ID NO: 3663004 - DNA, 15 bp, Homo sapiens
ggccagtccaggctg

SEQ ID NO: 3663005 - DNA, 18 bp, Homo sapiens
ggccagtcctgcctggcc

SEQ ID NO: 3663006 - DNA, 20 bp, Homo sapiens
ggccagtcctgcctggccag

SEQ ID NO: 3663007 - DNA, 22 bp, Homo sapiens
ggccagtcctgcctggccaggc

SEQ ID NO: 3663008 - DNA, 21 bp, Homo sapiens
ggccagtcctggttgtctgaa

SEQ ID NO: 3663009 - DNA, 14 bp, Homo sapiens
ggccagtctgtgga

SEQ ID NO: 3663010 - DNA, 15 bp, Homo sapiens
ggccagtctgtggat

SEQ ID NO: 3663011 - DNA, 18 bp, Homo sapiens
ggccagtctgtggatcag

SEQ ID NO: 3663012 - DNA, 15 bp, Homo sapiens
ggccatgatggcaac

SEQ ID NO: 3663013 - DNA, 13 bp, Homo sapiens
ggccatgctgagg

SEQ ID NO: 3663014 - DNA, 22 bp, Homo sapiens
ggccatgctgaggcctgggccg

SEQ ID NO: 3663015 - DNA, 23 bp, Homo sapiens
ggcccaacacaattcttcttcca

SEQ ID NO: 3663016 - DNA, 15 bp, Homo sapiens
ggcccagagcccagc

SEQ ID NO: 3663017 - DNA, 17 bp, Homo sapiens
ggcccagagcccagctc

SEQ ID NO: 3663018 - DNA, 23 bp, Homo sapiens
ggcccagctattaccacacttgg

SEQ ID NO: 3663019 - DNA, 22 bp, Homo sapiens
ggcccaggaccatcatcctact

SEQ ID NO: 3663020 - DNA, 22 bp, Homo sapiens
ggcccagggcccagagcccagc

SEQ ID NO: 3663021 - DNA, 18 bp, Homo sapiens
ggcccagtgcatggtggc

SEQ ID NO: 3663022 - DNA, 22 bp, Homo sapiens
ggcccagtgcatggtggccaga

SEQ ID NO: 3663023 - DNA, 16 bp, Homo sapiens
ggcccatatccctggt

SEQ ID NO: 3663024 - DNA, 23 bp, Homo sapiens
ggcccatggctgttggtgggacc

SEQ ID NO: 3663025 - DNA, 23 bp, Homo sapiens
ggccccaccctgggccctgggct

SEQ ID NO: 3663026 - DNA, 13 bp, Homo sapiens
ggccccagcctcc

SEQ ID NO: 3663027 - DNA, 14 bp, Homo sapiens
ggccccaggaagcc

SEQ ID NO: 3663028 - DNA, 15 bp, Homo sapiens
ggccccaggaagccg

SEQ ID NO: 3663029 - DNA, 17 bp, Homo sapiens
ggcccccagcccagggc

SEQ ID NO: 3663030 - DNA, 13 bp, Homo sapiens
ggcccccttcctg

SEQ ID NO: 3663031 - DNA, 17 bp, Homo sapiens
ggcccccttcctggccc

SEQ ID NO: 3663032 - DNA, 22 bp, Homo sapiens
ggcccctatgtagtccgtgctg

SEQ ID NO: 3663033 - DNA, 22 bp, Homo sapiens
ggcccctcccagtaagggcgtg

SEQ ID NO: 3663034 - DNA, 13 bp, Homo sapiens
ggcccctggcact

SEQ ID NO: 3663035 - DNA, 22 bp, Homo sapiens
ggccccttccacgggggctgtg

SEQ ID NO: 3663036 - DNA, 19 bp, Homo sapiens
ggcccgccctgcccgggct

SEQ ID NO: 3663037 - DNA, 19 bp, Homo sapiens
ggcccggcccctcctgact

SEQ ID NO: 3663038 - DNA, 15 bp, Homo sapiens
ggccctaccctcctg

SEQ ID NO: 3663039 - DNA, 18 bp, Homo sapiens
ggccctaccctcctgctg

SEQ ID NO: 3663040 - DNA, 23 bp, Homo sapiens
ggccctaccctcctgctgagctg

SEQ ID NO: 3663041 - DNA, 19 bp, Homo sapiens
ggccctccctgttccccag

SEQ ID NO: 3663042 - DNA, 21 bp, Homo sapiens
ggccctccctgttccccagag

SEQ ID NO: 3663043 - DNA, 23 bp, Homo sapiens
ggccctccctgttccccagagaa

SEQ ID NO: 3663044 - DNA, 14 bp, Homo sapiens
ggccctgtgtgcag

SEQ ID NO: 3663045 - DNA, 18 bp, Homo sapiens
ggccgcggctccccctgg

SEQ ID NO: 3663046 - DNA, 20 bp, Homo sapiens
ggccgcggctccccctggac

SEQ ID NO: 3663047 - DNA, 18 bp, Homo sapiens
ggccgctgaacccacccg

SEQ ID NO: 3663048 - DNA, 15 bp, Homo sapiens
ggccgctgccaccca

SEQ ID NO: 3663049 - DNA, 19 bp, Homo sapiens
ggccgctgccacccacctc

SEQ ID NO: 3663050 - DNA, 15 bp, Homo sapiens
ggccggccctgtgtg

SEQ ID NO: 3663051 - DNA, 20 bp, Homo sapiens
ggcctaccccgcagacacct

SEQ ID NO: 3663052 - DNA, 24 bp, Homo sapiens
ggcctactagagtctgaacagctg

SEQ ID NO: 3663053 - DNA, 16 bp, Homo sapiens
ggcctcagctgcctca

SEQ ID NO: 3663054 - DNA, 11 bp, Homo sapiens
ggcctcagttt

SEQ ID NO: 3663055 - DNA, 14 bp, Homo sapiens
ggcctcatgtggct

SEQ ID NO: 3663056 - DNA, 22 bp, Homo sapiens
ggcctcccctgccaccaggcca

SEQ ID NO: 3663057 - DNA, 23 bp, Homo sapiens
ggcctccctctctcttctgctcc

SEQ ID NO: 3663058 - DNA, 13 bp, Homo sapiens
ggcctcttgagca

SEQ ID NO: 3663059 - DNA, 17 bp, Homo sapiens
ggcctgcataggctcct

SEQ ID NO: 3663060 - DNA, 23 bp, Homo sapiens
ggcctgcgaccctgggggcacag

SEQ ID NO: 3663061 - DNA, 18 bp, Homo sapiens
ggcctgctccagacctga

SEQ ID NO: 3663062 - DNA, 18 bp, Homo sapiens
ggcctggagatcctcctg

SEQ ID NO: 3663063 - DNA, 14 bp, Homo sapiens
ggcctggccaggag

SEQ ID NO: 3663064 - DNA, 15 bp, Homo sapiens
ggcctggccaggagc

SEQ ID NO: 3663065 - DNA, 18 bp, Homo sapiens
ggcctggccaggagctct

SEQ ID NO: 3663066 - DNA, 23 bp, Homo sapiens
ggccttaaaattacttggctttt

SEQ ID NO: 3663067 - DNA, 16 bp, Homo sapiens
ggccttgctgtggagc

SEQ ID NO: 3663068 - DNA, 14 bp, Homo sapiens
ggcctttcctggaa

SEQ ID NO: 3663069 - DNA, 14 bp, Homo sapiens
ggcctttggcttca

SEQ ID NO: 3663070 - DNA, 16 bp, Homo sapiens
ggccttttctggcacc

SEQ ID NO: 3663071 - DNA, 17 bp, Homo sapiens
ggccttttctggcaccg

SEQ ID NO: 3663072 - DNA, 21 bp, Homo sapiens
ggcgccgtctccaggggctgc

SEQ ID NO: 3663073 - DNA, 14 bp, Homo sapiens
ggcgggactcctcc

SEQ ID NO: 3663074 - DNA, 21 bp, Homo sapiens
ggttctccgttagctcctgtg

SEQ ID NO: 3663075 - DNA, 20 bp, Homo sapiens
ggttctctgggcctcagttt

SEQ ID NO: 3663076 - DNA, 19 bp, Homo sapiens
ggttctgcctgccagctgc

SEQ ID NO: 3663077 - DNA, 13 bp, Homo sapiens
ggttctgcctgct

SEQ ID NO: 3663078 - DNA, 13 bp, Homo sapiens
ggttgaggtttca

SEQ ID NO: 3663079 - DNA, 21 bp, Homo sapiens
ggttggtatctcaggtctgaa

SEQ ID NO: 3663080 - DNA, 16 bp, Homo sapiens
ggttgtctgaacccag

SEQ ID NO: 3663081 - DNA, 20 bp, Homo sapiens
ggttgtctgaacccaggcag

SEQ ID NO: 3663082 - DNA, 21 bp, Homo sapiens
ggttgtctgaacccaggcagc

SEQ ID NO: 3663083 - DNA, 22 bp, Homo sapiens
ggttgtctgaacccaggcagct

SEQ ID NO: 3663084 - DNA, 14 bp, Homo sapiens
ggttgtgcactgtt

SEQ ID NO: 3663085 - DNA, 20 bp, Homo sapiens
ggttgttttttcctttgctc

SEQ ID NO: 3663086 - DNA, 13 bp, Homo sapiens
ggtttaagctgtt

SEQ ID NO: 3663087 - DNA, 15 bp, Homo sapiens
ggtttctctgtggct

SEQ ID NO: 3663088 - DNA, 22 bp, Homo sapiens
ggtttctctgtggctccaggcc

SEQ ID NO: 3663089 - DNA, 18 bp, Homo sapiens
ggtttgaatataaacact

SEQ ID NO: 3663090 - DNA, 14 bp, Homo sapiens
ggtttgcaaggaag

SEQ ID NO: 3663091 - DNA, 19 bp, Homo sapiens
ggtttttaaattttgtaat

SEQ ID NO: 3663092 - DNA, 13 bp, Homo sapiens
gtaaaaaaaccac

SEQ ID NO: 3663093 - DNA, 13 bp, Homo sapiens
gtaaaaataaaat

SEQ ID NO: 3663094 - DNA, 20 bp, Homo sapiens
gtaaaatcctacagtgaaat

SEQ ID NO: 3663095 - DNA, 16 bp, Homo sapiens
gtaaacataccaacat

SEQ ID NO: 3663096 - DNA, 16 bp, Homo sapiens
gtaaacgctgtcccta

SEQ ID NO: 3663097 - DNA, 21 bp, Homo sapiens
gtaaacttcctattttcttga

SEQ ID NO: 3663098 - DNA, 16 bp, Homo sapiens
gtaaagactgtagaag

SEQ ID NO: 3663099 - DNA, 20 bp, Homo sapiens
gtaaaggaaataagagcagt

SEQ ID NO: 3663100 - DNA, 20 bp, Homo sapiens
gtaaataggatttttagaat

SEQ ID NO: 3663101 - DNA, 16 bp, Homo sapiens
gtaaatatatgaacat

SEQ ID NO: 3663102 - DNA, 22 bp, Homo sapiens
gtaaatgttatcttatactgta

SEQ ID NO: 3663103 - DNA, 14 bp, Homo sapiens
gtaaattatatttg

SEQ ID NO: 3663104 - DNA, 15 bp, Homo sapiens
gtaaattatatttgt

SEQ ID NO: 3663105 - DNA, 20 bp, Homo sapiens
gtaaattatatttgtgctat

SEQ ID NO: 3663106 - DNA, 23 bp, Homo sapiens
gtaaattatatttgtgctatagt

SEQ ID NO: 3663107 - DNA, 20 bp, Homo sapiens
gtaacagatatcagtgtctc

SEQ ID NO: 3663108 - DNA, 18 bp, Homo sapiens
gtaacctctacaggcatt

SEQ ID NO: 3663109 - DNA, 19 bp, Homo sapiens
gtaactatttcttcagagt

SEQ ID NO: 3663110 - DNA, 12 bp, Homo sapiens
gtaactgtcagg

SEQ ID NO: 3663111 - DNA, 20 bp, Homo sapiens
gtaagaaacctactgcccag

SEQ ID NO: 3663112 - DNA, 22 bp, Homo sapiens
gtaagaagtttcttaaacattg

SEQ ID NO: 3663113 - DNA, 13 bp, Homo sapiens
gtaagggcgtggc

SEQ ID NO: 3663114 - DNA, 10 bp, Homo sapiens
gtaaggttcc

SEQ ID NO: 3663115 - DNA, 16 bp, Homo sapiens
gtaagtgcctgctgta

SEQ ID NO: 3663116 - DNA, 12 bp, Homo sapiens
gtaatatgaaat

SEQ ID NO: 3663117 - DNA, 20 bp, Homo sapiens
gtaatcccagctacttggga

SEQ ID NO: 3663118 - DNA, 23 bp, Homo sapiens
gtaatcctagcactttgggaggc

SEQ ID NO: 3663119 - DNA, 22 bp, Homo sapiens
gtaattaatatctcctggaaca

SEQ ID NO: 3663120 - DNA, 23 bp, Homo sapiens
gtaattgtactaaagccaaacat

SEQ ID NO: 3663121 - DNA, 21 bp, Homo sapiens
gtaatttattgtctgtctaca

SEQ ID NO: 3663122 - DNA, 18 bp, Homo sapiens
gtacaaaaataaatttat

SEQ ID NO: 3663123 - DNA, 14 bp, Homo sapiens
gtacaacggaggcc

SEQ ID NO: 3663124 - DNA, 23 bp, Homo sapiens
gtacaacggaggcctgcgaccct

SEQ ID NO: 3663125 - DNA, 16 bp, Homo sapiens
gtacagacatatttaa

SEQ ID NO: 3663126 - DNA, 15 bp, Homo sapiens
gtacaggcagcacag

SEQ ID NO: 3663127 - DNA, 15 bp, Homo sapiens
gtactagtgttctgt

SEQ ID NO: 3663128 - DNA, 14 bp, Homo sapiens
gtactcctccctgg

SEQ ID NO: 3663129 - DNA, 18 bp, Homo sapiens
gtactttctaagagaaag

SEQ ID NO: 3663130 - DNA, 22 bp, Homo sapiens
gtacttttcattctcttttaat

SEQ ID NO: 3663131 - DNA, 23 bp, Homo sapiens
gtactttttagtaatttcttttt

SEQ ID NO: 3663132 - DNA, 20 bp, Homo sapiens
gtacttttttaaatattttc

SEQ ID NO: 3663133 - DNA, 17 bp, Homo sapiens
gtagaactccaggccct

SEQ ID NO: 3663134 - DNA, 21 bp, Homo sapiens
gtagaccttgttacttctgag

SEQ ID NO: 3663135 - DNA, 13 bp, Homo sapiens
gtagagtgggagc

SEQ ID NO: 3663136 - DNA, 16 bp, Homo sapiens
gtagccacaccaggat

SEQ ID NO: 3663137 - DNA, 15 bp, Homo sapiens
gtagctaacagtgaa

SEQ ID NO: 3663138 - DNA, 14 bp, Homo sapiens
gtagctttcctggt

SEQ ID NO: 3663139 - DNA, 19 bp, Homo sapiens
gtaggaccaagcatcttgg

SEQ ID NO: 3663140 - DNA, 20 bp, Homo sapiens
gtaggtaaaagtagaagcat

SEQ ID NO: 3663141 - DNA, 22 bp, Homo sapiens
gtaggtgagcgctttgcagtca

SEQ ID NO: 3663142 - DNA, 16 bp, Homo sapiens
gtaggttcagccaagg

SEQ ID NO: 3663143 - DNA, 19 bp, Homo sapiens
gtagtaatttattgtctgt

SEQ ID NO: 3663144 - DNA, 24 bp, Homo sapiens
gtagtaatttattgtctgtctaca

SEQ ID NO: 3663145 - DNA, 22 bp, Homo sapiens
gtagtccgtgctgacagctgct

SEQ ID NO: 3663146 - DNA, 16 bp, Homo sapiens
gtagtcctcccaagct

SEQ ID NO: 3663147 - DNA, 17 bp, Homo sapiens
gtagtcctcccaagctg

SEQ ID NO: 3663148 - DNA, 19 bp, Homo sapiens
gtagtcctcccaagctgtg

SEQ ID NO: 3663149 - DNA, 20 bp, Homo sapiens
gtagtcctcccaagctgtgc

SEQ ID NO: 3663150 - DNA, 15 bp, Homo sapiens
gtataatatttttaa

SEQ ID NO: 3663151 - DNA, 15 bp, Homo sapiens
gtatacatcttatag

SEQ ID NO: 3663152 - DNA, 20 bp, Homo sapiens
gtatagcatgcatctgttta

SEQ ID NO: 3663153 - DNA, 15 bp, Homo sapiens
gtatatacttaagaa

SEQ ID NO: 3663154 - DNA, 17 bp, Homo sapiens
gtatatttgtaaagcta

SEQ ID NO: 3663155 - DNA, 14 bp, Homo sapiens
gtatccatgctctt

SEQ ID NO: 3663156 - DNA, 14 bp, Homo sapiens
gtatccccccatct

SEQ ID NO: 3663157 - DNA, 18 bp, Homo sapiens
gtatctgggtaagaagaa

SEQ ID NO: 3663158 - DNA, 23 bp, Homo sapiens
gtatctgggtaagaagaaagcaa

SEQ ID NO: 3663159 - DNA, 21 bp, Homo sapiens
gtattaatgtatgtaggagct

SEQ ID NO: 3663160 - DNA, 19 bp, Homo sapiens
gtatttgattcaaaatatt

SEQ ID NO: 3663161 - DNA, 14 bp, Homo sapiens
gtatttttatataa

SEQ ID NO: 3663162 - DNA, 14 bp, Homo sapiens
gtcaacagttttcc

SEQ ID NO: 3663163 - DNA, 21 bp, Homo sapiens
gtcaacagttttcctatgctt

SEQ ID NO: 3663164 - DNA, 21 bp, Homo sapiens
gtcaacctcgcgcttgctggc

SEQ ID NO: 3663165 - DNA, 17 bp, Homo sapiens
gtcaagagtagttatat

SEQ ID NO: 3663166 - DNA, 19 bp, Homo sapiens
gtcaagctcctcctccctg

SEQ ID NO: 3663167 - DNA, 19 bp, Homo sapiens
gtcaagtgaaaaaggagga

SEQ ID NO: 3663168 - DNA, 16 bp, Homo sapiens
gtcaatacaaatgtta

SEQ ID NO: 3663169 - DNA, 17 bp, Homo sapiens
gtcaatgggacctgtgg

SEQ ID NO: 3663170 - DNA, 17 bp, Homo sapiens
gtcaccggatcctgggt

SEQ ID NO: 3663171 - DNA, 19 bp, Homo sapiens
gtcacctagcaagctgccg

SEQ ID NO: 3663172 - DNA, 14 bp, Homo sapiens
gtcactaatacaca

SEQ ID NO: 3663173 - DNA, 13 bp, Homo sapiens
gtcactcaaggcg

SEQ ID NO: 3663174 - DNA, 12 bp, Homo sapiens
gtcagagccact

SEQ ID NO: 3663175 - DNA, 17 bp, Homo sapiens
gtcagcccaagattctt

SEQ ID NO: 3663176 - DNA, 13 bp, Homo sapiens
gtcagctccagct

SEQ ID NO: 3663177 - DNA, 17 bp, Homo sapiens
gtcagctgctccctggc

SEQ ID NO: 3663178 - DNA, 18 bp, Homo sapiens
gtcagggacccctgccct

SEQ ID NO: 3663179 - DNA, 23 bp, Homo sapiens
gtcagggtgtgggatctgaggag

SEQ ID NO: 3663180 - DNA, 16 bp, Homo sapiens
gtcagtgcagcagagg

SEQ ID NO: 3663181 - DNA, 16 bp, Homo sapiens
gtcagttactttttta

SEQ ID NO: 3663182 - DNA, 17 bp, Homo sapiens
gtcatatactgccatgt

SEQ ID NO: 3663183 - DNA, 16 bp, Homo sapiens
gtcatatgttaagcag

SEQ ID NO: 3663184 - DNA, 20 bp, Homo sapiens
gtcatcttgaccaagcagga

SEQ ID NO: 3663185 - DNA, 14 bp, Homo sapiens
gtcatgcaaagatt

SEQ ID NO: 3663186 - DNA, 16 bp, Homo sapiens
gtcatgccctcctctc

SEQ ID NO: 3663187 - DNA, 17 bp, Homo sapiens
gtcatgccctcctctcc

SEQ ID NO: 3663188 - DNA, 16 bp, Homo sapiens
gtcatggagaaccacc

SEQ ID NO: 3663189 - DNA, 16 bp, Homo sapiens
gtcatttgttaaaata

SEQ ID NO: 3663190 - DNA, 20 bp, Homo sapiens
gttggcttctccctggggac

SEQ ID NO: 3663191 - DNA, 15 bp, Homo sapiens
gttgggcccagatct

SEQ ID NO: 3663192 - DNA, 14 bp, Homo sapiens
gttggtaaacagtt

SEQ ID NO: 3663193 - DNA, 17 bp, Homo sapiens
gttggtatctcaggtct

SEQ ID NO: 3663194 - DNA, 18 bp, Homo sapiens
gttgtctgaacccaggca

SEQ ID NO: 3663195 - DNA, 19 bp, Homo sapiens
gttgtctgaacccaggcag

SEQ ID NO: 3663196 - DNA, 22 bp, Homo sapiens
gttgtctgaacccaggcagctg

SEQ ID NO: 3663197 - DNA, 16 bp, Homo sapiens
gttgtgaaatttaatg

SEQ ID NO: 3663198 - DNA, 13 bp, Homo sapiens
gttgttgttgttt

SEQ ID NO: 3663199 - DNA, 14 bp, Homo sapiens
gtttaatctgttat

SEQ ID NO: 3663200 - DNA, 21 bp, Homo sapiens
gtttaggctggtggcccagga

SEQ ID NO: 3663201 - DNA, 15 bp, Homo sapiens
gtttatcagcaaaaa

SEQ ID NO: 3663202 - DNA, 22 bp, Homo sapiens
gtttatggcctcagctgcctca

SEQ ID NO: 3663203 - DNA, 15 bp, Homo sapiens
gtttatgtcttgttc

SEQ ID NO: 3663204 - DNA, 15 bp, Homo sapiens
gtttcaaaataaaaa

SEQ ID NO: 3663205 - DNA, 19 bp, Homo sapiens
gtttcacaaggtctttaaa

SEQ ID NO: 3663206 - DNA, 16 bp, Homo sapiens
gtttcattcatcctga

SEQ ID NO: 3663207 - DNA, 17 bp, Homo sapiens
gtttccgtgcgtggcac

SEQ ID NO: 3663208 - DNA, 18 bp, Homo sapiens
gtttcctctagttctttg

SEQ ID NO: 3663209 - DNA, 22 bp, Homo sapiens
gtttcctctagttctttgttca

SEQ ID NO: 3663210 - DNA, 15 bp, Homo sapiens
gtttcctgacattgt

SEQ ID NO: 3663211 - DNA, 23 bp, Homo sapiens
gtttcgtggggaggtctaatcta

SEQ ID NO: 3663212 - DNA, 20 bp, Homo sapiens
gtttctgaaaattaacactg

SEQ ID NO: 3663213 - DNA, 16 bp, Homo sapiens
gtttctgcttatttca

SEQ ID NO: 3663214 - DNA, 22 bp, Homo sapiens
gtttcttaaccctttccagagt

SEQ ID NO: 3663215 - DNA, 19 bp, Homo sapiens
gtttctttaaccttgtata

SEQ ID NO: 3663216 - DNA, 19 bp, Homo sapiens
gtttctttattttgtgtaa

SEQ ID NO: 3663217 - DNA, 16 bp, Homo sapiens
gtttgaaagtaaaaac

SEQ ID NO: 3663218 - DNA, 18 bp, Homo sapiens
gtttgagatcagcctggg

SEQ ID NO: 3663219 - DNA, 15 bp, Homo sapiens
gtttgcaaggaagcc

SEQ ID NO: 3663220 - DNA, 22 bp, Homo sapiens
gtttgcaaggaagccacagctg

SEQ ID NO: 3663221 - DNA, 18 bp, Homo sapiens
gtttggctttcagggagg

SEQ ID NO: 3663222 - DNA, 18 bp, Homo sapiens
gtttgtcgctcatgtgtg

SEQ ID NO: 3663223 - DNA, 15 bp, Homo sapiens
gtttgtggcctcaga

SEQ ID NO: 3663224 - DNA, 13 bp, Homo sapiens
gtttgtggctggg

SEQ ID NO: 3663225 - DNA, 22 bp, Homo sapiens
gtttgtggctgggggcaggagg

SEQ ID NO: 3663226 - DNA, 15 bp, Homo sapiens
gttttaaatgtacag

SEQ ID NO: 3663227 - DNA, 22 bp, Homo sapiens
gttttaaatgtacagacatatt

SEQ ID NO: 3663228 - DNA, 18 bp, Homo sapiens
gttttactgcagctttgt

SEQ ID NO: 3663229 - DNA, 16 bp, Homo sapiens
gttttaggtagaaaaa

SEQ ID NO: 3663230 - DNA, 17 bp, Homo sapiens
gttttaggtagaaaaac

SEQ ID NO: 3663231 - DNA, 20 bp, Homo sapiens
gttttcagaacctcttcccc

SEQ ID NO: 3663232 - DNA, 13 bp, Homo sapiens
gttttcctccctt

SEQ ID NO: 3663233 - DNA, 14 bp, Homo sapiens
gttttcctcccttc

SEQ ID NO: 3663234 - DNA, 23 bp, Homo sapiens
gttttgatgtttgtggcctcaga

SEQ ID NO: 3663235 - DNA, 23 bp, Homo sapiens
gttttggctgaaattctcctgga

SEQ ID NO: 3663236 - DNA, 15 bp, Homo sapiens
gttttgggtatgttt

SEQ ID NO: 3663237 - DNA, 12 bp, Homo sapiens
gttttgtacatg

SEQ ID NO: 3663238 - DNA, 15 bp, Homo sapiens
gtttttaaattttgt

SEQ ID NO: 3663239 - DNA, 17 bp, Homo sapiens
gtttttatattaatgta

SEQ ID NO: 3663240 - DNA, 16 bp, Homo sapiens
gtttttattccttgtg

SEQ ID NO: 3663241 - DNA, 18 bp, Homo sapiens
gtttttctaggcctgggg

SEQ ID NO: 3663242 - DNA, 15 bp, Homo sapiens
gtttttggtgtttct

SEQ ID NO: 3663243 - DNA, 18 bp, Homo sapiens
gttttttcaaaatagaaa

SEQ ID NO: 3663244 - DNA, 15 bp, Homo sapiens
gtttttttaaatatt

SEQ ID NO: 3663245 - DNA, 20 bp, Homo sapiens
gttttttttttttttatgtg

SEQ ID NO: 3663246 - DNA, 18 bp, Homo sapiens
taaaaaagcatacttcta

SEQ ID NO: 3663247 - DNA, 19 bp, Homo sapiens
taaaaagagactgtgccat

SEQ ID NO: 3663248 - DNA, 15 bp, Homo sapiens
taaaaagtggaaaaa

SEQ ID NO: 3663249 - DNA, 22 bp, Homo sapiens
taaaaatgtcttgctgttgaca

SEQ ID NO: 3663250 - DNA, 18 bp, Homo sapiens
taaaactggacctgtata

SEQ ID NO: 3663251 - DNA, 18 bp, Homo sapiens
taaaactggctttggctt

SEQ ID NO: 3663252 - DNA, 16 bp, Homo sapiens
taaaacttaagatatt

SEQ ID NO: 3663253 - DNA, 13 bp, Homo sapiens
taaaactttcctc

SEQ ID NO: 3663254 - DNA, 16 bp, Homo sapiens
taaaagagagagagag

SEQ ID NO: 3663255 - DNA, 19 bp, Homo sapiens
taaaagagagagagagaaa

SEQ ID NO: 3663256 - DNA, 15 bp, Homo sapiens
taaaatcagactctt

SEQ ID NO: 3663257 - DNA, 17 bp, Homo sapiens
taaaatcctacagtgaa

SEQ ID NO: 3663258 - DNA, 15 bp, Homo sapiens
taaaatgtaaagcca

SEQ ID NO: 3663259 - DNA, 18 bp, Homo sapiens
taaaattaaagctgaaaa

SEQ ID NO: 3663260 - DNA, 18 bp, Homo sapiens
taaacacacagatacaca

SEQ ID NO: 3663261 - DNA, 22 bp, Homo sapiens
taaacacttatcttctggatta

SEQ ID NO: 3663262 - DNA, 18 bp, Homo sapiens
taaaccgccaaggctggg

SEQ ID NO: 3663263 - DNA, 16 bp, Homo sapiens
taaacctcctgctgtg

SEQ ID NO: 3663264 - DNA, 13 bp, Homo sapiens
taaactaaacacg

SEQ ID NO: 3663265 - DNA, 16 bp, Homo sapiens
taaagaatatgacttt

SEQ ID NO: 3663266 - DNA, 20 bp, Homo sapiens
taaagataacccttattcca

SEQ ID NO: 3663267 - DNA, 21 bp, Homo sapiens
taaagatgcaaggaccaggac

SEQ ID NO: 3663268 - DNA, 20 bp, Homo sapiens
taaagcttatttttctgtga

SEQ ID NO: 3663269 - DNA, 18 bp, Homo sapiens
taaaggaaataagagcag

SEQ ID NO: 3663270 - DNA, 13 bp, Homo sapiens
taaagtagaagag

SEQ ID NO: 3663271 - DNA, 18 bp, Homo sapiens
taaagtagaagagggttt

SEQ ID NO: 3663272 - DNA, 18 bp, Homo sapiens
taaagtatcacttttctg

SEQ ID NO: 3663273 - DNA, 19 bp, Homo sapiens
taaatagtaaaaataaaat

SEQ ID NO: 3663274 - DNA, 20 bp, Homo sapiens
taaatagtaaaaataaaatt

SEQ ID NO: 3663275 - DNA, 14 bp, Homo sapiens
taaatatacataaa

SEQ ID NO: 3663276 - DNA, 22 bp, Homo sapiens
taaatatccaggtgtgcccctc

SEQ ID NO: 3663277 - DNA, 19 bp, Homo sapiens
taaatcagccgtgtaacca

SEQ ID NO: 3663278 - DNA, 17 bp, Homo sapiens
taaatctgacccagtgc

SEQ ID NO: 3663279 - DNA, 17 bp, Homo sapiens
taaatgcctcttaaatt

SEQ ID NO: 3663280 - DNA, 17 bp, Homo sapiens
taaatgctgctttttct

SEQ ID NO: 3663281 - DNA, 16 bp, Homo sapiens
taaatggcctcatgtg

SEQ ID NO: 3663282 - DNA, 22 bp, Homo sapiens
taaatggcctcatgtggctgga

SEQ ID NO: 3663283 - DNA, 21 bp, Homo sapiens
taaatgtacagacatatttaa

SEQ ID NO: 3663284 - DNA, 14 bp, Homo sapiens
taaattacaatttt

SEQ ID NO: 3663285 - DNA, 13 bp, Homo sapiens
taaattatatatt

SEQ ID NO: 3663286 - DNA, 17 bp, Homo sapiens
taaattatatttgtgct

SEQ ID NO: 3663287 - DNA, 14 bp, Homo sapiens
taaattcctctttg

SEQ ID NO: 3663288 - DNA, 18 bp, Homo sapiens
taaattgaagaagcctca

SEQ ID NO: 3663289 - DNA, 13 bp, Homo sapiens
taaattttgtaat

SEQ ID NO: 3663290 - DNA, 14 bp, Homo sapiens
taaattttgtaatg

SEQ ID NO: 3663291 - DNA, 23 bp, Homo sapiens
taacaaaggcagctgtgtctgag

SEQ ID NO: 3663292 - DNA, 22 bp, Homo sapiens
taacaagggttttaatgtaatt

SEQ ID NO: 3663293 - DNA, 16 bp, Homo sapiens
taacaataatatttca

SEQ ID NO: 3663294 - DNA, 20 bp, Homo sapiens
taacaataatatttcaagtg

SEQ ID NO: 3663295 - DNA, 15 bp, Homo sapiens
taacaatctaacaat

SEQ ID NO: 3663296 - DNA, 14 bp, Homo sapiens
taaccccacacagc

SEQ ID NO: 3663297 - DNA, 21 bp, Homo sapiens
taaccggcatgtttccagcag

SEQ ID NO: 3663298 - DNA, 14 bp, Homo sapiens
taacctctgcacta

SEQ ID NO: 3663299 - DNA, 16 bp, Homo sapiens
taacctgcaaaatctg

SEQ ID NO: 3663300 - DNA, 19 bp, Homo sapiens
taaccttactaattatact

SEQ ID NO: 3663301 - DNA, 17 bp, Homo sapiens
taacgcgtcttcctgag

SEQ ID NO: 3663302 - DNA, 23 bp, Homo sapiens
taactacagaaaagacaaacagt

SEQ ID NO: 3663303 - DNA, 14 bp, Homo sapiens
taactcaatatttt

SEQ ID NO: 3663304 - DNA, 20 bp, Homo sapiens
taactgagtagctctcctga

SEQ ID NO: 3663305 - DNA, 23 bp, Homo sapiens
taactgagtagctctcctgactt

SEQ ID NO: 3663306 - DNA, 20 bp, Homo sapiens
tcaaaatatttaaaaatgtc

SEQ ID NO: 3663307 - DNA, 22 bp, Homo sapiens
tcaaaatatttaaaaatgtctt

SEQ ID NO: 3663308 - DNA, 14 bp, Homo sapiens
tcaaacaaagccag

SEQ ID NO: 3663309 - DNA, 15 bp, Homo sapiens
tcaaacaaagccaga

SEQ ID NO: 3663310 - DNA, 16 bp, Homo sapiens
tcaaacgtgaaaatgc

SEQ ID NO: 3663311 - DNA, 14 bp, Homo sapiens
tcaaactgagacag

SEQ ID NO: 3663312 - DNA, 16 bp, Homo sapiens
tcaaagaagctgtctt

SEQ ID NO: 3663313 - DNA, 20 bp, Homo sapiens
tcaaagaagctgtcttggaa

SEQ ID NO: 3663314 - DNA, 17 bp, Homo sapiens
tcaaaggtgatgtaatt

SEQ ID NO: 3663315 - DNA, 18 bp, Homo sapiens
tcaaatggggccagatcc

SEQ ID NO: 3663316 - DNA, 20 bp, Homo sapiens
tcaaatggggccagatccag

SEQ ID NO: 3663317 - DNA, 22 bp, Homo sapiens
tcaacaaatattcactggcccc

SEQ ID NO: 3663318 - DNA, 17 bp, Homo sapiens
tcaacaataaaattttt

SEQ ID NO: 3663319 - DNA, 18 bp, Homo sapiens
tcaacagtgaagacagaa

SEQ ID NO: 3663320 - DNA, 23 bp, Homo sapiens
tcaacagttttcctatgctttga

SEQ ID NO: 3663321 - DNA, 18 bp, Homo sapiens
tcaacctcgcgcttgctg

SEQ ID NO: 3663322 - DNA, 20 bp, Homo sapiens
tcaactgccaaaatgctcta

SEQ ID NO: 3663323 - DNA, 20 bp, Homo sapiens
tcaagcagtcgtgcctgtgt

SEQ ID NO: 3663324 - DNA, 21 bp, Homo sapiens
tcaagcagtcgtgcctgtgtc

SEQ ID NO: 3663325 - DNA, 16 bp, Homo sapiens
tcaagccaagcagcca

SEQ ID NO: 3663326 - DNA, 17 bp, Homo sapiens
tcaagccaagcagccaa

SEQ ID NO: 3663327 - DNA, 12 bp, Homo sapiens
tcaagccctgca

SEQ ID NO: 3663328 - DNA, 23 bp, Homo sapiens
tcaagtgaaaaaggaggaagaga

SEQ ID NO: 3663329 - DNA, 18 bp, Homo sapiens
tcaagtgcctagactgtt

SEQ ID NO: 3663330 - DNA, 15 bp, Homo sapiens
tcaatcacagtctca

SEQ ID NO: 3663331 - DNA, 13 bp, Homo sapiens
tcaatttccaaga

SEQ ID NO: 3663332 - DNA, 16 bp, Homo sapiens
tcacaaaacagccttt

SEQ ID NO: 3663333 - DNA, 19 bp, Homo sapiens
tcacaaagagatgtccttg

SEQ ID NO: 3663334 - DNA, 15 bp, Homo sapiens
tcacaaagcccaagg

SEQ ID NO: 3663335 - DNA, 18 bp, Homo sapiens
tcacacaaaggcatgctg

SEQ ID NO: 3663336 - DNA, 20 bp, Homo sapiens
tcacacaaaggcatgctgga

SEQ ID NO: 3663337 - DNA, 22 bp, Homo sapiens
tcacacaaaggcatgctggagt

SEQ ID NO: 3663338 - DNA, 15 bp, Homo sapiens
tcacagcttcagcca

SEQ ID NO: 3663339 - DNA, 17 bp, Homo sapiens
tcacagcttcagccagg

SEQ ID NO: 3663340 - DNA, 19 bp, Homo sapiens
tcacagcttcagccaggag

SEQ ID NO: 3663341 - DNA, 19 bp, Homo sapiens
tcacagctttgaggaacat

SEQ ID NO: 3663342 - DNA, 18 bp, Homo sapiens
tcacagggtgttggaaga

SEQ ID NO: 3663343 - DNA, 19 bp, Homo sapiens
tcacagggttgggcccaga

SEQ ID NO: 3663344 - DNA, 17 bp, Homo sapiens
tcacagtgctgtgtgcc

SEQ ID NO: 3663345 - DNA, 18 bp, Homo sapiens
tcacagtgggagccaggg

SEQ ID NO: 3663346 - DNA, 19 bp, Homo sapiens
tcacagttctttgggccag

SEQ ID NO: 3663347 - DNA, 21 bp, Homo sapiens
tcacatcgcttctgtgtatct

SEQ ID NO: 3663348 - DNA, 14 bp, Homo sapiens
tcacattagaagac

SEQ ID NO: 3663349 - DNA, 15 bp, Homo sapiens
tcacattagaagaca

SEQ ID NO: 3663350 - DNA, 11 bp, Homo sapiens
tcacattgttt

SEQ ID NO: 3663351 - DNA, 22 bp, Homo sapiens
tcaccacaaactgtaatacaat

SEQ ID NO: 3663352 - DNA, 14 bp, Homo sapiens
tcaccatctttctg

SEQ ID NO: 3663353 - DNA, 15 bp, Homo sapiens
tcacccaatcccagt

SEQ ID NO: 3663354 - DNA, 23 bp, Homo sapiens
tcacccaatcccagttcttcctg

SEQ ID NO: 3663355 - DNA, 14 bp, Homo sapiens
tcacccccatggcc

SEQ ID NO: 3663356 - DNA, 13 bp, Homo sapiens
tcaccctgtccaa

SEQ ID NO: 3663357 - DNA, 13 bp, Homo sapiens
tcaccctttgctg

SEQ ID NO: 3663358 - DNA, 15 bp, Homo sapiens
tcacctcattctgaa

SEQ ID NO: 3663359 - DNA, 15 bp, Homo sapiens
tcacctcctgctggg

SEQ ID NO: 3663360 - DNA, 15 bp, Homo sapiens
tcaccttaggcaggg

SEQ ID NO: 3663361 - DNA, 14 bp, Homo sapiens
tcacggaagagcct

SEQ ID NO: 3663362 - DNA, 23 bp, Homo sapiens
tcacggcaggacaacgaggaagc

SEQ ID NO: 3663363 - DNA, 15 bp, Homo sapiens
tcactaatacacagt

SEQ ID NO: 3663364 - DNA, 16 bp, Homo sapiens
tcactaatttttgtat

SEQ ID NO: 3663365 - DNA, 19 bp, Homo sapiens
tcactacaagtcagctcca

SEQ ID NO: 3663366 - DNA, 20 bp, Homo sapiens
tcactcaaggcggtgcttga

SEQ ID NO: 3663367 - DNA, 14 bp, Homo sapiens
tcactcccagtcca

SEQ ID NO: 3663368 - DNA, 23 bp, Homo sapiens
tcactgagttttccatggcagga

SEQ ID NO: 3663369 - DNA, 22 bp, Homo sapiens
tcactggcgaggtgcggccacc

SEQ ID NO: 3663370 - DNA, 16 bp, Homo sapiens
tcactgtttgttttta

SEQ ID NO: 3663371 - DNA, 13 bp, Homo sapiens
tcacttacatttt

SEQ ID NO: 3663372 - DNA, 21 bp, Homo sapiens
tcactttagaggcttgatcat

SEQ ID NO: 3663373 - DNA, 17 bp, Homo sapiens
tcagaacctcttcccca

SEQ ID NO: 3663374 - DNA, 20 bp, Homo sapiens
tcagaacctcttccccagaa

SEQ ID NO: 3663375 - DNA, 22 bp, Homo sapiens
tcagaactcaaatggggccaga

SEQ ID NO: 3663376 - DNA, 17 bp, Homo sapiens
tcagacagagaggactg

SEQ ID NO: 3663377 - DNA, 15 bp, Homo sapiens
tcagactgcagaggg

SEQ ID NO: 3663378 - DNA, 13 bp, Homo sapiens
tcagacttgtcaa

SEQ ID NO: 3663379 - DNA, 21 bp, Homo sapiens
tcagagatgcaccaccaagcc

SEQ ID NO: 3663380 - DNA, 11 bp, Homo sapiens
tcagagccact

SEQ ID NO: 3663381 - DNA, 12 bp, Homo sapiens
tcagagccactc

SEQ ID NO: 3663382 - DNA, 22 bp, Homo sapiens
tcagagcggatgggcacacaca

SEQ ID NO: 3663383 - DNA, 16 bp, Homo sapiens
tcagaggccttgctgt

SEQ ID NO: 3663384 - DNA, 23 bp, Homo sapiens
tcagaggtttacctagagaacag

SEQ ID NO: 3663385 - DNA, 23 bp, Homo sapiens
tcagataaggtaaaatgccatga

SEQ ID NO: 3663386 - DNA, 14 bp, Homo sapiens
tcagatccagggac

SEQ ID NO: 3663387 - DNA, 15 bp, Homo sapiens
tcagatccagggaca

SEQ ID NO: 3663388 - DNA, 18 bp, Homo sapiens
tcagatccagtgtaaact

SEQ ID NO: 3663389 - DNA, 23 bp, Homo sapiens
tcagatggaaccgcaggaagctg

SEQ ID NO: 3663390 - DNA, 16 bp, Homo sapiens
tcagatgtaatgtttt

SEQ ID NO: 3663391 - DNA, 12 bp, Homo sapiens
tcagcaccaccc

SEQ ID NO: 3663392 - DNA, 14 bp, Homo sapiens
tcagcaccacccta

SEQ ID NO: 3663393 - DNA, 13 bp, Homo sapiens
tcagcactgtccc

SEQ ID NO: 3663394 - DNA, 23 bp, Homo sapiens
tcagcagaagattgcgtagctct

SEQ ID NO: 3663395 - DNA, 23 bp, Homo sapiens
tcagccaaggttttataaggctg

SEQ ID NO: 3663396 - DNA, 12 bp, Homo sapiens
tcagccaggagc

SEQ ID NO: 3663397 - DNA, 20 bp, Homo sapiens
tcagcctccctggtagctgg

SEQ ID NO: 3663398 - DNA, 13 bp, Homo sapiens
tcagcctctgcca

SEQ ID NO: 3663399 - DNA, 19 bp, Homo sapiens
tcagcctggccagacacag

SEQ ID NO: 3663400 - DNA, 20 bp, Homo sapiens
tcagcctggccagacacagg

SEQ ID NO: 3663401 - DNA, 10 bp, Homo sapiens
tcagcctggg

SEQ ID NO: 3663402 - DNA, 18 bp, Homo sapiens
tcagctccactttcagtg

SEQ ID NO: 3663403 - DNA, 12 bp, Homo sapiens
tcagctgcctca

SEQ ID NO: 3663404 - DNA, 15 bp, Homo sapiens
tcagctgctccctgg

SEQ ID NO: 3663405 - DNA, 19 bp, Homo sapiens
tcagctgctccctggcatt

SEQ ID NO: 3663406 - DNA, 14 bp, Homo sapiens
tcaggacagatgcc

SEQ ID NO: 3663407 - DNA, 20 bp, Homo sapiens
tcaggatgatacactatgaa

SEQ ID NO: 3663408 - DNA, 18 bp, Homo sapiens
tcaggcaggtgggatgga

SEQ ID NO: 3663409 - DNA, 17 bp, Homo sapiens
tcaggcctccctctctc

SEQ ID NO: 3663410 - DNA, 15 bp, Homo sapiens
tcaggctgcttggga

SEQ ID NO: 3663411 - DNA, 12 bp, Homo sapiens
tcagggacccct

SEQ ID NO: 3663412 - DNA, 14 bp, Homo sapiens
tcagggacccctgc

SEQ ID NO: 3663413 - DNA, 17 bp, Homo sapiens
tcagggacccctgccct

SEQ ID NO: 3663414 - DNA, 15 bp, Homo sapiens
tcagggaggccctgt

SEQ ID NO: 3663415 - DNA, 22 bp, Homo sapiens
tcagggaggccctgtgcccctt

SEQ ID NO: 3663416 - DNA, 14 bp, Homo sapiens
tcagggccatgctg

SEQ ID NO: 3663417 - DNA, 21 bp, Homo sapiens
tcagggccatgctgaggcctg

SEQ ID NO: 3663418 - DNA, 18 bp, Homo sapiens
tcaggggactcagccctg

SEQ ID NO: 3663419 - DNA, 19 bp, Homo sapiens
tcaggggtgtgcggccttt

SEQ ID NO: 3663420 - DNA, 23 bp, Homo sapiens
tcaggggtgtgcggcctttggct

SEQ ID NO: 3663421 - DNA, 16 bp, Homo sapiens
tcaggtcaggagttcg

SEQ ID NO: 3663422 - DNA, 12 bp, Homo sapiens
tcaggtctgaat

SEQ ID NO: 3663423 - DNA, 13 bp, Homo sapiens
tccgcgggtggga

SEQ ID NO: 3663424 - DNA, 14 bp, Homo sapiens
tccgctttcctgga

SEQ ID NO: 3663425 - DNA, 18 bp, Homo sapiens
tccggcagttctgggtgc

SEQ ID NO: 3663426 - DNA, 14 bp, Homo sapiens
tccggcctctgcct

SEQ ID NO: 3663427 - DNA, 21 bp, Homo sapiens
tccgtgctgacagctgctcct

SEQ ID NO: 3663428 - DNA, 18 bp, Homo sapiens
tccgtggtcagagtgcca

SEQ ID NO: 3663429 - DNA, 16 bp, Homo sapiens
tccgttcattgctctc

SEQ ID NO: 3663430 - DNA, 23 bp, Homo sapiens
tcctaaagaaaaatatcttggcc

SEQ ID NO: 3663431 - DNA, 22 bp, Homo sapiens
tcctaatgaatgcataaaatgt

SEQ ID NO: 3663432 - DNA, 20 bp, Homo sapiens
tcctacagtgaaatgagcag

SEQ ID NO: 3663433 - DNA, 16 bp, Homo sapiens
tcctacctgaaggcag

SEQ ID NO: 3663434 - DNA, 20 bp, Homo sapiens
tcctacctgaaggcagggct

SEQ ID NO: 3663435 - DNA, 15 bp, Homo sapiens
tcctacctgggggca

SEQ ID NO: 3663436 - DNA, 23 bp, Homo sapiens
tcctacttagggaagaaaaagca

SEQ ID NO: 3663437 - DNA, 17 bp, Homo sapiens
tcctagcacttgtctca

SEQ ID NO: 3663438 - DNA, 20 bp, Homo sapiens
tcctagcactttgggaggcc

SEQ ID NO: 3663439 - DNA, 14 bp, Homo sapiens
tcctaggcatttgc

SEQ ID NO: 3663440 - DNA, 23 bp, Homo sapiens
tcctatgcttaataaaagaacat

SEQ ID NO: 3663441 - DNA, 20 bp, Homo sapiens
tcctatgctttgaaacagaa

SEQ ID NO: 3663442 - DNA, 12 bp, Homo sapiens
tcctcactccca

SEQ ID NO: 3663443 - DNA, 17 bp, Homo sapiens
tcctcactcccttccca

SEQ ID NO: 3663444 - DNA, 23 bp, Homo sapiens
tcctcactcgggtttctctgtgg

SEQ ID NO: 3663445 - DNA, 16 bp, Homo sapiens
tcctcagcctggggtt

SEQ ID NO: 3663446 - DNA, 18 bp, Homo sapiens
tcctcagccttgccagag

SEQ ID NO: 3663447 - DNA, 17 bp, Homo sapiens
tcctcattagcattttg

SEQ ID NO: 3663448 - DNA, 18 bp, Homo sapiens
tcctccagaagcctctgg

SEQ ID NO: 3663449 - DNA, 19 bp, Homo sapiens
tcctccagaagcctctggc

SEQ ID NO: 3663450 - DNA, 14 bp, Homo sapiens
tcctccagcaggga

SEQ ID NO: 3663451 - DNA, 20 bp, Homo sapiens
tcctccagcagggaaaatgc

SEQ ID NO: 3663452 - DNA, 18 bp, Homo sapiens
tcctcccaagctgtgctg

SEQ ID NO: 3663453 - DNA, 12 bp, Homo sapiens
tcctccctggag

SEQ ID NO: 3663454 - DNA, 11 bp, Homo sapiens
tcctccctggg

SEQ ID NO: 3663455 - DNA, 14 bp, Homo sapiens
tcctccctgggggc

SEQ ID NO: 3663456 - DNA, 16 bp, Homo sapiens
tcctccctgggggcgg

SEQ ID NO: 3663457 - DNA, 13 bp, Homo sapiens
tcctcctccctgc

SEQ ID NO: 3663458 - DNA, 17 bp, Homo sapiens
tcctcctccctgcatct

SEQ ID NO: 3663459 - DNA, 15 bp, Homo sapiens
tcctcctgcagacca

SEQ ID NO: 3663460 - DNA, 17 bp, Homo sapiens
tcctcctgcccacctgt

SEQ ID NO: 3663461 - DNA, 24 bp, Homo sapiens
tcctcgcctgacaaccactggtct

SEQ ID NO: 3663462 - DNA, 19 bp, Homo sapiens
tcctctcccattgtccctc

SEQ ID NO: 3663463 - DNA, 20 bp, Homo sapiens
tcctctcccattgtccctct

SEQ ID NO: 3663464 - DNA, 23 bp, Homo sapiens
tcctctcccattgtccctctgcc

SEQ ID NO: 3663465 - DNA, 17 bp, Homo sapiens
tcctctccccagcccag

SEQ ID NO: 3663466 - DNA, 20 bp, Homo sapiens
tcctctccccagcccagaga

SEQ ID NO: 3663467 - DNA, 15 bp, Homo sapiens
tcctctccctgccaa

SEQ ID NO: 3663468 - DNA, 17 bp, Homo sapiens
tcctctccctgccaagt

SEQ ID NO: 3663469 - DNA, 12 bp, Homo sapiens
tcctctgtgcca

SEQ ID NO: 3663470 - DNA, 13 bp, Homo sapiens
tcctctgtgccac

SEQ ID NO: 3663471 - DNA, 24 bp, Homo sapiens
tcctctgtggccagctgcatctgt

SEQ ID NO: 3663472 - DNA, 23 bp, Homo sapiens
tcctctttgctttgctttctgct

SEQ ID NO: 3663473 - DNA, 16 bp, Homo sapiens
tcctgaagaaccagtc

SEQ ID NO: 3663474 - DNA, 20 bp, Homo sapiens
tcctgaaggaggcggggctc

SEQ ID NO: 3663475 - DNA, 16 bp, Homo sapiens
tcctgaatgaggcgga

SEQ ID NO: 3663476 - DNA, 19 bp, Homo sapiens
tcctgaatgaggcggagct

SEQ ID NO: 3663477 - DNA, 15 bp, Homo sapiens
tcctgaccaagactg

SEQ ID NO: 3663478 - DNA, 20 bp, Homo sapiens
tcctgaccaagactgagcca

SEQ ID NO: 3663479 - DNA, 15 bp, Homo sapiens
tcctgacctgtctca

SEQ ID NO: 3663480 - DNA, 14 bp, Homo sapiens
tcctgactggtgct

SEQ ID NO: 3663481 - DNA, 15 bp, Homo sapiens
tcctgactggtgctg

SEQ ID NO: 3663482 - DNA, 21 bp, Homo sapiens
tcctgagcgaaaacaggagag

SEQ ID NO: 3663483 - DNA, 16 bp, Homo sapiens
tcctgaggggcatctg

SEQ ID NO: 3663484 - DNA, 19 bp, Homo sapiens
tcctgaggggcatctgccc

SEQ ID NO: 3663485 - DNA, 18 bp, Homo sapiens
tcctgataaagcacagct

SEQ ID NO: 3663486 - DNA, 22 bp, Homo sapiens
tcctgatagcctgttacaggaa

SEQ ID NO: 3663487 - DNA, 21 bp, Homo sapiens
tcctgattaaggcgtggcttc

SEQ ID NO: 3663488 - DNA, 22 bp, Homo sapiens
tcctgattaaggcgtggcttct

SEQ ID NO: 3663489 - DNA, 17 bp, Homo sapiens
tcctgcaactcaaggac

SEQ ID NO: 3663490 - DNA, 17 bp, Homo sapiens
tcctgcagaccacgccc

SEQ ID NO: 3663491 - DNA, 23 bp, Homo sapiens
tcctgccagggaactggcctgct

SEQ ID NO: 3663492 - DNA, 14 bp, Homo sapiens
tcctgccccaggcc

SEQ ID NO: 3663493 - DNA, 14 bp, Homo sapiens
tcctgcctcagcct

SEQ ID NO: 3663494 - DNA, 14 bp, Homo sapiens
tcctgcctggccag

SEQ ID NO: 3663495 - DNA, 13 bp, Homo sapiens
tcctgcctgtggc

SEQ ID NO: 3663496 - DNA, 14 bp, Homo sapiens
tcctgcctgtggcg

SEQ ID NO: 3663497 - DNA, 14 bp, Homo sapiens
tcctgctgagctgc

SEQ ID NO: 3663498 - DNA, 16 bp, Homo sapiens
tcctgctgagctgccc

SEQ ID NO: 3663499 - DNA, 18 bp, Homo sapiens
tcctgctgagctgcccct

SEQ ID NO: 3663500 - DNA, 12 bp, Homo sapiens
tcctgctttctc

SEQ ID NO: 3663501 - DNA, 22 bp, Homo sapiens
tcctggaaattgacgaggggtg

SEQ ID NO: 3663502 - DNA, 14 bp, Homo sapiens
tcctggaacctgga

SEQ ID NO: 3663503 - DNA, 16 bp, Homo sapiens
tcctggaacctggacc

SEQ ID NO: 3663504 - DNA, 17 bp, Homo sapiens
tcctggaacctggaccc

SEQ ID NO: 3663505 - DNA, 21 bp, Homo sapiens
tcctggaacctggaccccagc

SEQ ID NO: 3663506 - DNA, 13 bp, Homo sapiens
tcctggaggccca

SEQ ID NO: 3663507 - DNA, 14 bp, Homo sapiens
tcctggaggcccag

SEQ ID NO: 3663508 - DNA, 18 bp, Homo sapiens
tcctggaggcccagttca

SEQ ID NO: 3663509 - DNA, 14 bp, Homo sapiens
tcctggatggggca

SEQ ID NO: 3663510 - DNA, 16 bp, Homo sapiens
tcctggatggggcaga

SEQ ID NO: 3663511 - DNA, 15 bp, Homo sapiens
tcctggccatcccac

SEQ ID NO: 3663512 - DNA, 15 bp, Homo sapiens
tcctggcccctcatg

SEQ ID NO: 3663513 - DNA, 16 bp, Homo sapiens
tcctggccctccactc

SEQ ID NO: 3663514 - DNA, 16 bp, Homo sapiens
tcctggctcctgaggg

SEQ ID NO: 3663515 - DNA, 22 bp, Homo sapiens
tcctggctgcggcgtctgtctg

SEQ ID NO: 3663516 - DNA, 22 bp, Homo sapiens
tcctgggagaggacagggactt

SEQ ID NO: 3663517 - DNA, 21 bp, Homo sapiens
tcctgggtggtctgcaggcag

SEQ ID NO: 3663518 - DNA, 13 bp, Homo sapiens
tcctggtccctca

SEQ ID NO: 3663519 - DNA, 20 bp, Homo sapiens
tcctggtgtgggtccctctg

SEQ ID NO: 3663520 - DNA, 23 bp, Homo sapiens
tcctggtgtgggtccctctgccc

SEQ ID NO: 3663521 - DNA, 15 bp, Homo sapiens
tcctggttgtctgaa

SEQ ID NO: 3663522 - DNA, 22 bp, Homo sapiens
tcctggttgtctgaacccaggc

SEQ ID NO: 3663523 - DNA, 16 bp, Homo sapiens
tcctgtattcagacag

SEQ ID NO: 3663524 - DNA, 21 bp, Homo sapiens
tcctgtattcagacagatgag

SEQ ID NO: 3663525 - DNA, 14 bp, Homo sapiens
tcctgtccagctcc

SEQ ID NO: 3663526 - DNA, 20 bp, Homo sapiens
tcctgtgaatgccactgcct

SEQ ID NO: 3663527 - DNA, 23 bp, Homo sapiens
tcctgtggccccaccctgggccc

SEQ ID NO: 3663528 - DNA, 22 bp, Homo sapiens
tcctgttctgaaaccttagttt

SEQ ID NO: 3663529 - DNA, 17 bp, Homo sapiens
tccttaaagagtgtggc

SEQ ID NO: 3663530 - DNA, 23 bp, Homo sapiens
tccttaaagagtgtggcaaaata

SEQ ID NO: 3663531 - DNA, 14 bp, Homo sapiens
tccttacccatctg

SEQ ID NO: 3663532 - DNA, 18 bp, Homo sapiens
tccttagatctggcatgt

SEQ ID NO: 3663533 - DNA, 20 bp, Homo sapiens
tccttccaacaggagctggg

SEQ ID NO: 3663534 - DNA, 16 bp, Homo sapiens
tccttcctgtgggtgg

SEQ ID NO: 3663535 - DNA, 17 bp, Homo sapiens
tccttcctgtgggtggg

SEQ ID NO: 3663536 - DNA, 20 bp, Homo sapiens
tccttcgtccccagttgccg

SEQ ID NO: 3663537 - DNA, 18 bp, Homo sapiens
tccttgaagaactgcagg

SEQ ID NO: 3663538 - DNA, 23 bp, Homo sapiens
tccttgaagaactgcaggccctg

SEQ ID NO: 3663539 - DNA, 20 bp, Homo sapiens
tgaatattttatctttcctt

SEQ ID NO: 3663540 - DNA, 22 bp, Homo sapiens
tgaatcttcaccatctttctga

SEQ ID NO: 3663541 - DNA, 15 bp, Homo sapiens
tgaatgcataaaatg

SEQ ID NO: 3663542 - DNA, 16 bp, Homo sapiens
tgaatgcataaaatgt

SEQ ID NO: 3663543 - DNA, 12 bp, Homo sapiens
tgaatgctggga

SEQ ID NO: 3663544 - DNA, 13 bp, Homo sapiens
tgaatggggaggc

SEQ ID NO: 3663545 - DNA, 14 bp, Homo sapiens
tgaattttctggaa

SEQ ID NO: 3663546 - DNA, 15 bp, Homo sapiens
tgaattttctggaaa

SEQ ID NO: 3663547 - DNA, 19 bp, Homo sapiens
tgaattttctggaaaatgc

SEQ ID NO: 3663548 - DNA, 21 bp, Homo sapiens
tgaattttctggaaaatgctt

SEQ ID NO: 3663549 - DNA, 15 bp, Homo sapiens
tgaattttgggactt

SEQ ID NO: 3663550 - DNA, 17 bp, Homo sapiens
tgacaaatgtaaacatt

SEQ ID NO: 3663551 - DNA, 16 bp, Homo sapiens
tgacaaccactggtct

SEQ ID NO: 3663552 - DNA, 17 bp, Homo sapiens
tgacaaccactggtctg

SEQ ID NO: 3663553 - DNA, 17 bp, Homo sapiens
tgacaaccgagaaggtt

SEQ ID NO: 3663554 - DNA, 13 bp, Homo sapiens
tgacaactggcag

SEQ ID NO: 3663555 - DNA, 15 bp, Homo sapiens
tgacaactggcaggc

SEQ ID NO: 3663556 - DNA, 17 bp, Homo sapiens
tgacaactggcaggcag

SEQ ID NO: 3663557 - DNA, 18 bp, Homo sapiens
tgacaactggcaggcagg

SEQ ID NO: 3663558 - DNA, 17 bp, Homo sapiens
tgacaattctgttttta

SEQ ID NO: 3663559 - DNA, 13 bp, Homo sapiens
tgacaattgtcac

SEQ ID NO: 3663560 - DNA, 18 bp, Homo sapiens
tgacacaatctcagctca

SEQ ID NO: 3663561 - DNA, 16 bp, Homo sapiens
tgacacaggtctttcc

SEQ ID NO: 3663562 - DNA, 17 bp, Homo sapiens
tgacacaggtctttcct

SEQ ID NO: 3663563 - DNA, 21 bp, Homo sapiens
tgacagctgctcctagaggga

SEQ ID NO: 3663564 - DNA, 23 bp, Homo sapiens
tgacagctgctcctagagggagg

SEQ ID NO: 3663565 - DNA, 20 bp, Homo sapiens
tgacagctttgctgctgaag

SEQ ID NO: 3663566 - DNA, 12 bp, Homo sapiens
tgacatatttaa

SEQ ID NO: 3663567 - DNA, 22 bp, Homo sapiens
tgacatatttaatgttttaaat

SEQ ID NO: 3663568 - DNA, 23 bp, Homo sapiens
tgacatctgattggcagatgagc

SEQ ID NO: 3663569 - DNA, 18 bp, Homo sapiens
tgacatgggtattttata

SEQ ID NO: 3663570 - DNA, 14 bp, Homo sapiens
tgacattgtctcct

SEQ ID NO: 3663571 - DNA, 21 bp, Homo sapiens
tgaccaagactgagccagctt

SEQ ID NO: 3663572 - DNA, 15 bp, Homo sapiens
tgaccaagcaggaag

SEQ ID NO: 3663573 - DNA, 17 bp, Homo sapiens
tgaccaagcaggaagct

SEQ ID NO: 3663574 - DNA, 21 bp, Homo sapiens
tgaccaagtgatgtgtttaca

SEQ ID NO: 3663575 - DNA, 23 bp, Homo sapiens
tgaccaccaccccaacaaaccat

SEQ ID NO: 3663576 - DNA, 14 bp, Homo sapiens
tgaccagcagcgcc

SEQ ID NO: 3663577 - DNA, 17 bp, Homo sapiens
tgaccagggcaaggccc

SEQ ID NO: 3663578 - DNA, 22 bp, Homo sapiens
tgaccaggggccctacctgggg

SEQ ID NO: 3663579 - DNA, 16 bp, Homo sapiens
tgaccatactgaggga

SEQ ID NO: 3663580 - DNA, 22 bp, Homo sapiens
tgaccatccactctaccctccc

SEQ ID NO: 3663581 - DNA, 12 bp, Homo sapiens
tgaccatgctca

SEQ ID NO: 3663582 - DNA, 16 bp, Homo sapiens
tgacccagtgccccca

SEQ ID NO: 3663583 - DNA, 18 bp, Homo sapiens
tgacccagtgcccccact

SEQ ID NO: 3663584 - DNA, 13 bp, Homo sapiens
tgaccctcattct

SEQ ID NO: 3663585 - DNA, 18 bp, Homo sapiens
tgacctccgcctcctggg

SEQ ID NO: 3663586 - DNA, 15 bp, Homo sapiens
tgacctgaggctgtg

SEQ ID NO: 3663587 - DNA, 17 bp, Homo sapiens
tgacctgaggctgtggt

SEQ ID NO: 3663588 - DNA, 15 bp, Homo sapiens
tgacgacaagtgctg

SEQ ID NO: 3663589 - DNA, 14 bp, Homo sapiens
tgactaatggcatg

SEQ ID NO: 3663590 - DNA, 15 bp, Homo sapiens
tgactaattttacat

SEQ ID NO: 3663591 - DNA, 17 bp, Homo sapiens
tgactagggattcaggc

SEQ ID NO: 3663592 - DNA, 23 bp, Homo sapiens
tgactagggattcaggctgcttg

SEQ ID NO: 3663593 - DNA, 18 bp, Homo sapiens
tgactcacttatcccaag

SEQ ID NO: 3663594 - DNA, 18 bp, Homo sapiens
tgactcgggggtggggaa

SEQ ID NO: 3663595 - DNA, 16 bp, Homo sapiens
tgactcggtttctcca

SEQ ID NO: 3663596 - DNA, 22 bp, Homo sapiens
tgactgaaaaaaaaaaagaaga

SEQ ID NO: 3663597 - DNA, 23 bp, Homo sapiens
tgactgaaaaaaaaaaagaagaa

SEQ ID NO: 3663598 - DNA, 19 bp, Homo sapiens
tgactgaagccgtgcctgt

SEQ ID NO: 3663599 - DNA, 22 bp, Homo sapiens
tgactgcttgtaggtatgtctg

SEQ ID NO: 3663600 - DNA, 16 bp, Homo sapiens
tgacttaatgtgatta

SEQ ID NO: 3663601 - DNA, 13 bp, Homo sapiens
tgacttctgcctg

SEQ ID NO: 3663602 - DNA, 16 bp, Homo sapiens
tgacttctgcctggag

SEQ ID NO: 3663603 - DNA, 13 bp, Homo sapiens
tgacttcttcttc

SEQ ID NO: 3663604 - DNA, 22 bp, Homo sapiens
tgacttttctgtccgagctttg

SEQ ID NO: 3663605 - DNA, 12 bp, Homo sapiens
tgactttttaaa

SEQ ID NO: 3663606 - DNA, 23 bp, Homo sapiens
tgactttttaaaattctgagtga

SEQ ID NO: 3663607 - DNA, 19 bp, Homo sapiens
tgagaaaaaaaaaaaagac

SEQ ID NO: 3663608 - DNA, 20 bp, Homo sapiens
tgagaagcagaggaaggaga

SEQ ID NO: 3663609 - DNA, 13 bp, Homo sapiens
tgagaaggaacag

SEQ ID NO: 3663610 - DNA, 18 bp, Homo sapiens
tgagaagtgaatgctggg

SEQ ID NO: 3663611 - DNA, 14 bp, Homo sapiens
tgagaccaacctgg

SEQ ID NO: 3663612 - DNA, 14 bp, Homo sapiens
tgagacccccacac

SEQ ID NO: 3663613 - DNA, 16 bp, Homo sapiens
tgagacccccacacct

SEQ ID NO: 3663614 - DNA, 22 bp, Homo sapiens
tgagacccccacacctcagttc

SEQ ID NO: 3663615 - DNA, 14 bp, Homo sapiens
tgagatacatacag

SEQ ID NO: 3663616 - DNA, 15 bp, Homo sapiens
tgagatcaaaacggt

SEQ ID NO: 3663617 - DNA, 14 bp, Homo sapiens
tgagatcagcctgg

SEQ ID NO: 3663618 - DNA, 12 bp, Homo sapiens
tgagatgctggc

SEQ ID NO: 3663619 - DNA, 13 bp, Homo sapiens
tgagcactgaaac

SEQ ID NO: 3663620 - DNA, 21 bp, Homo sapiens
tgagcagcccttacagtattg

SEQ ID NO: 3663621 - DNA, 14 bp, Homo sapiens
tgagcagtggctgg

SEQ ID NO: 3663622 - DNA, 22 bp, Homo sapiens
tgagcagtggctggtccagggc

SEQ ID NO: 3663623 - DNA, 12 bp, Homo sapiens
tgagcatcacag

SEQ ID NO: 3663624 - DNA, 13 bp, Homo sapiens
tgagcatcacaga

SEQ ID NO: 3663625 - DNA, 14 bp, Homo sapiens
tgagcatcacagaa

SEQ ID NO: 3663626 - DNA, 18 bp, Homo sapiens
tgagcatcacagaatgtg

SEQ ID NO: 3663627 - DNA, 17 bp, Homo sapiens
tgagcccctgtctagag

SEQ ID NO: 3663628 - DNA, 10 bp, Homo sapiens
tgagcctggc

SEQ ID NO: 3663629 - DNA, 18 bp, Homo sapiens
tgagcgcctccatccaag

SEQ ID NO: 3663630 - DNA, 17 bp, Homo sapiens
tgagcgctactcttgga

SEQ ID NO: 3663631 - DNA, 15 bp, Homo sapiens
tgagctgaccagccg

SEQ ID NO: 3663632 - DNA, 20 bp, Homo sapiens
tgagcttatttcaaaaggaa

SEQ ID NO: 3663633 - DNA, 17 bp, Homo sapiens
tgaggagagaaaatata

SEQ ID NO: 3663634 - DNA, 11 bp, Homo sapiens
tgaggagctgc

SEQ ID NO: 3663635 - DNA, 12 bp, Homo sapiens
tgaggagctgct

SEQ ID NO: 3663636 - DNA, 14 bp, Homo sapiens
tgaggagctgctgg

SEQ ID NO: 3663637 - DNA, 17 bp, Homo sapiens
tgaggagctgctggctt

SEQ ID NO: 3663638 - DNA, 12 bp, Homo sapiens
tgaggagctggg

SEQ ID NO: 3663639 - DNA, 17 bp, Homo sapiens
tgaggagtggagggaaa

SEQ ID NO: 3663640 - DNA, 23 bp, Homo sapiens
tgaggatgacagtgacacccaga

SEQ ID NO: 3663641 - DNA, 14 bp, Homo sapiens
tgaggcagggaagt

SEQ ID NO: 3663642 - DNA, 16 bp, Homo sapiens
tgaggcccactctgtt

SEQ ID NO: 3663643 - DNA, 12 bp, Homo sapiens
tgaggcctggac

SEQ ID NO: 3663644 - DNA, 23 bp, Homo sapiens
tgaggcctggactttcctgcaac

SEQ ID NO: 3663645 - DNA, 13 bp, Homo sapiens
tgaggcctgggcc

SEQ ID NO: 3663646 - DNA, 16 bp, Homo sapiens
tgaggcttcttcctgg

SEQ ID NO: 3663647 - DNA, 16 bp, Homo sapiens
tgaggcttgcccagga

SEQ ID NO: 3663648 - DNA, 19 bp, Homo sapiens
tgaggctttccatgggacc

SEQ ID NO: 3663649 - DNA, 23 bp, Homo sapiens
tgagggaggacaggcgggaggag

SEQ ID NO: 3663650 - DNA, 16 bp, Homo sapiens
tgaggggagcatgctt

SEQ ID NO: 3663651 - DNA, 21 bp, Homo sapiens
tgaggggagcatgcttccctg

SEQ ID NO: 3663652 - DNA, 17 bp, Homo sapiens
tgagggggaattcctgg

SEQ ID NO: 3663653 - DNA, 19 bp, Homo sapiens
tgagggggaattcctggaa

SEQ ID NO: 3663654 - DNA, 18 bp, Homo sapiens
tgaggtgaaagggagcta

SEQ ID NO: 3663655 - DNA, 19 bp, Homo sapiens
tgaggtttcaaacctccct

SEQ ID NO: 3663656 - DNA, 23 bp, Homo sapiens
tggaaattcccgtgttgcttcaa

SEQ ID NO: 3663657 - DNA, 16 bp, Homo sapiens
tggaaattgacgaggg

SEQ ID NO: 3663658 - DNA, 14 bp, Homo sapiens
tggaacccagactc

SEQ ID NO: 3663659 - DNA, 16 bp, Homo sapiens
tggaacccagactcag

SEQ ID NO: 3663660 - DNA, 16 bp, Homo sapiens
tggaaccgcaggaagc

SEQ ID NO: 3663661 - DNA, 19 bp, Homo sapiens
tggaaccgcaggaagctgc

SEQ ID NO: 3663662 - DNA, 17 bp, Homo sapiens
tggaacctcagcctggc

SEQ ID NO: 3663663 - DNA, 19 bp, Homo sapiens
tggaacctgcaaaaaatac

SEQ ID NO: 3663664 - DNA, 20 bp, Homo sapiens
tggaacctggaccccagcct

SEQ ID NO: 3663665 - DNA, 16 bp, Homo sapiens
tggaagacacttgctg

SEQ ID NO: 3663666 - DNA, 17 bp, Homo sapiens
tggaagacacttgctga

SEQ ID NO: 3663667 - DNA, 20 bp, Homo sapiens
tggaagacacttgctgagtg

SEQ ID NO: 3663668 - DNA, 23 bp, Homo sapiens
tggaagacacttgctgagtgaag

SEQ ID NO: 3663669 - DNA, 15 bp, Homo sapiens
tggaagggtttgtgg

SEQ ID NO: 3663670 - DNA, 17 bp, Homo sapiens
tggaagggtttgtggct

SEQ ID NO: 3663671 - DNA, 14 bp, Homo sapiens
tggaagtgggccag

SEQ ID NO: 3663672 - DNA, 19 bp, Homo sapiens
tggaagttttcctacactt

SEQ ID NO: 3663673 - DNA, 19 bp, Homo sapiens
tggaattggcaaactagaa

SEQ ID NO: 3663674 - DNA, 13 bp, Homo sapiens
tggaatttgttca

SEQ ID NO: 3663675 - DNA, 15 bp, Homo sapiens
tggaatttgttcaag

SEQ ID NO: 3663676 - DNA, 12 bp, Homo sapiens
tggacagaagaa

SEQ ID NO: 3663677 - DNA, 22 bp, Homo sapiens
tggacagcctcttctgtcccaa

SEQ ID NO: 3663678 - DNA, 13 bp, Homo sapiens
tggacaggatgtg

SEQ ID NO: 3663679 - DNA, 18 bp, Homo sapiens
tggacaggatgtgtttgc

SEQ ID NO: 3663680 - DNA, 18 bp, Homo sapiens
tggacatcctcctcccac

SEQ ID NO: 3663681 - DNA, 23 bp, Homo sapiens
tggacatcctcctcccacccggc

SEQ ID NO: 3663682 - DNA, 13 bp, Homo sapiens
tggaccccagcct

SEQ ID NO: 3663683 - DNA, 15 bp, Homo sapiens
tggaccccagccttg

SEQ ID NO: 3663684 - DNA, 17 bp, Homo sapiens
tggacctaaatggcctc

SEQ ID NO: 3663685 - DNA, 21 bp, Homo sapiens
tggacctaaatggcctcatgt

SEQ ID NO: 3663686 - DNA, 18 bp, Homo sapiens
tggactatattgggactg

SEQ ID NO: 3663687 - DNA, 22 bp, Homo sapiens
tggactgctacctttcaaagct

SEQ ID NO: 3663688 - DNA, 23 bp, Homo sapiens
tggactgctacctttcaaagctt

SEQ ID NO: 3663689 - DNA, 13 bp, Homo sapiens
tggactttcctgc

SEQ ID NO: 3663690 - DNA, 18 bp, Homo sapiens
tggactttcctgcaactc

SEQ ID NO: 3663691 - DNA, 14 bp, Homo sapiens
tggagaaccaccta

SEQ ID NO: 3663692 - DNA, 15 bp, Homo sapiens
tggagaactcctagg

SEQ ID NO: 3663693 - DNA, 16 bp, Homo sapiens
tggagagctggtgccc

SEQ ID NO: 3663694 - DNA, 19 bp, Homo sapiens
tggagagctggtgcccgga

SEQ ID NO: 3663695 - DNA, 15 bp, Homo sapiens
tggagagtttcctga

SEQ ID NO: 3663696 - DNA, 16 bp, Homo sapiens
tggagatcctcctgca

SEQ ID NO: 3663697 - DNA, 21 bp, Homo sapiens
tggagatcctcctgcagacca

SEQ ID NO: 3663698 - DNA, 17 bp, Homo sapiens
tggagccaatggcccgg

SEQ ID NO: 3663699 - DNA, 14 bp, Homo sapiens
tggagccccatcag

SEQ ID NO: 3663700 - DNA, 12 bp, Homo sapiens
tggagccgaggc

SEQ ID NO: 3663701 - DNA, 19 bp, Homo sapiens
tggagctccactgccatgt

SEQ ID NO: 3663702 - DNA, 20 bp, Homo sapiens
tggagctgaattttctggaa

SEQ ID NO: 3663703 - DNA, 21 bp, Homo sapiens
tggagctgaattttctggaaa

SEQ ID NO: 3663704 - DNA, 11 bp, Homo sapiens
tggaggacagt

SEQ ID NO: 3663705 - DNA, 20 bp, Homo sapiens
tggaggagctcaggacacta

SEQ ID NO: 3663706 - DNA, 15 bp, Homo sapiens
tggaggcccagttca

SEQ ID NO: 3663707 - DNA, 14 bp, Homo sapiens
tggaggctcctgtg

SEQ ID NO: 3663708 - DNA, 17 bp, Homo sapiens
tggaggctcctgtggta

SEQ ID NO: 3663709 - DNA, 19 bp, Homo sapiens
tggaggctgacgtgtgagg

SEQ ID NO: 3663710 - DNA, 21 bp, Homo sapiens
tggaggttaaggctgaggaaa

SEQ ID NO: 3663711 - DNA, 17 bp, Homo sapiens
tggagtgtatgactgca

SEQ ID NO: 3663712 - DNA, 15 bp, Homo sapiens
tggagtgtgagccac

SEQ ID NO: 3663713 - DNA, 18 bp, Homo sapiens
tggatgaggcttcttcct

SEQ ID NO: 3663714 - DNA, 23 bp, Homo sapiens
tggatgcggaacccaaattacgt

SEQ ID NO: 3663715 - DNA, 13 bp, Homo sapiens
tggatggcagtgt

SEQ ID NO: 3663716 - DNA, 18 bp, Homo sapiens
tggatggccccagcacag

SEQ ID NO: 3663717 - DNA, 21 bp, Homo sapiens
tggatgggggaactcagatcc

SEQ ID NO: 3663718 - DNA, 23 bp, Homo sapiens
tggatgggggaactcagatccag

SEQ ID NO: 3663719 - DNA, 15 bp, Homo sapiens
tggatgttgtgtgta

SEQ ID NO: 3663720 - DNA, 19 bp, Homo sapiens
tggattccccatctcaggc

SEQ ID NO: 3663721 - DNA, 12 bp, Homo sapiens
tggcaaaaaggc

SEQ ID NO: 3663722 - DNA, 20 bp, Homo sapiens
tggcaaaaggatctttgtgg

SEQ ID NO: 3663723 - DNA, 13 bp, Homo sapiens
tggcaacagatct

SEQ ID NO: 3663724 - DNA, 22 bp, Homo sapiens
tggcaacagatctggaacctca

SEQ ID NO: 3663725 - DNA, 16 bp, Homo sapiens
tggcaatttcctggcc

SEQ ID NO: 3663726 - DNA, 18 bp, Homo sapiens
tggcacagcccaaagaag

SEQ ID NO: 3663727 - DNA, 23 bp, Homo sapiens
tggcaccagacacccaggactta

SEQ ID NO: 3663728 - DNA, 18 bp, Homo sapiens
tggcaccagcagcctgga

SEQ ID NO: 3663729 - DNA, 11 bp, Homo sapiens
tggcagctctg

SEQ ID NO: 3663730 - DNA, 22 bp, Homo sapiens
tggcagctctggacagccccac

SEQ ID NO: 3663731 - DNA, 19 bp, Homo sapiens
tggcaggagttggaagtgt

SEQ ID NO: 3663732 - DNA, 15 bp, Homo sapiens
tggcaggctggccag

SEQ ID NO: 3663733 - DNA, 19 bp, Homo sapiens
tggcagtgtggggagggca

SEQ ID NO: 3663734 - DNA, 20 bp, Homo sapiens
tggcagtgtggggagggcag

SEQ ID NO: 3663735 - DNA, 23 bp, Homo sapiens
tggcatcgcaccattctgactcg

SEQ ID NO: 3663736 - DNA, 16 bp, Homo sapiens
tggcatctttgccttg

SEQ ID NO: 3663737 - DNA, 21 bp, Homo sapiens
tggcatctttgccttgggctg

SEQ ID NO: 3663738 - DNA, 18 bp, Homo sapiens
tggcatgagaaatacaaa

SEQ ID NO: 3663739 - DNA, 15 bp, Homo sapiens
tggccaaggagctgc

SEQ ID NO: 3663740 - DNA, 12 bp, Homo sapiens
tggccactaagc

SEQ ID NO: 3663741 - DNA, 20 bp, Homo sapiens
tggccactccgagaggtggg

SEQ ID NO: 3663742 - DNA, 13 bp, Homo sapiens
tggccactgagct

SEQ ID NO: 3663743 - DNA, 18 bp, Homo sapiens
tggccactgagctggctg

SEQ ID NO: 3663744 - DNA, 18 bp, Homo sapiens
tggccagacacaggccct

SEQ ID NO: 3663745 - DNA, 14 bp, Homo sapiens
tggccagcctggca

SEQ ID NO: 3663746 - DNA, 20 bp, Homo sapiens
tggccagcctggcatcagtt

SEQ ID NO: 3663747 - DNA, 21 bp, Homo sapiens
tggccagcgcccctcagcctc

SEQ ID NO: 3663748 - DNA, 22 bp, Homo sapiens
tggccagcgcccctcagcctct

SEQ ID NO: 3663749 - DNA, 20 bp, Homo sapiens
tggccaggagctcttcaggc

SEQ ID NO: 3663750 - DNA, 12 bp, Homo sapiens
tggccaggcaga

SEQ ID NO: 3663751 - DNA, 23 bp, Homo sapiens
tggccaggcagatctgtgcccca

SEQ ID NO: 3663752 - DNA, 20 bp, Homo sapiens
tggccaggctggtcttgaac

SEQ ID NO: 3663753 - DNA, 15 bp, Homo sapiens
tggccagtccaggct

SEQ ID NO: 3663754 - DNA, 17 bp, Homo sapiens
tggccagtccaggctgc

SEQ ID NO: 3663755 - DNA, 23 bp, Homo sapiens
tggcccaaggctggcaggtcaac

SEQ ID NO: 3663756 - DNA, 13 bp, Homo sapiens
tggcccacgcact

SEQ ID NO: 3663757 - DNA, 19 bp, Homo sapiens
tggcccacgcacttcggga

SEQ ID NO: 3663758 - DNA, 13 bp, Homo sapiens
tggcccactgcat

SEQ ID NO: 3663759 - DNA, 15 bp, Homo sapiens
tggcccagggcccag

SEQ ID NO: 3663760 - DNA, 17 bp, Homo sapiens
tggcccagggcccagag

SEQ ID NO: 3663761 - DNA, 23 bp, Homo sapiens
tggcccagggcccagagcccagc

SEQ ID NO: 3663762 - DNA, 15 bp, Homo sapiens
tggccccaccctggg

SEQ ID NO: 3663763 - DNA, 18 bp, Homo sapiens
tggccccaccctgggccc

SEQ ID NO: 3663764 - DNA, 13 bp, Homo sapiens
tggccccagcaca

SEQ ID NO: 3663765 - DNA, 14 bp, Homo sapiens
tggccccagcacag

SEQ ID NO: 3663766 - DNA, 15 bp, Homo sapiens
tggcccggcccctcc

SEQ ID NO: 3663767 - DNA, 17 bp, Homo sapiens
tggcccggcccctcctg

SEQ ID NO: 3663768 - DNA, 18 bp, Homo sapiens
tggcccggcccctcctga

SEQ ID NO: 3663769 - DNA, 19 bp, Homo sapiens
tggcccggcccctcctgac

SEQ ID NO: 3663770 - DNA, 23 bp, Homo sapiens
tggcccttgcagttcagcaccac

SEQ ID NO: 3663771 - DNA, 17 bp, Homo sapiens
tggccggctctggtggc

SEQ ID NO: 3663772 - DNA, 19 bp, Homo sapiens
ttactatcatgtcaaacgt

SEQ ID NO: 3663773 - DNA, 17 bp, Homo sapiens
ttactgaaatgcgctct

SEQ ID NO: 3663774 - DNA, 19 bp, Homo sapiens
ttactttggcaatttcctg

SEQ ID NO: 3663775 - DNA, 20 bp, Homo sapiens
ttactttggcaatttcctgg

SEQ ID NO: 3663776 - DNA, 17 bp, Homo sapiens
ttagaagacaattgaca

SEQ ID NO: 3663777 - DNA, 22 bp, Homo sapiens
ttagactcatggtgtgttacac

SEQ ID NO: 3663778 - DNA, 12 bp, Homo sapiens
ttagagaataag

SEQ ID NO: 3663779 - DNA, 15 bp, Homo sapiens
ttagatctggcatgt

SEQ ID NO: 3663780 - DNA, 22 bp, Homo sapiens
ttagcaaagcaaaaggctgaga

SEQ ID NO: 3663781 - DNA, 15 bp, Homo sapiens
ttagcagcttccaga

SEQ ID NO: 3663782 - DNA, 16 bp, Homo sapiens
ttaggagaagccagga

SEQ ID NO: 3663783 - DNA, 16 bp, Homo sapiens
ttaggcagactcttta

SEQ ID NO: 3663784 - DNA, 13 bp, Homo sapiens
ttaggccttggct

SEQ ID NO: 3663785 - DNA, 17 bp, Homo sapiens
ttaggctggtggcccag

SEQ ID NO: 3663786 - DNA, 14 bp, Homo sapiens
ttaggtagaaaaac

SEQ ID NO: 3663787 - DNA, 15 bp, Homo sapiens
ttaggtagaaaaaca

SEQ ID NO: 3663788 - DNA, 13 bp, Homo sapiens
ttagtaaatgtta

SEQ ID NO: 3663789 - DNA, 18 bp, Homo sapiens
ttagtaagaaatttgcag

SEQ ID NO: 3663790 - DNA, 12 bp, Homo sapiens
ttagtcctggga

SEQ ID NO: 3663791 - DNA, 18 bp, Homo sapiens
ttagtcgccctacagaaa

SEQ ID NO: 3663792 - DNA, 13 bp, Homo sapiens
ttagtgccaactt

SEQ ID NO: 3663793 - DNA, 14 bp, Homo sapiens
ttagtgtttgaaaa

SEQ ID NO: 3663794 - DNA, 16 bp, Homo sapiens
ttagttcctcattagc

SEQ ID NO: 3663795 - DNA, 21 bp, Homo sapiens
ttagtttcaagagtctaaacc

SEQ ID NO: 3663796 - DNA, 15 bp, Homo sapiens
ttagtttgtgtgttg

SEQ ID NO: 3663797 - DNA, 23 bp, Homo sapiens
ttagtttttaacaatctaacaat

SEQ ID NO: 3663798 - DNA, 13 bp, Homo sapiens
ttataaaatggct

SEQ ID NO: 3663799 - DNA, 19 bp, Homo sapiens
ttataccaggttacctcac

SEQ ID NO: 3663800 - DNA, 14 bp, Homo sapiens
ttatactgtacaat

SEQ ID NO: 3663801 - DNA, 12 bp, Homo sapiens
ttatagatgcaa

SEQ ID NO: 3663802 - DNA, 13 bp, Homo sapiens
ttatagtttgaca

SEQ ID NO: 3663803 - DNA, 18 bp, Homo sapiens
ttatataatatctaaagt

SEQ ID NO: 3663804 - DNA, 20 bp, Homo sapiens
ttatataatatctaaagtta

SEQ ID NO: 3663805 - DNA, 21 bp, Homo sapiens
ttatataatatctaaagttat

SEQ ID NO: 3663806 - DNA, 12 bp, Homo sapiens
ttatataattgt

SEQ ID NO: 3663807 - DNA, 11 bp, Homo sapiens
ttatatttcag

SEQ ID NO: 3663808 - DNA, 15 bp, Homo sapiens
ttatcaacttcctaa

SEQ ID NO: 3663809 - DNA, 20 bp, Homo sapiens
ttatcaagcttagtgagcag

SEQ ID NO: 3663810 - DNA, 22 bp, Homo sapiens
ttatctgtttcctgacattgtc

SEQ ID NO: 3663811 - DNA, 20 bp, Homo sapiens
ttatcttatactgtacaata

SEQ ID NO: 3663812 - DNA, 20 bp, Homo sapiens
ttatgatgtgggtcaaggaa

SEQ ID NO: 3663813 - DNA, 11 bp, Homo sapiens
ttatggcctca

SEQ ID NO: 3663814 - DNA, 13 bp, Homo sapiens
ttatggcctcagc

SEQ ID NO: 3663815 - DNA, 15 bp, Homo sapiens
ttatggcctcagctg

SEQ ID NO: 3663816 - DNA, 15 bp, Homo sapiens
ttatgggcccctggc

SEQ ID NO: 3663817 - DNA, 20 bp, Homo sapiens
ttatgtactagtgttctgtt

SEQ ID NO: 3663818 - DNA, 15 bp, Homo sapiens
ttatgtcttgttctt

SEQ ID NO: 3663819 - DNA, 17 bp, Homo sapiens
ttatgttttacatgccc

SEQ ID NO: 3663820 - DNA, 16 bp, Homo sapiens
ttattaacaattaggc

SEQ ID NO: 3663821 - DNA, 14 bp, Homo sapiens
ttattaattgcttt

SEQ ID NO: 3663822 - DNA, 15 bp, Homo sapiens
ttattaattgctttg

SEQ ID NO: 3663823 - DNA, 15 bp, Homo sapiens
ttattgcgctgctac

SEQ ID NO: 3663824 - DNA, 15 bp, Homo sapiens
ttatttcctgattac

SEQ ID NO: 3663825 - DNA, 19 bp, Homo sapiens
ttattttctacgtttcttt

SEQ ID NO: 3663826 - DNA, 14 bp, Homo sapiens
ttcaaaataaaaac

SEQ ID NO: 3663827 - DNA, 13 bp, Homo sapiens
ttcaaaatattta

SEQ ID NO: 3663828 - DNA, 20 bp, Homo sapiens
ttcaaaatatttaaaaatgt

SEQ ID NO: 3663829 - DNA, 16 bp, Homo sapiens
ttcaaagaagctgtct

SEQ ID NO: 3663830 - DNA, 18 bp, Homo sapiens
ttcaacagtgaagacaga

SEQ ID NO: 3663831 - DNA, 23 bp, Homo sapiens
ttcaagagactctcctgcctcag

SEQ ID NO: 3663832 - DNA, 22 bp, Homo sapiens
ttcaagcagtcgtgcctgtgtc

SEQ ID NO: 3663833 - DNA, 23 bp, Homo sapiens
ttcaagcagtcgtgcctgtgtcc

SEQ ID NO: 3663834 - DNA, 24 bp, Homo sapiens
ttcaaggggagccaaaatctcaag

SEQ ID NO: 3663835 - DNA, 11 bp, Homo sapiens
ttcaagtgcct

SEQ ID NO: 3663836 - DNA, 14 bp, Homo sapiens
ttcaagtgcctaga

SEQ ID NO: 3663837 - DNA, 19 bp, Homo sapiens
ttcaattgctttgtgactt

SEQ ID NO: 3663838 - DNA, 19 bp, Homo sapiens
ttcaatttccaagagctga

SEQ ID NO: 3663839 - DNA, 12 bp, Homo sapiens
ttcacaacctgg

SEQ ID NO: 3663840 - DNA, 18 bp, Homo sapiens
ttcacagctttgaggaac

SEQ ID NO: 3663841 - DNA, 23 bp, Homo sapiens
ttcacagctttgaggaacatgca

SEQ ID NO: 3663842 - DNA, 15 bp, Homo sapiens
ttcacattcttggct

SEQ ID NO: 3663843 - DNA, 16 bp, Homo sapiens
ttcacattcttggctt

SEQ ID NO: 3663844 - DNA, 22 bp, Homo sapiens
ttcaccctgtccaaactgccta

SEQ ID NO: 3663845 - DNA, 20 bp, Homo sapiens
ttcactcttcaaatgcctga

SEQ ID NO: 3663846 - DNA, 15 bp, Homo sapiens
ttcacttttctgtaa

SEQ ID NO: 3663847 - DNA, 12 bp, Homo sapiens
ttcagaacctct

SEQ ID NO: 3663848 - DNA, 16 bp, Homo sapiens
ttcagaacctcttccc

SEQ ID NO: 3663849 - DNA, 21 bp, Homo sapiens
ttcagactcccattcctgaag

SEQ ID NO: 3663850 - DNA, 14 bp, Homo sapiens
ttcagacttgtcaa

SEQ ID NO: 3663851 - DNA, 16 bp, Homo sapiens
ttcagatgtaatgttt

SEQ ID NO: 3663852 - DNA, 18 bp, Homo sapiens
ttcagatgtgaaccatta

SEQ ID NO: 3663853 - DNA, 16 bp, Homo sapiens
ttcagcaccaccctag

SEQ ID NO: 3663854 - DNA, 14 bp, Homo sapiens
ttcagcactgtccc

SEQ ID NO: 3663855 - DNA, 10 bp, Homo sapiens
ttcagccaag

SEQ ID NO: 3663856 - DNA, 13 bp, Homo sapiens
ttcagccaggagc

SEQ ID NO: 3663857 - DNA, 13 bp, Homo sapiens
ttcagcccaccag

SEQ ID NO: 3663858 - DNA, 21 bp, Homo sapiens
ttcagcccaccagccacctca

SEQ ID NO: 3663859 - DNA, 20 bp, Homo sapiens
ttcagcctgccttcttttct

SEQ ID NO: 3663860 - DNA, 24 bp, Homo sapiens
ttcagctctgcaagaattgaagca

SEQ ID NO: 3663861 - DNA, 13 bp, Homo sapiens
ttcagggtcatag

SEQ ID NO: 3663862 - DNA, 14 bp, Homo sapiens
ttcaggtccaggct

SEQ ID NO: 3663863 - DNA, 16 bp, Homo sapiens
ttcagtgaaagcatca

SEQ ID NO: 3663864 - DNA, 19 bp, Homo sapiens
ttcagttaattcttagata

SEQ ID NO: 3663865 - DNA, 22 bp, Homo sapiens
ttcagttggttcgttctgtact

SEQ ID NO: 3663866 - DNA, 13 bp, Homo sapiens
ttcatcaagtagc

SEQ ID NO: 3663867 - DNA, 20 bp, Homo sapiens
ttcatcttccaactcaaact

SEQ ID NO: 3663868 - DNA, 15 bp, Homo sapiens
ttcattctccttgtt

SEQ ID NO: 3663869 - DNA, 14 bp, Homo sapiens
ttcattgctctcca

SEQ ID NO: 3663870 - DNA, 14 bp, Homo sapiens
ttcattttcagagt

SEQ ID NO: 3663871 - DNA, 16 bp, Homo sapiens
ttccaaacctggttca

SEQ ID NO: 3663872 - DNA, 17 bp, Homo sapiens
ttccaaacctggttcat

SEQ ID NO: 3663873 - DNA, 21 bp, Homo sapiens
ttccaaaggcagcgtgccgag

SEQ ID NO: 3663874 - DNA, 14 bp, Homo sapiens
ttccaaatgcttct

SEQ ID NO: 3663875 - DNA, 16 bp, Homo sapiens
ttccaaatgcttctat

SEQ ID NO: 3663876 - DNA, 16 bp, Homo sapiens
ttccaaatgtccctcc

SEQ ID NO: 3663877 - DNA, 16 bp, Homo sapiens
ttccaacacatttcac

SEQ ID NO: 3663878 - DNA, 22 bp, Homo sapiens
ttccaactcgtatagcatgcat

SEQ ID NO: 3663879 - DNA, 12 bp, Homo sapiens
ttccaagagctg

SEQ ID NO: 3663880 - DNA, 13 bp, Homo sapiens
ttccaagagctga

SEQ ID NO: 3663881 - DNA, 22 bp, Homo sapiens
ttccacaagtgccgcaaattgt

SEQ ID NO: 3663882 - DNA, 21 bp, Homo sapiens
ttccaccacagccagcacctg

SEQ ID NO: 3663883 - DNA, 22 bp, Homo sapiens
ttccaccacagccagcacctgg

SEQ ID NO: 3663884 - DNA, 22 bp, Homo sapiens
ttccacgggggctgtggctctg

SEQ ID NO: 3663885 - DNA, 16 bp, Homo sapiens
ttccactccattgtcg

SEQ ID NO: 3663886 - DNA, 16 bp, Homo sapiens
ttccagcccctctggt

SEQ ID NO: 3663887 - DNA, 15 bp, Homo sapiens
ttccagggaggggcc

SEQ ID NO: 3663888 - DNA, 16 bp, Homo sapiens
ttccagggtccctctg

SEQ ID NO: 3663889 - DNA, 17 bp, Homo sapiens
tttcctcccttctgcta

SEQ ID NO: 3663890 - DNA, 19 bp, Homo sapiens
tttcctcccttctgctact

SEQ ID NO: 3663891 - DNA, 15 bp, Homo sapiens
tttccttccatccct

SEQ ID NO: 3663892 - DNA, 18 bp, Homo sapiens
tttccttggggcaggcag

SEQ ID NO: 3663893 - DNA, 9 bp, Homo sapiens
tttcctttg

SEQ ID NO: 3663894 - DNA, 13 bp, Homo sapiens
tttcctttgctct

SEQ ID NO: 3663895 - DNA, 14 bp, Homo sapiens
tttcctttgtcctt

SEQ ID NO: 3663896 - DNA, 22 bp, Homo sapiens
tttctcgctgtcctttctagag

SEQ ID NO: 3663897 - DNA, 11 bp, Homo sapiens
tttctctgcca

SEQ ID NO: 3663898 - DNA, 18 bp, Homo sapiens
tttctctgtacttttcat

SEQ ID NO: 3663899 - DNA, 14 bp, Homo sapiens
tttctctgttgtaa

SEQ ID NO: 3663900 - DNA, 19 bp, Homo sapiens
tttctgaaaattaacactg

SEQ ID NO: 3663901 - DNA, 15 bp, Homo sapiens
tttctgaactgttac

SEQ ID NO: 3663902 - DNA, 17 bp, Homo sapiens
tttctgaactgttacaa

SEQ ID NO: 3663903 - DNA, 16 bp, Homo sapiens
tttctgccagggagct

SEQ ID NO: 3663904 - DNA, 22 bp, Homo sapiens
tttctgcctggagtgtatgact

SEQ ID NO: 3663905 - DNA, 16 bp, Homo sapiens
tttctggaaaatgctt

SEQ ID NO: 3663906 - DNA, 17 bp, Homo sapiens
tttctggtggtctgttg

SEQ ID NO: 3663907 - DNA, 16 bp, Homo sapiens
tttcttaaacaaatgt

SEQ ID NO: 3663908 - DNA, 13 bp, Homo sapiens
tttcttattgcgc

SEQ ID NO: 3663909 - DNA, 16 bp, Homo sapiens
tttcttgtttctgcat

SEQ ID NO: 3663910 - DNA, 18 bp, Homo sapiens
tttctttaggagatttat

SEQ ID NO: 3663911 - DNA, 15 bp, Homo sapiens
tttctttgcaaagta

SEQ ID NO: 3663912 - DNA, 14 bp, Homo sapiens
tttcttttttctct

SEQ ID NO: 3663913 - DNA, 14 bp, Homo sapiens
tttctttttttcct

SEQ ID NO: 3663914 - DNA, 23 bp, Homo sapiens
tttgaaaaagctggtctttgagc

SEQ ID NO: 3663915 - DNA, 20 bp, Homo sapiens
tttgaaatagtctgtgtgaa

SEQ ID NO: 3663916 - DNA, 11 bp, Homo sapiens
tttgaatttct

SEQ ID NO: 3663917 - DNA, 20 bp, Homo sapiens
tttgacaacgtttcagcgac

SEQ ID NO: 3663918 - DNA, 13 bp, Homo sapiens
tttgactgaaaaa

SEQ ID NO: 3663919 - DNA, 17 bp, Homo sapiens
tttgactttcttctgaa

SEQ ID NO: 3663920 - DNA, 19 bp, Homo sapiens
tttgagaaagtacagcagt

SEQ ID NO: 3663921 - DNA, 16 bp, Homo sapiens
tttgagatcagcctgg

SEQ ID NO: 3663922 - DNA, 20 bp, Homo sapiens
tttgaggacttgttaaagag

SEQ ID NO: 3663923 - DNA, 22 bp, Homo sapiens
tttgatacagtcaacaagcctg

SEQ ID NO: 3663924 - DNA, 19 bp, Homo sapiens
tttgatagggaactgggga

SEQ ID NO: 3663925 - DNA, 18 bp, Homo sapiens
tttgatagtattgtgcat

SEQ ID NO: 3663926 - DNA, 17 bp, Homo sapiens
tttgatgtttgtggcct

SEQ ID NO: 3663927 - DNA, 15 bp, Homo sapiens
tttgattaacatttg

SEQ ID NO: 3663928 - DNA, 22 bp, Homo sapiens
tttgcaaagtattgtaaattat

SEQ ID NO: 3663929 - DNA, 12 bp, Homo sapiens
tttgcaaggaag

SEQ ID NO: 3663930 - DNA, 21 bp, Homo sapiens
tttgcaaggaagccacagctg

SEQ ID NO: 3663931 - DNA, 21 bp, Homo sapiens
tttgccaaaataccagagcct

SEQ ID NO: 3663932 - DNA, 15 bp, Homo sapiens
tttgccagtgggaac

SEQ ID NO: 3663933 - DNA, 21 bp, Homo sapiens
tttgccttgggctgctcctca

SEQ ID NO: 3663934 - DNA, 16 bp, Homo sapiens
tttgctcacctggggt

SEQ ID NO: 3663935 - DNA, 20 bp, Homo sapiens
tttggattggggtccctcta

SEQ ID NO: 3663936 - DNA, 19 bp, Homo sapiens
tttggcccaatctctgcca

SEQ ID NO: 3663937 - DNA, 21 bp, Homo sapiens
tttggctgaaattctcctgga

SEQ ID NO: 3663938 - DNA, 22 bp, Homo sapiens
tttggctgaaattctcctggag

SEQ ID NO: 3663939 - DNA, 13 bp, Homo sapiens
tttggctttcagg

SEQ ID NO: 3663940 - DNA, 14 bp, Homo sapiens
tttgggacttctac

SEQ ID NO: 3663941 - DNA, 20 bp, Homo sapiens
tttggggggcagagaataaa

SEQ ID NO: 3663942 - DNA, 14 bp, Homo sapiens
tttgtaaagctatt

SEQ ID NO: 3663943 - DNA, 21 bp, Homo sapiens
tttgtaaatgcctcttaaatt

SEQ ID NO: 3663944 - DNA, 20 bp, Homo sapiens
tttgtaatgaattcctagaa

SEQ ID NO: 3663945 - DNA, 12 bp, Homo sapiens
tttgtagttttt

SEQ ID NO: 3663946 - DNA, 19 bp, Homo sapiens
tttgtcctgatgcttttgt

SEQ ID NO: 3663947 - DNA, 19 bp, Homo sapiens
tttgtcgctcatgtgtgca

SEQ ID NO: 3663948 - DNA, 12 bp, Homo sapiens
tttgtgaactgg

SEQ ID NO: 3663949 - DNA, 18 bp, Homo sapiens
tttgtgaactggaagaaa

SEQ ID NO: 3663950 - DNA, 17 bp, Homo sapiens
tttgtgacttcttcttc

SEQ ID NO: 3663951 - DNA, 20 bp, Homo sapiens
tttgtgctagaaattttcaa

SEQ ID NO: 3663952 - DNA, 20 bp, Homo sapiens
tttgtgctatagtatttgat

SEQ ID NO: 3663953 - DNA, 11 bp, Homo sapiens
tttgtggccaa

SEQ ID NO: 3663954 - DNA, 16 bp, Homo sapiens
tttgtggttttgagaa

SEQ ID NO: 3663955 - DNA, 14 bp, Homo sapiens
tttgtgttcttctt

SEQ ID NO: 3663956 - DNA, 24 bp, Homo sapiens
tttgttaaaatacagttctgtcat

SEQ ID NO: 3663957 - DNA, 22 bp, Homo sapiens
tttgttaggattttcacattct

SEQ ID NO: 3663958 - DNA, 16 bp, Homo sapiens
tttgttattgttttgt

SEQ ID NO: 3663959 - DNA, 15 bp, Homo sapiens
tttgttgtcagctga

SEQ ID NO: 3663960 - DNA, 13 bp, Homo sapiens
tttgtttgtgcat

SEQ ID NO: 3663961 - DNA, 18 bp, Homo sapiens
tttgtttttatttaaatt

SEQ ID NO: 3663962 - DNA, 21 bp, Homo sapiens
ttttaaaaaactgctgactgt

SEQ ID NO: 3663963 - DNA, 18 bp, Homo sapiens
ttttaaaaaatattttct

SEQ ID NO: 3663964 - DNA, 20 bp, Homo sapiens
ttttaaaaattgttaatttt

SEQ ID NO: 3663965 - DNA, 16 bp, Homo sapiens
ttttaaaatgcaatgt

SEQ ID NO: 3663966 - DNA, 21 bp, Homo sapiens
ttttaaataaaaattactgtg

SEQ ID NO: 3663967 - DNA, 14 bp, Homo sapiens
ttttaaatgtacag

SEQ ID NO: 3663968 - DNA, 22 bp, Homo sapiens
ttttaaatgtacagacatattt

SEQ ID NO: 3663969 - DNA, 15 bp, Homo sapiens
ttttaaattttgtaa

SEQ ID NO: 3663970 - DNA, 17 bp, Homo sapiens
ttttaaattttgtaatg

SEQ ID NO: 3663971 - DNA, 19 bp, Homo sapiens
ttttaactgccaatcctta

SEQ ID NO: 3663972 - DNA, 16 bp, Homo sapiens
ttttaagaattgttta

SEQ ID NO: 3663973 - DNA, 13 bp, Homo sapiens
ttttaaggtcttt

SEQ ID NO: 3663974 - DNA, 17 bp, Homo sapiens
ttttaaggtctttcagt

SEQ ID NO: 3663975 - DNA, 21 bp, Homo sapiens
ttttaaggtctttcagtactt

SEQ ID NO: 3663976 - DNA, 15 bp, Homo sapiens
ttttaagttaataga

SEQ ID NO: 3663977 - DNA, 18 bp, Homo sapiens
ttttaagttaatagattt

SEQ ID NO: 3663978 - DNA, 23 bp, Homo sapiens
ttttaagttaatagattttttca

SEQ ID NO: 3663979 - DNA, 20 bp, Homo sapiens
ttttaatgtcatttgttaaa

SEQ ID NO: 3663980 - DNA, 12 bp, Homo sapiens
ttttaatttagt

SEQ ID NO: 3663981 - DNA, 14 bp, Homo sapiens
ttttaatttagtaa

SEQ ID NO: 3663982 - DNA, 18 bp, Homo sapiens
ttttaatttagtaaatgt

SEQ ID NO: 3663983 - DNA, 20 bp, Homo sapiens
ttttaatttagtaaatgtta

SEQ ID NO: 3663984 - DNA, 13 bp, Homo sapiens
ttttaatttgata

SEQ ID NO: 3663985 - DNA, 15 bp, Homo sapiens
ttttaggtagaaaaa

SEQ ID NO: 3663986 - DNA, 22 bp, Homo sapiens
ttttataaaatggctgtaatca

SEQ ID NO: 3663987 - DNA, 17 bp, Homo sapiens
ttttatattaatgtact

SEQ ID NO: 3663988 - DNA, 15 bp, Homo sapiens
ttttatctgtttcct

SEQ ID NO: 3663989 - DNA, 19 bp, Homo sapiens
ttttatgccttttatttct

SEQ ID NO: 3663990 - DNA, 18 bp, Homo sapiens
ttttcaacagtgaagaca

SEQ ID NO: 3663991 - DNA, 19 bp, Homo sapiens
ttttcacagctttgaggaa

SEQ ID NO: 3663992 - DNA, 17 bp, Homo sapiens
ttttcagaacctcttcc

SEQ ID NO: 3663993 - DNA, 22 bp, Homo sapiens
ttttcagaacctcttccccaga

SEQ ID NO: 3663994 - DNA, 11 bp, Homo sapiens
ttttcagatgt

SEQ ID NO: 3663995 - DNA, 19 bp, Homo sapiens
ttttccaaagagtgatagt

SEQ ID NO: 3663996 - DNA, 19 bp, Homo sapiens
ttttccatgaaaatgcaac

SEQ ID NO: 3663997 - DNA, 18 bp, Homo sapiens
ttttccctattagagaag

SEQ ID NO: 3663998 - DNA, 15 bp, Homo sapiens
ttttccctgggtgga

SEQ ID NO: 3663999 - DNA, 17 bp, Homo sapiens
ttttcctcccttctgct

SEQ ID NO: 3664000 - DNA, 21 bp, Homo sapiens
ttttcctcccttctgctactg

SEQ ID NO: 3664001 - DNA, 21 bp, Homo sapiens
ttttctcgctgtcctttctag

SEQ ID NO: 3664002 - DNA, 14 bp, Homo sapiens
ttttctctgtactt

SEQ ID NO: 3664003 - DNA, 21 bp, Homo sapiens
ttttctcttagaacattgtat

SEQ ID NO: 3664004 - DNA, 17 bp, Homo sapiens
ttttctggaaaatgctt

SEQ ID NO: 3664005 - DNA, 14 bp, Homo sapiens
ttttcttgtttctg

SEQ ID NO: 3664006 - DNA, 17 bp, Homo sapiens
attttttggtacaaaaa

SEQ ID NO: 3664007 - DNA, 15 bp, Homo sapiens
caaaaaaaagtctat

SEQ ID NO: 3664008 - DNA, 17 bp, Homo sapiens
caaaaaagtccaatttt

SEQ ID NO: 3664009 - DNA, 22 bp, Homo sapiens
caaaaaagtccaattttaattt

SEQ ID NO: 3664010 - DNA, 19 bp, Homo sapiens
caaaaaatactttttctaa

SEQ ID NO: 3664011 - DNA, 10 bp, Homo sapiens
caaaaacaaa

SEQ ID NO: 3664012 - DNA, 12 bp, Homo sapiens
caaaaaccaaat

SEQ ID NO: 3664013 - DNA, 10 bp, Homo sapiens
caaaaataaa

SEQ ID NO: 3664014 - DNA, 15 bp, Homo sapiens
caaaaattagctggg

SEQ ID NO: 3664015 - DNA, 22 bp, Homo sapiens
caaaacgatgaagttatgctgt

SEQ ID NO: 3664016 - DNA, 19 bp, Homo sapiens
caaaactctacttaatcca

SEQ ID NO: 3664017 - DNA, 13 bp, Homo sapiens
caaaagaagcccc

SEQ ID NO: 3664018 - DNA, 17 bp, Homo sapiens
caaaagaagcccccagc

SEQ ID NO: 3664019 - DNA, 16 bp, Homo sapiens
caaaagatgcttctca

SEQ ID NO: 3664020 - DNA, 16 bp, Homo sapiens
caaaaggctgagaagg

SEQ ID NO: 3664021 - DNA, 16 bp, Homo sapiens
caaaataccagagcct

SEQ ID NO: 3664022 - DNA, 14 bp, Homo sapiens
caaaatatttaaaa

SEQ ID NO: 3664023 - DNA, 21 bp, Homo sapiens
caaaatatttaaaaatgtctt

SEQ ID NO: 3664024 - DNA, 16 bp, Homo sapiens
caaaatctgttctaac

SEQ ID NO: 3664025 - DNA, 17 bp, Homo sapiens
caaaatctgttctaaca

SEQ ID NO: 3664026 - DNA, 14 bp, Homo sapiens
caaaatttgactaa

SEQ ID NO: 3664027 - DNA, 20 bp, Homo sapiens
caaacaaaaaggttctcagg

SEQ ID NO: 3664028 - DNA, 21 bp, Homo sapiens
caaacaaaaaggttctcaggt

SEQ ID NO: 3664029 - DNA, 14 bp, Homo sapiens
caaacaaagccaga

SEQ ID NO: 3664030 - DNA, 14 bp, Homo sapiens
caaactcttcagtt

SEQ ID NO: 3664031 - DNA, 18 bp, Homo sapiens
caaactgcctaagccctc

SEQ ID NO: 3664032 - DNA, 22 bp, Homo sapiens
caaacttctgaactttggaagc

SEQ ID NO: 3664033 - DNA, 18 bp, Homo sapiens
caaagaaccttctctatg

SEQ ID NO: 3664034 - DNA, 19 bp, Homo sapiens
caaagaaggaaaaggcagg

SEQ ID NO: 3664035 - DNA, 21 bp, Homo sapiens
caaagacctccacttgcttaa

SEQ ID NO: 3664036 - DNA, 15 bp, Homo sapiens
caaagagatgtcctt

SEQ ID NO: 3664037 - DNA, 13 bp, Homo sapiens
caaagaggcaaga

SEQ ID NO: 3664038 - DNA, 21 bp, Homo sapiens
caaagatctgtcctcagcctt

SEQ ID NO: 3664039 - DNA, 17 bp, Homo sapiens
caaagattgagaagcca

SEQ ID NO: 3664040 - DNA, 13 bp, Homo sapiens
caaagccagaagc

SEQ ID NO: 3664041 - DNA, 18 bp, Homo sapiens
caaagccagaagctgagc

SEQ ID NO: 3664042 - DNA, 18 bp, Homo sapiens
caaagcctcctccagccg

SEQ ID NO: 3664043 - DNA, 13 bp, Homo sapiens
caaagctaggatg

SEQ ID NO: 3664044 - DNA, 22 bp, Homo sapiens
caaagctgagcctgcagggaag

SEQ ID NO: 3664045 - DNA, 23 bp, Homo sapiens
caaagctgagcctgcagggaagc

SEQ ID NO: 3664046 - DNA, 24 bp, Homo sapiens
caaagctgagcctgcagggaagcc

SEQ ID NO: 3664047 - DNA, 19 bp, Homo sapiens
caaagcttggagggaagcc

SEQ ID NO: 3664048 - DNA, 22 bp, Homo sapiens
caaagctttcctgccccaggcc

SEQ ID NO: 3664049 - DNA, 23 bp, Homo sapiens
caaagctttcctgccccaggcct

SEQ ID NO: 3664050 - DNA, 11 bp, Homo sapiens
caaaggcagcg

SEQ ID NO: 3664051 - DNA, 15 bp, Homo sapiens
caaaggcagcgtgcc

SEQ ID NO: 3664052 - DNA, 12 bp, Homo sapiens
caaaggcagctg

SEQ ID NO: 3664053 - DNA, 15 bp, Homo sapiens
caaaggcagctgtgt

SEQ ID NO: 3664054 - DNA, 21 bp, Homo sapiens
caaaggcagctgtgtctgagc

SEQ ID NO: 3664055 - DNA, 16 bp, Homo sapiens
caaaggcatgctggag

SEQ ID NO: 3664056 - DNA, 17 bp, Homo sapiens
caaaggcatgctggagt

SEQ ID NO: 3664057 - DNA, 16 bp, Homo sapiens
caaagtattgtaaatt

SEQ ID NO: 3664058 - DNA, 18 bp, Homo sapiens
caaagtattgtaaattat

SEQ ID NO: 3664059 - DNA, 19 bp, Homo sapiens
caaagtgctgggattacag

SEQ ID NO: 3664060 - DNA, 14 bp, Homo sapiens
caaatatgtcctgg

SEQ ID NO: 3664061 - DNA, 19 bp, Homo sapiens
caaatcaccacaaactgta

SEQ ID NO: 3664062 - DNA, 20 bp, Homo sapiens
caaatcaccacaaactgtaa

SEQ ID NO: 3664063 - DNA, 19 bp, Homo sapiens
caaatcacccaatcccagt

SEQ ID NO: 3664064 - DNA, 18 bp, Homo sapiens
caaatcattccttagata

SEQ ID NO: 3664065 - DNA, 16 bp, Homo sapiens
caaatgcagtatattt

SEQ ID NO: 3664066 - DNA, 12 bp, Homo sapiens
caaatgcttcta

SEQ ID NO: 3664067 - DNA, 20 bp, Homo sapiens
caaatggagctttctgtata

SEQ ID NO: 3664068 - DNA, 14 bp, Homo sapiens
caaatggggccaga

SEQ ID NO: 3664069 - DNA, 16 bp, Homo sapiens
caaatggggccagatc

SEQ ID NO: 3664070 - DNA, 17 bp, Homo sapiens
caaatggggccagatcc

SEQ ID NO: 3664071 - DNA, 18 bp, Homo sapiens
caaatggggccagatcca

SEQ ID NO: 3664072 - DNA, 16 bp, Homo sapiens
caaatgtttaaacatt

SEQ ID NO: 3664073 - DNA, 17 bp, Homo sapiens
caaatgtttatgttttc

SEQ ID NO: 3664074 - DNA, 23 bp, Homo sapiens
caaattcttttgaattgttacat

SEQ ID NO: 3664075 - DNA, 21 bp, Homo sapiens
caaatttagaaactaattgac

SEQ ID NO: 3664076 - DNA, 22 bp, Homo sapiens
caaatttagaaactaattgact

SEQ ID NO: 3664077 - DNA, 21 bp, Homo sapiens
caaatttttcaaatcattcct

SEQ ID NO: 3664078 - DNA, 14 bp, Homo sapiens
caacaaagaacact

SEQ ID NO: 3664079 - DNA, 19 bp, Homo sapiens
caacaaagattgagaagcc

SEQ ID NO: 3664080 - DNA, 21 bp, Homo sapiens
caacaaagattgagaagccat

SEQ ID NO: 3664081 - DNA, 13 bp, Homo sapiens
caacacagatccg

SEQ ID NO: 3664082 - DNA, 13 bp, Homo sapiens
caacacatttcac

SEQ ID NO: 3664083 - DNA, 21 bp, Homo sapiens
caacacatttcacttttctgt

SEQ ID NO: 3664084 - DNA, 14 bp, Homo sapiens
caacaggagctggg

SEQ ID NO: 3664085 - DNA, 20 bp, Homo sapiens
caacagttttcctatgcttt

SEQ ID NO: 3664086 - DNA, 13 bp, Homo sapiens
caacatgtataat

SEQ ID NO: 3664087 - DNA, 19 bp, Homo sapiens
caacatgttgggaaacttg

SEQ ID NO: 3664088 - DNA, 14 bp, Homo sapiens
caaccaatggaatg

SEQ ID NO: 3664089 - DNA, 16 bp, Homo sapiens
caaccactctgtggcc

SEQ ID NO: 3664090 - DNA, 23 bp, Homo sapiens
caaccactctgtggccagcctgg

SEQ ID NO: 3664091 - DNA, 23 bp, Homo sapiens
caaccactggtctgtagggattt

SEQ ID NO: 3664092 - DNA, 11 bp, Homo sapiens
caacccccacc

SEQ ID NO: 3664093 - DNA, 14 bp, Homo sapiens
caacccccacccca

SEQ ID NO: 3664094 - DNA, 18 bp, Homo sapiens
caacccccaccccacact

SEQ ID NO: 3664095 - DNA, 22 bp, Homo sapiens
caaccccctgtaaggttccatc

SEQ ID NO: 3664096 - DNA, 16 bp, Homo sapiens
caacccgtgcccctgg

SEQ ID NO: 3664097 - DNA, 19 bp, Homo sapiens
caacccgtgcccctgggat

SEQ ID NO: 3664098 - DNA, 20 bp, Homo sapiens
caaccctcctccaatggaaa

SEQ ID NO: 3664099 - DNA, 15 bp, Homo sapiens
caacccttacccctt

SEQ ID NO: 3664100 - DNA, 17 bp, Homo sapiens
caacccttccctcacct

SEQ ID NO: 3664101 - DNA, 14 bp, Homo sapiens
caaccgagaaggtt

SEQ ID NO: 3664102 - DNA, 17 bp, Homo sapiens
caacctgcaaagatctg

SEQ ID NO: 3664103 - DNA, 21 bp, Homo sapiens
caacggagagcgcctgcccct

SEQ ID NO: 3664104 - DNA, 20 bp, Homo sapiens
caacggccctgcagccagct

SEQ ID NO: 3664105 - DNA, 19 bp, Homo sapiens
caacgtggcccagagaagc

SEQ ID NO: 3664106 - DNA, 20 bp, Homo sapiens
caacgtggcccagagaagcc

SEQ ID NO: 3664107 - DNA, 19 bp, Homo sapiens
caactatgatttggaaaat

SEQ ID NO: 3664108 - DNA, 19 bp, Homo sapiens
caactcgtatagcatgcat

SEQ ID NO: 3664109 - DNA, 14 bp, Homo sapiens
caactggcaggcag

SEQ ID NO: 3664110 - DNA, 14 bp, Homo sapiens
caacttcccctcta

SEQ ID NO: 3664111 - DNA, 22 bp, Homo sapiens
caacttcccctctaactggaca

SEQ ID NO: 3664112 - DNA, 23 bp, Homo sapiens
caacttcccctctaactggacag

SEQ ID NO: 3664113 - DNA, 24 bp, Homo sapiens
caacttcccctctaactggacagc

SEQ ID NO: 3664114 - DNA, 14 bp, Homo sapiens
caacttgcttatca

SEQ ID NO: 3664115 - DNA, 12 bp, Homo sapiens
caacttgggaac

SEQ ID NO: 3664116 - DNA, 16 bp, Homo sapiens
caactttaagaggaca

SEQ ID NO: 3664117 - DNA, 21 bp, Homo sapiens
caagaaggaaagatttgtgaa

SEQ ID NO: 3664118 - DNA, 20 bp, Homo sapiens
caagaatgtacgtccagcct

SEQ ID NO: 3664119 - DNA, 19 bp, Homo sapiens
caagacaagtgattttcat

SEQ ID NO: 3664120 - DNA, 12 bp, Homo sapiens
caagacatttct

SEQ ID NO: 3664121 - DNA, 19 bp, Homo sapiens
caagaccaagcttagtcct

SEQ ID NO: 3664122 - DNA, 19 bp, Homo sapiens
cacgcccgtcctgcctgtg

SEQ ID NO: 3664123 - DNA, 21 bp, Homo sapiens
cacgcccgtcctgcctgtggc

SEQ ID NO: 3664124 - DNA, 21 bp, Homo sapiens
cacggcaggacaacgaggaag

SEQ ID NO: 3664125 - DNA, 22 bp, Homo sapiens
cacggcaggacaacgaggaagc

SEQ ID NO: 3664126 - DNA, 15 bp, Homo sapiens
cacggcgttgtacct

SEQ ID NO: 3664127 - DNA, 12 bp, Homo sapiens
cacggctctggg

SEQ ID NO: 3664128 - DNA, 14 bp, Homo sapiens
cacggctctggggt

SEQ ID NO: 3664129 - DNA, 17 bp, Homo sapiens
cacgtgacacaaacaca

SEQ ID NO: 3664130 - DNA, 13 bp, Homo sapiens
cacgtggcctctt

SEQ ID NO: 3664131 - DNA, 16 bp, Homo sapiens
cactaagcagaggagg

SEQ ID NO: 3664132 - DNA, 20 bp, Homo sapiens
cactaagcagaggaggggcc

SEQ ID NO: 3664133 - DNA, 13 bp, Homo sapiens
cactaaggggccc

SEQ ID NO: 3664134 - DNA, 23 bp, Homo sapiens
cactaaggggcccggccagccat

SEQ ID NO: 3664135 - DNA, 16 bp, Homo sapiens
cactaagtaacctcta

SEQ ID NO: 3664136 - DNA, 15 bp, Homo sapiens
cactaatttttgtat

SEQ ID NO: 3664137 - DNA, 21 bp, Homo sapiens
cactacaagtcagctccagct

SEQ ID NO: 3664138 - DNA, 16 bp, Homo sapiens
cactacaccttgcctt

SEQ ID NO: 3664139 - DNA, 14 bp, Homo sapiens
cactagacaagcca

SEQ ID NO: 3664140 - DNA, 19 bp, Homo sapiens
cactagacaagccagaact

SEQ ID NO: 3664141 - DNA, 16 bp, Homo sapiens
cactaggtaggcttct

SEQ ID NO: 3664142 - DNA, 14 bp, Homo sapiens
cactatgaagatgt

SEQ ID NO: 3664143 - DNA, 15 bp, Homo sapiens
cactcaaaagctggg

SEQ ID NO: 3664144 - DNA, 17 bp, Homo sapiens
cactcaaaagctgggca

SEQ ID NO: 3664145 - DNA, 20 bp, Homo sapiens
cactcaaaagctgggcaggt

SEQ ID NO: 3664146 - DNA, 18 bp, Homo sapiens
cactcaagccaagcagcc

SEQ ID NO: 3664147 - DNA, 19 bp, Homo sapiens
cactcaaggcggtgcttga

SEQ ID NO: 3664148 - DNA, 17 bp, Homo sapiens
cactcactaggccccca

SEQ ID NO: 3664149 - DNA, 22 bp, Homo sapiens
cactcactaggcccccacttgc

SEQ ID NO: 3664150 - DNA, 19 bp, Homo sapiens
cactcagtgggctgtttct

SEQ ID NO: 3664151 - DNA, 15 bp, Homo sapiens
cactctaccctccca

SEQ ID NO: 3664152 - DNA, 16 bp, Homo sapiens
cactctaccctcccac

SEQ ID NO: 3664153 - DNA, 16 bp, Homo sapiens
cactctgagtgtttta

SEQ ID NO: 3664154 - DNA, 15 bp, Homo sapiens
cactctgcttctctg

SEQ ID NO: 3664155 - DNA, 17 bp, Homo sapiens
cactctgtggccagcct

SEQ ID NO: 3664156 - DNA, 18 bp, Homo sapiens
cactctgtggccagcctg

SEQ ID NO: 3664157 - DNA, 22 bp, Homo sapiens
cactctgtggccagcctggcat

SEQ ID NO: 3664158 - DNA, 23 bp, Homo sapiens
cactctgtggccagcctggcatc

SEQ ID NO: 3664159 - DNA, 16 bp, Homo sapiens
cactgaaacattattt

SEQ ID NO: 3664160 - DNA, 17 bp, Homo sapiens
cactgaaatctgtcaag

SEQ ID NO: 3664161 - DNA, 17 bp, Homo sapiens
cactgaccatccactct

SEQ ID NO: 3664162 - DNA, 23 bp, Homo sapiens
cactgaccatccactctaccctc

SEQ ID NO: 3664163 - DNA, 14 bp, Homo sapiens
cactgagctggctg

SEQ ID NO: 3664164 - DNA, 16 bp, Homo sapiens
cactgagctggctgac

SEQ ID NO: 3664165 - DNA, 17 bp, Homo sapiens
cactgagctggctgact

SEQ ID NO: 3664166 - DNA, 14 bp, Homo sapiens
cactgaggcaggga

SEQ ID NO: 3664167 - DNA, 21 bp, Homo sapiens
cactgagttttccatggcagg

SEQ ID NO: 3664168 - DNA, 22 bp, Homo sapiens
cactgagttttccatggcagga

SEQ ID NO: 3664169 - DNA, 17 bp, Homo sapiens
cactgatgctgcccctc

SEQ ID NO: 3664170 - DNA, 20 bp, Homo sapiens
cactgcaaaccgccacctcc

SEQ ID NO: 3664171 - DNA, 18 bp, Homo sapiens
cactgccttcgcttcttg

SEQ ID NO: 3664172 - DNA, 23 bp, Homo sapiens
cactgccttcgcttcttgcctct

SEQ ID NO: 3664173 - DNA, 18 bp, Homo sapiens
cactgcgggagctctgta

SEQ ID NO: 3664174 - DNA, 21 bp, Homo sapiens
cactggggaaataacagctgt

SEQ ID NO: 3664175 - DNA, 12 bp, Homo sapiens
cactgtcccttg

SEQ ID NO: 3664176 - DNA, 15 bp, Homo sapiens
cactgtcctgggcct

SEQ ID NO: 3664177 - DNA, 13 bp, Homo sapiens
cactgtgaagaga

SEQ ID NO: 3664178 - DNA, 15 bp, Homo sapiens
cactgtttgttttta

SEQ ID NO: 3664179 - DNA, 13 bp, Homo sapiens
cacttacattttt

SEQ ID NO: 3664180 - DNA, 16 bp, Homo sapiens
cacttacttgcttatt

SEQ ID NO: 3664181 - DNA, 12 bp, Homo sapiens
cacttcagctga

SEQ ID NO: 3664182 - DNA, 16 bp, Homo sapiens
cacttcccaccctgcc

SEQ ID NO: 3664183 - DNA, 17 bp, Homo sapiens
cacttcctacaagagca

SEQ ID NO: 3664184 - DNA, 21 bp, Homo sapiens
cacttctgtgagacccccaca

SEQ ID NO: 3664185 - DNA, 22 bp, Homo sapiens
cacttctgtgagacccccacac

SEQ ID NO: 3664186 - DNA, 13 bp, Homo sapiens
cacttgagagaaa

SEQ ID NO: 3664187 - DNA, 13 bp, Homo sapiens
cacttgagtccag

SEQ ID NO: 3664188 - DNA, 11 bp, Homo sapiens
cacttgctgag

SEQ ID NO: 3664189 - DNA, 14 bp, Homo sapiens
cacttgctgagtga

SEQ ID NO: 3664190 - DNA, 16 bp, Homo sapiens
cacttgctgagtgaag

SEQ ID NO: 3664191 - DNA, 19 bp, Homo sapiens
cacttggtaattgtactaa

SEQ ID NO: 3664192 - DNA, 20 bp, Homo sapiens
cacttggtcctacctattat

SEQ ID NO: 3664193 - DNA, 12 bp, Homo sapiens
cacttgtctcag

SEQ ID NO: 3664194 - DNA, 15 bp, Homo sapiens
cacttgttccagctc

SEQ ID NO: 3664195 - DNA, 16 bp, Homo sapiens
cacttgttccagctct

SEQ ID NO: 3664196 - DNA, 17 bp, Homo sapiens
cacttgttccagctctt

SEQ ID NO: 3664197 - DNA, 21 bp, Homo sapiens
cactttagaggcttgatcatg

SEQ ID NO: 3664198 - DNA, 18 bp, Homo sapiens
cactttataagtcattgt

SEQ ID NO: 3664199 - DNA, 20 bp, Homo sapiens
cactttataagtcattgtat

SEQ ID NO: 3664200 - DNA, 19 bp, Homo sapiens
cactttcagtgaaagcatc

SEQ ID NO: 3664201 - DNA, 12 bp, Homo sapiens
cactttgtaaat

SEQ ID NO: 3664202 - DNA, 21 bp, Homo sapiens
cactttgtttcgtggggaggt

SEQ ID NO: 3664203 - DNA, 15 bp, Homo sapiens
cagaaaacaaaactg

SEQ ID NO: 3664204 - DNA, 21 bp, Homo sapiens
cagaaaagaaagttcatgctt

SEQ ID NO: 3664205 - DNA, 19 bp, Homo sapiens
cagaaatctagaagactgt

SEQ ID NO: 3664206 - DNA, 12 bp, Homo sapiens
cagaacctcttc

SEQ ID NO: 3664207 - DNA, 15 bp, Homo sapiens
cagaaccttgtccca

SEQ ID NO: 3664208 - DNA, 16 bp, Homo sapiens
cagaactcctacctga

SEQ ID NO: 3664209 - DNA, 14 bp, Homo sapiens
cagaagaaggcagc

SEQ ID NO: 3664210 - DNA, 18 bp, Homo sapiens
cagaagacaaaaagacaa

SEQ ID NO: 3664211 - DNA, 21 bp, Homo sapiens
cagaagattgcgtagctctca

SEQ ID NO: 3664212 - DNA, 18 bp, Homo sapiens
cagaaggccaagaggctg

SEQ ID NO: 3664213 - DNA, 20 bp, Homo sapiens
cagaagtgcccttcctgctg

SEQ ID NO: 3664214 - DNA, 22 bp, Homo sapiens
cagaattactgtaactgattac

SEQ ID NO: 3664215 - DNA, 15 bp, Homo sapiens
cagacacaggccctc

SEQ ID NO: 3664216 - DNA, 21 bp, Homo sapiens
cagacactgaccatccactct

SEQ ID NO: 3664217 - DNA, 15 bp, Homo sapiens
cagacagcaaggtgt

SEQ ID NO: 3664218 - DNA, 20 bp, Homo sapiens
cagaccacaaaacttttcta

SEQ ID NO: 3664219 - DNA, 22 bp, Homo sapiens
cagaccacgcccgtcctgcctg

SEQ ID NO: 3664220 - DNA, 23 bp, Homo sapiens
cagaccacgcccgtcctgcctgt

SEQ ID NO: 3664221 - DNA, 24 bp, Homo sapiens
cagaccacgcccgtcctgcctgtg

SEQ ID NO: 3664222 - DNA, 23 bp, Homo sapiens
cagacctgatcctggaggcccag

SEQ ID NO: 3664223 - DNA, 19 bp, Homo sapiens
cagactcccattcctgaag

SEQ ID NO: 3664224 - DNA, 15 bp, Homo sapiens
cagactctttatgct

SEQ ID NO: 3664225 - DNA, 16 bp, Homo sapiens
cagagaaaacttgcct

SEQ ID NO: 3664226 - DNA, 17 bp, Homo sapiens
cagagaaaacttgcctt

SEQ ID NO: 3664227 - DNA, 20 bp, Homo sapiens
cagagaaaacttgcctttca

SEQ ID NO: 3664228 - DNA, 19 bp, Homo sapiens
cagagaaaggggagcccac

SEQ ID NO: 3664229 - DNA, 15 bp, Homo sapiens
cagagacatacttga

SEQ ID NO: 3664230 - DNA, 20 bp, Homo sapiens
cagagacatacttgaagggc

SEQ ID NO: 3664231 - DNA, 15 bp, Homo sapiens
cagagaccaggctgt

SEQ ID NO: 3664232 - DNA, 18 bp, Homo sapiens
cagagaccaggctgtgtc

SEQ ID NO: 3664233 - DNA, 20 bp, Homo sapiens
cagagaggactgtagggagg

SEQ ID NO: 3664234 - DNA, 23 bp, Homo sapiens
cagagatccaaaagaagccccca

SEQ ID NO: 3664235 - DNA, 11 bp, Homo sapiens
cagagcccagc

SEQ ID NO: 3664236 - DNA, 11 bp, Homo sapiens
cagagccttca

SEQ ID NO: 3664237 - DNA, 15 bp, Homo sapiens
cagagccttcaagtg

SEQ ID NO: 3664238 - DNA, 19 bp, Homo sapiens
cagttctttgggccagaca

SEQ ID NO: 3664239 - DNA, 20 bp, Homo sapiens
cagttctttgggccagacat

SEQ ID NO: 3664240 - DNA, 21 bp, Homo sapiens
cagttctttgggccagacatg

SEQ ID NO: 3664241 - DNA, 12 bp, Homo sapiens
cagttgaaaaac

SEQ ID NO: 3664242 - DNA, 21 bp, Homo sapiens
cataatgctaatttaaagaga

SEQ ID NO: 3664243 - DNA, 21 bp, Homo sapiens
cataatgggccactgaaatct

SEQ ID NO: 3664244 - DNA, 14 bp, Homo sapiens
cataatggggtcct

SEQ ID NO: 3664245 - DNA, 14 bp, Homo sapiens
cataattcactctg

SEQ ID NO: 3664246 - DNA, 17 bp, Homo sapiens
cataattcactctgagt

SEQ ID NO: 3664247 - DNA, 18 bp, Homo sapiens
catacccacaatctgagc

SEQ ID NO: 3664248 - DNA, 18 bp, Homo sapiens
catacttgaagggccaga

SEQ ID NO: 3664249 - DNA, 20 bp, Homo sapiens
catagaaatggaaattttgc

SEQ ID NO: 3664250 - DNA, 16 bp, Homo sapiens
cataggacctttccac

SEQ ID NO: 3664251 - DNA, 16 bp, Homo sapiens
cataggctccttcctg

SEQ ID NO: 3664252 - DNA, 22 bp, Homo sapiens
cataggtctctttgctttctgg

SEQ ID NO: 3664253 - DNA, 17 bp, Homo sapiens
catagtagtttttacag

SEQ ID NO: 3664254 - DNA, 22 bp, Homo sapiens
catagtttctttattttgtgta

SEQ ID NO: 3664255 - DNA, 23 bp, Homo sapiens
catagtttctttattttgtgtaa

SEQ ID NO: 3664256 - DNA, 17 bp, Homo sapiens
catatatatactattaa

SEQ ID NO: 3664257 - DNA, 13 bp, Homo sapiens
catatatattaca

SEQ ID NO: 3664258 - DNA, 17 bp, Homo sapiens
catatattttttagaaa

SEQ ID NO: 3664259 - DNA, 15 bp, Homo sapiens
catatccctggttgc

SEQ ID NO: 3664260 - DNA, 19 bp, Homo sapiens
catatccctggttgcctca

SEQ ID NO: 3664261 - DNA, 13 bp, Homo sapiens
catatgttaagca

SEQ ID NO: 3664262 - DNA, 15 bp, Homo sapiens
catattctaaaacca

SEQ ID NO: 3664263 - DNA, 13 bp, Homo sapiens
catatttaactgg

SEQ ID NO: 3664264 - DNA, 20 bp, Homo sapiens
catatttaatgttttaaatg

SEQ ID NO: 3664265 - DNA, 23 bp, Homo sapiens
catatttaatgttttaaatgtac

SEQ ID NO: 3664266 - DNA, 12 bp, Homo sapiens
catatttcaatt

SEQ ID NO: 3664267 - DNA, 15 bp, Homo sapiens
catatttgagactag

SEQ ID NO: 3664268 - DNA, 14 bp, Homo sapiens
catcaacttaaaag

SEQ ID NO: 3664269 - DNA, 14 bp, Homo sapiens
catcacagggtggg

SEQ ID NO: 3664270 - DNA, 22 bp, Homo sapiens
catcacagggtgggcctcggcc

SEQ ID NO: 3664271 - DNA, 22 bp, Homo sapiens
catcacagggttgggcccagat

SEQ ID NO: 3664272 - DNA, 18 bp, Homo sapiens
catcaccttaggcaggga

SEQ ID NO: 3664273 - DNA, 20 bp, Homo sapiens
catcaccttaggcagggaag

SEQ ID NO: 3664274 - DNA, 23 bp, Homo sapiens
catcaccttaggcagggaagtgt

SEQ ID NO: 3664275 - DNA, 16 bp, Homo sapiens
catcactgagttttcc

SEQ ID NO: 3664276 - DNA, 14 bp, Homo sapiens
catcagctccagct

SEQ ID NO: 3664277 - DNA, 14 bp, Homo sapiens
catccaatgctcaa

SEQ ID NO: 3664278 - DNA, 22 bp, Homo sapiens
catccactctaccctcccaccc

SEQ ID NO: 3664279 - DNA, 19 bp, Homo sapiens
catccagtgacaaaccatc

SEQ ID NO: 3664280 - DNA, 15 bp, Homo sapiens
catccctgccagctc

SEQ ID NO: 3664281 - DNA, 20 bp, Homo sapiens
catcctaatcatccaatgct

SEQ ID NO: 3664282 - DNA, 14 bp, Homo sapiens
catcctatgcttaa

SEQ ID NO: 3664283 - DNA, 16 bp, Homo sapiens
catcctccgtccagcc

SEQ ID NO: 3664284 - DNA, 19 bp, Homo sapiens
catcctccgtccagccgcc

SEQ ID NO: 3664285 - DNA, 20 bp, Homo sapiens
catcctgaccaagactgagc

SEQ ID NO: 3664286 - DNA, 19 bp, Homo sapiens
catcctttacgtgtttaaa

SEQ ID NO: 3664287 - DNA, 12 bp, Homo sapiens
catctagccagc

SEQ ID NO: 3664288 - DNA, 17 bp, Homo sapiens
catctagccagcccctc

SEQ ID NO: 3664289 - DNA, 18 bp, Homo sapiens
catctatgtgtatgttga

SEQ ID NO: 3664290 - DNA, 17 bp, Homo sapiens
catctcaggccagagcc

SEQ ID NO: 3664291 - DNA, 14 bp, Homo sapiens
catctctctttaat

SEQ ID NO: 3664292 - DNA, 14 bp, Homo sapiens
catctgaccagcag

SEQ ID NO: 3664293 - DNA, 15 bp, Homo sapiens
catctgaccagcagc

SEQ ID NO: 3664294 - DNA, 19 bp, Homo sapiens
catctgaccagcagcgcct

SEQ ID NO: 3664295 - DNA, 18 bp, Homo sapiens
catctgcacccccctggg

SEQ ID NO: 3664296 - DNA, 18 bp, Homo sapiens
catctgcacctaaaccca

SEQ ID NO: 3664297 - DNA, 18 bp, Homo sapiens
catctgcccctcccccaa

SEQ ID NO: 3664298 - DNA, 19 bp, Homo sapiens
catctgttctatgcttcct

SEQ ID NO: 3664299 - DNA, 23 bp, Homo sapiens
catctgttctatgcttcctcgtg

SEQ ID NO: 3664300 - DNA, 20 bp, Homo sapiens
catcttgaccaagcaggaag

SEQ ID NO: 3664301 - DNA, 15 bp, Homo sapiens
catcttgcctccagg

SEQ ID NO: 3664302 - DNA, 18 bp, Homo sapiens
catcttgcctccaggtgc

SEQ ID NO: 3664303 - DNA, 19 bp, Homo sapiens
catcttgcctccaggtgca

SEQ ID NO: 3664304 - DNA, 15 bp, Homo sapiens
catcttgcttcccta

SEQ ID NO: 3664305 - DNA, 15 bp, Homo sapiens
catctttgccttggg

SEQ ID NO: 3664306 - DNA, 22 bp, Homo sapiens
catctttgccttgggctgctcc

SEQ ID NO: 3664307 - DNA, 20 bp, Homo sapiens
catgaataacatttaaattc

SEQ ID NO: 3664308 - DNA, 18 bp, Homo sapiens
catgaccatactgaggga

SEQ ID NO: 3664309 - DNA, 13 bp, Homo sapiens
catgagaaataca

SEQ ID NO: 3664310 - DNA, 15 bp, Homo sapiens
catgagactcagtgc

SEQ ID NO: 3664311 - DNA, 17 bp, Homo sapiens
catgagactcagtgcag

SEQ ID NO: 3664312 - DNA, 21 bp, Homo sapiens
catgatccctgtgttgtctct

SEQ ID NO: 3664313 - DNA, 16 bp, Homo sapiens
catgatgcctctgtct

SEQ ID NO: 3664314 - DNA, 17 bp, Homo sapiens
catgatgcctctgtctt

SEQ ID NO: 3664315 - DNA, 22 bp, Homo sapiens
catgatgcctctgtcttctgga

SEQ ID NO: 3664316 - DNA, 23 bp, Homo sapiens
catgatgcctctgtcttctggac

SEQ ID NO: 3664317 - DNA, 20 bp, Homo sapiens
catgatgcgggccagtgctc

SEQ ID NO: 3664318 - DNA, 20 bp, Homo sapiens
catgatggcaacagatctgg

SEQ ID NO: 3664319 - DNA, 22 bp, Homo sapiens
catgattaaccacttcagctga

SEQ ID NO: 3664320 - DNA, 23 bp, Homo sapiens
catgattaaccacttcagctgac

SEQ ID NO: 3664321 - DNA, 14 bp, Homo sapiens
catgcactgtgaag

SEQ ID NO: 3664322 - DNA, 18 bp, Homo sapiens
catgcactgtgaaggacc

SEQ ID NO: 3664323 - DNA, 22 bp, Homo sapiens
catgcactgtgaaggacccttg

SEQ ID NO: 3664324 - DNA, 20 bp, Homo sapiens
catgcagcccatgcccacct

SEQ ID NO: 3664325 - DNA, 13 bp, Homo sapiens
catgcatctgttt

SEQ ID NO: 3664326 - DNA, 23 bp, Homo sapiens
catgcattgagctgcctccagcc

SEQ ID NO: 3664327 - DNA, 17 bp, Homo sapiens
catgccacaaggacttc

SEQ ID NO: 3664328 - DNA, 21 bp, Homo sapiens
catgccacaaggacttcctgt

SEQ ID NO: 3664329 - DNA, 19 bp, Homo sapiens
catgccagcttatctcagg

SEQ ID NO: 3664330 - DNA, 17 bp, Homo sapiens
catgcccacctgcccat

SEQ ID NO: 3664331 - DNA, 21 bp, Homo sapiens
catgccccgtttttgagactg

SEQ ID NO: 3664332 - DNA, 14 bp, Homo sapiens
catgcccttctgat

SEQ ID NO: 3664333 - DNA, 18 bp, Homo sapiens
catgcctgtccagcctgg

SEQ ID NO: 3664334 - DNA, 21 bp, Homo sapiens
catgcctgtccagcctgggca

SEQ ID NO: 3664335 - DNA, 23 bp, Homo sapiens
catgcgccccctccgccctgcca

SEQ ID NO: 3664336 - DNA, 16 bp, Homo sapiens
catgcggcccaggatg

SEQ ID NO: 3664337 - DNA, 14 bp, Homo sapiens
catgctcctggccc

SEQ ID NO: 3664338 - DNA, 17 bp, Homo sapiens
catgctcctggcccact

SEQ ID NO: 3664339 - DNA, 21 bp, Homo sapiens
catgctcttgaccttgtagag

SEQ ID NO: 3664340 - DNA, 18 bp, Homo sapiens
catgctgaggcctgggcc

SEQ ID NO: 3664341 - DNA, 17 bp, Homo sapiens
catgctggaaaataata

SEQ ID NO: 3664342 - DNA, 22 bp, Homo sapiens
catgctggaaaataatactgct

SEQ ID NO: 3664343 - DNA, 23 bp, Homo sapiens
catgctggaacctgcaaaaaata

SEQ ID NO: 3664344 - DNA, 19 bp, Homo sapiens
catgctggagtacccagcc

SEQ ID NO: 3664345 - DNA, 22 bp, Homo sapiens
catgctggagtacccagcctat

SEQ ID NO: 3664346 - DNA, 19 bp, Homo sapiens
catgctgtgattgtgccta

SEQ ID NO: 3664347 - DNA, 20 bp, Homo sapiens
catgcttccctgcagctgac

SEQ ID NO: 3664348 - DNA, 14 bp, Homo sapiens
catggccctgggcg

SEQ ID NO: 3664349 - DNA, 16 bp, Homo sapiens
catggcgacactaaag

SEQ ID NO: 3664350 - DNA, 13 bp, Homo sapiens
catgggaagggga

SEQ ID NO: 3664351 - DNA, 17 bp, Homo sapiens
catgggaccacaactat

SEQ ID NO: 3664352 - DNA, 11 bp, Homo sapiens
catggggaggg

SEQ ID NO: 3664353 - DNA, 20 bp, Homo sapiens
catggggagggattctggtt

SEQ ID NO: 3664354 - DNA, 18 bp, Homo sapiens
ccaggtccagctctggag

SEQ ID NO: 3664355 - DNA, 13 bp, Homo sapiens
ccaggtgcagagg

SEQ ID NO: 3664356 - DNA, 20 bp, Homo sapiens
ccaggtgcagaggtaccctg

SEQ ID NO: 3664357 - DNA, 13 bp, Homo sapiens
ccaggtgcatttc

SEQ ID NO: 3664358 - DNA, 14 bp, Homo sapiens
ccaggtgcatttct

SEQ ID NO: 3664359 - DNA, 16 bp, Homo sapiens
ccaggtgcctttcaaa

SEQ ID NO: 3664360 - DNA, 18 bp, Homo sapiens
ccaggtgcctttcaaatt

SEQ ID NO: 3664361 - DNA, 20 bp, Homo sapiens
ccaggtgtgcccctccaagt

SEQ ID NO: 3664362 - DNA, 15 bp, Homo sapiens
ccaggttcaacccac

SEQ ID NO: 3664363 - DNA, 21 bp, Homo sapiens
ccaggttctccgttagctcct

SEQ ID NO: 3664364 - DNA, 24 bp, Homo sapiens
ccaggttctccgttagctcctgtg

SEQ ID NO: 3664365 - DNA, 20 bp, Homo sapiens
ccagtaacgcgtcttcctga

SEQ ID NO: 3664366 - DNA, 22 bp, Homo sapiens
ccagtagaccttgttacttctg

SEQ ID NO: 3664367 - DNA, 16 bp, Homo sapiens
ccagtcaagaagaaaa

SEQ ID NO: 3664368 - DNA, 18 bp, Homo sapiens
ccagtccaaatgtcctcc

SEQ ID NO: 3664369 - DNA, 16 bp, Homo sapiens
ccagtccaggctgccg

SEQ ID NO: 3664370 - DNA, 19 bp, Homo sapiens
ccagtccaggctgccgtgg

SEQ ID NO: 3664371 - DNA, 21 bp, Homo sapiens
ccagtcctgcctggccaggca

SEQ ID NO: 3664372 - DNA, 18 bp, Homo sapiens
ccagtcctggttgtctga

SEQ ID NO: 3664373 - DNA, 19 bp, Homo sapiens
ccagtcctggttgtctgaa

SEQ ID NO: 3664374 - DNA, 17 bp, Homo sapiens
ccagtgacctgaggaag

SEQ ID NO: 3664375 - DNA, 16 bp, Homo sapiens
ccagtgaggatgacag

SEQ ID NO: 3664376 - DNA, 21 bp, Homo sapiens
ccagtgatgctaaaggttgta

SEQ ID NO: 3664377 - DNA, 16 bp, Homo sapiens
ccagtgcagaatgtaa

SEQ ID NO: 3664378 - DNA, 19 bp, Homo sapiens
ccagtgcatggtggccaga

SEQ ID NO: 3664379 - DNA, 18 bp, Homo sapiens
ccagtgcccccactgacc

SEQ ID NO: 3664380 - DNA, 20 bp, Homo sapiens
ccagtgccgagaaggaagcc

SEQ ID NO: 3664381 - DNA, 20 bp, Homo sapiens
ccagttagtaaacttcctat

SEQ ID NO: 3664382 - DNA, 13 bp, Homo sapiens
ccagttcaccctg

SEQ ID NO: 3664383 - DNA, 22 bp, Homo sapiens
ccagttcctttcaatggtttgc

SEQ ID NO: 3664384 - DNA, 16 bp, Homo sapiens
ccatatgctccaggat

SEQ ID NO: 3664385 - DNA, 18 bp, Homo sapiens
ccatcactgagttttcca

SEQ ID NO: 3664386 - DNA, 21 bp, Homo sapiens
ccatcagcttaggggctgctg

SEQ ID NO: 3664387 - DNA, 22 bp, Homo sapiens
ccatccactctaccctcccacc

SEQ ID NO: 3664388 - DNA, 17 bp, Homo sapiens
ccatccagctacaggag

SEQ ID NO: 3664389 - DNA, 19 bp, Homo sapiens
ccatccagctacaggagag

SEQ ID NO: 3664390 - DNA, 19 bp, Homo sapiens
ccatcccccacctgccagc

SEQ ID NO: 3664391 - DNA, 14 bp, Homo sapiens
ccatccccgcagtg

SEQ ID NO: 3664392 - DNA, 22 bp, Homo sapiens
ccatcccctgtagagtgggagc

SEQ ID NO: 3664393 - DNA, 21 bp, Homo sapiens
ccatcctaatcatccaatgct

SEQ ID NO: 3664394 - DNA, 23 bp, Homo sapiens
ccatcctaatcatccaatgctca

SEQ ID NO: 3664395 - DNA, 14 bp, Homo sapiens
ccatcctccagcag

SEQ ID NO: 3664396 - DNA, 16 bp, Homo sapiens
ccatcctccagcaggg

SEQ ID NO: 3664397 - DNA, 16 bp, Homo sapiens
ccatcctctgcctcaa

SEQ ID NO: 3664398 - DNA, 19 bp, Homo sapiens
ccatcctgggacggcggca

SEQ ID NO: 3664399 - DNA, 23 bp, Homo sapiens
ccatctagccagcccctcttccc

SEQ ID NO: 3664400 - DNA, 20 bp, Homo sapiens
ccatctagtcacaaagactc

SEQ ID NO: 3664401 - DNA, 11 bp, Homo sapiens
ccatctcaggc

SEQ ID NO: 3664402 - DNA, 14 bp, Homo sapiens
ccatctcaggccag

SEQ ID NO: 3664403 - DNA, 18 bp, Homo sapiens
ccatctcaggccagagcc

SEQ ID NO: 3664404 - DNA, 20 bp, Homo sapiens
ccatctcgggcacaggccca

SEQ ID NO: 3664405 - DNA, 20 bp, Homo sapiens
ccatcttgcttccctaatct

SEQ ID NO: 3664406 - DNA, 22 bp, Homo sapiens
ccatgaaaatgcaacaacatgt

SEQ ID NO: 3664407 - DNA, 22 bp, Homo sapiens
ccatgatccctgtgttgtctct

SEQ ID NO: 3664408 - DNA, 20 bp, Homo sapiens
ccatgatgcctctgtcttct

SEQ ID NO: 3664409 - DNA, 16 bp, Homo sapiens
ccatgatggcaacaga

SEQ ID NO: 3664410 - DNA, 19 bp, Homo sapiens
ccatgatggcaacagatct

SEQ ID NO: 3664411 - DNA, 21 bp, Homo sapiens
ccatgatggcaacagatctgg

SEQ ID NO: 3664412 - DNA, 21 bp, Homo sapiens
ccatgattaaccacttcagct

SEQ ID NO: 3664413 - DNA, 16 bp, Homo sapiens
ccatgcaagcagagga

SEQ ID NO: 3664414 - DNA, 20 bp, Homo sapiens
ccatgcaagcagaggaccag

SEQ ID NO: 3664415 - DNA, 16 bp, Homo sapiens
ccatgcactgtgaagg

SEQ ID NO: 3664416 - DNA, 20 bp, Homo sapiens
ccatgcactgtgaaggaccc

SEQ ID NO: 3664417 - DNA, 20 bp, Homo sapiens
ccatgccaaagctagggtgg

SEQ ID NO: 3664418 - DNA, 17 bp, Homo sapiens
ccatgcccacctgccca

SEQ ID NO: 3664419 - DNA, 19 bp, Homo sapiens
ccatgcctgcaaccttgca

SEQ ID NO: 3664420 - DNA, 22 bp, Homo sapiens
ccatgcctgtagctttcctggt

SEQ ID NO: 3664421 - DNA, 17 bp, Homo sapiens
ccatgcctgtccagcct

SEQ ID NO: 3664422 - DNA, 22 bp, Homo sapiens
ccatgcgccccctccgccctgc

SEQ ID NO: 3664423 - DNA, 22 bp, Homo sapiens
ccatgcgctcagggccatgctg

SEQ ID NO: 3664424 - DNA, 13 bp, Homo sapiens
ccatgctcatctg

SEQ ID NO: 3664425 - DNA, 17 bp, Homo sapiens
ccatgctcatctgctgg

SEQ ID NO: 3664426 - DNA, 18 bp, Homo sapiens
ccatgctcatctgctggt

SEQ ID NO: 3664427 - DNA, 15 bp, Homo sapiens
ccatgctcctggccc

SEQ ID NO: 3664428 - DNA, 18 bp, Homo sapiens
ccatgctcctggcccact

SEQ ID NO: 3664429 - DNA, 17 bp, Homo sapiens
ccatgctgaggcctggg

SEQ ID NO: 3664430 - DNA, 14 bp, Homo sapiens
ccatggcaggaagg

SEQ ID NO: 3664431 - DNA, 17 bp, Homo sapiens
ccatggctcagggtggt

SEQ ID NO: 3664432 - DNA, 15 bp, Homo sapiens
ccatgggaccacaac

SEQ ID NO: 3664433 - DNA, 20 bp, Homo sapiens
ccatggggagggattctggt

SEQ ID NO: 3664434 - DNA, 19 bp, Homo sapiens
ccatgggtgtggatggcag

SEQ ID NO: 3664435 - DNA, 13 bp, Homo sapiens
ccatggtgagaaa

SEQ ID NO: 3664436 - DNA, 17 bp, Homo sapiens
ccatgtactagttttag

SEQ ID NO: 3664437 - DNA, 22 bp, Homo sapiens
ccattaaccagatctagtcaat

SEQ ID NO: 3664438 - DNA, 18 bp, Homo sapiens
ccattctcaagccctgca

SEQ ID NO: 3664439 - DNA, 13 bp, Homo sapiens
ccattctgactcg

SEQ ID NO: 3664440 - DNA, 20 bp, Homo sapiens
ccattgggaccctccagtgc

SEQ ID NO: 3664441 - DNA, 14 bp, Homo sapiens
ccatttctcaggga

SEQ ID NO: 3664442 - DNA, 20 bp, Homo sapiens
ccatttctgaactgttacaa

SEQ ID NO: 3664443 - DNA, 12 bp, Homo sapiens
cccaaagaagga

SEQ ID NO: 3664444 - DNA, 14 bp, Homo sapiens
cccaaagctgagcc

SEQ ID NO: 3664445 - DNA, 18 bp, Homo sapiens
cccaaagctgagcctgca

SEQ ID NO: 3664446 - DNA, 17 bp, Homo sapiens
cccaacaaaccatccag

SEQ ID NO: 3664447 - DNA, 20 bp, Homo sapiens
cccaaccaggcacctcttcc

SEQ ID NO: 3664448 - DNA, 12 bp, Homo sapiens
cccaacccccac

SEQ ID NO: 3664449 - DNA, 17 bp, Homo sapiens
cccaacccttccctcac

SEQ ID NO: 3664450 - DNA, 16 bp, Homo sapiens
cccaactctagctggg

SEQ ID NO: 3664451 - DNA, 14 bp, Homo sapiens
cccaagattcttca

SEQ ID NO: 3664452 - DNA, 15 bp, Homo sapiens
cccaagccagaggct

SEQ ID NO: 3664453 - DNA, 15 bp, Homo sapiens
cccaagctgtgctgg

SEQ ID NO: 3664454 - DNA, 19 bp, Homo sapiens
cccaagtatacaataaagt

SEQ ID NO: 3664455 - DNA, 16 bp, Homo sapiens
cccaatcccagttctt

SEQ ID NO: 3664456 - DNA, 14 bp, Homo sapiens
cccacaatctgagc

SEQ ID NO: 3664457 - DNA, 23 bp, Homo sapiens
cccacaatctggcttagtgccac

SEQ ID NO: 3664458 - DNA, 14 bp, Homo sapiens
cccacactaacctg

SEQ ID NO: 3664459 - DNA, 17 bp, Homo sapiens
cccacacttgttccagc

SEQ ID NO: 3664460 - DNA, 19 bp, Homo sapiens
cccacacttgttccagctc

SEQ ID NO: 3664461 - DNA, 15 bp, Homo sapiens
cccacagccctgaga

SEQ ID NO: 3664462 - DNA, 15 bp, Homo sapiens
cccaccactggaagc

SEQ ID NO: 3664463 - DNA, 17 bp, Homo sapiens
cccaccaggctgctcag

SEQ ID NO: 3664464 - DNA, 13 bp, Homo sapiens
cccacccaggagg

SEQ ID NO: 3664465 - DNA, 13 bp, Homo sapiens
cccaccccacact

SEQ ID NO: 3664466 - DNA, 22 bp, Homo sapiens
cccacccctgggggctctcatg

SEQ ID NO: 3664467 - DNA, 18 bp, Homo sapiens
cccaccctgaaagccctg

SEQ ID NO: 3664468 - DNA, 13 bp, Homo sapiens
cccaccctgggcc

SEQ ID NO: 3664469 - DNA, 14 bp, Homo sapiens
cccacctccctgcc

SEQ ID NO: 3664470 - DNA, 13 bp, Homo sapiens
ccctgtgtgcagg

SEQ ID NO: 3664471 - DNA, 16 bp, Homo sapiens
ccctgtgtgtgtcccc

SEQ ID NO: 3664472 - DNA, 18 bp, Homo sapiens
ccctgtgttgtctctaga

SEQ ID NO: 3664473 - DNA, 21 bp, Homo sapiens
ccctgtgttgtctctagagca

SEQ ID NO: 3664474 - DNA, 22 bp, Homo sapiens
cccttaccccttagcctccctg

SEQ ID NO: 3664475 - DNA, 14 bp, Homo sapiens
cccttagcctccct

SEQ ID NO: 3664476 - DNA, 13 bp, Homo sapiens
cccttcacaaagc

SEQ ID NO: 3664477 - DNA, 22 bp, Homo sapiens
cccttcccctccctggctccca

SEQ ID NO: 3664478 - DNA, 13 bp, Homo sapiens
cccttccctcacc

SEQ ID NO: 3664479 - DNA, 20 bp, Homo sapiens
cccttcctcagcctggggtt

SEQ ID NO: 3664480 - DNA, 13 bp, Homo sapiens
cccttcctggccc

SEQ ID NO: 3664481 - DNA, 23 bp, Homo sapiens
cccttctagggttattgcatttg

SEQ ID NO: 3664482 - DNA, 13 bp, Homo sapiens
cccttctctgctc

SEQ ID NO: 3664483 - DNA, 14 bp, Homo sapiens
cccttctctgctcc

SEQ ID NO: 3664484 - DNA, 15 bp, Homo sapiens
cccttctctgctcca

SEQ ID NO: 3664485 - DNA, 16 bp, Homo sapiens
cccttctctgctccac

SEQ ID NO: 3664486 - DNA, 16 bp, Homo sapiens
cctgccagggaactgg

SEQ ID NO: 3664487 - DNA, 22 bp, Homo sapiens
cctgccagggaactggcctgct

SEQ ID NO: 3664488 - DNA, 21 bp, Homo sapiens
cctgccattcttctggtgcta

SEQ ID NO: 3664489 - DNA, 16 bp, Homo sapiens
cctgccccaggcctga

SEQ ID NO: 3664490 - DNA, 18 bp, Homo sapiens
cctgccccggagctggag

SEQ ID NO: 3664491 - DNA, 16 bp, Homo sapiens
cctgcccctcagagac

SEQ ID NO: 3664492 - DNA, 16 bp, Homo sapiens
cctgccccttccttta

SEQ ID NO: 3664493 - DNA, 15 bp, Homo sapiens
cctgccctcgggtct

SEQ ID NO: 3664494 - DNA, 16 bp, Homo sapiens
cctgccctcgggtctc

SEQ ID NO: 3664495 - DNA, 12 bp, Homo sapiens
cctgccctggtc

SEQ ID NO: 3664496 - DNA, 15 bp, Homo sapiens
cctgcccttgtccca

SEQ ID NO: 3664497 - DNA, 17 bp, Homo sapiens
cctgcctgagggtgggc

SEQ ID NO: 3664498 - DNA, 11 bp, Homo sapiens
cctgcctggcc

SEQ ID NO: 3664499 - DNA, 12 bp, Homo sapiens
cctgcctggcca

SEQ ID NO: 3664500 - DNA, 18 bp, Homo sapiens
cctgcctggccaggcaga

SEQ ID NO: 3664501 - DNA, 23 bp, Homo sapiens
cctgcctgtggcgccgtctccag

SEQ ID NO: 3664502 - DNA, 16 bp, Homo sapiens
cctgccttatcttgca

SEQ ID NO: 3664503 - DNA, 15 bp, Homo sapiens
cctgcgaccctgggg

SEQ ID NO: 3664504 - DNA, 17 bp, Homo sapiens
cctgcgaccctgggggc

SEQ ID NO: 3664505 - DNA, 14 bp, Homo sapiens
cctgcgcctgtgat

SEQ ID NO: 3664506 - DNA, 21 bp, Homo sapiens
cctgcgggggcgaggcccctc

SEQ ID NO: 3664507 - DNA, 16 bp, Homo sapiens
cctgctccagacctga

SEQ ID NO: 3664508 - DNA, 22 bp, Homo sapiens
cctgctccagacctgatcctgg

SEQ ID NO: 3664509 - DNA, 12 bp, Homo sapiens
cctgctccagct

SEQ ID NO: 3664510 - DNA, 11 bp, Homo sapiens
cctgctgagct

SEQ ID NO: 3664511 - DNA, 12 bp, Homo sapiens
cctgctgagctg

SEQ ID NO: 3664512 - DNA, 14 bp, Homo sapiens
cctgctgagctgcc

SEQ ID NO: 3664513 - DNA, 14 bp, Homo sapiens
cctgctgcgcagtt

SEQ ID NO: 3664514 - DNA, 21 bp, Homo sapiens
cctgctgcgccccaggccccg

SEQ ID NO: 3664515 - DNA, 15 bp, Homo sapiens
cctgctgctggtgca

SEQ ID NO: 3664516 - DNA, 21 bp, Homo sapiens
cctgcttgatgggattctgga

SEQ ID NO: 3664517 - DNA, 11 bp, Homo sapiens
cctgctttctc

SEQ ID NO: 3664518 - DNA, 16 bp, Homo sapiens
cctggaacctggaccc

SEQ ID NO: 3664519 - DNA, 20 bp, Homo sapiens
cctggaacctggaccccagc

SEQ ID NO: 3664520 - DNA, 13 bp, Homo sapiens
cctggaacttggg

SEQ ID NO: 3664521 - DNA, 18 bp, Homo sapiens
cctggacagaggcggggc

SEQ ID NO: 3664522 - DNA, 14 bp, Homo sapiens
cctggaccccagcc

SEQ ID NO: 3664523 - DNA, 16 bp, Homo sapiens
cctggaccccagcctt

SEQ ID NO: 3664524 - DNA, 19 bp, Homo sapiens
cctggaccccagccttggt

SEQ ID NO: 3664525 - DNA, 13 bp, Homo sapiens
cctggaccctgtg

SEQ ID NO: 3664526 - DNA, 13 bp, Homo sapiens
cctggactttcct

SEQ ID NO: 3664527 - DNA, 15 bp, Homo sapiens
cctggagaagcacca

SEQ ID NO: 3664528 - DNA, 17 bp, Homo sapiens
cctggagaagcaccagc

SEQ ID NO: 3664529 - DNA, 19 bp, Homo sapiens
cctggagacttagggcacc

SEQ ID NO: 3664530 - DNA, 16 bp, Homo sapiens
cctggagatcctcctg

SEQ ID NO: 3664531 - DNA, 17 bp, Homo sapiens
cctggagatcctcctgc

SEQ ID NO: 3664532 - DNA, 19 bp, Homo sapiens
cctggagccaatggcccgg

SEQ ID NO: 3664533 - DNA, 14 bp, Homo sapiens
cctggaggcccagt

SEQ ID NO: 3664534 - DNA, 20 bp, Homo sapiens
cctggatggggcagagcttc

SEQ ID NO: 3664535 - DNA, 12 bp, Homo sapiens
cctggatgtttg

SEQ ID NO: 3664536 - DNA, 20 bp, Homo sapiens
cctggcagctctggacagcc

SEQ ID NO: 3664537 - DNA, 21 bp, Homo sapiens
cctggcagctctggacagccc

SEQ ID NO: 3664538 - DNA, 22 bp, Homo sapiens
cctggcagggtcatcctgtgct

SEQ ID NO: 3664539 - DNA, 13 bp, Homo sapiens
cctggcatttcac

SEQ ID NO: 3664540 - DNA, 14 bp, Homo sapiens
cctggccagacaca

SEQ ID NO: 3664541 - DNA, 18 bp, Homo sapiens
cctggccagacacaggcc

SEQ ID NO: 3664542 - DNA, 14 bp, Homo sapiens
cctggccaggagct

SEQ ID NO: 3664543 - DNA, 18 bp, Homo sapiens
cctggccaggagctcttc

SEQ ID NO: 3664544 - DNA, 20 bp, Homo sapiens
cctggccaggagctcttcag

SEQ ID NO: 3664545 - DNA, 22 bp, Homo sapiens
cctggccaggagctcttcaggc

SEQ ID NO: 3664546 - DNA, 14 bp, Homo sapiens
cctggccatcccac

SEQ ID NO: 3664547 - DNA, 15 bp, Homo sapiens
cctggccatcccaca

SEQ ID NO: 3664548 - DNA, 17 bp, Homo sapiens
cctggccatcccacaag

SEQ ID NO: 3664549 - DNA, 19 bp, Homo sapiens
cctggccatcccacaagtg

SEQ ID NO: 3664550 - DNA, 15 bp, Homo sapiens
cctggctcccatgac

SEQ ID NO: 3664551 - DNA, 15 bp, Homo sapiens
cctggctcctgaggg

SEQ ID NO: 3664552 - DNA, 23 bp, Homo sapiens
cctggctcctgaggggcatctgc

SEQ ID NO: 3664553 - DNA, 20 bp, Homo sapiens
cctggctctgaccgaaacag

SEQ ID NO: 3664554 - DNA, 13 bp, Homo sapiens
cctggctgccggc

SEQ ID NO: 3664555 - DNA, 19 bp, Homo sapiens
cctgggaaccgccctcctg

SEQ ID NO: 3664556 - DNA, 22 bp, Homo sapiens
cctgggaaccgccctcctgatt

SEQ ID NO: 3664557 - DNA, 18 bp, Homo sapiens
cctgggacggcggcagta

SEQ ID NO: 3664558 - DNA, 22 bp, Homo sapiens
cctgggagaaatctggcttctg

SEQ ID NO: 3664559 - DNA, 13 bp, Homo sapiens
cctgggagaggac

SEQ ID NO: 3664560 - DNA, 20 bp, Homo sapiens
cctgggaggtcaaggctgca

SEQ ID NO: 3664561 - DNA, 16 bp, Homo sapiens
cctgggatccgagggc

SEQ ID NO: 3664562 - DNA, 19 bp, Homo sapiens
cctgggatccgagggcccc

SEQ ID NO: 3664563 - DNA, 18 bp, Homo sapiens
cctgggcagccaggctgc

SEQ ID NO: 3664564 - DNA, 16 bp, Homo sapiens
cctgggccctgggctg

SEQ ID NO: 3664565 - DNA, 18 bp, Homo sapiens
cctgggccctgggctgga

SEQ ID NO: 3664566 - DNA, 13 bp, Homo sapiens
cctgggccgctgc

SEQ ID NO: 3664567 - DNA, 17 bp, Homo sapiens
cctgggccgctgccacg

SEQ ID NO: 3664568 - DNA, 14 bp, Homo sapiens
cctgggctggaatc

SEQ ID NO: 3664569 - DNA, 18 bp, Homo sapiens
cctgggggcgggactcct

SEQ ID NO: 3664570 - DNA, 12 bp, Homo sapiens
cctgggggctct

SEQ ID NO: 3664571 - DNA, 16 bp, Homo sapiens
cctgggggtggggctc

SEQ ID NO: 3664572 - DNA, 22 bp, Homo sapiens
cctgggggtggggctcctacct

SEQ ID NO: 3664573 - DNA, 22 bp, Homo sapiens
cctggggtataaaactttcctc

SEQ ID NO: 3664574 - DNA, 14 bp, Homo sapiens
cctggggtctggag

SEQ ID NO: 3664575 - DNA, 20 bp, Homo sapiens
cctggggtgtgggaggcccg

SEQ ID NO: 3664576 - DNA, 21 bp, Homo sapiens
cctggggtttgaccacccacc

SEQ ID NO: 3664577 - DNA, 13 bp, Homo sapiens
cctgggtggagca

SEQ ID NO: 3664578 - DNA, 23 bp, Homo sapiens
cctgggtggagcaggactcccac

SEQ ID NO: 3664579 - DNA, 20 bp, Homo sapiens
cctgggtggtctgcaggcag

SEQ ID NO: 3664580 - DNA, 16 bp, Homo sapiens
cctgggttgcagacag

SEQ ID NO: 3664581 - DNA, 14 bp, Homo sapiens
cctggtccagggaa

SEQ ID NO: 3664582 - DNA, 22 bp, Homo sapiens
cctggtccagggaagctggccg

SEQ ID NO: 3664583 - DNA, 23 bp, Homo sapiens
cctggtgggccaacaaagaacac

SEQ ID NO: 3664584 - DNA, 23 bp, Homo sapiens
cctggttattgatgtggccctgg

SEQ ID NO: 3664585 - DNA, 14 bp, Homo sapiens
cctggttgtctgaa

SEQ ID NO: 3664586 - DNA, 15 bp, Homo sapiens
cctggttgtctgaac

SEQ ID NO: 3664587 - DNA, 23 bp, Homo sapiens
cctggttgtctgaacccaggcag

SEQ ID NO: 3664588 - DNA, 14 bp, Homo sapiens
cctgtacagtagat

SEQ ID NO: 3664589 - DNA, 22 bp, Homo sapiens
cctgtacagtagattttccaaa

SEQ ID NO: 3664590 - DNA, 16 bp, Homo sapiens
cctgtacattgtggga

SEQ ID NO: 3664591 - DNA, 19 bp, Homo sapiens
cctgtagagtgggagctga

SEQ ID NO: 3664592 - DNA, 16 bp, Homo sapiens
cctgtagctttcctgg

SEQ ID NO: 3664593 - DNA, 22 bp, Homo sapiens
cctgtagctttcctggtccctc

SEQ ID NO: 3664594 - DNA, 16 bp, Homo sapiens
cctgtattcagacaga

SEQ ID NO: 3664595 - DNA, 22 bp, Homo sapiens
cctgtcaaacaaagccagaagc

SEQ ID NO: 3664596 - DNA, 19 bp, Homo sapiens
cctgtccaaactgcctaag

SEQ ID NO: 3664597 - DNA, 16 bp, Homo sapiens
cctgtccagcctgggc

SEQ ID NO: 3664598 - DNA, 15 bp, Homo sapiens
cctgtccagctccaa

SEQ ID NO: 3664599 - DNA, 18 bp, Homo sapiens
cctgtctcatccccaggg

SEQ ID NO: 3664600 - DNA, 16 bp, Homo sapiens
cctgtgaatgccactg

SEQ ID NO: 3664601 - DNA, 16 bp, Homo sapiens
cctgtgaccctctttg

SEQ ID NO: 3664602 - DNA, 19 bp, Homo sapiens
cctgtgaccctctttgctg

SEQ ID NO: 3664603 - DNA, 14 bp, Homo sapiens
ctaagactaacaaa

SEQ ID NO: 3664604 - DNA, 18 bp, Homo sapiens
ctaagactaacaaaggca

SEQ ID NO: 3664605 - DNA, 20 bp, Homo sapiens
ctaagactaacaaaggcagc

SEQ ID NO: 3664606 - DNA, 22 bp, Homo sapiens
ctaagactaacaaaggcagctg

SEQ ID NO: 3664607 - DNA, 23 bp, Homo sapiens
ctaagactaacaaaggcagctgt

SEQ ID NO: 3664608 - DNA, 22 bp, Homo sapiens
ctaagagaatgataggcttttg

SEQ ID NO: 3664609 - DNA, 13 bp, Homo sapiens
ctaagcagaggag

SEQ ID NO: 3664610 - DNA, 16 bp, Homo sapiens
ctaagcagaggagggg

SEQ ID NO: 3664611 - DNA, 19 bp, Homo sapiens
ctaagcagaggaggggccg

SEQ ID NO: 3664612 - DNA, 20 bp, Homo sapiens
ctaagcagaggaggggccgc

SEQ ID NO: 3664613 - DNA, 15 bp, Homo sapiens
ctaagccccgtctga

SEQ ID NO: 3664614 - DNA, 16 bp, Homo sapiens
ctaagccccgtctgac

SEQ ID NO: 3664615 - DNA, 20 bp, Homo sapiens
ctaagcctgaaggggcgtct

SEQ ID NO: 3664616 - DNA, 22 bp, Homo sapiens
ctaaggaggggaaaaaaatgtt

SEQ ID NO: 3664617 - DNA, 23 bp, Homo sapiens
ctaaggaggggaaaaaaatgttg

SEQ ID NO: 3664618 - DNA, 13 bp, Homo sapiens
ctaaggggcccgg

SEQ ID NO: 3664619 - DNA, 14 bp, Homo sapiens
ctaagtaacctcta

SEQ ID NO: 3664620 - DNA, 12 bp, Homo sapiens
ctaatacaccag

SEQ ID NO: 3664621 - DNA, 23 bp, Homo sapiens
ctaatatcaaatgcagtatattt

SEQ ID NO: 3664622 - DNA, 16 bp, Homo sapiens
ctaatcatccaatgct

SEQ ID NO: 3664623 - DNA, 23 bp, Homo sapiens
ctaatccaggcagatccaggact

SEQ ID NO: 3664624 - DNA, 18 bp, Homo sapiens
ctaatctatggtcgggag

SEQ ID NO: 3664625 - DNA, 14 bp, Homo sapiens
ctaatggcatgaga

SEQ ID NO: 3664626 - DNA, 17 bp, Homo sapiens
ctaattaaccttactaa

SEQ ID NO: 3664627 - DNA, 22 bp, Homo sapiens
ctaattgctgtgtgtcccaggc

SEQ ID NO: 3664628 - DNA, 19 bp, Homo sapiens
ctaattttacatgtttata

SEQ ID NO: 3664629 - DNA, 18 bp, Homo sapiens
ctaatttttgtattattt

SEQ ID NO: 3664630 - DNA, 15 bp, Homo sapiens
ctacaaccaatggaa

SEQ ID NO: 3664631 - DNA, 15 bp, Homo sapiens
ctacaagagcagcct

SEQ ID NO: 3664632 - DNA, 17 bp, Homo sapiens
ctacaagagcagcctgt

SEQ ID NO: 3664633 - DNA, 20 bp, Homo sapiens
ctacaagagcagcctgtggc

SEQ ID NO: 3664634 - DNA, 15 bp, Homo sapiens
ctacaccttgccttg

SEQ ID NO: 3664635 - DNA, 19 bp, Homo sapiens
ctacagattgggcggggct

SEQ ID NO: 3664636 - DNA, 18 bp, Homo sapiens
ctacaggaagcaccccat

SEQ ID NO: 3664637 - DNA, 19 bp, Homo sapiens
ctacagttgaaaaacagct

SEQ ID NO: 3664638 - DNA, 14 bp, Homo sapiens
ctacatgctggggt

SEQ ID NO: 3664639 - DNA, 17 bp, Homo sapiens
ctaccacctccccagcc

SEQ ID NO: 3664640 - DNA, 13 bp, Homo sapiens
ctaccctcccacc

SEQ ID NO: 3664641 - DNA, 14 bp, Homo sapiens
ctaccctcccaccc

SEQ ID NO: 3664642 - DNA, 18 bp, Homo sapiens
ctaccctcctgctgagct

SEQ ID NO: 3664643 - DNA, 20 bp, Homo sapiens
ctacctcaggcaggaagggc

SEQ ID NO: 3664644 - DNA, 15 bp, Homo sapiens
ctacctctgagaaga

SEQ ID NO: 3664645 - DNA, 16 bp, Homo sapiens
ctacctgaaggcaggg

SEQ ID NO: 3664646 - DNA, 17 bp, Homo sapiens
ctacctgaaggcagggc

SEQ ID NO: 3664647 - DNA, 19 bp, Homo sapiens
ctacctgaaggcagggctc

SEQ ID NO: 3664648 - DNA, 21 bp, Homo sapiens
ctacctgaaggcagggctcct

SEQ ID NO: 3664649 - DNA, 22 bp, Homo sapiens
ctacctgaaggcagggctcctc

SEQ ID NO: 3664650 - DNA, 21 bp, Homo sapiens
ctacctgttgagcatcacaga

SEQ ID NO: 3664651 - DNA, 14 bp, Homo sapiens
ctactgacatgtgg

SEQ ID NO: 3664652 - DNA, 21 bp, Homo sapiens
ctactgcccaggcactgcaaa

SEQ ID NO: 3664653 - DNA, 16 bp, Homo sapiens
ctactgtgtgatcagg

SEQ ID NO: 3664654 - DNA, 14 bp, Homo sapiens
ctacttagggaaga

SEQ ID NO: 3664655 - DNA, 15 bp, Homo sapiens
ctacttagggaagaa

SEQ ID NO: 3664656 - DNA, 16 bp, Homo sapiens
ctacttagggaagaaa

SEQ ID NO: 3664657 - DNA, 21 bp, Homo sapiens
ctacttagggaagaaaaagca

SEQ ID NO: 3664658 - DNA, 23 bp, Homo sapiens
ctacttcattttcagagtgacac

SEQ ID NO: 3664659 - DNA, 15 bp, Homo sapiens
ctactttgattctga

SEQ ID NO: 3664660 - DNA, 16 bp, Homo sapiens
ctactttgattctgat

SEQ ID NO: 3664661 - DNA, 13 bp, Homo sapiens
ctagaaattttca

SEQ ID NO: 3664662 - DNA, 16 bp, Homo sapiens
ctagaataatcttgct

SEQ ID NO: 3664663 - DNA, 16 bp, Homo sapiens
ctagacaagccagaac

SEQ ID NO: 3664664 - DNA, 17 bp, Homo sapiens
ctagacaagccagaact

SEQ ID NO: 3664665 - DNA, 18 bp, Homo sapiens
ctagactcccaagctgga

SEQ ID NO: 3664666 - DNA, 18 bp, Homo sapiens
ctagactgttactttggc

SEQ ID NO: 3664667 - DNA, 12 bp, Homo sapiens
ctagagagggag

SEQ ID NO: 3664668 - DNA, 23 bp, Homo sapiens
ctagagagggaggcaagccctgt

SEQ ID NO: 3664669 - DNA, 19 bp, Homo sapiens
ctagaggaaccaaccccca

SEQ ID NO: 3664670 - DNA, 17 bp, Homo sapiens
ctagaggccagccccac

SEQ ID NO: 3664671 - DNA, 18 bp, Homo sapiens
ctagaggccagccccacc

SEQ ID NO: 3664672 - DNA, 16 bp, Homo sapiens
ctagagggaggggcct

SEQ ID NO: 3664673 - DNA, 16 bp, Homo sapiens
ctagagtctgaacagc

SEQ ID NO: 3664674 - DNA, 16 bp, Homo sapiens
ctagatggctcctctc

SEQ ID NO: 3664675 - DNA, 16 bp, Homo sapiens
ctagcacttgtctcag

SEQ ID NO: 3664676 - DNA, 17 bp, Homo sapiens
ctagcacttgtctcagg

SEQ ID NO: 3664677 - DNA, 20 bp, Homo sapiens
ctagcagcccaccctgctgc

SEQ ID NO: 3664678 - DNA, 18 bp, Homo sapiens
ctagctgggggtgggcca

SEQ ID NO: 3664679 - DNA, 12 bp, Homo sapiens
ctagctgttagg

SEQ ID NO: 3664680 - DNA, 21 bp, Homo sapiens
ctaggagaaccaaatctggaa

SEQ ID NO: 3664681 - DNA, 18 bp, Homo sapiens
ctaggattgggcctccca

SEQ ID NO: 3664682 - DNA, 17 bp, Homo sapiens
ctaggcatctctgtact

SEQ ID NO: 3664683 - DNA, 13 bp, Homo sapiens
ctaggcccccact

SEQ ID NO: 3664684 - DNA, 13 bp, Homo sapiens
ctaggcctcagcc

SEQ ID NO: 3664685 - DNA, 13 bp, Homo sapiens
ctaggcctgggga

SEQ ID NO: 3664686 - DNA, 20 bp, Homo sapiens
ctaggctggagcccagggag

SEQ ID NO: 3664687 - DNA, 19 bp, Homo sapiens
ctagggaaaaaccagcgtg

SEQ ID NO: 3664688 - DNA, 14 bp, Homo sapiens
ctagggagccatgt

SEQ ID NO: 3664689 - DNA, 17 bp, Homo sapiens
ctagggtggcccttgca

SEQ ID NO: 3664690 - DNA, 19 bp, Homo sapiens
ctaggtaggcttctacctg

SEQ ID NO: 3664691 - DNA, 21 bp, Homo sapiens
ctaggtaggcttctacctgca

SEQ ID NO: 3664692 - DNA, 22 bp, Homo sapiens
ctaggtaggcttctacctgcag

SEQ ID NO: 3664693 - DNA, 17 bp, Homo sapiens
ctagtaagtgcctgctg

SEQ ID NO: 3664694 - DNA, 14 bp, Homo sapiens
ctagtcacaaagac

SEQ ID NO: 3664695 - DNA, 15 bp, Homo sapiens
ctagtcccttcccct

SEQ ID NO: 3664696 - DNA, 17 bp, Homo sapiens
ctagtcccttcccctcc

SEQ ID NO: 3664697 - DNA, 21 bp, Homo sapiens
ctagtcccttcccctccctgg

SEQ ID NO: 3664698 - DNA, 17 bp, Homo sapiens
ctagtgccttctaaagg

SEQ ID NO: 3664699 - DNA, 19 bp, Homo sapiens
ctagtgtctcctctctggt

SEQ ID NO: 3664700 - DNA, 22 bp, Homo sapiens
ctagttctttgttcatagccca

SEQ ID NO: 3664701 - DNA, 17 bp, Homo sapiens
ctataagaactttgagc

SEQ ID NO: 3664702 - DNA, 23 bp, Homo sapiens
ctatactgcttggagctgagcaa

SEQ ID NO: 3664703 - DNA, 14 bp, Homo sapiens
ctatagcctggggt

SEQ ID NO: 3664704 - DNA, 20 bp, Homo sapiens
ctatagttattaagttcttt

SEQ ID NO: 3664705 - DNA, 22 bp, Homo sapiens
ctatatttgggcctgctccaga

SEQ ID NO: 3664706 - DNA, 22 bp, Homo sapiens
ctatcaggtgcccctcttccaa

SEQ ID NO: 3664707 - DNA, 18 bp, Homo sapiens
ctatcatgtcaaacgtga

SEQ ID NO: 3664708 - DNA, 11 bp, Homo sapiens
ctatctgtctg

SEQ ID NO: 3664709 - DNA, 14 bp, Homo sapiens
ctatctgtctggtg

SEQ ID NO: 3664710 - DNA, 17 bp, Homo sapiens
ctatctgtctggtggcc

SEQ ID NO: 3664711 - DNA, 19 bp, Homo sapiens
ctatgatttggaaaataaa

SEQ ID NO: 3664712 - DNA, 20 bp, Homo sapiens
ctatgcaaaaaattctttag

SEQ ID NO: 3664713 - DNA, 17 bp, Homo sapiens
ctatgcttaataaaaga

SEQ ID NO: 3664714 - DNA, 19 bp, Homo sapiens
ctatgcttaataaaagaac

SEQ ID NO: 3664715 - DNA, 17 bp, Homo sapiens
ctatgctttgaaacaga

SEQ ID NO: 3664716 - DNA, 14 bp, Homo sapiens
ctatgggagcccca

SEQ ID NO: 3664717 - DNA, 15 bp, Homo sapiens
ctatgggagccccag

SEQ ID NO: 3664718 - DNA, 16 bp, Homo sapiens
ctatgggagccccagg

SEQ ID NO: 3664719 - DNA, 16 bp, Homo sapiens
ctccaggtgcagaggt

SEQ ID NO: 3664720 - DNA, 18 bp, Homo sapiens
ctccaggtgcagaggtac

SEQ ID NO: 3664721 - DNA, 18 bp, Homo sapiens
ctccagtgctggatttga

SEQ ID NO: 3664722 - DNA, 13 bp, Homo sapiens
ctccatccaaggc

SEQ ID NO: 3664723 - DNA, 21 bp, Homo sapiens
ctccatcctgtttgtatgaaa

SEQ ID NO: 3664724 - DNA, 22 bp, Homo sapiens
ctccatttcaattgctttgtga

SEQ ID NO: 3664725 - DNA, 17 bp, Homo sapiens
ctcccaagctgtgctgg

SEQ ID NO: 3664726 - DNA, 18 bp, Homo sapiens
ctcccaagctgtgctggg

SEQ ID NO: 3664727 - DNA, 22 bp, Homo sapiens
ctcccacacccaaagctgagcc

SEQ ID NO: 3664728 - DNA, 23 bp, Homo sapiens
ctcccacccccttctctgctcca

SEQ ID NO: 3664729 - DNA, 19 bp, Homo sapiens
ctcccacccggctgcagag

SEQ ID NO: 3664730 - DNA, 21 bp, Homo sapiens
ctcccaggatcagcagaagat

SEQ ID NO: 3664731 - DNA, 22 bp, Homo sapiens
ctcccaggctggagtgcagtga

SEQ ID NO: 3664732 - DNA, 18 bp, Homo sapiens
ctcccaggtgcatttctt

SEQ ID NO: 3664733 - DNA, 22 bp, Homo sapiens
ctcccagtaagggcgtggctct

SEQ ID NO: 3664734 - DNA, 16 bp, Homo sapiens
ctcccatgaccatact

SEQ ID NO: 3664735 - DNA, 17 bp, Homo sapiens
ctcccattcctgaagaa

SEQ ID NO: 3664736 - DNA, 15 bp, Homo sapiens
ctccccacctccagg

SEQ ID NO: 3664737 - DNA, 16 bp, Homo sapiens
ctccccacctccaggc

SEQ ID NO: 3664738 - DNA, 21 bp, Homo sapiens
ctccccagcattccagcccct

SEQ ID NO: 3664739 - DNA, 14 bp, Homo sapiens
ctccccagcccaga

SEQ ID NO: 3664740 - DNA, 15 bp, Homo sapiens
ctccccagcccagag

SEQ ID NO: 3664741 - DNA, 17 bp, Homo sapiens
ctccccagcccagagac

SEQ ID NO: 3664742 - DNA, 19 bp, Homo sapiens
ctccccaggtccagctctg

SEQ ID NO: 3664743 - DNA, 21 bp, Homo sapiens
ctcccccaacccccaccccac

SEQ ID NO: 3664744 - DNA, 13 bp, Homo sapiens
ctcccctgccacc

SEQ ID NO: 3664745 - DNA, 12 bp, Homo sapiens
ctcccctgccct

SEQ ID NO: 3664746 - DNA, 17 bp, Homo sapiens
ctcccctggacagaggc

SEQ ID NO: 3664747 - DNA, 18 bp, Homo sapiens
ctcccgaagtcctctgtg

SEQ ID NO: 3664748 - DNA, 22 bp, Homo sapiens
ctcccgaagtcctctgtggcca

SEQ ID NO: 3664749 - DNA, 15 bp, Homo sapiens
ctccctaccacctcc

SEQ ID NO: 3664750 - DNA, 23 bp, Homo sapiens
ctccctcccctgccctggtccag

SEQ ID NO: 3664751 - DNA, 20 bp, Homo sapiens
ctccctctctcttctgctcc

SEQ ID NO: 3664752 - DNA, 21 bp, Homo sapiens
ctccctctctcttctgctcca

SEQ ID NO: 3664753 - DNA, 20 bp, Homo sapiens
ctccctgaagtaagcaaaga

SEQ ID NO: 3664754 - DNA, 15 bp, Homo sapiens
ctccctgagggcgga

SEQ ID NO: 3664755 - DNA, 23 bp, Homo sapiens
ctccctgagggcggagcgcctcc

SEQ ID NO: 3664756 - DNA, 19 bp, Homo sapiens
ctccctgccaagtctcaga

SEQ ID NO: 3664757 - DNA, 11 bp, Homo sapiens
ctccctggctc

SEQ ID NO: 3664758 - DNA, 12 bp, Homo sapiens
ctccctggctcc

SEQ ID NO: 3664759 - DNA, 13 bp, Homo sapiens
ctccctggggacg

SEQ ID NO: 3664760 - DNA, 19 bp, Homo sapiens
ctccctggggacggggctc

SEQ ID NO: 3664761 - DNA, 20 bp, Homo sapiens
ctccctggggacggggctcc

SEQ ID NO: 3664762 - DNA, 16 bp, Homo sapiens
ctccctgggggcggga

SEQ ID NO: 3664763 - DNA, 23 bp, Homo sapiens
ctccctgggggtggggctcctac

SEQ ID NO: 3664764 - DNA, 17 bp, Homo sapiens
ctccctgttccccagag

SEQ ID NO: 3664765 - DNA, 18 bp, Homo sapiens
ctccctgttccccagaga

SEQ ID NO: 3664766 - DNA, 16 bp, Homo sapiens
ctcccttctgctactg

SEQ ID NO: 3664767 - DNA, 13 bp, Homo sapiens
ctccgagaggtgg

SEQ ID NO: 3664768 - DNA, 13 bp, Homo sapiens
ctccgccaggaag

SEQ ID NO: 3664769 - DNA, 13 bp, Homo sapiens
ctccgccctgcca

SEQ ID NO: 3664770 - DNA, 17 bp, Homo sapiens
ctccgccctgccactca

SEQ ID NO: 3664771 - DNA, 14 bp, Homo sapiens
ctccgcgggtggga

SEQ ID NO: 3664772 - DNA, 16 bp, Homo sapiens
ctccgcgggtgggact

SEQ ID NO: 3664773 - DNA, 18 bp, Homo sapiens
ctccgcgggtgggactct

SEQ ID NO: 3664774 - DNA, 15 bp, Homo sapiens
ctccgtccagccgcc

SEQ ID NO: 3664775 - DNA, 20 bp, Homo sapiens
ctccgtgatgctgtttttct

SEQ ID NO: 3664776 - DNA, 15 bp, Homo sapiens
ctccgttagctcctg

SEQ ID NO: 3664777 - DNA, 18 bp, Homo sapiens
ctccgttagctcctgtgg

SEQ ID NO: 3664778 - DNA, 22 bp, Homo sapiens
ctccgttagctcctgtggcccc

SEQ ID NO: 3664779 - DNA, 12 bp, Homo sapiens
ctccgttggcca

SEQ ID NO: 3664780 - DNA, 20 bp, Homo sapiens
ctccgttggccactccgaga

SEQ ID NO: 3664781 - DNA, 10 bp, Homo sapiens
ctcctacctg

SEQ ID NO: 3664782 - DNA, 20 bp, Homo sapiens
ctcctacctgaaggcagggc

SEQ ID NO: 3664783 - DNA, 22 bp, Homo sapiens
ctcctacctgaaggcagggctc

SEQ ID NO: 3664784 - DNA, 15 bp, Homo sapiens
ctcctacctgggggc

SEQ ID NO: 3664785 - DNA, 18 bp, Homo sapiens
ctcctagagggaggggcc

SEQ ID NO: 3664786 - DNA, 21 bp, Homo sapiens
ctcctcacctctggactggct

SEQ ID NO: 3664787 - DNA, 13 bp, Homo sapiens
ctcctccctgcat

SEQ ID NO: 3664788 - DNA, 14 bp, Homo sapiens
ctcctccctgcatc

SEQ ID NO: 3664789 - DNA, 13 bp, Homo sapiens
ctcctccctggag

SEQ ID NO: 3664790 - DNA, 15 bp, Homo sapiens
ctcctccctgggggt

SEQ ID NO: 3664791 - DNA, 16 bp, Homo sapiens
ctcctcgcaagctggg

SEQ ID NO: 3664792 - DNA, 17 bp, Homo sapiens
ctcctcgcaagctgggt

SEQ ID NO: 3664793 - DNA, 19 bp, Homo sapiens
ctcctcgcaagctgggtaa

SEQ ID NO: 3664794 - DNA, 19 bp, Homo sapiens
ctcctcgttcttatttaat

SEQ ID NO: 3664795 - DNA, 18 bp, Homo sapiens
ctcctctccccagcccag

SEQ ID NO: 3664796 - DNA, 19 bp, Homo sapiens
ctcctctccccagcccaga

SEQ ID NO: 3664797 - DNA, 20 bp, Homo sapiens
ctcctctccccagcccagag

SEQ ID NO: 3664798 - DNA, 21 bp, Homo sapiens
ctcctctctggtggctgggct

SEQ ID NO: 3664799 - DNA, 22 bp, Homo sapiens
ctcctctctggtggctgggctg

SEQ ID NO: 3664800 - DNA, 22 bp, Homo sapiens
ctcctctgcaaaacgagggggt

SEQ ID NO: 3664801 - DNA, 12 bp, Homo sapiens
ctcctctgtttg

SEQ ID NO: 3664802 - DNA, 21 bp, Homo sapiens
ctcctgaatgaggcggagctc

SEQ ID NO: 3664803 - DNA, 14 bp, Homo sapiens
ctcctgaccagggc

SEQ ID NO: 3664804 - DNA, 16 bp, Homo sapiens
ctcctgactggtgctg

SEQ ID NO: 3664805 - DNA, 17 bp, Homo sapiens
ctcctgcacttacttgc

SEQ ID NO: 3664806 - DNA, 20 bp, Homo sapiens
ctcctgcacttacttgctta

SEQ ID NO: 3664807 - DNA, 13 bp, Homo sapiens
ctcctgccaggga

SEQ ID NO: 3664808 - DNA, 14 bp, Homo sapiens
ctcctgccattctt

SEQ ID NO: 3664809 - DNA, 14 bp, Homo sapiens
ctcctgcccacctg

SEQ ID NO: 3664810 - DNA, 14 bp, Homo sapiens
ctcctgctgagctg

SEQ ID NO: 3664811 - DNA, 16 bp, Homo sapiens
ctcctgctgagctgcc

SEQ ID NO: 3664812 - DNA, 23 bp, Homo sapiens
ctcctgctgagctgcccctgctg

SEQ ID NO: 3664813 - DNA, 13 bp, Homo sapiens
ctcctgctgggca

SEQ ID NO: 3664814 - DNA, 23 bp, Homo sapiens
ctcctgctgtgcctcgcatccta

SEQ ID NO: 3664815 - DNA, 19 bp, Homo sapiens
ctcctgtggccccaccctg

SEQ ID NO: 3664816 - DNA, 22 bp, Homo sapiens
ctcctgtggccccaccctgggc

SEQ ID NO: 3664817 - DNA, 23 bp, Homo sapiens
ctcctgtggtagtcctcccaagc

SEQ ID NO: 3664818 - DNA, 23 bp, Homo sapiens
ctccttcctgtgggtggggcttc

SEQ ID NO: 3664819 - DNA, 18 bp, Homo sapiens
ctccttgagatcctgata

SEQ ID NO: 3664820 - DNA, 12 bp, Homo sapiens
ctccttggagga

SEQ ID NO: 3664821 - DNA, 18 bp, Homo sapiens
ctccttggaggacagtgg

SEQ ID NO: 3664822 - DNA, 19 bp, Homo sapiens
ctccttggaggacagtggg

SEQ ID NO: 3664823 - DNA, 19 bp, Homo sapiens
ctccttggcctttcctgga

SEQ ID NO: 3664824 - DNA, 20 bp, Homo sapiens
ctccttggcctttcctggaa

SEQ ID NO: 3664825 - DNA, 17 bp, Homo sapiens
ctccttgggaggcccca

SEQ ID NO: 3664826 - DNA, 21 bp, Homo sapiens
ctccttgggaggccccactgg

SEQ ID NO: 3664827 - DNA, 16 bp, Homo sapiens
ctcgaatctctgtgcc

SEQ ID NO: 3664828 - DNA, 13 bp, Homo sapiens
ctcgcaagctggg

SEQ ID NO: 3664829 - DNA, 19 bp, Homo sapiens
ctcgcacctcttggctttg

SEQ ID NO: 3664830 - DNA, 18 bp, Homo sapiens
ctcgggtctccccacctg

SEQ ID NO: 3664831 - DNA, 17 bp, Homo sapiens
ctcggtgtggagaagcg

SEQ ID NO: 3664832 - DNA, 13 bp, Homo sapiens
ctcggtttctcca

SEQ ID NO: 3664833 - DNA, 15 bp, Homo sapiens
ctcggtttgccaaaa

SEQ ID NO: 3664834 - DNA, 16 bp, Homo sapiens
ctcggtttgccaaaat

SEQ ID NO: 3664835 - DNA, 19 bp, Homo sapiens
ctgcataggctccttcctg

SEQ ID NO: 3664836 - DNA, 19 bp, Homo sapiens
ctgcatctgaccagcagcg

SEQ ID NO: 3664837 - DNA, 22 bp, Homo sapiens
ctgcatctgaccagcagcgcct

SEQ ID NO: 3664838 - DNA, 13 bp, Homo sapiens
ctgcatctttttg

SEQ ID NO: 3664839 - DNA, 17 bp, Homo sapiens
ctgcatttcggtggcta

SEQ ID NO: 3664840 - DNA, 18 bp, Homo sapiens
ctgccaaggccagagtgg

SEQ ID NO: 3664841 - DNA, 19 bp, Homo sapiens
ctgccaagtctcagaagag

SEQ ID NO: 3664842 - DNA, 15 bp, Homo sapiens
ctgccaatccttaaa

SEQ ID NO: 3664843 - DNA, 23 bp, Homo sapiens
ctgccaatccttaaatatgtgaa

SEQ ID NO: 3664844 - DNA, 23 bp, Homo sapiens
ctgccaattgctaccgagaaggt

SEQ ID NO: 3664845 - DNA, 14 bp, Homo sapiens
ctgccacccacctc

SEQ ID NO: 3664846 - DNA, 16 bp, Homo sapiens
ctgccactcactaggc

SEQ ID NO: 3664847 - DNA, 19 bp, Homo sapiens
ctgccactcactaggcccc

SEQ ID NO: 3664848 - DNA, 20 bp, Homo sapiens
ctgccagcggtttcctggtg

SEQ ID NO: 3664849 - DNA, 16 bp, Homo sapiens
ctgccagctgcactga

SEQ ID NO: 3664850 - DNA, 17 bp, Homo sapiens
ctgccagctgcactgat

SEQ ID NO: 3664851 - DNA, 13 bp, Homo sapiens
ctgccaggcatgg

SEQ ID NO: 3664852 - DNA, 12 bp, Homo sapiens
ctgccagtgaca

SEQ ID NO: 3664853 - DNA, 14 bp, Homo sapiens
ctgccatctagcca

SEQ ID NO: 3664854 - DNA, 21 bp, Homo sapiens
ctgccatctcacctcctgctg

SEQ ID NO: 3664855 - DNA, 15 bp, Homo sapiens
ctgccattcttctgg

SEQ ID NO: 3664856 - DNA, 17 bp, Homo sapiens
ctgcccaacccttccct

SEQ ID NO: 3664857 - DNA, 13 bp, Homo sapiens
ctgcccagagctg

SEQ ID NO: 3664858 - DNA, 13 bp, Homo sapiens
ctgccccatcctc

SEQ ID NO: 3664859 - DNA, 22 bp, Homo sapiens
ctgccccatcctccagcaggga

SEQ ID NO: 3664860 - DNA, 16 bp, Homo sapiens
ctgcccctcccagaac

SEQ ID NO: 3664861 - DNA, 14 bp, Homo sapiens
ctgcccctccccca

SEQ ID NO: 3664862 - DNA, 16 bp, Homo sapiens
ctgcccgggctcccac

SEQ ID NO: 3664863 - DNA, 14 bp, Homo sapiens
ctgccctcttactg

SEQ ID NO: 3664864 - DNA, 16 bp, Homo sapiens
ctgccggccctggggc

SEQ ID NO: 3664865 - DNA, 13 bp, Homo sapiens
ctgccgtcagtgc

SEQ ID NO: 3664866 - DNA, 20 bp, Homo sapiens
ctgccgtcagtgctgtgctg

SEQ ID NO: 3664867 - DNA, 20 bp, Homo sapiens
ctgccgtggggccgccgcct

SEQ ID NO: 3664868 - DNA, 21 bp, Homo sapiens
ctgccgtggggccgccgcctc

SEQ ID NO: 3664869 - DNA, 15 bp, Homo sapiens
ctgcctacgccagga

SEQ ID NO: 3664870 - DNA, 15 bp, Homo sapiens
ctgcctccagcctgg

SEQ ID NO: 3664871 - DNA, 21 bp, Homo sapiens
ctgcctccagcctggtggccc

SEQ ID NO: 3664872 - DNA, 16 bp, Homo sapiens
ctgcctgccagctgca

SEQ ID NO: 3664873 - DNA, 20 bp, Homo sapiens
ctgcctgccagctgcactga

SEQ ID NO: 3664874 - DNA, 21 bp, Homo sapiens
ctgcctgccagctgcactgat

SEQ ID NO: 3664875 - DNA, 22 bp, Homo sapiens
ctgcctgtggcgccgtctccag

SEQ ID NO: 3664876 - DNA, 20 bp, Homo sapiens
ctgccttcgcttcttgcctc

SEQ ID NO: 3664877 - DNA, 23 bp, Homo sapiens
ctgccttcgcttcttgcctctgt

SEQ ID NO: 3664878 - DNA, 18 bp, Homo sapiens
ctgcgactttctgcctgg

SEQ ID NO: 3664879 - DNA, 20 bp, Homo sapiens
ctgcgactttctgcctggag

SEQ ID NO: 3664880 - DNA, 14 bp, Homo sapiens
ctgcgccccaggcc

SEQ ID NO: 3664881 - DNA, 14 bp, Homo sapiens
ctgcgcccccttct

SEQ ID NO: 3664882 - DNA, 17 bp, Homo sapiens
ctgcgggagctctgtat

SEQ ID NO: 3664883 - DNA, 18 bp, Homo sapiens
ctgcgggggcgaggcccc

SEQ ID NO: 3664884 - DNA, 21 bp, Homo sapiens
ctgcgggtggggcttggggct

SEQ ID NO: 3664885 - DNA, 15 bp, Homo sapiens
ctgcgtcgagctggg

SEQ ID NO: 3664886 - DNA, 16 bp, Homo sapiens
ctgcgtcgagctggga

SEQ ID NO: 3664887 - DNA, 17 bp, Homo sapiens
ctgcgtcgagctgggaa

SEQ ID NO: 3664888 - DNA, 20 bp, Homo sapiens
ctgcgttggcttctccctgg

SEQ ID NO: 3664889 - DNA, 20 bp, Homo sapiens
ctgctacctctgagaagaca

SEQ ID NO: 3664890 - DNA, 15 bp, Homo sapiens
ctgctatagcctggg

SEQ ID NO: 3664891 - DNA, 17 bp, Homo sapiens
ctgctatcaaagaggtt

SEQ ID NO: 3664892 - DNA, 18 bp, Homo sapiens
ctgctcagaggccttgct

SEQ ID NO: 3664893 - DNA, 19 bp, Homo sapiens
ctgctcagaggccttgctg

SEQ ID NO: 3664894 - DNA, 18 bp, Homo sapiens
ctgctcagcttctcctgt

SEQ ID NO: 3664895 - DNA, 11 bp, Homo sapiens
ctgctccaccc

SEQ ID NO: 3664896 - DNA, 14 bp, Homo sapiens
ctgctccacccttg

SEQ ID NO: 3664897 - DNA, 15 bp, Homo sapiens
ctgctccacccttgg

SEQ ID NO: 3664898 - DNA, 16 bp, Homo sapiens
ctgctccacccttggc

SEQ ID NO: 3664899 - DNA, 18 bp, Homo sapiens
ctgctccacccttggcct

SEQ ID NO: 3664900 - DNA, 13 bp, Homo sapiens
ctgctccagacct

SEQ ID NO: 3664901 - DNA, 23 bp, Homo sapiens
ctgctccctgagggcggagcgcc

SEQ ID NO: 3664902 - DNA, 13 bp, Homo sapiens
ctgctccctggca

SEQ ID NO: 3664903 - DNA, 15 bp, Homo sapiens
ctgctccctggcatt

SEQ ID NO: 3664904 - DNA, 15 bp, Homo sapiens
ctgctcctagaggga

SEQ ID NO: 3664905 - DNA, 17 bp, Homo sapiens
ctgctcctagagggagg

SEQ ID NO: 3664906 - DNA, 14 bp, Homo sapiens
ctgctctttctctg

SEQ ID NO: 3664907 - DNA, 16 bp, Homo sapiens
ctgctctttctctgcc

SEQ ID NO: 3664908 - DNA, 16 bp, Homo sapiens
ctgctgaaggctcatt

SEQ ID NO: 3664909 - DNA, 18 bp, Homo sapiens
ctgctgacctccacagct

SEQ ID NO: 3664910 - DNA, 21 bp, Homo sapiens
ctgctgactgttttctcttga

SEQ ID NO: 3664911 - DNA, 12 bp, Homo sapiens
ctgctgagctgc

SEQ ID NO: 3664912 - DNA, 13 bp, Homo sapiens
ctgctgagctgcc

SEQ ID NO: 3664913 - DNA, 23 bp, Homo sapiens
ctgctgagctgcccctgctgctt

SEQ ID NO: 3664914 - DNA, 13 bp, Homo sapiens
ctgctgcctcttt

SEQ ID NO: 3664915 - DNA, 21 bp, Homo sapiens
ctgctgcctctttccctagga

SEQ ID NO: 3664916 - DNA, 18 bp, Homo sapiens
ctgctgcgccccaggccc

SEQ ID NO: 3664917 - DNA, 19 bp, Homo sapiens
ctgctgcttaagtgcatgc

SEQ ID NO: 3664918 - DNA, 16 bp, Homo sapiens
ctgctggggagacaaa

SEQ ID NO: 3664919 - DNA, 17 bp, Homo sapiens
ctgctggtccgtgggac

SEQ ID NO: 3664920 - DNA, 11 bp, Homo sapiens
ctgctgtgcaa

SEQ ID NO: 3664921 - DNA, 14 bp, Homo sapiens
ctgcttcctcctgg

SEQ ID NO: 3664922 - DNA, 18 bp, Homo sapiens
ctgcttcctcctggaaat

SEQ ID NO: 3664923 - DNA, 13 bp, Homo sapiens
ctgcttctctgac

SEQ ID NO: 3664924 - DNA, 20 bp, Homo sapiens
ctgcttctctgacttctgcc

SEQ ID NO: 3664925 - DNA, 13 bp, Homo sapiens
ctgcttgaggcaa

SEQ ID NO: 3664926 - DNA, 23 bp, Homo sapiens
ctgctttaacagtggagctgaat

SEQ ID NO: 3664927 - DNA, 21 bp, Homo sapiens
ctgcttttccttggggcaggc

SEQ ID NO: 3664928 - DNA, 23 bp, Homo sapiens
ctgcttttccttggggcaggcag

SEQ ID NO: 3664929 - DNA, 17 bp, Homo sapiens
ctggaaaataatactgc

SEQ ID NO: 3664930 - DNA, 16 bp, Homo sapiens
ctggaaaatgcttctt

SEQ ID NO: 3664931 - DNA, 21 bp, Homo sapiens
ctggaaaatgcttcttggctg

SEQ ID NO: 3664932 - DNA, 20 bp, Homo sapiens
ctggaacactagacaagcca

SEQ ID NO: 3664933 - DNA, 22 bp, Homo sapiens
ctggaacactagacaagccaga

SEQ ID NO: 3664934 - DNA, 19 bp, Homo sapiens
ctggaacccagactcagac

SEQ ID NO: 3664935 - DNA, 12 bp, Homo sapiens
ctggaacctcag

SEQ ID NO: 3664936 - DNA, 16 bp, Homo sapiens
ctggaacctcagcctg

SEQ ID NO: 3664937 - DNA, 20 bp, Homo sapiens
ctggaacctcagcctggcca

SEQ ID NO: 3664938 - DNA, 23 bp, Homo sapiens
ctggaacctcagcctggccagac

SEQ ID NO: 3664939 - DNA, 21 bp, Homo sapiens
ctggaacctgcaaaaaatact

SEQ ID NO: 3664940 - DNA, 18 bp, Homo sapiens
ctggaacctggaccccag

SEQ ID NO: 3664941 - DNA, 23 bp, Homo sapiens
ctggaacctggaccccagccttg

SEQ ID NO: 3664942 - DNA, 13 bp, Homo sapiens
ctggaagaaagca

SEQ ID NO: 3664943 - DNA, 14 bp, Homo sapiens
ctggaagaaagcaa

SEQ ID NO: 3664944 - DNA, 14 bp, Homo sapiens
ctggaagatcctgc

SEQ ID NO: 3664945 - DNA, 23 bp, Homo sapiens
ctggaagcaggatggagctgact

SEQ ID NO: 3664946 - DNA, 15 bp, Homo sapiens
ctggacagccccacc

SEQ ID NO: 3664947 - DNA, 17 bp, Homo sapiens
ctggaccccagccttgg

SEQ ID NO: 3664948 - DNA, 19 bp, Homo sapiens
ctggacggggcgggccctg

SEQ ID NO: 3664949 - DNA, 15 bp, Homo sapiens
ctggactttcctgca

SEQ ID NO: 3664950 - DNA, 16 bp, Homo sapiens
ctggactttcctgcaa

SEQ ID NO: 3664951 - DNA, 18 bp, Homo sapiens
ctggactttcctgcaact

SEQ ID NO: 3664952 - DNA, 15 bp, Homo sapiens
cttaaagagtgtggc

SEQ ID NO: 3664953 - DNA, 21 bp, Homo sapiens
cttaaagagtgtggcaaaata

SEQ ID NO: 3664954 - DNA, 17 bp, Homo sapiens
cttaagcaaaagaaaaa

SEQ ID NO: 3664955 - DNA, 14 bp, Homo sapiens
cttaaggtgtagcc

SEQ ID NO: 3664956 - DNA, 20 bp, Homo sapiens
cttaagtaccaatgggaagc

SEQ ID NO: 3664957 - DNA, 22 bp, Homo sapiens
cttaatgtgattactgctctat

SEQ ID NO: 3664958 - DNA, 13 bp, Homo sapiens
cttacacaccatt

SEQ ID NO: 3664959 - DNA, 22 bp, Homo sapiens
cttacatttttgtggttttgag

SEQ ID NO: 3664960 - DNA, 21 bp, Homo sapiens
cttacctgtgaccctctttgc

SEQ ID NO: 3664961 - DNA, 16 bp, Homo sapiens
cttagatctggcatgt

SEQ ID NO: 3664962 - DNA, 20 bp, Homo sapiens
cttagcaactgctggggaga

SEQ ID NO: 3664963 - DNA, 18 bp, Homo sapiens
cttagcagcttccagatt

SEQ ID NO: 3664964 - DNA, 14 bp, Homo sapiens
cttagcctccctga

SEQ ID NO: 3664965 - DNA, 15 bp, Homo sapiens
cttagcctccctgaa

SEQ ID NO: 3664966 - DNA, 15 bp, Homo sapiens
cttaggcagggaagt

SEQ ID NO: 3664967 - DNA, 15 bp, Homo sapiens
cttagggcaccaggg

SEQ ID NO: 3664968 - DNA, 17 bp, Homo sapiens
cttaggttggcaaaaag

SEQ ID NO: 3664969 - DNA, 11 bp, Homo sapiens
cttagtcctgg

SEQ ID NO: 3664970 - DNA, 13 bp, Homo sapiens
cttagtcctggga

SEQ ID NO: 3664971 - DNA, 20 bp, Homo sapiens
cttagtcctgggagaggaca

SEQ ID NO: 3664972 - DNA, 16 bp, Homo sapiens
cttagtgagcagtgag

SEQ ID NO: 3664973 - DNA, 18 bp, Homo sapiens
cttagtgccacccacctt

SEQ ID NO: 3664974 - DNA, 22 bp, Homo sapiens
cttagtttgtgtgttgtctctt

SEQ ID NO: 3664975 - DNA, 15 bp, Homo sapiens
cttatactgtacaat

SEQ ID NO: 3664976 - DNA, 19 bp, Homo sapiens
cttatggtaccagatgcag

SEQ ID NO: 3664977 - DNA, 21 bp, Homo sapiens
cttattaacaattaggcagac

SEQ ID NO: 3664978 - DNA, 14 bp, Homo sapiens
cttattgcgctgct

SEQ ID NO: 3664979 - DNA, 16 bp, Homo sapiens
cttcaaatgcctgact

SEQ ID NO: 3664980 - DNA, 19 bp, Homo sapiens
cttcaagtgccaaacagag

SEQ ID NO: 3664981 - DNA, 17 bp, Homo sapiens
cttcacaaagcccaagg

SEQ ID NO: 3664982 - DNA, 19 bp, Homo sapiens
cttcacacagacccctcgc

SEQ ID NO: 3664983 - DNA, 17 bp, Homo sapiens
cttcaccatctttctga

SEQ ID NO: 3664984 - DNA, 15 bp, Homo sapiens
cttcacggaagagcc

SEQ ID NO: 3664985 - DNA, 13 bp, Homo sapiens
cttcacggcagga

SEQ ID NO: 3664986 - DNA, 19 bp, Homo sapiens
cttcagacagagaggactg

SEQ ID NO: 3664987 - DNA, 15 bp, Homo sapiens
cttcagccaggagct

SEQ ID NO: 3664988 - DNA, 17 bp, Homo sapiens
cttcagccaggagctgg

SEQ ID NO: 3664989 - DNA, 15 bp, Homo sapiens
cttcagctgactttt

SEQ ID NO: 3664990 - DNA, 19 bp, Homo sapiens
cttcagggttctaaccttt

SEQ ID NO: 3664991 - DNA, 10 bp, Homo sapiens
cttcaggtcc

SEQ ID NO: 3664992 - DNA, 14 bp, Homo sapiens
cttcagtaagccgt

SEQ ID NO: 3664993 - DNA, 15 bp, Homo sapiens
cttcatagaaacctc

SEQ ID NO: 3664994 - DNA, 15 bp, Homo sapiens
cttcatgcccttctg

SEQ ID NO: 3664995 - DNA, 18 bp, Homo sapiens
cttcatgcccttctgatt

SEQ ID NO: 3664996 - DNA, 13 bp, Homo sapiens
cttcatggatggg

SEQ ID NO: 3664997 - DNA, 19 bp, Homo sapiens
cttcattgccttaactgga

SEQ ID NO: 3664998 - DNA, 14 bp, Homo sapiens
cttcattttcagag

SEQ ID NO: 3664999 - DNA, 15 bp, Homo sapiens
cttcattttcagagt

SEQ ID NO: 3665000 - DNA, 19 bp, Homo sapiens
cttcattttcagagtgaca

SEQ ID NO: 3665001 - DNA, 22 bp, Homo sapiens
cttccaaaggcagcgtgccgag

SEQ ID NO: 3665002 - DNA, 17 bp, Homo sapiens
cttccaaatgtccctcc

SEQ ID NO: 3665003 - DNA, 14 bp, Homo sapiens
cttccaacacattt

SEQ ID NO: 3665004 - DNA, 20 bp, Homo sapiens
cttccaacacatttcacttt

SEQ ID NO: 3665005 - DNA, 18 bp, Homo sapiens
cttccaacaggagctggg

SEQ ID NO: 3665006 - DNA, 22 bp, Homo sapiens
cttccacgggggctgtggctct

SEQ ID NO: 3665007 - DNA, 21 bp, Homo sapiens
cttccagcatttagctggcca

SEQ ID NO: 3665008 - DNA, 17 bp, Homo sapiens
cttccatccctaccccc

SEQ ID NO: 3665009 - DNA, 15 bp, Homo sapiens
cttcccattggcttt

SEQ ID NO: 3665010 - DNA, 16 bp, Homo sapiens
cttcccattggctttc

SEQ ID NO: 3665011 - DNA, 19 bp, Homo sapiens
cttcccattggctttctct

SEQ ID NO: 3665012 - DNA, 19 bp, Homo sapiens
cttccccagaaaggagact

SEQ ID NO: 3665013 - DNA, 14 bp, Homo sapiens
cttcccctccctgg

SEQ ID NO: 3665014 - DNA, 16 bp, Homo sapiens
cttcccctccctggct

SEQ ID NO: 3665015 - DNA, 18 bp, Homo sapiens
cttcccctccctggctcc

SEQ ID NO: 3665016 - DNA, 15 bp, Homo sapiens
cttccctacctcagg

SEQ ID NO: 3665017 - DNA, 12 bp, Homo sapiens
cttccctgcagc

SEQ ID NO: 3665018 - DNA, 15 bp, Homo sapiens
cttccctgcagctga

SEQ ID NO: 3665019 - DNA, 18 bp, Homo sapiens
cttccctgcgcctgtgat

SEQ ID NO: 3665020 - DNA, 16 bp, Homo sapiens
cttcccttgagccctc

SEQ ID NO: 3665021 - DNA, 20 bp, Homo sapiens
cttccgtggtcagagtgcca

SEQ ID NO: 3665022 - DNA, 18 bp, Homo sapiens
cttcctcagcctggggtt

SEQ ID NO: 3665023 - DNA, 17 bp, Homo sapiens
cttcctctgtgccacgc

SEQ ID NO: 3665024 - DNA, 16 bp, Homo sapiens
cttcctggatggggca

SEQ ID NO: 3665025 - DNA, 20 bp, Homo sapiens
cttcctggatggggcagagc

SEQ ID NO: 3665026 - DNA, 18 bp, Homo sapiens
cttcctgtgggtggggct

SEQ ID NO: 3665027 - DNA, 23 bp, Homo sapiens
cttcctgtgggtggggcttctct

SEQ ID NO: 3665028 - DNA, 21 bp, Homo sapiens
cttccttgaagaactgcaggc

SEQ ID NO: 3665029 - DNA, 16 bp, Homo sapiens
cttcctttaaaaaact

SEQ ID NO: 3665030 - DNA, 16 bp, Homo sapiens
cttcgcttcttgcctc

SEQ ID NO: 3665031 - DNA, 20 bp, Homo sapiens
cttcgcttcttgcctctgtg

SEQ ID NO: 3665032 - DNA, 21 bp, Homo sapiens
cttcgcttcttgcctctgtgc

SEQ ID NO: 3665033 - DNA, 19 bp, Homo sapiens
cttcgggaggtcgaggcag

SEQ ID NO: 3665034 - DNA, 14 bp, Homo sapiens
cttcgtctttccca

SEQ ID NO: 3665035 - DNA, 18 bp, Homo sapiens
cttcgttctttttaagtt

SEQ ID NO: 3665036 - DNA, 15 bp, Homo sapiens
cttctaaaggtgttg

SEQ ID NO: 3665037 - DNA, 21 bp, Homo sapiens
cttctaaaggtgttgtccctt

SEQ ID NO: 3665038 - DNA, 23 bp, Homo sapiens
cttctaaatggcaaaggaaggtg

SEQ ID NO: 3665039 - DNA, 22 bp, Homo sapiens
cttctacccagatggaaaaata

SEQ ID NO: 3665040 - DNA, 23 bp, Homo sapiens
cttctacctgcaggcggggctcc

SEQ ID NO: 3665041 - DNA, 13 bp, Homo sapiens
cttctagaaccag

SEQ ID NO: 3665042 - DNA, 13 bp, Homo sapiens
cttctaggaagct

SEQ ID NO: 3665043 - DNA, 19 bp, Homo sapiens
cttctagggttattgcatt

SEQ ID NO: 3665044 - DNA, 17 bp, Homo sapiens
cttctatattaaggcag

SEQ ID NO: 3665045 - DNA, 16 bp, Homo sapiens
cttctcactgccatgc

SEQ ID NO: 3665046 - DNA, 21 bp, Homo sapiens
cttctcactgccatgccagct

SEQ ID NO: 3665047 - DNA, 18 bp, Homo sapiens
cttctccttggaggacag

SEQ ID NO: 3665048 - DNA, 20 bp, Homo sapiens
cttctctgacttctgcctgg

SEQ ID NO: 3665049 - DNA, 14 bp, Homo sapiens
cttctctgctccac

SEQ ID NO: 3665050 - DNA, 22 bp, Homo sapiens
cttctctgctccaccacatcct

SEQ ID NO: 3665051 - DNA, 12 bp, Homo sapiens
cttctcttgggt

SEQ ID NO: 3665052 - DNA, 19 bp, Homo sapiens
cttctcttgggtgggacag

SEQ ID NO: 3665053 - DNA, 23 bp, Homo sapiens
cttctcttgggtgggacagggct

SEQ ID NO: 3665054 - DNA, 15 bp, Homo sapiens
cttctgaatatttta

SEQ ID NO: 3665055 - DNA, 19 bp, Homo sapiens
cttctgccggccctggggc

SEQ ID NO: 3665056 - DNA, 19 bp, Homo sapiens
cttctgctactggcaaaag

SEQ ID NO: 3665057 - DNA, 17 bp, Homo sapiens
cttctgctccacccttg

SEQ ID NO: 3665058 - DNA, 15 bp, Homo sapiens
cttctggactggttt

SEQ ID NO: 3665059 - DNA, 12 bp, Homo sapiens
cttctggccagg

SEQ ID NO: 3665060 - DNA, 17 bp, Homo sapiens
cttctggccaggaagct

SEQ ID NO: 3665061 - DNA, 20 bp, Homo sapiens
cttctgtccaagtacttaac

SEQ ID NO: 3665062 - DNA, 14 bp, Homo sapiens
cttctgtcccaagt

SEQ ID NO: 3665063 - DNA, 16 bp, Homo sapiens
cttctgtcccaagtct

SEQ ID NO: 3665064 - DNA, 22 bp, Homo sapiens
cttctgtcccaagtctccagag

SEQ ID NO: 3665065 - DNA, 22 bp, Homo sapiens
cttctgtgagacccccacacct

SEQ ID NO: 3665066 - DNA, 12 bp, Homo sapiens
cttcttcctgga

SEQ ID NO: 3665067 - DNA, 10 bp, Homo sapiens
cttcttcttc

SEQ ID NO: 3665068 - DNA, 14 bp, Homo sapiens
cttcttctttgttt

SEQ ID NO: 3665069 - DNA, 22 bp, Homo sapiens
gaactcaaatggggccagatcc

SEQ ID NO: 3665070 - DNA, 15 bp, Homo sapiens
gaactcagatccagg

SEQ ID NO: 3665071 - DNA, 16 bp, Homo sapiens
gaactcagatccaggg

SEQ ID NO: 3665072 - DNA, 21 bp, Homo sapiens
gaactcagatccagggacaga

SEQ ID NO: 3665073 - DNA, 23 bp, Homo sapiens
gaactccaggccctcctctccca

SEQ ID NO: 3665074 - DNA, 15 bp, Homo sapiens
gaactcctaaatcaa

SEQ ID NO: 3665075 - DNA, 14 bp, Homo sapiens
gaactggaagaaag

SEQ ID NO: 3665076 - DNA, 20 bp, Homo sapiens
gaactggagggtgagaggaa

SEQ ID NO: 3665077 - DNA, 11 bp, Homo sapiens
gaactgttaca

SEQ ID NO: 3665078 - DNA, 17 bp, Homo sapiens
gaactgttgcccttctg

SEQ ID NO: 3665079 - DNA, 22 bp, Homo sapiens
gaacttgaaatatcctgcttga

SEQ ID NO: 3665080 - DNA, 17 bp, Homo sapiens
gaacttgggccactgtg

SEQ ID NO: 3665081 - DNA, 22 bp, Homo sapiens
gaacttggggagttaagacctg

SEQ ID NO: 3665082 - DNA, 10 bp, Homo sapiens
gaagaaaaaa

SEQ ID NO: 3665083 - DNA, 17 bp, Homo sapiens
gaagaaaaagcaagtgt

SEQ ID NO: 3665084 - DNA, 19 bp, Homo sapiens
gaagaaccagtccccccac

SEQ ID NO: 3665085 - DNA, 15 bp, Homo sapiens
gaagaactgcaggcc

SEQ ID NO: 3665086 - DNA, 15 bp, Homo sapiens
gaagacaaaaagaca

SEQ ID NO: 3665087 - DNA, 14 bp, Homo sapiens
gaagacaattgaca

SEQ ID NO: 3665088 - DNA, 20 bp, Homo sapiens
gaagactgtcagcttccaaa

SEQ ID NO: 3665089 - DNA, 12 bp, Homo sapiens
gaagagccttgc

SEQ ID NO: 3665090 - DNA, 19 bp, Homo sapiens
gaagcagatgcaaagaggc

SEQ ID NO: 3665091 - DNA, 12 bp, Homo sapiens
gaagcagcctct

SEQ ID NO: 3665092 - DNA, 16 bp, Homo sapiens
gaagcaggatggagct

SEQ ID NO: 3665093 - DNA, 23 bp, Homo sapiens
gaagccaggaatttcccaggacc

SEQ ID NO: 3665094 - DNA, 14 bp, Homo sapiens
gaagcccccagcta

SEQ ID NO: 3665095 - DNA, 17 bp, Homo sapiens
gaagcccccagctaaga

SEQ ID NO: 3665096 - DNA, 19 bp, Homo sapiens
gaagcccctgagtcctgag

SEQ ID NO: 3665097 - DNA, 16 bp, Homo sapiens
gaagccgtgccctgcc

SEQ ID NO: 3665098 - DNA, 17 bp, Homo sapiens
gaagccgtgccctgccc

SEQ ID NO: 3665099 - DNA, 12 bp, Homo sapiens
gaagcctctggc

SEQ ID NO: 3665100 - DNA, 20 bp, Homo sapiens
gaagctcctctccccagccc

SEQ ID NO: 3665101 - DNA, 21 bp, Homo sapiens
gaagctcctctccccagccca

SEQ ID NO: 3665102 - DNA, 14 bp, Homo sapiens
gaagctgagcacca

SEQ ID NO: 3665103 - DNA, 17 bp, Homo sapiens
gaagctgagcaccaggg

SEQ ID NO: 3665104 - DNA, 23 bp, Homo sapiens
gaagctggccgagggtcctggct

SEQ ID NO: 3665105 - DNA, 20 bp, Homo sapiens
gaagctttggtgagaacctg

SEQ ID NO: 3665106 - DNA, 20 bp, Homo sapiens
gaaggaaaaggcagggagcg

SEQ ID NO: 3665107 - DNA, 13 bp, Homo sapiens
gaaggactacagg

SEQ ID NO: 3665108 - DNA, 15 bp, Homo sapiens
gaaggcagggctcct

SEQ ID NO: 3665109 - DNA, 16 bp, Homo sapiens
gaaggcagggctcctc

SEQ ID NO: 3665110 - DNA, 17 bp, Homo sapiens
gaaggcttgttgtgctt

SEQ ID NO: 3665111 - DNA, 23 bp, Homo sapiens
gaagggaagcgtatatacttaag

SEQ ID NO: 3665112 - DNA, 14 bp, Homo sapiens
gaagggccagagcc

SEQ ID NO: 3665113 - DNA, 14 bp, Homo sapiens
gaagggccagtcct

SEQ ID NO: 3665114 - DNA, 17 bp, Homo sapiens
gaagggcctcccagccc

SEQ ID NO: 3665115 - DNA, 23 bp, Homo sapiens
gaaggggcaaattcttttgaatt

SEQ ID NO: 3665116 - DNA, 20 bp, Homo sapiens
gaaggtactgtcatgggcta

SEQ ID NO: 3665117 - DNA, 17 bp, Homo sapiens
gaaggtattagcaaagc

SEQ ID NO: 3665118 - DNA, 18 bp, Homo sapiens
gaaggtcccacagccctg

SEQ ID NO: 3665119 - DNA, 20 bp, Homo sapiens
gaaggtcccacagccctgag

SEQ ID NO: 3665120 - DNA, 14 bp, Homo sapiens
gaaggttccatgaa

SEQ ID NO: 3665121 - DNA, 22 bp, Homo sapiens
gaagtaagatgtaaattgaaga

SEQ ID NO: 3665122 - DNA, 15 bp, Homo sapiens
gaagtgaatgctggg

SEQ ID NO: 3665123 - DNA, 16 bp, Homo sapiens
gaagtgcccttcctgc

SEQ ID NO: 3665124 - DNA, 17 bp, Homo sapiens
gaagtgggccagtcctg

SEQ ID NO: 3665125 - DNA, 21 bp, Homo sapiens
gaagtgggccagtcctggttg

SEQ ID NO: 3665126 - DNA, 18 bp, Homo sapiens
gaagtgttgaagggaggt

SEQ ID NO: 3665127 - DNA, 12 bp, Homo sapiens
gaagttttccta

SEQ ID NO: 3665128 - DNA, 16 bp, Homo sapiens
gaataacatttaaatt

SEQ ID NO: 3665129 - DNA, 14 bp, Homo sapiens
gaataataagcagg

SEQ ID NO: 3665130 - DNA, 23 bp, Homo sapiens
gaatcaggaatattttccaaaga

SEQ ID NO: 3665131 - DNA, 18 bp, Homo sapiens
gaatcccggctccagagc

SEQ ID NO: 3665132 - DNA, 21 bp, Homo sapiens
gaatcccggctccagagcagg

SEQ ID NO: 3665133 - DNA, 15 bp, Homo sapiens
gaatctctgtgcctt

SEQ ID NO: 3665134 - DNA, 19 bp, Homo sapiens
gaatctttaaaagatgctt

SEQ ID NO: 3665135 - DNA, 16 bp, Homo sapiens
gaatgaaattgctgaa

SEQ ID NO: 3665136 - DNA, 19 bp, Homo sapiens
gaatgaggcggagctccag

SEQ ID NO: 3665137 - DNA, 20 bp, Homo sapiens
gaatgatgatcctaggcatt

SEQ ID NO: 3665138 - DNA, 14 bp, Homo sapiens
gaatgcataaaatg

SEQ ID NO: 3665139 - DNA, 20 bp, Homo sapiens
gaatgcatggggcgggtcct

SEQ ID NO: 3665140 - DNA, 14 bp, Homo sapiens
gaatgccgtggatt

SEQ ID NO: 3665141 - DNA, 21 bp, Homo sapiens
gaatgtagtattcaatgattt

SEQ ID NO: 3665142 - DNA, 22 bp, Homo sapiens
gaatgttaattttttggtacaa

SEQ ID NO: 3665143 - DNA, 23 bp, Homo sapiens
gaatgttaattttttggtacaaa

SEQ ID NO: 3665144 - DNA, 20 bp, Homo sapiens
gaatgttgattacagtgcag

SEQ ID NO: 3665145 - DNA, 18 bp, Homo sapiens
gaattaagttagggaatg

SEQ ID NO: 3665146 - DNA, 21 bp, Homo sapiens
gaattaagttagggaatggca

SEQ ID NO: 3665147 - DNA, 20 bp, Homo sapiens
gaattgatcattttcccccc

SEQ ID NO: 3665148 - DNA, 18 bp, Homo sapiens
gaattggcaaactagaat

SEQ ID NO: 3665149 - DNA, 12 bp, Homo sapiens
gaattgttacat

SEQ ID NO: 3665150 - DNA, 22 bp, Homo sapiens
gaattgttgacaaatgtaaaca

SEQ ID NO: 3665151 - DNA, 22 bp, Homo sapiens
gaatttagtttgtactcagtgg

SEQ ID NO: 3665152 - DNA, 20 bp, Homo sapiens
gaatttatcacacttctgtg

SEQ ID NO: 3665153 - DNA, 15 bp, Homo sapiens
gaattttatttattt

SEQ ID NO: 3665154 - DNA, 14 bp, Homo sapiens
gaattttctggaaa

SEQ ID NO: 3665155 - DNA, 23 bp, Homo sapiens
gaattttctggaaaatgcttctt

SEQ ID NO: 3665156 - DNA, 17 bp, Homo sapiens
gacaaacagtagagaac

SEQ ID NO: 3665157 - DNA, 17 bp, Homo sapiens
gacaaccactggtctgt

SEQ ID NO: 3665158 - DNA, 16 bp, Homo sapiens
gacaacgaggaagccc

SEQ ID NO: 3665159 - DNA, 17 bp, Homo sapiens
gacaacgtttcagcgac

SEQ ID NO: 3665160 - DNA, 15 bp, Homo sapiens
gacaactggcaggca

SEQ ID NO: 3665161 - DNA, 16 bp, Homo sapiens
gacaactggcaggcag

SEQ ID NO: 3665162 - DNA, 18 bp, Homo sapiens
gacaactggcaggcaggc

SEQ ID NO: 3665163 - DNA, 19 bp, Homo sapiens
gacaagtgattttcattgt

SEQ ID NO: 3665164 - DNA, 20 bp, Homo sapiens
gacaatgtgaaaagaaaaat

SEQ ID NO: 3665165 - DNA, 15 bp, Homo sapiens
gacacaaacacacac

SEQ ID NO: 3665166 - DNA, 19 bp, Homo sapiens
gacacaaacacacacaaaa

SEQ ID NO: 3665167 - DNA, 19 bp, Homo sapiens
gacacaaggtgatttcaga

SEQ ID NO: 3665168 - DNA, 22 bp, Homo sapiens
gacacaggtctttcctaaggct

SEQ ID NO: 3665169 - DNA, 18 bp, Homo sapiens
gacacccaagagggctgc

SEQ ID NO: 3665170 - DNA, 20 bp, Homo sapiens
gacagaagtttgcactatct

SEQ ID NO: 3665171 - DNA, 15 bp, Homo sapiens
gacagacaggctctt

SEQ ID NO: 3665172 - DNA, 19 bp, Homo sapiens
gacagaggccccagcctcc

SEQ ID NO: 3665173 - DNA, 16 bp, Homo sapiens
gacagagggaagaaaa

SEQ ID NO: 3665174 - DNA, 14 bp, Homo sapiens
gacagatgccccag

SEQ ID NO: 3665175 - DNA, 18 bp, Homo sapiens
gacagatgccccagagct

SEQ ID NO: 3665176 - DNA, 17 bp, Homo sapiens
gacagcaaggtgtggag

SEQ ID NO: 3665177 - DNA, 18 bp, Homo sapiens
gacagcaaggtgtggagg

SEQ ID NO: 3665178 - DNA, 14 bp, Homo sapiens
gacagccccaccct

SEQ ID NO: 3665179 - DNA, 14 bp, Homo sapiens
gacagctgctccta

SEQ ID NO: 3665180 - DNA, 12 bp, Homo sapiens
gacagctttgct

SEQ ID NO: 3665181 - DNA, 14 bp, Homo sapiens
gacaggatgtgttt

SEQ ID NO: 3665182 - DNA, 20 bp, Homo sapiens
gacaggatgtgtttgctttc

SEQ ID NO: 3665183 - DNA, 13 bp, Homo sapiens
gacaggctcttag

SEQ ID NO: 3665184 - DNA, 12 bp, Homo sapiens
gacagggcttct

SEQ ID NO: 3665185 - DNA, 13 bp, Homo sapiens
ggacaaaatgtta

SEQ ID NO: 3665186 - DNA, 15 bp, Homo sapiens
ggacaacgaggaagc

SEQ ID NO: 3665187 - DNA, 17 bp, Homo sapiens
ggacaacgaggaagccc

SEQ ID NO: 3665188 - DNA, 18 bp, Homo sapiens
ggacaatgagtggaatac

SEQ ID NO: 3665189 - DNA, 15 bp, Homo sapiens
ggacagaggccccag

SEQ ID NO: 3665190 - DNA, 16 bp, Homo sapiens
ggacagaggccccagc

SEQ ID NO: 3665191 - DNA, 20 bp, Homo sapiens
ggacagaggccccagcctcc

SEQ ID NO: 3665192 - DNA, 16 bp, Homo sapiens
ggacagccccaccctg

SEQ ID NO: 3665193 - DNA, 20 bp, Homo sapiens
ggacaggatgtgtttgcttt

SEQ ID NO: 3665194 - DNA, 20 bp, Homo sapiens
ggacagggacttcgcagagg

SEQ ID NO: 3665195 - DNA, 17 bp, Homo sapiens
ggacagggcttctcctg

SEQ ID NO: 3665196 - DNA, 21 bp, Homo sapiens
ggacatcacagggtgggcctc

SEQ ID NO: 3665197 - DNA, 17 bp, Homo sapiens
ggaccaggactccctcc

SEQ ID NO: 3665198 - DNA, 18 bp, Homo sapiens
ggacccaccactggaagc

SEQ ID NO: 3665199 - DNA, 17 bp, Homo sapiens
ggacctaaatggcctca

SEQ ID NO: 3665200 - DNA, 16 bp, Homo sapiens
ggacctgtggctgtcg

SEQ ID NO: 3665201 - DNA, 20 bp, Homo sapiens
ggacctttccaccacagcca

SEQ ID NO: 3665202 - DNA, 15 bp, Homo sapiens
ggacgctttgtctgt

SEQ ID NO: 3665203 - DNA, 17 bp, Homo sapiens
ggacggccaagaatgta

SEQ ID NO: 3665204 - DNA, 21 bp, Homo sapiens
ggacggcctgatgctccctcc

SEQ ID NO: 3665205 - DNA, 12 bp, Homo sapiens
ggacggggctcc

SEQ ID NO: 3665206 - DNA, 14 bp, Homo sapiens
ggacgtgagagaag

SEQ ID NO: 3665207 - DNA, 17 bp, Homo sapiens
ggactcagccctgaggt

SEQ ID NO: 3665208 - DNA, 13 bp, Homo sapiens
ggactcccaggct

SEQ ID NO: 3665209 - DNA, 18 bp, Homo sapiens
ggactcccaggctggaga

SEQ ID NO: 3665210 - DNA, 12 bp, Homo sapiens
ggactcctccct

SEQ ID NO: 3665211 - DNA, 17 bp, Homo sapiens
ggactcctccctggggg

SEQ ID NO: 3665212 - DNA, 14 bp, Homo sapiens
ggactcttccctgg

SEQ ID NO: 3665213 - DNA, 22 bp, Homo sapiens
ggactgctacctttcaaagctt

SEQ ID NO: 3665214 - DNA, 22 bp, Homo sapiens
ggactttgcagccggcacaggg

SEQ ID NO: 3665215 - DNA, 20 bp, Homo sapiens
ggagaaccaaatctggaagc

SEQ ID NO: 3665216 - DNA, 13 bp, Homo sapiens
ggagaaccaccta

SEQ ID NO: 3665217 - DNA, 16 bp, Homo sapiens
ggagaaccacctaccc

SEQ ID NO: 3665218 - DNA, 12 bp, Homo sapiens
ggagaagccagg

SEQ ID NO: 3665219 - DNA, 14 bp, Homo sapiens
ggagacagcatcag

SEQ ID NO: 3665220 - DNA, 17 bp, Homo sapiens
ggagacagcatcagggt

SEQ ID NO: 3665221 - DNA, 15 bp, Homo sapiens
ggagagaaaatatat

SEQ ID NO: 3665222 - DNA, 17 bp, Homo sapiens
ggagagcaagaaggaaa

SEQ ID NO: 3665223 - DNA, 18 bp, Homo sapiens
ggagagcgcctgcccctc

SEQ ID NO: 3665224 - DNA, 21 bp, Homo sapiens
ggagagctagcagcagggagg

SEQ ID NO: 3665225 - DNA, 17 bp, Homo sapiens
ggagaggacagggactt

SEQ ID NO: 3665226 - DNA, 22 bp, Homo sapiens
ggagaggccctctggagtggcc

SEQ ID NO: 3665227 - DNA, 18 bp, Homo sapiens
ggagagtttcctgaaaca

SEQ ID NO: 3665228 - DNA, 17 bp, Homo sapiens
ggagattggacggcctg

SEQ ID NO: 3665229 - DNA, 17 bp, Homo sapiens
ggagcaagtgaggccgg

SEQ ID NO: 3665230 - DNA, 21 bp, Homo sapiens
ggagcaccctgtcttcttaat

SEQ ID NO: 3665231 - DNA, 19 bp, Homo sapiens
ggagcatgcttccctgcag

SEQ ID NO: 3665232 - DNA, 21 bp, Homo sapiens
ggagcatgcttccctgcagct

SEQ ID NO: 3665233 - DNA, 23 bp, Homo sapiens
ggagcatgcttccctgcagctga

SEQ ID NO: 3665234 - DNA, 20 bp, Homo sapiens
ggagcccactgtcctgggcc

SEQ ID NO: 3665235 - DNA, 13 bp, Homo sapiens
ggagccccagggt

SEQ ID NO: 3665236 - DNA, 14 bp, Homo sapiens
ggagccccagggtc

SEQ ID NO: 3665237 - DNA, 21 bp, Homo sapiens
ggagccgaggcctaccccgca

SEQ ID NO: 3665238 - DNA, 20 bp, Homo sapiens
ggagcctccaattgcagtgg

SEQ ID NO: 3665239 - DNA, 14 bp, Homo sapiens
ggagcggaaagcag

SEQ ID NO: 3665240 - DNA, 15 bp, Homo sapiens
ggagcggaaagcagc

SEQ ID NO: 3665241 - DNA, 15 bp, Homo sapiens
ggagctccaggatgg

SEQ ID NO: 3665242 - DNA, 19 bp, Homo sapiens
ggagctccaggatggggag

SEQ ID NO: 3665243 - DNA, 20 bp, Homo sapiens
ggagctcttcaggcctccct

SEQ ID NO: 3665244 - DNA, 20 bp, Homo sapiens
ggagctgaattttctggaaa

SEQ ID NO: 3665245 - DNA, 18 bp, Homo sapiens
ggagctgctatagcctgg

SEQ ID NO: 3665246 - DNA, 13 bp, Homo sapiens
ggagctgctggct

SEQ ID NO: 3665247 - DNA, 18 bp, Homo sapiens
ggagctgggcagaaggcc

SEQ ID NO: 3665248 - DNA, 13 bp, Homo sapiens
ggagctttctgta

SEQ ID NO: 3665249 - DNA, 10 bp, Homo sapiens
ggaggacagt

SEQ ID NO: 3665250 - DNA, 22 bp, Homo sapiens
ggaggacagtgggaactggagg

SEQ ID NO: 3665251 - DNA, 21 bp, Homo sapiens
ggaggatctcttgagcctggg

SEQ ID NO: 3665252 - DNA, 18 bp, Homo sapiens
ggaggccaaggtgggagg

SEQ ID NO: 3665253 - DNA, 16 bp, Homo sapiens
ggaggccagccagtga

SEQ ID NO: 3665254 - DNA, 13 bp, Homo sapiens
ggaggcccagttc

SEQ ID NO: 3665255 - DNA, 15 bp, Homo sapiens
ggaggccctgtgccc

SEQ ID NO: 3665256 - DNA, 13 bp, Homo sapiens
ggaggccgaggcc

SEQ ID NO: 3665257 - DNA, 13 bp, Homo sapiens
ggaggcggggctc

SEQ ID NO: 3665258 - DNA, 14 bp, Homo sapiens
ggaggcggggctct

SEQ ID NO: 3665259 - DNA, 20 bp, Homo sapiens
ggaggctcccgaggggaagg

SEQ ID NO: 3665260 - DNA, 10 bp, Homo sapiens
ggaggctgcg

SEQ ID NO: 3665261 - DNA, 13 bp, Homo sapiens
ggagggagatgga

SEQ ID NO: 3665262 - DNA, 11 bp, Homo sapiens
ggagggaggcc

SEQ ID NO: 3665263 - DNA, 17 bp, Homo sapiens
ggagggattctggttcc

SEQ ID NO: 3665264 - DNA, 22 bp, Homo sapiens
ggagggattctggttccagggt

SEQ ID NO: 3665265 - DNA, 18 bp, Homo sapiens
ggagggcaggtccagctc

SEQ ID NO: 3665266 - DNA, 21 bp, Homo sapiens
ggagggcaggtccagctctgt

SEQ ID NO: 3665267 - DNA, 21 bp, Homo sapiens
ggagggcggcaggggcctgga

SEQ ID NO: 3665268 - DNA, 20 bp, Homo sapiens
ggaggtcaaggctgcagtga

SEQ ID NO: 3665269 - DNA, 18 bp, Homo sapiens
ggaggtcgaggcaggagg

SEQ ID NO: 3665270 - DNA, 13 bp, Homo sapiens
ggaggtggctggg

SEQ ID NO: 3665271 - DNA, 12 bp, Homo sapiens
ggaggtgtgagg

SEQ ID NO: 3665272 - DNA, 19 bp, Homo sapiens
ggaggttcacctgcagcga

SEQ ID NO: 3665273 - DNA, 15 bp, Homo sapiens
ggaggtttggggggc

SEQ ID NO: 3665274 - DNA, 19 bp, Homo sapiens
ggaggtttggggggcatca

SEQ ID NO: 3665275 - DNA, 14 bp, Homo sapiens
ggaggtttgtcggg

SEQ ID NO: 3665276 - DNA, 13 bp, Homo sapiens
ggagtacccagcc

SEQ ID NO: 3665277 - DNA, 16 bp, Homo sapiens
ggagtacccagcctat

SEQ ID NO: 3665278 - DNA, 12 bp, Homo sapiens
ggagtagaatac

SEQ ID NO: 3665279 - DNA, 23 bp, Homo sapiens
ggagtcatctcaaccatcccctc

SEQ ID NO: 3665280 - DNA, 17 bp, Homo sapiens
ggagttccagcaaacaa

SEQ ID NO: 3665281 - DNA, 22 bp, Homo sapiens
ggagttctaacaaaacaagttg

SEQ ID NO: 3665282 - DNA, 14 bp, Homo sapiens
ggagttgatctgga

SEQ ID NO: 3665283 - DNA, 13 bp, Homo sapiens
ggatagatgctgg

SEQ ID NO: 3665284 - DNA, 18 bp, Homo sapiens
ggatagatgctggcccag

SEQ ID NO: 3665285 - DNA, 19 bp, Homo sapiens
ggatagatgctggcccagg

SEQ ID NO: 3665286 - DNA, 21 bp, Homo sapiens
ggatagatgctggcccagggc

SEQ ID NO: 3665287 - DNA, 16 bp, Homo sapiens
ggatagttgctatttt

SEQ ID NO: 3665288 - DNA, 17 bp, Homo sapiens
ggatccctcccccccat

SEQ ID NO: 3665289 - DNA, 17 bp, Homo sapiens
ggatccgactgctttgg

SEQ ID NO: 3665290 - DNA, 13 bp, Homo sapiens
ggatctccttgag

SEQ ID NO: 3665291 - DNA, 17 bp, Homo sapiens
ggatctggtcctaccca

SEQ ID NO: 3665292 - DNA, 15 bp, Homo sapiens
ggatctttgtggcca

SEQ ID NO: 3665293 - DNA, 18 bp, Homo sapiens
ggatgaggcttcttcctg

SEQ ID NO: 3665294 - DNA, 13 bp, Homo sapiens
ggatgccctggag

SEQ ID NO: 3665295 - DNA, 15 bp, Homo sapiens
ggatgccctggaggt

SEQ ID NO: 3665296 - DNA, 17 bp, Homo sapiens
ggatgctccatttcaat

SEQ ID NO: 3665297 - DNA, 18 bp, Homo sapiens
ggatggatttccagccaa

SEQ ID NO: 3665298 - DNA, 14 bp, Homo sapiens
ggatggccccagca

SEQ ID NO: 3665299 - DNA, 14 bp, Homo sapiens
ggatggggaggggc

SEQ ID NO: 3665300 - DNA, 11 bp, Homo sapiens
ggatggggcag

SEQ ID NO: 3665301 - DNA, 23 bp, Homo sapiens
ggatggggcagagcttctcctga

SEQ ID NO: 3665302 - DNA, 14 bp, Homo sapiens
gggaaggggcggtg

SEQ ID NO: 3665303 - DNA, 11 bp, Homo sapiens
gggaaggttcc

SEQ ID NO: 3665304 - DNA, 14 bp, Homo sapiens
gggaagtccccagg

SEQ ID NO: 3665305 - DNA, 13 bp, Homo sapiens
gggacagagcaga

SEQ ID NO: 3665306 - DNA, 18 bp, Homo sapiens
gggacagaggccccagcc

SEQ ID NO: 3665307 - DNA, 19 bp, Homo sapiens
gggacagaggccccagcct

SEQ ID NO: 3665308 - DNA, 20 bp, Homo sapiens
gggacagaggccccagcctc

SEQ ID NO: 3665309 - DNA, 12 bp, Homo sapiens
gggacagggctt

SEQ ID NO: 3665310 - DNA, 17 bp, Homo sapiens
gggacatcacagggtgg

SEQ ID NO: 3665311 - DNA, 13 bp, Homo sapiens
gggaccaggctcc

SEQ ID NO: 3665312 - DNA, 12 bp, Homo sapiens
gggacccagtgc

SEQ ID NO: 3665313 - DNA, 23 bp, Homo sapiens
gggacccccgtggggcagggagc

SEQ ID NO: 3665314 - DNA, 16 bp, Homo sapiens
gggactcagccctgag

SEQ ID NO: 3665315 - DNA, 17 bp, Homo sapiens
gggactcctccctgggg

SEQ ID NO: 3665316 - DNA, 18 bp, Homo sapiens
gggactcctccctggggg

SEQ ID NO: 3665317 - DNA, 23 bp, Homo sapiens
gggactcctccctgggggtgggg

SEQ ID NO: 3665318 - DNA, 12 bp, Homo sapiens
gggagacagcat

SEQ ID NO: 3665319 - DNA, 22 bp, Homo sapiens
gggagacggtttccagggaggg

SEQ ID NO: 3665320 - DNA, 19 bp, Homo sapiens
gggagatggatcaatcaaa

SEQ ID NO: 3665321 - DNA, 21 bp, Homo sapiens
gggagcatgcttccctgcagc

SEQ ID NO: 3665322 - DNA, 22 bp, Homo sapiens
gggagccaaaatctcaagaaat

SEQ ID NO: 3665323 - DNA, 19 bp, Homo sapiens
gggagccatgcgccccctc

SEQ ID NO: 3665324 - DNA, 10 bp, Homo sapiens
gggagcccac

SEQ ID NO: 3665325 - DNA, 19 bp, Homo sapiens
gggagcccactgtcctggg

SEQ ID NO: 3665326 - DNA, 20 bp, Homo sapiens
gggagcccactgtcctgggc

SEQ ID NO: 3665327 - DNA, 21 bp, Homo sapiens
gggagccccagggtcttccct

SEQ ID NO: 3665328 - DNA, 12 bp, Homo sapiens
gggagcctctgg

SEQ ID NO: 3665329 - DNA, 13 bp, Homo sapiens
gggagcctctgga

SEQ ID NO: 3665330 - DNA, 14 bp, Homo sapiens
gggagcctctggaa

SEQ ID NO: 3665331 - DNA, 12 bp, Homo sapiens
gggaggacaggc

SEQ ID NO: 3665332 - DNA, 14 bp, Homo sapiens
gggaggccccaggg

SEQ ID NO: 3665333 - DNA, 20 bp, Homo sapiens
gggagggcaggtccagctct

SEQ ID NO: 3665334 - DNA, 14 bp, Homo sapiens
gggaggggcctagg

SEQ ID NO: 3665335 - DNA, 21 bp, Homo sapiens
gggagtcatctcaaccatccc

SEQ ID NO: 3665336 - DNA, 15 bp, Homo sapiens
gggagttaagacctg

SEQ ID NO: 3665337 - DNA, 16 bp, Homo sapiens
gggagttaagacctgg

SEQ ID NO: 3665338 - DNA, 19 bp, Homo sapiens
gggattctggttccagggt

SEQ ID NO: 3665339 - DNA, 18 bp, Homo sapiens
gggcacaccgccatcctc

SEQ ID NO: 3665340 - DNA, 16 bp, Homo sapiens
gggcacagggtctcta

SEQ ID NO: 3665341 - DNA, 15 bp, Homo sapiens
gggcaccagccagcg

SEQ ID NO: 3665342 - DNA, 18 bp, Homo sapiens
gggcaccaggggtttctc

SEQ ID NO: 3665343 - DNA, 13 bp, Homo sapiens
gggcacggctctg

SEQ ID NO: 3665344 - DNA, 16 bp, Homo sapiens
gggcacggctctgggg

SEQ ID NO: 3665345 - DNA, 11 bp, Homo sapiens
gggcagagctg

SEQ ID NO: 3665346 - DNA, 16 bp, Homo sapiens
gggcagccaggctgcc

SEQ ID NO: 3665347 - DNA, 15 bp, Homo sapiens
gggcagctgtccctt

SEQ ID NO: 3665348 - DNA, 16 bp, Homo sapiens
gggcaggaaggagagc

SEQ ID NO: 3665349 - DNA, 18 bp, Homo sapiens
gggcaggagggccctacc

SEQ ID NO: 3665350 - DNA, 18 bp, Homo sapiens
gggcagggagctgggccc

SEQ ID NO: 3665351 - DNA, 18 bp, Homo sapiens
gggcaggtccagctctgt

SEQ ID NO: 3665352 - DNA, 23 bp, Homo sapiens
gggcaggtccagctctgtgggcc

SEQ ID NO: 3665353 - DNA, 21 bp, Homo sapiens
gggcaggttctgcctgctttg

SEQ ID NO: 3665354 - DNA, 17 bp, Homo sapiens
gggcaggttggtggggg

SEQ ID NO: 3665355 - DNA, 19 bp, Homo sapiens
gggcatctgcccctccccc

SEQ ID NO: 3665356 - DNA, 20 bp, Homo sapiens
gggcatctgcccctccccca

SEQ ID NO: 3665357 - DNA, 14 bp, Homo sapiens
gggccagagccagg

SEQ ID NO: 3665358 - DNA, 16 bp, Homo sapiens
gggccagatccagcct

SEQ ID NO: 3665359 - DNA, 18 bp, Homo sapiens
gggccagatccagcctgg

SEQ ID NO: 3665360 - DNA, 14 bp, Homo sapiens
gggccatgctgagg

SEQ ID NO: 3665361 - DNA, 19 bp, Homo sapiens
gggccatgctgaggcctgg

SEQ ID NO: 3665362 - DNA, 23 bp, Homo sapiens
gggccatgctgaggcctgggccg

SEQ ID NO: 3665363 - DNA, 13 bp, Homo sapiens
gggccatggctca

SEQ ID NO: 3665364 - DNA, 15 bp, Homo sapiens
gggccatggctcagg

SEQ ID NO: 3665365 - DNA, 17 bp, Homo sapiens
gggccatttggccggct

SEQ ID NO: 3665366 - DNA, 15 bp, Homo sapiens
gggcccagagcccag

SEQ ID NO: 3665367 - DNA, 16 bp, Homo sapiens
gggcccagagcccagc

SEQ ID NO: 3665368 - DNA, 17 bp, Homo sapiens
gggcccctcaccctgcc

SEQ ID NO: 3665369 - DNA, 21 bp, Homo sapiens
gggcccctctccaagcgcctg

SEQ ID NO: 3665370 - DNA, 22 bp, Homo sapiens
gggccccttccaaatgtccctc

SEQ ID NO: 3665371 - DNA, 16 bp, Homo sapiens
gggccctaccctcctg

SEQ ID NO: 3665372 - DNA, 17 bp, Homo sapiens
gggccctaccctcctgc

SEQ ID NO: 3665373 - DNA, 13 bp, Homo sapiens
gggccctgggctg

SEQ ID NO: 3665374 - DNA, 21 bp, Homo sapiens
gggccgctgccacccacctcc

SEQ ID NO: 3665375 - DNA, 18 bp, Homo sapiens
gggccggcccccttcctg

SEQ ID NO: 3665376 - DNA, 12 bp, Homo sapiens
gggccggccctg

SEQ ID NO: 3665377 - DNA, 17 bp, Homo sapiens
gggcctactagagtctg

SEQ ID NO: 3665378 - DNA, 23 bp, Homo sapiens
gggcctcccataattgctttgcc

SEQ ID NO: 3665379 - DNA, 13 bp, Homo sapiens
gggcctgctccag

SEQ ID NO: 3665380 - DNA, 18 bp, Homo sapiens
gggcctgctccagacctg

SEQ ID NO: 3665381 - DNA, 21 bp, Homo sapiens
gggcctggagatcctcctgca

SEQ ID NO: 3665382 - DNA, 20 bp, Homo sapiens
gggcctttgttctgggggga

SEQ ID NO: 3665383 - DNA, 21 bp, Homo sapiens
gggccttttctggcaccgcag

SEQ ID NO: 3665384 - DNA, 13 bp, Homo sapiens
gggcgccccaaga

SEQ ID NO: 3665385 - DNA, 17 bp, Homo sapiens
gggcggagcgcctcctt

SEQ ID NO: 3665386 - DNA, 17 bp, Homo sapiens
gggcggcaggggcctgg

SEQ ID NO: 3665387 - DNA, 14 bp, Homo sapiens
gggcgggactcctc

SEQ ID NO: 3665388 - DNA, 14 bp, Homo sapiens
gggcgggtcctagc

SEQ ID NO: 3665389 - DNA, 18 bp, Homo sapiens
gggctcagcaaaagatgc

SEQ ID NO: 3665390 - DNA, 15 bp, Homo sapiens
gggctcccctggaca

SEQ ID NO: 3665391 - DNA, 16 bp, Homo sapiens
gggctcctacctgggg

SEQ ID NO: 3665392 - DNA, 15 bp, Homo sapiens
gggctcctcctgaag

SEQ ID NO: 3665393 - DNA, 18 bp, Homo sapiens
gggctcctcctgaaggag

SEQ ID NO: 3665394 - DNA, 23 bp, Homo sapiens
gggctctcatgttttcaactgcc

SEQ ID NO: 3665395 - DNA, 20 bp, Homo sapiens
gggctgactagaagggccag

SEQ ID NO: 3665396 - DNA, 23 bp, Homo sapiens
gggcttttccctgggtggagcag

SEQ ID NO: 3665397 - DNA, 17 bp, Homo sapiens
ggggaaaatcagcctgc

SEQ ID NO: 3665398 - DNA, 19 bp, Homo sapiens
ggggaaaatcagcctgctc

SEQ ID NO: 3665399 - DNA, 24 bp, Homo sapiens
ggggaaaatcagcctgctccagct

SEQ ID NO: 3665400 - DNA, 21 bp, Homo sapiens
ggggaactcagatccagggac

SEQ ID NO: 3665401 - DNA, 15 bp, Homo sapiens
ggggaattcatctct

SEQ ID NO: 3665402 - DNA, 15 bp, Homo sapiens
ggggactcagccctg

SEQ ID NO: 3665403 - DNA, 16 bp, Homo sapiens
ggggactcagccctga

SEQ ID NO: 3665404 - DNA, 12 bp, Homo sapiens
ggggagcatgct

SEQ ID NO: 3665405 - DNA, 11 bp, Homo sapiens
ggggagcccac

SEQ ID NO: 3665406 - DNA, 23 bp, Homo sapiens
ggggaggcccatcccccacctgc

SEQ ID NO: 3665407 - DNA, 14 bp, Homo sapiens
ggggagggattctg

SEQ ID NO: 3665408 - DNA, 22 bp, Homo sapiens
ggggagggcaggtccagctctg

SEQ ID NO: 3665409 - DNA, 14 bp, Homo sapiens
ggggaggggctctg

SEQ ID NO: 3665410 - DNA, 17 bp, Homo sapiens
ggggatcacagcctctg

SEQ ID NO: 3665411 - DNA, 15 bp, Homo sapiens
ggggcagagaataaa

SEQ ID NO: 3665412 - DNA, 15 bp, Homo sapiens
ggggcagagcttctc

SEQ ID NO: 3665413 - DNA, 20 bp, Homo sapiens
ggggcatctgcccctccccc

SEQ ID NO: 3665414 - DNA, 17 bp, Homo sapiens
ggggccagatccagcct

SEQ ID NO: 3665415 - DNA, 19 bp, Homo sapiens
ggggccagatccagcctgg

SEQ ID NO: 3665416 - DNA, 22 bp, Homo sapiens
ggggccatttggccggctctgg

SEQ ID NO: 3665417 - DNA, 13 bp, Homo sapiens
ggggcccggccag

SEQ ID NO: 3665418 - DNA, 16 bp, Homo sapiens
ggggccctacctgggg

SEQ ID NO: 3665419 - DNA, 15 bp, Homo sapiens
gtcacctagcaagct

SEQ ID NO: 3665420 - DNA, 16 bp, Homo sapiens
gtcagcccaagattct

SEQ ID NO: 3665421 - DNA, 17 bp, Homo sapiens
gtcaggctgaaaacaat

SEQ ID NO: 3665422 - DNA, 14 bp, Homo sapiens
gtcagggacccctg

SEQ ID NO: 3665423 - DNA, 19 bp, Homo sapiens
gtcagggtgtgggatctga

SEQ ID NO: 3665424 - DNA, 14 bp, Homo sapiens
gtcaggtactcctg

SEQ ID NO: 3665425 - DNA, 22 bp, Homo sapiens
gtcaggtactcctgccagggaa

SEQ ID NO: 3665426 - DNA, 17 bp, Homo sapiens
gtcagtttttttttgta

SEQ ID NO: 3665427 - DNA, 19 bp, Homo sapiens
gtcatatggaaaaaatgta

SEQ ID NO: 3665428 - DNA, 17 bp, Homo sapiens
gtcatcggcgtggccca

SEQ ID NO: 3665429 - DNA, 22 bp, Homo sapiens
gtcatcttgaccaagcaggaag

SEQ ID NO: 3665430 - DNA, 13 bp, Homo sapiens
gtcatcttgcaca

SEQ ID NO: 3665431 - DNA, 19 bp, Homo sapiens
gtcatcttgcacacacttt

SEQ ID NO: 3665432 - DNA, 18 bp, Homo sapiens
gtcatggagaaccaccta

SEQ ID NO: 3665433 - DNA, 21 bp, Homo sapiens
gtccaaactgcctaagccctc

SEQ ID NO: 3665434 - DNA, 20 bp, Homo sapiens
gtccaaaggaggctggcagg

SEQ ID NO: 3665435 - DNA, 14 bp, Homo sapiens
gtccacagcccctt

SEQ ID NO: 3665436 - DNA, 15 bp, Homo sapiens
gtccaccctgcctgc

SEQ ID NO: 3665437 - DNA, 16 bp, Homo sapiens
gtccacgcgtgccgtg

SEQ ID NO: 3665438 - DNA, 22 bp, Homo sapiens
gtccacgcgtgccgtggcacca

SEQ ID NO: 3665439 - DNA, 18 bp, Homo sapiens
gtccagccccccaggctg

SEQ ID NO: 3665440 - DNA, 23 bp, Homo sapiens
gtccagcctgccccggagctgga

SEQ ID NO: 3665441 - DNA, 11 bp, Homo sapiens
gtccagctctg

SEQ ID NO: 3665442 - DNA, 12 bp, Homo sapiens
gtccagctctgg

SEQ ID NO: 3665443 - DNA, 12 bp, Homo sapiens
gtccagctctgt

SEQ ID NO: 3665444 - DNA, 13 bp, Homo sapiens
gtccagctctgtg

SEQ ID NO: 3665445 - DNA, 16 bp, Homo sapiens
gtccagctctgtgggc

SEQ ID NO: 3665446 - DNA, 13 bp, Homo sapiens
gtccaggctgccg

SEQ ID NO: 3665447 - DNA, 16 bp, Homo sapiens
gtccaggctgccgtgg

SEQ ID NO: 3665448 - DNA, 20 bp, Homo sapiens
gtccagggaagctggccgag

SEQ ID NO: 3665449 - DNA, 14 bp, Homo sapiens
gtcccacagccctg

SEQ ID NO: 3665450 - DNA, 17 bp, Homo sapiens
gtcccacagccctgaga

SEQ ID NO: 3665451 - DNA, 15 bp, Homo sapiens
gtcccagccaccccg

SEQ ID NO: 3665452 - DNA, 21 bp, Homo sapiens
gtcccatccagctaccaccac

SEQ ID NO: 3665453 - DNA, 21 bp, Homo sapiens
gtccccaacccgtgcccctgg

SEQ ID NO: 3665454 - DNA, 21 bp, Homo sapiens
gtccccaggccccaggaagcc

SEQ ID NO: 3665455 - DNA, 12 bp, Homo sapiens
gtccccccaccc

SEQ ID NO: 3665456 - DNA, 18 bp, Homo sapiens
gtcccctcgtcccatcca

SEQ ID NO: 3665457 - DNA, 11 bp, Homo sapiens
gtccctccctt

SEQ ID NO: 3665458 - DNA, 14 bp, Homo sapiens
gtccctccctttcc

SEQ ID NO: 3665459 - DNA, 21 bp, Homo sapiens
gtccctctgccccatcctcca

SEQ ID NO: 3665460 - DNA, 11 bp, Homo sapiens
gtccctctgtg

SEQ ID NO: 3665461 - DNA, 13 bp, Homo sapiens
gtccctctgtgta

SEQ ID NO: 3665462 - DNA, 13 bp, Homo sapiens
gtcccttcccctc

SEQ ID NO: 3665463 - DNA, 18 bp, Homo sapiens
gtcccttcccctccctgg

SEQ ID NO: 3665464 - DNA, 20 bp, Homo sapiens
gtcccttcccctccctggct

SEQ ID NO: 3665465 - DNA, 22 bp, Homo sapiens
gtcccttcccctccctggctcc

SEQ ID NO: 3665466 - DNA, 13 bp, Homo sapiens
gtcccttgcctca

SEQ ID NO: 3665467 - DNA, 19 bp, Homo sapiens
gtcccttgcctcaatgcca

SEQ ID NO: 3665468 - DNA, 13 bp, Homo sapiens
gtccgagctttga

SEQ ID NO: 3665469 - DNA, 21 bp, Homo sapiens
gtccggtccctgtcccagtgc

SEQ ID NO: 3665470 - DNA, 19 bp, Homo sapiens
gtccgtgctgacagctgct

SEQ ID NO: 3665471 - DNA, 14 bp, Homo sapiens
gtcctacccatccc

SEQ ID NO: 3665472 - DNA, 18 bp, Homo sapiens
gtcctacccatccccgca

SEQ ID NO: 3665473 - DNA, 12 bp, Homo sapiens
gtcctcagcctt

SEQ ID NO: 3665474 - DNA, 14 bp, Homo sapiens
gtcctcagccttgc

SEQ ID NO: 3665475 - DNA, 16 bp, Homo sapiens
gtcctcagccttgcca

SEQ ID NO: 3665476 - DNA, 21 bp, Homo sapiens
gtcctcagccttgccagagat

SEQ ID NO: 3665477 - DNA, 18 bp, Homo sapiens
gtcctccagaagcctctg

SEQ ID NO: 3665478 - DNA, 21 bp, Homo sapiens
gtcctccagaagcctctggct

SEQ ID NO: 3665479 - DNA, 12 bp, Homo sapiens
gtcctcccaagc

SEQ ID NO: 3665480 - DNA, 16 bp, Homo sapiens
gtcctcccaagctgtg

SEQ ID NO: 3665481 - DNA, 16 bp, Homo sapiens
gtcctctccctgccaa

SEQ ID NO: 3665482 - DNA, 16 bp, Homo sapiens
gtcctgacctgtctca

SEQ ID NO: 3665483 - DNA, 15 bp, Homo sapiens
gtcctgcctggccag

SEQ ID NO: 3665484 - DNA, 11 bp, Homo sapiens
gtcctgcctgt

SEQ ID NO: 3665485 - DNA, 15 bp, Homo sapiens
gtcctgcctgtggcg

SEQ ID NO: 3665486 - DNA, 17 bp, Homo sapiens
gtcctggatgttgtgtg

SEQ ID NO: 3665487 - DNA, 16 bp, Homo sapiens
gtcctggccatcccac

SEQ ID NO: 3665488 - DNA, 18 bp, Homo sapiens
gtcctggccatcccacaa

SEQ ID NO: 3665489 - DNA, 13 bp, Homo sapiens
gtcctgggcctgc

SEQ ID NO: 3665490 - DNA, 16 bp, Homo sapiens
gtcctggttgtctgaa

SEQ ID NO: 3665491 - DNA, 15 bp, Homo sapiens
gtcctttctggaagt

SEQ ID NO: 3665492 - DNA, 20 bp, Homo sapiens
gtcctttctggaagtttctg

SEQ ID NO: 3665493 - DNA, 16 bp, Homo sapiens
gtcgctcatgtgtgca

SEQ ID NO: 3665494 - DNA, 21 bp, Homo sapiens
gtcgctcatgtgtgcaacagg

SEQ ID NO: 3665495 - DNA, 14 bp, Homo sapiens
gtcggctgaccatg

SEQ ID NO: 3665496 - DNA, 11 bp, Homo sapiens
gtcgggtcccc

SEQ ID NO: 3665497 - DNA, 19 bp, Homo sapiens
gtcgtcactaatacacagt

SEQ ID NO: 3665498 - DNA, 13 bp, Homo sapiens
gtcgtgcctgtgt

SEQ ID NO: 3665499 - DNA, 15 bp, Homo sapiens
gtcgtgcctgtgtcc

SEQ ID NO: 3665500 - DNA, 22 bp, Homo sapiens
gtctaattaaaacactttcaaa

SEQ ID NO: 3665501 - DNA, 15 bp, Homo sapiens
gtctagagagggagg

SEQ ID NO: 3665502 - DNA, 19 bp, Homo sapiens
gtctagatggctcctctca

SEQ ID NO: 3665503 - DNA, 17 bp, Homo sapiens
gtctaggattgggcctc

SEQ ID NO: 3665504 - DNA, 23 bp, Homo sapiens
gtctcacccatgcaagcagagga

SEQ ID NO: 3665505 - DNA, 23 bp, Homo sapiens
gtctcaggagcaccctgtcttct

SEQ ID NO: 3665506 - DNA, 15 bp, Homo sapiens
gtctcatccccaggg

SEQ ID NO: 3665507 - DNA, 21 bp, Homo sapiens
gtctccagagagaaatcaggc

SEQ ID NO: 3665508 - DNA, 14 bp, Homo sapiens
gtctccagggaggg

SEQ ID NO: 3665509 - DNA, 15 bp, Homo sapiens
gtctccaggggctgc

SEQ ID NO: 3665510 - DNA, 20 bp, Homo sapiens
gtctccaggggctgcttcct

SEQ ID NO: 3665511 - DNA, 20 bp, Homo sapiens
gtctcccaggctggagtgca

SEQ ID NO: 3665512 - DNA, 19 bp, Homo sapiens
gtctcccaggtgcatttct

SEQ ID NO: 3665513 - DNA, 22 bp, Homo sapiens
gtctcctctctggtggctgggc

SEQ ID NO: 3665514 - DNA, 22 bp, Homo sapiens
gtctcttcttggggcccagtgc

SEQ ID NO: 3665515 - DNA, 21 bp, Homo sapiens
gtctctttgctttctggtggt

SEQ ID NO: 3665516 - DNA, 19 bp, Homo sapiens
gtctgaacccaggcagctg

SEQ ID NO: 3665517 - DNA, 20 bp, Homo sapiens
gtctgaacccaggcagctgg

SEQ ID NO: 3665518 - DNA, 21 bp, Homo sapiens
gtctgaacccaggcagctggc

SEQ ID NO: 3665519 - DNA, 22 bp, Homo sapiens
gtctgaacccaggcagctggca

SEQ ID NO: 3665520 - DNA, 19 bp, Homo sapiens
gtctgaatggtgcgtgaag

SEQ ID NO: 3665521 - DNA, 15 bp, Homo sapiens
gtctgaccccagccc

SEQ ID NO: 3665522 - DNA, 22 bp, Homo sapiens
gtctgaccccagcccagacagc

SEQ ID NO: 3665523 - DNA, 23 bp, Homo sapiens
gtctgaccccagcccagacagca

SEQ ID NO: 3665524 - DNA, 23 bp, Homo sapiens
gtctgccggacccggaggccgag

SEQ ID NO: 3665525 - DNA, 19 bp, Homo sapiens
gtctgctctttctctgcca

SEQ ID NO: 3665526 - DNA, 22 bp, Homo sapiens
gtctgctctttctctgccagtg

SEQ ID NO: 3665527 - DNA, 21 bp, Homo sapiens
gtctggagttgatctggaacc

SEQ ID NO: 3665528 - DNA, 19 bp, Homo sapiens
gtctgtatttatgtgtgag

SEQ ID NO: 3665529 - DNA, 21 bp, Homo sapiens
gtctgtcaatcacagtctcag

SEQ ID NO: 3665530 - DNA, 22 bp, Homo sapiens
gtctgtgccatttctcagggaa

SEQ ID NO: 3665531 - DNA, 19 bp, Homo sapiens
gtctgttggcaggctggcc

SEQ ID NO: 3665532 - DNA, 22 bp, Homo sapiens
gtctgttggcaggctggccagt

SEQ ID NO: 3665533 - DNA, 13 bp, Homo sapiens
gtctgtttactgc

SEQ ID NO: 3665534 - DNA, 15 bp, Homo sapiens
gtcttcacggcagga

SEQ ID NO: 3665535 - DNA, 23 bp, Homo sapiens
gttgctgttttcctcccttctgc

SEQ ID NO: 3665536 - DNA, 22 bp, Homo sapiens
gttggaggtgattccagtgaag

SEQ ID NO: 3665537 - DNA, 15 bp, Homo sapiens
gttggcaggctggcc

SEQ ID NO: 3665538 - DNA, 16 bp, Homo sapiens
gttggcaggctggcca

SEQ ID NO: 3665539 - DNA, 20 bp, Homo sapiens
gttggcaggctggccagtcc

SEQ ID NO: 3665540 - DNA, 13 bp, Homo sapiens
gttgggcccagat

SEQ ID NO: 3665541 - DNA, 15 bp, Homo sapiens
gttgtctgaacccag

SEQ ID NO: 3665542 - DNA, 20 bp, Homo sapiens
gttgtctgaacccaggcagc

SEQ ID NO: 3665543 - DNA, 21 bp, Homo sapiens
gttgtctgaacccaggcagct

SEQ ID NO: 3665544 - DNA, 16 bp, Homo sapiens
gtttaaaaagtttcta

SEQ ID NO: 3665545 - DNA, 21 bp, Homo sapiens
gtttacatttgatgcatgtct

SEQ ID NO: 3665546 - DNA, 18 bp, Homo sapiens
gtttaggctggtggccca

SEQ ID NO: 3665547 - DNA, 21 bp, Homo sapiens
gtttatgagatgctggttttc

SEQ ID NO: 3665548 - DNA, 18 bp, Homo sapiens
gtttatggcctcagctgc

SEQ ID NO: 3665549 - DNA, 23 bp, Homo sapiens
gtttatggcctcagctgcctcac

SEQ ID NO: 3665550 - DNA, 20 bp, Homo sapiens
gtttattcttccaacacatt

SEQ ID NO: 3665551 - DNA, 17 bp, Homo sapiens
gtttattttctacgttt

SEQ ID NO: 3665552 - DNA, 23 bp, Homo sapiens
gtttattttctacgtttctttaa

SEQ ID NO: 3665553 - DNA, 19 bp, Homo sapiens
gtttcaaaataaaaaccaa

SEQ ID NO: 3665554 - DNA, 18 bp, Homo sapiens
gtttcagcgactccgttg

SEQ ID NO: 3665555 - DNA, 17 bp, Homo sapiens
gtttccagcagaagaca

SEQ ID NO: 3665556 - DNA, 14 bp, Homo sapiens
gtttccagggaggg

SEQ ID NO: 3665557 - DNA, 13 bp, Homo sapiens
gtttccgtgcgtg

SEQ ID NO: 3665558 - DNA, 22 bp, Homo sapiens
gtttcctgaaacaacttggaaa

SEQ ID NO: 3665559 - DNA, 21 bp, Homo sapiens
gtttctttaaccttgtataaa

SEQ ID NO: 3665560 - DNA, 13 bp, Homo sapiens
gtttgaatataaa

SEQ ID NO: 3665561 - DNA, 19 bp, Homo sapiens
gtttgaatataaacactat

SEQ ID NO: 3665562 - DNA, 17 bp, Homo sapiens
gtttgcaaggaagccac

SEQ ID NO: 3665563 - DNA, 15 bp, Homo sapiens
gtttgccttccagaa

SEQ ID NO: 3665564 - DNA, 21 bp, Homo sapiens
gtttgctttctgatcaaggcc

SEQ ID NO: 3665565 - DNA, 17 bp, Homo sapiens
gtttggaaaagtggcgt

SEQ ID NO: 3665566 - DNA, 13 bp, Homo sapiens
gtttgtaaatgcc

SEQ ID NO: 3665567 - DNA, 14 bp, Homo sapiens
gtttgtaaatgcct

SEQ ID NO: 3665568 - DNA, 22 bp, Homo sapiens
gtttgtcctgatgcttttgtct

SEQ ID NO: 3665569 - DNA, 13 bp, Homo sapiens
gtttgtggcctca

SEQ ID NO: 3665570 - DNA, 22 bp, Homo sapiens
gtttgtttaaacacttatcttc

SEQ ID NO: 3665571 - DNA, 12 bp, Homo sapiens
gtttgtttggct

SEQ ID NO: 3665572 - DNA, 21 bp, Homo sapiens
gttttaaaactggacctgtat

SEQ ID NO: 3665573 - DNA, 15 bp, Homo sapiens
gttttaatgtaattt

SEQ ID NO: 3665574 - DNA, 18 bp, Homo sapiens
gttttatagcctggactg

SEQ ID NO: 3665575 - DNA, 17 bp, Homo sapiens
gttttcctatgctttga

SEQ ID NO: 3665576 - DNA, 18 bp, Homo sapiens
gttttcctcccttctgct

SEQ ID NO: 3665577 - DNA, 12 bp, Homo sapiens
gttttgaggaat

SEQ ID NO: 3665578 - DNA, 22 bp, Homo sapiens
gttttgatgtttgtggcctcag

SEQ ID NO: 3665579 - DNA, 20 bp, Homo sapiens
gttttggctgaaattctcct

SEQ ID NO: 3665580 - DNA, 17 bp, Homo sapiens
gttttgtgtaacatatt

SEQ ID NO: 3665581 - DNA, 12 bp, Homo sapiens
gtttttgagact

SEQ ID NO: 3665582 - DNA, 13 bp, Homo sapiens
gtttttgagactg

SEQ ID NO: 3665583 - DNA, 14 bp, Homo sapiens
gttttttcaaaata

SEQ ID NO: 3665584 - DNA, 16 bp, Homo sapiens
gttttttcctttgctc

SEQ ID NO: 3665585 - DNA, 20 bp, Homo sapiens
taaaaaactgctgactgttt

SEQ ID NO: 3665586 - DNA, 23 bp, Homo sapiens
taaaaaactgctgactgttttct

SEQ ID NO: 3665587 - DNA, 13 bp, Homo sapiens
taaaaaatatttt

SEQ ID NO: 3665588 - DNA, 16 bp, Homo sapiens
taaaaaatattttctc

SEQ ID NO: 3665589 - DNA, 18 bp, Homo sapiens
taaaaaatattttctctg

SEQ ID NO: 3665590 - DNA, 18 bp, Homo sapiens
taaaaagagactgtgcca

SEQ ID NO: 3665591 - DNA, 16 bp, Homo sapiens
taaaaaggatctcctt

SEQ ID NO: 3665592 - DNA, 19 bp, Homo sapiens
taaaaaggcacctataaaa

SEQ ID NO: 3665593 - DNA, 23 bp, Homo sapiens
taaaaatctgagaaactctacat

SEQ ID NO: 3665594 - DNA, 22 bp, Homo sapiens
taaaaattgttaatttttccta

SEQ ID NO: 3665595 - DNA, 23 bp, Homo sapiens
taaaaattgtttcaaaataaaaa

SEQ ID NO: 3665596 - DNA, 17 bp, Homo sapiens
taaaacatcattactat

SEQ ID NO: 3665597 - DNA, 15 bp, Homo sapiens
taaaagatgctttta

SEQ ID NO: 3665598 - DNA, 19 bp, Homo sapiens
taaaagtagaagcatgttt

SEQ ID NO: 3665599 - DNA, 18 bp, Homo sapiens
taaaatggatgccttgaa

SEQ ID NO: 3665600 - DNA, 18 bp, Homo sapiens
taaaatggctgtaatcat

SEQ ID NO: 3665601 - DNA, 16 bp, Homo sapiens
taaaattaaagctgaa

SEQ ID NO: 3665602 - DNA, 16 bp, Homo sapiens
taaaattacttggctt

SEQ ID NO: 3665603 - DNA, 12 bp, Homo sapiens
taaacaaatgta

SEQ ID NO: 3665604 - DNA, 19 bp, Homo sapiens
taaacacttatcttctgga

SEQ ID NO: 3665605 - DNA, 16 bp, Homo sapiens
taaaccgccaaggctg

SEQ ID NO: 3665606 - DNA, 23 bp, Homo sapiens
taaacggggcagtactcctccct

SEQ ID NO: 3665607 - DNA, 13 bp, Homo sapiens
taaactgtgttta

SEQ ID NO: 3665608 - DNA, 16 bp, Homo sapiens
taaagaaagcaacttt

SEQ ID NO: 3665609 - DNA, 14 bp, Homo sapiens
taaagagtgtggca

SEQ ID NO: 3665610 - DNA, 18 bp, Homo sapiens
taaagagttagtttgagt

SEQ ID NO: 3665611 - DNA, 22 bp, Homo sapiens
taaagatgcaaggaccaggact

SEQ ID NO: 3665612 - DNA, 15 bp, Homo sapiens
taaagccatgctgga

SEQ ID NO: 3665613 - DNA, 14 bp, Homo sapiens
taaagctgaaaact

SEQ ID NO: 3665614 - DNA, 17 bp, Homo sapiens
taaagtagtcctgtgaa

SEQ ID NO: 3665615 - DNA, 22 bp, Homo sapiens
taaagtgaattgttgacaaatg

SEQ ID NO: 3665616 - DNA, 13 bp, Homo sapiens
taaagttatattt

SEQ ID NO: 3665617 - DNA, 16 bp, Homo sapiens
taaagttatatttcag

SEQ ID NO: 3665618 - DNA, 23 bp, Homo sapiens
taaatatttgactttagtgaaag

SEQ ID NO: 3665619 - DNA, 17 bp, Homo sapiens
taaatattttctatttt

SEQ ID NO: 3665620 - DNA, 19 bp, Homo sapiens
taaatcaagttggcttcta

SEQ ID NO: 3665621 - DNA, 19 bp, Homo sapiens
taaatcttaatacttgaac

SEQ ID NO: 3665622 - DNA, 16 bp, Homo sapiens
taaatgattttatgtt

SEQ ID NO: 3665623 - DNA, 15 bp, Homo sapiens
taaatgccctcttct

SEQ ID NO: 3665624 - DNA, 20 bp, Homo sapiens
taaatgtctagttgtaacac

SEQ ID NO: 3665625 - DNA, 13 bp, Homo sapiens
taaattacaattt

SEQ ID NO: 3665626 - DNA, 23 bp, Homo sapiens
taaattacaattttatctgtttc

SEQ ID NO: 3665627 - DNA, 21 bp, Homo sapiens
taaattatatttgtgctatag

SEQ ID NO: 3665628 - DNA, 18 bp, Homo sapiens
taaattcctctttgcttt

SEQ ID NO: 3665629 - DNA, 17 bp, Homo sapiens
taacaaaggcagctgtg

SEQ ID NO: 3665630 - DNA, 24 bp, Homo sapiens
taacaataatatttcaagtgccta

SEQ ID NO: 3665631 - DNA, 21 bp, Homo sapiens
taacaatctaacaataatatt

SEQ ID NO: 3665632 - DNA, 16 bp, Homo sapiens
taacaattaggcagac

SEQ ID NO: 3665633 - DNA, 22 bp, Homo sapiens
taacacttcttacgcaatgctt

SEQ ID NO: 3665634 - DNA, 15 bp, Homo sapiens
taacagtggagctga

SEQ ID NO: 3665635 - DNA, 12 bp, Homo sapiens
taacatttaaat

SEQ ID NO: 3665636 - DNA, 13 bp, Homo sapiens
taacatttaaatt

SEQ ID NO: 3665637 - DNA, 14 bp, Homo sapiens
taacatttaaattc

SEQ ID NO: 3665638 - DNA, 22 bp, Homo sapiens
taaccagatctagtcaatcaag

SEQ ID NO: 3665639 - DNA, 20 bp, Homo sapiens
taaccctggtggttgctgtt

SEQ ID NO: 3665640 - DNA, 13 bp, Homo sapiens
taaccttgtataa

SEQ ID NO: 3665641 - DNA, 15 bp, Homo sapiens
taactgccaatcctt

SEQ ID NO: 3665642 - DNA, 18 bp, Homo sapiens
taactggagccccatcag

SEQ ID NO: 3665643 - DNA, 20 bp, Homo sapiens
taactggtgcactttgtaaa

SEQ ID NO: 3665644 - DNA, 22 bp, Homo sapiens
taactggtgcactttgtaaatt

SEQ ID NO: 3665645 - DNA, 13 bp, Homo sapiens
taactgtaaatca

SEQ ID NO: 3665646 - DNA, 17 bp, Homo sapiens
taacttggtcagagcca

SEQ ID NO: 3665647 - DNA, 15 bp, Homo sapiens
taacttttattatct

SEQ ID NO: 3665648 - DNA, 19 bp, Homo sapiens
taagaaatgtagctgaagt

SEQ ID NO: 3665649 - DNA, 10 bp, Homo sapiens
taagaattgt

SEQ ID NO: 3665650 - DNA, 14 bp, Homo sapiens
taagacaacaggca

SEQ ID NO: 3665651 - DNA, 17 bp, Homo sapiens
tatagaatagcctgagg

SEQ ID NO: 3665652 - DNA, 16 bp, Homo sapiens
tatagctacaggaagc

SEQ ID NO: 3665653 - DNA, 19 bp, Homo sapiens
tatagtatttgattcaaaa

SEQ ID NO: 3665654 - DNA, 12 bp, Homo sapiens
tatataatatct

SEQ ID NO: 3665655 - DNA, 15 bp, Homo sapiens
tatatatacatatat

SEQ ID NO: 3665656 - DNA, 11 bp, Homo sapiens
tatatatataa

SEQ ID NO: 3665657 - DNA, 14 bp, Homo sapiens
tatatatatataac

SEQ ID NO: 3665658 - DNA, 14 bp, Homo sapiens
tatatattttaatt

SEQ ID NO: 3665659 - DNA, 17 bp, Homo sapiens
tatatctatatatataa

SEQ ID NO: 3665660 - DNA, 14 bp, Homo sapiens
tatatgaaaacctg

SEQ ID NO: 3665661 - DNA, 17 bp, Homo sapiens
tatatgtatttttatat

SEQ ID NO: 3665662 - DNA, 15 bp, Homo sapiens
tatattaaggcagta

SEQ ID NO: 3665663 - DNA, 14 bp, Homo sapiens
tatattatttacat

SEQ ID NO: 3665664 - DNA, 16 bp, Homo sapiens
tatatttcagatgtaa

SEQ ID NO: 3665665 - DNA, 22 bp, Homo sapiens
tatatttgggcctgctccagac

SEQ ID NO: 3665666 - DNA, 15 bp, Homo sapiens
tatatttgtaaagct

SEQ ID NO: 3665667 - DNA, 16 bp, Homo sapiens
tatatttgtgctatag

SEQ ID NO: 3665668 - DNA, 21 bp, Homo sapiens
tatatttgtgctatagtattt

SEQ ID NO: 3665669 - DNA, 23 bp, Homo sapiens
tatcaaatgcagtatatttcttc

SEQ ID NO: 3665670 - DNA, 19 bp, Homo sapiens
tatcaacttcctaaatatt

SEQ ID NO: 3665671 - DNA, 17 bp, Homo sapiens
tatcacctcattctgaa

SEQ ID NO: 3665672 - DNA, 14 bp, Homo sapiens
tatcagcaaaaaag

SEQ ID NO: 3665673 - DNA, 23 bp, Homo sapiens
tatcagtttgctagcagaaatct

SEQ ID NO: 3665674 - DNA, 16 bp, Homo sapiens
tatcatattattatcc

SEQ ID NO: 3665675 - DNA, 16 bp, Homo sapiens
tatcatgtcaaacgtg

SEQ ID NO: 3665676 - DNA, 17 bp, Homo sapiens
tatccatatagaaatct

SEQ ID NO: 3665677 - DNA, 15 bp, Homo sapiens
tatccccccatcttg

SEQ ID NO: 3665678 - DNA, 16 bp, Homo sapiens
tatccctggttgcctc

SEQ ID NO: 3665679 - DNA, 16 bp, Homo sapiens
tatcctcctgttctga

SEQ ID NO: 3665680 - DNA, 14 bp, Homo sapiens
tatccttctacttg

SEQ ID NO: 3665681 - DNA, 23 bp, Homo sapiens
tatcgacttgtttttgcacatgt

SEQ ID NO: 3665682 - DNA, 14 bp, Homo sapiens
tatctaaaccatat

SEQ ID NO: 3665683 - DNA, 18 bp, Homo sapiens
tatctaaagttatatttc

SEQ ID NO: 3665684 - DNA, 20 bp, Homo sapiens
tatctaaagttatatttcag

SEQ ID NO: 3665685 - DNA, 13 bp, Homo sapiens
tatctcaggtctg

SEQ ID NO: 3665686 - DNA, 18 bp, Homo sapiens
tatctccctggagaagca

SEQ ID NO: 3665687 - DNA, 19 bp, Homo sapiens
tatctccctggagaagcac

SEQ ID NO: 3665688 - DNA, 14 bp, Homo sapiens
tatctcctggaaca

SEQ ID NO: 3665689 - DNA, 17 bp, Homo sapiens
tatctcctggaacacta

SEQ ID NO: 3665690 - DNA, 17 bp, Homo sapiens
tatctctatttgagaat

SEQ ID NO: 3665691 - DNA, 17 bp, Homo sapiens
tatctgggtaagaagaa

SEQ ID NO: 3665692 - DNA, 22 bp, Homo sapiens
tatctgggtaagaagaaagcaa

SEQ ID NO: 3665693 - DNA, 22 bp, Homo sapiens
tatctgtttcctgacattgtct

SEQ ID NO: 3665694 - DNA, 19 bp, Homo sapiens
tatcttagatgtttcacac

SEQ ID NO: 3665695 - DNA, 18 bp, Homo sapiens
tatcttatactgtacaat

SEQ ID NO: 3665696 - DNA, 15 bp, Homo sapiens
tatctttaagaaaaa

SEQ ID NO: 3665697 - DNA, 16 bp, Homo sapiens
tatgaccttctaggaa

SEQ ID NO: 3665698 - DNA, 13 bp, Homo sapiens
tatgactttttat

SEQ ID NO: 3665699 - DNA, 19 bp, Homo sapiens
tatgactttttataaaatg

SEQ ID NO: 3665700 - DNA, 15 bp, Homo sapiens
tatgatttggaaaat

SEQ ID NO: 3665701 - DNA, 18 bp, Homo sapiens
tatgatttggaaaataaa

SEQ ID NO: 3665702 - DNA, 18 bp, Homo sapiens
tatgcatggtgccccagg

SEQ ID NO: 3665703 - DNA, 19 bp, Homo sapiens
tatgctgctttaacagtgg

SEQ ID NO: 3665704 - DNA, 21 bp, Homo sapiens
tatggactatctgtctggtgg

SEQ ID NO: 3665705 - DNA, 23 bp, Homo sapiens
tatggcctcagctgcctcacttc

SEQ ID NO: 3665706 - DNA, 16 bp, Homo sapiens
tatgggagccccaggg

SEQ ID NO: 3665707 - DNA, 17 bp, Homo sapiens
tatggtaccagatgcag

SEQ ID NO: 3665708 - DNA, 14 bp, Homo sapiens
tatgtaccaagaat

SEQ ID NO: 3665709 - DNA, 13 bp, Homo sapiens
tatgtatgttaat

SEQ ID NO: 3665710 - DNA, 15 bp, Homo sapiens
tatgtctgtgccatt

SEQ ID NO: 3665711 - DNA, 21 bp, Homo sapiens
tatgtgtatgttgacttttta

SEQ ID NO: 3665712 - DNA, 12 bp, Homo sapiens
tatgtgtctccc

SEQ ID NO: 3665713 - DNA, 18 bp, Homo sapiens
tatgtgtctcccaggtgc

SEQ ID NO: 3665714 - DNA, 18 bp, Homo sapiens
tatgtttttaatatgcat

SEQ ID NO: 3665715 - DNA, 20 bp, Homo sapiens
tattaaaaaggtttacagaa

SEQ ID NO: 3665716 - DNA, 14 bp, Homo sapiens
tattaaggaagaca

SEQ ID NO: 3665717 - DNA, 13 bp, Homo sapiens
tattaattgcttt

SEQ ID NO: 3665718 - DNA, 17 bp, Homo sapiens
tattacatatatcatta

SEQ ID NO: 3665719 - DNA, 22 bp, Homo sapiens
tattactcccaggatcagcaga

SEQ ID NO: 3665720 - DNA, 22 bp, Homo sapiens
tattagtggtttatcagcaaaa

SEQ ID NO: 3665721 - DNA, 22 bp, Homo sapiens
tattatcctaagggaagataaa

SEQ ID NO: 3665722 - DNA, 22 bp, Homo sapiens
tattatcctcctgttctgaaac

SEQ ID NO: 3665723 - DNA, 14 bp, Homo sapiens
tattatccttctac

SEQ ID NO: 3665724 - DNA, 21 bp, Homo sapiens
tattcacatcgcttctgtgta

SEQ ID NO: 3665725 - DNA, 13 bp, Homo sapiens
tattcagacagat

SEQ ID NO: 3665726 - DNA, 20 bp, Homo sapiens
tattcatgaagcggtcacag

SEQ ID NO: 3665727 - DNA, 17 bp, Homo sapiens
tattctatgtatgttaa

SEQ ID NO: 3665728 - DNA, 18 bp, Homo sapiens
tattcttccaacacattt

SEQ ID NO: 3665729 - DNA, 21 bp, Homo sapiens
tattgccttttaatttttaat

SEQ ID NO: 3665730 - DNA, 17 bp, Homo sapiens
tattggacaaagaacct

SEQ ID NO: 3665731 - DNA, 19 bp, Homo sapiens
tattgtctgtctacatttc

SEQ ID NO: 3665732 - DNA, 20 bp, Homo sapiens
tattgtctgtctacatttct

SEQ ID NO: 3665733 - DNA, 24 bp, Homo sapiens
tatttaaactctgttgcaagtgca

SEQ ID NO: 3665734 - DNA, 22 bp, Homo sapiens
tatttaactggtgcactttgta

SEQ ID NO: 3665735 - DNA, 12 bp, Homo sapiens
tatttaatgttt

SEQ ID NO: 3665736 - DNA, 15 bp, Homo sapiens
tatttaatgttttaa

SEQ ID NO: 3665737 - DNA, 20 bp, Homo sapiens
tatttaatgttttaaatgta

SEQ ID NO: 3665738 - DNA, 22 bp, Homo sapiens
tatttaatgttttaaatgtaca

SEQ ID NO: 3665739 - DNA, 10 bp, Homo sapiens
tatttacatt

SEQ ID NO: 3665740 - DNA, 14 bp, Homo sapiens
tatttatgtgtgag

SEQ ID NO: 3665741 - DNA, 16 bp, Homo sapiens
tatttattggtcaggg

SEQ ID NO: 3665742 - DNA, 21 bp, Homo sapiens
tatttcagatgtaatgttttc

SEQ ID NO: 3665743 - DNA, 14 bp, Homo sapiens
tatttctattatta

SEQ ID NO: 3665744 - DNA, 13 bp, Homo sapiens
tatttcttaaaca

SEQ ID NO: 3665745 - DNA, 20 bp, Homo sapiens
tatttcttaaacaaatgtat

SEQ ID NO: 3665746 - DNA, 15 bp, Homo sapiens
tatttgaacaagtgg

SEQ ID NO: 3665747 - DNA, 15 bp, Homo sapiens
tatttgattcaaaat

SEQ ID NO: 3665748 - DNA, 17 bp, Homo sapiens
tatttgattcaaaatat

SEQ ID NO: 3665749 - DNA, 18 bp, Homo sapiens
tatttgcagtcatggaga

SEQ ID NO: 3665750 - DNA, 11 bp, Homo sapiens
tatttgctttt

SEQ ID NO: 3665751 - DNA, 22 bp, Homo sapiens
tattttaaaggggtctgaaatt

SEQ ID NO: 3665752 - DNA, 17 bp, Homo sapiens
tattttatttatttaat

SEQ ID NO: 3665753 - DNA, 20 bp, Homo sapiens
tattttccatgaaaatgcaa

SEQ ID NO: 3665754 - DNA, 14 bp, Homo sapiens
tattttctacgttt

SEQ ID NO: 3665755 - DNA, 20 bp, Homo sapiens
tattttctacgtttctttaa

SEQ ID NO: 3665756 - DNA, 16 bp, Homo sapiens
tattttgctgatttaa

SEQ ID NO: 3665757 - DNA, 13 bp, Homo sapiens
tattttgtgtaaa

SEQ ID NO: 3665758 - DNA, 13 bp, Homo sapiens
tatttttaatcag

SEQ ID NO: 3665759 - DNA, 14 bp, Homo sapiens
tatttttgtagtga

SEQ ID NO: 3665760 - DNA, 13 bp, Homo sapiens
tatttttgttgtt

SEQ ID NO: 3665761 - DNA, 11 bp, Homo sapiens
tattttttcct

SEQ ID NO: 3665762 - DNA, 14 bp, Homo sapiens
tattttttcctttt

SEQ ID NO: 3665763 - DNA, 18 bp, Homo sapiens
tatttttttaaagtgatt

SEQ ID NO: 3665764 - DNA, 15 bp, Homo sapiens
tcaaaagcattgtct

SEQ ID NO: 3665765 - DNA, 13 bp, Homo sapiens
tcaaaataaaaac

SEQ ID NO: 3665766 - DNA, 20 bp, Homo sapiens
tcaaaataaaaaccaagaag

SEQ ID NO: 3665767 - DNA, 15 bp, Homo sapiens
tcaaaatatcctaag

SEQ ID NO: 3665768 - DNA, 22 bp, Homo sapiens
tcccaccaggctgctcagggct

SEQ ID NO: 3665769 - DNA, 11 bp, Homo sapiens
tcccacccacc

SEQ ID NO: 3665770 - DNA, 16 bp, Homo sapiens
tcccacccacctcacc

SEQ ID NO: 3665771 - DNA, 17 bp, Homo sapiens
tcccacccccttctctg

SEQ ID NO: 3665772 - DNA, 20 bp, Homo sapiens
tcccacccccttctctgctc

SEQ ID NO: 3665773 - DNA, 20 bp, Homo sapiens
tcccagaacacactccatca

SEQ ID NO: 3665774 - DNA, 16 bp, Homo sapiens
tcccagatacttgggg

SEQ ID NO: 3665775 - DNA, 20 bp, Homo sapiens
tcccagccaccccgggctct

SEQ ID NO: 3665776 - DNA, 13 bp, Homo sapiens
tcccagcccccaa

SEQ ID NO: 3665777 - DNA, 13 bp, Homo sapiens
tcccaggaccctg

SEQ ID NO: 3665778 - DNA, 20 bp, Homo sapiens
tcccaggatcagcagaagat

SEQ ID NO: 3665779 - DNA, 20 bp, Homo sapiens
tcccaggctggagtgcagtg

SEQ ID NO: 3665780 - DNA, 23 bp, Homo sapiens
tcccaggctggagtgcagtgaca

SEQ ID NO: 3665781 - DNA, 16 bp, Homo sapiens
tcccagggacacctgg

SEQ ID NO: 3665782 - DNA, 17 bp, Homo sapiens
tcccagttcttcctgca

SEQ ID NO: 3665783 - DNA, 21 bp, Homo sapiens
tcccataattgctttgccaaa

SEQ ID NO: 3665784 - DNA, 15 bp, Homo sapiens
tcccatgatccctgt

SEQ ID NO: 3665785 - DNA, 15 bp, Homo sapiens
tcccattcctgaaga

SEQ ID NO: 3665786 - DNA, 17 bp, Homo sapiens
tcccattcctgaagaac

SEQ ID NO: 3665787 - DNA, 18 bp, Homo sapiens
tcccattgtccctctgcc

SEQ ID NO: 3665788 - DNA, 21 bp, Homo sapiens
tcccattgtccctctgcccca

SEQ ID NO: 3665789 - DNA, 23 bp, Homo sapiens
tccccaaccccctgtaaggttcc

SEQ ID NO: 3665790 - DNA, 23 bp, Homo sapiens
tccccaacccgtgcccctgggat

SEQ ID NO: 3665791 - DNA, 15 bp, Homo sapiens
tccccacaggtgaaa

SEQ ID NO: 3665792 - DNA, 11 bp, Homo sapiens
tccccagagaa

SEQ ID NO: 3665793 - DNA, 20 bp, Homo sapiens
tccccagcattccagcccct

SEQ ID NO: 3665794 - DNA, 14 bp, Homo sapiens
tccccagcccagag

SEQ ID NO: 3665795 - DNA, 11 bp, Homo sapiens
tccccaggccc

SEQ ID NO: 3665796 - DNA, 19 bp, Homo sapiens
tccccaggccccaggaagc

SEQ ID NO: 3665797 - DNA, 18 bp, Homo sapiens
tccccaggggtcccagcc

SEQ ID NO: 3665798 - DNA, 14 bp, Homo sapiens
tcccccaaccccca

SEQ ID NO: 3665799 - DNA, 16 bp, Homo sapiens
tcccccaacccccacc

SEQ ID NO: 3665800 - DNA, 20 bp, Homo sapiens
tcccccaacccccaccccac

SEQ ID NO: 3665801 - DNA, 18 bp, Homo sapiens
tccccctggacggggcgg

SEQ ID NO: 3665802 - DNA, 14 bp, Homo sapiens
tcccccttcacaaa

SEQ ID NO: 3665803 - DNA, 15 bp, Homo sapiens
tcccccttcacaaag

SEQ ID NO: 3665804 - DNA, 20 bp, Homo sapiens
tccccgcagtgtgcactaag

SEQ ID NO: 3665805 - DNA, 15 bp, Homo sapiens
tccccgctgctgtgc

SEQ ID NO: 3665806 - DNA, 22 bp, Homo sapiens
tccccggcatgagactcagtgc

SEQ ID NO: 3665807 - DNA, 13 bp, Homo sapiens
tcccctccctggc

SEQ ID NO: 3665808 - DNA, 16 bp, Homo sapiens
tcccctccctggctcc

SEQ ID NO: 3665809 - DNA, 19 bp, Homo sapiens
tcccctccctggctcccat

SEQ ID NO: 3665810 - DNA, 17 bp, Homo sapiens
tcccctccgccaggcga

SEQ ID NO: 3665811 - DNA, 14 bp, Homo sapiens
tcccctcctcactc

SEQ ID NO: 3665812 - DNA, 13 bp, Homo sapiens
tcccctgccacca

SEQ ID NO: 3665813 - DNA, 17 bp, Homo sapiens
tcccctgccaccaggcc

SEQ ID NO: 3665814 - DNA, 16 bp, Homo sapiens
tcccggctccagagca

SEQ ID NO: 3665815 - DNA, 20 bp, Homo sapiens
tcccggctccagagcaggaa

SEQ ID NO: 3665816 - DNA, 22 bp, Homo sapiens
tcccgtccctccctttcctccg

SEQ ID NO: 3665817 - DNA, 13 bp, Homo sapiens
tcccgtgttgctt

SEQ ID NO: 3665818 - DNA, 17 bp, Homo sapiens
tccctacctcaggcagg

SEQ ID NO: 3665819 - DNA, 17 bp, Homo sapiens
tccctatactgcttgga

SEQ ID NO: 3665820 - DNA, 15 bp, Homo sapiens
tccctcacccccatg

SEQ ID NO: 3665821 - DNA, 15 bp, Homo sapiens
tccctccaacacaga

SEQ ID NO: 3665822 - DNA, 12 bp, Homo sapiens
tccctccccccc

SEQ ID NO: 3665823 - DNA, 14 bp, Homo sapiens
tccctcccctgccc

SEQ ID NO: 3665824 - DNA, 17 bp, Homo sapiens
tccctcccctgccctgg

SEQ ID NO: 3665825 - DNA, 12 bp, Homo sapiens
tccctcctcacc

SEQ ID NO: 3665826 - DNA, 17 bp, Homo sapiens
tccctcctcacctctgg

SEQ ID NO: 3665827 - DNA, 12 bp, Homo sapiens
tccctctctctt

SEQ ID NO: 3665828 - DNA, 23 bp, Homo sapiens
tccctctctcttctgctccaccc

SEQ ID NO: 3665829 - DNA, 13 bp, Homo sapiens
tccctctgcccca

SEQ ID NO: 3665830 - DNA, 20 bp, Homo sapiens
tccctgagggcggagcgcct

SEQ ID NO: 3665831 - DNA, 12 bp, Homo sapiens
tccctgcagctg

SEQ ID NO: 3665832 - DNA, 13 bp, Homo sapiens
tccctgcagctga

SEQ ID NO: 3665833 - DNA, 16 bp, Homo sapiens
tccctgcatctgacca

SEQ ID NO: 3665834 - DNA, 20 bp, Homo sapiens
tccctgcatctgaccagcag

SEQ ID NO: 3665835 - DNA, 21 bp, Homo sapiens
tccctgcatctgaccagcagc

SEQ ID NO: 3665836 - DNA, 19 bp, Homo sapiens
tccctgccctcgggtctcc

SEQ ID NO: 3665837 - DNA, 20 bp, Homo sapiens
tccctgccctcgggtctccc

SEQ ID NO: 3665838 - DNA, 15 bp, Homo sapiens
tccctggagaagcac

SEQ ID NO: 3665839 - DNA, 22 bp, Homo sapiens
tccctgggaaccgccctcctga

SEQ ID NO: 3665840 - DNA, 20 bp, Homo sapiens
tccctggggaaaacttgcag

SEQ ID NO: 3665841 - DNA, 18 bp, Homo sapiens
tccctggggacggggctc

SEQ ID NO: 3665842 - DNA, 15 bp, Homo sapiens
tccctgggggtgggg

SEQ ID NO: 3665843 - DNA, 21 bp, Homo sapiens
tccctgggggtggggctccta

SEQ ID NO: 3665844 - DNA, 23 bp, Homo sapiens
tccctgggggtggggctcctacc

SEQ ID NO: 3665845 - DNA, 11 bp, Homo sapiens
tccctgggtgg

SEQ ID NO: 3665846 - DNA, 15 bp, Homo sapiens
tccctgggtggagca

SEQ ID NO: 3665847 - DNA, 20 bp, Homo sapiens
tccctgggtggagcaggact

SEQ ID NO: 3665848 - DNA, 15 bp, Homo sapiens
tccctgttccccaga

SEQ ID NO: 3665849 - DNA, 17 bp, Homo sapiens
tccctgttccccagaga

SEQ ID NO: 3665850 - DNA, 17 bp, Homo sapiens
tcccttcctctgtgcca

SEQ ID NO: 3665851 - DNA, 20 bp, Homo sapiens
tcccttctgctactggcaaa

SEQ ID NO: 3665852 - DNA, 21 bp, Homo sapiens
tcccttgcttgcctgcagggc

SEQ ID NO: 3665853 - DNA, 16 bp, Homo sapiens
tcccttggcctcagaa

SEQ ID NO: 3665854 - DNA, 15 bp, Homo sapiens
tccgatgaattctta

SEQ ID NO: 3665855 - DNA, 14 bp, Homo sapiens
tccgatggtatctg

SEQ ID NO: 3665856 - DNA, 13 bp, Homo sapiens
tccgccctgccac

SEQ ID NO: 3665857 - DNA, 16 bp, Homo sapiens
tccgcgggtgggactc

SEQ ID NO: 3665858 - DNA, 19 bp, Homo sapiens
tccgcgtgtgcctgtgtgc

SEQ ID NO: 3665859 - DNA, 18 bp, Homo sapiens
tccggcctctgcctttgc

SEQ ID NO: 3665860 - DNA, 15 bp, Homo sapiens
tccgtatctccctgg

SEQ ID NO: 3665861 - DNA, 20 bp, Homo sapiens
tccgtatctccctggagaag

SEQ ID NO: 3665862 - DNA, 13 bp, Homo sapiens
tccgtgctgacag

SEQ ID NO: 3665863 - DNA, 18 bp, Homo sapiens
tccgtgctgacagctgct

SEQ ID NO: 3665864 - DNA, 17 bp, Homo sapiens
tccgtgggacggtgccc

SEQ ID NO: 3665865 - DNA, 21 bp, Homo sapiens
tccgtggtcagagtgccactg

SEQ ID NO: 3665866 - DNA, 15 bp, Homo sapiens
tccgttagctcctgt

SEQ ID NO: 3665867 - DNA, 13 bp, Homo sapiens
tccgttggccact

SEQ ID NO: 3665868 - DNA, 22 bp, Homo sapiens
tcctaagactaacaaaggcagc

SEQ ID NO: 3665869 - DNA, 18 bp, Homo sapiens
tcctacaagagcagcctg

SEQ ID NO: 3665870 - DNA, 19 bp, Homo sapiens
tcctacaagagcagcctgt

SEQ ID NO: 3665871 - DNA, 20 bp, Homo sapiens
tcctacaagagcagcctgtg

SEQ ID NO: 3665872 - DNA, 23 bp, Homo sapiens
tcctacaagagcagcctgtggca

SEQ ID NO: 3665873 - DNA, 12 bp, Homo sapiens
tcctacagtgaa

SEQ ID NO: 3665874 - DNA, 21 bp, Homo sapiens
tcctacagtgaaatgagcagc

SEQ ID NO: 3665875 - DNA, 15 bp, Homo sapiens
tcctacccatccccg

SEQ ID NO: 3665876 - DNA, 14 bp, Homo sapiens
tcctacctattatc

SEQ ID NO: 3665877 - DNA, 15 bp, Homo sapiens
tcctacctattatcc

SEQ ID NO: 3665878 - DNA, 22 bp, Homo sapiens
tcctacctattatccttctact

SEQ ID NO: 3665879 - DNA, 13 bp, Homo sapiens
tcctacctggggg

SEQ ID NO: 3665880 - DNA, 21 bp, Homo sapiens
tcctacctgggggcagaactc

SEQ ID NO: 3665881 - DNA, 19 bp, Homo sapiens
tcctacttagggaagaaaa

SEQ ID NO: 3665882 - DNA, 17 bp, Homo sapiens
tcctagagggaggggcc

SEQ ID NO: 3665883 - DNA, 20 bp, Homo sapiens
tcctagagggaggggcctag

SEQ ID NO: 3665884 - DNA, 21 bp, Homo sapiens
tcctagagggaggggcctagg

SEQ ID NO: 3665885 - DNA, 20 bp, Homo sapiens
tgactagggattcaggctgc

SEQ ID NO: 3665886 - DNA, 16 bp, Homo sapiens
tgactcgggggtgggg

SEQ ID NO: 3665887 - DNA, 14 bp, Homo sapiens
tgactcggtttctc

SEQ ID NO: 3665888 - DNA, 18 bp, Homo sapiens
tgactcggtttctccaaa

SEQ ID NO: 3665889 - DNA, 21 bp, Homo sapiens
tgactgaaaaaaaaaaagaag

SEQ ID NO: 3665890 - DNA, 15 bp, Homo sapiens
tgactggtgctgcag

SEQ ID NO: 3665891 - DNA, 15 bp, Homo sapiens
tgactgttcttggta

SEQ ID NO: 3665892 - DNA, 21 bp, Homo sapiens
tgactgttttctcttgagagg

SEQ ID NO: 3665893 - DNA, 15 bp, Homo sapiens
tgacttgtgtcccat

SEQ ID NO: 3665894 - DNA, 20 bp, Homo sapiens
tgactttaagtaatcaggat

SEQ ID NO: 3665895 - DNA, 21 bp, Homo sapiens
tgactttagaaagctgacatt

SEQ ID NO: 3665896 - DNA, 15 bp, Homo sapiens
tgactttagtgaaag

SEQ ID NO: 3665897 - DNA, 14 bp, Homo sapiens
tgactttttataaa

SEQ ID NO: 3665898 - DNA, 19 bp, Homo sapiens
tgactttttataaaatggc

SEQ ID NO: 3665899 - DNA, 14 bp, Homo sapiens
tgagaaaaatgtaa

SEQ ID NO: 3665900 - DNA, 14 bp, Homo sapiens
tgagaaaacaggct

SEQ ID NO: 3665901 - DNA, 16 bp, Homo sapiens
tgagaaagccttcttt

SEQ ID NO: 3665902 - DNA, 22 bp, Homo sapiens
tgagaaagtacagcagtagact

SEQ ID NO: 3665903 - DNA, 14 bp, Homo sapiens
tgagaaatcctgga

SEQ ID NO: 3665904 - DNA, 12 bp, Homo sapiens
tgagaacctggg

SEQ ID NO: 3665905 - DNA, 21 bp, Homo sapiens
tgagaacctgggttgcagaca

SEQ ID NO: 3665906 - DNA, 22 bp, Homo sapiens
tgagaacctgggttgcagacag

SEQ ID NO: 3665907 - DNA, 23 bp, Homo sapiens
tgagaacctgggttgcagacagg

SEQ ID NO: 3665908 - DNA, 19 bp, Homo sapiens
tgagaagtgaatgctggga

SEQ ID NO: 3665909 - DNA, 18 bp, Homo sapiens
tgagacaaatggaggcct

SEQ ID NO: 3665910 - DNA, 15 bp, Homo sapiens
tgagacagtcttgct

SEQ ID NO: 3665911 - DNA, 13 bp, Homo sapiens
tgagacccccaca

SEQ ID NO: 3665912 - DNA, 15 bp, Homo sapiens
tgagacccccacacc

SEQ ID NO: 3665913 - DNA, 15 bp, Homo sapiens
tgagactcagtgcag

SEQ ID NO: 3665914 - DNA, 15 bp, Homo sapiens
tgagatacatacaga

SEQ ID NO: 3665915 - DNA, 21 bp, Homo sapiens
tgagatacatacagaattact

SEQ ID NO: 3665916 - DNA, 17 bp, Homo sapiens
tgagatgctggttttct

SEQ ID NO: 3665917 - DNA, 23 bp, Homo sapiens
tgagattttgtatatttaggaaa

SEQ ID NO: 3665918 - DNA, 16 bp, Homo sapiens
tgagcaaatcaccaca

SEQ ID NO: 3665919 - DNA, 21 bp, Homo sapiens
tgagcacaactttaagaggac

SEQ ID NO: 3665920 - DNA, 16 bp, Homo sapiens
tgagcaccaggggatg

SEQ ID NO: 3665921 - DNA, 15 bp, Homo sapiens
tgagcacgctaccaa

SEQ ID NO: 3665922 - DNA, 23 bp, Homo sapiens
tgagcagcccttacagtattgtt

SEQ ID NO: 3665923 - DNA, 17 bp, Homo sapiens
tgagcagtgagcactga

SEQ ID NO: 3665924 - DNA, 19 bp, Homo sapiens
tgagcagtgagcactgaaa

SEQ ID NO: 3665925 - DNA, 20 bp, Homo sapiens
tgagcagtgagcactgaaac

SEQ ID NO: 3665926 - DNA, 13 bp, Homo sapiens
tgagcagtggctg

SEQ ID NO: 3665927 - DNA, 15 bp, Homo sapiens
tgagcagtggctggt

SEQ ID NO: 3665928 - DNA, 18 bp, Homo sapiens
tgagcagtggctggtcca

SEQ ID NO: 3665929 - DNA, 22 bp, Homo sapiens
tgagcatacatcttaaatcttt

SEQ ID NO: 3665930 - DNA, 16 bp, Homo sapiens
tgagccactgcaccca

SEQ ID NO: 3665931 - DNA, 13 bp, Homo sapiens
tgagcctgcaggg

SEQ ID NO: 3665932 - DNA, 11 bp, Homo sapiens
tgagcctggca

SEQ ID NO: 3665933 - DNA, 23 bp, Homo sapiens
tgagcgcctccatccaaggccag

SEQ ID NO: 3665934 - DNA, 11 bp, Homo sapiens
tgagctcagga

SEQ ID NO: 3665935 - DNA, 19 bp, Homo sapiens
tgagctcaggagtttgaga

SEQ ID NO: 3665936 - DNA, 16 bp, Homo sapiens
tgagctgcccctgctg

SEQ ID NO: 3665937 - DNA, 17 bp, Homo sapiens
tgagctgcccctgctgc

SEQ ID NO: 3665938 - DNA, 16 bp, Homo sapiens
tgagctgcctccagcc

SEQ ID NO: 3665939 - DNA, 20 bp, Homo sapiens
tgagctgcctccagcctggt

SEQ ID NO: 3665940 - DNA, 21 bp, Homo sapiens
tgagctgcctccagcctggtg

SEQ ID NO: 3665941 - DNA, 23 bp, Homo sapiens
tgagctgcctccagcctggtggc

SEQ ID NO: 3665942 - DNA, 17 bp, Homo sapiens
tgaggaattcagaagtg

SEQ ID NO: 3665943 - DNA, 21 bp, Homo sapiens
tgaggagagaaaatatatgta

SEQ ID NO: 3665944 - DNA, 13 bp, Homo sapiens
tgaggagctgctg

SEQ ID NO: 3665945 - DNA, 16 bp, Homo sapiens
tgaggagctgctggct

SEQ ID NO: 3665946 - DNA, 13 bp, Homo sapiens
tgaggagctgggg

SEQ ID NO: 3665947 - DNA, 17 bp, Homo sapiens
tgaggatgacagtgaca

SEQ ID NO: 3665948 - DNA, 15 bp, Homo sapiens
tgaggcaagtgtggg

SEQ ID NO: 3665949 - DNA, 16 bp, Homo sapiens
tgaggcaagtgtgggc

SEQ ID NO: 3665950 - DNA, 23 bp, Homo sapiens
tgaggccaccagtaaaagacatt

SEQ ID NO: 3665951 - DNA, 11 bp, Homo sapiens
tgaggcctgga

SEQ ID NO: 3665952 - DNA, 14 bp, Homo sapiens
tgaggcctggactt

SEQ ID NO: 3665953 - DNA, 14 bp, Homo sapiens
tgaggcggagctcc

SEQ ID NO: 3665954 - DNA, 12 bp, Homo sapiens
tgaggctgtcct

SEQ ID NO: 3665955 - DNA, 14 bp, Homo sapiens
tgaggctgtcctgt

SEQ ID NO: 3665956 - DNA, 11 bp, Homo sapiens
tgaggctgtgg

SEQ ID NO: 3665957 - DNA, 21 bp, Homo sapiens
tgaggctgtggtcacagcgga

SEQ ID NO: 3665958 - DNA, 17 bp, Homo sapiens
tgaggcttgcccaggag

SEQ ID NO: 3665959 - DNA, 19 bp, Homo sapiens
tgaggcttgcccaggagca

SEQ ID NO: 3665960 - DNA, 14 bp, Homo sapiens
tgaggctttccatg

SEQ ID NO: 3665961 - DNA, 17 bp, Homo sapiens
tgagggcggagcgcctc

SEQ ID NO: 3665962 - DNA, 17 bp, Homo sapiens
tgaggggcatctgcccc

SEQ ID NO: 3665963 - DNA, 22 bp, Homo sapiens
tgaggggcatctgcccctcccc

SEQ ID NO: 3665964 - DNA, 11 bp, Homo sapiens
tgagggtgggc

SEQ ID NO: 3665965 - DNA, 16 bp, Homo sapiens
tgaggtattttttcct

SEQ ID NO: 3665966 - DNA, 17 bp, Homo sapiens
tgaggtgaaagggagct

SEQ ID NO: 3665967 - DNA, 21 bp, Homo sapiens
tgagtatctcctcgcaagctg

SEQ ID NO: 3665968 - DNA, 14 bp, Homo sapiens
tgagtctgggcagc

SEQ ID NO: 3665969 - DNA, 23 bp, Homo sapiens
tgagttgacttgacagaacactg

SEQ ID NO: 3665970 - DNA, 13 bp, Homo sapiens
tgagttttccatg

SEQ ID NO: 3665971 - DNA, 19 bp, Homo sapiens
tgagttttccatggcagga

SEQ ID NO: 3665972 - DNA, 19 bp, Homo sapiens
tgagtttttacaagatgta

SEQ ID NO: 3665973 - DNA, 23 bp, Homo sapiens
tgataagttcctttccttttctt

SEQ ID NO: 3665974 - DNA, 23 bp, Homo sapiens
tgatacactatgaagatgtttca

SEQ ID NO: 3665975 - DNA, 17 bp, Homo sapiens
tgataccagaagggaaa

SEQ ID NO: 3665976 - DNA, 18 bp, Homo sapiens
tgataccagaagggaaag

SEQ ID NO: 3665977 - DNA, 21 bp, Homo sapiens
tgataccagaagggaaagctt

SEQ ID NO: 3665978 - DNA, 18 bp, Homo sapiens
tgatactggaggaacact

SEQ ID NO: 3665979 - DNA, 19 bp, Homo sapiens
tgatagacacatatgaggg

SEQ ID NO: 3665980 - DNA, 15 bp, Homo sapiens
tgatagcctgttaca

SEQ ID NO: 3665981 - DNA, 22 bp, Homo sapiens
tgatagcctgttacaggaatga

SEQ ID NO: 3665982 - DNA, 12 bp, Homo sapiens
tgatcaaggcct

SEQ ID NO: 3665983 - DNA, 16 bp, Homo sapiens
tgatcaattttgactt

SEQ ID NO: 3665984 - DNA, 15 bp, Homo sapiens
tgatcatgtactttt

SEQ ID NO: 3665985 - DNA, 19 bp, Homo sapiens
tgatcatgtactttttagt

SEQ ID NO: 3665986 - DNA, 17 bp, Homo sapiens
tgatcctggaggcccag

SEQ ID NO: 3665987 - DNA, 23 bp, Homo sapiens
tgatcctggaggtcttttctagt

SEQ ID NO: 3665988 - DNA, 21 bp, Homo sapiens
tgatcctgtattcagacagat

SEQ ID NO: 3665989 - DNA, 14 bp, Homo sapiens
tgatctcgatgcag

SEQ ID NO: 3665990 - DNA, 20 bp, Homo sapiens
tgatctgatgcaagcaagaa

SEQ ID NO: 3665991 - DNA, 15 bp, Homo sapiens
tgatctggaacccag

SEQ ID NO: 3665992 - DNA, 18 bp, Homo sapiens
tgatgaaatgtaaatact

SEQ ID NO: 3665993 - DNA, 14 bp, Homo sapiens
tgatgagattttta

SEQ ID NO: 3665994 - DNA, 23 bp, Homo sapiens
tgatgagggggaattcctggaac

SEQ ID NO: 3665995 - DNA, 13 bp, Homo sapiens
tgatgaggtattt

SEQ ID NO: 3665996 - DNA, 16 bp, Homo sapiens
tgatgaggtatttttt

SEQ ID NO: 3665997 - DNA, 14 bp, Homo sapiens
tgatgatcactgtg

SEQ ID NO: 3665998 - DNA, 17 bp, Homo sapiens
tgatgctccctcccctg

SEQ ID NO: 3665999 - DNA, 21 bp, Homo sapiens
tgatgctccctcccctgccct

SEQ ID NO: 3666000 - DNA, 23 bp, Homo sapiens
tgatgctccctcccctgccctgg

SEQ ID NO: 3666001 - DNA, 15 bp, Homo sapiens
tgatgctgcccctca

SEQ ID NO: 3666002 - DNA, 18 bp, Homo sapiens
tggattccccatctcagg

SEQ ID NO: 3666003 - DNA, 21 bp, Homo sapiens
tggatttgatgagttaactgt

SEQ ID NO: 3666004 - DNA, 24 bp, Homo sapiens
tggatttgatgagttaactgtgaa

SEQ ID NO: 3666005 - DNA, 16 bp, Homo sapiens
tggcaaaaaggcagga

SEQ ID NO: 3666006 - DNA, 21 bp, Homo sapiens
tggcaaaaggatctttgtggc

SEQ ID NO: 3666007 - DNA, 21 bp, Homo sapiens
tggcaaagccttcattgcctt

SEQ ID NO: 3666008 - DNA, 17 bp, Homo sapiens
tggcaaaggaaggtgga

SEQ ID NO: 3666009 - DNA, 17 bp, Homo sapiens
tggcaagagtgtggagg

SEQ ID NO: 3666010 - DNA, 19 bp, Homo sapiens
tggcaagagtgtggaggct

SEQ ID NO: 3666011 - DNA, 16 bp, Homo sapiens
tggcaatataatcttt

SEQ ID NO: 3666012 - DNA, 21 bp, Homo sapiens
tggcaatttcctggccctcca

SEQ ID NO: 3666013 - DNA, 22 bp, Homo sapiens
tggcaatttcctggccctccac

SEQ ID NO: 3666014 - DNA, 20 bp, Homo sapiens
tggcaccagacacccaggac

SEQ ID NO: 3666015 - DNA, 16 bp, Homo sapiens
tggcaccagcagcctg

SEQ ID NO: 3666016 - DNA, 23 bp, Homo sapiens
tggcaccgcctccccacctccag

SEQ ID NO: 3666017 - DNA, 20 bp, Homo sapiens
tggcacctaatccaggcaga

SEQ ID NO: 3666018 - DNA, 17 bp, Homo sapiens
tggcaggaaggcttgtt

SEQ ID NO: 3666019 - DNA, 15 bp, Homo sapiens
tggcaggagtggggt

SEQ ID NO: 3666020 - DNA, 17 bp, Homo sapiens
tggcaggagtggggtgg

SEQ ID NO: 3666021 - DNA, 13 bp, Homo sapiens
tggcaggctggcc

SEQ ID NO: 3666022 - DNA, 14 bp, Homo sapiens
tggcaggctggcca

SEQ ID NO: 3666023 - DNA, 15 bp, Homo sapiens
tggcaggggacagga

SEQ ID NO: 3666024 - DNA, 17 bp, Homo sapiens
tggcagtgtggggaggg

SEQ ID NO: 3666025 - DNA, 13 bp, Homo sapiens
tggcatcagttta

SEQ ID NO: 3666026 - DNA, 22 bp, Homo sapiens
tggcatcagtttaggccttggc

SEQ ID NO: 3666027 - DNA, 20 bp, Homo sapiens
tggcatcttagacctccaca

SEQ ID NO: 3666028 - DNA, 23 bp, Homo sapiens
tggcatctttgccttgggctgct

SEQ ID NO: 3666029 - DNA, 16 bp, Homo sapiens
tggccaaggagctgct

SEQ ID NO: 3666030 - DNA, 17 bp, Homo sapiens
tggccaaggagctgcta

SEQ ID NO: 3666031 - DNA, 23 bp, Homo sapiens
tggccactccgagaggtgggcca

SEQ ID NO: 3666032 - DNA, 16 bp, Homo sapiens
tggccactgagctggc

SEQ ID NO: 3666033 - DNA, 12 bp, Homo sapiens
tggccagacaca

SEQ ID NO: 3666034 - DNA, 13 bp, Homo sapiens
tggccagacacag

SEQ ID NO: 3666035 - DNA, 12 bp, Homo sapiens
tggccagcctgg

SEQ ID NO: 3666036 - DNA, 13 bp, Homo sapiens
tggccagcctggc

SEQ ID NO: 3666037 - DNA, 18 bp, Homo sapiens
tggccagcctggcatcag

SEQ ID NO: 3666038 - DNA, 21 bp, Homo sapiens
tggccaggaagctttggtgag

SEQ ID NO: 3666039 - DNA, 14 bp, Homo sapiens
tggccaggagctct

SEQ ID NO: 3666040 - DNA, 16 bp, Homo sapiens
tggccaggagctcttc

SEQ ID NO: 3666041 - DNA, 22 bp, Homo sapiens
tggccaggagctcttcaggcct

SEQ ID NO: 3666042 - DNA, 23 bp, Homo sapiens
tggccaggagctcttcaggcctc

SEQ ID NO: 3666043 - DNA, 19 bp, Homo sapiens
tggccaggcagatctgtgc

SEQ ID NO: 3666044 - DNA, 21 bp, Homo sapiens
tggccagtccaccctgcctgc

SEQ ID NO: 3666045 - DNA, 22 bp, Homo sapiens
tggccagtccaccctgcctgcc

SEQ ID NO: 3666046 - DNA, 21 bp, Homo sapiens
tggccagtccaggctgccgtg

SEQ ID NO: 3666047 - DNA, 13 bp, Homo sapiens
tggccatcccaca

SEQ ID NO: 3666048 - DNA, 14 bp, Homo sapiens
tggcccagggccca

SEQ ID NO: 3666049 - DNA, 16 bp, Homo sapiens
tggcccagggcccaga

SEQ ID NO: 3666050 - DNA, 18 bp, Homo sapiens
tggccccagcacagcttg

SEQ ID NO: 3666051 - DNA, 22 bp, Homo sapiens
tggccccaggcccacagcgtgg

SEQ ID NO: 3666052 - DNA, 15 bp, Homo sapiens
tggcccctactttgt

SEQ ID NO: 3666053 - DNA, 20 bp, Homo sapiens
tggcccggcccctcctgact

SEQ ID NO: 3666054 - DNA, 22 bp, Homo sapiens
tggcccgggaatgaatggggag

SEQ ID NO: 3666055 - DNA, 11 bp, Homo sapiens
tggccctccac

SEQ ID NO: 3666056 - DNA, 14 bp, Homo sapiens
tggccctggctgcc

SEQ ID NO: 3666057 - DNA, 22 bp, Homo sapiens
tggcccttgcagttcagcacca

SEQ ID NO: 3666058 - DNA, 18 bp, Homo sapiens
tggccgagggtcctggct

SEQ ID NO: 3666059 - DNA, 17 bp, Homo sapiens
tggcctcagctgcctca

SEQ ID NO: 3666060 - DNA, 19 bp, Homo sapiens
tggcctcagctgcctcact

SEQ ID NO: 3666061 - DNA, 17 bp, Homo sapiens
tggcctcatgtggctgg

SEQ ID NO: 3666062 - DNA, 15 bp, Homo sapiens
tggcctcccctgcca

SEQ ID NO: 3666063 - DNA, 21 bp, Homo sapiens
tggcctcccctgccaccaggc

SEQ ID NO: 3666064 - DNA, 20 bp, Homo sapiens
tggcctcttgagcagtggct

SEQ ID NO: 3666065 - DNA, 22 bp, Homo sapiens
tggcctcttgagcagtggctgg

SEQ ID NO: 3666066 - DNA, 23 bp, Homo sapiens
tggcctgcataggctccttcctg

SEQ ID NO: 3666067 - DNA, 15 bp, Homo sapiens
tggcctggccaggag

SEQ ID NO: 3666068 - DNA, 16 bp, Homo sapiens
tggcctggccaggagc

SEQ ID NO: 3666069 - DNA, 18 bp, Homo sapiens
tggcctgtctcatcccca

SEQ ID NO: 3666070 - DNA, 24 bp, Homo sapiens
tggcctgtctcatccccaggggtc

SEQ ID NO: 3666071 - DNA, 16 bp, Homo sapiens
tggcctgtggctgtcg

SEQ ID NO: 3666072 - DNA, 17 bp, Homo sapiens
tggcctgtggctgtcgg

SEQ ID NO: 3666073 - DNA, 15 bp, Homo sapiens
tggcctttcctggaa

SEQ ID NO: 3666074 - DNA, 20 bp, Homo sapiens
tggcgacactaaaggaggag

SEQ ID NO: 3666075 - DNA, 16 bp, Homo sapiens
tggcgggactggagaa

SEQ ID NO: 3666076 - DNA, 17 bp, Homo sapiens
tggcgtgggagccagcc

SEQ ID NO: 3666077 - DNA, 16 bp, Homo sapiens
tggctagagtcctcac

SEQ ID NO: 3666078 - DNA, 21 bp, Homo sapiens
tggctagagtcctcactccca

SEQ ID NO: 3666079 - DNA, 17 bp, Homo sapiens
tggctagtcaagctcct

SEQ ID NO: 3666080 - DNA, 21 bp, Homo sapiens
tggctagtcaagctcctcctc

SEQ ID NO: 3666081 - DNA, 19 bp, Homo sapiens
tggctcacacctgtaatcc

SEQ ID NO: 3666082 - DNA, 13 bp, Homo sapiens
tggctcacgcctg

SEQ ID NO: 3666083 - DNA, 14 bp, Homo sapiens
tggctcagggtggt

SEQ ID NO: 3666084 - DNA, 14 bp, Homo sapiens
tggctccaggccaa

SEQ ID NO: 3666085 - DNA, 20 bp, Homo sapiens
tggctcctgaggggcatctg

SEQ ID NO: 3666086 - DNA, 18 bp, Homo sapiens
tggctcgaatctctgtgc

SEQ ID NO: 3666087 - DNA, 20 bp, Homo sapiens
tggctcgaatctctgtgcct

SEQ ID NO: 3666088 - DNA, 15 bp, Homo sapiens
tggctctgggtgggc

SEQ ID NO: 3666089 - DNA, 23 bp, Homo sapiens
tggctctgggtgggcgtggcctg

SEQ ID NO: 3666090 - DNA, 22 bp, Homo sapiens
tggctgaaattctcctggaggt

SEQ ID NO: 3666091 - DNA, 22 bp, Homo sapiens
tggctgactaagccccgtctga

SEQ ID NO: 3666092 - DNA, 14 bp, Homo sapiens
tggctgcaggaatc

SEQ ID NO: 3666093 - DNA, 16 bp, Homo sapiens
tggctgcaggaatctt

SEQ ID NO: 3666094 - DNA, 19 bp, Homo sapiens
tggctgcaggaatctttaa

SEQ ID NO: 3666095 - DNA, 19 bp, Homo sapiens
tggctggaagatcctgcgg

SEQ ID NO: 3666096 - DNA, 16 bp, Homo sapiens
tggctgggggcaggag

SEQ ID NO: 3666097 - DNA, 13 bp, Homo sapiens
tggctggtccagg

SEQ ID NO: 3666098 - DNA, 13 bp, Homo sapiens
tggctgtaatcat

SEQ ID NO: 3666099 - DNA, 20 bp, Homo sapiens
tggctgttgacgcacctgtg

SEQ ID NO: 3666100 - DNA, 20 bp, Homo sapiens
tggcttcacggaagagcctt

SEQ ID NO: 3666101 - DNA, 23 bp, Homo sapiens
tggcttcacggaagagccttgcg

SEQ ID NO: 3666102 - DNA, 19 bp, Homo sapiens
tggcttctccctggggacg

SEQ ID NO: 3666103 - DNA, 24 bp, Homo sapiens
tggcttctccctggggacggggct

SEQ ID NO: 3666104 - DNA, 16 bp, Homo sapiens
tggcttctgcaggaat

SEQ ID NO: 3666105 - DNA, 16 bp, Homo sapiens
tggcttctggccagga

SEQ ID NO: 3666106 - DNA, 14 bp, Homo sapiens
tggctttcagggag

SEQ ID NO: 3666107 - DNA, 17 bp, Homo sapiens
tggctttggcttcttgg

SEQ ID NO: 3666108 - DNA, 16 bp, Homo sapiens
tggctttgttgatgct

SEQ ID NO: 3666109 - DNA, 14 bp, Homo sapiens
tgggaactggaggg

SEQ ID NO: 3666110 - DNA, 17 bp, Homo sapiens
tgggaactggagggtga

SEQ ID NO: 3666111 - DNA, 21 bp, Homo sapiens
tgggaagcagggaattcctgg

SEQ ID NO: 3666112 - DNA, 12 bp, Homo sapiens
tgggaagcccgg

SEQ ID NO: 3666113 - DNA, 17 bp, Homo sapiens
tgggaaggggaggaccc

SEQ ID NO: 3666114 - DNA, 13 bp, Homo sapiens
tgggacagggctt

SEQ ID NO: 3666115 - DNA, 19 bp, Homo sapiens
tgggacagggcttctcctg

SEQ ID NO: 3666116 - DNA, 20 bp, Homo sapiens
tgggacagggcttctcctgc

SEQ ID NO: 3666117 - DNA, 17 bp, Homo sapiens
tgggaccacaactattt

SEQ ID NO: 3666118 - DNA, 21 bp, Homo sapiens
ttctggtggtggcctgtttga

SEQ ID NO: 3666119 - DNA, 15 bp, Homo sapiens
ttctggttccagggt

SEQ ID NO: 3666120 - DNA, 17 bp, Homo sapiens
ttctggttccagggtcc

SEQ ID NO: 3666121 - DNA, 18 bp, Homo sapiens
ttctgtattttgtttttg

SEQ ID NO: 3666122 - DNA, 18 bp, Homo sapiens
ttctgtgacccatctgta

SEQ ID NO: 3666123 - DNA, 12 bp, Homo sapiens
ttctgtttgtta

SEQ ID NO: 3666124 - DNA, 20 bp, Homo sapiens
ttctgtttttctaggcctgg

SEQ ID NO: 3666125 - DNA, 20 bp, Homo sapiens
ttcttcatattctaaaacca

SEQ ID NO: 3666126 - DNA, 12 bp, Homo sapiens
ttcttcctgcaa

SEQ ID NO: 3666127 - DNA, 16 bp, Homo sapiens
ttcttctggtgctact

SEQ ID NO: 3666128 - DNA, 23 bp, Homo sapiens
ttcttctggtgctactccatgca

SEQ ID NO: 3666129 - DNA, 22 bp, Homo sapiens
ttcttgaaaggtccaaatgttt

SEQ ID NO: 3666130 - DNA, 21 bp, Homo sapiens
ttcttgagtcaaaaaacatga

SEQ ID NO: 3666131 - DNA, 23 bp, Homo sapiens
ttcttgccagttagactgggcct

SEQ ID NO: 3666132 - DNA, 17 bp, Homo sapiens
ttcttgcctctgtgctg

SEQ ID NO: 3666133 - DNA, 22 bp, Homo sapiens
ttcttgcctctgtgctgtgtgt

SEQ ID NO: 3666134 - DNA, 15 bp, Homo sapiens
ttcttgtggaagaca

SEQ ID NO: 3666135 - DNA, 22 bp, Homo sapiens
ttctttaaagaagttgaagttt

SEQ ID NO: 3666136 - DNA, 15 bp, Homo sapiens
ttctttagagatgct

SEQ ID NO: 3666137 - DNA, 16 bp, Homo sapiens
ttctttgcaaagtatt

SEQ ID NO: 3666138 - DNA, 18 bp, Homo sapiens
ttgaaaagacaatagccc

SEQ ID NO: 3666139 - DNA, 16 bp, Homo sapiens
ttgaaataactggaac

SEQ ID NO: 3666140 - DNA, 22 bp, Homo sapiens
ttgaacgcccccccccacccct

SEQ ID NO: 3666141 - DNA, 20 bp, Homo sapiens
ttgaagaactgcaggccctg

SEQ ID NO: 3666142 - DNA, 20 bp, Homo sapiens
ttgaagggccagagccaggg

SEQ ID NO: 3666143 - DNA, 20 bp, Homo sapiens
ttgaataataagcaggatgt

SEQ ID NO: 3666144 - DNA, 16 bp, Homo sapiens
ttgaatataaacacta

SEQ ID NO: 3666145 - DNA, 18 bp, Homo sapiens
ttgaatataaacactata

SEQ ID NO: 3666146 - DNA, 13 bp, Homo sapiens
ttgaattgttaca

SEQ ID NO: 3666147 - DNA, 18 bp, Homo sapiens
ttgacaactggcaggcag

SEQ ID NO: 3666148 - DNA, 22 bp, Homo sapiens
ttgacacaggtctttcctaagg

SEQ ID NO: 3666149 - DNA, 16 bp, Homo sapiens
ttgacatatttaatgt

SEQ ID NO: 3666150 - DNA, 18 bp, Homo sapiens
ttgaccaagcaggaagct

SEQ ID NO: 3666151 - DNA, 20 bp, Homo sapiens
ttgaccaagcaggaagctca

SEQ ID NO: 3666152 - DNA, 15 bp, Homo sapiens
ttgaccacccacctg

SEQ ID NO: 3666153 - DNA, 18 bp, Homo sapiens
ttgactgccctcttactg

SEQ ID NO: 3666154 - DNA, 23 bp, Homo sapiens
ttgactgccctcttactgttttg

SEQ ID NO: 3666155 - DNA, 19 bp, Homo sapiens
ttgacttgacagaacactg

SEQ ID NO: 3666156 - DNA, 14 bp, Homo sapiens
ttgagactagtttt

SEQ ID NO: 3666157 - DNA, 12 bp, Homo sapiens
ttgagactgatc

SEQ ID NO: 3666158 - DNA, 15 bp, Homo sapiens
ttgagatcagcctgg

SEQ ID NO: 3666159 - DNA, 11 bp, Homo sapiens
ttgagctgcct

SEQ ID NO: 3666160 - DNA, 12 bp, Homo sapiens
ttgagctgcctc

SEQ ID NO: 3666161 - DNA, 13 bp, Homo sapiens
ttgaggcaagtgt

SEQ ID NO: 3666162 - DNA, 13 bp, Homo sapiens
ttgaggggagcat

SEQ ID NO: 3666163 - DNA, 18 bp, Homo sapiens
ttgagttaacctttaaga

SEQ ID NO: 3666164 - DNA, 15 bp, Homo sapiens
ttgatctggaaccca

SEQ ID NO: 3666165 - DNA, 18 bp, Homo sapiens
ttgatgatcactgtgaaa

SEQ ID NO: 3666166 - DNA, 23 bp, Homo sapiens
ttgatggaagtgggccagtcctg

SEQ ID NO: 3666167 - DNA, 23 bp, Homo sapiens
ttgatggtgatgaaatgtaaata

SEQ ID NO: 3666168 - DNA, 20 bp, Homo sapiens
ttgatgtggccctggctgcc

SEQ ID NO: 3666169 - DNA, 17 bp, Homo sapiens
ttgattacagtgcagtg

SEQ ID NO: 3666170 - DNA, 12 bp, Homo sapiens
ttgattcaaaat

SEQ ID NO: 3666171 - DNA, 18 bp, Homo sapiens
ttgattcaaaatatttaa

SEQ ID NO: 3666172 - DNA, 14 bp, Homo sapiens
ttgattcagcctgt

SEQ ID NO: 3666173 - DNA, 16 bp, Homo sapiens
ttgattcagctctgca

SEQ ID NO: 3666174 - DNA, 11 bp, Homo sapiens
ttgattctgat

SEQ ID NO: 3666175 - DNA, 18 bp, Homo sapiens
ttgatttaaacacacaga

SEQ ID NO: 3666176 - DNA, 15 bp, Homo sapiens
ttgcaaaaactacaa

SEQ ID NO: 3666177 - DNA, 17 bp, Homo sapiens
ttgcaaagtattgtaaa

SEQ ID NO: 3666178 - DNA, 21 bp, Homo sapiens
ttgcaaagtattgtaaattat

SEQ ID NO: 3666179 - DNA, 13 bp, Homo sapiens
ttgcaaatacctc

SEQ ID NO: 3666180 - DNA, 16 bp, Homo sapiens
ttgcacatgtttcctc

SEQ ID NO: 3666181 - DNA, 15 bp, Homo sapiens
ttgcaccactgcact

SEQ ID NO: 3666182 - DNA, 21 bp, Homo sapiens
ttgcaccccaaagctttcctg

SEQ ID NO: 3666183 - DNA, 22 bp, Homo sapiens
ttgcaccccaaagctttcctgc

SEQ ID NO: 3666184 - DNA, 15 bp, Homo sapiens
ttgcactatctttca

SEQ ID NO: 3666185 - DNA, 16 bp, Homo sapiens
ttgcactccagcctgg

SEQ ID NO: 3666186 - DNA, 15 bp, Homo sapiens
ttgcagacaggaatc

SEQ ID NO: 3666187 - DNA, 16 bp, Homo sapiens
ttgcagacaggaatct

SEQ ID NO: 3666188 - DNA, 14 bp, Homo sapiens
ttgcagctgcccag

SEQ ID NO: 3666189 - DNA, 22 bp, Homo sapiens
ttgcagctgcccagcccctcct

SEQ ID NO: 3666190 - DNA, 22 bp, Homo sapiens
ttgcatttcttgtgttctgtag

SEQ ID NO: 3666191 - DNA, 21 bp, Homo sapiens
ttgcatttggattggggtccc

SEQ ID NO: 3666192 - DNA, 19 bp, Homo sapiens
ttgccaaaataccagagcc

SEQ ID NO: 3666193 - DNA, 20 bp, Homo sapiens
ttgccaaaataccagagcct

SEQ ID NO: 3666194 - DNA, 16 bp, Homo sapiens
ttgccaaatatgtcct

SEQ ID NO: 3666195 - DNA, 18 bp, Homo sapiens
ttgccaaatatgtcctgg

SEQ ID NO: 3666196 - DNA, 15 bp, Homo sapiens
ttgccaccaggagaa

SEQ ID NO: 3666197 - DNA, 12 bp, Homo sapiens
ttgcctctgtgc

SEQ ID NO: 3666198 - DNA, 19 bp, Homo sapiens
ttgcctctgtgctgtgtgt

SEQ ID NO: 3666199 - DNA, 17 bp, Homo sapiens
ttgcctttgttttgatg

SEQ ID NO: 3666200 - DNA, 19 bp, Homo sapiens
ttgccttttaatttttaat

SEQ ID NO: 3666201 - DNA, 13 bp, Homo sapiens
ttgctcacctggg

SEQ ID NO: 3666202 - DNA, 14 bp, Homo sapiens
ttgctgagtgaagg

SEQ ID NO: 3666203 - DNA, 23 bp, Homo sapiens
ttgctgcattgatccaggagata

SEQ ID NO: 3666204 - DNA, 22 bp, Homo sapiens
ttgctggccagtccaccctgcc

SEQ ID NO: 3666205 - DNA, 14 bp, Homo sapiens
ttgctgtgaggctg

SEQ ID NO: 3666206 - DNA, 17 bp, Homo sapiens
ttgctgtgaggctgtcc

SEQ ID NO: 3666207 - DNA, 20 bp, Homo sapiens
ttgctgtgtgtcccaggcag

SEQ ID NO: 3666208 - DNA, 13 bp, Homo sapiens
ttgctgttattat

SEQ ID NO: 3666209 - DNA, 16 bp, Homo sapiens
ttgctgttttcctccc

SEQ ID NO: 3666210 - DNA, 22 bp, Homo sapiens
ttgctgttttcctcccttctgc

SEQ ID NO: 3666211 - DNA, 16 bp, Homo sapiens
ttgcttccccttttgc

SEQ ID NO: 3666212 - DNA, 19 bp, Homo sapiens
ttgcttgcctgcagggcca

SEQ ID NO: 3666213 - DNA, 12 bp, Homo sapiens
ttgctttctggt

SEQ ID NO: 3666214 - DNA, 20 bp, Homo sapiens
ttgcttttggcaaaactcta

SEQ ID NO: 3666215 - DNA, 15 bp, Homo sapiens
ttggaaaataaatca

SEQ ID NO: 3666216 - DNA, 19 bp, Homo sapiens
ttggacctaaatggcctca

SEQ ID NO: 3666217 - DNA, 21 bp, Homo sapiens
ttggacctaaatggcctcatg

SEQ ID NO: 3666218 - DNA, 23 bp, Homo sapiens
ttggacctaaatggcctcatgtg

SEQ ID NO: 3666219 - DNA, 22 bp, Homo sapiens
ttggacttcagtcttgcctagg

SEQ ID NO: 3666220 - DNA, 20 bp, Homo sapiens
ttggagaagcccgtgtgaga

SEQ ID NO: 3666221 - DNA, 13 bp, Homo sapiens
ttggagacataca

SEQ ID NO: 3666222 - DNA, 16 bp, Homo sapiens
ttggagagtttcctga

SEQ ID NO: 3666223 - DNA, 18 bp, Homo sapiens
ttggagagtttcctgaaa

SEQ ID NO: 3666224 - DNA, 21 bp, Homo sapiens
ttggagagtttcctgaaacaa

SEQ ID NO: 3666225 - DNA, 11 bp, Homo sapiens
ttggagctgac

SEQ ID NO: 3666226 - DNA, 15 bp, Homo sapiens
ttggaggacagtggg

SEQ ID NO: 3666227 - DNA, 18 bp, Homo sapiens
ttggagtgttatgtattt

SEQ ID NO: 3666228 - DNA, 23 bp, Homo sapiens
ttggcaccagacacccaggactt

SEQ ID NO: 3666229 - DNA, 19 bp, Homo sapiens
ttggcacctaatccaggca

SEQ ID NO: 3666230 - DNA, 12 bp, Homo sapiens
ttggcaggctgg

SEQ ID NO: 3666231 - DNA, 14 bp, Homo sapiens
ttggcaggctggcc

SEQ ID NO: 3666232 - DNA, 14 bp, Homo sapiens
ttggccactccgag

SEQ ID NO: 3666233 - DNA, 21 bp, Homo sapiens
ttggccactccgagaggtggg

SEQ ID NO: 3666234 - DNA, 14 bp, Homo sapiens
gcattgagctgcct

SEQ ID NO: 3666235 - DNA, 15 bp, Homo sapiens
gcattgagctgcctc

SEQ ID NO: 3666236 - DNA, 19 bp, Homo sapiens
gcattgagctgcctccagc

SEQ ID NO: 3666237 - DNA, 21 bp, Homo sapiens
gcattgagctgcctccagcct

SEQ ID NO: 3666238 - DNA, 18 bp, Homo sapiens
gcattgatggggaaggag

SEQ ID NO: 3666239 - DNA, 16 bp, Homo sapiens
gcatttagctggccac

SEQ ID NO: 3666240 - DNA, 23 bp, Homo sapiens
gcatttggattggggtccctcta

SEQ ID NO: 3666241 - DNA, 21 bp, Homo sapiens
gcatttgtgctagaaattttc

SEQ ID NO: 3666242 - DNA, 18 bp, Homo sapiens
gcattttccagcactttg

SEQ ID NO: 3666243 - DNA, 16 bp, Homo sapiens
gccaaaaaggatacat

SEQ ID NO: 3666244 - DNA, 20 bp, Homo sapiens
gccaaaggctggtggcaagt

SEQ ID NO: 3666245 - DNA, 15 bp, Homo sapiens
gccaaatatgtcctg

SEQ ID NO: 3666246 - DNA, 20 bp, Homo sapiens
gccaacatgctgaaaccctg

SEQ ID NO: 3666247 - DNA, 21 bp, Homo sapiens
gccaaccctcctccaatggaa

SEQ ID NO: 3666248 - DNA, 17 bp, Homo sapiens
gccaactggtgtttgaa

SEQ ID NO: 3666249 - DNA, 15 bp, Homo sapiens
gccaaggagctgcta

SEQ ID NO: 3666250 - DNA, 18 bp, Homo sapiens
gccaagggaacctgtgtc

SEQ ID NO: 3666251 - DNA, 14 bp, Homo sapiens
gccaaggtgggagg

SEQ ID NO: 3666252 - DNA, 17 bp, Homo sapiens
gccaagtctcagaagag

SEQ ID NO: 3666253 - DNA, 18 bp, Homo sapiens
gccaatggcccggcccct

SEQ ID NO: 3666254 - DNA, 20 bp, Homo sapiens
gccaattgctaccgagaagg

SEQ ID NO: 3666255 - DNA, 18 bp, Homo sapiens
gccacaaggacttcctgt

SEQ ID NO: 3666256 - DNA, 21 bp, Homo sapiens
gccacaaggacttcctgtcca

SEQ ID NO: 3666257 - DNA, 13 bp, Homo sapiens
gccacaccaggat

SEQ ID NO: 3666258 - DNA, 21 bp, Homo sapiens
gccacaccaggatagagactg

SEQ ID NO: 3666259 - DNA, 18 bp, Homo sapiens
gccaccaggccacctccc

SEQ ID NO: 3666260 - DNA, 21 bp, Homo sapiens
gccaccaggtgcctttcaaat

SEQ ID NO: 3666261 - DNA, 21 bp, Homo sapiens
gccacccacctccctgcctcc

SEQ ID NO: 3666262 - DNA, 14 bp, Homo sapiens
gccaccccttcctc

SEQ ID NO: 3666263 - DNA, 20 bp, Homo sapiens
gccacgctcctctgtttgtt

SEQ ID NO: 3666264 - DNA, 19 bp, Homo sapiens
gccactaagcagaggaggg

SEQ ID NO: 3666265 - DNA, 23 bp, Homo sapiens
gccactaagcagaggaggggccg

SEQ ID NO: 3666266 - DNA, 16 bp, Homo sapiens
gccactacctcctttc

SEQ ID NO: 3666267 - DNA, 18 bp, Homo sapiens
gccactcactaggccccc

SEQ ID NO: 3666268 - DNA, 21 bp, Homo sapiens
gccactctatgagttggactt

SEQ ID NO: 3666269 - DNA, 12 bp, Homo sapiens
gccactgagctg

SEQ ID NO: 3666270 - DNA, 18 bp, Homo sapiens
gccactgagctggctgac

SEQ ID NO: 3666271 - DNA, 20 bp, Homo sapiens
gccactgagctggctgacta

SEQ ID NO: 3666272 - DNA, 18 bp, Homo sapiens
gccactgtgaagagaacc

SEQ ID NO: 3666273 - DNA, 12 bp, Homo sapiens
gccagaagctga

SEQ ID NO: 3666274 - DNA, 21 bp, Homo sapiens
gccagaagctgagcaccaggg

SEQ ID NO: 3666275 - DNA, 13 bp, Homo sapiens
gccagagatccaa

SEQ ID NO: 3666276 - DNA, 23 bp, Homo sapiens
gccagagatccaaaagaagcccc

SEQ ID NO: 3666277 - DNA, 12 bp, Homo sapiens
gccagagccagg

SEQ ID NO: 3666278 - DNA, 20 bp, Homo sapiens
gccagaggcccccagcccag

SEQ ID NO: 3666279 - DNA, 23 bp, Homo sapiens
gccagagtggcctggccaggagc

SEQ ID NO: 3666280 - DNA, 24 bp, Homo sapiens
gccagagtggcctggccaggagct

SEQ ID NO: 3666281 - DNA, 11 bp, Homo sapiens
gccagatccag

SEQ ID NO: 3666282 - DNA, 15 bp, Homo sapiens
gccagatccagcctg

SEQ ID NO: 3666283 - DNA, 15 bp, Homo sapiens
gccagcaagaggaag

SEQ ID NO: 3666284 - DNA, 21 bp, Homo sapiens
gccagcaagaggaaggggtgc

SEQ ID NO: 3666285 - DNA, 13 bp, Homo sapiens
gccagccatgtct

SEQ ID NO: 3666286 - DNA, 14 bp, Homo sapiens
gccagccccaccca

SEQ ID NO: 3666287 - DNA, 15 bp, Homo sapiens
gccagcccctcttcc

SEQ ID NO: 3666288 - DNA, 19 bp, Homo sapiens
gccagcccttcatatctgt

SEQ ID NO: 3666289 - DNA, 11 bp, Homo sapiens
gccagcctggc

SEQ ID NO: 3666290 - DNA, 14 bp, Homo sapiens
gccagcctggcatc

SEQ ID NO: 3666291 - DNA, 15 bp, Homo sapiens
gccagcctggcatca

SEQ ID NO: 3666292 - DNA, 18 bp, Homo sapiens
gccagcggtttcctggtg

SEQ ID NO: 3666293 - DNA, 17 bp, Homo sapiens
gccagctcacagtgctg

SEQ ID NO: 3666294 - DNA, 18 bp, Homo sapiens
gccaggaatttcccagga

SEQ ID NO: 3666295 - DNA, 17 bp, Homo sapiens
gccaggagaagttgagg

SEQ ID NO: 3666296 - DNA, 18 bp, Homo sapiens
gccaggagaagttgaggg

SEQ ID NO: 3666297 - DNA, 23 bp, Homo sapiens
gccaggcggggcgccccaagagc

SEQ ID NO: 3666298 - DNA, 15 bp, Homo sapiens
gccagggagaagctc

SEQ ID NO: 3666299 - DNA, 17 bp, Homo sapiens
gccaggggaaaatcagc

SEQ ID NO: 3666300 - DNA, 23 bp, Homo sapiens
gccaggggaaaatcagcctgctc

SEQ ID NO: 3666301 - DNA, 20 bp, Homo sapiens
gccagtaacgcgtcttcctg

SEQ ID NO: 3666302 - DNA, 21 bp, Homo sapiens
gccagtccaggctgccgtggg

SEQ ID NO: 3666303 - DNA, 16 bp, Homo sapiens
gccagtcctgcctggc

SEQ ID NO: 3666304 - DNA, 19 bp, Homo sapiens
gccagtcctgcctggccag

SEQ ID NO: 3666305 - DNA, 13 bp, Homo sapiens
gccagtctgtgga

SEQ ID NO: 3666306 - DNA, 20 bp, Homo sapiens
gccagtctgtggatcagaga

SEQ ID NO: 3666307 - DNA, 18 bp, Homo sapiens
gccagtgacctgaggaag

SEQ ID NO: 3666308 - DNA, 15 bp, Homo sapiens
gccagtgctccagcc

SEQ ID NO: 3666309 - DNA, 13 bp, Homo sapiens
gccatcctctgcc

SEQ ID NO: 3666310 - DNA, 16 bp, Homo sapiens
gccatcctctgcctca

SEQ ID NO: 3666311 - DNA, 13 bp, Homo sapiens
gccatgccagctt

SEQ ID NO: 3666312 - DNA, 20 bp, Homo sapiens
gccatgcgccccctccgccc

SEQ ID NO: 3666313 - DNA, 17 bp, Homo sapiens
gccatgctgaggcctgg

SEQ ID NO: 3666314 - DNA, 19 bp, Homo sapiens
gccatgctgaggcctgggc

SEQ ID NO: 3666315 - DNA, 17 bp, Homo sapiens
gccatggtgagaaaaat

SEQ ID NO: 3666316 - DNA, 16 bp, Homo sapiens
gccattctcaagccct

SEQ ID NO: 3666317 - DNA, 17 bp, Homo sapiens
gccattgccaccaggag

SEQ ID NO: 3666318 - DNA, 19 bp, Homo sapiens
gccattgccaccaggagaa

SEQ ID NO: 3666319 - DNA, 19 bp, Homo sapiens
gccatttggccggctctgg

SEQ ID NO: 3666320 - DNA, 20 bp, Homo sapiens
gccatttggccggctctggt

SEQ ID NO: 3666321 - DNA, 15 bp, Homo sapiens
gcccaagccagaggc

SEQ ID NO: 3666322 - DNA, 23 bp, Homo sapiens
gcccaagccagaggctgggttca

SEQ ID NO: 3666323 - DNA, 19 bp, Homo sapiens
gcccaagggatctggtcct

SEQ ID NO: 3666324 - DNA, 16 bp, Homo sapiens
gcccaccctgctgctg

SEQ ID NO: 3666325 - DNA, 14 bp, Homo sapiens
gcccacctgccggc

SEQ ID NO: 3666326 - DNA, 15 bp, Homo sapiens
gcccactgtcctggg

SEQ ID NO: 3666327 - DNA, 17 bp, Homo sapiens
gcccactgtcctgggcc

SEQ ID NO: 3666328 - DNA, 21 bp, Homo sapiens
gcccactgtcctgggcctgca

SEQ ID NO: 3666329 - DNA, 14 bp, Homo sapiens
gcccagacagcaag

SEQ ID NO: 3666330 - DNA, 23 bp, Homo sapiens
gcccagacagcaaggtgtggagg

SEQ ID NO: 3666331 - DNA, 13 bp, Homo sapiens
gcccagagaagcc

SEQ ID NO: 3666332 - DNA, 23 bp, Homo sapiens
gcccagagacatacttgaagggc

SEQ ID NO: 3666333 - DNA, 13 bp, Homo sapiens
gcccagagcccag

SEQ ID NO: 3666334 - DNA, 16 bp, Homo sapiens
gcccagagcccagctc

SEQ ID NO: 3666335 - DNA, 14 bp, Homo sapiens
gcccagagctgctg

SEQ ID NO: 3666336 - DNA, 18 bp, Homo sapiens
gcccagcccctcctccct

SEQ ID NO: 3666337 - DNA, 15 bp, Homo sapiens
gcccagctccaaggg

SEQ ID NO: 3666338 - DNA, 18 bp, Homo sapiens
gcccaggagcaagtgagg

SEQ ID NO: 3666339 - DNA, 12 bp, Homo sapiens
gcccagggctcc

SEQ ID NO: 3666340 - DNA, 17 bp, Homo sapiens
gcccagtagaccttgtt

SEQ ID NO: 3666341 - DNA, 11 bp, Homo sapiens
gcccagtgcat

SEQ ID NO: 3666342 - DNA, 14 bp, Homo sapiens
gcccagtgcatggt

SEQ ID NO: 3666343 - DNA, 21 bp, Homo sapiens
gcccagtgcatggtggccaga

SEQ ID NO: 3666344 - DNA, 15 bp, Homo sapiens
gcccatatccctggt

SEQ ID NO: 3666345 - DNA, 21 bp, Homo sapiens
gcccatatccctggttgcctc

SEQ ID NO: 3666346 - DNA, 17 bp, Homo sapiens
gcccatcacagggttgg

SEQ ID NO: 3666347 - DNA, 15 bp, Homo sapiens
gcccatgcccacctg

SEQ ID NO: 3666348 - DNA, 13 bp, Homo sapiens
gccccaagagccc

SEQ ID NO: 3666349 - DNA, 23 bp, Homo sapiens
gccccacatgtccagcaccttgt

SEQ ID NO: 3666350 - DNA, 19 bp, Homo sapiens
gcgtatatacttaagaata

SEQ ID NO: 3666351 - DNA, 17 bp, Homo sapiens
gcgtcagctgctccctg

SEQ ID NO: 3666352 - DNA, 13 bp, Homo sapiens
gcgtcgagctggg

SEQ ID NO: 3666353 - DNA, 15 bp, Homo sapiens
gcgtcgagctgggaa

SEQ ID NO: 3666354 - DNA, 23 bp, Homo sapiens
gcgtgccagtcaagaagaaaaag

SEQ ID NO: 3666355 - DNA, 21 bp, Homo sapiens
gcgtgcgcatcttgcctccag

SEQ ID NO: 3666356 - DNA, 22 bp, Homo sapiens
gcgtgcgcatcttgcctccagg

SEQ ID NO: 3666357 - DNA, 20 bp, Homo sapiens
gcgtgcttgcatgtgctgca

SEQ ID NO: 3666358 - DNA, 20 bp, Homo sapiens
gcgtggcccaaggctggcag

SEQ ID NO: 3666359 - DNA, 21 bp, Homo sapiens
gcgtggcctgcataggctcct

SEQ ID NO: 3666360 - DNA, 22 bp, Homo sapiens
gcgtggcctgcataggctcctt

SEQ ID NO: 3666361 - DNA, 13 bp, Homo sapiens
gcgtggctctggg

SEQ ID NO: 3666362 - DNA, 17 bp, Homo sapiens
gcgtggctctgggtggg

SEQ ID NO: 3666363 - DNA, 13 bp, Homo sapiens
gcgtggcttctgc

SEQ ID NO: 3666364 - DNA, 13 bp, Homo sapiens
gctaaatgtgaat

SEQ ID NO: 3666365 - DNA, 13 bp, Homo sapiens
gctaacaagtagc

SEQ ID NO: 3666366 - DNA, 13 bp, Homo sapiens
gctaactgtaaat

SEQ ID NO: 3666367 - DNA, 14 bp, Homo sapiens
gctaactgtaaatc

SEQ ID NO: 3666368 - DNA, 20 bp, Homo sapiens
gctaatgctatgcaaaaaat

SEQ ID NO: 3666369 - DNA, 14 bp, Homo sapiens
gctaccgttgactt

SEQ ID NO: 3666370 - DNA, 15 bp, Homo sapiens
gctacctctgagaag

SEQ ID NO: 3666371 - DNA, 22 bp, Homo sapiens
gctactgccgtcagtgctgtgc

SEQ ID NO: 3666372 - DNA, 13 bp, Homo sapiens
gctagagtcctca

SEQ ID NO: 3666373 - DNA, 16 bp, Homo sapiens
gctagagtcctcactc

SEQ ID NO: 3666374 - DNA, 18 bp, Homo sapiens
gctagagtcctcactccc

SEQ ID NO: 3666375 - DNA, 14 bp, Homo sapiens
gctagggtggccct

SEQ ID NO: 3666376 - DNA, 19 bp, Homo sapiens
gctagtcaagctcctcctc

SEQ ID NO: 3666377 - DNA, 18 bp, Homo sapiens
gctagtgtctcctctctg

SEQ ID NO: 3666378 - DNA, 19 bp, Homo sapiens
gctagtgtctcctctctgg

SEQ ID NO: 3666379 - DNA, 23 bp, Homo sapiens
gctataaattcctctttgctttg

SEQ ID NO: 3666380 - DNA, 16 bp, Homo sapiens
gctatagctacaggaa

SEQ ID NO: 3666381 - DNA, 13 bp, Homo sapiens
gctatagtatttg

SEQ ID NO: 3666382 - DNA, 16 bp, Homo sapiens
gctatagtatttgatt

SEQ ID NO: 3666383 - DNA, 18 bp, Homo sapiens
gctatgaaatactcaggg

SEQ ID NO: 3666384 - DNA, 19 bp, Homo sapiens
gctatgaaatactcagggt

SEQ ID NO: 3666385 - DNA, 14 bp, Homo sapiens
gctatgggagcccc

SEQ ID NO: 3666386 - DNA, 18 bp, Homo sapiens
gctatgggagccccaggg

SEQ ID NO: 3666387 - DNA, 19 bp, Homo sapiens
gctatgggagccccagggt

SEQ ID NO: 3666388 - DNA, 19 bp, Homo sapiens
gctatttatgggcccctgg

SEQ ID NO: 3666389 - DNA, 13 bp, Homo sapiens
gctatttttgtaa

SEQ ID NO: 3666390 - DNA, 16 bp, Homo sapiens
gctatttttgtaaagt

SEQ ID NO: 3666391 - DNA, 20 bp, Homo sapiens
gctatttttgtaaagtttcc

SEQ ID NO: 3666392 - DNA, 13 bp, Homo sapiens
gctcaaaactttc

SEQ ID NO: 3666393 - DNA, 14 bp, Homo sapiens
gctcaaaggcacag

SEQ ID NO: 3666394 - DNA, 16 bp, Homo sapiens
gctcaaaggcacagtg

SEQ ID NO: 3666395 - DNA, 21 bp, Homo sapiens
gctcaagtgttcacaacctgg

SEQ ID NO: 3666396 - DNA, 22 bp, Homo sapiens
gctcacctggggtgtgggaggc

SEQ ID NO: 3666397 - DNA, 18 bp, Homo sapiens
gctcagaggccttgctgt

SEQ ID NO: 3666398 - DNA, 20 bp, Homo sapiens
gctcagaggccttgctgtgg

SEQ ID NO: 3666399 - DNA, 20 bp, Homo sapiens
gctcagcaaaagatgcttct

SEQ ID NO: 3666400 - DNA, 19 bp, Homo sapiens
gctcagctgcgcccccttc

SEQ ID NO: 3666401 - DNA, 13 bp, Homo sapiens
gctcagcttctcc

SEQ ID NO: 3666402 - DNA, 17 bp, Homo sapiens
gctcaggacagatgcca

SEQ ID NO: 3666403 - DNA, 20 bp, Homo sapiens
gctcaggacagatgccacac

SEQ ID NO: 3666404 - DNA, 20 bp, Homo sapiens
gctcagggccatgctgaggc

SEQ ID NO: 3666405 - DNA, 14 bp, Homo sapiens
gctcatctgctggt

SEQ ID NO: 3666406 - DNA, 15 bp, Homo sapiens
gctccacccttggcc

SEQ ID NO: 3666407 - DNA, 19 bp, Homo sapiens
gctccactctgcttctctg

SEQ ID NO: 3666408 - DNA, 20 bp, Homo sapiens
gctccagacctgatcctgga

SEQ ID NO: 3666409 - DNA, 20 bp, Homo sapiens
gctccagctgctctgtcttc

SEQ ID NO: 3666410 - DNA, 21 bp, Homo sapiens
gctccagctgctctgtcttct

SEQ ID NO: 3666411 - DNA, 21 bp, Homo sapiens
gctccagctttctgccatcta

SEQ ID NO: 3666412 - DNA, 22 bp, Homo sapiens
gctccatcccaaccaggcacct

SEQ ID NO: 3666413 - DNA, 21 bp, Homo sapiens
gctccatttcaattgctttgt

SEQ ID NO: 3666414 - DNA, 13 bp, Homo sapiens
gctcccacaccgt

SEQ ID NO: 3666415 - DNA, 23 bp, Homo sapiens
gctcccaccctcaaggtgcgggg

SEQ ID NO: 3666416 - DNA, 14 bp, Homo sapiens
gctccccctggacg

SEQ ID NO: 3666417 - DNA, 15 bp, Homo sapiens
gctccctaccacctc

SEQ ID NO: 3666418 - DNA, 20 bp, Homo sapiens
gctccctaccacctccccag

SEQ ID NO: 3666419 - DNA, 15 bp, Homo sapiens
gctccctgagggcgg

SEQ ID NO: 3666420 - DNA, 11 bp, Homo sapiens
gctcctacctg

SEQ ID NO: 3666421 - DNA, 14 bp, Homo sapiens
gctcctacctgggg

SEQ ID NO: 3666422 - DNA, 15 bp, Homo sapiens
gctcctagagggagg

SEQ ID NO: 3666423 - DNA, 16 bp, Homo sapiens
gctcctagagggaggg

SEQ ID NO: 3666424 - DNA, 14 bp, Homo sapiens
gctcctccctggag

SEQ ID NO: 3666425 - DNA, 15 bp, Homo sapiens
gctcctccctggagc

SEQ ID NO: 3666426 - DNA, 13 bp, Homo sapiens
gctcctcctgaag

SEQ ID NO: 3666427 - DNA, 15 bp, Homo sapiens
gctcctcctgaagga

SEQ ID NO: 3666428 - DNA, 12 bp, Homo sapiens
gctcctctcagt

SEQ ID NO: 3666429 - DNA, 15 bp, Homo sapiens
gctcctctccccagc

SEQ ID NO: 3666430 - DNA, 20 bp, Homo sapiens
gctcctctccccagcccaga

SEQ ID NO: 3666431 - DNA, 23 bp, Homo sapiens
gctcctctccccagcccagagac

SEQ ID NO: 3666432 - DNA, 21 bp, Homo sapiens
gctcctgaatgaggcggagct

SEQ ID NO: 3666433 - DNA, 20 bp, Homo sapiens
gctcctgcacttacttgctt

SEQ ID NO: 3666434 - DNA, 15 bp, Homo sapiens
gctcctggcccactg

SEQ ID NO: 3666435 - DNA, 19 bp, Homo sapiens
gctcctggcccactgcatc

SEQ ID NO: 3666436 - DNA, 15 bp, Homo sapiens
gctcctgtggcccca

SEQ ID NO: 3666437 - DNA, 20 bp, Homo sapiens
gctcctgtggccccaccctg

SEQ ID NO: 3666438 - DNA, 21 bp, Homo sapiens
gctcctgtggccccaccctgg

SEQ ID NO: 3666439 - DNA, 15 bp, Homo sapiens
gctccttcctgtggg

SEQ ID NO: 3666440 - DNA, 20 bp, Homo sapiens
gctccttcctgtgggtgggg

SEQ ID NO: 3666441 - DNA, 21 bp, Homo sapiens
gctccttcctgtgggtggggc

SEQ ID NO: 3666442 - DNA, 14 bp, Homo sapiens
gctccttgctgcat

SEQ ID NO: 3666443 - DNA, 13 bp, Homo sapiens
gctccttgggagg

SEQ ID NO: 3666444 - DNA, 21 bp, Homo sapiens
gctccttgggaggccccactg

SEQ ID NO: 3666445 - DNA, 15 bp, Homo sapiens
gctcgaatctctgtg

SEQ ID NO: 3666446 - DNA, 16 bp, Homo sapiens
gctcgaatctctgtgc

SEQ ID NO: 3666447 - DNA, 19 bp, Homo sapiens
gctcgaatctctgtgcctt

SEQ ID NO: 3666448 - DNA, 20 bp, Homo sapiens
gctcgcgaaggtcccacagc

SEQ ID NO: 3666449 - DNA, 16 bp, Homo sapiens
gctctaggatggggca

SEQ ID NO: 3666450 - DNA, 12 bp, Homo sapiens
gctctagtgcct

SEQ ID NO: 3666451 - DNA, 15 bp, Homo sapiens
gctctagtgccttct

SEQ ID NO: 3666452 - DNA, 16 bp, Homo sapiens
gctctcctgactttta

SEQ ID NO: 3666453 - DNA, 13 bp, Homo sapiens
gctctctgctgta

SEQ ID NO: 3666454 - DNA, 14 bp, Homo sapiens
gctctgagcgcctc

SEQ ID NO: 3666455 - DNA, 17 bp, Homo sapiens
gctctgagcgcctccat

SEQ ID NO: 3666456 - DNA, 18 bp, Homo sapiens
gctctgagcgcctccatc

SEQ ID NO: 3666457 - DNA, 23 bp, Homo sapiens
gctctgcaagaattgaagcagga

SEQ ID NO: 3666458 - DNA, 22 bp, Homo sapiens
gctctgctcaaatgttgcagga

SEQ ID NO: 3666459 - DNA, 19 bp, Homo sapiens
gctctggacagccccaccc

SEQ ID NO: 3666460 - DNA, 20 bp, Homo sapiens
gctctggacagccccaccct

SEQ ID NO: 3666461 - DNA, 17 bp, Homo sapiens
gctctgggtgggcgggg

SEQ ID NO: 3666462 - DNA, 21 bp, Homo sapiens
gctctgggtgggcgtggcctg

SEQ ID NO: 3666463 - DNA, 19 bp, Homo sapiens
gctctgtctacttgctcag

SEQ ID NO: 3666464 - DNA, 18 bp, Homo sapiens
gctctgtctcccaggctg

SEQ ID NO: 3666465 - DNA, 19 bp, Homo sapiens
gctctgtctcccaggctgg

SEQ ID NO: 3666466 - DNA, 15 bp, Homo sapiens
actggctttggcttc

SEQ ID NO: 3666467 - DNA, 16 bp, Homo sapiens
actggctttggcttct

SEQ ID NO: 3666468 - DNA, 12 bp, Homo sapiens
actgggccctga

SEQ ID NO: 3666469 - DNA, 13 bp, Homo sapiens
actggtgcacttt

SEQ ID NO: 3666470 - DNA, 21 bp, Homo sapiens
actggtgcactttgtaaattc

SEQ ID NO: 3666471 - DNA, 17 bp, Homo sapiens
actgtacaataaaaaca

SEQ ID NO: 3666472 - DNA, 20 bp, Homo sapiens
actgtcaggctgaaaacaat

SEQ ID NO: 3666473 - DNA, 16 bp, Homo sapiens
actgtcccttgcctca

SEQ ID NO: 3666474 - DNA, 16 bp, Homo sapiens
actgtcctgggcctgc

SEQ ID NO: 3666475 - DNA, 17 bp, Homo sapiens
actgtcctgggcctgca

SEQ ID NO: 3666476 - DNA, 19 bp, Homo sapiens
actgtctttaaaagagaga

SEQ ID NO: 3666477 - DNA, 15 bp, Homo sapiens
actgtgaaggaccct

SEQ ID NO: 3666478 - DNA, 14 bp, Homo sapiens
actgtgtgatcagg

SEQ ID NO: 3666479 - DNA, 16 bp, Homo sapiens
actgttactgggccct

SEQ ID NO: 3666480 - DNA, 18 bp, Homo sapiens
actgttactgggccctga

SEQ ID NO: 3666481 - DNA, 22 bp, Homo sapiens
actgttactttggcaatttcct

SEQ ID NO: 3666482 - DNA, 14 bp, Homo sapiens
actgttatttaatt

SEQ ID NO: 3666483 - DNA, 16 bp, Homo sapiens
actgttgttaagcaac

SEQ ID NO: 3666484 - DNA, 21 bp, Homo sapiens
actgtttgtttttatttaaat

SEQ ID NO: 3666485 - DNA, 14 bp, Homo sapiens
actgttttgaggaa

SEQ ID NO: 3666486 - DNA, 23 bp, Homo sapiens
actgttttttttttttttaattt

SEQ ID NO: 3666487 - DNA, 23 bp, Homo sapiens
acttaactatctgttcccttcct

SEQ ID NO: 3666488 - DNA, 14 bp, Homo sapiens
acttaagcaaaaga

SEQ ID NO: 3666489 - DNA, 16 bp, Homo sapiens
acttaagcaaaagaaa

SEQ ID NO: 3666490 - DNA, 19 bp, Homo sapiens
acttagaacctttctgtgt

SEQ ID NO: 3666491 - DNA, 16 bp, Homo sapiens
acttagggaagaaaaa

SEQ ID NO: 3666492 - DNA, 23 bp, Homo sapiens
acttagggcaccaggggtttctc

SEQ ID NO: 3666493 - DNA, 12 bp, Homo sapiens
acttattaacaa

SEQ ID NO: 3666494 - DNA, 20 bp, Homo sapiens
acttcaaagaagctgtcttg

SEQ ID NO: 3666495 - DNA, 15 bp, Homo sapiens
acttcaataatcatt

SEQ ID NO: 3666496 - DNA, 16 bp, Homo sapiens
acttcattttcagagt

SEQ ID NO: 3666497 - DNA, 17 bp, Homo sapiens
acttcattttcagagtg

SEQ ID NO: 3666498 - DNA, 17 bp, Homo sapiens
acttcccaccctgcccc

SEQ ID NO: 3666499 - DNA, 19 bp, Homo sapiens
acttcccaccctgcccctc

SEQ ID NO: 3666500 - DNA, 16 bp, Homo sapiens
acttccccacaggtga

SEQ ID NO: 3666501 - DNA, 18 bp, Homo sapiens
acttcctgtccagctcca

SEQ ID NO: 3666502 - DNA, 14 bp, Homo sapiens
acttcgcagaggca

SEQ ID NO: 3666503 - DNA, 22 bp, Homo sapiens
acttcgggaggtcgaggcagga

SEQ ID NO: 3666504 - DNA, 18 bp, Homo sapiens
acttctacccagatggaa

SEQ ID NO: 3666505 - DNA, 23 bp, Homo sapiens
acttctacttctgcccttgccaa

SEQ ID NO: 3666506 - DNA, 18 bp, Homo sapiens
acttctgaactttggaag

SEQ ID NO: 3666507 - DNA, 13 bp, Homo sapiens
acttctgcctgga

SEQ ID NO: 3666508 - DNA, 20 bp, Homo sapiens
acttctgtgagacccccaca

SEQ ID NO: 3666509 - DNA, 17 bp, Homo sapiens
acttcttacgcaatgct

SEQ ID NO: 3666510 - DNA, 12 bp, Homo sapiens
acttcttgaagg

SEQ ID NO: 3666511 - DNA, 14 bp, Homo sapiens
acttgaagggccag

SEQ ID NO: 3666512 - DNA, 18 bp, Homo sapiens
acttgaagggccagagcc

SEQ ID NO: 3666513 - DNA, 20 bp, Homo sapiens
acttgaagggccagagccag

SEQ ID NO: 3666514 - DNA, 17 bp, Homo sapiens
acttgacagaacactgt

SEQ ID NO: 3666515 - DNA, 14 bp, Homo sapiens
acttgaccctgagc

SEQ ID NO: 3666516 - DNA, 13 bp, Homo sapiens
acttgcctcttcc

SEQ ID NO: 3666517 - DNA, 19 bp, Homo sapiens
acttggctcgaatctctgt

SEQ ID NO: 3666518 - DNA, 21 bp, Homo sapiens
acttggctcgaatctctgtgc

SEQ ID NO: 3666519 - DNA, 16 bp, Homo sapiens
acttggctgcaggaat

SEQ ID NO: 3666520 - DNA, 14 bp, Homo sapiens
acttgggccactgt

SEQ ID NO: 3666521 - DNA, 15 bp, Homo sapiens
acttggtcagagcca

SEQ ID NO: 3666522 - DNA, 15 bp, Homo sapiens
acttgttccagctct

SEQ ID NO: 3666523 - DNA, 17 bp, Homo sapiens
acttgttccagctcttt

SEQ ID NO: 3666524 - DNA, 16 bp, Homo sapiens
actttaaatttaaagt

SEQ ID NO: 3666525 - DNA, 17 bp, Homo sapiens
actttagaaagctgaca

SEQ ID NO: 3666526 - DNA, 13 bp, Homo sapiens
actttagtgaaag

SEQ ID NO: 3666527 - DNA, 22 bp, Homo sapiens
actttataagtcattgtatgtt

SEQ ID NO: 3666528 - DNA, 22 bp, Homo sapiens
actttcaggccacatggctaaa

SEQ ID NO: 3666529 - DNA, 21 bp, Homo sapiens
actttccgaaaaataaagaca

SEQ ID NO: 3666530 - DNA, 14 bp, Homo sapiens
actttcctgcaact

SEQ ID NO: 3666531 - DNA, 23 bp, Homo sapiens
actttgtaaataggatttttaga

SEQ ID NO: 3666532 - DNA, 10 bp, Homo sapiens
acttttcatt

SEQ ID NO: 3666533 - DNA, 11 bp, Homo sapiens
acttttctggg

SEQ ID NO: 3666534 - DNA, 15 bp, Homo sapiens
actttttagtaattt

SEQ ID NO: 3666535 - DNA, 17 bp, Homo sapiens
actttttagtaatttct

SEQ ID NO: 3666536 - DNA, 18 bp, Homo sapiens
acttttttaaatattttc

SEQ ID NO: 3666537 - DNA, 19 bp, Homo sapiens
acttttttaaatattttct

SEQ ID NO: 3666538 - DNA, 13 bp, Homo sapiens
agaaaaagaaaaa

SEQ ID NO: 3666539 - DNA, 23 bp, Homo sapiens
agaaaatatatgtatttttatat

SEQ ID NO: 3666540 - DNA, 15 bp, Homo sapiens
agaaacacactgagg

SEQ ID NO: 3666541 - DNA, 16 bp, Homo sapiens
agaaacccgacagagg

SEQ ID NO: 3666542 - DNA, 18 bp, Homo sapiens
agaaacccgacagaggga

SEQ ID NO: 3666543 - DNA, 23 bp, Homo sapiens
agaaacctactgcccaggcactg

SEQ ID NO: 3666544 - DNA, 18 bp, Homo sapiens
agaaacctgttgaagatt

SEQ ID NO: 3666545 - DNA, 20 bp, Homo sapiens
agaaagaaacccgacagagg

SEQ ID NO: 3666546 - DNA, 22 bp, Homo sapiens
agaaagaaacccgacagaggga

SEQ ID NO: 3666547 - DNA, 20 bp, Homo sapiens
agaaagatgtatataggtgt

SEQ ID NO: 3666548 - DNA, 13 bp, Homo sapiens
agaaagccttctt

SEQ ID NO: 3666549 - DNA, 14 bp, Homo sapiens
agaaagttcatgct

SEQ ID NO: 3666550 - DNA, 14 bp, Homo sapiens
agaaatacaaaaat

SEQ ID NO: 3666551 - DNA, 14 bp, Homo sapiens
agaaatctagaaga

SEQ ID NO: 3666552 - DNA, 19 bp, Homo sapiens
agaaatctagaatttttac

SEQ ID NO: 3666553 - DNA, 23 bp, Homo sapiens
agaaatggtccgctttcctggag

SEQ ID NO: 3666554 - DNA, 16 bp, Homo sapiens
agaacacaaggtcatt

SEQ ID NO: 3666555 - DNA, 23 bp, Homo sapiens
agaacaggtgttggtgacaattg

SEQ ID NO: 3666556 - DNA, 16 bp, Homo sapiens
agaaccagtcccccca

SEQ ID NO: 3666557 - DNA, 19 bp, Homo sapiens
agaaccagtccccccaccc

SEQ ID NO: 3666558 - DNA, 18 bp, Homo sapiens
agaacctcacgcacctcc

SEQ ID NO: 3666559 - DNA, 15 bp, Homo sapiens
agaacctcttcccca

SEQ ID NO: 3666560 - DNA, 20 bp, Homo sapiens
agaacctggaacttggggag

SEQ ID NO: 3666561 - DNA, 21 bp, Homo sapiens
agaacctggaacttggggagt

SEQ ID NO: 3666562 - DNA, 20 bp, Homo sapiens
agaaccttgtcccagccagt

SEQ ID NO: 3666563 - DNA, 19 bp, Homo sapiens
agaactcaaatggggccag

SEQ ID NO: 3666564 - DNA, 15 bp, Homo sapiens
agaactccaggccct

SEQ ID NO: 3666565 - DNA, 15 bp, Homo sapiens
agaactcctacctga

SEQ ID NO: 3666566 - DNA, 22 bp, Homo sapiens
agaactcctacctgaaggcagg

SEQ ID NO: 3666567 - DNA, 16 bp, Homo sapiens
agaactgcaggccctg

SEQ ID NO: 3666568 - DNA, 20 bp, Homo sapiens
agaactgcaggccctggcct

SEQ ID NO: 3666569 - DNA, 15 bp, Homo sapiens
agaactgctgtttca

SEQ ID NO: 3666570 - DNA, 20 bp, Homo sapiens
agaactttgagctactgccg

SEQ ID NO: 3666571 - DNA, 12 bp, Homo sapiens
agaagaaagcaa

SEQ ID NO: 3666572 - DNA, 13 bp, Homo sapiens
agaagaaagcaaa

SEQ ID NO: 3666573 - DNA, 18 bp, Homo sapiens
agaagaaattaaggaaca

SEQ ID NO: 3666574 - DNA, 18 bp, Homo sapiens
agaagaagaaggagagca

SEQ ID NO: 3666575 - DNA, 14 bp, Homo sapiens
agaagaaggagagc

SEQ ID NO: 3666576 - DNA, 15 bp, Homo sapiens
agaagacaaaaagac

SEQ ID NO: 3666577 - DNA, 13 bp, Homo sapiens
agaagccaggaat

SEQ ID NO: 3666578 - DNA, 22 bp, Homo sapiens
agaagccaggaatttcccagga

SEQ ID NO: 3666579 - DNA, 17 bp, Homo sapiens
agaagcccccagctaag

SEQ ID NO: 3666580 - DNA, 23 bp, Homo sapiens
agaagcccccagctaagaacctg

SEQ ID NO: 3666581 - DNA, 24 bp, Homo sapiens
agaagcccccagctaagaacctgg

SEQ ID NO: 3666582 - DNA, 14 bp, Homo sapiens
agaagcctctggct

SEQ ID NO: 3666583 - DNA, 22 bp, Homo sapiens
agatcccaagtagaatctcagt

SEQ ID NO: 3666584 - DNA, 15 bp, Homo sapiens
agatcgcagtttgcc

SEQ ID NO: 3666585 - DNA, 20 bp, Homo sapiens
agatctggaacctcagcctg

SEQ ID NO: 3666586 - DNA, 15 bp, Homo sapiens
agatctgtcctcagc

SEQ ID NO: 3666587 - DNA, 18 bp, Homo sapiens
agatctgtcctcagcctt

SEQ ID NO: 3666588 - DNA, 17 bp, Homo sapiens
agatgagaaaacaggct

SEQ ID NO: 3666589 - DNA, 16 bp, Homo sapiens
agatgatattaagaac

SEQ ID NO: 3666590 - DNA, 15 bp, Homo sapiens
agatgcaaggaccag

SEQ ID NO: 3666591 - DNA, 17 bp, Homo sapiens
agatgcaaggaccagga

SEQ ID NO: 3666592 - DNA, 20 bp, Homo sapiens
agatgcaccaccaagccaag

SEQ ID NO: 3666593 - DNA, 21 bp, Homo sapiens
agatgcaccaccaagccaagg

SEQ ID NO: 3666594 - DNA, 12 bp, Homo sapiens
agatgccccaga

SEQ ID NO: 3666595 - DNA, 17 bp, Homo sapiens
agatgccccagagctgt

SEQ ID NO: 3666596 - DNA, 18 bp, Homo sapiens
agatgctggcccagggcc

SEQ ID NO: 3666597 - DNA, 19 bp, Homo sapiens
agatgctggcccagggccc

SEQ ID NO: 3666598 - DNA, 23 bp, Homo sapiens
agatgctggcccagggcccagag

SEQ ID NO: 3666599 - DNA, 16 bp, Homo sapiens
agatgcttctcactgc

SEQ ID NO: 3666600 - DNA, 11 bp, Homo sapiens
agatgctttta

SEQ ID NO: 3666601 - DNA, 18 bp, Homo sapiens
agatgcttttaacagagt

SEQ ID NO: 3666602 - DNA, 17 bp, Homo sapiens
agatggaaccgcaggaa

SEQ ID NO: 3666603 - DNA, 15 bp, Homo sapiens
agatggctcctctca

SEQ ID NO: 3666604 - DNA, 21 bp, Homo sapiens
agatgggccggcccccttcct

SEQ ID NO: 3666605 - DNA, 23 bp, Homo sapiens
agatgggccggcccccttcctgg

SEQ ID NO: 3666606 - DNA, 14 bp, Homo sapiens
agatgtaatgtttt

SEQ ID NO: 3666607 - DNA, 17 bp, Homo sapiens
agatgtaatgttttctt

SEQ ID NO: 3666608 - DNA, 23 bp, Homo sapiens
agatgttacaagtttatatatat

SEQ ID NO: 3666609 - DNA, 14 bp, Homo sapiens
agatgtttcacacc

SEQ ID NO: 3666610 - DNA, 16 bp, Homo sapiens
agattatttcattcgt

SEQ ID NO: 3666611 - DNA, 12 bp, Homo sapiens
agattcttcagc

SEQ ID NO: 3666612 - DNA, 19 bp, Homo sapiens
agatttattttttggactt

SEQ ID NO: 3666613 - DNA, 13 bp, Homo sapiens
agattttgcattt

SEQ ID NO: 3666614 - DNA, 21 bp, Homo sapiens
agattttgtatatttaggaaa

SEQ ID NO: 3666615 - DNA, 21 bp, Homo sapiens
agattttttcagacttgtcaa

SEQ ID NO: 3666616 - DNA, 14 bp, Homo sapiens
agcaaaagaaaaag

SEQ ID NO: 3666617 - DNA, 15 bp, Homo sapiens
agcaaaaggctgaga

SEQ ID NO: 3666618 - DNA, 20 bp, Homo sapiens
agcaaaatcaagcaagcctc

SEQ ID NO: 3666619 - DNA, 18 bp, Homo sapiens
agcaaatcaccacaaact

SEQ ID NO: 3666620 - DNA, 15 bp, Homo sapiens
agcaagaaagaaacc

SEQ ID NO: 3666621 - DNA, 22 bp, Homo sapiens
agcaagaaggaaagatttgtga

SEQ ID NO: 3666622 - DNA, 20 bp, Homo sapiens
agcaaggtgtggaggctcct

SEQ ID NO: 3666623 - DNA, 21 bp, Homo sapiens
agcaaggtgtggaggctcctg

SEQ ID NO: 3666624 - DNA, 22 bp, Homo sapiens
agcaaggtgtggaggctcctgt

SEQ ID NO: 3666625 - DNA, 16 bp, Homo sapiens
agcaagtgagaccctg

SEQ ID NO: 3666626 - DNA, 18 bp, Homo sapiens
agcacagcttgacctgag

SEQ ID NO: 3666627 - DNA, 14 bp, Homo sapiens
agcaccctgtcttc

SEQ ID NO: 3666628 - DNA, 17 bp, Homo sapiens
agcaccctgtcttctta

SEQ ID NO: 3666629 - DNA, 18 bp, Homo sapiens
agcaccgaggggcctttg

SEQ ID NO: 3666630 - DNA, 15 bp, Homo sapiens
agcaccttgtgcctg

SEQ ID NO: 3666631 - DNA, 17 bp, Homo sapiens
agcacgctaccaaatct

SEQ ID NO: 3666632 - DNA, 19 bp, Homo sapiens
agcactgtcccttgcctca

SEQ ID NO: 3666633 - DNA, 19 bp, Homo sapiens
agcacttgtctcaggactc

SEQ ID NO: 3666634 - DNA, 19 bp, Homo sapiens
agcactttgcaaggaatgt

SEQ ID NO: 3666635 - DNA, 22 bp, Homo sapiens
agcactttgggaggccaaggtg

SEQ ID NO: 3666636 - DNA, 18 bp, Homo sapiens
agcagaggaccagggcct

SEQ ID NO: 3666637 - DNA, 13 bp, Homo sapiens
agcagatgcaaag

SEQ ID NO: 3666638 - DNA, 19 bp, Homo sapiens
agcagatgcaaagaggcaa

SEQ ID NO: 3666639 - DNA, 20 bp, Homo sapiens
agcagccaagctccttggga

SEQ ID NO: 3666640 - DNA, 21 bp, Homo sapiens
agcagccaagctccttgggag

SEQ ID NO: 3666641 - DNA, 16 bp, Homo sapiens
agcagcccaccctgct

SEQ ID NO: 3666642 - DNA, 20 bp, Homo sapiens
agcagcccaccctgctgctg

SEQ ID NO: 3666643 - DNA, 15 bp, Homo sapiens
agcagcgcctttccc

SEQ ID NO: 3666644 - DNA, 18 bp, Homo sapiens
agcagctaaattttctga

SEQ ID NO: 3666645 - DNA, 12 bp, Homo sapiens
agcagcttccag

SEQ ID NO: 3666646 - DNA, 12 bp, Homo sapiens
agcaggaagctc

SEQ ID NO: 3666647 - DNA, 15 bp, Homo sapiens
agcaggaagctcaga

SEQ ID NO: 3666648 - DNA, 22 bp, Homo sapiens
agcagtaattaatatctcctgg

SEQ ID NO: 3666649 - DNA, 14 bp, Homo sapiens
agcagtcacaacag

SEQ ID NO: 3666650 - DNA, 17 bp, Homo sapiens
agcagtcgtgcctgtgt

SEQ ID NO: 3666651 - DNA, 19 bp, Homo sapiens
agcagtcgtgcctgtgtcc

SEQ ID NO: 3666652 - DNA, 21 bp, Homo sapiens
agcagtcgtgcctgtgtccat

SEQ ID NO: 3666653 - DNA, 16 bp, Homo sapiens
agcagtggctggtcca

SEQ ID NO: 3666654 - DNA, 17 bp, Homo sapiens
agcagtggctggtccag

SEQ ID NO: 3666655 - DNA, 21 bp, Homo sapiens
agcataaaaacattttaaaaa

SEQ ID NO: 3666656 - DNA, 17 bp, Homo sapiens
agcatactttgtaaata

SEQ ID NO: 3666657 - DNA, 22 bp, Homo sapiens
agcatactttgtaaataggatt

SEQ ID NO: 3666658 - DNA, 17 bp, Homo sapiens
agcatccccttgaactc

SEQ ID NO: 3666659 - DNA, 18 bp, Homo sapiens
agcatccccttgaactct

SEQ ID NO: 3666660 - DNA, 20 bp, Homo sapiens
agcatccccttgaactcttc

SEQ ID NO: 3666661 - DNA, 18 bp, Homo sapiens
agcatgaataacatttaa

SEQ ID NO: 3666662 - DNA, 20 bp, Homo sapiens
agcatgaataacatttaaat

SEQ ID NO: 3666663 - DNA, 15 bp, Homo sapiens
agcatgcatctgttt

SEQ ID NO: 3666664 - DNA, 15 bp, Homo sapiens
agcatgcttccctgc

SEQ ID NO: 3666665 - DNA, 17 bp, Homo sapiens
agcatgcttccctgcag

SEQ ID NO: 3666666 - DNA, 23 bp, Homo sapiens
agcatgcttccctgcagctgacc

SEQ ID NO: 3666667 - DNA, 16 bp, Homo sapiens
agcattccagcccctc

SEQ ID NO: 3666668 - DNA, 16 bp, Homo sapiens
agcatttagctggcca

SEQ ID NO: 3666669 - DNA, 20 bp, Homo sapiens
agcattttccagcactttgc

SEQ ID NO: 3666670 - DNA, 22 bp, Homo sapiens
agccaaaatgtaggcttagttt

SEQ ID NO: 3666671 - DNA, 17 bp, Homo sapiens
agccaagctccttggga

SEQ ID NO: 3666672 - DNA, 21 bp, Homo sapiens
agccaagggaacctgtgtccg

SEQ ID NO: 3666673 - DNA, 23 bp, Homo sapiens
agccaagtgtggtagagtgtgcc

SEQ ID NO: 3666674 - DNA, 19 bp, Homo sapiens
agccaatggcccggcccct

SEQ ID NO: 3666675 - DNA, 20 bp, Homo sapiens
agccaatggcccggcccctc

SEQ ID NO: 3666676 - DNA, 20 bp, Homo sapiens
agccaccccgggctctctgc

SEQ ID NO: 3666677 - DNA, 18 bp, Homo sapiens
agccacctcatccccaac

SEQ ID NO: 3666678 - DNA, 21 bp, Homo sapiens
agccactctatgagttggact

SEQ ID NO: 3666679 - DNA, 12 bp, Homo sapiens
agccagaagctg

SEQ ID NO: 3666680 - DNA, 14 bp, Homo sapiens
agccagaagctgag

SEQ ID NO: 3666681 - DNA, 18 bp, Homo sapiens
agccagaggctgggttca

SEQ ID NO: 3666682 - DNA, 14 bp, Homo sapiens
agccagcacctggc

SEQ ID NO: 3666683 - DNA, 17 bp, Homo sapiens
agccagcccctcttccc

SEQ ID NO: 3666684 - DNA, 16 bp, Homo sapiens
agccagcttagcaact

SEQ ID NO: 3666685 - DNA, 19 bp, Homo sapiens
agccaggaatttcccagga

SEQ ID NO: 3666686 - DNA, 22 bp, Homo sapiens
agccaggaatttcccaggaccc

SEQ ID NO: 3666687 - DNA, 23 bp, Homo sapiens
agccaggaatttcccaggaccct

SEQ ID NO: 3666688 - DNA, 14 bp, Homo sapiens
agccaggagctggg

SEQ ID NO: 3666689 - DNA, 21 bp, Homo sapiens
agccagtgacctgaggaagcg

SEQ ID NO: 3666690 - DNA, 21 bp, Homo sapiens
agccatgccgtctgccggacc

SEQ ID NO: 3666691 - DNA, 16 bp, Homo sapiens
agccatgcgccccctc

SEQ ID NO: 3666692 - DNA, 15 bp, Homo sapiens
agccatgtttcacaa

SEQ ID NO: 3666693 - DNA, 16 bp, Homo sapiens
agcccaaaagagggca

SEQ ID NO: 3666694 - DNA, 14 bp, Homo sapiens
agcccaagattctt

SEQ ID NO: 3666695 - DNA, 21 bp, Homo sapiens
agcccaagggatctggtccta

SEQ ID NO: 3666696 - DNA, 19 bp, Homo sapiens
agcccaccctgctgctggt

SEQ ID NO: 3666697 - DNA, 22 bp, Homo sapiens
agcccaccctgctgctggtgca

SEQ ID NO: 3666698 - DNA, 17 bp, Homo sapiens
agcccactgtcctgggc

SEQ ID NO: 3666699 - DNA, 23 bp, Homo sapiens
agcccactgtcctgggcctgcag

SEQ ID NO: 3666700 - DNA, 12 bp, Homo sapiens
agcccagagaca

SEQ ID NO: 3666701 - DNA, 21 bp, Homo sapiens
agcccagagacatacttgaag

SEQ ID NO: 3666702 - DNA, 15 bp, Homo sapiens
agcccagggctcctg

SEQ ID NO: 3666703 - DNA, 16 bp, Homo sapiens
agcccagggctcctgc

SEQ ID NO: 3666704 - DNA, 17 bp, Homo sapiens
agcccagggctcctgca

SEQ ID NO: 3666705 - DNA, 15 bp, Homo sapiens
agcccagtagacctt

SEQ ID NO: 3666706 - DNA, 22 bp, Homo sapiens
agcccatgcccacctgcccatc

SEQ ID NO: 3666707 - DNA, 12 bp, Homo sapiens
agccccacccag

SEQ ID NO: 3666708 - DNA, 17 bp, Homo sapiens
agccccatcagctccag

SEQ ID NO: 3666709 - DNA, 19 bp, Homo sapiens
agcccccagctaagaacct

SEQ ID NO: 3666710 - DNA, 23 bp, Homo sapiens
agccccccaggctgcccagagct

SEQ ID NO: 3666711 - DNA, 22 bp, Homo sapiens
agcccctctggtcgctcctgcc

SEQ ID NO: 3666712 - DNA, 12 bp, Homo sapiens
agcccctcttcc

SEQ ID NO: 3666713 - DNA, 23 bp, Homo sapiens
agcccctgtctagagagggaggc

SEQ ID NO: 3666714 - DNA, 13 bp, Homo sapiens
agcccggactgac

SEQ ID NO: 3666715 - DNA, 20 bp, Homo sapiens
agcccggactgaccaaatca

SEQ ID NO: 3666716 - DNA, 23 bp, Homo sapiens
agccctccgccattctcaagccc

SEQ ID NO: 3666717 - DNA, 15 bp, Homo sapiens
agccctgagctttct

SEQ ID NO: 3666718 - DNA, 20 bp, Homo sapiens
agccctgttgacacaggtct

SEQ ID NO: 3666719 - DNA, 17 bp, Homo sapiens
agccgccattgccacca

SEQ ID NO: 3666720 - DNA, 18 bp, Homo sapiens
agccgccattgccaccag

SEQ ID NO: 3666721 - DNA, 14 bp, Homo sapiens
agccggcacagggt

SEQ ID NO: 3666722 - DNA, 13 bp, Homo sapiens
agccgtgagcatg

SEQ ID NO: 3666723 - DNA, 16 bp, Homo sapiens
agccgtgccctgcccc

SEQ ID NO: 3666724 - DNA, 12 bp, Homo sapiens
agcctccctgaa

SEQ ID NO: 3666725 - DNA, 15 bp, Homo sapiens
agcctccctgaagcc

SEQ ID NO: 3666726 - DNA, 22 bp, Homo sapiens
agcctctccccaggtccagctc

SEQ ID NO: 3666727 - DNA, 13 bp, Homo sapiens
agcctctcgtccc

SEQ ID NO: 3666728 - DNA, 13 bp, Homo sapiens
agcctctggctag

SEQ ID NO: 3666729 - DNA, 20 bp, Homo sapiens
agcctcttctgtcccaagtc

SEQ ID NO: 3666730 - DNA, 17 bp, Homo sapiens
agcctgaagggcctccc

SEQ ID NO: 3666731 - DNA, 22 bp, Homo sapiens
agcctgaaggggcgtctgttcc

SEQ ID NO: 3666732 - DNA, 18 bp, Homo sapiens
agcctgatgagattttta

SEQ ID NO: 3666733 - DNA, 19 bp, Homo sapiens
agcctgatgagatttttaa

SEQ ID NO: 3666734 - DNA, 19 bp, Homo sapiens
agcctgcctcttctctact

SEQ ID NO: 3666735 - DNA, 17 bp, Homo sapiens
agcctgctccagctgtt

SEQ ID NO: 3666736 - DNA, 19 bp, Homo sapiens
agcctgctccagctgttca

SEQ ID NO: 3666737 - DNA, 16 bp, Homo sapiens
agcctggccagacaca

SEQ ID NO: 3666738 - DNA, 18 bp, Homo sapiens
agcctggccagacacagg

SEQ ID NO: 3666739 - DNA, 12 bp, Homo sapiens
agcctgggaggt

SEQ ID NO: 3666740 - DNA, 20 bp, Homo sapiens
agcctgggaggtcaaggctg

SEQ ID NO: 3666741 - DNA, 18 bp, Homo sapiens
agcctgggcagccaggct

SEQ ID NO: 3666742 - DNA, 19 bp, Homo sapiens
agcctgggtgacaaagcga

SEQ ID NO: 3666743 - DNA, 15 bp, Homo sapiens
agcctggtggcccag

SEQ ID NO: 3666744 - DNA, 21 bp, Homo sapiens
agcctgtggcatctttgcctt

SEQ ID NO: 3666745 - DNA, 23 bp, Homo sapiens
agcctgtgtctttaaatgctgct

SEQ ID NO: 3666746 - DNA, 17 bp, Homo sapiens
agcctgttacaggaatg

SEQ ID NO: 3666747 - DNA, 21 bp, Homo sapiens
agcctgttgaaggactacagg

SEQ ID NO: 3666748 - DNA, 13 bp, Homo sapiens
agccttcaagtgc

SEQ ID NO: 3666749 - DNA, 17 bp, Homo sapiens
agccttcaagtgccaaa

SEQ ID NO: 3666750 - DNA, 24 bp, Homo sapiens
agccttcaagtgccaaacagagta

SEQ ID NO: 3666751 - DNA, 13 bp, Homo sapiens
agccttgccagag

SEQ ID NO: 3666752 - DNA, 19 bp, Homo sapiens
agccttgccagagatccaa

SEQ ID NO: 3666753 - DNA, 17 bp, Homo sapiens
agcctttgggaaatgct

SEQ ID NO: 3666754 - DNA, 17 bp, Homo sapiens
agcgatcagccatggcg

SEQ ID NO: 3666755 - DNA, 17 bp, Homo sapiens
agcgcccctcagcctct

SEQ ID NO: 3666756 - DNA, 22 bp, Homo sapiens
agcgcccctcagcctctgccac

SEQ ID NO: 3666757 - DNA, 19 bp, Homo sapiens
agcgcctccttaggagtgg

SEQ ID NO: 3666758 - DNA, 14 bp, Homo sapiens
agcggaaagcagct

SEQ ID NO: 3666759 - DNA, 23 bp, Homo sapiens
agcggaaagcagctcaaaggcac

SEQ ID NO: 3666760 - DNA, 22 bp, Homo sapiens
agcgtgaaggccgagaagcaag

SEQ ID NO: 3666761 - DNA, 16 bp, Homo sapiens
agctaactgtaaatca

SEQ ID NO: 3666762 - DNA, 12 bp, Homo sapiens
agctaagaacct

SEQ ID NO: 3666763 - DNA, 13 bp, Homo sapiens
agctaagaacctg

SEQ ID NO: 3666764 - DNA, 17 bp, Homo sapiens
agctagtgtctcctctc

SEQ ID NO: 3666765 - DNA, 12 bp, Homo sapiens
agctagttttct

SEQ ID NO: 3666766 - DNA, 14 bp, Homo sapiens
agctatcaggaaca

SEQ ID NO: 3666767 - DNA, 20 bp, Homo sapiens
agctatgaaatactcagggt

SEQ ID NO: 3666768 - DNA, 19 bp, Homo sapiens
agctatgggagccccaggg

SEQ ID NO: 3666769 - DNA, 18 bp, Homo sapiens
agctcaggacagatgcca

SEQ ID NO: 3666770 - DNA, 16 bp, Homo sapiens
agctccaacctgcaaa

SEQ ID NO: 3666771 - DNA, 11 bp, Homo sapiens
agctccactct

SEQ ID NO: 3666772 - DNA, 16 bp, Homo sapiens
agctccactctgcttc

SEQ ID NO: 3666773 - DNA, 22 bp, Homo sapiens
agctccactctgcttctctgac

SEQ ID NO: 3666774 - DNA, 23 bp, Homo sapiens
agctccactctgcttctctgact

SEQ ID NO: 3666775 - DNA, 24 bp, Homo sapiens
agctccactctgcttctctgactt

SEQ ID NO: 3666776 - DNA, 14 bp, Homo sapiens
agctccagctttct

SEQ ID NO: 3666777 - DNA, 13 bp, Homo sapiens
agctccaggatgg

SEQ ID NO: 3666778 - DNA, 13 bp, Homo sapiens
agctcctcctccc

SEQ ID NO: 3666779 - DNA, 16 bp, Homo sapiens
agctcctctccccagc

SEQ ID NO: 3666780 - DNA, 16 bp, Homo sapiens
agctcctgtggcccca

SEQ ID NO: 3666781 - DNA, 22 bp, Homo sapiens
agctcctgtggccccaccctgg

SEQ ID NO: 3666782 - DNA, 12 bp, Homo sapiens
agctccttggga

SEQ ID NO: 3666783 - DNA, 14 bp, Homo sapiens
agctctcctgactt

SEQ ID NO: 3666784 - DNA, 21 bp, Homo sapiens
agctctggacagccccaccct

SEQ ID NO: 3666785 - DNA, 12 bp, Homo sapiens
agctctggaggg

SEQ ID NO: 3666786 - DNA, 17 bp, Homo sapiens
agctctggaggggaggg

SEQ ID NO: 3666787 - DNA, 13 bp, Homo sapiens
agctcttcaggcc

SEQ ID NO: 3666788 - DNA, 15 bp, Homo sapiens
agctcttcaggcctc

SEQ ID NO: 3666789 - DNA, 16 bp, Homo sapiens
agctcttcaggcctcc

SEQ ID NO: 3666790 - DNA, 18 bp, Homo sapiens
agctcttcaggcctccct

SEQ ID NO: 3666791 - DNA, 22 bp, Homo sapiens
agctcttctgccggccctgggg

SEQ ID NO: 3666792 - DNA, 13 bp, Homo sapiens
agctgaattttct

SEQ ID NO: 3666793 - DNA, 16 bp, Homo sapiens
agctgaattttctgga

SEQ ID NO: 3666794 - DNA, 18 bp, Homo sapiens
agctgaattttctggaaa

SEQ ID NO: 3666795 - DNA, 16 bp, Homo sapiens
agctgaccagccgtga

SEQ ID NO: 3666796 - DNA, 21 bp, Homo sapiens
agctgacttttctgtccgagc

SEQ ID NO: 3666797 - DNA, 16 bp, Homo sapiens
agctgagcaaatcacc

SEQ ID NO: 3666798 - DNA, 15 bp, Homo sapiens
agctgagcaccaggg

SEQ ID NO: 3666799 - DNA, 19 bp, Homo sapiens
agctgcaccctcaggcagg

SEQ ID NO: 3666800 - DNA, 19 bp, Homo sapiens
agctgcccagcccctcctc

SEQ ID NO: 3666801 - DNA, 22 bp, Homo sapiens
agctgcccagcccctcctccct

SEQ ID NO: 3666802 - DNA, 16 bp, Homo sapiens
agctgcccctgctgct

SEQ ID NO: 3666803 - DNA, 14 bp, Homo sapiens
agctgcccctggct

SEQ ID NO: 3666804 - DNA, 23 bp, Homo sapiens
agctgcctccagcctggtggccc

SEQ ID NO: 3666805 - DNA, 15 bp, Homo sapiens
agctgctatagcctg

SEQ ID NO: 3666806 - DNA, 17 bp, Homo sapiens
agctgctccctggcatt

SEQ ID NO: 3666807 - DNA, 19 bp, Homo sapiens
agctgctcctagagggagg

SEQ ID NO: 3666808 - DNA, 22 bp, Homo sapiens
agctgctcctagagggaggggc

SEQ ID NO: 3666809 - DNA, 16 bp, Homo sapiens
agctgctctgtcttct

SEQ ID NO: 3666810 - DNA, 20 bp, Homo sapiens
agctggccgagggtcctggc

SEQ ID NO: 3666811 - DNA, 23 bp, Homo sapiens
agctggccgagggtcctggctcc

SEQ ID NO: 3666812 - DNA, 20 bp, Homo sapiens
agctggctctgagcgcctcc

SEQ ID NO: 3666813 - DNA, 11 bp, Homo sapiens
agctggctgac

SEQ ID NO: 3666814 - DNA, 12 bp, Homo sapiens
agctggctgact

SEQ ID NO: 3666815 - DNA, 12 bp, Homo sapiens
aggcaggaaggg

SEQ ID NO: 3666816 - DNA, 16 bp, Homo sapiens
aggcaggaagggaagc

SEQ ID NO: 3666817 - DNA, 20 bp, Homo sapiens
aggcaggaagggcaggaagg

SEQ ID NO: 3666818 - DNA, 14 bp, Homo sapiens
aggcaggcatggcc

SEQ ID NO: 3666819 - DNA, 17 bp, Homo sapiens
aggcaggcatggccctg

SEQ ID NO: 3666820 - DNA, 18 bp, Homo sapiens
aggcaggcatggccctgg

SEQ ID NO: 3666821 - DNA, 16 bp, Homo sapiens
aggcaggctcccaggg

SEQ ID NO: 3666822 - DNA, 23 bp, Homo sapiens
aggcagggagacggtttccaggg

SEQ ID NO: 3666823 - DNA, 13 bp, Homo sapiens
aggcagggctcct

SEQ ID NO: 3666824 - DNA, 18 bp, Homo sapiens
aggcagggctcctccctg

SEQ ID NO: 3666825 - DNA, 19 bp, Homo sapiens
aggcagggctcctccctgg

SEQ ID NO: 3666826 - DNA, 22 bp, Homo sapiens
aggcagggctcctccctggagc

SEQ ID NO: 3666827 - DNA, 22 bp, Homo sapiens
aggcataggtctctttgctttc

SEQ ID NO: 3666828 - DNA, 21 bp, Homo sapiens
aggcatctctgtactttgctt

SEQ ID NO: 3666829 - DNA, 13 bp, Homo sapiens
aggcatggccctg

SEQ ID NO: 3666830 - DNA, 16 bp, Homo sapiens
aggcatggccctgggc

SEQ ID NO: 3666831 - DNA, 21 bp, Homo sapiens
aggcatgggtgcaaggaaaat

SEQ ID NO: 3666832 - DNA, 17 bp, Homo sapiens
aggcatgtgtgaaacat

SEQ ID NO: 3666833 - DNA, 16 bp, Homo sapiens
aggcatttgctgaata

SEQ ID NO: 3666834 - DNA, 15 bp, Homo sapiens
aggcatttttaccat

SEQ ID NO: 3666835 - DNA, 16 bp, Homo sapiens
aggccaaggtgggagg

SEQ ID NO: 3666836 - DNA, 18 bp, Homo sapiens
aggccaaggtgggaggat

SEQ ID NO: 3666837 - DNA, 17 bp, Homo sapiens
aggccacctccccagca

SEQ ID NO: 3666838 - DNA, 14 bp, Homo sapiens
aggccagagccaag

SEQ ID NO: 3666839 - DNA, 20 bp, Homo sapiens
aggccagagtggcctggcca

SEQ ID NO: 3666840 - DNA, 21 bp, Homo sapiens
aggccagagtggcctggccag

SEQ ID NO: 3666841 - DNA, 13 bp, Homo sapiens
aggccagccagtg

SEQ ID NO: 3666842 - DNA, 22 bp, Homo sapiens
aggccagccagtgacctgagga

SEQ ID NO: 3666843 - DNA, 14 bp, Homo sapiens
aggccagccccacc

SEQ ID NO: 3666844 - DNA, 15 bp, Homo sapiens
aggccagccccaccc

SEQ ID NO: 3666845 - DNA, 16 bp, Homo sapiens
aggccagccccaccca

SEQ ID NO: 3666846 - DNA, 19 bp, Homo sapiens
aggccagctggcagcagag

SEQ ID NO: 3666847 - DNA, 13 bp, Homo sapiens
aggcccccaagcc

SEQ ID NO: 3666848 - DNA, 18 bp, Homo sapiens
aggcccccagcccagggc

SEQ ID NO: 3666849 - DNA, 22 bp, Homo sapiens
aggcccccagcccagggctcct

SEQ ID NO: 3666850 - DNA, 13 bp, Homo sapiens
aggccccttccac

SEQ ID NO: 3666851 - DNA, 16 bp, Homo sapiens
aggcccgccctgcccg

SEQ ID NO: 3666852 - DNA, 15 bp, Homo sapiens
aggcccgtccggcag

SEQ ID NO: 3666853 - DNA, 12 bp, Homo sapiens
aggccctcccaa

SEQ ID NO: 3666854 - DNA, 15 bp, Homo sapiens
aggccctctggagtg

SEQ ID NO: 3666855 - DNA, 21 bp, Homo sapiens
aggccctggcctcccctgcca

SEQ ID NO: 3666856 - DNA, 23 bp, Homo sapiens
aggccctggcctcccctgccacc

SEQ ID NO: 3666857 - DNA, 19 bp, Homo sapiens
aggccgagaagcaagaaag

SEQ ID NO: 3666858 - DNA, 14 bp, Homo sapiens
aggccgtttctcat

SEQ ID NO: 3666859 - DNA, 14 bp, Homo sapiens
aggcctcagccaga

SEQ ID NO: 3666860 - DNA, 16 bp, Homo sapiens
aggcctcagccagaga

SEQ ID NO: 3666861 - DNA, 21 bp, Homo sapiens
aggcctgaaagaggctgaggc

SEQ ID NO: 3666862 - DNA, 19 bp, Homo sapiens
aggcctgcgaccctggggg

SEQ ID NO: 3666863 - DNA, 17 bp, Homo sapiens
aggcctggactttcctg

SEQ ID NO: 3666864 - DNA, 18 bp, Homo sapiens
aggcctggactttcctgc

SEQ ID NO: 3666865 - DNA, 21 bp, Homo sapiens
aggcctgggccgctgccacgt

SEQ ID NO: 3666866 - DNA, 12 bp, Homo sapiens
aggcctggggac

SEQ ID NO: 3666867 - DNA, 22 bp, Homo sapiens
aggcctgtcctgacctgtctca

SEQ ID NO: 3666868 - DNA, 18 bp, Homo sapiens
aggcgcgccgacgcctgt

SEQ ID NO: 3666869 - DNA, 22 bp, Homo sapiens
aggcgctgcccacctgccggcc

SEQ ID NO: 3666870 - DNA, 14 bp, Homo sapiens
aggcggggctcctc

SEQ ID NO: 3666871 - DNA, 17 bp, Homo sapiens
aggcggggctcctcctg

SEQ ID NO: 3666872 - DNA, 13 bp, Homo sapiens
aggcggggctcta

SEQ ID NO: 3666873 - DNA, 21 bp, Homo sapiens
aggctagtcttgaatttctga

SEQ ID NO: 3666874 - DNA, 22 bp, Homo sapiens
aggctcactgcaacttctgcct

SEQ ID NO: 3666875 - DNA, 17 bp, Homo sapiens
aggctccaatggggcgg

SEQ ID NO: 3666876 - DNA, 13 bp, Homo sapiens
aggctcctgtggt

SEQ ID NO: 3666877 - DNA, 22 bp, Homo sapiens
aggctcctgtggtagtcctccc

SEQ ID NO: 3666878 - DNA, 19 bp, Homo sapiens
aggctcttagcagcttcca

SEQ ID NO: 3666879 - DNA, 21 bp, Homo sapiens
aggctcttctccttggaggac

SEQ ID NO: 3666880 - DNA, 16 bp, Homo sapiens
aggctgacgtgtgagg

SEQ ID NO: 3666881 - DNA, 13 bp, Homo sapiens
aggctgagaagga

SEQ ID NO: 3666882 - DNA, 14 bp, Homo sapiens
aggctgaggaaagg

SEQ ID NO: 3666883 - DNA, 20 bp, Homo sapiens
aggctgaggaaaggccagct

SEQ ID NO: 3666884 - DNA, 14 bp, Homo sapiens
aggctgaggcctgg

SEQ ID NO: 3666885 - DNA, 15 bp, Homo sapiens
aggctgaggcctgga

SEQ ID NO: 3666886 - DNA, 22 bp, Homo sapiens
aggctgcaaggtttaggctggt

SEQ ID NO: 3666887 - DNA, 17 bp, Homo sapiens
aggctgccaaggccaga

SEQ ID NO: 3666888 - DNA, 17 bp, Homo sapiens
aggctgctccctgaggg

SEQ ID NO: 3666889 - DNA, 15 bp, Homo sapiens
aggctggccagtcca

SEQ ID NO: 3666890 - DNA, 18 bp, Homo sapiens
aggctggccagtccaggc

SEQ ID NO: 3666891 - DNA, 21 bp, Homo sapiens
aggctggccagtccaggctgc

SEQ ID NO: 3666892 - DNA, 14 bp, Homo sapiens
aggctggcttgtcc

SEQ ID NO: 3666893 - DNA, 18 bp, Homo sapiens
aggctgggcgtagtggct

SEQ ID NO: 3666894 - DNA, 14 bp, Homo sapiens
aggctggtggccca

SEQ ID NO: 3666895 - DNA, 19 bp, Homo sapiens
aggctgtccttacccatct

SEQ ID NO: 3666896 - DNA, 21 bp, Homo sapiens
aggctgtccttacccatctgc

SEQ ID NO: 3666897 - DNA, 16 bp, Homo sapiens
aggctgtggtcacagc

SEQ ID NO: 3666898 - DNA, 20 bp, Homo sapiens
aggctgtgtttggctttcag

SEQ ID NO: 3666899 - DNA, 21 bp, Homo sapiens
aggctgtgtttggctttcagg

SEQ ID NO: 3666900 - DNA, 15 bp, Homo sapiens
aggcttagtttgtgt

SEQ ID NO: 3666901 - DNA, 14 bp, Homo sapiens
aggcttctacctgc

SEQ ID NO: 3666902 - DNA, 14 bp, Homo sapiens
aggcttcttcctgg

SEQ ID NO: 3666903 - DNA, 15 bp, Homo sapiens
aggcttcttcctgga

SEQ ID NO: 3666904 - DNA, 15 bp, Homo sapiens
aggcttgcccaggag

SEQ ID NO: 3666905 - DNA, 16 bp, Homo sapiens
aggcttgcccaggagc

SEQ ID NO: 3666906 - DNA, 17 bp, Homo sapiens
aggcttgcccaggagca

SEQ ID NO: 3666907 - DNA, 23 bp, Homo sapiens
agggaacccagctctaatacatt

SEQ ID NO: 3666908 - DNA, 14 bp, Homo sapiens
agggaactggcctg

SEQ ID NO: 3666909 - DNA, 16 bp, Homo sapiens
agggaactggcctgct

SEQ ID NO: 3666910 - DNA, 13 bp, Homo sapiens
agggaactgggga

SEQ ID NO: 3666911 - DNA, 16 bp, Homo sapiens
agggaagctggccgag

SEQ ID NO: 3666912 - DNA, 14 bp, Homo sapiens
agggaagtaagatg

SEQ ID NO: 3666913 - DNA, 13 bp, Homo sapiens
agggaagttttgt

SEQ ID NO: 3666914 - DNA, 21 bp, Homo sapiens
agggacagaggccccagcctc

SEQ ID NO: 3666915 - DNA, 22 bp, Homo sapiens
agggacagaggccccagcctcc

SEQ ID NO: 3666916 - DNA, 19 bp, Homo sapiens
agggaccaactgggcccaa

SEQ ID NO: 3666917 - DNA, 15 bp, Homo sapiens
agggacccctgccct

SEQ ID NO: 3666918 - DNA, 23 bp, Homo sapiens
agggaccttcatgcccttctgat

SEQ ID NO: 3666919 - DNA, 17 bp, Homo sapiens
agggagggcagttttct

SEQ ID NO: 3666920 - DNA, 19 bp, Homo sapiens
agggaggggcctaggcctc

SEQ ID NO: 3666921 - DNA, 20 bp, Homo sapiens
agggaggggcctaggcctca

SEQ ID NO: 3666922 - DNA, 17 bp, Homo sapiens
agggatgccctggaggt

SEQ ID NO: 3666923 - DNA, 20 bp, Homo sapiens
agggatgccctggaggtggc

SEQ ID NO: 3666924 - DNA, 17 bp, Homo sapiens
agggattaacctctgca

SEQ ID NO: 3666925 - DNA, 18 bp, Homo sapiens
agggattaacctctgcac

SEQ ID NO: 3666926 - DNA, 18 bp, Homo sapiens
agggattcaggctgcttg

SEQ ID NO: 3666927 - DNA, 20 bp, Homo sapiens
agggattctggttccagggt

SEQ ID NO: 3666928 - DNA, 20 bp, Homo sapiens
agggcacaagtcctggatgt

SEQ ID NO: 3666929 - DNA, 18 bp, Homo sapiens
agggcaggaaggagagcc

SEQ ID NO: 3666930 - DNA, 19 bp, Homo sapiens
agggcaggaaggagagcct

SEQ ID NO: 3666931 - DNA, 16 bp, Homo sapiens
agtaccaatgggaagc

SEQ ID NO: 3666932 - DNA, 19 bp, Homo sapiens
agtaccaatgggaagcagg

SEQ ID NO: 3666933 - DNA, 13 bp, Homo sapiens
agtacccagccta

SEQ ID NO: 3666934 - DNA, 18 bp, Homo sapiens
agtacttaactatctgtt

SEQ ID NO: 3666935 - DNA, 17 bp, Homo sapiens
agtactttggaggcccc

SEQ ID NO: 3666936 - DNA, 15 bp, Homo sapiens
agtacttttttaaat

SEQ ID NO: 3666937 - DNA, 15 bp, Homo sapiens
agtagaagcatgttt

SEQ ID NO: 3666938 - DNA, 21 bp, Homo sapiens
agtagaatctcagttgatttt

SEQ ID NO: 3666939 - DNA, 23 bp, Homo sapiens
agtagaccttgttacttctgagg

SEQ ID NO: 3666940 - DNA, 20 bp, Homo sapiens
agtagatttacagaacaaag

SEQ ID NO: 3666941 - DNA, 13 bp, Homo sapiens
agtaggcatgtta

SEQ ID NO: 3666942 - DNA, 22 bp, Homo sapiens
agtaggcatttttaccatcact

SEQ ID NO: 3666943 - DNA, 20 bp, Homo sapiens
agtagggtttgacatttcat

SEQ ID NO: 3666944 - DNA, 13 bp, Homo sapiens
agtagttatataa

SEQ ID NO: 3666945 - DNA, 15 bp, Homo sapiens
agtatctcagggcct

SEQ ID NO: 3666946 - DNA, 20 bp, Homo sapiens
agtatgcttggactgaaggg

SEQ ID NO: 3666947 - DNA, 23 bp, Homo sapiens
agtatgtattacttttgtaatca

SEQ ID NO: 3666948 - DNA, 16 bp, Homo sapiens
agtattgtaaattata

SEQ ID NO: 3666949 - DNA, 18 bp, Homo sapiens
agtattgtaaattatatt

SEQ ID NO: 3666950 - DNA, 17 bp, Homo sapiens
agtatttgattcaaaat

SEQ ID NO: 3666951 - DNA, 19 bp, Homo sapiens
agtatttgattcaaaatat

SEQ ID NO: 3666952 - DNA, 23 bp, Homo sapiens
agtatttgattcaaaatatttaa

SEQ ID NO: 3666953 - DNA, 20 bp, Homo sapiens
agtattttagtgaacttgaa

SEQ ID NO: 3666954 - DNA, 13 bp, Homo sapiens
agtcaagctcctc

SEQ ID NO: 3666955 - DNA, 14 bp, Homo sapiens
agtcaagctcctcc

SEQ ID NO: 3666956 - DNA, 17 bp, Homo sapiens
agtcaagctcctcctcc

SEQ ID NO: 3666957 - DNA, 18 bp, Homo sapiens
agtcaagctcctcctccc

SEQ ID NO: 3666958 - DNA, 22 bp, Homo sapiens
agtcaagctcctcctccctgca

SEQ ID NO: 3666959 - DNA, 12 bp, Homo sapiens
agtcaatcaagt

SEQ ID NO: 3666960 - DNA, 24 bp, Homo sapiens
agtcaatcaagtctgtttactgca

SEQ ID NO: 3666961 - DNA, 12 bp, Homo sapiens
agtcacaaagac

SEQ ID NO: 3666962 - DNA, 19 bp, Homo sapiens
agtcacaaagagatgtcct

SEQ ID NO: 3666963 - DNA, 22 bp, Homo sapiens
agtcacagagataattctagct

SEQ ID NO: 3666964 - DNA, 19 bp, Homo sapiens
agtcagggacccctgccct

SEQ ID NO: 3666965 - DNA, 20 bp, Homo sapiens
agtcatcttgaccaagcagg

SEQ ID NO: 3666966 - DNA, 19 bp, Homo sapiens
agtcatgcgtttaatcaca

SEQ ID NO: 3666967 - DNA, 23 bp, Homo sapiens
agtcattcagcagcaaattttca

SEQ ID NO: 3666968 - DNA, 13 bp, Homo sapiens
agtcattgtatgt

SEQ ID NO: 3666969 - DNA, 23 bp, Homo sapiens
agtccaaatgtcctccagaagcc

SEQ ID NO: 3666970 - DNA, 15 bp, Homo sapiens
agtccaattttaatt

SEQ ID NO: 3666971 - DNA, 14 bp, Homo sapiens
agtccaggctgccg

SEQ ID NO: 3666972 - DNA, 23 bp, Homo sapiens
agtccatatttcaatttccaaga

SEQ ID NO: 3666973 - DNA, 13 bp, Homo sapiens
agtccccaggccc

SEQ ID NO: 3666974 - DNA, 17 bp, Homo sapiens
agtccccaggccccagg

SEQ ID NO: 3666975 - DNA, 14 bp, Homo sapiens
agtcccttcccctc

SEQ ID NO: 3666976 - DNA, 15 bp, Homo sapiens
agtcccttcccctcc

SEQ ID NO: 3666977 - DNA, 22 bp, Homo sapiens
agtcccttcccctccctggctc

SEQ ID NO: 3666978 - DNA, 15 bp, Homo sapiens
agtcctcactcccag

SEQ ID NO: 3666979 - DNA, 16 bp, Homo sapiens
agtcctcactcccagt

SEQ ID NO: 3666980 - DNA, 17 bp, Homo sapiens
agtcctcactcccagtc

SEQ ID NO: 3666981 - DNA, 15 bp, Homo sapiens
agtcctcccaagctg

SEQ ID NO: 3666982 - DNA, 20 bp, Homo sapiens
agtcctcccaagctgtgctg

SEQ ID NO: 3666983 - DNA, 15 bp, Homo sapiens
agtcctgcctggcca

SEQ ID NO: 3666984 - DNA, 19 bp, Homo sapiens
agtcctggttgtctgaacc

SEQ ID NO: 3666985 - DNA, 13 bp, Homo sapiens
agtcctgtgaatg

SEQ ID NO: 3666986 - DNA, 18 bp, Homo sapiens
agtcctgtgaatgccact

SEQ ID NO: 3666987 - DNA, 15 bp, Homo sapiens
agtcgtgcctgtgtc

SEQ ID NO: 3666988 - DNA, 18 bp, Homo sapiens
agtctagatggctcctct

SEQ ID NO: 3666989 - DNA, 23 bp, Homo sapiens
agtctatggccaggtatgcatgg

SEQ ID NO: 3666990 - DNA, 15 bp, Homo sapiens
agtctgaacagctgt

SEQ ID NO: 3666991 - DNA, 18 bp, Homo sapiens
agtctgaacagctgtaat

SEQ ID NO: 3666992 - DNA, 20 bp, Homo sapiens
agtctgaacctatttcttaa

SEQ ID NO: 3666993 - DNA, 21 bp, Homo sapiens
agtctgtatttttaaagcatg

SEQ ID NO: 3666994 - DNA, 17 bp, Homo sapiens
agtctgtggatcagaga

SEQ ID NO: 3666995 - DNA, 11 bp, Homo sapiens
agtctgtgtga

SEQ ID NO: 3666996 - DNA, 17 bp, Homo sapiens
agtctgtttactgcaag

SEQ ID NO: 3666997 - DNA, 14 bp, Homo sapiens
agtcttttgctttt

SEQ ID NO: 3666998 - DNA, 18 bp, Homo sapiens
agtcttttgcttttggca

SEQ ID NO: 3666999 - DNA, 20 bp, Homo sapiens
agtcttttgcttttggcaaa

SEQ ID NO: 3667000 - DNA, 17 bp, Homo sapiens
agtgaaaaaggaggaag

SEQ ID NO: 3667001 - DNA, 13 bp, Homo sapiens
agtgaaaaatctt

SEQ ID NO: 3667002 - DNA, 22 bp, Homo sapiens
agtgaaaaatcttaagtaccaa

SEQ ID NO: 3667003 - DNA, 14 bp, Homo sapiens
agtgaaagcatcac

SEQ ID NO: 3667004 - DNA, 17 bp, Homo sapiens
agtgacacccagaggga

SEQ ID NO: 3667005 - DNA, 23 bp, Homo sapiens
agtgacacccagagggagtagaa

SEQ ID NO: 3667006 - DNA, 14 bp, Homo sapiens
agtgacctgaggaa

SEQ ID NO: 3667007 - DNA, 17 bp, Homo sapiens
agtgacctgaggaagcg

SEQ ID NO: 3667008 - DNA, 16 bp, Homo sapiens
agtgacttgtgtccca

SEQ ID NO: 3667009 - DNA, 21 bp, Homo sapiens
agtgagaccctgtctcaaaaa

SEQ ID NO: 3667010 - DNA, 16 bp, Homo sapiens
agtgagcactgaaaca

SEQ ID NO: 3667011 - DNA, 21 bp, Homo sapiens
agtgagcttggaaaggaccag

SEQ ID NO: 3667012 - DNA, 15 bp, Homo sapiens
agtgatagtcttttg

SEQ ID NO: 3667013 - DNA, 12 bp, Homo sapiens
agtgattttcat

SEQ ID NO: 3667014 - DNA, 18 bp, Homo sapiens
agtgcacggggcacagcg

SEQ ID NO: 3667015 - DNA, 24 bp, Homo sapiens
agtgcatgcattgagctgcctcca

SEQ ID NO: 3667016 - DNA, 15 bp, Homo sapiens
agtgccaaacagagt

SEQ ID NO: 3667017 - DNA, 16 bp, Homo sapiens
agtgcccccactgacc

SEQ ID NO: 3667018 - DNA, 17 bp, Homo sapiens
agtgccgcaaattgtac

SEQ ID NO: 3667019 - DNA, 14 bp, Homo sapiens
agtgcctgctgtat

SEQ ID NO: 3667020 - DNA, 15 bp, Homo sapiens
agtgctatgaagaca

SEQ ID NO: 3667021 - DNA, 12 bp, Homo sapiens
agtgctccagcc

SEQ ID NO: 3667022 - DNA, 16 bp, Homo sapiens
agtgctgaacagtgga

SEQ ID NO: 3667023 - DNA, 12 bp, Homo sapiens
agtgctggattt

SEQ ID NO: 3667024 - DNA, 12 bp, Homo sapiens
agtgctgtgctg

SEQ ID NO: 3667025 - DNA, 15 bp, Homo sapiens
agtgctgttgaagat

SEQ ID NO: 3667026 - DNA, 19 bp, Homo sapiens
agtgctgttgaagatttga

SEQ ID NO: 3667027 - DNA, 13 bp, Homo sapiens
agtggagctgaat

SEQ ID NO: 3667028 - DNA, 23 bp, Homo sapiens
agtggaggttaaggctgaggaaa

SEQ ID NO: 3667029 - DNA, 12 bp, Homo sapiens
agtggatgtata

SEQ ID NO: 3667030 - DNA, 11 bp, Homo sapiens
agtggcagggg

SEQ ID NO: 3667031 - DNA, 19 bp, Homo sapiens
agtggccactaagcagagg

SEQ ID NO: 3667032 - DNA, 15 bp, Homo sapiens
agtggcctggccagg

SEQ ID NO: 3667033 - DNA, 20 bp, Homo sapiens
agtggcctggccaggagctc

SEQ ID NO: 3667034 - DNA, 15 bp, Homo sapiens
agtggctggtccagg

SEQ ID NO: 3667035 - DNA, 18 bp, Homo sapiens
agtggctggtccagggct

SEQ ID NO: 3667036 - DNA, 15 bp, Homo sapiens
agtgggccagtcctg

SEQ ID NO: 3667037 - DNA, 15 bp, Homo sapiens
agtggggacagagca

SEQ ID NO: 3667038 - DNA, 13 bp, Homo sapiens
agtgggtgaataa

SEQ ID NO: 3667039 - DNA, 18 bp, Homo sapiens
agtgggtgaataatacag

SEQ ID NO: 3667040 - DNA, 19 bp, Homo sapiens
agtgggtgaataatacagt

SEQ ID NO: 3667041 - DNA, 19 bp, Homo sapiens
agtggtggtaaccctggtg

SEQ ID NO: 3667042 - DNA, 17 bp, Homo sapiens
agtgtaacccaagcatt

SEQ ID NO: 3667043 - DNA, 18 bp, Homo sapiens
agtgtatgactgcacatg

SEQ ID NO: 3667044 - DNA, 17 bp, Homo sapiens
agtgtccttcttgctcc

SEQ ID NO: 3667045 - DNA, 19 bp, Homo sapiens
agtgtcttcacggcaggac

SEQ ID NO: 3667046 - DNA, 16 bp, Homo sapiens
agtgtcttttgacatt

SEQ ID NO: 3667047 - DNA, 21 bp, Homo sapiens
agtgtgcctgaagtcccagat

SEQ ID NO: 3667048 - DNA, 16 bp, Homo sapiens
agatgctaaaattctt

SEQ ID NO: 3667049 - DNA, 17 bp, Homo sapiens
agatgctggcttgggca

SEQ ID NO: 3667050 - DNA, 18 bp, Homo sapiens
agatgctggcttgggcag

SEQ ID NO: 3667051 - DNA, 18 bp, Homo sapiens
agatgctgtgtatatggt

SEQ ID NO: 3667052 - DNA, 19 bp, Homo sapiens
agatgctgtgtatatggta

SEQ ID NO: 3667053 - DNA, 20 bp, Homo sapiens
agatgcttttaacagagtct

SEQ ID NO: 3667054 - DNA, 16 bp, Homo sapiens
agatggaaaaataaca

SEQ ID NO: 3667055 - DNA, 21 bp, Homo sapiens
agatggaaccgcaggaagctg

SEQ ID NO: 3667056 - DNA, 16 bp, Homo sapiens
agatgtaaattgaaga

SEQ ID NO: 3667057 - DNA, 20 bp, Homo sapiens
agatgtaaattgaagaagcc

SEQ ID NO: 3667058 - DNA, 15 bp, Homo sapiens
agatgttagactcat

SEQ ID NO: 3667059 - DNA, 23 bp, Homo sapiens
agatgtttcacaccggaaggttt

SEQ ID NO: 3667060 - DNA, 17 bp, Homo sapiens
agattgacgacaagtgc

SEQ ID NO: 3667061 - DNA, 16 bp, Homo sapiens
agatttgtgaactgga

SEQ ID NO: 3667062 - DNA, 18 bp, Homo sapiens
agatttgtgaactggaag

SEQ ID NO: 3667063 - DNA, 16 bp, Homo sapiens
agattttgtatattta

SEQ ID NO: 3667064 - DNA, 23 bp, Homo sapiens
agcaaatcaccacaaactgtaat

SEQ ID NO: 3667065 - DNA, 20 bp, Homo sapiens
agcaacaaagattgagaagc

SEQ ID NO: 3667066 - DNA, 15 bp, Homo sapiens
agcaacctacccagc

SEQ ID NO: 3667067 - DNA, 16 bp, Homo sapiens
agcaactgctggggag

SEQ ID NO: 3667068 - DNA, 22 bp, Homo sapiens
agcaagaggaaggggtgctgtg

SEQ ID NO: 3667069 - DNA, 17 bp, Homo sapiens
agcaagtgttcactgct

SEQ ID NO: 3667070 - DNA, 19 bp, Homo sapiens
agcacaactttaagaggac

SEQ ID NO: 3667071 - DNA, 19 bp, Homo sapiens
agcacactgagtttgaaca

SEQ ID NO: 3667072 - DNA, 20 bp, Homo sapiens
agcacagcttgacctgaggc

SEQ ID NO: 3667073 - DNA, 19 bp, Homo sapiens
agcaccccatgccaaagct

SEQ ID NO: 3667074 - DNA, 13 bp, Homo sapiens
agcactgtccctt

SEQ ID NO: 3667075 - DNA, 15 bp, Homo sapiens
agcactgtcccttgc

SEQ ID NO: 3667076 - DNA, 21 bp, Homo sapiens
agcacttcaaagaagctgtct

SEQ ID NO: 3667077 - DNA, 23 bp, Homo sapiens
agcacttcaaagaagctgtcttg

SEQ ID NO: 3667078 - DNA, 15 bp, Homo sapiens
agcacttctttttct

SEQ ID NO: 3667079 - DNA, 23 bp, Homo sapiens
agcactttgggaggccaaggtgg

SEQ ID NO: 3667080 - DNA, 13 bp, Homo sapiens
agcagaagacaaa

SEQ ID NO: 3667081 - DNA, 16 bp, Homo sapiens
agcagactgtgtttcg

SEQ ID NO: 3667082 - DNA, 22 bp, Homo sapiens
agcagactgtgtttcgtgaact

SEQ ID NO: 3667083 - DNA, 17 bp, Homo sapiens
agcagaggaaggagagg

SEQ ID NO: 3667084 - DNA, 17 bp, Homo sapiens
agcagaggaccagggcc

SEQ ID NO: 3667085 - DNA, 15 bp, Homo sapiens
agcagaggaggggcc

SEQ ID NO: 3667086 - DNA, 21 bp, Homo sapiens
agcagaggaggggccgctgcc

SEQ ID NO: 3667087 - DNA, 14 bp, Homo sapiens
agcagatgcaaaga

SEQ ID NO: 3667088 - DNA, 18 bp, Homo sapiens
agcagatgcaaagaggca

SEQ ID NO: 3667089 - DNA, 20 bp, Homo sapiens
agcagcaaattttcagcatt

SEQ ID NO: 3667090 - DNA, 14 bp, Homo sapiens
agcagcccaccctg

SEQ ID NO: 3667091 - DNA, 16 bp, Homo sapiens
agcagcctggaccctg

SEQ ID NO: 3667092 - DNA, 17 bp, Homo sapiens
agcagctaaattttctg

SEQ ID NO: 3667093 - DNA, 15 bp, Homo sapiens
agcagctcaaaggca

SEQ ID NO: 3667094 - DNA, 22 bp, Homo sapiens
agcaggaaattcagcccaccag

SEQ ID NO: 3667095 - DNA, 16 bp, Homo sapiens
agcaggactcccacct

SEQ ID NO: 3667096 - DNA, 18 bp, Homo sapiens
agcaggatgctcagtgat

SEQ ID NO: 3667097 - DNA, 17 bp, Homo sapiens
agcagggatgccctgga

SEQ ID NO: 3667098 - DNA, 24 bp, Homo sapiens
agcagggatgccctggaggtggct

SEQ ID NO: 3667099 - DNA, 11 bp, Homo sapiens
agcagtcacaa

SEQ ID NO: 3667100 - DNA, 14 bp, Homo sapiens
agcagtgagcactg

SEQ ID NO: 3667101 - DNA, 18 bp, Homo sapiens
agcagtgagcactgaaac

SEQ ID NO: 3667102 - DNA, 11 bp, Homo sapiens
agcagtggctg

SEQ ID NO: 3667103 - DNA, 21 bp, Homo sapiens
agcagtggctggtccagggct

SEQ ID NO: 3667104 - DNA, 23 bp, Homo sapiens
agcataaaaattagccaagtgtg

SEQ ID NO: 3667105 - DNA, 13 bp, Homo sapiens
agcatcacagaat

SEQ ID NO: 3667106 - DNA, 19 bp, Homo sapiens
agcatcttgggggggtggc

SEQ ID NO: 3667107 - DNA, 21 bp, Homo sapiens
agcatcttgggggggtggccg

SEQ ID NO: 3667108 - DNA, 21 bp, Homo sapiens
agcatgaataacatttaaatt

SEQ ID NO: 3667109 - DNA, 18 bp, Homo sapiens
agcatgcttccctgcagc

SEQ ID NO: 3667110 - DNA, 21 bp, Homo sapiens
agcatgcttccctgcagctga

SEQ ID NO: 3667111 - DNA, 18 bp, Homo sapiens
agcatggaaaatcagtga

SEQ ID NO: 3667112 - DNA, 14 bp, Homo sapiens
agcattccttttga

SEQ ID NO: 3667113 - DNA, 17 bp, Homo sapiens
agcatttgattaacatt

SEQ ID NO: 3667114 - DNA, 19 bp, Homo sapiens
agcatttgattaacatttg

SEQ ID NO: 3667115 - DNA, 17 bp, Homo sapiens
agccaaaatgtaggctt

SEQ ID NO: 3667116 - DNA, 21 bp, Homo sapiens
agccaaacatatatatactat

SEQ ID NO: 3667117 - DNA, 17 bp, Homo sapiens
agccaagggaacctgtg

SEQ ID NO: 3667118 - DNA, 22 bp, Homo sapiens
agccaaggttttataaggctga

SEQ ID NO: 3667119 - DNA, 15 bp, Homo sapiens
agccagaagctgagc

SEQ ID NO: 3667120 - DNA, 15 bp, Homo sapiens
agccagaggctgggt

SEQ ID NO: 3667121 - DNA, 16 bp, Homo sapiens
agccagcaagaggaag

SEQ ID NO: 3667122 - DNA, 13 bp, Homo sapiens
agccagcacctgg

SEQ ID NO: 3667123 - DNA, 16 bp, Homo sapiens
agccagcccctcttcc

SEQ ID NO: 3667124 - DNA, 18 bp, Homo sapiens
agccaggagctgggcaga

SEQ ID NO: 3667125 - DNA, 20 bp, Homo sapiens
agccaggctgccaaggccag

SEQ ID NO: 3667126 - DNA, 15 bp, Homo sapiens
agccatgtctgcatt

SEQ ID NO: 3667127 - DNA, 15 bp, Homo sapiens
agcccaaaagagggc

SEQ ID NO: 3667128 - DNA, 14 bp, Homo sapiens
agcccaaagaagga

SEQ ID NO: 3667129 - DNA, 16 bp, Homo sapiens
agcccaaagaaggaaa

SEQ ID NO: 3667130 - DNA, 17 bp, Homo sapiens
agcccaaattctcctct

SEQ ID NO: 3667131 - DNA, 14 bp, Homo sapiens
agcccaacccttct

SEQ ID NO: 3667132 - DNA, 16 bp, Homo sapiens
agcccaagggatctgg

SEQ ID NO: 3667133 - DNA, 23 bp, Homo sapiens
agcccaaggtgctgatgtcaaag

SEQ ID NO: 3667134 - DNA, 17 bp, Homo sapiens
agcccaccagccacctc

SEQ ID NO: 3667135 - DNA, 18 bp, Homo sapiens
agcccaccagccacctca

SEQ ID NO: 3667136 - DNA, 13 bp, Homo sapiens
agcccaccctgct

SEQ ID NO: 3667137 - DNA, 14 bp, Homo sapiens
agcccaccctgctg

SEQ ID NO: 3667138 - DNA, 22 bp, Homo sapiens
agcccagacagcaaggtgtgga

SEQ ID NO: 3667139 - DNA, 19 bp, Homo sapiens
agcccagggagcggaaagc

SEQ ID NO: 3667140 - DNA, 20 bp, Homo sapiens
agcccagggagcggaaagca

SEQ ID NO: 3667141 - DNA, 23 bp, Homo sapiens
agcccagggagcggaaagcagct

SEQ ID NO: 3667142 - DNA, 16 bp, Homo sapiens
agcccatgcccacctg

SEQ ID NO: 3667143 - DNA, 13 bp, Homo sapiens
agccccacccagg

SEQ ID NO: 3667144 - DNA, 15 bp, Homo sapiens
agccccacccaggag

SEQ ID NO: 3667145 - DNA, 10 bp, Homo sapiens
agccccaggg

SEQ ID NO: 3667146 - DNA, 16 bp, Homo sapiens
agccccaggggacaag

SEQ ID NO: 3667147 - DNA, 22 bp, Homo sapiens
agccccagggtcttccctacct

SEQ ID NO: 3667148 - DNA, 12 bp, Homo sapiens
agcccccagcta

SEQ ID NO: 3667149 - DNA, 17 bp, Homo sapiens
aggcacagtgaaggctg

SEQ ID NO: 3667150 - DNA, 21 bp, Homo sapiens
aggcacctataaaacaggtca

SEQ ID NO: 3667151 - DNA, 19 bp, Homo sapiens
aggcactgcaaaccgccac

SEQ ID NO: 3667152 - DNA, 20 bp, Homo sapiens
aggcagactctttatgcttg

SEQ ID NO: 3667153 - DNA, 11 bp, Homo sapiens
aggcagatcca

SEQ ID NO: 3667154 - DNA, 22 bp, Homo sapiens
aggcagatctgtgccccatgcc

SEQ ID NO: 3667155 - DNA, 12 bp, Homo sapiens
aggcagcgtgcc

SEQ ID NO: 3667156 - DNA, 15 bp, Homo sapiens
aggcagcgtgccgag

SEQ ID NO: 3667157 - DNA, 19 bp, Homo sapiens
aggcagctgtgtctgagcc

SEQ ID NO: 3667158 - DNA, 20 bp, Homo sapiens
aggcagctgtgtctgagccc

SEQ ID NO: 3667159 - DNA, 22 bp, Homo sapiens
aggcagctgtgtctgagcccaa

SEQ ID NO: 3667160 - DNA, 16 bp, Homo sapiens
aggcaggaagggcagg

SEQ ID NO: 3667161 - DNA, 15 bp, Homo sapiens
aggcaggctcccagg

SEQ ID NO: 3667162 - DNA, 21 bp, Homo sapiens
aggcagggaagtgtaagaaac

SEQ ID NO: 3667163 - DNA, 18 bp, Homo sapiens
aggcataggtctctttgc

SEQ ID NO: 3667164 - DNA, 22 bp, Homo sapiens
aggcatctctgtactttgcttg

SEQ ID NO: 3667165 - DNA, 15 bp, Homo sapiens
aggcatgctggagta

SEQ ID NO: 3667166 - DNA, 22 bp, Homo sapiens
aggcatgctggagtacccagcc

SEQ ID NO: 3667167 - DNA, 23 bp, Homo sapiens
aggcatgctggagtacccagcct

SEQ ID NO: 3667168 - DNA, 12 bp, Homo sapiens
aggcatggccct

SEQ ID NO: 3667169 - DNA, 14 bp, Homo sapiens
aggcatggccctgg

SEQ ID NO: 3667170 - DNA, 15 bp, Homo sapiens
aggcatggccctggg

SEQ ID NO: 3667171 - DNA, 20 bp, Homo sapiens
aggcatgggtgcaaggaaaa

SEQ ID NO: 3667172 - DNA, 15 bp, Homo sapiens
aggcatggtggccca

SEQ ID NO: 3667173 - DNA, 13 bp, Homo sapiens
aggcattaacaca

SEQ ID NO: 3667174 - DNA, 19 bp, Homo sapiens
aggcattaacacaaaggag

SEQ ID NO: 3667175 - DNA, 14 bp, Homo sapiens
aggccaagaggctg

SEQ ID NO: 3667176 - DNA, 17 bp, Homo sapiens
aggccagaggagagctg

SEQ ID NO: 3667177 - DNA, 18 bp, Homo sapiens
aggccagaggcccccagc

SEQ ID NO: 3667178 - DNA, 15 bp, Homo sapiens
cagtcgtgcctgtgt

SEQ ID NO: 3667179 - DNA, 14 bp, Homo sapiens
cagtcttgcctagg

SEQ ID NO: 3667180 - DNA, 21 bp, Homo sapiens
cagtgacacaatctcagctca

SEQ ID NO: 3667181 - DNA, 13 bp, Homo sapiens
cagtgacacccag

SEQ ID NO: 3667182 - DNA, 16 bp, Homo sapiens
cagtgacagacaggct

SEQ ID NO: 3667183 - DNA, 16 bp, Homo sapiens
cagtgacctgaggaag

SEQ ID NO: 3667184 - DNA, 19 bp, Homo sapiens
cagtgacctgaggaagcgt

SEQ ID NO: 3667185 - DNA, 12 bp, Homo sapiens
cagtgagcactg

SEQ ID NO: 3667186 - DNA, 13 bp, Homo sapiens
cagtgagcactga

SEQ ID NO: 3667187 - DNA, 15 bp, Homo sapiens
cagtgcagaatgtaa

SEQ ID NO: 3667188 - DNA, 14 bp, Homo sapiens
cagtgcagatggag

SEQ ID NO: 3667189 - DNA, 17 bp, Homo sapiens
cagtgcatggtggccag

SEQ ID NO: 3667190 - DNA, 21 bp, Homo sapiens
cagtgcatggtggccagaggt

SEQ ID NO: 3667191 - DNA, 21 bp, Homo sapiens
cagtgcccccactgaccagaa

SEQ ID NO: 3667192 - DNA, 12 bp, Homo sapiens
cagtgctgtgct

SEQ ID NO: 3667193 - DNA, 12 bp, Homo sapiens
cagtgctgtgtg

SEQ ID NO: 3667194 - DNA, 15 bp, Homo sapiens
cagtgctgttgaaga

SEQ ID NO: 3667195 - DNA, 21 bp, Homo sapiens
cagtggacagtgctgttgaag

SEQ ID NO: 3667196 - DNA, 16 bp, Homo sapiens
cagtggagctgaattt

SEQ ID NO: 3667197 - DNA, 22 bp, Homo sapiens
cagtggagctgaattttctgga

SEQ ID NO: 3667198 - DNA, 20 bp, Homo sapiens
cagtggaggaagagggacag

SEQ ID NO: 3667199 - DNA, 18 bp, Homo sapiens
cagtggctggtccagggc

SEQ ID NO: 3667200 - DNA, 11 bp, Homo sapiens
cagtgggaact

SEQ ID NO: 3667201 - DNA, 18 bp, Homo sapiens
cagtgggagccagggctg

SEQ ID NO: 3667202 - DNA, 18 bp, Homo sapiens
cagtgggctgtttctgct

SEQ ID NO: 3667203 - DNA, 19 bp, Homo sapiens
cagtgggctgtttctgctt

SEQ ID NO: 3667204 - DNA, 23 bp, Homo sapiens
cagttaacacaatgtgaatttct

SEQ ID NO: 3667205 - DNA, 22 bp, Homo sapiens
cagttacataattcactctgag

SEQ ID NO: 3667206 - DNA, 18 bp, Homo sapiens
cagttattacatgtaatt

SEQ ID NO: 3667207 - DNA, 13 bp, Homo sapiens
cagttcagcacca

SEQ ID NO: 3667208 - DNA, 20 bp, Homo sapiens
cagttcccttggcctcagaa

SEQ ID NO: 3667209 - DNA, 20 bp, Homo sapiens
cagttctgggtgctccctac

SEQ ID NO: 3667210 - DNA, 14 bp, Homo sapiens
cagttcttcctgca

SEQ ID NO: 3667211 - DNA, 19 bp, Homo sapiens
cagttgaaaaacagctgag

SEQ ID NO: 3667212 - DNA, 16 bp, Homo sapiens
cagttgattttctgga

SEQ ID NO: 3667213 - DNA, 18 bp, Homo sapiens
cagttgccgtctaggatt

SEQ ID NO: 3667214 - DNA, 19 bp, Homo sapiens
cagttgccgtctaggattg

SEQ ID NO: 3667215 - DNA, 22 bp, Homo sapiens
cagttggagttttttgtaccaa

SEQ ID NO: 3667216 - DNA, 14 bp, Homo sapiens
cagtttaggccttg

SEQ ID NO: 3667217 - DNA, 16 bp, Homo sapiens
cagtttaggccttggc

SEQ ID NO: 3667218 - DNA, 19 bp, Homo sapiens
cagttttcctatgctttga

SEQ ID NO: 3667219 - DNA, 17 bp, Homo sapiens
cagtttttggagtgtta

SEQ ID NO: 3667220 - DNA, 19 bp, Homo sapiens
cataaaaacattttaaaaa

SEQ ID NO: 3667221 - DNA, 21 bp, Homo sapiens
cataaaaattagccaagtgtg

SEQ ID NO: 3667222 - DNA, 17 bp, Homo sapiens
cataagtttgtttaaac

SEQ ID NO: 3667223 - DNA, 22 bp, Homo sapiens
cataatgggccactgaaatctg

SEQ ID NO: 3667224 - DNA, 19 bp, Homo sapiens
catacaagtttataaagag

SEQ ID NO: 3667225 - DNA, 20 bp, Homo sapiens
catacaccagcattcctttt

SEQ ID NO: 3667226 - DNA, 19 bp, Homo sapiens
catacccacaatctgagca

SEQ ID NO: 3667227 - DNA, 15 bp, Homo sapiens
catactgagggacca

SEQ ID NO: 3667228 - DNA, 19 bp, Homo sapiens
catactgagggaccaactg

SEQ ID NO: 3667229 - DNA, 20 bp, Homo sapiens
catacttgaagggccagagc

SEQ ID NO: 3667230 - DNA, 21 bp, Homo sapiens
catacttgaagggccagagcc

SEQ ID NO: 3667231 - DNA, 22 bp, Homo sapiens
catacttgaagggccagagcca

SEQ ID NO: 3667232 - DNA, 23 bp, Homo sapiens
catacttgaagggccagagccag

SEQ ID NO: 3667233 - DNA, 17 bp, Homo sapiens
cataggctccttcctgt

SEQ ID NO: 3667234 - DNA, 20 bp, Homo sapiens
catagtatactgatttaatt

SEQ ID NO: 3667235 - DNA, 18 bp, Homo sapiens
catagtattcatgactat

SEQ ID NO: 3667236 - DNA, 16 bp, Homo sapiens
catagttctttttagt

SEQ ID NO: 3667237 - DNA, 12 bp, Homo sapiens
catagtttcttt

SEQ ID NO: 3667238 - DNA, 11 bp, Homo sapiens
catatatatat

SEQ ID NO: 3667239 - DNA, 16 bp, Homo sapiens
catatatatatataac

SEQ ID NO: 3667240 - DNA, 18 bp, Homo sapiens
catatgttaagcagctaa

SEQ ID NO: 3667241 - DNA, 15 bp, Homo sapiens
catattcttgtgctt

SEQ ID NO: 3667242 - DNA, 14 bp, Homo sapiens
catatttaactggt

SEQ ID NO: 3667243 - DNA, 13 bp, Homo sapiens
catatttaatgtt

SEQ ID NO: 3667244 - DNA, 14 bp, Homo sapiens
catatttaatgttt

SEQ ID NO: 3667245 - DNA, 21 bp, Homo sapiens
catatttaatgttttaaatgt

SEQ ID NO: 3667246 - DNA, 22 bp, Homo sapiens
catatttaatgttttaaatgta

SEQ ID NO: 3667247 - DNA, 14 bp, Homo sapiens
catatttatacttt

SEQ ID NO: 3667248 - DNA, 16 bp, Homo sapiens
catatttatactttgc

SEQ ID NO: 3667249 - DNA, 12 bp, Homo sapiens
catcacagaatg

SEQ ID NO: 3667250 - DNA, 21 bp, Homo sapiens
catcacagggtgggcctcggc

SEQ ID NO: 3667251 - DNA, 16 bp, Homo sapiens
catcaccttaggcagg

SEQ ID NO: 3667252 - DNA, 19 bp, Homo sapiens
catcaccttaggcagggaa

SEQ ID NO: 3667253 - DNA, 14 bp, Homo sapiens
catcagacagatgg

SEQ ID NO: 3667254 - DNA, 23 bp, Homo sapiens
catcagcttaggggctgctgacc

SEQ ID NO: 3667255 - DNA, 20 bp, Homo sapiens
catcagtttaggccttggct

SEQ ID NO: 3667256 - DNA, 13 bp, Homo sapiens
catcattgatgat

SEQ ID NO: 3667257 - DNA, 21 bp, Homo sapiens
catcattgatgatcactgtga

SEQ ID NO: 3667258 - DNA, 23 bp, Homo sapiens
catcattgatgatcactgtgaaa

SEQ ID NO: 3667259 - DNA, 14 bp, Homo sapiens
catccactctaccc

SEQ ID NO: 3667260 - DNA, 17 bp, Homo sapiens
catccactctaccctcc

SEQ ID NO: 3667261 - DNA, 18 bp, Homo sapiens
catccagctaccaccacg

SEQ ID NO: 3667262 - DNA, 18 bp, Homo sapiens
catcccaaccaggcacct

SEQ ID NO: 3667263 - DNA, 20 bp, Homo sapiens
catcccaaccaggcacctct

SEQ ID NO: 3667264 - DNA, 12 bp, Homo sapiens
catccccagggg

SEQ ID NO: 3667265 - DNA, 14 bp, Homo sapiens
catccctaccccct

SEQ ID NO: 3667266 - DNA, 22 bp, Homo sapiens
catccctaccccctaagagcca

SEQ ID NO: 3667267 - DNA, 23 bp, Homo sapiens
catccctgagacagggagggaag

SEQ ID NO: 3667268 - DNA, 15 bp, Homo sapiens
catcctatgcttaat

SEQ ID NO: 3667269 - DNA, 17 bp, Homo sapiens
catcctatgcttaataa

SEQ ID NO: 3667270 - DNA, 14 bp, Homo sapiens
catcctccagcagg

SEQ ID NO: 3667271 - DNA, 13 bp, Homo sapiens
catcctcctccca

SEQ ID NO: 3667272 - DNA, 16 bp, Homo sapiens
catcctcctcccaccc

SEQ ID NO: 3667273 - DNA, 20 bp, Homo sapiens
catcctcctcccacccggct

SEQ ID NO: 3667274 - DNA, 18 bp, Homo sapiens
catcctgaccaagactga

SEQ ID NO: 3667275 - DNA, 19 bp, Homo sapiens
catcctgaccaagactgag

SEQ ID NO: 3667276 - DNA, 22 bp, Homo sapiens
catcctgaccaagactgagcca

SEQ ID NO: 3667277 - DNA, 12 bp, Homo sapiens
catcctggctgc

SEQ ID NO: 3667278 - DNA, 15 bp, Homo sapiens
catcctggctgcggc

SEQ ID NO: 3667279 - DNA, 15 bp, Homo sapiens
catcctttacgtgtt

SEQ ID NO: 3667280 - DNA, 18 bp, Homo sapiens
catcgcaccattctgact

SEQ ID NO: 3667281 - DNA, 19 bp, Homo sapiens
catcgcaccattctgactc

SEQ ID NO: 3667282 - DNA, 14 bp, Homo sapiens
catcgctggaaaac

SEQ ID NO: 3667283 - DNA, 21 bp, Homo sapiens
catctaattctctgtggaatg

SEQ ID NO: 3667284 - DNA, 13 bp, Homo sapiens
catctagccagcc

SEQ ID NO: 3667285 - DNA, 22 bp, Homo sapiens
catctagccagcccctcttccc

SEQ ID NO: 3667286 - DNA, 20 bp, Homo sapiens
catctcccaaagtgctggga

SEQ ID NO: 3667287 - DNA, 13 bp, Homo sapiens
catctctctgccc

SEQ ID NO: 3667288 - DNA, 16 bp, Homo sapiens
catctctctgcccaac

SEQ ID NO: 3667289 - DNA, 18 bp, Homo sapiens
catctctgtactttgctt

SEQ ID NO: 3667290 - DNA, 21 bp, Homo sapiens
catctgaaggggcaaattctt

SEQ ID NO: 3667291 - DNA, 22 bp, Homo sapiens
catctgaaggggcaaattcttt

SEQ ID NO: 3667292 - DNA, 13 bp, Homo sapiens
catctgcatgtct

SEQ ID NO: 3667293 - DNA, 11 bp, Homo sapiens
catctgcccct

SEQ ID NO: 3667294 - DNA, 22 bp, Homo sapiens
cattcctaaagaaaaatatctt

SEQ ID NO: 3667295 - DNA, 16 bp, Homo sapiens
cattcctgaagaacca

SEQ ID NO: 3667296 - DNA, 17 bp, Homo sapiens
cattcctgaagaaccag

SEQ ID NO: 3667297 - DNA, 21 bp, Homo sapiens
cattcctgaagaaccagtccc

SEQ ID NO: 3667298 - DNA, 16 bp, Homo sapiens
cattctcaagccctgc

SEQ ID NO: 3667299 - DNA, 15 bp, Homo sapiens
cattctgagaccaaa

SEQ ID NO: 3667300 - DNA, 22 bp, Homo sapiens
cattctgccaggcccccaagcc

SEQ ID NO: 3667301 - DNA, 14 bp, Homo sapiens
cattgagctgcctc

SEQ ID NO: 3667302 - DNA, 19 bp, Homo sapiens
cattgagctgcctccagcc

SEQ ID NO: 3667303 - DNA, 22 bp, Homo sapiens
cattgagctgcctccagcctgg

SEQ ID NO: 3667304 - DNA, 17 bp, Homo sapiens
cattgatccaggagata

SEQ ID NO: 3667305 - DNA, 14 bp, Homo sapiens
cattgatggggaag

SEQ ID NO: 3667306 - DNA, 12 bp, Homo sapiens
cattgcactcca

SEQ ID NO: 3667307 - DNA, 17 bp, Homo sapiens
cattgcactccagcctg

SEQ ID NO: 3667308 - DNA, 13 bp, Homo sapiens
cattgccaccagg

SEQ ID NO: 3667309 - DNA, 16 bp, Homo sapiens
cattgccaccaggaga

SEQ ID NO: 3667310 - DNA, 17 bp, Homo sapiens
cattgccaccaggagaa

SEQ ID NO: 3667311 - DNA, 20 bp, Homo sapiens
cattgccaccaggagaacca

SEQ ID NO: 3667312 - DNA, 14 bp, Homo sapiens
cattgcctttgaat

SEQ ID NO: 3667313 - DNA, 18 bp, Homo sapiens
cattgctgggcttgtctg

SEQ ID NO: 3667314 - DNA, 18 bp, Homo sapiens
cattgctgttagagaaat

SEQ ID NO: 3667315 - DNA, 10 bp, Homo sapiens
cattggagct

SEQ ID NO: 3667316 - DNA, 16 bp, Homo sapiens
cattggagctgactgt

SEQ ID NO: 3667317 - DNA, 19 bp, Homo sapiens
cattggagctgactgttct

SEQ ID NO: 3667318 - DNA, 14 bp, Homo sapiens
cattggctttctct

SEQ ID NO: 3667319 - DNA, 16 bp, Homo sapiens
cattgggaccctccag

SEQ ID NO: 3667320 - DNA, 17 bp, Homo sapiens
cattgggaccctccagt

SEQ ID NO: 3667321 - DNA, 21 bp, Homo sapiens
cattgtccctctgccccatcc

SEQ ID NO: 3667322 - DNA, 20 bp, Homo sapiens
cctgtggatgataaaacaca

SEQ ID NO: 3667323 - DNA, 23 bp, Homo sapiens
cctgtggcatctttgccttgggc

SEQ ID NO: 3667324 - DNA, 20 bp, Homo sapiens
cctgtggccccaccctgggc

SEQ ID NO: 3667325 - DNA, 12 bp, Homo sapiens
cctgtgggtggg

SEQ ID NO: 3667326 - DNA, 13 bp, Homo sapiens
cctgtgggtgggg

SEQ ID NO: 3667327 - DNA, 14 bp, Homo sapiens
cctgtgggtggggc

SEQ ID NO: 3667328 - DNA, 15 bp, Homo sapiens
cctgtgggtggggct

SEQ ID NO: 3667329 - DNA, 23 bp, Homo sapiens
cctgtgggtggggcttctctggg

SEQ ID NO: 3667330 - DNA, 18 bp, Homo sapiens
cctgtggtagtcctccca

SEQ ID NO: 3667331 - DNA, 16 bp, Homo sapiens
cctgtgtgcaggttcc

SEQ ID NO: 3667332 - DNA, 13 bp, Homo sapiens
cctgttccccaga

SEQ ID NO: 3667333 - DNA, 22 bp, Homo sapiens
cctgttgacacaggtctttcct

SEQ ID NO: 3667334 - DNA, 17 bp, Homo sapiens
cctgttgagcatcacag

SEQ ID NO: 3667335 - DNA, 17 bp, Homo sapiens
ccttaaagagtgtggca

SEQ ID NO: 3667336 - DNA, 14 bp, Homo sapiens
ccttaactggagcc

SEQ ID NO: 3667337 - DNA, 17 bp, Homo sapiens
ccttaactggagcccca

SEQ ID NO: 3667338 - DNA, 23 bp, Homo sapiens
ccttaagggaaaggtaggaagag

SEQ ID NO: 3667339 - DNA, 17 bp, Homo sapiens
ccttacacaccattttg

SEQ ID NO: 3667340 - DNA, 18 bp, Homo sapiens
ccttacacaccattttgt

SEQ ID NO: 3667341 - DNA, 15 bp, Homo sapiens
ccttagcctccctga

SEQ ID NO: 3667342 - DNA, 16 bp, Homo sapiens
ccttagcctccctgaa

SEQ ID NO: 3667343 - DNA, 14 bp, Homo sapiens
ccttcaagtgccaa

SEQ ID NO: 3667344 - DNA, 15 bp, Homo sapiens
ccttcaagtgccaaa

SEQ ID NO: 3667345 - DNA, 23 bp, Homo sapiens
ccttccacgggggctgtggctct

SEQ ID NO: 3667346 - DNA, 16 bp, Homo sapiens
ccttcccattggcttt

SEQ ID NO: 3667347 - DNA, 15 bp, Homo sapiens
ccttcccctccctgg

SEQ ID NO: 3667348 - DNA, 17 bp, Homo sapiens
ccttcccctccctggct

SEQ ID NO: 3667349 - DNA, 22 bp, Homo sapiens
ccttcccctccctggctcccat

SEQ ID NO: 3667350 - DNA, 17 bp, Homo sapiens
ccttcctcagcctgggg

SEQ ID NO: 3667351 - DNA, 18 bp, Homo sapiens
ccttcctcagcctggggt

SEQ ID NO: 3667352 - DNA, 14 bp, Homo sapiens
ccttcctctgtgcc

SEQ ID NO: 3667353 - DNA, 19 bp, Homo sapiens
ccttcctctgtgccacgct

SEQ ID NO: 3667354 - DNA, 13 bp, Homo sapiens
ccttcctggcccc

SEQ ID NO: 3667355 - DNA, 21 bp, Homo sapiens
ccttcgcttcttgcctctgtg

SEQ ID NO: 3667356 - DNA, 23 bp, Homo sapiens
ccttcgcttcttgcctctgtgct

SEQ ID NO: 3667357 - DNA, 16 bp, Homo sapiens
ccttcgtctttcccat

SEQ ID NO: 3667358 - DNA, 14 bp, Homo sapiens
ccttctaaaggtgt

SEQ ID NO: 3667359 - DNA, 21 bp, Homo sapiens
ccttctcctacttagggaaga

SEQ ID NO: 3667360 - DNA, 14 bp, Homo sapiens
ccttctctgctcca

SEQ ID NO: 3667361 - DNA, 17 bp, Homo sapiens
ccttctctgctccacca

SEQ ID NO: 3667362 - DNA, 22 bp, Homo sapiens
ccttgaaaggcaggaagggaag

SEQ ID NO: 3667363 - DNA, 23 bp, Homo sapiens
ccttgaagaactgcaggccctgg

SEQ ID NO: 3667364 - DNA, 21 bp, Homo sapiens
ccttgacaactggcaggcagg

SEQ ID NO: 3667365 - DNA, 23 bp, Homo sapiens
ccttgcagttcagcaccacccta

SEQ ID NO: 3667366 - DNA, 12 bp, Homo sapiens
ccttgccagaga

SEQ ID NO: 3667367 - DNA, 19 bp, Homo sapiens
ccttgcctcaatgccagta

SEQ ID NO: 3667368 - DNA, 21 bp, Homo sapiens
ccttgcttgcctgcagggcca

SEQ ID NO: 3667369 - DNA, 16 bp, Homo sapiens
ccttggaggacagtgg

SEQ ID NO: 3667370 - DNA, 18 bp, Homo sapiens
ccttggaggacagtggga

SEQ ID NO: 3667371 - DNA, 15 bp, Homo sapiens
ccttggcaccagaca

SEQ ID NO: 3667372 - DNA, 21 bp, Homo sapiens
ccttggcaccagacacccagg

SEQ ID NO: 3667373 - DNA, 22 bp, Homo sapiens
ccttggcaccagacacccagga

SEQ ID NO: 3667374 - DNA, 23 bp, Homo sapiens
ccttggcaccagacacccaggac

SEQ ID NO: 3667375 - DNA, 13 bp, Homo sapiens
ccttggcctcaga

SEQ ID NO: 3667376 - DNA, 23 bp, Homo sapiens
ccttggcctgtctcatccccagg

SEQ ID NO: 3667377 - DNA, 14 bp, Homo sapiens
ccttggcttgatgg

SEQ ID NO: 3667378 - DNA, 15 bp, Homo sapiens
ccttgggaggcccca

SEQ ID NO: 3667379 - DNA, 14 bp, Homo sapiens
ccttgggctgctcc

SEQ ID NO: 3667380 - DNA, 20 bp, Homo sapiens
ccttggggaggcccatcccc

SEQ ID NO: 3667381 - DNA, 14 bp, Homo sapiens
ccttggggcaggca

SEQ ID NO: 3667382 - DNA, 16 bp, Homo sapiens
ccttgtcccagccagt

SEQ ID NO: 3667383 - DNA, 15 bp, Homo sapiens
ccttgttacttctga

SEQ ID NO: 3667384 - DNA, 19 bp, Homo sapiens
ccttgtttacacataccct

SEQ ID NO: 3667385 - DNA, 15 bp, Homo sapiens
cctttacgtgtttaa

SEQ ID NO: 3667386 - DNA, 16 bp, Homo sapiens
cctttatcacctcatt

SEQ ID NO: 3667387 - DNA, 15 bp, Homo sapiens
cctttcaaatttaga

SEQ ID NO: 3667388 - DNA, 21 bp, Homo sapiens
cctttcaaatttagaaactaa

SEQ ID NO: 3667389 - DNA, 19 bp, Homo sapiens
cctttccaccacagccagc

SEQ ID NO: 3667390 - DNA, 23 bp, Homo sapiens
cctttccaccacagccagcacct

SEQ ID NO: 3667391 - DNA, 18 bp, Homo sapiens
cctttcctatctttacat

SEQ ID NO: 3667392 - DNA, 14 bp, Homo sapiens
cctttctagagcac

SEQ ID NO: 3667393 - DNA, 21 bp, Homo sapiens
cctttctggaagtttctggtg

SEQ ID NO: 3667394 - DNA, 16 bp, Homo sapiens
cctttgcgcctgtgac

SEQ ID NO: 3667395 - DNA, 13 bp, Homo sapiens
cctttgctgtgag

SEQ ID NO: 3667396 - DNA, 22 bp, Homo sapiens
cctttgctgtgaggctgtcctg

SEQ ID NO: 3667397 - DNA, 23 bp, Homo sapiens
cctttgctgtgaggctgtcctgt

SEQ ID NO: 3667398 - DNA, 23 bp, Homo sapiens
cctttgttttgatgtttgtggcc

SEQ ID NO: 3667399 - DNA, 14 bp, Homo sapiens
ccttttttcttttt

SEQ ID NO: 3667400 - DNA, 23 bp, Homo sapiens
ccttttttgttttttcaaaatag

SEQ ID NO: 3667401 - DNA, 13 bp, Homo sapiens
cgaaacagcgctg

SEQ ID NO: 3667402 - DNA, 20 bp, Homo sapiens
cgaaaggatgaaagtgacca

SEQ ID NO: 3667403 - DNA, 20 bp, Homo sapiens
cgaaggtcccacagccctga

SEQ ID NO: 3667404 - DNA, 16 bp, Homo sapiens
cgaatctctgtgcctt

SEQ ID NO: 3667405 - DNA, 12 bp, Homo sapiens
cgacaagtgctg

SEQ ID NO: 3667406 - DNA, 16 bp, Homo sapiens
cgacagagcgagactt

SEQ ID NO: 3667407 - DNA, 23 bp, Homo sapiens
cgacatggctccggcctctgcct

SEQ ID NO: 3667408 - DNA, 12 bp, Homo sapiens
cgaccctggggg

SEQ ID NO: 3667409 - DNA, 19 bp, Homo sapiens
cgaccctgggggcacagga

SEQ ID NO: 3667410 - DNA, 23 bp, Homo sapiens
cgaccctgggggcacaggaggca

SEQ ID NO: 3667411 - DNA, 21 bp, Homo sapiens
cgaccgaggccctcccaaaga

SEQ ID NO: 3667412 - DNA, 19 bp, Homo sapiens
cgactccgttggccactcc

SEQ ID NO: 3667413 - DNA, 14 bp, Homo sapiens
cgagaccagcctgg

SEQ ID NO: 3667414 - DNA, 15 bp, Homo sapiens
cgagaccagcctggc

SEQ ID NO: 3667415 - DNA, 16 bp, Homo sapiens
cgagaccagcctggcc

SEQ ID NO: 3667416 - DNA, 14 bp, Homo sapiens
cgagaggtgggcca

SEQ ID NO: 3667417 - DNA, 15 bp, Homo sapiens
cgagaggtgggccag

SEQ ID NO: 3667418 - DNA, 17 bp, Homo sapiens
cgagctgggaaggttcc

SEQ ID NO: 3667419 - DNA, 18 bp, Homo sapiens
cgagggcccctctccaag

SEQ ID NO: 3667420 - DNA, 18 bp, Homo sapiens
cgaggggtgtcttgggca

SEQ ID NO: 3667421 - DNA, 14 bp, Homo sapiens
cgagggtcctggct

SEQ ID NO: 3667422 - DNA, 18 bp, Homo sapiens
cgaggtgcggccaccacc

SEQ ID NO: 3667423 - DNA, 23 bp, Homo sapiens
cgatactgcgactttctgcctgg

SEQ ID NO: 3667424 - DNA, 21 bp, Homo sapiens
cgattcaccctgtccaaactg

SEQ ID NO: 3667425 - DNA, 20 bp, Homo sapiens
cgcaccctgcctacgccagg

SEQ ID NO: 3667426 - DNA, 17 bp, Homo sapiens
cgcagacaccttggaca

SEQ ID NO: 3667427 - DNA, 12 bp, Homo sapiens
cgcagctgaagt

SEQ ID NO: 3667428 - DNA, 15 bp, Homo sapiens
cgcaggaagctgctc

SEQ ID NO: 3667429 - DNA, 17 bp, Homo sapiens
cgcagtgtgcactaagg

SEQ ID NO: 3667430 - DNA, 22 bp, Homo sapiens
cgcagtgtgcactaaggggccc

SEQ ID NO: 3667431 - DNA, 13 bp, Homo sapiens
cgcataaagaaga

SEQ ID NO: 3667432 - DNA, 17 bp, Homo sapiens
cgcatcttgcctccagg

SEQ ID NO: 3667433 - DNA, 19 bp, Homo sapiens
cgcatcttgcctccaggtg

SEQ ID NO: 3667434 - DNA, 14 bp, Homo sapiens
cgcatgcggcccag

SEQ ID NO: 3667435 - DNA, 13 bp, Homo sapiens
cgccatcctctgc

SEQ ID NO: 3667436 - DNA, 17 bp, Homo sapiens
cgccatgctcctggccc

SEQ ID NO: 3667437 - DNA, 14 bp, Homo sapiens
cgccattgccacca

SEQ ID NO: 3667438 - DNA, 16 bp, Homo sapiens
cgccattgccaccagg

SEQ ID NO: 3667439 - DNA, 19 bp, Homo sapiens
cgccccctccgccctgcca

SEQ ID NO: 3667440 - DNA, 15 bp, Homo sapiens
cgcccgtcctgcctg

SEQ ID NO: 3667441 - DNA, 14 bp, Homo sapiens
cgccctgccactca

SEQ ID NO: 3667442 - DNA, 15 bp, Homo sapiens
cgccctgcccgggct

SEQ ID NO: 3667443 - DNA, 15 bp, Homo sapiens
cgccgtctccagggg

SEQ ID NO: 3667444 - DNA, 17 bp, Homo sapiens
cgcctccccacctccag

SEQ ID NO: 3667445 - DNA, 19 bp, Homo sapiens
cgcctccccacctccaggc

SEQ ID NO: 3667446 - DNA, 20 bp, Homo sapiens
cgcctgacaaccactggtct

SEQ ID NO: 3667447 - DNA, 21 bp, Homo sapiens
cgcctgacaaccactggtctg

SEQ ID NO: 3667448 - DNA, 16 bp, Homo sapiens
cgcctgcccctcccag

SEQ ID NO: 3667449 - DNA, 15 bp, Homo sapiens
cgcctgtccacagcc

SEQ ID NO: 3667450 - DNA, 16 bp, Homo sapiens
cgcctgtccacagccc

SEQ ID NO: 3667451 - DNA, 22 bp, Homo sapiens
cgcgggtgggactcttccctgg

SEQ ID NO: 3667452 - DNA, 19 bp, Homo sapiens
cgctcagggccatgctgag

SEQ ID NO: 3667453 - DNA, 21 bp, Homo sapiens
cgctcagggccatgctgaggc

SEQ ID NO: 3667454 - DNA, 17 bp, Homo sapiens
cgctgaacccacccggc

SEQ ID NO: 3667455 - DNA, 13 bp, Homo sapiens
cgctgagtggcag

SEQ ID NO: 3667456 - DNA, 18 bp, Homo sapiens
cgctgcccacctgccggc

SEQ ID NO: 3667457 - DNA, 22 bp, Homo sapiens
cgctgtatgaaaggagagagca

SEQ ID NO: 3667458 - DNA, 20 bp, Homo sapiens
cgcttctgtgtatctctttc

SEQ ID NO: 3667459 - DNA, 16 bp, Homo sapiens
cgcttcttgcctctgt

SEQ ID NO: 3667460 - DNA, 19 bp, Homo sapiens
cgcttcttgcctctgtgct

SEQ ID NO: 3667461 - DNA, 15 bp, Homo sapiens
cgctttcctggagcc

SEQ ID NO: 3667462 - DNA, 13 bp, Homo sapiens
cggaaagcagctc

SEQ ID NO: 3667463 - DNA, 17 bp, Homo sapiens
cggaaggtttttaaaca

SEQ ID NO: 3667464 - DNA, 15 bp, Homo sapiens
cggacttttctgcaa

SEQ ID NO: 3667465 - DNA, 16 bp, Homo sapiens
cggagctccaggatgg

SEQ ID NO: 3667466 - DNA, 23 bp, Homo sapiens
cggagctccaggatggggagggg

SEQ ID NO: 3667467 - DNA, 20 bp, Homo sapiens
cggaggcctgcgaccctggg

SEQ ID NO: 3667468 - DNA, 22 bp, Homo sapiens
cggaggcctgcgaccctggggg

SEQ ID NO: 3667469 - DNA, 16 bp, Homo sapiens
cggaggtgtggagccg

SEQ ID NO: 3667470 - DNA, 15 bp, Homo sapiens
cggagtcgtggggtg

SEQ ID NO: 3667471 - DNA, 22 bp, Homo sapiens
cggagtcgtggggtgtgctggg

SEQ ID NO: 3667472 - DNA, 20 bp, Homo sapiens
cggatagttgctatttttgt

SEQ ID NO: 3667473 - DNA, 21 bp, Homo sapiens
cggcacagggtctgctctttc

SEQ ID NO: 3667474 - DNA, 18 bp, Homo sapiens
cggcatgagactcagtgc

SEQ ID NO: 3667475 - DNA, 20 bp, Homo sapiens
cggcatgagactcagtgcag

SEQ ID NO: 3667476 - DNA, 23 bp, Homo sapiens
cggcatgagactcagtgcagatg

SEQ ID NO: 3667477 - DNA, 13 bp, Homo sapiens
cggccaagaatgt

SEQ ID NO: 3667478 - DNA, 16 bp, Homo sapiens
cggccaccactgcagc

SEQ ID NO: 3667479 - DNA, 17 bp, Homo sapiens
cggcccaggatggcttt

SEQ ID NO: 3667480 - DNA, 17 bp, Homo sapiens
cggcccatatccctggt

SEQ ID NO: 3667481 - DNA, 14 bp, Homo sapiens
cggcccccttcctg

SEQ ID NO: 3667482 - DNA, 16 bp, Homo sapiens
cggcccccttcctggc

SEQ ID NO: 3667483 - DNA, 19 bp, Homo sapiens
cggccctgcagccagctca

SEQ ID NO: 3667484 - DNA, 11 bp, Homo sapiens
cggccctgggg

SEQ ID NO: 3667485 - DNA, 15 bp, Homo sapiens
cggcctgatgctccc

SEQ ID NO: 3667486 - DNA, 19 bp, Homo sapiens
cggcctgatgctccctccc

SEQ ID NO: 3667487 - DNA, 16 bp, Homo sapiens
cggcgcttcccagcac

SEQ ID NO: 3667488 - DNA, 17 bp, Homo sapiens
cggcgtggcccaaggct

SEQ ID NO: 3667489 - DNA, 15 bp, Homo sapiens
cggcgtgtgcagtgc

SEQ ID NO: 3667490 - DNA, 15 bp, Homo sapiens
cggctccagagcagg

SEQ ID NO: 3667491 - DNA, 23 bp, Homo sapiens
cggctctggggtaggctgctccc

SEQ ID NO: 3667492 - DNA, 23 bp, Homo sapiens
cggctgaccatgctcatctgctg

SEQ ID NO: 3667493 - DNA, 12 bp, Homo sapiens
cggctgcagagg

SEQ ID NO: 3667494 - DNA, 20 bp, Homo sapiens
cggctgcagaggccagaggc

SEQ ID NO: 3667495 - DNA, 15 bp, Homo sapiens
cggctggggactgct

SEQ ID NO: 3667496 - DNA, 17 bp, Homo sapiens
cggcttcctcattcctt

SEQ ID NO: 3667497 - DNA, 15 bp, Homo sapiens
cgggactcctccctg

SEQ ID NO: 3667498 - DNA, 22 bp, Homo sapiens
cgggagccatgcgccccctccg

SEQ ID NO: 3667499 - DNA, 17 bp, Homo sapiens
cgggaggtcgaggcagg

SEQ ID NO: 3667500 - DNA, 17 bp, Homo sapiens
cgggaggtttggggggc

SEQ ID NO: 3667501 - DNA, 16 bp, Homo sapiens
cgggcaccagccagcg

SEQ ID NO: 3667502 - DNA, 20 bp, Homo sapiens
cgggccctgcctgagggtgg

SEQ ID NO: 3667503 - DNA, 11 bp, Homo sapiens
cgggctcagca

SEQ ID NO: 3667504 - DNA, 21 bp, Homo sapiens
cggggcagtactcctccctgg

SEQ ID NO: 3667505 - DNA, 13 bp, Homo sapiens
cggggctcctcct

SEQ ID NO: 3667506 - DNA, 16 bp, Homo sapiens
cggggctcctcctgaa

SEQ ID NO: 3667507 - DNA, 15 bp, Homo sapiens
cggggcttctcttgg

SEQ ID NO: 3667508 - DNA, 16 bp, Homo sapiens
cgggtggggcttgggg

SEQ ID NO: 3667509 - DNA, 12 bp, Homo sapiens
cggtcactgatg

SEQ ID NO: 3667510 - DNA, 16 bp, Homo sapiens
cggtctcctgactggt

SEQ ID NO: 3667511 - DNA, 18 bp, Homo sapiens
cggtgcccaagccagagg

SEQ ID NO: 3667512 - DNA, 23 bp, Homo sapiens
cggtgcccaagccagaggctggg

SEQ ID NO: 3667513 - DNA, 20 bp, Homo sapiens
cggtggctagtcaagctcct

SEQ ID NO: 3667514 - DNA, 20 bp, Homo sapiens
cggtggctcatgcctgtaat

SEQ ID NO: 3667515 - DNA, 14 bp, Homo sapiens
cggttaaattccat

SEQ ID NO: 3667516 - DNA, 16 bp, Homo sapiens
cggtttccagggaggg

SEQ ID NO: 3667517 - DNA, 15 bp, Homo sapiens
cgtataggcatgtaa

SEQ ID NO: 3667518 - DNA, 20 bp, Homo sapiens
cgtatatacttaagaataca

SEQ ID NO: 3667519 - DNA, 19 bp, Homo sapiens
cgtatctccctggagaagc

SEQ ID NO: 3667520 - DNA, 22 bp, Homo sapiens
cgtcaggtactcctgccaggga

SEQ ID NO: 3667521 - DNA, 21 bp, Homo sapiens
cgtccagccgccattgccacc

SEQ ID NO: 3667522 - DNA, 21 bp, Homo sapiens
cgtccccagttgccgtctagg

SEQ ID NO: 3667523 - DNA, 14 bp, Homo sapiens
cgtcctgcctgtgg

SEQ ID NO: 3667524 - DNA, 16 bp, Homo sapiens
cgtcctgcctgtggcg

SEQ ID NO: 3667525 - DNA, 20 bp, Homo sapiens
cgtcgagctgggaaggttcc

SEQ ID NO: 3667526 - DNA, 13 bp, Homo sapiens
cgtctctgctctg

SEQ ID NO: 3667527 - DNA, 21 bp, Homo sapiens
cgtctgaccccagcccagaca

SEQ ID NO: 3667528 - DNA, 23 bp, Homo sapiens
cgtctgaccccagcccagacagc

SEQ ID NO: 3667529 - DNA, 18 bp, Homo sapiens
cgtctgccggacccggag

SEQ ID NO: 3667530 - DNA, 23 bp, Homo sapiens
cgtgaaagtgcatttttgtaaat

SEQ ID NO: 3667531 - DNA, 20 bp, Homo sapiens
cgtgaccggacttttctgca

SEQ ID NO: 3667532 - DNA, 19 bp, Homo sapiens
cgtgaggatgtcactcaga

SEQ ID NO: 3667533 - DNA, 20 bp, Homo sapiens
cgtgcacgtggagagctggt

SEQ ID NO: 3667534 - DNA, 22 bp, Homo sapiens
cgtgcttgtttgctcacctggg

SEQ ID NO: 3667535 - DNA, 20 bp, Homo sapiens
cgtggagagctggtgcccgg

SEQ ID NO: 3667536 - DNA, 13 bp, Homo sapiens
cgtggagggaggc

SEQ ID NO: 3667537 - DNA, 17 bp, Homo sapiens
cgtggattgcacgtggc

SEQ ID NO: 3667538 - DNA, 13 bp, Homo sapiens
cgtggcatcacct

SEQ ID NO: 3667539 - DNA, 15 bp, Homo sapiens
cgtggcccagagaag

SEQ ID NO: 3667540 - DNA, 19 bp, Homo sapiens
cgtggcctgcataggctcc

SEQ ID NO: 3667541 - DNA, 19 bp, Homo sapiens
cgtgggacggtgcccaagc

SEQ ID NO: 3667542 - DNA, 16 bp, Homo sapiens
cgtggggcagggagct

SEQ ID NO: 3667543 - DNA, 23 bp, Homo sapiens
cgtggggcagggagctgggcccg

SEQ ID NO: 3667544 - DNA, 14 bp, Homo sapiens
cgtgtctgtattta

SEQ ID NO: 3667545 - DNA, 22 bp, Homo sapiens
cgtgttgcttcaaactgagaca

SEQ ID NO: 3667546 - DNA, 13 bp, Homo sapiens
cgttagctcctgt

SEQ ID NO: 3667547 - DNA, 16 bp, Homo sapiens
cgttagctcctgtggc

SEQ ID NO: 3667548 - DNA, 17 bp, Homo sapiens
ctaaaaccattccattt

SEQ ID NO: 3667549 - DNA, 18 bp, Homo sapiens
ctaaaatatataatttat

SEQ ID NO: 3667550 - DNA, 12 bp, Homo sapiens
ctaaacctcagt

SEQ ID NO: 3667551 - DNA, 13 bp, Homo sapiens
ctaaacctcagtt

SEQ ID NO: 3667552 - DNA, 21 bp, Homo sapiens
ctaaagaaaaatatcttggcc

SEQ ID NO: 3667553 - DNA, 18 bp, Homo sapiens
ctaaagccaaacatatat

SEQ ID NO: 3667554 - DNA, 17 bp, Homo sapiens
ctaaaggaggaggagcc

SEQ ID NO: 3667555 - DNA, 11 bp, Homo sapiens
ctaaagttata

SEQ ID NO: 3667556 - DNA, 13 bp, Homo sapiens
ctaaagttatatt

SEQ ID NO: 3667557 - DNA, 22 bp, Homo sapiens
ctaaagttatatttcagatgta

SEQ ID NO: 3667558 - DNA, 20 bp, Homo sapiens
ccccaagagcccaaaagagg

SEQ ID NO: 3667559 - DNA, 12 bp, Homo sapiens
ccccaccctcat

SEQ ID NO: 3667560 - DNA, 16 bp, Homo sapiens
ccccacctgcactcca

SEQ ID NO: 3667561 - DNA, 14 bp, Homo sapiens
ccccacctgccagc

SEQ ID NO: 3667562 - DNA, 15 bp, Homo sapiens
ccccactctccccac

SEQ ID NO: 3667563 - DNA, 18 bp, Homo sapiens
ccccactctccccacact

SEQ ID NO: 3667564 - DNA, 14 bp, Homo sapiens
ccccactgaccaga

SEQ ID NO: 3667565 - DNA, 14 bp, Homo sapiens
ccccactggggaaa

SEQ ID NO: 3667566 - DNA, 22 bp, Homo sapiens
ccccactggggaaataacagct

SEQ ID NO: 3667567 - DNA, 13 bp, Homo sapiens
ccccacttgcctc

SEQ ID NO: 3667568 - DNA, 11 bp, Homo sapiens
ccccagagctg

SEQ ID NO: 3667569 - DNA, 19 bp, Homo sapiens
ccccagattcttcagcttg

SEQ ID NO: 3667570 - DNA, 20 bp, Homo sapiens
ccccagcccagggctcctgc

SEQ ID NO: 3667571 - DNA, 21 bp, Homo sapiens
ccccagcccagggctcctgca

SEQ ID NO: 3667572 - DNA, 17 bp, Homo sapiens
ccccagctaagaacctg

SEQ ID NO: 3667573 - DNA, 15 bp, Homo sapiens
ccccaggaccagctc

SEQ ID NO: 3667574 - DNA, 12 bp, Homo sapiens
ccccaggcccca

SEQ ID NO: 3667575 - DNA, 22 bp, Homo sapiens
ccccaggtggttatggagaggg

SEQ ID NO: 3667576 - DNA, 15 bp, Homo sapiens
ccccatcctccagca

SEQ ID NO: 3667577 - DNA, 20 bp, Homo sapiens
ccccatgcctgtccagcctg

SEQ ID NO: 3667578 - DNA, 18 bp, Homo sapiens
ccccatggccccaggccc

SEQ ID NO: 3667579 - DNA, 20 bp, Homo sapiens
ccccatggccccaggcccac

SEQ ID NO: 3667580 - DNA, 14 bp, Homo sapiens
cccccaagcctgca

SEQ ID NO: 3667581 - DNA, 17 bp, Homo sapiens
cccccacacctcagttc

SEQ ID NO: 3667582 - DNA, 13 bp, Homo sapiens
cccccagctaaga

SEQ ID NO: 3667583 - DNA, 16 bp, Homo sapiens
ccccgggctctctgct

SEQ ID NO: 3667584 - DNA, 18 bp, Homo sapiens
ccccgggctctctgctgt

SEQ ID NO: 3667585 - DNA, 22 bp, Homo sapiens
ccccgtgtcctctccctgccaa

SEQ ID NO: 3667586 - DNA, 13 bp, Homo sapiens
cccctcaccctgc

SEQ ID NO: 3667587 - DNA, 16 bp, Homo sapiens
cccctcaccctgcctt

SEQ ID NO: 3667588 - DNA, 18 bp, Homo sapiens
cccctcagcctctgccac

SEQ ID NO: 3667589 - DNA, 12 bp, Homo sapiens
cccctcccagaa

SEQ ID NO: 3667590 - DNA, 15 bp, Homo sapiens
cccctcccccaaccc

SEQ ID NO: 3667591 - DNA, 16 bp, Homo sapiens
cccctcccccaacccc

SEQ ID NO: 3667592 - DNA, 13 bp, Homo sapiens
cccctccctggct

SEQ ID NO: 3667593 - DNA, 14 bp, Homo sapiens
cccctccctggctc

SEQ ID NO: 3667594 - DNA, 16 bp, Homo sapiens
cccctccgccctgcca

SEQ ID NO: 3667595 - DNA, 18 bp, Homo sapiens
cccctccgccctgccact

SEQ ID NO: 3667596 - DNA, 19 bp, Homo sapiens
cccctccgccctgccactc

SEQ ID NO: 3667597 - DNA, 14 bp, Homo sapiens
cccctcctccctgc

SEQ ID NO: 3667598 - DNA, 23 bp, Homo sapiens
cccctcctgactcatccgcctgg

SEQ ID NO: 3667599 - DNA, 18 bp, Homo sapiens
cccctctaactggacagc

SEQ ID NO: 3667600 - DNA, 19 bp, Homo sapiens
cccctctaactggacagcc

SEQ ID NO: 3667601 - DNA, 12 bp, Homo sapiens
cccctctctcct

SEQ ID NO: 3667602 - DNA, 19 bp, Homo sapiens
cccctctggtcgctcctgc

SEQ ID NO: 3667603 - DNA, 20 bp, Homo sapiens
cccctctggtcgctcctgcc

SEQ ID NO: 3667604 - DNA, 21 bp, Homo sapiens
cccctgagacaaatggaggcc

SEQ ID NO: 3667605 - DNA, 20 bp, Homo sapiens
cccctgccaccaggccacct

SEQ ID NO: 3667606 - DNA, 13 bp, Homo sapiens
cccctgccctggt

SEQ ID NO: 3667607 - DNA, 17 bp, Homo sapiens
cccctgccctggtccag

SEQ ID NO: 3667608 - DNA, 17 bp, Homo sapiens
cccctggacagaggcgg

SEQ ID NO: 3667609 - DNA, 12 bp, Homo sapiens
cccctgggatcc

SEQ ID NO: 3667610 - DNA, 16 bp, Homo sapiens
cccctgtaaggttcca

SEQ ID NO: 3667611 - DNA, 17 bp, Homo sapiens
cccctgtaaggttccat

SEQ ID NO: 3667612 - DNA, 14 bp, Homo sapiens
cccctgtctagaga

SEQ ID NO: 3667613 - DNA, 18 bp, Homo sapiens
cccctgtctagagaggga

SEQ ID NO: 3667614 - DNA, 16 bp, Homo sapiens
ccccttctctgctcca

SEQ ID NO: 3667615 - DNA, 23 bp, Homo sapiens
ccccttgacaactggcaggcagg

SEQ ID NO: 3667616 - DNA, 21 bp, Homo sapiens
ccccttgatttaaacacacag

SEQ ID NO: 3667617 - DNA, 15 bp, Homo sapiens
cccgacagagggaag

SEQ ID NO: 3667618 - DNA, 18 bp, Homo sapiens
cccgcccgtctctgctct

SEQ ID NO: 3667619 - DNA, 16 bp, Homo sapiens
cccgctgctgtgcaac

SEQ ID NO: 3667620 - DNA, 14 bp, Homo sapiens
cccggaacaagcct

SEQ ID NO: 3667621 - DNA, 23 bp, Homo sapiens
cccggcatgagactcagtgcaga

SEQ ID NO: 3667622 - DNA, 16 bp, Homo sapiens
cccggctgcagaggcc

SEQ ID NO: 3667623 - DNA, 16 bp, Homo sapiens
cccgggctctctgctg

SEQ ID NO: 3667624 - DNA, 17 bp, Homo sapiens
cccgtctctgctctgct

SEQ ID NO: 3667625 - DNA, 12 bp, Homo sapiens
cccgtctgaccc

SEQ ID NO: 3667626 - DNA, 13 bp, Homo sapiens
cccgtctgacccc

SEQ ID NO: 3667627 - DNA, 14 bp, Homo sapiens
cccgtggggcaggg

SEQ ID NO: 3667628 - DNA, 22 bp, Homo sapiens
cccgtggggcagggagctgggc

SEQ ID NO: 3667629 - DNA, 14 bp, Homo sapiens
cccgtttctggtgg

SEQ ID NO: 3667630 - DNA, 15 bp, Homo sapiens
ccctaatctatggtc

SEQ ID NO: 3667631 - DNA, 19 bp, Homo sapiens
ccctaccacctccccagcc

SEQ ID NO: 3667632 - DNA, 12 bp, Homo sapiens
ccctaccctcct

SEQ ID NO: 3667633 - DNA, 17 bp, Homo sapiens
ccctaccctcctgctga

SEQ ID NO: 3667634 - DNA, 20 bp, Homo sapiens
ccctaccctcctgctgagct

SEQ ID NO: 3667635 - DNA, 16 bp, Homo sapiens
ccctacctcaggcagg

SEQ ID NO: 3667636 - DNA, 17 bp, Homo sapiens
ccctcacccccatggcc

SEQ ID NO: 3667637 - DNA, 20 bp, Homo sapiens
ccctcaccttggcaccagac

SEQ ID NO: 3667638 - DNA, 23 bp, Homo sapiens
ccctcataagtttgtttaaacac

SEQ ID NO: 3667639 - DNA, 22 bp, Homo sapiens
ccctcatggcgggactggagaa

SEQ ID NO: 3667640 - DNA, 13 bp, Homo sapiens
ccctcccaccccc

SEQ ID NO: 3667641 - DNA, 13 bp, Homo sapiens
ccctcccctgccc

SEQ ID NO: 3667642 - DNA, 14 bp, Homo sapiens
ccctcccctgccct

SEQ ID NO: 3667643 - DNA, 16 bp, Homo sapiens
ccctccctggctccca

SEQ ID NO: 3667644 - DNA, 20 bp, Homo sapiens
ccctccctgttccccagaga

SEQ ID NO: 3667645 - DNA, 19 bp, Homo sapiens
ccctccgccctgccactca

SEQ ID NO: 3667646 - DNA, 12 bp, Homo sapiens
ccctcctcacct

SEQ ID NO: 3667647 - DNA, 14 bp, Homo sapiens
ccctcctgctgagc

SEQ ID NO: 3667648 - DNA, 15 bp, Homo sapiens
ccctcctgctgagct

SEQ ID NO: 3667649 - DNA, 17 bp, Homo sapiens
ccctcctgctgagctgc

SEQ ID NO: 3667650 - DNA, 19 bp, Homo sapiens
ccctcctgctgagctgccc

SEQ ID NO: 3667651 - DNA, 13 bp, Homo sapiens
ccctccttcccat

SEQ ID NO: 3667652 - DNA, 16 bp, Homo sapiens
ccctcggtgggagcca

SEQ ID NO: 3667653 - DNA, 15 bp, Homo sapiens
ccctcgtcccatcca

SEQ ID NO: 3667654 - DNA, 16 bp, Homo sapiens
ccctcgtcccatccag

SEQ ID NO: 3667655 - DNA, 17 bp, Homo sapiens
ccctcgtcccatccagc

SEQ ID NO: 3667656 - DNA, 15 bp, Homo sapiens
ccctctaactggaca

SEQ ID NO: 3667657 - DNA, 17 bp, Homo sapiens
ccctctaactggacagc

SEQ ID NO: 3667658 - DNA, 13 bp, Homo sapiens
ccctctctcctcc

SEQ ID NO: 3667659 - DNA, 13 bp, Homo sapiens
ccctctctcttct

SEQ ID NO: 3667660 - DNA, 17 bp, Homo sapiens
ccctctctcttctgctc

SEQ ID NO: 3667661 - DNA, 22 bp, Homo sapiens
ccctctctcttctgctccaccc

SEQ ID NO: 3667662 - DNA, 23 bp, Homo sapiens
ccctctctcttctgctccaccct

SEQ ID NO: 3667663 - DNA, 13 bp, Homo sapiens
ccctctgccccat

SEQ ID NO: 3667664 - DNA, 13 bp, Homo sapiens
ccctctgccccgc

SEQ ID NO: 3667665 - DNA, 18 bp, Homo sapiens
ccctctggagtggccact

SEQ ID NO: 3667666 - DNA, 22 bp, Homo sapiens
ccctctggtcgctcctgcccac

SEQ ID NO: 3667667 - DNA, 18 bp, Homo sapiens
ccctctgtgtatttgctt

SEQ ID NO: 3667668 - DNA, 18 bp, Homo sapiens
ccctcttccaaaggcagc

SEQ ID NO: 3667669 - DNA, 22 bp, Homo sapiens
ccctgaaaatgtttttctgcca

SEQ ID NO: 3667670 - DNA, 18 bp, Homo sapiens
ccctgaaagccctgagct

SEQ ID NO: 3667671 - DNA, 20 bp, Homo sapiens
ccctgacagtccctcctctc

SEQ ID NO: 3667672 - DNA, 17 bp, Homo sapiens
ccctgagacaaatggag

SEQ ID NO: 3667673 - DNA, 20 bp, Homo sapiens
ccctgagacaaatggaggcc

SEQ ID NO: 3667674 - DNA, 11 bp, Homo sapiens
ccctgagctga

SEQ ID NO: 3667675 - DNA, 22 bp, Homo sapiens
ccctgagggcggagcgcctcct

SEQ ID NO: 3667676 - DNA, 14 bp, Homo sapiens
ccctgagtcctgag

SEQ ID NO: 3667677 - DNA, 15 bp, Homo sapiens
ccctgagtctgggca

SEQ ID NO: 3667678 - DNA, 22 bp, Homo sapiens
ccaataataaatgccctcttct

SEQ ID NO: 3667679 - DNA, 15 bp, Homo sapiens
ccaatcccagttctt

SEQ ID NO: 3667680 - DNA, 20 bp, Homo sapiens
ccaatcccagttcttcctgc

SEQ ID NO: 3667681 - DNA, 21 bp, Homo sapiens
ccaatcccagttcttcctgca

SEQ ID NO: 3667682 - DNA, 22 bp, Homo sapiens
ccaatggcccggcccctcctga

SEQ ID NO: 3667683 - DNA, 17 bp, Homo sapiens
ccaatgggaagcaggga

SEQ ID NO: 3667684 - DNA, 19 bp, Homo sapiens
ccaatggggcggggcttct

SEQ ID NO: 3667685 - DNA, 22 bp, Homo sapiens
ccaatggggcggggcttctctc

SEQ ID NO: 3667686 - DNA, 16 bp, Homo sapiens
ccaattttaatttagt

SEQ ID NO: 3667687 - DNA, 22 bp, Homo sapiens
ccaattttaatttagtaaatgt

SEQ ID NO: 3667688 - DNA, 15 bp, Homo sapiens
ccacaagcctgagaa

SEQ ID NO: 3667689 - DNA, 21 bp, Homo sapiens
ccacaaggacttcctgtccag

SEQ ID NO: 3667690 - DNA, 21 bp, Homo sapiens
ccacaagtgccgcaaattgta

SEQ ID NO: 3667691 - DNA, 15 bp, Homo sapiens
ccacaatctgagcac

SEQ ID NO: 3667692 - DNA, 19 bp, Homo sapiens
ccacaccccaacacttcca

SEQ ID NO: 3667693 - DNA, 21 bp, Homo sapiens
ccacaccccaacacttccagc

SEQ ID NO: 3667694 - DNA, 20 bp, Homo sapiens
ccacacttgttccagctctt

SEQ ID NO: 3667695 - DNA, 23 bp, Homo sapiens
ccacagaaaagaaagttcatgct

SEQ ID NO: 3667696 - DNA, 12 bp, Homo sapiens
ccacagccctga

SEQ ID NO: 3667697 - DNA, 19 bp, Homo sapiens
ccacatcctccgtccagcc

SEQ ID NO: 3667698 - DNA, 13 bp, Homo sapiens
ccacatgtccagc

SEQ ID NO: 3667699 - DNA, 15 bp, Homo sapiens
ccaccaagggatctg

SEQ ID NO: 3667700 - DNA, 17 bp, Homo sapiens
ccattatgaagaagaga

SEQ ID NO: 3667701 - DNA, 16 bp, Homo sapiens
ccattcctgaagaacc

SEQ ID NO: 3667702 - DNA, 20 bp, Homo sapiens
ccattctgactcggtttctc

SEQ ID NO: 3667703 - DNA, 19 bp, Homo sapiens
ccattgcactccagcctgg

SEQ ID NO: 3667704 - DNA, 15 bp, Homo sapiens
ccattgccaccagga

SEQ ID NO: 3667705 - DNA, 16 bp, Homo sapiens
ccattgccaccaggag

SEQ ID NO: 3667706 - DNA, 21 bp, Homo sapiens
ccattgccaccaggagaacca

SEQ ID NO: 3667707 - DNA, 17 bp, Homo sapiens
ccattgtccctctgccc

SEQ ID NO: 3667708 - DNA, 15 bp, Homo sapiens
ccatttctcagggaa

SEQ ID NO: 3667709 - DNA, 19 bp, Homo sapiens
ccatttctgaactgttaca

SEQ ID NO: 3667710 - DNA, 22 bp, Homo sapiens
ccatttgtgttttgaaagccca

SEQ ID NO: 3667711 - DNA, 15 bp, Homo sapiens
cccaaagaggcccgc

SEQ ID NO: 3667712 - DNA, 13 bp, Homo sapiens
cccaaagctgagc

SEQ ID NO: 3667713 - DNA, 20 bp, Homo sapiens
cccaaagctttcctgcccca

SEQ ID NO: 3667714 - DNA, 16 bp, Homo sapiens
cccaacggccctgcag

SEQ ID NO: 3667715 - DNA, 20 bp, Homo sapiens
cccaacggccctgcagccag

SEQ ID NO: 3667716 - DNA, 22 bp, Homo sapiens
cccaacggccctgcagccagct

SEQ ID NO: 3667717 - DNA, 19 bp, Homo sapiens
cccaagacagatgccccag

SEQ ID NO: 3667718 - DNA, 21 bp, Homo sapiens
cccaaggtgctgatgtcaaag

SEQ ID NO: 3667719 - DNA, 21 bp, Homo sapiens
cccaattcttacaaacatgtg

SEQ ID NO: 3667720 - DNA, 21 bp, Homo sapiens
cccacaaaggagagctagcag

SEQ ID NO: 3667721 - DNA, 16 bp, Homo sapiens
cccacaagtggtggta

SEQ ID NO: 3667722 - DNA, 14 bp, Homo sapiens
cccacatgtccagc

SEQ ID NO: 3667723 - DNA, 14 bp, Homo sapiens
cccaccccacactt

SEQ ID NO: 3667724 - DNA, 19 bp, Homo sapiens
cccacccccttctctgctc

SEQ ID NO: 3667725 - DNA, 17 bp, Homo sapiens
cccaccctgctgctggt

SEQ ID NO: 3667726 - DNA, 14 bp, Homo sapiens
cccacctccaggct

SEQ ID NO: 3667727 - DNA, 17 bp, Homo sapiens
cccacctccctgcctcc

SEQ ID NO: 3667728 - DNA, 22 bp, Homo sapiens
cccacctgccagcggtttcctg

SEQ ID NO: 3667729 - DNA, 23 bp, Homo sapiens
cccacctgtcaaacaaagccaga

SEQ ID NO: 3667730 - DNA, 20 bp, Homo sapiens
cccacggagtcgtggggtgt

SEQ ID NO: 3667731 - DNA, 23 bp, Homo sapiens
cccactcaagccaagcagccaag

SEQ ID NO: 3667732 - DNA, 11 bp, Homo sapiens
cccactctccc

SEQ ID NO: 3667733 - DNA, 16 bp, Homo sapiens
cccactgtcctgggcc

SEQ ID NO: 3667734 - DNA, 14 bp, Homo sapiens
cccacttgcctctt

SEQ ID NO: 3667735 - DNA, 15 bp, Homo sapiens
cccacttgcctcttc

SEQ ID NO: 3667736 - DNA, 21 bp, Homo sapiens
cccacttgcctcttccttgaa

SEQ ID NO: 3667737 - DNA, 14 bp, Homo sapiens
cccagaaaggagac

SEQ ID NO: 3667738 - DNA, 15 bp, Homo sapiens
cccagaaaggagact

SEQ ID NO: 3667739 - DNA, 14 bp, Homo sapiens
cccagaacacactc

SEQ ID NO: 3667740 - DNA, 18 bp, Homo sapiens
cccagaacacactccatc

SEQ ID NO: 3667741 - DNA, 20 bp, Homo sapiens
cccagacagcaaggtgtgga

SEQ ID NO: 3667742 - DNA, 12 bp, Homo sapiens
cccagactcaga

SEQ ID NO: 3667743 - DNA, 18 bp, Homo sapiens
cccagagacatacttgaa

SEQ ID NO: 3667744 - DNA, 12 bp, Homo sapiens
cccagagcccag

SEQ ID NO: 3667745 - DNA, 13 bp, Homo sapiens
cccagagcccagc

SEQ ID NO: 3667746 - DNA, 11 bp, Homo sapiens
cccagagctgt

SEQ ID NO: 3667747 - DNA, 18 bp, Homo sapiens
cccagatctggtcccttg

SEQ ID NO: 3667748 - DNA, 18 bp, Homo sapiens
cccagcacagcttgacct

SEQ ID NO: 3667749 - DNA, 12 bp, Homo sapiens
cccagccacccc

SEQ ID NO: 3667750 - DNA, 15 bp, Homo sapiens
cccagcccagacagc

SEQ ID NO: 3667751 - DNA, 11 bp, Homo sapiens
cccagcccagg

SEQ ID NO: 3667752 - DNA, 18 bp, Homo sapiens
cccagcccagggctcctg

SEQ ID NO: 3667753 - DNA, 18 bp, Homo sapiens
cccagcctatcaggtgcc

SEQ ID NO: 3667754 - DNA, 20 bp, Homo sapiens
cccagccttggtgggggagc

SEQ ID NO: 3667755 - DNA, 22 bp, Homo sapiens
cccagccttggtgggggagcct

SEQ ID NO: 3667756 - DNA, 22 bp, Homo sapiens
cccagctaagaacctggaactt

SEQ ID NO: 3667757 - DNA, 15 bp, Homo sapiens
cccaggaccagctca

SEQ ID NO: 3667758 - DNA, 17 bp, Homo sapiens
cccaggaccagctcagg

SEQ ID NO: 3667759 - DNA, 22 bp, Homo sapiens
cccaggaccagctcaggacaga

SEQ ID NO: 3667760 - DNA, 11 bp, Homo sapiens
cccaggaccct

SEQ ID NO: 3667761 - DNA, 11 bp, Homo sapiens
cccaggcagct

SEQ ID NO: 3667762 - DNA, 13 bp, Homo sapiens
cccaggcagctgg

SEQ ID NO: 3667763 - DNA, 14 bp, Homo sapiens
cccaggcagctggc

SEQ ID NO: 3667764 - DNA, 15 bp, Homo sapiens
cccaggcagctggca

SEQ ID NO: 3667765 - DNA, 17 bp, Homo sapiens
cccaggcagctggcagg

SEQ ID NO: 3667766 - DNA, 13 bp, Homo sapiens
cccaggccccagg

SEQ ID NO: 3667767 - DNA, 18 bp, Homo sapiens
cccaggccccaggaagcc

SEQ ID NO: 3667768 - DNA, 20 bp, Homo sapiens
cccaggctggagtgcagtga

SEQ ID NO: 3667769 - DNA, 15 bp, Homo sapiens
cccagggaagttttg

SEQ ID NO: 3667770 - DNA, 22 bp, Homo sapiens
cccagggagcggaaagcagctc

SEQ ID NO: 3667771 - DNA, 17 bp, Homo sapiens
cccagggcccagagccc

SEQ ID NO: 3667772 - DNA, 22 bp, Homo sapiens
cccagggcccagagcccagctc

SEQ ID NO: 3667773 - DNA, 23 bp, Homo sapiens
cccagggccctcggtgggagcca

SEQ ID NO: 3667774 - DNA, 22 bp, Homo sapiens
cccagggggtctcacccatgca

SEQ ID NO: 3667775 - DNA, 20 bp, Homo sapiens
cccaggggtcccagccaccc

SEQ ID NO: 3667776 - DNA, 15 bp, Homo sapiens
cccagggtcttccct

SEQ ID NO: 3667777 - DNA, 14 bp, Homo sapiens
cccaggtccagctc

SEQ ID NO: 3667778 - DNA, 17 bp, Homo sapiens
cccaggtccagctctgg

SEQ ID NO: 3667779 - DNA, 16 bp, Homo sapiens
cccagtagaccttgtt

SEQ ID NO: 3667780 - DNA, 15 bp, Homo sapiens
cccagtgcagaatgt

SEQ ID NO: 3667781 - DNA, 14 bp, Homo sapiens
cccagtgcatggtg

SEQ ID NO: 3667782 - DNA, 21 bp, Homo sapiens
cccagtgcatggtggccagag

SEQ ID NO: 3667783 - DNA, 19 bp, Homo sapiens
cccagtgcccccactgacc

SEQ ID NO: 3667784 - DNA, 20 bp, Homo sapiens
cccagtgcccccactgacca

SEQ ID NO: 3667785 - DNA, 22 bp, Homo sapiens
cccagtgcccccactgaccaga

SEQ ID NO: 3667786 - DNA, 15 bp, Homo sapiens
cccagtgccgagaag

SEQ ID NO: 3667787 - DNA, 18 bp, Homo sapiens
cccagtgccgagaaggaa

SEQ ID NO: 3667788 - DNA, 17 bp, Homo sapiens
cccagttcttcctgcaa

SEQ ID NO: 3667789 - DNA, 21 bp, Homo sapiens
cccataattgctttgccaaaa

SEQ ID NO: 3667790 - DNA, 15 bp, Homo sapiens
cccatccagctacca

SEQ ID NO: 3667791 - DNA, 18 bp, Homo sapiens
cccatcctccagcaggga

SEQ ID NO: 3667792 - DNA, 21 bp, Homo sapiens
cccatgcaagcagaggaccag

SEQ ID NO: 3667793 - DNA, 18 bp, Homo sapiens
cccatgcactgtgaagga

SEQ ID NO: 3667794 - DNA, 14 bp, Homo sapiens
cccatgcccacctg

SEQ ID NO: 3667795 - DNA, 13 bp, Homo sapiens
cccatgcctgtcc

SEQ ID NO: 3667796 - DNA, 16 bp, Homo sapiens
cccatgcctgtccagc

SEQ ID NO: 3667797 - DNA, 17 bp, Homo sapiens
cccatggccccaggccc

SEQ ID NO: 3667798 - DNA, 12 bp, Homo sapiens
cccattcctgaa

SEQ ID NO: 3667799 - DNA, 16 bp, Homo sapiens
ccccaaagctttcctg

SEQ ID NO: 3667800 - DNA, 18 bp, Homo sapiens
ccccaaagctttcctgcc

SEQ ID NO: 3667801 - DNA, 19 bp, Homo sapiens
ccccaaagctttcctgccc

SEQ ID NO: 3667802 - DNA, 21 bp, Homo sapiens
ccccaaagctttcctgcccca

SEQ ID NO: 3667803 - DNA, 23 bp, Homo sapiens
ccccaacccgtgcccctgggatc

SEQ ID NO: 3667804 - DNA, 18 bp, Homo sapiens
cctgaagggcctcccagc

SEQ ID NO: 3667805 - DNA, 21 bp, Homo sapiens
cctgaatgaggcggagctcca

SEQ ID NO: 3667806 - DNA, 19 bp, Homo sapiens
cctgaccaagactgagcca

SEQ ID NO: 3667807 - DNA, 18 bp, Homo sapiens
cctgaccagggcaaggcc

SEQ ID NO: 3667808 - DNA, 21 bp, Homo sapiens
cctgagacaaatggaggcctg

SEQ ID NO: 3667809 - DNA, 19 bp, Homo sapiens
cctgagatgggccggcccc

SEQ ID NO: 3667810 - DNA, 15 bp, Homo sapiens
cctgagcgaaaacag

SEQ ID NO: 3667811 - DNA, 19 bp, Homo sapiens
cctgaggggcatctgcccc

SEQ ID NO: 3667812 - DNA, 20 bp, Homo sapiens
cctgaggggcatctgcccct

SEQ ID NO: 3667813 - DNA, 22 bp, Homo sapiens
cctgaggggcatctgcccctcc

SEQ ID NO: 3667814 - DNA, 19 bp, Homo sapiens
cctgaggtcatcggcgtgg

SEQ ID NO: 3667815 - DNA, 14 bp, Homo sapiens
cctgaggtcccctc

SEQ ID NO: 3667816 - DNA, 13 bp, Homo sapiens
cctgagtcctgag

SEQ ID NO: 3667817 - DNA, 18 bp, Homo sapiens
cctgataaagcacagctg

SEQ ID NO: 3667818 - DNA, 19 bp, Homo sapiens
cctgatcctggaggcccag

SEQ ID NO: 3667819 - DNA, 17 bp, Homo sapiens
cctgatgagatttttaa

SEQ ID NO: 3667820 - DNA, 16 bp, Homo sapiens
cctgatgctccctccc

SEQ ID NO: 3667821 - DNA, 19 bp, Homo sapiens
cctgatgctccctcccctg

SEQ ID NO: 3667822 - DNA, 19 bp, Homo sapiens
cctgatgcttttgtctaat

SEQ ID NO: 3667823 - DNA, 13 bp, Homo sapiens
cctgcaaccactc

SEQ ID NO: 3667824 - DNA, 17 bp, Homo sapiens
cctgcaaccactctgtg

SEQ ID NO: 3667825 - DNA, 23 bp, Homo sapiens
cctgcaaccactctgtggccagc

SEQ ID NO: 3667826 - DNA, 20 bp, Homo sapiens
cctgcaactcaaggactttg

SEQ ID NO: 3667827 - DNA, 16 bp, Homo sapiens
cctgcaggcggggctc

SEQ ID NO: 3667828 - DNA, 18 bp, Homo sapiens
cctgcaggcggggctcct

SEQ ID NO: 3667829 - DNA, 21 bp, Homo sapiens
cctgcaggcggggctcctcct

SEQ ID NO: 3667830 - DNA, 12 bp, Homo sapiens
cctgcagggcca

SEQ ID NO: 3667831 - DNA, 20 bp, Homo sapiens
cctgcataggctccttcctg

SEQ ID NO: 3667832 - DNA, 21 bp, Homo sapiens
cctgcataggctccttcctgt

SEQ ID NO: 3667833 - DNA, 19 bp, Homo sapiens
cctgcatctgaccagcagc

SEQ ID NO: 3667834 - DNA, 20 bp, Homo sapiens
cctgccaagtctcagaagag

SEQ ID NO: 3667835 - DNA, 15 bp, Homo sapiens
cctgccaccaggcca

SEQ ID NO: 3667836 - DNA, 18 bp, Homo sapiens
cctgccaccaggccacct

SEQ ID NO: 3667837 - DNA, 19 bp, Homo sapiens
cctgccaccaggccacctc

SEQ ID NO: 3667838 - DNA, 18 bp, Homo sapiens
cctgccactcactaggcc

SEQ ID NO: 3667839 - DNA, 17 bp, Homo sapiens
cctgccagctgcactga

SEQ ID NO: 3667840 - DNA, 15 bp, Homo sapiens
cctgccaggcatggt

SEQ ID NO: 3667841 - DNA, 18 bp, Homo sapiens
cctgccattcttctggtg

SEQ ID NO: 3667842 - DNA, 23 bp, Homo sapiens
cctgccattcttctggtgctact

SEQ ID NO: 3667843 - DNA, 13 bp, Homo sapiens
cctgcccacctgt

SEQ ID NO: 3667844 - DNA, 14 bp, Homo sapiens
cctgcccacctgtc

SEQ ID NO: 3667845 - DNA, 14 bp, Homo sapiens
cctgcccctcccag

SEQ ID NO: 3667846 - DNA, 15 bp, Homo sapiens
cctgcccgggctccc

SEQ ID NO: 3667847 - DNA, 18 bp, Homo sapiens
cctgcccgggctcccaca

SEQ ID NO: 3667848 - DNA, 19 bp, Homo sapiens
cctgcccttgtcccactca

SEQ ID NO: 3667849 - DNA, 14 bp, Homo sapiens
cctgcctccaggaa

SEQ ID NO: 3667850 - DNA, 23 bp, Homo sapiens
cctgcctggccaggcagatctgt

SEQ ID NO: 3667851 - DNA, 21 bp, Homo sapiens
cctgcgaccctgggggcacag

SEQ ID NO: 3667852 - DNA, 16 bp, Homo sapiens
cctgcgtcgagctggg

SEQ ID NO: 3667853 - DNA, 11 bp, Homo sapiens
cctgctccaga

SEQ ID NO: 3667854 - DNA, 14 bp, Homo sapiens
cctgctccagctgt

SEQ ID NO: 3667855 - DNA, 10 bp, Homo sapiens
cctgctgcat

SEQ ID NO: 3667856 - DNA, 21 bp, Homo sapiens
cctgctgtgcctcgcatccta

SEQ ID NO: 3667857 - DNA, 22 bp, Homo sapiens
cctgcttgatgggattctggac

SEQ ID NO: 3667858 - DNA, 15 bp, Homo sapiens
cctgctttggcgggc

SEQ ID NO: 3667859 - DNA, 13 bp, Homo sapiens
cctggaacctgga

SEQ ID NO: 3667860 - DNA, 17 bp, Homo sapiens
cctggaacttggggagt

SEQ ID NO: 3667861 - DNA, 22 bp, Homo sapiens
cctggacagaggcggggctaca

SEQ ID NO: 3667862 - DNA, 13 bp, Homo sapiens
cctggaccccagc

SEQ ID NO: 3667863 - DNA, 15 bp, Homo sapiens
cctggaccccagcct

SEQ ID NO: 3667864 - DNA, 17 bp, Homo sapiens
cctggaccccagccttg

SEQ ID NO: 3667865 - DNA, 14 bp, Homo sapiens
cctggaccctgtgg

SEQ ID NO: 3667866 - DNA, 20 bp, Homo sapiens
cctggacggggcgggccctg

SEQ ID NO: 3667867 - DNA, 15 bp, Homo sapiens
cctggactttcctgc

SEQ ID NO: 3667868 - DNA, 16 bp, Homo sapiens
cctggactttcctgca

SEQ ID NO: 3667869 - DNA, 17 bp, Homo sapiens
cctggactttcctgcaa

SEQ ID NO: 3667870 - DNA, 15 bp, Homo sapiens
cctggagatcctcct

SEQ ID NO: 3667871 - DNA, 23 bp, Homo sapiens
cctggagccaatggcccggcccc

SEQ ID NO: 3667872 - DNA, 19 bp, Homo sapiens
cctggagctagtgtctcct

SEQ ID NO: 3667873 - DNA, 16 bp, Homo sapiens
cctggaggcccagttc

SEQ ID NO: 3667874 - DNA, 14 bp, Homo sapiens
cctggaggtggctg

SEQ ID NO: 3667875 - DNA, 22 bp, Homo sapiens
cctggatggggcagagcttctc

SEQ ID NO: 3667876 - DNA, 23 bp, Homo sapiens
cctggatggggcagagcttctcc

SEQ ID NO: 3667877 - DNA, 17 bp, Homo sapiens
cctggatgttgtgtgta

SEQ ID NO: 3667878 - DNA, 15 bp, Homo sapiens
cctggcagctctgga

SEQ ID NO: 3667879 - DNA, 19 bp, Homo sapiens
cctggcagctctggacagc

SEQ ID NO: 3667880 - DNA, 15 bp, Homo sapiens
cctggccagacacag

SEQ ID NO: 3667881 - DNA, 23 bp, Homo sapiens
cctggccagacacaggccctccc

SEQ ID NO: 3667882 - DNA, 19 bp, Homo sapiens
cctggccaggagctcttca

SEQ ID NO: 3667883 - DNA, 14 bp, Homo sapiens
cctggcccactgca

SEQ ID NO: 3667884 - DNA, 15 bp, Homo sapiens
cctggcccctcatgg

SEQ ID NO: 3667885 - DNA, 20 bp, Homo sapiens
cctggccctccactcctcat

SEQ ID NO: 3667886 - DNA, 19 bp, Homo sapiens
cctggcctcccctgccacc

SEQ ID NO: 3667887 - DNA, 14 bp, Homo sapiens
cctggctcccatga

SEQ ID NO: 3667888 - DNA, 21 bp, Homo sapiens
cctggctcccatgaccatact

SEQ ID NO: 3667889 - DNA, 11 bp, Homo sapiens
cctggctctga

SEQ ID NO: 3667890 - DNA, 15 bp, Homo sapiens
cctggctgccggcac

SEQ ID NO: 3667891 - DNA, 22 bp, Homo sapiens
cctggctttggaatgctccagg

SEQ ID NO: 3667892 - DNA, 22 bp, Homo sapiens
cctgggaggtcaaggctgcagt

SEQ ID NO: 3667893 - DNA, 24 bp, Homo sapiens
cctgggatccgagggcccctctcc

SEQ ID NO: 3667894 - DNA, 19 bp, Homo sapiens
cctgggcagcatactgaga

SEQ ID NO: 3667895 - DNA, 17 bp, Homo sapiens
cctgggcagccaggctg

SEQ ID NO: 3667896 - DNA, 19 bp, Homo sapiens
cctgggccctgggctggaa

SEQ ID NO: 3667897 - DNA, 12 bp, Homo sapiens
cctgggcctgca

SEQ ID NO: 3667898 - DNA, 22 bp, Homo sapiens
cctgggctgagagaacctcacg

SEQ ID NO: 3667899 - DNA, 16 bp, Homo sapiens
cctggggaaagcctga

SEQ ID NO: 3667900 - DNA, 18 bp, Homo sapiens
cctgggggcacaggaggc

SEQ ID NO: 3667901 - DNA, 19 bp, Homo sapiens
cctgggggcgggactcctc

SEQ ID NO: 3667902 - DNA, 22 bp, Homo sapiens
cctggggtttgaccacccacct

SEQ ID NO: 3667903 - DNA, 17 bp, Homo sapiens
cctgggtggagcaggac

SEQ ID NO: 3667904 - DNA, 21 bp, Homo sapiens
cctgggtggtctgcaggcagg

SEQ ID NO: 3667905 - DNA, 21 bp, Homo sapiens
cctggtccagggaagctggcc

SEQ ID NO: 3667906 - DNA, 15 bp, Homo sapiens
cctggtccctcaccc

SEQ ID NO: 3667907 - DNA, 23 bp, Homo sapiens
cctggtccctcacccccatggcc

SEQ ID NO: 3667908 - DNA, 18 bp, Homo sapiens
cctggttattgatgtggc

SEQ ID NO: 3667909 - DNA, 14 bp, Homo sapiens
cctggttcatattt

SEQ ID NO: 3667910 - DNA, 21 bp, Homo sapiens
cctggttgtctgaacccaggc

SEQ ID NO: 3667911 - DNA, 24 bp, Homo sapiens
cctggttgtctgaacccaggcagc

SEQ ID NO: 3667912 - DNA, 14 bp, Homo sapiens
cctgtaaggttcca

SEQ ID NO: 3667913 - DNA, 21 bp, Homo sapiens
cctgtaaggttccatccaccc

SEQ ID NO: 3667914 - DNA, 17 bp, Homo sapiens
cctgtagcacttactgg

SEQ ID NO: 3667915 - DNA, 19 bp, Homo sapiens
cctgtagctttcctggtcc

SEQ ID NO: 3667916 - DNA, 19 bp, Homo sapiens
cctgtatatttgtaaagct

SEQ ID NO: 3667917 - DNA, 20 bp, Homo sapiens
cctgtcaaacaaagccagaa

SEQ ID NO: 3667918 - DNA, 19 bp, Homo sapiens
cctgtcctgacctgtctca

SEQ ID NO: 3667919 - DNA, 14 bp, Homo sapiens
cctgtctagagagg

SEQ ID NO: 3667920 - DNA, 17 bp, Homo sapiens
cctgtctcatccccagg

SEQ ID NO: 3667921 - DNA, 17 bp, Homo sapiens
cctgtgccaccccttcc

SEQ ID NO: 3667922 - DNA, 12 bp, Homo sapiens
ccctgccagctc

SEQ ID NO: 3667923 - DNA, 17 bp, Homo sapiens
ccctgccctcgggtctc

SEQ ID NO: 3667924 - DNA, 12 bp, Homo sapiens
ccctgccctggt

SEQ ID NO: 3667925 - DNA, 14 bp, Homo sapiens
ccctgccctggtcc

SEQ ID NO: 3667926 - DNA, 21 bp, Homo sapiens
ccctgcgtcgagctgggaagg

SEQ ID NO: 3667927 - DNA, 15 bp, Homo sapiens
ccctgctgctggtgc

SEQ ID NO: 3667928 - DNA, 16 bp, Homo sapiens
ccctgctgctggtgca

SEQ ID NO: 3667929 - DNA, 23 bp, Homo sapiens
ccctgctgcttaagtgcatgcat

SEQ ID NO: 3667930 - DNA, 20 bp, Homo sapiens
ccctggacagaggcggggct

SEQ ID NO: 3667931 - DNA, 14 bp, Homo sapiens
ccctggcctcccct

SEQ ID NO: 3667932 - DNA, 19 bp, Homo sapiens
ccctggcctcccctgccac

SEQ ID NO: 3667933 - DNA, 13 bp, Homo sapiens
ccctggctcccat

SEQ ID NO: 3667934 - DNA, 18 bp, Homo sapiens
ccctgggccctgggctgg

SEQ ID NO: 3667935 - DNA, 13 bp, Homo sapiens
ccctgggctggaa

SEQ ID NO: 3667936 - DNA, 14 bp, Homo sapiens
ccctgggctggaat

SEQ ID NO: 3667937 - DNA, 18 bp, Homo sapiens
ccctggggacggggctcc

SEQ ID NO: 3667938 - DNA, 18 bp, Homo sapiens
ccctgggggtggggctcc

SEQ ID NO: 3667939 - DNA, 23 bp, Homo sapiens
ccctgggggtggggctcctacct

SEQ ID NO: 3667940 - DNA, 22 bp, Homo sapiens
ccctggttattgatgtggccct

SEQ ID NO: 3667941 - DNA, 20 bp, Homo sapiens
ccctggttgcctcatggcca

SEQ ID NO: 3667942 - DNA, 21 bp, Homo sapiens
ccctgtagagtgggagctgag

SEQ ID NO: 3667943 - DNA, 12 bp, Homo sapiens
ccctgtctagag

SEQ ID NO: 3667944 - DNA, 17 bp, Homo sapiens
ccctgtctagagaggga

SEQ ID NO: 3667945 - DNA, 23 bp, Homo sapiens
ccctgtgttgtctctagagcagg

SEQ ID NO: 3667946 - DNA, 17 bp, Homo sapiens
ccctgttccccagagaa

SEQ ID NO: 3667947 - DNA, 18 bp, Homo sapiens
cccttcacaaagcccaag

SEQ ID NO: 3667948 - DNA, 12 bp, Homo sapiens
cccttcccctcc

SEQ ID NO: 3667949 - DNA, 15 bp, Homo sapiens
cccttcccctccctg

SEQ ID NO: 3667950 - DNA, 17 bp, Homo sapiens
cccttcccttgagccct

SEQ ID NO: 3667951 - DNA, 16 bp, Homo sapiens
cccttcctcagcctgg

SEQ ID NO: 3667952 - DNA, 16 bp, Homo sapiens
cccttcctctgtgcca

SEQ ID NO: 3667953 - DNA, 15 bp, Homo sapiens
cccttcctggcccct

SEQ ID NO: 3667954 - DNA, 11 bp, Homo sapiens
cccttccttta

SEQ ID NO: 3667955 - DNA, 19 bp, Homo sapiens
cccttgacaactggcaggc

SEQ ID NO: 3667956 - DNA, 21 bp, Homo sapiens
cccttgatttaaacacacaga

SEQ ID NO: 3667957 - DNA, 22 bp, Homo sapiens
cccttgcttgcctgcagggcca

SEQ ID NO: 3667958 - DNA, 23 bp, Homo sapiens
cccttgcttgcctgcagggccat

SEQ ID NO: 3667959 - DNA, 13 bp, Homo sapiens
cccttggaggcca

SEQ ID NO: 3667960 - DNA, 13 bp, Homo sapiens
cccttggcctcag

SEQ ID NO: 3667961 - DNA, 16 bp, Homo sapiens
cccttggcctgtctca

SEQ ID NO: 3667962 - DNA, 13 bp, Homo sapiens
ccctttccttcca

SEQ ID NO: 3667963 - DNA, 15 bp, Homo sapiens
ccctttccttccatc

SEQ ID NO: 3667964 - DNA, 18 bp, Homo sapiens
ccgaagtcctctgtggcc

SEQ ID NO: 3667965 - DNA, 16 bp, Homo sapiens
ccgactgtgctgctcg

SEQ ID NO: 3667966 - DNA, 19 bp, Homo sapiens
ccgagaagcaagaaagaaa

SEQ ID NO: 3667967 - DNA, 22 bp, Homo sapiens
ccgaggcctaccccgcagacac

SEQ ID NO: 3667968 - DNA, 14 bp, Homo sapiens
ccgaggggcctttg

SEQ ID NO: 3667969 - DNA, 21 bp, Homo sapiens
ccgagggtcctggctcctgag

SEQ ID NO: 3667970 - DNA, 19 bp, Homo sapiens
ccgatgttattagatgtta

SEQ ID NO: 3667971 - DNA, 12 bp, Homo sapiens
ccgcaccctgcc

SEQ ID NO: 3667972 - DNA, 12 bp, Homo sapiens
ccgcaggaagct

SEQ ID NO: 3667973 - DNA, 23 bp, Homo sapiens
ccgcagtgtgcactaaggggccc

SEQ ID NO: 3667974 - DNA, 17 bp, Homo sapiens
ccgcatgcggcccagga

SEQ ID NO: 3667975 - DNA, 17 bp, Homo sapiens
ccgccaaggctggggga

SEQ ID NO: 3667976 - DNA, 16 bp, Homo sapiens
ccgccatgctcctggc

SEQ ID NO: 3667977 - DNA, 16 bp, Homo sapiens
ccgccattgccaccag

SEQ ID NO: 3667978 - DNA, 11 bp, Homo sapiens
ccgctgccacc

SEQ ID NO: 3667979 - DNA, 17 bp, Homo sapiens
ccgctgccacccacctc

SEQ ID NO: 3667980 - DNA, 24 bp, Homo sapiens
ccgctgccacccacctccctgcct

SEQ ID NO: 3667981 - DNA, 20 bp, Homo sapiens
ccgctgccacgttggagaag

SEQ ID NO: 3667982 - DNA, 17 bp, Homo sapiens
ccgctttcctggagcca

SEQ ID NO: 3667983 - DNA, 19 bp, Homo sapiens
ccggagattggacggcctg

SEQ ID NO: 3667984 - DNA, 23 bp, Homo sapiens
ccggagctggaggatcccctcca

SEQ ID NO: 3667985 - DNA, 15 bp, Homo sapiens
ccggatcctgggtgg

SEQ ID NO: 3667986 - DNA, 19 bp, Homo sapiens
ccggcacagggtctgctct

SEQ ID NO: 3667987 - DNA, 21 bp, Homo sapiens
ccggcatgagactcagtgcag

SEQ ID NO: 3667988 - DNA, 23 bp, Homo sapiens
ccggcatgagactcagtgcagat

SEQ ID NO: 3667989 - DNA, 18 bp, Homo sapiens
ccggcatgtttccagcag

SEQ ID NO: 3667990 - DNA, 15 bp, Homo sapiens
ccggcccccttcctg

SEQ ID NO: 3667991 - DNA, 23 bp, Homo sapiens
ccggcccccttcctggcccctca

SEQ ID NO: 3667992 - DNA, 13 bp, Homo sapiens
ccggccctggggc

SEQ ID NO: 3667993 - DNA, 13 bp, Homo sapiens
ccggccctgtgtg

SEQ ID NO: 3667994 - DNA, 15 bp, Homo sapiens
ccggctccagagcag

SEQ ID NO: 3667995 - DNA, 14 bp, Homo sapiens
ccggctctggtggc

SEQ ID NO: 3667996 - DNA, 17 bp, Homo sapiens
ccggctctggtggccac

SEQ ID NO: 3667997 - DNA, 20 bp, Homo sapiens
ccgggcgcggtggctcacgc

SEQ ID NO: 3667998 - DNA, 12 bp, Homo sapiens
ccgggctcccac

SEQ ID NO: 3667999 - DNA, 14 bp, Homo sapiens
ccgggctctctgct

SEQ ID NO: 3668000 - DNA, 16 bp, Homo sapiens
ccgggctctctgctgt

SEQ ID NO: 3668001 - DNA, 24 bp, Homo sapiens
ccgggtcacacaaaggcatgctgg

SEQ ID NO: 3668002 - DNA, 22 bp, Homo sapiens
ccgtccagccgccattgccacc

SEQ ID NO: 3668003 - DNA, 15 bp, Homo sapiens
ccgtcctgcctgtgg

SEQ ID NO: 3668004 - DNA, 16 bp, Homo sapiens
ccgtcctgcctgtggc

SEQ ID NO: 3668005 - DNA, 19 bp, Homo sapiens
ccgtctaggattgggcctc

SEQ ID NO: 3668006 - DNA, 16 bp, Homo sapiens
ccgtctgaccccagcc

SEQ ID NO: 3668007 - DNA, 18 bp, Homo sapiens
ccgtctgaccccagccca

SEQ ID NO: 3668008 - DNA, 20 bp, Homo sapiens
ccgtctgaccccagcccaga

SEQ ID NO: 3668009 - DNA, 21 bp, Homo sapiens
ccgtgctgacagctgctccta

SEQ ID NO: 3668010 - DNA, 22 bp, Homo sapiens
ccgtgcttgtttgctcacctgg

SEQ ID NO: 3668011 - DNA, 14 bp, Homo sapiens
ccgtggggcaggga

SEQ ID NO: 3668012 - DNA, 17 bp, Homo sapiens
ccgtggggccgccgcct

SEQ ID NO: 3668013 - DNA, 20 bp, Homo sapiens
ccgtggggccgccgcctctt

SEQ ID NO: 3668014 - DNA, 15 bp, Homo sapiens
ccgtggtcagagtgc

SEQ ID NO: 3668015 - DNA, 17 bp, Homo sapiens
ccgtggtcagagtgcca

SEQ ID NO: 3668016 - DNA, 22 bp, Homo sapiens
cctaagactaacaaaggcagct

SEQ ID NO: 3668017 - DNA, 23 bp, Homo sapiens
cctaagactaacaaaggcagctg

SEQ ID NO: 3668018 - DNA, 12 bp, Homo sapiens
cctaaggctgca

SEQ ID NO: 3668019 - DNA, 19 bp, Homo sapiens
cctaagggctcaccgtggc

SEQ ID NO: 3668020 - DNA, 17 bp, Homo sapiens
cctaatatcaaatgcag

SEQ ID NO: 3668021 - DNA, 13 bp, Homo sapiens
cctaatccaggca

SEQ ID NO: 3668022 - DNA, 13 bp, Homo sapiens
cctaccacctccc

SEQ ID NO: 3668023 - DNA, 19 bp, Homo sapiens
cctacccatccccgcagtg

SEQ ID NO: 3668024 - DNA, 21 bp, Homo sapiens
cctaccccgcagacaccttgg

SEQ ID NO: 3668025 - DNA, 14 bp, Homo sapiens
cctacccctgactt

SEQ ID NO: 3668026 - DNA, 14 bp, Homo sapiens
cctaccctcctgct

SEQ ID NO: 3668027 - DNA, 22 bp, Homo sapiens
cctaccctcctgctgagctgcc

SEQ ID NO: 3668028 - DNA, 20 bp, Homo sapiens
cctacctgaaggcagggctc

SEQ ID NO: 3668029 - DNA, 23 bp, Homo sapiens
cctacctgaaggcagggctcctc

SEQ ID NO: 3668030 - DNA, 21 bp, Homo sapiens
cctacctgattggtgcaaccc

SEQ ID NO: 3668031 - DNA, 12 bp, Homo sapiens
cctacctgggga

SEQ ID NO: 3668032 - DNA, 20 bp, Homo sapiens
cctacctggggaaagcctga

SEQ ID NO: 3668033 - DNA, 14 bp, Homo sapiens
cctacgccaggaga

SEQ ID NO: 3668034 - DNA, 20 bp, Homo sapiens
cctactgcccaggcactgca

SEQ ID NO: 3668035 - DNA, 15 bp, Homo sapiens
cctacttagggaaga

SEQ ID NO: 3668036 - DNA, 16 bp, Homo sapiens
cctacttagggaagaa

SEQ ID NO: 3668037 - DNA, 21 bp, Homo sapiens
cctacttcattttcagagtga

SEQ ID NO: 3668038 - DNA, 18 bp, Homo sapiens
ctagtcacaaagactcct

SEQ ID NO: 3668039 - DNA, 20 bp, Homo sapiens
ctagtcccttcccctccctg

SEQ ID NO: 3668040 - DNA, 16 bp, Homo sapiens
ctagtcttgaatttct

SEQ ID NO: 3668041 - DNA, 13 bp, Homo sapiens
ctagtgtctcctc

SEQ ID NO: 3668042 - DNA, 20 bp, Homo sapiens
ctagttttagttttctctta

SEQ ID NO: 3668043 - DNA, 13 bp, Homo sapiens
ctataaaacaggt

SEQ ID NO: 3668044 - DNA, 13 bp, Homo sapiens
ctataaagagaag

SEQ ID NO: 3668045 - DNA, 22 bp, Homo sapiens
ctataaattcctctttgctttg

SEQ ID NO: 3668046 - DNA, 12 bp, Homo sapiens
ctatactgcttg

SEQ ID NO: 3668047 - DNA, 13 bp, Homo sapiens
ctatagcctgggg

SEQ ID NO: 3668048 - DNA, 21 bp, Homo sapiens
ctatagcctggggtggggtca

SEQ ID NO: 3668049 - DNA, 12 bp, Homo sapiens
ctatagtatttg

SEQ ID NO: 3668050 - DNA, 23 bp, Homo sapiens
ctatagtatttgattcaaaatat

SEQ ID NO: 3668051 - DNA, 13 bp, Homo sapiens
ctatatatataat

SEQ ID NO: 3668052 - DNA, 13 bp, Homo sapiens
ctatatatttcta

SEQ ID NO: 3668053 - DNA, 14 bp, Homo sapiens
ctatatatttctat

SEQ ID NO: 3668054 - DNA, 13 bp, Homo sapiens
ctatattgggact

SEQ ID NO: 3668055 - DNA, 13 bp, Homo sapiens
ctatattgtacac

SEQ ID NO: 3668056 - DNA, 12 bp, Homo sapiens
ctatatttgggc

SEQ ID NO: 3668057 - DNA, 13 bp, Homo sapiens
ctatcacttacat

SEQ ID NO: 3668058 - DNA, 15 bp, Homo sapiens
ctatgagttggactt

SEQ ID NO: 3668059 - DNA, 13 bp, Homo sapiens
ctatgcaaaaaat

SEQ ID NO: 3668060 - DNA, 13 bp, Homo sapiens
ctatgcatggtgc

SEQ ID NO: 3668061 - DNA, 20 bp, Homo sapiens
ctatgcatggtgccccagga

SEQ ID NO: 3668062 - DNA, 21 bp, Homo sapiens
ctatgcatggtgccccaggac

SEQ ID NO: 3668063 - DNA, 22 bp, Homo sapiens
ctatgcatggtgccccaggacc

SEQ ID NO: 3668064 - DNA, 15 bp, Homo sapiens
ctatgctttgaaaca

SEQ ID NO: 3668065 - DNA, 19 bp, Homo sapiens
ctatgctttgaaacagaaa

SEQ ID NO: 3668066 - DNA, 17 bp, Homo sapiens
ctatgggagccccaggg

SEQ ID NO: 3668067 - DNA, 19 bp, Homo sapiens
ctatgggagccccagggtc

SEQ ID NO: 3668068 - DNA, 21 bp, Homo sapiens
ctatggtcgggagacagcatc

SEQ ID NO: 3668069 - DNA, 16 bp, Homo sapiens
ctatggtgctctgtct

SEQ ID NO: 3668070 - DNA, 20 bp, Homo sapiens
ctatgtagtccgtgctgaca

SEQ ID NO: 3668071 - DNA, 18 bp, Homo sapiens
ctatgtatgttaatttat

SEQ ID NO: 3668072 - DNA, 20 bp, Homo sapiens
ctatgtatgttaatttattt

SEQ ID NO: 3668073 - DNA, 13 bp, Homo sapiens
ctattactcccag

SEQ ID NO: 3668074 - DNA, 15 bp, Homo sapiens
ctattactcccagga

SEQ ID NO: 3668075 - DNA, 15 bp, Homo sapiens
ctattccaaaaaggt

SEQ ID NO: 3668076 - DNA, 18 bp, Homo sapiens
ctatttcttaaacacttg

SEQ ID NO: 3668077 - DNA, 14 bp, Homo sapiens
ctatttgaacaagt

SEQ ID NO: 3668078 - DNA, 22 bp, Homo sapiens
ctattttcagatgtgaaccatt

SEQ ID NO: 3668079 - DNA, 13 bp, Homo sapiens
ctatttttgtaaa

SEQ ID NO: 3668080 - DNA, 13 bp, Homo sapiens
ctatttttgttgt

SEQ ID NO: 3668081 - DNA, 18 bp, Homo sapiens
ctcaaaaaaagaaaaaga

SEQ ID NO: 3668082 - DNA, 16 bp, Homo sapiens
ctcaaaatatcctaag

SEQ ID NO: 3668083 - DNA, 15 bp, Homo sapiens
ctcaaatggggccag

SEQ ID NO: 3668084 - DNA, 17 bp, Homo sapiens
ctcaaatggggccagat

SEQ ID NO: 3668085 - DNA, 15 bp, Homo sapiens
ctcaagaaattccca

SEQ ID NO: 3668086 - DNA, 18 bp, Homo sapiens
ctcaagccaagcagccaa

SEQ ID NO: 3668087 - DNA, 22 bp, Homo sapiens
ctcaagccctgcagtcacagct

SEQ ID NO: 3668088 - DNA, 16 bp, Homo sapiens
ctcaaggactttgcag

SEQ ID NO: 3668089 - DNA, 17 bp, Homo sapiens
ctcaaggcggtgcttga

SEQ ID NO: 3668090 - DNA, 23 bp, Homo sapiens
ctcaaggcggtgcttgatagaaa

SEQ ID NO: 3668091 - DNA, 20 bp, Homo sapiens
ctcaagtgttcacaacctgg

SEQ ID NO: 3668092 - DNA, 11 bp, Homo sapiens
ctcaatatttt

SEQ ID NO: 3668093 - DNA, 22 bp, Homo sapiens
ctcaatattttccatgaaaatg

SEQ ID NO: 3668094 - DNA, 16 bp, Homo sapiens
ctcaatgaagccagct

SEQ ID NO: 3668095 - DNA, 18 bp, Homo sapiens
ctcacagtgggagccagg

SEQ ID NO: 3668096 - DNA, 19 bp, Homo sapiens
ctcacagtgggagccaggg

SEQ ID NO: 3668097 - DNA, 22 bp, Homo sapiens
ctcacccatgcaagcagaggac

SEQ ID NO: 3668098 - DNA, 14 bp, Homo sapiens
ctcaccctgcctta

SEQ ID NO: 3668099 - DNA, 15 bp, Homo sapiens
ctcaccctgccttat

SEQ ID NO: 3668100 - DNA, 21 bp, Homo sapiens
ctcaccctgccttatcttgca

SEQ ID NO: 3668101 - DNA, 13 bp, Homo sapiens
ctcacctcctgct

SEQ ID NO: 3668102 - DNA, 16 bp, Homo sapiens
ctcacgcacctcccat

SEQ ID NO: 3668103 - DNA, 16 bp, Homo sapiens
ctcacgtccaggttca

SEQ ID NO: 3668104 - DNA, 17 bp, Homo sapiens
ctcactaatttttgtat

SEQ ID NO: 3668105 - DNA, 23 bp, Homo sapiens
ctcactaatttttgtattatttt

SEQ ID NO: 3668106 - DNA, 15 bp, Homo sapiens
ctcactcccagtcca

SEQ ID NO: 3668107 - DNA, 11 bp, Homo sapiens
ctcactgtgac

SEQ ID NO: 3668108 - DNA, 21 bp, Homo sapiens
ctcactgtttgtttttattta

SEQ ID NO: 3668109 - DNA, 14 bp, Homo sapiens
ctcagaaccttgtc

SEQ ID NO: 3668110 - DNA, 13 bp, Homo sapiens
ctcagacattggc

SEQ ID NO: 3668111 - DNA, 17 bp, Homo sapiens
ctcagaggccttgctgt

SEQ ID NO: 3668112 - DNA, 23 bp, Homo sapiens
ctcagataaggtaaaatgccatg

SEQ ID NO: 3668113 - DNA, 14 bp, Homo sapiens
ctcagatccaggga

SEQ ID NO: 3668114 - DNA, 20 bp, Homo sapiens
ctcagatccagggacagagg

SEQ ID NO: 3668115 - DNA, 16 bp, Homo sapiens
ctcagatggaaccgca

SEQ ID NO: 3668116 - DNA, 21 bp, Homo sapiens
ctcagcaaaagatgcttctca

SEQ ID NO: 3668117 - DNA, 22 bp, Homo sapiens
ctcagcatttgattaacatttg

SEQ ID NO: 3668118 - DNA, 15 bp, Homo sapiens
ctcagccctgaggtg

SEQ ID NO: 3668119 - DNA, 15 bp, Homo sapiens
ctcagccttgccaga

SEQ ID NO: 3668120 - DNA, 19 bp, Homo sapiens
ctcagccttgccagagatc

SEQ ID NO: 3668121 - DNA, 16 bp, Homo sapiens
ctcagctgcctcactt

SEQ ID NO: 3668122 - DNA, 12 bp, Homo sapiens
ctcaggacagat

SEQ ID NO: 3668123 - DNA, 16 bp, Homo sapiens
ctcaggacagatgcca

SEQ ID NO: 3668124 - DNA, 18 bp, Homo sapiens
ctcaggacagatgccaca

SEQ ID NO: 3668125 - DNA, 13 bp, Homo sapiens
ctcagggccatgc

SEQ ID NO: 3668126 - DNA, 15 bp, Homo sapiens
ctcagggccatgctg

SEQ ID NO: 3668127 - DNA, 18 bp, Homo sapiens
ctcagggccatgctgagg

SEQ ID NO: 3668128 - DNA, 15 bp, Homo sapiens
ctcagggcctggtcg

SEQ ID NO: 3668129 - DNA, 15 bp, Homo sapiens
ctcaggtacttgtaa

SEQ ID NO: 3668130 - DNA, 14 bp, Homo sapiens
ctcaggtctgaatc

SEQ ID NO: 3668131 - DNA, 19 bp, Homo sapiens
ctcaggtgagaagcagagg

SEQ ID NO: 3668132 - DNA, 20 bp, Homo sapiens
ctcaggtgagaagcagagga

SEQ ID NO: 3668133 - DNA, 12 bp, Homo sapiens
ctcagtactttg

SEQ ID NO: 3668134 - DNA, 17 bp, Homo sapiens
ctcagtactttggaggc

SEQ ID NO: 3668135 - DNA, 19 bp, Homo sapiens
ctcagtactttggaggccc

SEQ ID NO: 3668136 - DNA, 17 bp, Homo sapiens
ctcagtggacagtgctg

SEQ ID NO: 3668137 - DNA, 24 bp, Homo sapiens
ctcagtggacagtgctgttgaaga

SEQ ID NO: 3668138 - DNA, 15 bp, Homo sapiens
ctccacccttggcct

SEQ ID NO: 3668139 - DNA, 17 bp, Homo sapiens
ctccacccttggcctgt

SEQ ID NO: 3668140 - DNA, 18 bp, Homo sapiens
ctccactcctcatcccca

SEQ ID NO: 3668141 - DNA, 21 bp, Homo sapiens
ctccactctgcttctctgact

SEQ ID NO: 3668142 - DNA, 17 bp, Homo sapiens
ctccagaagcctctggc

SEQ ID NO: 3668143 - DNA, 18 bp, Homo sapiens
ctccagaagcctctggct

SEQ ID NO: 3668144 - DNA, 23 bp, Homo sapiens
ctccagagagaaatcaggcctga

SEQ ID NO: 3668145 - DNA, 14 bp, Homo sapiens
ctccagagcaggaa

SEQ ID NO: 3668146 - DNA, 17 bp, Homo sapiens
ctccagcctggtggccc

SEQ ID NO: 3668147 - DNA, 21 bp, Homo sapiens
ctccagcctggtggcccagct

SEQ ID NO: 3668148 - DNA, 20 bp, Homo sapiens
ctccagctgctctgtcttct

SEQ ID NO: 3668149 - DNA, 13 bp, Homo sapiens
ctccagctgttca

SEQ ID NO: 3668150 - DNA, 18 bp, Homo sapiens
ctccagctgttcagctgg

SEQ ID NO: 3668151 - DNA, 15 bp, Homo sapiens
ctccaggatctttga

SEQ ID NO: 3668152 - DNA, 17 bp, Homo sapiens
ctccaggatggggaggg

SEQ ID NO: 3668153 - DNA, 22 bp, Homo sapiens
ctccaggatggggaggggctct

SEQ ID NO: 3668154 - DNA, 20 bp, Homo sapiens
ctccaggccctcctctccca

SEQ ID NO: 3668155 - DNA, 15 bp, Homo sapiens
ctccaggctttccca

SEQ ID NO: 3668156 - DNA, 15 bp, Homo sapiens
ctccaggggctgctt

SEQ ID NO: 3668157 - DNA, 18 bp, Homo sapiens
ctccaggggctgcttcct

SEQ ID NO: 3668158 - DNA, 17 bp, Homo sapiens
ctccagtgctggatttg

SEQ ID NO: 3668159 - DNA, 21 bp, Homo sapiens
ctccatacccacaatctgagc

SEQ ID NO: 3668160 - DNA, 12 bp, Homo sapiens
ctccatccaagg

SEQ ID NO: 3668161 - DNA, 22 bp, Homo sapiens
ctccatgcaggggtcagtgcag

SEQ ID NO: 3668162 - DNA, 19 bp, Homo sapiens
ctccatttctactgtgtga

SEQ ID NO: 3668163 - DNA, 15 bp, Homo sapiens
ctcccaaagtgctgg

SEQ ID NO: 3668164 - DNA, 14 bp, Homo sapiens
ctcccaagctgtgc

SEQ ID NO: 3668165 - DNA, 15 bp, Homo sapiens
ctcccaagctgtgct

SEQ ID NO: 3668166 - DNA, 21 bp, Homo sapiens
ctcccaatttcagactcccat

SEQ ID NO: 3668167 - DNA, 15 bp, Homo sapiens
ctcccacaaaggaga

SEQ ID NO: 3668168 - DNA, 20 bp, Homo sapiens
ctcccaggctggagtgcagt

SEQ ID NO: 3668169 - DNA, 16 bp, Homo sapiens
ctcccagtaagggcgt

SEQ ID NO: 3668170 - DNA, 18 bp, Homo sapiens
ctcccagtaagggcgtgg

SEQ ID NO: 3668171 - DNA, 20 bp, Homo sapiens
ctcccagtccaaatgtcctc

SEQ ID NO: 3668172 - DNA, 14 bp, Homo sapiens
ctcccattcctgaa

SEQ ID NO: 3668173 - DNA, 16 bp, Homo sapiens
ctcccattcctgaaga

SEQ ID NO: 3668174 - DNA, 17 bp, Homo sapiens
ctcccattgtccctctg

SEQ ID NO: 3668175 - DNA, 12 bp, Homo sapiens
ctccccacctgc

SEQ ID NO: 3668176 - DNA, 13 bp, Homo sapiens
ctccccagcccag

SEQ ID NO: 3668177 - DNA, 18 bp, Homo sapiens
ctccccagcccagagaca

SEQ ID NO: 3668178 - DNA, 16 bp, Homo sapiens
ctccccaggtccagct

SEQ ID NO: 3668179 - DNA, 18 bp, Homo sapiens
ctccccaggtccagctct

SEQ ID NO: 3668180 - DNA, 15 bp, Homo sapiens
ctcccccccatgcac

SEQ ID NO: 3668181 - DNA, 13 bp, Homo sapiens
ctccccctggacg

SEQ ID NO: 3668182 - DNA, 23 bp, Homo sapiens
ctccccggcatgagactcagtgc

SEQ ID NO: 3668183 - DNA, 23 bp, Homo sapiens
ctcccctggacagaggcggggct

SEQ ID NO: 3668184 - DNA, 21 bp, Homo sapiens
ctcccgaagtcctctgtggcc

SEQ ID NO: 3668185 - DNA, 17 bp, Homo sapiens
ctcccgtagttttttct

SEQ ID NO: 3668186 - DNA, 14 bp, Homo sapiens
ctccctaccacctc

SEQ ID NO: 3668187 - DNA, 22 bp, Homo sapiens
ctccctaccacctccccagcct

SEQ ID NO: 3668188 - DNA, 15 bp, Homo sapiens
ctccctcctcacctc

SEQ ID NO: 3668189 - DNA, 19 bp, Homo sapiens
ctccctcctcacctctgga

SEQ ID NO: 3668190 - DNA, 17 bp, Homo sapiens
ctccctctctcttctgc

SEQ ID NO: 3668191 - DNA, 22 bp, Homo sapiens
ctccctctctcttctgctccac

SEQ ID NO: 3668192 - DNA, 21 bp, Homo sapiens
ctccctgaaaatgtttttctg

SEQ ID NO: 3668193 - DNA, 18 bp, Homo sapiens
ctccctgaagcctttgca

SEQ ID NO: 3668194 - DNA, 11 bp, Homo sapiens
ctccctgaggg

SEQ ID NO: 3668195 - DNA, 22 bp, Homo sapiens
ctccctgagggcggagcgcctc

SEQ ID NO: 3668196 - DNA, 21 bp, Homo sapiens
ctccctgccaagtctcagaag

SEQ ID NO: 3668197 - DNA, 15 bp, Homo sapiens
ctccctgcctccagg

SEQ ID NO: 3668198 - DNA, 16 bp, Homo sapiens
ctccctgcctccagga

SEQ ID NO: 3668199 - DNA, 16 bp, Homo sapiens
ctccctggagaagcac

SEQ ID NO: 3668200 - DNA, 15 bp, Homo sapiens
ctccctggctcccat

SEQ ID NO: 3668201 - DNA, 11 bp, Homo sapiens
ctccctgggga

SEQ ID NO: 3668202 - DNA, 20 bp, Homo sapiens
ctccctgggggcgggactcc

SEQ ID NO: 3668203 - DNA, 21 bp, Homo sapiens
ctccctgggggcgggactcct

SEQ ID NO: 3668204 - DNA, 16 bp, Homo sapiens
ctccctgggggtgggg

SEQ ID NO: 3668205 - DNA, 20 bp, Homo sapiens
ctccctgggggtggggctcc

SEQ ID NO: 3668206 - DNA, 22 bp, Homo sapiens
ctccctgggggtggggctccta

SEQ ID NO: 3668207 - DNA, 16 bp, Homo sapiens
ctccctgttccccaga

SEQ ID NO: 3668208 - DNA, 17 bp, Homo sapiens
ctcccttcccataagct

SEQ ID NO: 3668209 - DNA, 14 bp, Homo sapiens
ctcccttctgctac

SEQ ID NO: 3668210 - DNA, 15 bp, Homo sapiens
ctcccttctgctact

SEQ ID NO: 3668211 - DNA, 19 bp, Homo sapiens
ctcccttttaatcctggct

SEQ ID NO: 3668212 - DNA, 14 bp, Homo sapiens
ctccgagaggtggg

SEQ ID NO: 3668213 - DNA, 22 bp, Homo sapiens
ctccgagaggtgggccagtctg

SEQ ID NO: 3668214 - DNA, 13 bp, Homo sapiens
ctccgccaggcga

SEQ ID NO: 3668215 - DNA, 23 bp, Homo sapiens
ctccgccaggcgagatggggtgg

SEQ ID NO: 3668216 - DNA, 18 bp, Homo sapiens
ctccgcctgtccacagcc

SEQ ID NO: 3668217 - DNA, 20 bp, Homo sapiens
ctcctacttagggaagaaaa

SEQ ID NO: 3668218 - DNA, 21 bp, Homo sapiens
ctcctacttagggaagaaaaa

SEQ ID NO: 3668219 - DNA, 23 bp, Homo sapiens
ctcctagagggaggggcctaggc

SEQ ID NO: 3668220 - DNA, 14 bp, Homo sapiens
ctcctatatatttc

SEQ ID NO: 3668221 - DNA, 13 bp, Homo sapiens
ctcctcacctctg

SEQ ID NO: 3668222 - DNA, 16 bp, Homo sapiens
ctcctcacctctggac

SEQ ID NO: 3668223 - DNA, 21 bp, Homo sapiens
ctcctcactcccttcccataa

SEQ ID NO: 3668224 - DNA, 15 bp, Homo sapiens
ctcctccagccgcca

SEQ ID NO: 3668225 - DNA, 15 bp, Homo sapiens
ctcctccctgcatct

SEQ ID NO: 3668226 - DNA, 14 bp, Homo sapiens
ctcctccctggagc

SEQ ID NO: 3668227 - DNA, 12 bp, Homo sapiens
ctcctccctggg

SEQ ID NO: 3668228 - DNA, 14 bp, Homo sapiens
ctcctccctggggg

SEQ ID NO: 3668229 - DNA, 14 bp, Homo sapiens
ctcctcctccctgc

SEQ ID NO: 3668230 - DNA, 15 bp, Homo sapiens
ctcctcgcaagctgg

SEQ ID NO: 3668231 - DNA, 18 bp, Homo sapiens
ctcttctgctccaccctt

SEQ ID NO: 3668232 - DNA, 19 bp, Homo sapiens
ctcttctgctccacccttg

SEQ ID NO: 3668233 - DNA, 21 bp, Homo sapiens
ctcttctgtcccaagtctcca

SEQ ID NO: 3668234 - DNA, 20 bp, Homo sapiens
ctcttcttggggcccagtgc

SEQ ID NO: 3668235 - DNA, 15 bp, Homo sapiens
ctcttgagcctggga

SEQ ID NO: 3668236 - DNA, 16 bp, Homo sapiens
ctcttggctttgttga

SEQ ID NO: 3668237 - DNA, 12 bp, Homo sapiens
ctcttgggtggg

SEQ ID NO: 3668238 - DNA, 15 bp, Homo sapiens
ctcttgggtgggaca

SEQ ID NO: 3668239 - DNA, 12 bp, Homo sapiens
ctctttgctgaa

SEQ ID NO: 3668240 - DNA, 12 bp, Homo sapiens
ctctttgctttg

SEQ ID NO: 3668241 - DNA, 15 bp, Homo sapiens
ctctttgctttgctt

SEQ ID NO: 3668242 - DNA, 22 bp, Homo sapiens
ctctttgctttgctttctgctc

SEQ ID NO: 3668243 - DNA, 18 bp, Homo sapiens
ctctttggacactcacac

SEQ ID NO: 3668244 - DNA, 21 bp, Homo sapiens
ctctttttccaacttggctgc

SEQ ID NO: 3668245 - DNA, 16 bp, Homo sapiens
ctgaaacaacttggaa

SEQ ID NO: 3668246 - DNA, 15 bp, Homo sapiens
ctgaaacctaggaag

SEQ ID NO: 3668247 - DNA, 23 bp, Homo sapiens
ctgaaaccttagtttcaagagtc

SEQ ID NO: 3668248 - DNA, 22 bp, Homo sapiens
ctgaaagaggctgaggcctgga

SEQ ID NO: 3668249 - DNA, 15 bp, Homo sapiens
ctgaaagccctgagc

SEQ ID NO: 3668250 - DNA, 19 bp, Homo sapiens
ctgaaagccctgagctttc

SEQ ID NO: 3668251 - DNA, 12 bp, Homo sapiens
ctgaaatgcgct

SEQ ID NO: 3668252 - DNA, 17 bp, Homo sapiens
ctgaaattctcctggag

SEQ ID NO: 3668253 - DNA, 19 bp, Homo sapiens
ctgaaattctcctggaggt

SEQ ID NO: 3668254 - DNA, 14 bp, Homo sapiens
ctgaacccaggcag

SEQ ID NO: 3668255 - DNA, 17 bp, Homo sapiens
ctgaacccaggcagctg

SEQ ID NO: 3668256 - DNA, 19 bp, Homo sapiens
ctgaacccaggcagctggc

SEQ ID NO: 3668257 - DNA, 20 bp, Homo sapiens
ctgaacccaggcagctggca

SEQ ID NO: 3668258 - DNA, 15 bp, Homo sapiens
ctgctccagacctga

SEQ ID NO: 3668259 - DNA, 22 bp, Homo sapiens
ctgctccagacctgatcctgga

SEQ ID NO: 3668260 - DNA, 15 bp, Homo sapiens
ctgctccagctgttc

SEQ ID NO: 3668261 - DNA, 23 bp, Homo sapiens
ctgctcctgaatgaggcggagct

SEQ ID NO: 3668262 - DNA, 23 bp, Homo sapiens
ctgctcgcgaaggtcccacagcc

SEQ ID NO: 3668263 - DNA, 21 bp, Homo sapiens
ctgctctattccaaaaaggtt

SEQ ID NO: 3668264 - DNA, 15 bp, Homo sapiens
ctgctctttctctgc

SEQ ID NO: 3668265 - DNA, 17 bp, Homo sapiens
ctgctctttctctgcca

SEQ ID NO: 3668266 - DNA, 20 bp, Homo sapiens
ctgctctttctctgccagtg

SEQ ID NO: 3668267 - DNA, 11 bp, Homo sapiens
ctgctgagctg

SEQ ID NO: 3668268 - DNA, 14 bp, Homo sapiens
ctgctgagctgccc

SEQ ID NO: 3668269 - DNA, 18 bp, Homo sapiens
ctgctgagctgcccctgc

SEQ ID NO: 3668270 - DNA, 21 bp, Homo sapiens
ctgctgagctgcccctgctgc

SEQ ID NO: 3668271 - DNA, 16 bp, Homo sapiens
ctgctgcatggggtgg

SEQ ID NO: 3668272 - DNA, 12 bp, Homo sapiens
ctgctgcctctt

SEQ ID NO: 3668273 - DNA, 22 bp, Homo sapiens
ctgctgcctctttccctaggaa

SEQ ID NO: 3668274 - DNA, 17 bp, Homo sapiens
ctgctgcgccccaggcc

SEQ ID NO: 3668275 - DNA, 19 bp, Homo sapiens
ctgctgcgccccaggcccc

SEQ ID NO: 3668276 - DNA, 15 bp, Homo sapiens
ctgctggggagacaa

SEQ ID NO: 3668277 - DNA, 16 bp, Homo sapiens
ctgctggtctcatttg

SEQ ID NO: 3668278 - DNA, 22 bp, Homo sapiens
ctgctggtctcatttgggggcg

SEQ ID NO: 3668279 - DNA, 14 bp, Homo sapiens
ctgctgtgcaacgg

SEQ ID NO: 3668280 - DNA, 19 bp, Homo sapiens
ctgctgtgcctcgcatcct

SEQ ID NO: 3668281 - DNA, 18 bp, Homo sapiens
ctgcttaagtgcatgcat

SEQ ID NO: 3668282 - DNA, 21 bp, Homo sapiens
ctgcttatttcatctgttcta

SEQ ID NO: 3668283 - DNA, 17 bp, Homo sapiens
ctgcttcccatgcctgc

SEQ ID NO: 3668284 - DNA, 12 bp, Homo sapiens
ctgcttcctcct

SEQ ID NO: 3668285 - DNA, 16 bp, Homo sapiens
ctgcttctctgacttc

SEQ ID NO: 3668286 - DNA, 22 bp, Homo sapiens
ctgcttctctgacttctgcctg

SEQ ID NO: 3668287 - DNA, 12 bp, Homo sapiens
ctgctttctcct

SEQ ID NO: 3668288 - DNA, 17 bp, Homo sapiens
ctggaacaaattatttt

SEQ ID NO: 3668289 - DNA, 21 bp, Homo sapiens
ctggaacactagacaagccag

SEQ ID NO: 3668290 - DNA, 14 bp, Homo sapiens
ctggaacccagact

SEQ ID NO: 3668291 - DNA, 18 bp, Homo sapiens
ctggaacccagactcaga

SEQ ID NO: 3668292 - DNA, 22 bp, Homo sapiens
ctggaacccagactcagacatt

SEQ ID NO: 3668293 - DNA, 15 bp, Homo sapiens
ctggaacctcagcct

SEQ ID NO: 3668294 - DNA, 15 bp, Homo sapiens
ctggaacctgcaaaa

SEQ ID NO: 3668295 - DNA, 19 bp, Homo sapiens
ctggaacctggaccccagc

SEQ ID NO: 3668296 - DNA, 14 bp, Homo sapiens
ctggaagaaaaaaa

SEQ ID NO: 3668297 - DNA, 20 bp, Homo sapiens
ctggaagaaagcaacaaaga

SEQ ID NO: 3668298 - DNA, 13 bp, Homo sapiens
ctggaagacagag

SEQ ID NO: 3668299 - DNA, 23 bp, Homo sapiens
ctggaatcaggaatattttccaa

SEQ ID NO: 3668300 - DNA, 15 bp, Homo sapiens
ctggaatgcatgggg

SEQ ID NO: 3668301 - DNA, 20 bp, Homo sapiens
ctggaatgcatggggcgggt

SEQ ID NO: 3668302 - DNA, 13 bp, Homo sapiens
ctggacagcccca

SEQ ID NO: 3668303 - DNA, 14 bp, Homo sapiens
ctggacagccccac

SEQ ID NO: 3668304 - DNA, 16 bp, Homo sapiens
ctggacagccccaccc

SEQ ID NO: 3668305 - DNA, 18 bp, Homo sapiens
ctggacagccccaccctg

SEQ ID NO: 3668306 - DNA, 13 bp, Homo sapiens
ctggacagcctct

SEQ ID NO: 3668307 - DNA, 22 bp, Homo sapiens
ctggacagcctcttctgtccca

SEQ ID NO: 3668308 - DNA, 18 bp, Homo sapiens
ctggaccccagccttggt

SEQ ID NO: 3668309 - DNA, 15 bp, Homo sapiens
ctggacctgtatatt

SEQ ID NO: 3668310 - DNA, 20 bp, Homo sapiens
ctggactatattgggactgg

SEQ ID NO: 3668311 - DNA, 21 bp, Homo sapiens
ctggactggctagagtcctca

SEQ ID NO: 3668312 - DNA, 13 bp, Homo sapiens
ctggactttcctg

SEQ ID NO: 3668313 - DNA, 14 bp, Homo sapiens
ctggactttcctgc

SEQ ID NO: 3668314 - DNA, 22 bp, Homo sapiens
ctggagaaggtattagcaaagc

SEQ ID NO: 3668315 - DNA, 15 bp, Homo sapiens
ctggagacttagggc

SEQ ID NO: 3668316 - DNA, 14 bp, Homo sapiens
ctggagagcactgc

SEQ ID NO: 3668317 - DNA, 22 bp, Homo sapiens
ctggagaggccctctggagtgg

SEQ ID NO: 3668318 - DNA, 14 bp, Homo sapiens
ctggagatcctcct

SEQ ID NO: 3668319 - DNA, 15 bp, Homo sapiens
ctggagatcctcctg

SEQ ID NO: 3668320 - DNA, 16 bp, Homo sapiens
ctggagatcctcctgc

SEQ ID NO: 3668321 - DNA, 19 bp, Homo sapiens
ctggagctagtgtctcctc

SEQ ID NO: 3668322 - DNA, 18 bp, Homo sapiens
ctggaggaacacttgatg

SEQ ID NO: 3668323 - DNA, 20 bp, Homo sapiens
ctggaggtggctgagcccct

SEQ ID NO: 3668324 - DNA, 13 bp, Homo sapiens
ctggagtacccag

SEQ ID NO: 3668325 - DNA, 23 bp, Homo sapiens
ctggagtggccactaagcagagg

SEQ ID NO: 3668326 - DNA, 17 bp, Homo sapiens
ctggatggggcagagct

SEQ ID NO: 3668327 - DNA, 15 bp, Homo sapiens
ctggatgtttggaaa

SEQ ID NO: 3668328 - DNA, 19 bp, Homo sapiens
ctggcaaaaggatctttgt

SEQ ID NO: 3668329 - DNA, 14 bp, Homo sapiens
ctggcaagaatgtg

SEQ ID NO: 3668330 - DNA, 18 bp, Homo sapiens
ctggcaggcaggctccca

SEQ ID NO: 3668331 - DNA, 15 bp, Homo sapiens
ctggcatcagtttag

SEQ ID NO: 3668332 - DNA, 22 bp, Homo sapiens
ctggcatcagtttaggccttgg

SEQ ID NO: 3668333 - DNA, 19 bp, Homo sapiens
ctggcatcgcaccattctg

SEQ ID NO: 3668334 - DNA, 18 bp, Homo sapiens
ctggccagacacaggccc

SEQ ID NO: 3668335 - DNA, 21 bp, Homo sapiens
ctggccagacacaggccctcc

SEQ ID NO: 3668336 - DNA, 12 bp, Homo sapiens
ctggccaggagc

SEQ ID NO: 3668337 - DNA, 11 bp, Homo sapiens
ctggccaggca

SEQ ID NO: 3668338 - DNA, 22 bp, Homo sapiens
ctggccaggcagatctgtgccc

SEQ ID NO: 3668339 - DNA, 18 bp, Homo sapiens
ctggccagtccaccctgc

SEQ ID NO: 3668340 - DNA, 20 bp, Homo sapiens
ctggccagtccaccctgcct

SEQ ID NO: 3668341 - DNA, 15 bp, Homo sapiens
ctggccagtccaggc

SEQ ID NO: 3668342 - DNA, 23 bp, Homo sapiens
ctggccagtccaggctgccgtgg

SEQ ID NO: 3668343 - DNA, 18 bp, Homo sapiens
ctggccatcccacaagtg

SEQ ID NO: 3668344 - DNA, 14 bp, Homo sapiens
ctggcccagggccc

SEQ ID NO: 3668345 - DNA, 15 bp, Homo sapiens
ctggcccagggccca

SEQ ID NO: 3668346 - DNA, 20 bp, Homo sapiens
ctggcccagggcccagagcc

SEQ ID NO: 3668347 - DNA, 22 bp, Homo sapiens
ctggcccagggcccagagccca

SEQ ID NO: 3668348 - DNA, 12 bp, Homo sapiens
ctggccctccac

SEQ ID NO: 3668349 - DNA, 19 bp, Homo sapiens
ctggccgagggtcctggct

SEQ ID NO: 3668350 - DNA, 16 bp, Homo sapiens
ctggcctcccctgcca

SEQ ID NO: 3668351 - DNA, 13 bp, Homo sapiens
ctggccttctcct

SEQ ID NO: 3668352 - DNA, 21 bp, Homo sapiens
ctggctagaggccagccccac

SEQ ID NO: 3668353 - DNA, 22 bp, Homo sapiens
ctggctagaggccagccccacc

SEQ ID NO: 3668354 - DNA, 19 bp, Homo sapiens
ctggctagagtcctcactc

SEQ ID NO: 3668355 - DNA, 15 bp, Homo sapiens
ctggctcctgagggg

SEQ ID NO: 3668356 - DNA, 14 bp, Homo sapiens
ctggcttagtgcca

SEQ ID NO: 3668357 - DNA, 14 bp, Homo sapiens
ctggcttcacagat

SEQ ID NO: 3668358 - DNA, 12 bp, Homo sapiens
ctggcttctggc

SEQ ID NO: 3668359 - DNA, 16 bp, Homo sapiens
ctggcttgggcagcat

SEQ ID NO: 3668360 - DNA, 17 bp, Homo sapiens
ctggctttggaatgctc

SEQ ID NO: 3668361 - DNA, 11 bp, Homo sapiens
ctggctttggc

SEQ ID NO: 3668362 - DNA, 18 bp, Homo sapiens
ctgggaaccgccctcctg

SEQ ID NO: 3668363 - DNA, 22 bp, Homo sapiens
ctgggaagcccggactgaccaa

SEQ ID NO: 3668364 - DNA, 23 bp, Homo sapiens
ctgggaagcccggactgaccaaa

SEQ ID NO: 3668365 - DNA, 14 bp, Homo sapiens
ctgggaaggttcca

SEQ ID NO: 3668366 - DNA, 14 bp, Homo sapiens
ctgggactcagcct

SEQ ID NO: 3668367 - DNA, 15 bp, Homo sapiens
ctgggactcagcctt

SEQ ID NO: 3668368 - DNA, 18 bp, Homo sapiens
ctgggactcagccttcag

SEQ ID NO: 3668369 - DNA, 21 bp, Homo sapiens
ctgggactcagccttcagaca

SEQ ID NO: 3668370 - DNA, 14 bp, Homo sapiens
ctgggacttctggg

SEQ ID NO: 3668371 - DNA, 19 bp, Homo sapiens
ctgggagaaatctggcttc

SEQ ID NO: 3668372 - DNA, 16 bp, Homo sapiens
ctgggagctccactct

SEQ ID NO: 3668373 - DNA, 17 bp, Homo sapiens
ctgggagctccactctg

SEQ ID NO: 3668374 - DNA, 23 bp, Homo sapiens
ctgggagctccactctgcttctc

SEQ ID NO: 3668375 - DNA, 21 bp, Homo sapiens
ctgatgagggggaattcctgg

SEQ ID NO: 3668376 - DNA, 22 bp, Homo sapiens
ctgatgagggggaattcctgga

SEQ ID NO: 3668377 - DNA, 24 bp, Homo sapiens
ctgatgctccctcccctgccctgg

SEQ ID NO: 3668378 - DNA, 21 bp, Homo sapiens
ctgatggtgtggcctgtggct

SEQ ID NO: 3668379 - DNA, 20 bp, Homo sapiens
ctgatgtcaatttctgtgtt

SEQ ID NO: 3668380 - DNA, 16 bp, Homo sapiens
ctgattccgcaccctg

SEQ ID NO: 3668381 - DNA, 17 bp, Homo sapiens
ctgatttaggagaagcc

SEQ ID NO: 3668382 - DNA, 21 bp, Homo sapiens
ctgatttaggagaagccagga

SEQ ID NO: 3668383 - DNA, 22 bp, Homo sapiens
ctgcaaagatctgtcctcagcc

SEQ ID NO: 3668384 - DNA, 23 bp, Homo sapiens
ctgcaaagatctgtcctcagcct

SEQ ID NO: 3668385 - DNA, 18 bp, Homo sapiens
ctgcaaccactctgtggc

SEQ ID NO: 3668386 - DNA, 21 bp, Homo sapiens
ctgcaaccactctgtggccag

SEQ ID NO: 3668387 - DNA, 17 bp, Homo sapiens
ctgcaaccttgcatcca

SEQ ID NO: 3668388 - DNA, 15 bp, Homo sapiens
ctgcaactcaaggac

SEQ ID NO: 3668389 - DNA, 18 bp, Homo sapiens
ctgcaacttgtaaatgtg

SEQ ID NO: 3668390 - DNA, 16 bp, Homo sapiens
ctgcacaagctgcacc

SEQ ID NO: 3668391 - DNA, 22 bp, Homo sapiens
ctgcacaagctgcaccctcagg

SEQ ID NO: 3668392 - DNA, 16 bp, Homo sapiens
ctgcacactcagtggg

SEQ ID NO: 3668393 - DNA, 16 bp, Homo sapiens
ctgcacccccctgggc

SEQ ID NO: 3668394 - DNA, 13 bp, Homo sapiens
ctgcaccctcagg

SEQ ID NO: 3668395 - DNA, 14 bp, Homo sapiens
ctgcaccctcaggc

SEQ ID NO: 3668396 - DNA, 18 bp, Homo sapiens
ctgcaccctcaggcaggt

SEQ ID NO: 3668397 - DNA, 19 bp, Homo sapiens
ctgcactccagcctgggtg

SEQ ID NO: 3668398 - DNA, 15 bp, Homo sapiens
ctgcactccatccag

SEQ ID NO: 3668399 - DNA, 21 bp, Homo sapiens
ctgcagaggccagaggccccc

SEQ ID NO: 3668400 - DNA, 21 bp, Homo sapiens
ctgcagaggggaaagacttcc

SEQ ID NO: 3668401 - DNA, 17 bp, Homo sapiens
ctgcagatcttccgtgg

SEQ ID NO: 3668402 - DNA, 22 bp, Homo sapiens
ctgcagccagctcacgtccagg

SEQ ID NO: 3668403 - DNA, 13 bp, Homo sapiens
ctgcagctgaccg

SEQ ID NO: 3668404 - DNA, 22 bp, Homo sapiens
ctgcaggaatcccggctccaga

SEQ ID NO: 3668405 - DNA, 12 bp, Homo sapiens
ctgcaggcaggg

SEQ ID NO: 3668406 - DNA, 23 bp, Homo sapiens
ctgggtgggcgtggcctgcatag

SEQ ID NO: 3668407 - DNA, 21 bp, Homo sapiens
ctgggtggtctgcaggcaggg

SEQ ID NO: 3668408 - DNA, 21 bp, Homo sapiens
ctgggtgtccccgctgctgtg

SEQ ID NO: 3668409 - DNA, 22 bp, Homo sapiens
ctgggttcaagagactctcctg

SEQ ID NO: 3668410 - DNA, 15 bp, Homo sapiens
ctgggttgcagacag

SEQ ID NO: 3668411 - DNA, 13 bp, Homo sapiens
ctgggttggaaaa

SEQ ID NO: 3668412 - DNA, 18 bp, Homo sapiens
ctggtacaacggaggcct

SEQ ID NO: 3668413 - DNA, 19 bp, Homo sapiens
ctggtacaacggaggcctg

SEQ ID NO: 3668414 - DNA, 15 bp, Homo sapiens
ctggtccagggaagc

SEQ ID NO: 3668415 - DNA, 14 bp, Homo sapiens
ctggtccagggcta

SEQ ID NO: 3668416 - DNA, 16 bp, Homo sapiens
ctggtcctacccatcc

SEQ ID NO: 3668417 - DNA, 22 bp, Homo sapiens
ctggtcctacccatccccgcag

SEQ ID NO: 3668418 - DNA, 13 bp, Homo sapiens
ctggtcgctcctg

SEQ ID NO: 3668419 - DNA, 14 bp, Homo sapiens
ctggtcgctcctgc

SEQ ID NO: 3668420 - DNA, 23 bp, Homo sapiens
ctggtcgctcctgcccacggagt

SEQ ID NO: 3668421 - DNA, 19 bp, Homo sapiens
ctggtctcatttgggggcg

SEQ ID NO: 3668422 - DNA, 18 bp, Homo sapiens
ctggtcttgaactcctgg

SEQ ID NO: 3668423 - DNA, 19 bp, Homo sapiens
ctggtgcacagccactccc

SEQ ID NO: 3668424 - DNA, 18 bp, Homo sapiens
ctggtgcactttgtaaat

SEQ ID NO: 3668425 - DNA, 19 bp, Homo sapiens
ctggtgcactttgtaaatt

SEQ ID NO: 3668426 - DNA, 15 bp, Homo sapiens
ctggtgccatttctg

SEQ ID NO: 3668427 - DNA, 18 bp, Homo sapiens
ctggtggccactgagctg

SEQ ID NO: 3668428 - DNA, 20 bp, Homo sapiens
ctggtggccactgagctggc

SEQ ID NO: 3668429 - DNA, 14 bp, Homo sapiens
ctggtggcccagga

SEQ ID NO: 3668430 - DNA, 22 bp, Homo sapiens
ctggtggtctgttggcaggctg

SEQ ID NO: 3668431 - DNA, 23 bp, Homo sapiens
ctggtggtctgttggcaggctgg

SEQ ID NO: 3668432 - DNA, 20 bp, Homo sapiens
ctggtggttgctgttttcct

SEQ ID NO: 3668433 - DNA, 14 bp, Homo sapiens
ctggttccagggtc

SEQ ID NO: 3668434 - DNA, 15 bp, Homo sapiens
ctggttctgcaatga

SEQ ID NO: 3668435 - DNA, 14 bp, Homo sapiens
ctggttgtctgaac

SEQ ID NO: 3668436 - DNA, 21 bp, Homo sapiens
ctgtaagaaacctactgccca

SEQ ID NO: 3668437 - DNA, 19 bp, Homo sapiens
ctgtaaggttccatccacc

SEQ ID NO: 3668438 - DNA, 20 bp, Homo sapiens
ctgtaataaagatgattgtg

SEQ ID NO: 3668439 - DNA, 14 bp, Homo sapiens
ctgtaatctatgaa

SEQ ID NO: 3668440 - DNA, 11 bp, Homo sapiens
ctgtacaataa

SEQ ID NO: 3668441 - DNA, 15 bp, Homo sapiens
ctgtacattgtggga

SEQ ID NO: 3668442 - DNA, 19 bp, Homo sapiens
ctgtactgttactgggccc

SEQ ID NO: 3668443 - DNA, 20 bp, Homo sapiens
ctgtactgttactgggccct

SEQ ID NO: 3668444 - DNA, 18 bp, Homo sapiens
ctgtacttttcattctct

SEQ ID NO: 3668445 - DNA, 15 bp, Homo sapiens
ctgtagctttcctgg

SEQ ID NO: 3668446 - DNA, 22 bp, Homo sapiens
ctgtagctttcctggtccctca

SEQ ID NO: 3668447 - DNA, 16 bp, Homo sapiens
ctgtagcttttaggaa

SEQ ID NO: 3668448 - DNA, 21 bp, Homo sapiens
ctgtagggagggcggcagggg

SEQ ID NO: 3668449 - DNA, 19 bp, Homo sapiens
ctgtagtaatttattgtct

SEQ ID NO: 3668450 - DNA, 20 bp, Homo sapiens
ctgtagtgtcactcaaggcg

SEQ ID NO: 3668451 - DNA, 15 bp, Homo sapiens
ctgtattcagacaga

SEQ ID NO: 3668452 - DNA, 16 bp, Homo sapiens
ctgtattcagacagat

SEQ ID NO: 3668453 - DNA, 18 bp, Homo sapiens
ctgtatttatgtgtgagg

SEQ ID NO: 3668454 - DNA, 18 bp, Homo sapiens
ctgtatttttaaagcatg

SEQ ID NO: 3668455 - DNA, 20 bp, Homo sapiens
ctgtcaatcacagtctcagt

SEQ ID NO: 3668456 - DNA, 19 bp, Homo sapiens
ctgtcaggctgaaaacaat

SEQ ID NO: 3668457 - DNA, 18 bp, Homo sapiens
ctgtccaaaggaggctgg

SEQ ID NO: 3668458 - DNA, 15 bp, Homo sapiens
ctgtccagcctgggc

SEQ ID NO: 3668459 - DNA, 17 bp, Homo sapiens
ctgtccagcctgggcag

SEQ ID NO: 3668460 - DNA, 13 bp, Homo sapiens
ctgtccagctcca

SEQ ID NO: 3668461 - DNA, 12 bp, Homo sapiens
ctgtcccaagtc

SEQ ID NO: 3668462 - DNA, 21 bp, Homo sapiens
ctgtcccttgcctcaatgcca

SEQ ID NO: 3668463 - DNA, 14 bp, Homo sapiens
ctgtcctacaatct

SEQ ID NO: 3668464 - DNA, 21 bp, Homo sapiens
ctgtcctcagccttgccagag

SEQ ID NO: 3668465 - DNA, 22 bp, Homo sapiens
ctgtcctcagccttgccagaga

SEQ ID NO: 3668466 - DNA, 14 bp, Homo sapiens
ctgtcctgtacatt

SEQ ID NO: 3668467 - DNA, 22 bp, Homo sapiens
ctgtcctgtacattgtgggatg

SEQ ID NO: 3668468 - DNA, 13 bp, Homo sapiens
ctgtcctttctag

SEQ ID NO: 3668469 - DNA, 19 bp, Homo sapiens
ctgtcgagaaacagcctgt

SEQ ID NO: 3668470 - DNA, 21 bp, Homo sapiens
ctgtcgtgatggggcaagggc

SEQ ID NO: 3668471 - DNA, 11 bp, Homo sapiens
ctgtctacatt

SEQ ID NO: 3668472 - DNA, 16 bp, Homo sapiens
ctgtctagagagggag

SEQ ID NO: 3668473 - DNA, 16 bp, Homo sapiens
ctgtctcaaaaaaaga

SEQ ID NO: 3668474 - DNA, 22 bp, Homo sapiens
ctgtctcaaaaaaagaaaaaga

SEQ ID NO: 3668475 - DNA, 19 bp, Homo sapiens
ctgtctcaggagcaccctg

SEQ ID NO: 3668476 - DNA, 14 bp, Homo sapiens
ctgtctcccaggct

SEQ ID NO: 3668477 - DNA, 14 bp, Homo sapiens
ctgtcttctggact

SEQ ID NO: 3668478 - DNA, 16 bp, Homo sapiens
ctgtctttaaaagaga

SEQ ID NO: 3668479 - DNA, 15 bp, Homo sapiens
ctgtgaatgccactg

SEQ ID NO: 3668480 - DNA, 13 bp, Homo sapiens
ctgtgacccatct

SEQ ID NO: 3668481 - DNA, 14 bp, Homo sapiens
ctgtgacccatctg

SEQ ID NO: 3668482 - DNA, 21 bp, Homo sapiens
cttctagggttattgcatttg

SEQ ID NO: 3668483 - DNA, 14 bp, Homo sapiens
cttctccctgggga

SEQ ID NO: 3668484 - DNA, 17 bp, Homo sapiens
cttctcctgaccagggc

SEQ ID NO: 3668485 - DNA, 18 bp, Homo sapiens
cttctcctgaccagggca

SEQ ID NO: 3668486 - DNA, 15 bp, Homo sapiens
cttctccttggagga

SEQ ID NO: 3668487 - DNA, 16 bp, Homo sapiens
cttctccttggaggac

SEQ ID NO: 3668488 - DNA, 23 bp, Homo sapiens
cttctccttggaggacagtggga

SEQ ID NO: 3668489 - DNA, 22 bp, Homo sapiens
cttctctccgcgggtgggactc

SEQ ID NO: 3668490 - DNA, 12 bp, Homo sapiens
cttctctgactt

SEQ ID NO: 3668491 - DNA, 15 bp, Homo sapiens
cttctctgacttctg

SEQ ID NO: 3668492 - DNA, 21 bp, Homo sapiens
cttctctgacttctgcctgga

SEQ ID NO: 3668493 - DNA, 12 bp, Homo sapiens
cttctctgctcc

SEQ ID NO: 3668494 - DNA, 21 bp, Homo sapiens
cttctctgctccaccacatcc

SEQ ID NO: 3668495 - DNA, 13 bp, Homo sapiens
cttctctgggacc

SEQ ID NO: 3668496 - DNA, 19 bp, Homo sapiens
cttctctgggaccaggctc

SEQ ID NO: 3668497 - DNA, 20 bp, Homo sapiens
cttctctgggaccaggctcc

SEQ ID NO: 3668498 - DNA, 21 bp, Homo sapiens
cttctctgggaccaggctcca

SEQ ID NO: 3668499 - DNA, 22 bp, Homo sapiens
cttctctgggaccaggctccaa

SEQ ID NO: 3668500 - DNA, 15 bp, Homo sapiens
cttctcttgggtggg

SEQ ID NO: 3668501 - DNA, 21 bp, Homo sapiens
cttctcttgggtgggacaggg

SEQ ID NO: 3668502 - DNA, 18 bp, Homo sapiens
cttctgaatattttatct

SEQ ID NO: 3668503 - DNA, 14 bp, Homo sapiens
cttctgcaggaatc

SEQ ID NO: 3668504 - DNA, 20 bp, Homo sapiens
cttctgccatttctgagatc

SEQ ID NO: 3668505 - DNA, 18 bp, Homo sapiens
cttctgccggccctgggg

SEQ ID NO: 3668506 - DNA, 16 bp, Homo sapiens
cttctgcctggagact

SEQ ID NO: 3668507 - DNA, 20 bp, Homo sapiens
cttctgctactggcaaaagg

SEQ ID NO: 3668508 - DNA, 18 bp, Homo sapiens
cttctggaatttgttcaa

SEQ ID NO: 3668509 - DNA, 15 bp, Homo sapiens
cttctggtgctactc

SEQ ID NO: 3668510 - DNA, 21 bp, Homo sapiens
cttctggtgctactccatgca

SEQ ID NO: 3668511 - DNA, 19 bp, Homo sapiens
cttctgtgagacccccaca

SEQ ID NO: 3668512 - DNA, 20 bp, Homo sapiens
cttctgtgagacccccacac

SEQ ID NO: 3668513 - DNA, 13 bp, Homo sapiens
cttcttgcctctg

SEQ ID NO: 3668514 - DNA, 24 bp, Homo sapiens
cttcttggggcccagtgcatggtg

SEQ ID NO: 3668515 - DNA, 16 bp, Homo sapiens
cttgaaaggcaggaag

SEQ ID NO: 3668516 - DNA, 23 bp, Homo sapiens
cttgaaaggcaggaagggaagcg

SEQ ID NO: 3668517 - DNA, 19 bp, Homo sapiens
cttgaaatatcctgcttga

SEQ ID NO: 3668518 - DNA, 20 bp, Homo sapiens
cttgaactgttgcccttctg

SEQ ID NO: 3668519 - DNA, 18 bp, Homo sapiens
cttgaagaactgcaggcc

SEQ ID NO: 3668520 - DNA, 13 bp, Homo sapiens
cttgaagggccag

SEQ ID NO: 3668521 - DNA, 20 bp, Homo sapiens
cttgaagggccagagccagg

SEQ ID NO: 3668522 - DNA, 14 bp, Homo sapiens
cttgaaggtgctga

SEQ ID NO: 3668523 - DNA, 14 bp, Homo sapiens
cttgaataataagc

SEQ ID NO: 3668524 - DNA, 20 bp, Homo sapiens
cttgacaactggcaggcagg

SEQ ID NO: 3668525 - DNA, 14 bp, Homo sapiens
cttgacagaacact

SEQ ID NO: 3668526 - DNA, 15 bp, Homo sapiens
cttgaccaagcagga

SEQ ID NO: 3668527 - DNA, 17 bp, Homo sapiens
cttgaccaagcaggaag

SEQ ID NO: 3668528 - DNA, 19 bp, Homo sapiens
cttgaccaagcaggaagct

SEQ ID NO: 3668529 - DNA, 20 bp, Homo sapiens
cttgaccaagcaggaagctc

SEQ ID NO: 3668530 - DNA, 14 bp, Homo sapiens
cttgagagggtgga

SEQ ID NO: 3668531 - DNA, 18 bp, Homo sapiens
cttgagattttgtatatt

SEQ ID NO: 3668532 - DNA, 16 bp, Homo sapiens
cttgagcctgggaggt

SEQ ID NO: 3668533 - DNA, 21 bp, Homo sapiens
cttgagttgattcagctctgc

SEQ ID NO: 3668534 - DNA, 12 bp, Homo sapiens
cttgatagaaat

SEQ ID NO: 3668535 - DNA, 14 bp, Homo sapiens
cttgatagaaatgc

SEQ ID NO: 3668536 - DNA, 21 bp, Homo sapiens
cttgatggaagtgggccagtc

SEQ ID NO: 3668537 - DNA, 24 bp, Homo sapiens
cttgatggaagtgggccagtcctg

SEQ ID NO: 3668538 - DNA, 17 bp, Homo sapiens
cttgatgtttggggtct

SEQ ID NO: 3668539 - DNA, 23 bp, Homo sapiens
cttgcaaatacctcctccctaat

SEQ ID NO: 3668540 - DNA, 18 bp, Homo sapiens
cttgcagctaaggagggg

SEQ ID NO: 3668541 - DNA, 12 bp, Homo sapiens
cttgccagagat

SEQ ID NO: 3668542 - DNA, 22 bp, Homo sapiens
cttgcccaggagcaagtgaggc

SEQ ID NO: 3668543 - DNA, 23 bp, Homo sapiens
cttgccctcccaaagtgctggga

SEQ ID NO: 3668544 - DNA, 13 bp, Homo sapiens
cttgcctccaggt

SEQ ID NO: 3668545 - DNA, 14 bp, Homo sapiens
cttgcctccaggtg

SEQ ID NO: 3668546 - DNA, 15 bp, Homo sapiens
cttgcctccaggtgc

SEQ ID NO: 3668547 - DNA, 22 bp, Homo sapiens
ctgtgtttcgtgaactgcagtg

SEQ ID NO: 3668548 - DNA, 15 bp, Homo sapiens
ctgttactgggccct

SEQ ID NO: 3668549 - DNA, 20 bp, Homo sapiens
ctgttactgggccctgagtc

SEQ ID NO: 3668550 - DNA, 22 bp, Homo sapiens
ctgttagggacatttccaagct

SEQ ID NO: 3668551 - DNA, 13 bp, Homo sapiens
ctgttatttaatt

SEQ ID NO: 3668552 - DNA, 18 bp, Homo sapiens
ctgttcagctggttgagg

SEQ ID NO: 3668553 - DNA, 14 bp, Homo sapiens
ctgttccccagaga

SEQ ID NO: 3668554 - DNA, 15 bp, Homo sapiens
ctgttccccagagaa

SEQ ID NO: 3668555 - DNA, 17 bp, Homo sapiens
ctgttcccccttcacaa

SEQ ID NO: 3668556 - DNA, 23 bp, Homo sapiens
ctgttcccccttcacaaagccca

SEQ ID NO: 3668557 - DNA, 20 bp, Homo sapiens
ctgttcccttcctctgtgcc

SEQ ID NO: 3668558 - DNA, 21 bp, Homo sapiens
ctgttcccttcctctgtgcca

SEQ ID NO: 3668559 - DNA, 22 bp, Homo sapiens
ctgttcccttcctctgtgccac

SEQ ID NO: 3668560 - DNA, 15 bp, Homo sapiens
ctgttctaacatgta

SEQ ID NO: 3668561 - DNA, 13 bp, Homo sapiens
ctgttcttggtaa

SEQ ID NO: 3668562 - DNA, 22 bp, Homo sapiens
ctgttgacacaggtctttccta

SEQ ID NO: 3668563 - DNA, 19 bp, Homo sapiens
ctgttgacatatttaatgt

SEQ ID NO: 3668564 - DNA, 20 bp, Homo sapiens
ctgttgacatatttaatgtt

SEQ ID NO: 3668565 - DNA, 22 bp, Homo sapiens
ctgttgacatatttaatgtttt

SEQ ID NO: 3668566 - DNA, 19 bp, Homo sapiens
ctgtttagtctccttttta

SEQ ID NO: 3668567 - DNA, 16 bp, Homo sapiens
ctgtttatggcctcag

SEQ ID NO: 3668568 - DNA, 18 bp, Homo sapiens
ctgtttatggcctcagct

SEQ ID NO: 3668569 - DNA, 22 bp, Homo sapiens
ctgtttatggcctcagctgcct

SEQ ID NO: 3668570 - DNA, 20 bp, Homo sapiens
ctgttttcctcccttctgct

SEQ ID NO: 3668571 - DNA, 13 bp, Homo sapiens
ctgttttctcttg

SEQ ID NO: 3668572 - DNA, 14 bp, Homo sapiens
ctgttttctcttga

SEQ ID NO: 3668573 - DNA, 13 bp, Homo sapiens
ctgtttttgttgt

SEQ ID NO: 3668574 - DNA, 14 bp, Homo sapiens
cttaaacaaatgta

SEQ ID NO: 3668575 - DNA, 20 bp, Homo sapiens
cttaaattatatatttattt

SEQ ID NO: 3668576 - DNA, 20 bp, Homo sapiens
cttaaatttctaaaaacagt

SEQ ID NO: 3668577 - DNA, 18 bp, Homo sapiens
cttaacaaactcttcagt

SEQ ID NO: 3668578 - DNA, 18 bp, Homo sapiens
cttaagaattttgagcag

SEQ ID NO: 3668579 - DNA, 21 bp, Homo sapiens
cttaagattccattttggaaa

SEQ ID NO: 3668580 - DNA, 18 bp, Homo sapiens
cttaagcaaaagaaaaag

SEQ ID NO: 3668581 - DNA, 13 bp, Homo sapiens
cttaagggaaagg

SEQ ID NO: 3668582 - DNA, 17 bp, Homo sapiens
cttaaggtgtagccaca

SEQ ID NO: 3668583 - DNA, 14 bp, Homo sapiens
cttaagtaccaatg

SEQ ID NO: 3668584 - DNA, 15 bp, Homo sapiens
cttaagtaccaatgg

SEQ ID NO: 3668585 - DNA, 17 bp, Homo sapiens
cttaagtgcatgcattg

SEQ ID NO: 3668586 - DNA, 14 bp, Homo sapiens
cttaataaaagaac

SEQ ID NO: 3668587 - DNA, 20 bp, Homo sapiens
cttaataaaagaacatgctt

SEQ ID NO: 3668588 - DNA, 14 bp, Homo sapiens
cttaatcattttca

SEQ ID NO: 3668589 - DNA, 13 bp, Homo sapiens
cttacatttttgt

SEQ ID NO: 3668590 - DNA, 17 bp, Homo sapiens
cttacatttttgtggtt

SEQ ID NO: 3668591 - DNA, 13 bp, Homo sapiens
cttacctcggtgc

SEQ ID NO: 3668592 - DNA, 21 bp, Homo sapiens
cttacctcggtgccttcctct

SEQ ID NO: 3668593 - DNA, 23 bp, Homo sapiens
cttacctgtgaccctctttgctg

SEQ ID NO: 3668594 - DNA, 13 bp, Homo sapiens
cttagcaactgct

SEQ ID NO: 3668595 - DNA, 22 bp, Homo sapiens
cttagcaactgctggggagaca

SEQ ID NO: 3668596 - DNA, 11 bp, Homo sapiens
cttagcctccc

SEQ ID NO: 3668597 - DNA, 16 bp, Homo sapiens
cttagggaagaaaaag

SEQ ID NO: 3668598 - DNA, 16 bp, Homo sapiens
cttaggggctgctgac

SEQ ID NO: 3668599 - DNA, 16 bp, Homo sapiens
cttagtgccacccacc

SEQ ID NO: 3668600 - DNA, 23 bp, Homo sapiens
cttagtttgtgtgttgtctcttg

SEQ ID NO: 3668601 - DNA, 12 bp, Homo sapiens
cttatagatgca

SEQ ID NO: 3668602 - DNA, 15 bp, Homo sapiens
cttatcttctggatt

SEQ ID NO: 3668603 - DNA, 15 bp, Homo sapiens
cttatgaatatattt

SEQ ID NO: 3668604 - DNA, 13 bp, Homo sapiens
cttatgagaaact

SEQ ID NO: 3668605 - DNA, 18 bp, Homo sapiens
cttatttaatctccattt

SEQ ID NO: 3668606 - DNA, 16 bp, Homo sapiens
cttatttcaaaaggaa

SEQ ID NO: 3668607 - DNA, 13 bp, Homo sapiens
cttattttacatt

SEQ ID NO: 3668608 - DNA, 13 bp, Homo sapiens
cttcaagtgccaa

SEQ ID NO: 3668609 - DNA, 15 bp, Homo sapiens
cttcaagtgccaaac

SEQ ID NO: 3668610 - DNA, 14 bp, Homo sapiens
cttcacaaagccca

SEQ ID NO: 3668611 - DNA, 15 bp, Homo sapiens
cttcacaaagcccaa

SEQ ID NO: 3668612 - DNA, 23 bp, Homo sapiens
cttcacaaagcccaagggatctg

SEQ ID NO: 3668613 - DNA, 19 bp, Homo sapiens
cttcactcttcaaatgcct

SEQ ID NO: 3668614 - DNA, 16 bp, Homo sapiens
cttcagagtttgtcat

SEQ ID NO: 3668615 - DNA, 23 bp, Homo sapiens
cttcagagtttgtcatatactgc

SEQ ID NO: 3668616 - DNA, 19 bp, Homo sapiens
cttcagccaggagctgggc

SEQ ID NO: 3668617 - DNA, 12 bp, Homo sapiens
cttcaggcctcc

SEQ ID NO: 3668618 - DNA, 15 bp, Homo sapiens
gacttctgggtctcc

SEQ ID NO: 3668619 - DNA, 22 bp, Homo sapiens
gacttctgggtctccagggagg

SEQ ID NO: 3668620 - DNA, 18 bp, Homo sapiens
gacttgtgtcccatgatc

SEQ ID NO: 3668621 - DNA, 18 bp, Homo sapiens
gacttgtttttgcacatg

SEQ ID NO: 3668622 - DNA, 12 bp, Homo sapiens
gactttcctgca

SEQ ID NO: 3668623 - DNA, 12 bp, Homo sapiens
gactttctgcct

SEQ ID NO: 3668624 - DNA, 15 bp, Homo sapiens
gactttctgcctgga

SEQ ID NO: 3668625 - DNA, 14 bp, Homo sapiens
gactttgagctgag

SEQ ID NO: 3668626 - DNA, 21 bp, Homo sapiens
gactttgcagccggcacaggg

SEQ ID NO: 3668627 - DNA, 10 bp, Homo sapiens
gagaaaaaaa

SEQ ID NO: 3668628 - DNA, 11 bp, Homo sapiens
gagaaaatata

SEQ ID NO: 3668629 - DNA, 17 bp, Homo sapiens
gagaaaatatatgtatt

SEQ ID NO: 3668630 - DNA, 17 bp, Homo sapiens
gagaaaggggagcccac

SEQ ID NO: 3668631 - DNA, 18 bp, Homo sapiens
gagaaaggggagcccact

SEQ ID NO: 3668632 - DNA, 14 bp, Homo sapiens
gagaaatacaaaaa

SEQ ID NO: 3668633 - DNA, 15 bp, Homo sapiens
gagaaatacaaaaat

SEQ ID NO: 3668634 - DNA, 16 bp, Homo sapiens
gagaaatcaggcctga

SEQ ID NO: 3668635 - DNA, 18 bp, Homo sapiens
gagaacaggtggttttta

SEQ ID NO: 3668636 - DNA, 13 bp, Homo sapiens
gagaaccaaatct

SEQ ID NO: 3668637 - DNA, 22 bp, Homo sapiens
gagaacctcacgcacctcccat

SEQ ID NO: 3668638 - DNA, 21 bp, Homo sapiens
gagaacctgggttgcagacag

SEQ ID NO: 3668639 - DNA, 23 bp, Homo sapiens
gagaacctgggttgcagacagga

SEQ ID NO: 3668640 - DNA, 15 bp, Homo sapiens
gagaactcctagggt

SEQ ID NO: 3668641 - DNA, 16 bp, Homo sapiens
gagaagcagaggaagg

SEQ ID NO: 3668642 - DNA, 18 bp, Homo sapiens
gagaagccaaaagattgg

SEQ ID NO: 3668643 - DNA, 23 bp, Homo sapiens
gagaagccaggaatttcccagga

SEQ ID NO: 3668644 - DNA, 21 bp, Homo sapiens
gagaagccatgtactcaagta

SEQ ID NO: 3668645 - DNA, 19 bp, Homo sapiens
gagaagctcctctccccag

SEQ ID NO: 3668646 - DNA, 13 bp, Homo sapiens
gagaaggaacagg

SEQ ID NO: 3668647 - DNA, 19 bp, Homo sapiens
gagaagtgaatgctgggac

SEQ ID NO: 3668648 - DNA, 15 bp, Homo sapiens
gagacatacttgaag

SEQ ID NO: 3668649 - DNA, 21 bp, Homo sapiens
gagacatacttgaagggccag

SEQ ID NO: 3668650 - DNA, 13 bp, Homo sapiens
gagaccagcctgg

SEQ ID NO: 3668651 - DNA, 18 bp, Homo sapiens
gagacggtgttttgccat

SEQ ID NO: 3668652 - DNA, 19 bp, Homo sapiens
gagacggtttccagggagg

SEQ ID NO: 3668653 - DNA, 16 bp, Homo sapiens
gagactagattgcctt

SEQ ID NO: 3668654 - DNA, 13 bp, Homo sapiens
gagactcagtgca

SEQ ID NO: 3668655 - DNA, 19 bp, Homo sapiens
gagactctcctgcctcagc

SEQ ID NO: 3668656 - DNA, 12 bp, Homo sapiens
gagactgtgcca

SEQ ID NO: 3668657 - DNA, 15 bp, Homo sapiens
gagactgtgccatgg

SEQ ID NO: 3668658 - DNA, 16 bp, Homo sapiens
gagactgtgccatggt

SEQ ID NO: 3668659 - DNA, 18 bp, Homo sapiens
gagacttagggcaccagg

SEQ ID NO: 3668660 - DNA, 21 bp, Homo sapiens
gagacttgtgctcaaggaatc

SEQ ID NO: 3668661 - DNA, 17 bp, Homo sapiens
gagagaaaatatatgta

SEQ ID NO: 3668662 - DNA, 18 bp, Homo sapiens
gagagaaatcaggcctga

SEQ ID NO: 3668663 - DNA, 13 bp, Homo sapiens
gagagcctgctgc

SEQ ID NO: 3668664 - DNA, 14 bp, Homo sapiens
gagagcctgctgca

SEQ ID NO: 3668665 - DNA, 13 bp, Homo sapiens
gagagctggtgcc

SEQ ID NO: 3668666 - DNA, 20 bp, Homo sapiens
gagaggactgtagggagggc

SEQ ID NO: 3668667 - DNA, 19 bp, Homo sapiens
gagagggaggcaagccctg

SEQ ID NO: 3668668 - DNA, 20 bp, Homo sapiens
gagagttagtcgccctacag

SEQ ID NO: 3668669 - DNA, 12 bp, Homo sapiens
gagataattgtt

SEQ ID NO: 3668670 - DNA, 13 bp, Homo sapiens
gagatacatacag

SEQ ID NO: 3668671 - DNA, 16 bp, Homo sapiens
gagatacatacagaat

SEQ ID NO: 3668672 - DNA, 15 bp, Homo sapiens
gagatagaagcctct

SEQ ID NO: 3668673 - DNA, 13 bp, Homo sapiens
gagatcagcctgg

SEQ ID NO: 3668674 - DNA, 12 bp, Homo sapiens
gagatcctcctg

SEQ ID NO: 3668675 - DNA, 17 bp, Homo sapiens
gagatcctcctgcagac

SEQ ID NO: 3668676 - DNA, 12 bp, Homo sapiens
gagatgctggct

SEQ ID NO: 3668677 - DNA, 19 bp, Homo sapiens
gagatgctggcttgggcag

SEQ ID NO: 3668678 - DNA, 23 bp, Homo sapiens
gagatgggccggcccccttcctg

SEQ ID NO: 3668679 - DNA, 17 bp, Homo sapiens
gagcaagtgaggccgga

SEQ ID NO: 3668680 - DNA, 14 bp, Homo sapiens
gagcagcctgtggc

SEQ ID NO: 3668681 - DNA, 16 bp, Homo sapiens
gagcagcctgtggcat

SEQ ID NO: 3668682 - DNA, 18 bp, Homo sapiens
gagcagtgagcactgaaa

SEQ ID NO: 3668683 - DNA, 23 bp, Homo sapiens
gagcagtggctggtccagggcta

SEQ ID NO: 3668684 - DNA, 20 bp, Homo sapiens
gagcatgcttccctgcagct

SEQ ID NO: 3668685 - DNA, 21 bp, Homo sapiens
gagcatgcttccctgcagctg

SEQ ID NO: 3668686 - DNA, 21 bp, Homo sapiens
gagccactctatgagttggac

SEQ ID NO: 3668687 - DNA, 18 bp, Homo sapiens
gagccagcaagaggaagg

SEQ ID NO: 3668688 - DNA, 22 bp, Homo sapiens
gagccagcaagaggaaggggtg

SEQ ID NO: 3668689 - DNA, 12 bp, Homo sapiens
gagccatgtttc

SEQ ID NO: 3668690 - DNA, 12 bp, Homo sapiens
gagcccagctcc

SEQ ID NO: 3668691 - DNA, 13 bp, Homo sapiens
gagcccagctcca

SEQ ID NO: 3668692 - DNA, 18 bp, Homo sapiens
gagccccatcagctccag

SEQ ID NO: 3668693 - DNA, 20 bp, Homo sapiens
gagcccctgtctagagaggg

SEQ ID NO: 3668694 - DNA, 12 bp, Homo sapiens
gagcctctggaa

SEQ ID NO: 3668695 - DNA, 16 bp, Homo sapiens
gagcctgcagggaagc

SEQ ID NO: 3668696 - DNA, 21 bp, Homo sapiens
gagcctgggaggtcaaggctg

SEQ ID NO: 3668697 - DNA, 19 bp, Homo sapiens
gagccttcaagtgccaaac

SEQ ID NO: 3668698 - DNA, 19 bp, Homo sapiens
gagcgcctccatccaaggc

SEQ ID NO: 3668699 - DNA, 18 bp, Homo sapiens
gagcgcctgcccctccca

SEQ ID NO: 3668700 - DNA, 14 bp, Homo sapiens
gagcggaaagcagc

SEQ ID NO: 3668701 - DNA, 18 bp, Homo sapiens
gagcggatgggcacacac

SEQ ID NO: 3668702 - DNA, 15 bp, Homo sapiens
gagctagcagcaggg

SEQ ID NO: 3668703 - DNA, 22 bp, Homo sapiens
gagctccactgccatgtaccca

SEQ ID NO: 3668704 - DNA, 16 bp, Homo sapiens
gagctcttcaggcctc

SEQ ID NO: 3668705 - DNA, 22 bp, Homo sapiens
gagctcttcaggcctccctctc

SEQ ID NO: 3668706 - DNA, 17 bp, Homo sapiens
gagctgcagttcttgtg

SEQ ID NO: 3668707 - DNA, 16 bp, Homo sapiens
gagctgcccctgctgc

SEQ ID NO: 3668708 - DNA, 17 bp, Homo sapiens
gagctgcctccagcctg

SEQ ID NO: 3668709 - DNA, 18 bp, Homo sapiens
gagctgcctccagcctgg

SEQ ID NO: 3668710 - DNA, 18 bp, Homo sapiens
gagctgctatagcctggg

SEQ ID NO: 3668711 - DNA, 17 bp, Homo sapiens
gagctggctctgagcgc

SEQ ID NO: 3668712 - DNA, 21 bp, Homo sapiens
gagctggctgactaagccccg

SEQ ID NO: 3668713 - DNA, 17 bp, Homo sapiens
gagctgggcagaaggcc

SEQ ID NO: 3668714 - DNA, 15 bp, Homo sapiens
gagctggtgcccgga

SEQ ID NO: 3668715 - DNA, 20 bp, Homo sapiens
gagctgtttatggcctcagc

SEQ ID NO: 3668716 - DNA, 18 bp, Homo sapiens
gagcttctcctgaccagg

SEQ ID NO: 3668717 - DNA, 20 bp, Homo sapiens
gagctttgaaaattcagtgg

SEQ ID NO: 3668718 - DNA, 20 bp, Homo sapiens
gaggaacatgcataagaaat

SEQ ID NO: 3668719 - DNA, 17 bp, Homo sapiens
gaggaagagaaaaaata

SEQ ID NO: 3668720 - DNA, 19 bp, Homo sapiens
gaggaaggggtgctgtgag

SEQ ID NO: 3668721 - DNA, 20 bp, Homo sapiens
gaggacagtctggagaaggt

SEQ ID NO: 3668722 - DNA, 20 bp, Homo sapiens
gaggactgtagggagggcgg

SEQ ID NO: 3668723 - DNA, 21 bp, Homo sapiens
gaggactgtagggagggcggc

SEQ ID NO: 3668724 - DNA, 16 bp, Homo sapiens
gaggagagaaaatata

SEQ ID NO: 3668725 - DNA, 18 bp, Homo sapiens
gaggaggggccgctgcca

SEQ ID NO: 3668726 - DNA, 22 bp, Homo sapiens
gaggatctcttgagcctgggag

SEQ ID NO: 3668727 - DNA, 20 bp, Homo sapiens
gaggatgtcactcagatgga

SEQ ID NO: 3668728 - DNA, 16 bp, Homo sapiens
gaggattgcttgagct

SEQ ID NO: 3668729 - DNA, 22 bp, Homo sapiens
gaggcaagcgaccgaggccctc

SEQ ID NO: 3668730 - DNA, 20 bp, Homo sapiens
gaggcagaggttgcagtgag

SEQ ID NO: 3668731 - DNA, 16 bp, Homo sapiens
gaggcaggcatggccc

SEQ ID NO: 3668732 - DNA, 20 bp, Homo sapiens
gaggcaggcatggccctggg

SEQ ID NO: 3668733 - DNA, 18 bp, Homo sapiens
gaggccaaaggctggtgg

SEQ ID NO: 3668734 - DNA, 19 bp, Homo sapiens
gaggccaaaggctggtggc

SEQ ID NO: 3668735 - DNA, 22 bp, Homo sapiens
gaggccaaggtgggaggattgc

SEQ ID NO: 3668736 - DNA, 21 bp, Homo sapiens
gaggccagaggcccccagccc

SEQ ID NO: 3668737 - DNA, 15 bp, Homo sapiens
ctttaaaagagagag

SEQ ID NO: 3668738 - DNA, 18 bp, Homo sapiens
ctttaacagtggagctga

SEQ ID NO: 3668739 - DNA, 17 bp, Homo sapiens
ctttaaccttgtataaa

SEQ ID NO: 3668740 - DNA, 14 bp, Homo sapiens
ctttaagaggacat

SEQ ID NO: 3668741 - DNA, 20 bp, Homo sapiens
ctttaagcctgcattcttaa

SEQ ID NO: 3668742 - DNA, 12 bp, Homo sapiens
ctttaatataaa

SEQ ID NO: 3668743 - DNA, 22 bp, Homo sapiens
ctttacgtgtttaaaaaaaagc

SEQ ID NO: 3668744 - DNA, 11 bp, Homo sapiens
ctttcaaattt

SEQ ID NO: 3668745 - DNA, 14 bp, Homo sapiens
ctttcaaatttaga

SEQ ID NO: 3668746 - DNA, 19 bp, Homo sapiens
ctttcaaatttagaaacta

SEQ ID NO: 3668747 - DNA, 23 bp, Homo sapiens
ctttcaagcagtcgtgcctgtgt

SEQ ID NO: 3668748 - DNA, 20 bp, Homo sapiens
ctttcaatggtttgcaagga

SEQ ID NO: 3668749 - DNA, 19 bp, Homo sapiens
ctttcactacatattaaat

SEQ ID NO: 3668750 - DNA, 15 bp, Homo sapiens
ctttcagtgaaagca

SEQ ID NO: 3668751 - DNA, 17 bp, Homo sapiens
ctttcagtgaaagcatc

SEQ ID NO: 3668752 - DNA, 23 bp, Homo sapiens
ctttccaccacagccagcacctg

SEQ ID NO: 3668753 - DNA, 16 bp, Homo sapiens
ctttccagcttagaat

SEQ ID NO: 3668754 - DNA, 16 bp, Homo sapiens
ctttcccaactctagc

SEQ ID NO: 3668755 - DNA, 17 bp, Homo sapiens
ctttcccatggggaggg

SEQ ID NO: 3668756 - DNA, 19 bp, Homo sapiens
ctttcctgccccaggcctg

SEQ ID NO: 3668757 - DNA, 10 bp, Homo sapiens
ctttcctgga

SEQ ID NO: 3668758 - DNA, 15 bp, Homo sapiens
ctttccttccatccc

SEQ ID NO: 3668759 - DNA, 15 bp, Homo sapiens
ctttccttttcttta

SEQ ID NO: 3668760 - DNA, 17 bp, Homo sapiens
ctttctgatcaaggcct

SEQ ID NO: 3668761 - DNA, 18 bp, Homo sapiens
ctttctgatcaaggcctt

SEQ ID NO: 3668762 - DNA, 23 bp, Homo sapiens
ctttctgattccgcaccctgcct

SEQ ID NO: 3668763 - DNA, 15 bp, Homo sapiens
ctttctgcctggagt

SEQ ID NO: 3668764 - DNA, 13 bp, Homo sapiens
ctttctgctcagc

SEQ ID NO: 3668765 - DNA, 14 bp, Homo sapiens
ctttctgctcagct

SEQ ID NO: 3668766 - DNA, 17 bp, Homo sapiens
ctttcttttttctctga

SEQ ID NO: 3668767 - DNA, 16 bp, Homo sapiens
ctttgaatgcggccca

SEQ ID NO: 3668768 - DNA, 17 bp, Homo sapiens
ctttgaatgttaatttt

SEQ ID NO: 3668769 - DNA, 20 bp, Homo sapiens
ctttgactgaagccgtgcct

SEQ ID NO: 3668770 - DNA, 16 bp, Homo sapiens
ctttgagcttaagaat

SEQ ID NO: 3668771 - DNA, 13 bp, Homo sapiens
ctttgaggaacat

SEQ ID NO: 3668772 - DNA, 15 bp, Homo sapiens
ctttgcaaagtattg

SEQ ID NO: 3668773 - DNA, 18 bp, Homo sapiens
ctttgcaatccaaataaa

SEQ ID NO: 3668774 - DNA, 19 bp, Homo sapiens
ctttgcaatccaaataaag

SEQ ID NO: 3668775 - DNA, 14 bp, Homo sapiens
ctttgcagctgccc

SEQ ID NO: 3668776 - DNA, 15 bp, Homo sapiens
ctttgcatttcttgt

SEQ ID NO: 3668777 - DNA, 13 bp, Homo sapiens
ctttgccttgggc

SEQ ID NO: 3668778 - DNA, 18 bp, Homo sapiens
ctttgccttgggctgctc

SEQ ID NO: 3668779 - DNA, 18 bp, Homo sapiens
ctttgctgaagaatattt

SEQ ID NO: 3668780 - DNA, 13 bp, Homo sapiens
ctttgctttctgc

SEQ ID NO: 3668781 - DNA, 14 bp, Homo sapiens
ctttgctttctgct

SEQ ID NO: 3668782 - DNA, 15 bp, Homo sapiens
ctttgctttctgctc

SEQ ID NO: 3668783 - DNA, 17 bp, Homo sapiens
ctttgctttgctttctg

SEQ ID NO: 3668784 - DNA, 18 bp, Homo sapiens
ctttggcaatttcctggc

SEQ ID NO: 3668785 - DNA, 13 bp, Homo sapiens
ctttgggaggcca

SEQ ID NO: 3668786 - DNA, 14 bp, Homo sapiens
ctttgtgacttctt

SEQ ID NO: 3668787 - DNA, 22 bp, Homo sapiens
ctttgtgacttcttcttctttg

SEQ ID NO: 3668788 - DNA, 11 bp, Homo sapiens
ctttgtggcca

SEQ ID NO: 3668789 - DNA, 13 bp, Homo sapiens
ctttgtggccaag

SEQ ID NO: 3668790 - DNA, 15 bp, Homo sapiens
ctttgtggccaagga

SEQ ID NO: 3668791 - DNA, 16 bp, Homo sapiens
ctttgtggccaaggag

SEQ ID NO: 3668792 - DNA, 21 bp, Homo sapiens
ctttgtggccaaggagctgct

SEQ ID NO: 3668793 - DNA, 22 bp, Homo sapiens
ctttgtggccaaggagctgcta

SEQ ID NO: 3668794 - DNA, 18 bp, Homo sapiens
ctttgttcatagcccagt

SEQ ID NO: 3668795 - DNA, 17 bp, Homo sapiens
ctttgtttcgtggggag

SEQ ID NO: 3668796 - DNA, 21 bp, Homo sapiens
ctttgtttgttgtcagctgaa

SEQ ID NO: 3668797 - DNA, 24 bp, Homo sapiens
ctttgttttgatgtttgtggcctc

SEQ ID NO: 3668798 - DNA, 24 bp, Homo sapiens
gaagccaggaatttcccaggaccc

SEQ ID NO: 3668799 - DNA, 17 bp, Homo sapiens
gaagccccacatgtcca

SEQ ID NO: 3668800 - DNA, 21 bp, Homo sapiens
gaagcccccagctaagaacct

SEQ ID NO: 3668801 - DNA, 22 bp, Homo sapiens
gaagcccccagctaagaacctg

SEQ ID NO: 3668802 - DNA, 20 bp, Homo sapiens
gaagcccctgagtcctgagc

SEQ ID NO: 3668803 - DNA, 23 bp, Homo sapiens
gaagcctctcgtcccgtccctcc

SEQ ID NO: 3668804 - DNA, 14 bp, Homo sapiens
gaagcctctggcta

SEQ ID NO: 3668805 - DNA, 14 bp, Homo sapiens
gaagcggctggcag

SEQ ID NO: 3668806 - DNA, 23 bp, Homo sapiens
gaagctcctctccccagcccaga

SEQ ID NO: 3668807 - DNA, 19 bp, Homo sapiens
gaagctgagcaccagggga

SEQ ID NO: 3668808 - DNA, 13 bp, Homo sapiens
gaagctgctccgt

SEQ ID NO: 3668809 - DNA, 14 bp, Homo sapiens
gaaggaggctggct

SEQ ID NO: 3668810 - DNA, 13 bp, Homo sapiens
gaaggcagggctc

SEQ ID NO: 3668811 - DNA, 22 bp, Homo sapiens
gaaggcagggctcctccctgga

SEQ ID NO: 3668812 - DNA, 19 bp, Homo sapiens
gaaggcttgttgtgctttt

SEQ ID NO: 3668813 - DNA, 13 bp, Homo sapiens
gaagggccagagc

SEQ ID NO: 3668814 - DNA, 15 bp, Homo sapiens
gaagggccagagcca

SEQ ID NO: 3668815 - DNA, 21 bp, Homo sapiens
gaaggggcgtctgttccccct

SEQ ID NO: 3668816 - DNA, 17 bp, Homo sapiens
gaaggggtgctgtgagg

SEQ ID NO: 3668817 - DNA, 14 bp, Homo sapiens
gaagggtggctttg

SEQ ID NO: 3668818 - DNA, 15 bp, Homo sapiens
gaaggtcccacagcc

SEQ ID NO: 3668819 - DNA, 21 bp, Homo sapiens
gaaggtcccacagccctgaga

SEQ ID NO: 3668820 - DNA, 22 bp, Homo sapiens
gaaggtcccacagccctgagat

SEQ ID NO: 3668821 - DNA, 18 bp, Homo sapiens
gaaggtgctgacggccag

SEQ ID NO: 3668822 - DNA, 23 bp, Homo sapiens
gaagtccccaggccccaggaagc

SEQ ID NO: 3668823 - DNA, 17 bp, Homo sapiens
gaagtcctctgtggcca

SEQ ID NO: 3668824 - DNA, 20 bp, Homo sapiens
gaagtgggccagtcctggtt

SEQ ID NO: 3668825 - DNA, 21 bp, Homo sapiens
gaagttgaggggagcatgctt

SEQ ID NO: 3668826 - DNA, 14 bp, Homo sapiens
gaataacatttaaa

SEQ ID NO: 3668827 - DNA, 17 bp, Homo sapiens
gaataacatttaaattc

SEQ ID NO: 3668828 - DNA, 18 bp, Homo sapiens
gaatacgcagaactacca

SEQ ID NO: 3668829 - DNA, 21 bp, Homo sapiens
gaatcaggaatattttccaaa

SEQ ID NO: 3668830 - DNA, 20 bp, Homo sapiens
gaatcccggctccagagcag

SEQ ID NO: 3668831 - DNA, 22 bp, Homo sapiens
gaatcccggctccagagcagga

SEQ ID NO: 3668832 - DNA, 20 bp, Homo sapiens
gaatcctagcacttgtctca

SEQ ID NO: 3668833 - DNA, 18 bp, Homo sapiens
gaatcggctttgcagtgc

SEQ ID NO: 3668834 - DNA, 21 bp, Homo sapiens
gaatcttaaggtgtagccaca

SEQ ID NO: 3668835 - DNA, 15 bp, Homo sapiens
gaatcttggtttgcc

SEQ ID NO: 3668836 - DNA, 20 bp, Homo sapiens
gaatcttggtttgccttcca

SEQ ID NO: 3668837 - DNA, 15 bp, Homo sapiens
gaatgcatggggcgg

SEQ ID NO: 3668838 - DNA, 20 bp, Homo sapiens
gaatgccggttaaattccat

SEQ ID NO: 3668839 - DNA, 13 bp, Homo sapiens
gaatgctgggact

SEQ ID NO: 3668840 - DNA, 16 bp, Homo sapiens
gaatgctgggactcag

SEQ ID NO: 3668841 - DNA, 18 bp, Homo sapiens
gaatgtgataaggaaatc

SEQ ID NO: 3668842 - DNA, 13 bp, Homo sapiens
gaatgttaatttt

SEQ ID NO: 3668843 - DNA, 17 bp, Homo sapiens
gaattcctagaattaaa

SEQ ID NO: 3668844 - DNA, 20 bp, Homo sapiens
gaattcctggaacctggacc

SEQ ID NO: 3668845 - DNA, 21 bp, Homo sapiens
gaattgatcattttcccccca

SEQ ID NO: 3668846 - DNA, 22 bp, Homo sapiens
gaatttatcacacttctgtgag

SEQ ID NO: 3668847 - DNA, 14 bp, Homo sapiens
gaatttcccaggac

SEQ ID NO: 3668848 - DNA, 15 bp, Homo sapiens
gaatttcccaggacc

SEQ ID NO: 3668849 - DNA, 19 bp, Homo sapiens
gacaaccactggtctgtag

SEQ ID NO: 3668850 - DNA, 15 bp, Homo sapiens
gacaacgaggaagcc

SEQ ID NO: 3668851 - DNA, 12 bp, Homo sapiens
gacaatgtgaaa

SEQ ID NO: 3668852 - DNA, 13 bp, Homo sapiens
gacaattctgttt

SEQ ID NO: 3668853 - DNA, 13 bp, Homo sapiens
gacacaggccctc

SEQ ID NO: 3668854 - DNA, 16 bp, Homo sapiens
gacacaggtctttcct

SEQ ID NO: 3668855 - DNA, 17 bp, Homo sapiens
gacacaggtctttccta

SEQ ID NO: 3668856 - DNA, 14 bp, Homo sapiens
gacacccaggactt

SEQ ID NO: 3668857 - DNA, 18 bp, Homo sapiens
gacacctgggagaaatct

SEQ ID NO: 3668858 - DNA, 15 bp, Homo sapiens
gacactgactagagt

SEQ ID NO: 3668859 - DNA, 15 bp, Homo sapiens
gacagaagtttgcac

SEQ ID NO: 3668860 - DNA, 22 bp, Homo sapiens
gacagaagtttgcactatcttt

SEQ ID NO: 3668861 - DNA, 21 bp, Homo sapiens
gaggccagccccacccaggag

SEQ ID NO: 3668862 - DNA, 21 bp, Homo sapiens
gaggccatgtgcatagtttct

SEQ ID NO: 3668863 - DNA, 22 bp, Homo sapiens
gaggccatgtgcatagtttctt

SEQ ID NO: 3668864 - DNA, 13 bp, Homo sapiens
gaggcccagttca

SEQ ID NO: 3668865 - DNA, 14 bp, Homo sapiens
gaggccccactggg

SEQ ID NO: 3668866 - DNA, 20 bp, Homo sapiens
gaggcccccagcccagggct

SEQ ID NO: 3668867 - DNA, 14 bp, Homo sapiens
gaggcccctcccag

SEQ ID NO: 3668868 - DNA, 23 bp, Homo sapiens
gaggcccgccctgcccgggctcc

SEQ ID NO: 3668869 - DNA, 18 bp, Homo sapiens
gaggcctaccccgcagac

SEQ ID NO: 3668870 - DNA, 20 bp, Homo sapiens
gaggcctgggccgctgccac

SEQ ID NO: 3668871 - DNA, 21 bp, Homo sapiens
gaggcctgggccgctgccacg

SEQ ID NO: 3668872 - DNA, 14 bp, Homo sapiens
gaggcggggctcta

SEQ ID NO: 3668873 - DNA, 19 bp, Homo sapiens
gaggctgaggcctggactt

SEQ ID NO: 3668874 - DNA, 14 bp, Homo sapiens
gaggctgtcctgta

SEQ ID NO: 3668875 - DNA, 15 bp, Homo sapiens
gaggcttcttcctgg

SEQ ID NO: 3668876 - DNA, 18 bp, Homo sapiens
gaggcttcttcctggatg

SEQ ID NO: 3668877 - DNA, 17 bp, Homo sapiens
gaggcttgcccaggagc

SEQ ID NO: 3668878 - DNA, 23 bp, Homo sapiens
gagggaaagggtcctgctttctc

SEQ ID NO: 3668879 - DNA, 18 bp, Homo sapiens
gagggaccaactgggccc

SEQ ID NO: 3668880 - DNA, 19 bp, Homo sapiens
gagggaccaactgggccca

SEQ ID NO: 3668881 - DNA, 23 bp, Homo sapiens
gagggcacaccgccatcctctgc

SEQ ID NO: 3668882 - DNA, 19 bp, Homo sapiens
gagggcaggtccagctctg

SEQ ID NO: 3668883 - DNA, 20 bp, Homo sapiens
gaggggagcatgcttccctg

SEQ ID NO: 3668884 - DNA, 11 bp, Homo sapiens
gaggggagggg

SEQ ID NO: 3668885 - DNA, 22 bp, Homo sapiens
gaggggccggccctgtgtgcag

SEQ ID NO: 3668886 - DNA, 17 bp, Homo sapiens
gaggggcctaggcctca

SEQ ID NO: 3668887 - DNA, 23 bp, Homo sapiens
gaggggctctgcgttggcttctc

SEQ ID NO: 3668888 - DNA, 14 bp, Homo sapiens
gagggtatttattg

SEQ ID NO: 3668889 - DNA, 21 bp, Homo sapiens
gagggtcctggctcctgaggg

SEQ ID NO: 3668890 - DNA, 12 bp, Homo sapiens
gagggtggaata

SEQ ID NO: 3668891 - DNA, 21 bp, Homo sapiens
gagggtgggcttttccctggg

SEQ ID NO: 3668892 - DNA, 22 bp, Homo sapiens
gaggtcggtaggttcagccaag

SEQ ID NO: 3668893 - DNA, 16 bp, Homo sapiens
gaggtgaaagggagct

SEQ ID NO: 3668894 - DNA, 20 bp, Homo sapiens
gaggtgcggccaccacccta

SEQ ID NO: 3668895 - DNA, 20 bp, Homo sapiens
gaggtgggaggatcttttga

SEQ ID NO: 3668896 - DNA, 17 bp, Homo sapiens
gaggtgggccagtctgt

SEQ ID NO: 3668897 - DNA, 16 bp, Homo sapiens
gaggtgtggagccgag

SEQ ID NO: 3668898 - DNA, 16 bp, Homo sapiens
gaggtttcaaacctcc

SEQ ID NO: 3668899 - DNA, 17 bp, Homo sapiens
gatgggattctggacag

SEQ ID NO: 3668900 - DNA, 19 bp, Homo sapiens
gatggggcagagcttctcc

SEQ ID NO: 3668901 - DNA, 22 bp, Homo sapiens
gatggggtggggtggagaactc

SEQ ID NO: 3668902 - DNA, 23 bp, Homo sapiens
gatgtaacaagggttttaatgta

SEQ ID NO: 3668903 - DNA, 13 bp, Homo sapiens
gatgtaatgtttt

SEQ ID NO: 3668904 - DNA, 14 bp, Homo sapiens
gatgtatacatctt

SEQ ID NO: 3668905 - DNA, 18 bp, Homo sapiens
gatgtcaatttctgtgtt

SEQ ID NO: 3668906 - DNA, 17 bp, Homo sapiens
gatgtgggtcaaggaat

SEQ ID NO: 3668907 - DNA, 20 bp, Homo sapiens
gatgttcagcactgtccctt

SEQ ID NO: 3668908 - DNA, 22 bp, Homo sapiens
gatgttcagcactgtcccttgc

SEQ ID NO: 3668909 - DNA, 14 bp, Homo sapiens
gatgtttgtggcct

SEQ ID NO: 3668910 - DNA, 19 bp, Homo sapiens
gattaaccacttcagctga

SEQ ID NO: 3668911 - DNA, 21 bp, Homo sapiens
gattaaccacttcagctgact

SEQ ID NO: 3668912 - DNA, 18 bp, Homo sapiens
gattaaggcgtggcttct

SEQ ID NO: 3668913 - DNA, 23 bp, Homo sapiens
gattacaggtgtgagccactgca

SEQ ID NO: 3668914 - DNA, 14 bp, Homo sapiens
gattacctgccaat

SEQ ID NO: 3668915 - DNA, 13 bp, Homo sapiens
gattcaaaatatt

SEQ ID NO: 3668916 - DNA, 16 bp, Homo sapiens
gattcaaaatatttaa

SEQ ID NO: 3668917 - DNA, 23 bp, Homo sapiens
gattcaaaatatttaaaaatgtc

SEQ ID NO: 3668918 - DNA, 12 bp, Homo sapiens
gattcaggctgc

SEQ ID NO: 3668919 - DNA, 16 bp, Homo sapiens
gattcggtatcccccc

SEQ ID NO: 3668920 - DNA, 15 bp, Homo sapiens
gattgaattccatta

SEQ ID NO: 3668921 - DNA, 12 bp, Homo sapiens
gattgagaagcc

SEQ ID NO: 3668922 - DNA, 16 bp, Homo sapiens
gattggacggcctgat

SEQ ID NO: 3668923 - DNA, 23 bp, Homo sapiens
gattggacggcctgatgctccct

SEQ ID NO: 3668924 - DNA, 16 bp, Homo sapiens
gatttaaacacacaga

SEQ ID NO: 3668925 - DNA, 14 bp, Homo sapiens
gatttaaactctta

SEQ ID NO: 3668926 - DNA, 19 bp, Homo sapiens
gatttacctcgttctgctc

SEQ ID NO: 3668927 - DNA, 20 bp, Homo sapiens
gatttaggagaagccaggaa

SEQ ID NO: 3668928 - DNA, 19 bp, Homo sapiens
gatttgatgagttaactgt

SEQ ID NO: 3668929 - DNA, 21 bp, Homo sapiens
gatttgatgagttaactgtga

SEQ ID NO: 3668930 - DNA, 19 bp, Homo sapiens
gattttcacattcttggct

SEQ ID NO: 3668931 - DNA, 17 bp, Homo sapiens
gattttgtaagaagttt

SEQ ID NO: 3668932 - DNA, 21 bp, Homo sapiens
gattttttcagacttgtcaag

SEQ ID NO: 3668933 - DNA, 16 bp, Homo sapiens
gcaaaaaagtccaatt

SEQ ID NO: 3668934 - DNA, 18 bp, Homo sapiens
gcaaaaaatactttttct

SEQ ID NO: 3668935 - DNA, 15 bp, Homo sapiens
gcaaaaaattcttta

SEQ ID NO: 3668936 - DNA, 18 bp, Homo sapiens
gcaaaaaattctttagag

SEQ ID NO: 3668937 - DNA, 22 bp, Homo sapiens
gcaaaaaattctttagagatta

SEQ ID NO: 3668938 - DNA, 22 bp, Homo sapiens
gcaaaactctacttaatccaat

SEQ ID NO: 3668939 - DNA, 23 bp, Homo sapiens
gcaaaactctacttaatccaatg

SEQ ID NO: 3668940 - DNA, 17 bp, Homo sapiens
gcaaaagatgcttctca

SEQ ID NO: 3668941 - DNA, 22 bp, Homo sapiens
gcaaaagatgcttctcactgcc

SEQ ID NO: 3668942 - DNA, 20 bp, Homo sapiens
gcaaaaggatctttgtggcc

SEQ ID NO: 3668943 - DNA, 15 bp, Homo sapiens
gcaaaaggctgagaa

SEQ ID NO: 3668944 - DNA, 20 bp, Homo sapiens
gcaaagatctgtcctcagcc

SEQ ID NO: 3668945 - DNA, 13 bp, Homo sapiens
gcaacagatctgg

SEQ ID NO: 3668946 - DNA, 16 bp, Homo sapiens
gcaaccactctgtggc

SEQ ID NO: 3668947 - DNA, 17 bp, Homo sapiens
gcaaccactctgtggcc

SEQ ID NO: 3668948 - DNA, 21 bp, Homo sapiens
gcaaccactctgtggccagcc

SEQ ID NO: 3668949 - DNA, 23 bp, Homo sapiens
gcaaccactctgtggccagcctg

SEQ ID NO: 3668950 - DNA, 18 bp, Homo sapiens
gcaactgcattggctttg

SEQ ID NO: 3668951 - DNA, 17 bp, Homo sapiens
gcaagaaagaaacccga

SEQ ID NO: 3668952 - DNA, 14 bp, Homo sapiens
gcaagaaggaaaga

SEQ ID NO: 3668953 - DNA, 14 bp, Homo sapiens
gcaagcagaggacc

SEQ ID NO: 3668954 - DNA, 13 bp, Homo sapiens
gcaagctgggtaa

SEQ ID NO: 3668955 - DNA, 20 bp, Homo sapiens
gcaaggaccaggactccctc

SEQ ID NO: 3668956 - DNA, 21 bp, Homo sapiens
gcaaggaccaggactccctcc

SEQ ID NO: 3668957 - DNA, 14 bp, Homo sapiens
gcaaggccccttcc

SEQ ID NO: 3668958 - DNA, 16 bp, Homo sapiens
gcaaggccccttccac

SEQ ID NO: 3668959 - DNA, 16 bp, Homo sapiens
gcaaggtgtggaggct

SEQ ID NO: 3668960 - DNA, 21 bp, Homo sapiens
gcaaggtttaggctggtggcc

SEQ ID NO: 3668961 - DNA, 13 bp, Homo sapiens
gcaagtgaggccg

SEQ ID NO: 3668962 - DNA, 16 bp, Homo sapiens
gcaagtgaggccggag

SEQ ID NO: 3668963 - DNA, 20 bp, Homo sapiens
gcaataacctcaaagtgact

SEQ ID NO: 3668964 - DNA, 21 bp, Homo sapiens
gcaatctccccttgatttaaa

SEQ ID NO: 3668965 - DNA, 18 bp, Homo sapiens
gcaattctctttctttta

SEQ ID NO: 3668966 - DNA, 20 bp, Homo sapiens
gcaatttcctggccctccac

SEQ ID NO: 3668967 - DNA, 22 bp, Homo sapiens
gcacaagctgcaccctcaggca

SEQ ID NO: 3668968 - DNA, 13 bp, Homo sapiens
gcacactcagtgg

SEQ ID NO: 3668969 - DNA, 17 bp, Homo sapiens
gcacagcccaaagaagg

SEQ ID NO: 3668970 - DNA, 16 bp, Homo sapiens
gcacagctgtagtggg

SEQ ID NO: 3668971 - DNA, 15 bp, Homo sapiens
gcacaggaggcaggc

SEQ ID NO: 3668972 - DNA, 21 bp, Homo sapiens
gcacaggaggcaggcatggcc

SEQ ID NO: 3668973 - DNA, 17 bp, Homo sapiens
gcacagggtctgctctt

SEQ ID NO: 3668974 - DNA, 18 bp, Homo sapiens
gcacagggtctgctcttt

SEQ ID NO: 3668975 - DNA, 20 bp, Homo sapiens
gcacatccgcgtgtgcctgt

SEQ ID NO: 3668976 - DNA, 13 bp, Homo sapiens
gcacatgactcgg

SEQ ID NO: 3668977 - DNA, 17 bp, Homo sapiens
gcaccaccaagccaagg

SEQ ID NO: 3668978 - DNA, 18 bp, Homo sapiens
gcaccaccaagccaaggg

SEQ ID NO: 3668979 - DNA, 23 bp, Homo sapiens
gcaccaccctagtcccttcccct

SEQ ID NO: 3668980 - DNA, 21 bp, Homo sapiens
gcaccactgcactccagcctg

SEQ ID NO: 3668981 - DNA, 21 bp, Homo sapiens
gcaccagacacccaggactta

SEQ ID NO: 3668982 - DNA, 15 bp, Homo sapiens
gcaccagcagcctgg

SEQ ID NO: 3668983 - DNA, 19 bp, Homo sapiens
gcaccagccagcgtagcag

SEQ ID NO: 3668984 - DNA, 17 bp, Homo sapiens
gaccaggggccctacct

SEQ ID NO: 3668985 - DNA, 19 bp, Homo sapiens
gaccatccactctaccctc

SEQ ID NO: 3668986 - DNA, 23 bp, Homo sapiens
gaccatccactctaccctcccac

SEQ ID NO: 3668987 - DNA, 21 bp, Homo sapiens
gaccatgctcatctgctggtc

SEQ ID NO: 3668988 - DNA, 13 bp, Homo sapiens
gacccagtgcaga

SEQ ID NO: 3668989 - DNA, 15 bp, Homo sapiens
gacccagtgccccca

SEQ ID NO: 3668990 - DNA, 17 bp, Homo sapiens
gacccagtgcccccact

SEQ ID NO: 3668991 - DNA, 17 bp, Homo sapiens
gaccccagcccagacag

SEQ ID NO: 3668992 - DNA, 14 bp, Homo sapiens
gaccccagccttgg

SEQ ID NO: 3668993 - DNA, 15 bp, Homo sapiens
gacccccacacctca

SEQ ID NO: 3668994 - DNA, 18 bp, Homo sapiens
gaccctctttgctgaaga

SEQ ID NO: 3668995 - DNA, 20 bp, Homo sapiens
gaccctgagctgaccagccg

SEQ ID NO: 3668996 - DNA, 17 bp, Homo sapiens
gaccggacttttctgca

SEQ ID NO: 3668997 - DNA, 20 bp, Homo sapiens
gacctaaatggcctcatgtg

SEQ ID NO: 3668998 - DNA, 14 bp, Homo sapiens
gacctgaggaagcg

SEQ ID NO: 3668999 - DNA, 15 bp, Homo sapiens
gacctgatcctggag

SEQ ID NO: 3669000 - DNA, 18 bp, Homo sapiens
gacctgatcctggaggcc

SEQ ID NO: 3669001 - DNA, 21 bp, Homo sapiens
gacctgatcctggaggcccag

SEQ ID NO: 3669002 - DNA, 15 bp, Homo sapiens
gacctggcagctctg

SEQ ID NO: 3669003 - DNA, 16 bp, Homo sapiens
gacctggcagctctgg

SEQ ID NO: 3669004 - DNA, 21 bp, Homo sapiens
gacctgtatatttgtaaagct

SEQ ID NO: 3669005 - DNA, 21 bp, Homo sapiens
gaccttcatgcccttctgatt

SEQ ID NO: 3669006 - DNA, 17 bp, Homo sapiens
gaccttgttacttctga

SEQ ID NO: 3669007 - DNA, 23 bp, Homo sapiens
gacctttccaccacagccagcac

SEQ ID NO: 3669008 - DNA, 16 bp, Homo sapiens
gacggccaagaatgta

SEQ ID NO: 3669009 - DNA, 22 bp, Homo sapiens
gacggcctgatgctccctcccc

SEQ ID NO: 3669010 - DNA, 23 bp, Homo sapiens
gacgggcggtcctactgctgtga

SEQ ID NO: 3669011 - DNA, 17 bp, Homo sapiens
gacggggctcccctgga

SEQ ID NO: 3669012 - DNA, 23 bp, Homo sapiens
gacggggctcccctggacagagg

SEQ ID NO: 3669013 - DNA, 16 bp, Homo sapiens
gacggtgcccaagcca

SEQ ID NO: 3669014 - DNA, 23 bp, Homo sapiens
gacggtgcccaagccagaggctg

SEQ ID NO: 3669015 - DNA, 15 bp, Homo sapiens
gacggtttccaggga

SEQ ID NO: 3669016 - DNA, 12 bp, Homo sapiens
gactaacaaagg

SEQ ID NO: 3669017 - DNA, 17 bp, Homo sapiens
gactaacaaaggcagct

SEQ ID NO: 3669018 - DNA, 17 bp, Homo sapiens
gactactcccccaggtg

SEQ ID NO: 3669019 - DNA, 18 bp, Homo sapiens
gactatctgtctggtggc

SEQ ID NO: 3669020 - DNA, 17 bp, Homo sapiens
gactattccttttctgt

SEQ ID NO: 3669021 - DNA, 23 bp, Homo sapiens
gactcaaggactgaattgtttta

SEQ ID NO: 3669022 - DNA, 23 bp, Homo sapiens
gactcacttatcccaagagaatg

SEQ ID NO: 3669023 - DNA, 13 bp, Homo sapiens
gactcagccctga

SEQ ID NO: 3669024 - DNA, 15 bp, Homo sapiens
gactcagccctgagg

SEQ ID NO: 3669025 - DNA, 16 bp, Homo sapiens
gactcagccctgaggt

SEQ ID NO: 3669026 - DNA, 14 bp, Homo sapiens
gactcagccttcag

SEQ ID NO: 3669027 - DNA, 18 bp, Homo sapiens
gactcatccgcctggccc

SEQ ID NO: 3669028 - DNA, 12 bp, Homo sapiens
gactccctcctc

SEQ ID NO: 3669029 - DNA, 14 bp, Homo sapiens
gactccctcctcac

SEQ ID NO: 3669030 - DNA, 23 bp, Homo sapiens
gactccctcctcacctctggact

SEQ ID NO: 3669031 - DNA, 16 bp, Homo sapiens
gactccgttggccact

SEQ ID NO: 3669032 - DNA, 15 bp, Homo sapiens
gactcctccctgggg

SEQ ID NO: 3669033 - DNA, 21 bp, Homo sapiens
gactcctccctgggggtgggg

SEQ ID NO: 3669034 - DNA, 19 bp, Homo sapiens
gactctacctcatatcagt

SEQ ID NO: 3669035 - DNA, 23 bp, Homo sapiens
gactctacctcatatcagtttgc

SEQ ID NO: 3669036 - DNA, 17 bp, Homo sapiens
gactctaggtgcccttg

SEQ ID NO: 3669037 - DNA, 17 bp, Homo sapiens
gactctgaaactataga

SEQ ID NO: 3669038 - DNA, 13 bp, Homo sapiens
gactgcccggcag

SEQ ID NO: 3669039 - DNA, 18 bp, Homo sapiens
gactgctacctctgagaa

SEQ ID NO: 3669040 - DNA, 19 bp, Homo sapiens
gactgctacctctgagaag

SEQ ID NO: 3669041 - DNA, 20 bp, Homo sapiens
gactgctacctctgagaaga

SEQ ID NO: 3669042 - DNA, 20 bp, Homo sapiens
gactggctagagtcctcact

SEQ ID NO: 3669043 - DNA, 15 bp, Homo sapiens
gactggtgctgcagc

SEQ ID NO: 3669044 - DNA, 20 bp, Homo sapiens
gactgtgtttcgtgaactgc

SEQ ID NO: 3669045 - DNA, 22 bp, Homo sapiens
gactgttactttggcaatttcc

SEQ ID NO: 3669046 - DNA, 21 bp, Homo sapiens
gactgttcttggtaactgatt

SEQ ID NO: 3669047 - DNA, 16 bp, Homo sapiens
gacttagggcaccagg

SEQ ID NO: 3669048 - DNA, 22 bp, Homo sapiens
gacttcctgtccagctccaacc

SEQ ID NO: 3669049 - DNA, 15 bp, Homo sapiens
gacttcgcagaggca

SEQ ID NO: 3669050 - DNA, 14 bp, Homo sapiens
gacttctacccaga

SEQ ID NO: 3669051 - DNA, 17 bp, Homo sapiens
gacttctgcctggagac

SEQ ID NO: 3669052 - DNA, 18 bp, Homo sapiens
gcagagggcatcggggcc

SEQ ID NO: 3669053 - DNA, 18 bp, Homo sapiens
gcagaggtaccctgggtg

SEQ ID NO: 3669054 - DNA, 19 bp, Homo sapiens
gcagaggtaccctgggtgt

SEQ ID NO: 3669055 - DNA, 20 bp, Homo sapiens
gcagatcttccgtggtcaga

SEQ ID NO: 3669056 - DNA, 22 bp, Homo sapiens
gcagatgcaaagaggcaagagg

SEQ ID NO: 3669057 - DNA, 20 bp, Homo sapiens
gcagcaggtggcagaatggg

SEQ ID NO: 3669058 - DNA, 14 bp, Homo sapiens
gcagccaggctgcc

SEQ ID NO: 3669059 - DNA, 18 bp, Homo sapiens
gcagcccatgcccacctg

SEQ ID NO: 3669060 - DNA, 22 bp, Homo sapiens
gcagcccatgcccacctgccca

SEQ ID NO: 3669061 - DNA, 12 bp, Homo sapiens
gcagcctctccc

SEQ ID NO: 3669062 - DNA, 14 bp, Homo sapiens
gcagcctgtggcat

SEQ ID NO: 3669063 - DNA, 21 bp, Homo sapiens
gcagcgagggcggagccggcc

SEQ ID NO: 3669064 - DNA, 13 bp, Homo sapiens
gcagcgcctttcc

SEQ ID NO: 3669065 - DNA, 19 bp, Homo sapiens
gcagcgtgccgagccagca

SEQ ID NO: 3669066 - DNA, 18 bp, Homo sapiens
gcagctcaagagatccca

SEQ ID NO: 3669067 - DNA, 12 bp, Homo sapiens
gcagctggcagg

SEQ ID NO: 3669068 - DNA, 15 bp, Homo sapiens
gcagctggcaggagt

SEQ ID NO: 3669069 - DNA, 19 bp, Homo sapiens
gcagctgtgtctgagccca

SEQ ID NO: 3669070 - DNA, 21 bp, Homo sapiens
gcaggaaattcagcccaccag

SEQ ID NO: 3669071 - DNA, 15 bp, Homo sapiens
gcaggaagctgctcc

SEQ ID NO: 3669072 - DNA, 23 bp, Homo sapiens
gcaggaaggagagcctgctgcat

SEQ ID NO: 3669073 - DNA, 22 bp, Homo sapiens
gcaggaatcccggctccagagc

SEQ ID NO: 3669074 - DNA, 18 bp, Homo sapiens
gcaggacaacgaggaagc

SEQ ID NO: 3669075 - DNA, 11 bp, Homo sapiens
gcaggactccc

SEQ ID NO: 3669076 - DNA, 12 bp, Homo sapiens
gcaggactccca

SEQ ID NO: 3669077 - DNA, 19 bp, Homo sapiens
gcaggactttgaggcaagt

SEQ ID NO: 3669078 - DNA, 22 bp, Homo sapiens
gcaggagggccctacctgattg

SEQ ID NO: 3669079 - DNA, 18 bp, Homo sapiens
gcaggcaggctcccaggg

SEQ ID NO: 3669080 - DNA, 13 bp, Homo sapiens
gcaggcagggctg

SEQ ID NO: 3669081 - DNA, 9 bp, Homo sapiens
gcaggcagt

SEQ ID NO: 3669082 - DNA, 19 bp, Homo sapiens
gcaggcatggccctgggcg

SEQ ID NO: 3669083 - DNA, 12 bp, Homo sapiens
gcaggccctggc

SEQ ID NO: 3669084 - DNA, 23 bp, Homo sapiens
gcaggcggggctcctcctgaagg

SEQ ID NO: 3669085 - DNA, 14 bp, Homo sapiens
gcaggctggccagt

SEQ ID NO: 3669086 - DNA, 22 bp, Homo sapiens
gcaggctggccagtccaggctg

SEQ ID NO: 3669087 - DNA, 23 bp, Homo sapiens
gcagggaagccccacatgtccag

SEQ ID NO: 3669088 - DNA, 15 bp, Homo sapiens
gcagggaattcctgg

SEQ ID NO: 3669089 - DNA, 13 bp, Homo sapiens
gcagggatgccct

SEQ ID NO: 3669090 - DNA, 23 bp, Homo sapiens
gcagggatgccctggaggtggct

SEQ ID NO: 3669091 - DNA, 13 bp, Homo sapiens
gcagggccatggc

SEQ ID NO: 3669092 - DNA, 18 bp, Homo sapiens
gcagggccatggctcagg

SEQ ID NO: 3669093 - DNA, 20 bp, Homo sapiens
gcagggctcctccctggagc

SEQ ID NO: 3669094 - DNA, 22 bp, Homo sapiens
gcaggtccagctctgtgggccc

SEQ ID NO: 3669095 - DNA, 23 bp, Homo sapiens
gcagtaattaatatctcctggaa

SEQ ID NO: 3669096 - DNA, 19 bp, Homo sapiens
gcagtactcctccctgggg

SEQ ID NO: 3669097 - DNA, 20 bp, Homo sapiens
gcagtactcctccctggggg

SEQ ID NO: 3669098 - DNA, 12 bp, Homo sapiens
gcagtatatttc

SEQ ID NO: 3669099 - DNA, 23 bp, Homo sapiens
gcagtcatcttgaccaagcagga

SEQ ID NO: 3669100 - DNA, 22 bp, Homo sapiens
gcagtgcgcgtgcacgtggaga

SEQ ID NO: 3669101 - DNA, 23 bp, Homo sapiens
gcagtggaggtggggtgtttggg

SEQ ID NO: 3669102 - DNA, 20 bp, Homo sapiens
gcagtggctggtccagggct

SEQ ID NO: 3669103 - DNA, 21 bp, Homo sapiens
gcagtgtgcactaaggggccc

SEQ ID NO: 3669104 - DNA, 17 bp, Homo sapiens
gcagtgtggggagggca

SEQ ID NO: 3669105 - DNA, 19 bp, Homo sapiens
gcagtgtggggagggcagg

SEQ ID NO: 3669106 - DNA, 17 bp, Homo sapiens
gcagttcttgtggaaga

SEQ ID NO: 3669107 - DNA, 21 bp, Homo sapiens
gcagttttgttttaaaactgg

SEQ ID NO: 3669108 - DNA, 13 bp, Homo sapiens
gcataagaaatgt

SEQ ID NO: 3669109 - DNA, 16 bp, Homo sapiens
gcatactttgtaaata

SEQ ID NO: 3669110 - DNA, 20 bp, Homo sapiens
gcataggtctctttgctttc

SEQ ID NO: 3669111 - DNA, 15 bp, Homo sapiens
gcatagtttctttat

SEQ ID NO: 3669112 - DNA, 20 bp, Homo sapiens
gcatcagtttaggccttggc

SEQ ID NO: 3669113 - DNA, 18 bp, Homo sapiens
gcatcctatgcttaataa

SEQ ID NO: 3669114 - DNA, 21 bp, Homo sapiens
gcatcctatgcttaataaaag

SEQ ID NO: 3669115 - DNA, 22 bp, Homo sapiens
gcatcggggccatttggccggc

SEQ ID NO: 3669116 - DNA, 23 bp, Homo sapiens
gcatcggggccatttggccggct

SEQ ID NO: 3669117 - DNA, 15 bp, Homo sapiens
gcatctgaccagcag

SEQ ID NO: 3669118 - DNA, 18 bp, Homo sapiens
gcatctgaccagcagcgc

SEQ ID NO: 3669119 - DNA, 12 bp, Homo sapiens
gcatctgcccct

SEQ ID NO: 3669120 - DNA, 15 bp, Homo sapiens
gcatctgcccctccc

SEQ ID NO: 3669121 - DNA, 18 bp, Homo sapiens
gcatctgtctgaatggtg

SEQ ID NO: 3669122 - DNA, 15 bp, Homo sapiens
gcatcttgcctccag

SEQ ID NO: 3669123 - DNA, 15 bp, Homo sapiens
gcatctttgccttgg

SEQ ID NO: 3669124 - DNA, 18 bp, Homo sapiens
gcatctttgccttgggct

SEQ ID NO: 3669125 - DNA, 13 bp, Homo sapiens
gcatgaaggtttc

SEQ ID NO: 3669126 - DNA, 21 bp, Homo sapiens
gcatgaataacatttaaattc

SEQ ID NO: 3669127 - DNA, 23 bp, Homo sapiens
gcatgcattgagctgcctccagc

SEQ ID NO: 3669128 - DNA, 12 bp, Homo sapiens
gcatgctggagt

SEQ ID NO: 3669129 - DNA, 19 bp, Homo sapiens
gcatgctggagtacccagc

SEQ ID NO: 3669130 - DNA, 21 bp, Homo sapiens
gcatgctggagtacccagcct

SEQ ID NO: 3669131 - DNA, 20 bp, Homo sapiens
gcatgcttccctgcagctga

SEQ ID NO: 3669132 - DNA, 17 bp, Homo sapiens
gcatggggcgggtccta

SEQ ID NO: 3669133 - DNA, 20 bp, Homo sapiens
gcatggggcgggtcctagct

SEQ ID NO: 3669134 - DNA, 22 bp, Homo sapiens
gcatggggcgggtcctagctgt

SEQ ID NO: 3669135 - DNA, 19 bp, Homo sapiens
gcatggtgccccaggacca

SEQ ID NO: 3669136 - DNA, 14 bp, Homo sapiens
gcatggtggccaga

SEQ ID NO: 3669137 - DNA, 15 bp, Homo sapiens
gcatgtcttttaaaa

SEQ ID NO: 3669138 - DNA, 15 bp, Homo sapiens
gcattccagcccctc

SEQ ID NO: 3669139 - DNA, 23 bp, Homo sapiens
gcattgagctgcctccagcctgg

SEQ ID NO: 3669140 - DNA, 16 bp, Homo sapiens
gcattgatccaggaga

SEQ ID NO: 3669141 - DNA, 19 bp, Homo sapiens
gcatttcacaaaacagcct

SEQ ID NO: 3669142 - DNA, 20 bp, Homo sapiens
gcatttcacaaaacagcctt

SEQ ID NO: 3669143 - DNA, 19 bp, Homo sapiens
gccaaaaaggatacataat

SEQ ID NO: 3669144 - DNA, 16 bp, Homo sapiens
gccaaagcctcctcca

SEQ ID NO: 3669145 - DNA, 17 bp, Homo sapiens
gccaaatatgtcctggg

SEQ ID NO: 3669146 - DNA, 13 bp, Homo sapiens
gccaagaatgtac

SEQ ID NO: 3669147 - DNA, 12 bp, Homo sapiens
gccaagcagcca

SEQ ID NO: 3669148 - DNA, 16 bp, Homo sapiens
gccaagctccaagccc

SEQ ID NO: 3669149 - DNA, 16 bp, Homo sapiens
gccaagctccttggga

SEQ ID NO: 3669150 - DNA, 17 bp, Homo sapiens
gccaagctccttgggag

SEQ ID NO: 3669151 - DNA, 21 bp, Homo sapiens
gccaaggccagagtggcctgg

SEQ ID NO: 3669152 - DNA, 19 bp, Homo sapiens
gccaagggaacctgtgtcc

SEQ ID NO: 3669153 - DNA, 18 bp, Homo sapiens
gccaaggggcttcaggtc

SEQ ID NO: 3669154 - DNA, 23 bp, Homo sapiens
gccaaggtgggaggattgcttga

SEQ ID NO: 3669155 - DNA, 23 bp, Homo sapiens
gccaatggcccggcccctcctga

SEQ ID NO: 3669156 - DNA, 20 bp, Homo sapiens
gccacaaagctaggatggtt

SEQ ID NO: 3669157 - DNA, 17 bp, Homo sapiens
gccacaaggacttcctg

SEQ ID NO: 3669158 - DNA, 19 bp, Homo sapiens
gccacaaggacttcctgtc

SEQ ID NO: 3669159 - DNA, 20 bp, Homo sapiens
gccaccaggccacctcccca

SEQ ID NO: 3669160 - DNA, 20 bp, Homo sapiens
gccaccaggtgcctttcaaa

SEQ ID NO: 3669161 - DNA, 22 bp, Homo sapiens
gccaccatgcctcactaatttt

SEQ ID NO: 3669162 - DNA, 18 bp, Homo sapiens
gccacccacctccctgcc

SEQ ID NO: 3669163 - DNA, 18 bp, Homo sapiens
gccaccccgggctctctg

SEQ ID NO: 3669164 - DNA, 16 bp, Homo sapiens
gcctccatccaaggcc

SEQ ID NO: 3669165 - DNA, 13 bp, Homo sapiens
gcctcccagcccc

SEQ ID NO: 3669166 - DNA, 13 bp, Homo sapiens
gcctcggcccctc

SEQ ID NO: 3669167 - DNA, 18 bp, Homo sapiens
gcctctccccaggtccag

SEQ ID NO: 3669168 - DNA, 19 bp, Homo sapiens
gcctctggctagaggccag

SEQ ID NO: 3669169 - DNA, 22 bp, Homo sapiens
gcctctggctagaggccagccc

SEQ ID NO: 3669170 - DNA, 11 bp, Homo sapiens
gcctctgtgct

SEQ ID NO: 3669171 - DNA, 12 bp, Homo sapiens
gcctctgtgctg

SEQ ID NO: 3669172 - DNA, 23 bp, Homo sapiens
gcctcttctctactctagggaaa

SEQ ID NO: 3669173 - DNA, 19 bp, Homo sapiens
gcctcttctgtcccaagtc

SEQ ID NO: 3669174 - DNA, 18 bp, Homo sapiens
gcctcttgagcagtggct

SEQ ID NO: 3669175 - DNA, 20 bp, Homo sapiens
gcctcttgagcagtggctgg

SEQ ID NO: 3669176 - DNA, 21 bp, Homo sapiens
gctagtcaagctcctcctccc

SEQ ID NO: 3669177 - DNA, 21 bp, Homo sapiens
gctagtgacttgtgtcccatg

SEQ ID NO: 3669178 - DNA, 20 bp, Homo sapiens
gctagtgtctcctctctggt

SEQ ID NO: 3669179 - DNA, 20 bp, Homo sapiens
gctataactatgttgataaa

SEQ ID NO: 3669180 - DNA, 17 bp, Homo sapiens
gctatgggagccccagg

SEQ ID NO: 3669181 - DNA, 16 bp, Homo sapiens
gctattggaggatcag

SEQ ID NO: 3669182 - DNA, 22 bp, Homo sapiens
gctatttatgggcccctggcac

SEQ ID NO: 3669183 - DNA, 13 bp, Homo sapiens
gctcacacacctg

SEQ ID NO: 3669184 - DNA, 12 bp, Homo sapiens
gctcacctgggg

SEQ ID NO: 3669185 - DNA, 17 bp, Homo sapiens
gctcagcaaaagatgct

SEQ ID NO: 3669186 - DNA, 23 bp, Homo sapiens
gctcagcaaaagatgcttctcac

SEQ ID NO: 3669187 - DNA, 21 bp, Homo sapiens
gctcagctgcgcccccttctt

SEQ ID NO: 3669188 - DNA, 16 bp, Homo sapiens
gctcagcttctcctgt

SEQ ID NO: 3669189 - DNA, 19 bp, Homo sapiens
gctcagggccatgctgagg

SEQ ID NO: 3669190 - DNA, 13 bp, Homo sapiens
gctcatctgctgg

SEQ ID NO: 3669191 - DNA, 15 bp, Homo sapiens
gctccaacctgcaaa

SEQ ID NO: 3669192 - DNA, 16 bp, Homo sapiens
gctccaagccccatct

SEQ ID NO: 3669193 - DNA, 21 bp, Homo sapiens
gctccaaggggaatcagaact

SEQ ID NO: 3669194 - DNA, 19 bp, Homo sapiens
gctccaatggggcggggct

SEQ ID NO: 3669195 - DNA, 15 bp, Homo sapiens
gctccaccacatcct

SEQ ID NO: 3669196 - DNA, 13 bp, Homo sapiens
gctccacccttgg

SEQ ID NO: 3669197 - DNA, 19 bp, Homo sapiens
gctccacccttggcctgtc

SEQ ID NO: 3669198 - DNA, 22 bp, Homo sapiens
gctccacccttggcctgtctca

SEQ ID NO: 3669199 - DNA, 16 bp, Homo sapiens
gctccactctgcttct

SEQ ID NO: 3669200 - DNA, 17 bp, Homo sapiens
gctccactctgcttctc

SEQ ID NO: 3669201 - DNA, 16 bp, Homo sapiens
gctccactgccatgta

SEQ ID NO: 3669202 - DNA, 21 bp, Homo sapiens
gctccagcgatctctccactg

SEQ ID NO: 3669203 - DNA, 21 bp, Homo sapiens
gctccagctgttcagctggtt

SEQ ID NO: 3669204 - DNA, 20 bp, Homo sapiens
gctccaggatggggaggggc

SEQ ID NO: 3669205 - DNA, 23 bp, Homo sapiens
gctcccacaccgtcaggtactcc

SEQ ID NO: 3669206 - DNA, 16 bp, Homo sapiens
gctccccctggacggg

SEQ ID NO: 3669207 - DNA, 19 bp, Homo sapiens
gctcccctggacagaggcg

SEQ ID NO: 3669208 - DNA, 23 bp, Homo sapiens
gctcccggccttgtgtgatttta

SEQ ID NO: 3669209 - DNA, 19 bp, Homo sapiens
gctccctcccctgccctgg

SEQ ID NO: 3669210 - DNA, 20 bp, Homo sapiens
gctccctcccctgccctggt

SEQ ID NO: 3669211 - DNA, 23 bp, Homo sapiens
gctccctcccctgccctggtcca

SEQ ID NO: 3669212 - DNA, 12 bp, Homo sapiens
gctccctgaggg

SEQ ID NO: 3669213 - DNA, 21 bp, Homo sapiens
gctccggcctctgcctttgca

SEQ ID NO: 3669214 - DNA, 15 bp, Homo sapiens
gctcctacctggggg

SEQ ID NO: 3669215 - DNA, 14 bp, Homo sapiens
gctcctagagggag

SEQ ID NO: 3669216 - DNA, 13 bp, Homo sapiens
gctcctccctgga

SEQ ID NO: 3669217 - DNA, 18 bp, Homo sapiens
gctcctcctccctgcatc

SEQ ID NO: 3669218 - DNA, 14 bp, Homo sapiens
gctcctcctgaagg

SEQ ID NO: 3669219 - DNA, 12 bp, Homo sapiens
gctcctctgttt

SEQ ID NO: 3669220 - DNA, 12 bp, Homo sapiens
gctcctgcactt

SEQ ID NO: 3669221 - DNA, 12 bp, Homo sapiens
gctcctgcccac

SEQ ID NO: 3669222 - DNA, 11 bp, Homo sapiens
gctcctgtggt

SEQ ID NO: 3669223 - DNA, 17 bp, Homo sapiens
gctccttgctgcattga

SEQ ID NO: 3669224 - DNA, 18 bp, Homo sapiens
gctcgcgaaggtcccaca

SEQ ID NO: 3669225 - DNA, 21 bp, Homo sapiens
gctcgcgaaggtcccacagcc

SEQ ID NO: 3669226 - DNA, 12 bp, Homo sapiens
gctctaggatgg

SEQ ID NO: 3669227 - DNA, 11 bp, Homo sapiens
gctctctgctg

SEQ ID NO: 3669228 - DNA, 18 bp, Homo sapiens
gctctgcgttggcttctc

SEQ ID NO: 3669229 - DNA, 23 bp, Homo sapiens
gctctgcgttggcttctccctgg

SEQ ID NO: 3669230 - DNA, 15 bp, Homo sapiens
gctctggaggggagg

SEQ ID NO: 3669231 - DNA, 16 bp, Homo sapiens
gctctggaggggaggg

SEQ ID NO: 3669232 - DNA, 20 bp, Homo sapiens
gctctggggtaggctgctcc

SEQ ID NO: 3669233 - DNA, 18 bp, Homo sapiens
gctctgggtgggcgtggc

SEQ ID NO: 3669234 - DNA, 15 bp, Homo sapiens
gctctggtggccact

SEQ ID NO: 3669235 - DNA, 16 bp, Homo sapiens
gctctggtggccactg

SEQ ID NO: 3669236 - DNA, 22 bp, Homo sapiens
gctctggtggccactgagctgg

SEQ ID NO: 3669237 - DNA, 23 bp, Homo sapiens
gctctggtggccactgagctggc

SEQ ID NO: 3669238 - DNA, 16 bp, Homo sapiens
gctctgtctcccaggc

SEQ ID NO: 3669239 - DNA, 16 bp, Homo sapiens
gctcttagcagcttcc

SEQ ID NO: 3669240 - DNA, 12 bp, Homo sapiens
gctcttcaggcc

SEQ ID NO: 3669241 - DNA, 15 bp, Homo sapiens
gctcttcaggcctcc

SEQ ID NO: 3669242 - DNA, 18 bp, Homo sapiens
gctcttcaggcctccctc

SEQ ID NO: 3669243 - DNA, 14 bp, Homo sapiens
gctcttctgccggc

SEQ ID NO: 3669244 - DNA, 21 bp, Homo sapiens
gctctttctctgccagtgaca

SEQ ID NO: 3669245 - DNA, 21 bp, Homo sapiens
gctctttgaaatagtctgtgt

SEQ ID NO: 3669246 - DNA, 13 bp, Homo sapiens
gctctttgtagct

SEQ ID NO: 3669247 - DNA, 18 bp, Homo sapiens
gctgaaattctcctggag

SEQ ID NO: 3669248 - DNA, 15 bp, Homo sapiens
gctgaattttctgga

SEQ ID NO: 3669249 - DNA, 21 bp, Homo sapiens
gctgaccatgctcatctgctg

SEQ ID NO: 3669250 - DNA, 22 bp, Homo sapiens
gctgaccatgctcatctgctgg

SEQ ID NO: 3669251 - DNA, 15 bp, Homo sapiens
gctgacgtgtgaggg

SEQ ID NO: 3669252 - DNA, 23 bp, Homo sapiens
gctgactagaagggccagtcctg

SEQ ID NO: 3669253 - DNA, 17 bp, Homo sapiens
gctgactgttcttggta

SEQ ID NO: 3669254 - DNA, 17 bp, Homo sapiens
gctgagcaccaggggat

SEQ ID NO: 3669255 - DNA, 13 bp, Homo sapiens
gctgagcccctgt

SEQ ID NO: 3669256 - DNA, 15 bp, Homo sapiens
gctgagcccctgtct

SEQ ID NO: 3669257 - DNA, 19 bp, Homo sapiens
gctgagcctgcagggaagc

SEQ ID NO: 3669258 - DNA, 21 bp, Homo sapiens
gctgagctgcccctgctgctt

SEQ ID NO: 3669259 - DNA, 22 bp, Homo sapiens
gctgaggaaaggccagctggca

SEQ ID NO: 3669260 - DNA, 14 bp, Homo sapiens
gctgaggcaattct

SEQ ID NO: 3669261 - DNA, 13 bp, Homo sapiens
gctgaggcctggg

SEQ ID NO: 3669262 - DNA, 16 bp, Homo sapiens
gctgaggcctgggccg

SEQ ID NO: 3669263 - DNA, 23 bp, Homo sapiens
gctgaggcctgggccgctgccac

SEQ ID NO: 3669264 - DNA, 23 bp, Homo sapiens
gctgagggtgagtgggtgaataa

SEQ ID NO: 3669265 - DNA, 19 bp, Homo sapiens
gctgagtggcaggggacag

SEQ ID NO: 3669266 - DNA, 22 bp, Homo sapiens
gctgagtgggggatcacagcct

SEQ ID NO: 3669267 - DNA, 23 bp, Homo sapiens
gctgagtgggggatcacagcctc

SEQ ID NO: 3669268 - DNA, 13 bp, Homo sapiens
gctgagttggtgt

SEQ ID NO: 3669269 - DNA, 22 bp, Homo sapiens
gctgatggtgtggcctgtggct

SEQ ID NO: 3669270 - DNA, 13 bp, Homo sapiens
gctgcaccctcag

SEQ ID NO: 3669271 - DNA, 16 bp, Homo sapiens
gctgcaccctcaggca

SEQ ID NO: 3669272 - DNA, 16 bp, Homo sapiens
gctgcagcaccgaggg

SEQ ID NO: 3669273 - DNA, 20 bp, Homo sapiens
gctgcagcaccgaggggcct

SEQ ID NO: 3669274 - DNA, 14 bp, Homo sapiens
gctgcagttcttgt

SEQ ID NO: 3669275 - DNA, 18 bp, Homo sapiens
gctgccaaggccagagtg

SEQ ID NO: 3669276 - DNA, 22 bp, Homo sapiens
gctgccaaggccagagtggcct

SEQ ID NO: 3669277 - DNA, 17 bp, Homo sapiens
gctgccacccacctccc

SEQ ID NO: 3669278 - DNA, 22 bp, Homo sapiens
gctgccacccacctccctgcct

SEQ ID NO: 3669279 - DNA, 14 bp, Homo sapiens
gctgcccagagctg

SEQ ID NO: 3669280 - DNA, 13 bp, Homo sapiens
gctgcccagcccc

SEQ ID NO: 3669281 - DNA, 21 bp, Homo sapiens
gctgcccagcccctcctccct

SEQ ID NO: 3669282 - DNA, 17 bp, Homo sapiens
gctgcccctggctctga

SEQ ID NO: 3669283 - DNA, 22 bp, Homo sapiens
gctgccgtggggccgccgcctc

SEQ ID NO: 3669284 - DNA, 18 bp, Homo sapiens
ggtagatcacgagatcaa

SEQ ID NO: 3669285 - DNA, 18 bp, Homo sapiens
ggtagctgcccctggctc

SEQ ID NO: 3669286 - DNA, 19 bp, Homo sapiens
ggtaggctgctccctgagg

SEQ ID NO: 3669287 - DNA, 20 bp, Homo sapiens
ggtaggctgctccctgaggg

SEQ ID NO: 3669288 - DNA, 16 bp, Homo sapiens
ggtaggcttctacctg

SEQ ID NO: 3669289 - DNA, 18 bp, Homo sapiens
ggtaggcttctacctgca

SEQ ID NO: 3669290 - DNA, 20 bp, Homo sapiens
ggtagtcctcccaagctgtg

SEQ ID NO: 3669291 - DNA, 24 bp, Homo sapiens
ggtagtcctcccaagctgtgctgg

SEQ ID NO: 3669292 - DNA, 18 bp, Homo sapiens
ggtatccccccatcttgc

SEQ ID NO: 3669293 - DNA, 21 bp, Homo sapiens
ggtatgaactaaaaagagact

SEQ ID NO: 3669294 - DNA, 12 bp, Homo sapiens
ggtatgtttaat

SEQ ID NO: 3669295 - DNA, 23 bp, Homo sapiens
ggtattagcaaagcaaaaggctg

SEQ ID NO: 3669296 - DNA, 19 bp, Homo sapiens
ggtcacacaaaggcatgct

SEQ ID NO: 3669297 - DNA, 21 bp, Homo sapiens
ggtcacagcggaggtgtggag

SEQ ID NO: 3669298 - DNA, 14 bp, Homo sapiens
ggtcagagccactc

SEQ ID NO: 3669299 - DNA, 17 bp, Homo sapiens
ggtcagagtgccactgc

SEQ ID NO: 3669300 - DNA, 17 bp, Homo sapiens
ggtcagcccaagattct

SEQ ID NO: 3669301 - DNA, 16 bp, Homo sapiens
ggtcatgccctcctct

SEQ ID NO: 3669302 - DNA, 20 bp, Homo sapiens
ggtccagccccccaggctgc

SEQ ID NO: 3669303 - DNA, 15 bp, Homo sapiens
ggtccagctctggag

SEQ ID NO: 3669304 - DNA, 21 bp, Homo sapiens
ggtccagggaagctggccgag

SEQ ID NO: 3669305 - DNA, 12 bp, Homo sapiens
ggtccagggcta

SEQ ID NO: 3669306 - DNA, 18 bp, Homo sapiens
ggtcccacagccctgaga

SEQ ID NO: 3669307 - DNA, 14 bp, Homo sapiens
ggtcccagccaccc

SEQ ID NO: 3669308 - DNA, 20 bp, Homo sapiens
ggtccctcacccccatggcc

SEQ ID NO: 3669309 - DNA, 23 bp, Homo sapiens
ggtccctctgccccgccctcctt

SEQ ID NO: 3669310 - DNA, 14 bp, Homo sapiens
ggtccctctgtgta

SEQ ID NO: 3669311 - DNA, 13 bp, Homo sapiens
ggtccgtgggacg

SEQ ID NO: 3669312 - DNA, 17 bp, Homo sapiens
ggtcctacccatccccg

SEQ ID NO: 3669313 - DNA, 15 bp, Homo sapiens
ggtcctgctttctcc

SEQ ID NO: 3669314 - DNA, 13 bp, Homo sapiens
ggtcctggccatc

SEQ ID NO: 3669315 - DNA, 14 bp, Homo sapiens
ggtcctggccatcc

SEQ ID NO: 3669316 - DNA, 13 bp, Homo sapiens
ggtctccagggag

SEQ ID NO: 3669317 - DNA, 23 bp, Homo sapiens
ggtctcctgactggtgctgcagc

SEQ ID NO: 3669318 - DNA, 13 bp, Homo sapiens
ggtctgcaggcag

SEQ ID NO: 3669319 - DNA, 22 bp, Homo sapiens
ggtctgtgtgtgtgtgtgtgcg

SEQ ID NO: 3669320 - DNA, 19 bp, Homo sapiens
ggtctttcctaaggctgca

SEQ ID NO: 3669321 - DNA, 17 bp, Homo sapiens
ggtgaaagtttttctga

SEQ ID NO: 3669322 - DNA, 18 bp, Homo sapiens
ggtgagacccatggctgt

SEQ ID NO: 3669323 - DNA, 15 bp, Homo sapiens
ggtgcactttgtaaa

SEQ ID NO: 3669324 - DNA, 16 bp, Homo sapiens
ggtgcactttgtaaat

SEQ ID NO: 3669325 - DNA, 12 bp, Homo sapiens
ggtgcatttctt

SEQ ID NO: 3669326 - DNA, 23 bp, Homo sapiens
ggtgccaaacaaaaaggttctca

SEQ ID NO: 3669327 - DNA, 15 bp, Homo sapiens
ggtgccaactggtgt

SEQ ID NO: 3669328 - DNA, 23 bp, Homo sapiens
ggtgccccaggaccagctcagga

SEQ ID NO: 3669329 - DNA, 23 bp, Homo sapiens
ggtgcccctcttccaaaggcagc

SEQ ID NO: 3669330 - DNA, 17 bp, Homo sapiens
ggtgcccttggaggcca

SEQ ID NO: 3669331 - DNA, 22 bp, Homo sapiens
ggtgcccttggaggccagccag

SEQ ID NO: 3669332 - DNA, 19 bp, Homo sapiens
ggtgcctttcaaatttaga

SEQ ID NO: 3669333 - DNA, 12 bp, Homo sapiens
ggtgctctgtct

SEQ ID NO: 3669334 - DNA, 15 bp, Homo sapiens
ggtgctgacggccag

SEQ ID NO: 3669335 - DNA, 16 bp, Homo sapiens
ggtgctgacggccagg

SEQ ID NO: 3669336 - DNA, 23 bp, Homo sapiens
ggtgctgtgaggcttgcccagga

SEQ ID NO: 3669337 - DNA, 19 bp, Homo sapiens
ggtggatgaggcttcttcc

SEQ ID NO: 3669338 - DNA, 14 bp, Homo sapiens
ggtggatggcccca

SEQ ID NO: 3669339 - DNA, 22 bp, Homo sapiens
ggtggatggccccagcacagct

SEQ ID NO: 3669340 - DNA, 15 bp, Homo sapiens
ggtggcagtggaggt

SEQ ID NO: 3669341 - DNA, 15 bp, Homo sapiens
ggtggccactgagct

SEQ ID NO: 3669342 - DNA, 20 bp, Homo sapiens
ggtggccactgagctggctg

SEQ ID NO: 3669343 - DNA, 17 bp, Homo sapiens
ggtggccagaggtgtca

SEQ ID NO: 3669344 - DNA, 20 bp, Homo sapiens
ggtggctagtcaagctcctc

SEQ ID NO: 3669345 - DNA, 15 bp, Homo sapiens
ggtgggaaggggagc

SEQ ID NO: 3669346 - DNA, 18 bp, Homo sapiens
ggtgggactcttccctgg

SEQ ID NO: 3669347 - DNA, 12 bp, Homo sapiens
ggtgggccaggc

SEQ ID NO: 3669348 - DNA, 19 bp, Homo sapiens
ggtgggcttttccctgggt

SEQ ID NO: 3669349 - DNA, 16 bp, Homo sapiens
ggtggggctcctacct

SEQ ID NO: 3669350 - DNA, 12 bp, Homo sapiens
ggtggggcttct

SEQ ID NO: 3669351 - DNA, 17 bp, Homo sapiens
ggtgggggagcctctgg

SEQ ID NO: 3669352 - DNA, 18 bp, Homo sapiens
ggtgggggagcctctgga

SEQ ID NO: 3669353 - DNA, 15 bp, Homo sapiens
ggtggggtcatgccc

SEQ ID NO: 3669354 - DNA, 16 bp, Homo sapiens
ggtggtctgttggcag

SEQ ID NO: 3669355 - DNA, 21 bp, Homo sapiens
ggtgtcacccaaaccggcagg

SEQ ID NO: 3669356 - DNA, 24 bp, Homo sapiens
ggtgtcacccaaaccggcaggtgc

SEQ ID NO: 3669357 - DNA, 20 bp, Homo sapiens
ggtgtcttgggcagagctgg

SEQ ID NO: 3669358 - DNA, 21 bp, Homo sapiens
ggtgtgcggcctttggcttca

SEQ ID NO: 3669359 - DNA, 12 bp, Homo sapiens
ggtgtggagaag

SEQ ID NO: 3669360 - DNA, 14 bp, Homo sapiens
ggtgtggagaagcg

SEQ ID NO: 3669361 - DNA, 23 bp, Homo sapiens
ggtgtggagaagcggctggcagc

SEQ ID NO: 3669362 - DNA, 16 bp, Homo sapiens
ggtgtggagccgaggc

SEQ ID NO: 3669363 - DNA, 18 bp, Homo sapiens
ggtgtggaggctcctgtg

SEQ ID NO: 3669364 - DNA, 13 bp, Homo sapiens
ggttatggagagg

SEQ ID NO: 3669365 - DNA, 14 bp, Homo sapiens
ggttcaacttatta

SEQ ID NO: 3669366 - DNA, 14 bp, Homo sapiens
ggttcaagagactc

SEQ ID NO: 3669367 - DNA, 22 bp, Homo sapiens
ggttccctttccttccatccct

SEQ ID NO: 3669368 - DNA, 24 bp, Homo sapiens
ggttccgtatctccctggagaagc

SEQ ID NO: 3669369 - DNA, 18 bp, Homo sapiens
ggttctcaggtgttgcca

SEQ ID NO: 3669370 - DNA, 20 bp, Homo sapiens
ggttctccgttagctcctgt

SEQ ID NO: 3669371 - DNA, 19 bp, Homo sapiens
ggttctgtgacccatctgt

SEQ ID NO: 3669372 - DNA, 19 bp, Homo sapiens
ggttgctgttttcctccct

SEQ ID NO: 3669373 - DNA, 20 bp, Homo sapiens
ggttgctgttttcctccctt

SEQ ID NO: 3669374 - DNA, 18 bp, Homo sapiens
ggttggcaaaaaggcagg

SEQ ID NO: 3669375 - DNA, 17 bp, Homo sapiens
ggttgggcccagatctg

SEQ ID NO: 3669376 - DNA, 15 bp, Homo sapiens
ggttggtatctcagg

SEQ ID NO: 3669377 - DNA, 19 bp, Homo sapiens
ggttggtatctcaggtctg

SEQ ID NO: 3669378 - DNA, 15 bp, Homo sapiens
ggttgtctgaaccca

SEQ ID NO: 3669379 - DNA, 17 bp, Homo sapiens
ggttgtctgaacccagg

SEQ ID NO: 3669380 - DNA, 20 bp, Homo sapiens
ggtttaggctggtggcccag

SEQ ID NO: 3669381 - DNA, 22 bp, Homo sapiens
ggtttaggctggtggcccagga

SEQ ID NO: 3669382 - DNA, 12 bp, Homo sapiens
ggtttccaggga

SEQ ID NO: 3669383 - DNA, 11 bp, Homo sapiens
ggtttcctggt

SEQ ID NO: 3669384 - DNA, 21 bp, Homo sapiens
ggtttctcgcataggaccttt

SEQ ID NO: 3669385 - DNA, 17 bp, Homo sapiens
ggttttaggtagaaaaa

SEQ ID NO: 3669386 - DNA, 15 bp, Homo sapiens
gtaaaatggaggtgg

SEQ ID NO: 3669387 - DNA, 19 bp, Homo sapiens
gtaaacataccaacatgtt

SEQ ID NO: 3669388 - DNA, 18 bp, Homo sapiens
gtaaagtatcacttttct

SEQ ID NO: 3669389 - DNA, 23 bp, Homo sapiens
gtaaagtttccgtgcgtggcact

SEQ ID NO: 3669390 - DNA, 22 bp, Homo sapiens
gtaaatgcctcttaaattatat

SEQ ID NO: 3669391 - DNA, 12 bp, Homo sapiens
gtaaatgtgtac

SEQ ID NO: 3669392 - DNA, 18 bp, Homo sapiens
gtaactatttcttcagag

SEQ ID NO: 3669393 - DNA, 12 bp, Homo sapiens
gtaagaagaaag

SEQ ID NO: 3669394 - DNA, 14 bp, Homo sapiens
gtaagaagaaagca

SEQ ID NO: 3669395 - DNA, 18 bp, Homo sapiens
gtaagggcgtggctctgg

SEQ ID NO: 3669396 - DNA, 22 bp, Homo sapiens
gtaagggcgtggctctgggtgg

SEQ ID NO: 3669397 - DNA, 14 bp, Homo sapiens
gtaagtgggcccac

SEQ ID NO: 3669398 - DNA, 17 bp, Homo sapiens
gtaagtgggcccacccg

SEQ ID NO: 3669399 - DNA, 21 bp, Homo sapiens
gtaatgttttctttgcaaagt

SEQ ID NO: 3669400 - DNA, 13 bp, Homo sapiens
gtaatttattgtc

SEQ ID NO: 3669401 - DNA, 21 bp, Homo sapiens
gtaatttctttttttcctttt

SEQ ID NO: 3669402 - DNA, 22 bp, Homo sapiens
ggaggctcctgtggtagtcctc

SEQ ID NO: 3669403 - DNA, 21 bp, Homo sapiens
ggagggaaagggtcctgcttt

SEQ ID NO: 3669404 - DNA, 13 bp, Homo sapiens
ggagggaggcccc

SEQ ID NO: 3669405 - DNA, 16 bp, Homo sapiens
ggagggccctacctga

SEQ ID NO: 3669406 - DNA, 18 bp, Homo sapiens
ggaggggaaaaaaatgtt

SEQ ID NO: 3669407 - DNA, 15 bp, Homo sapiens
ggaggtcgaggcagg

SEQ ID NO: 3669408 - DNA, 16 bp, Homo sapiens
ggaggtcgaggcagga

SEQ ID NO: 3669409 - DNA, 14 bp, Homo sapiens
ggaggtggggaagg

SEQ ID NO: 3669410 - DNA, 19 bp, Homo sapiens
ggaggttaaggctgaggaa

SEQ ID NO: 3669411 - DNA, 17 bp, Homo sapiens
ggagtcatctcaaccat

SEQ ID NO: 3669412 - DNA, 16 bp, Homo sapiens
ggagtccactttgttt

SEQ ID NO: 3669413 - DNA, 24 bp, Homo sapiens
ggagtcgtggggtgtgctgggagc

SEQ ID NO: 3669414 - DNA, 18 bp, Homo sapiens
ggagtctgtcctgtgacg

SEQ ID NO: 3669415 - DNA, 12 bp, Homo sapiens
ggagtgcagtga

SEQ ID NO: 3669416 - DNA, 18 bp, Homo sapiens
ggagttaagacctggcag

SEQ ID NO: 3669417 - DNA, 16 bp, Homo sapiens
ggagttcaggaaccct

SEQ ID NO: 3669418 - DNA, 17 bp, Homo sapiens
ggagttgatctggaacc

SEQ ID NO: 3669419 - DNA, 21 bp, Homo sapiens
ggagttggaagtgtgtgatct

SEQ ID NO: 3669420 - DNA, 13 bp, Homo sapiens
ggataaagcagct

SEQ ID NO: 3669421 - DNA, 21 bp, Homo sapiens
ggatacgcatcagacagatgg

SEQ ID NO: 3669422 - DNA, 15 bp, Homo sapiens
ggatattttaaattc

SEQ ID NO: 3669423 - DNA, 21 bp, Homo sapiens
ggatcatctaattctctgtgg

SEQ ID NO: 3669424 - DNA, 14 bp, Homo sapiens
ggatctttgactga

SEQ ID NO: 3669425 - DNA, 17 bp, Homo sapiens
ggatctttgtggccaag

SEQ ID NO: 3669426 - DNA, 21 bp, Homo sapiens
ggatgccctggaggtggctga

SEQ ID NO: 3669427 - DNA, 13 bp, Homo sapiens
ggatgctcagtga

SEQ ID NO: 3669428 - DNA, 15 bp, Homo sapiens
ggatgctccatttca

SEQ ID NO: 3669429 - DNA, 11 bp, Homo sapiens
ggatggcagtg

SEQ ID NO: 3669430 - DNA, 23 bp, Homo sapiens
ggatgggggaactcagatccagg

SEQ ID NO: 3669431 - DNA, 16 bp, Homo sapiens
ggatgtatggggaatc

SEQ ID NO: 3669432 - DNA, 15 bp, Homo sapiens
ggattaacctctgca

SEQ ID NO: 3669433 - DNA, 16 bp, Homo sapiens
ggattaacctctgcac

SEQ ID NO: 3669434 - DNA, 17 bp, Homo sapiens
ggattaacctctgcact

SEQ ID NO: 3669435 - DNA, 18 bp, Homo sapiens
ggattccccatctcaggc

SEQ ID NO: 3669436 - DNA, 21 bp, Homo sapiens
ggattctcatgggaaggggag

SEQ ID NO: 3669437 - DNA, 19 bp, Homo sapiens
ggattctggttccagggtc

SEQ ID NO: 3669438 - DNA, 18 bp, Homo sapiens
ggattgcacgtggcctct

SEQ ID NO: 3669439 - DNA, 23 bp, Homo sapiens
ggatttgatgagttaactgtgaa

SEQ ID NO: 3669440 - DNA, 12 bp, Homo sapiens
ggcaaaactcta

SEQ ID NO: 3669441 - DNA, 11 bp, Homo sapiens
ggcaaaataat

SEQ ID NO: 3669442 - DNA, 19 bp, Homo sapiens
ggcaaaggaaggtggatgg

SEQ ID NO: 3669443 - DNA, 14 bp, Homo sapiens
ggcaaattcttttg

SEQ ID NO: 3669444 - DNA, 19 bp, Homo sapiens
ggcaacagatctggaacct

SEQ ID NO: 3669445 - DNA, 18 bp, Homo sapiens
ggcaactgcattggcttt

SEQ ID NO: 3669446 - DNA, 18 bp, Homo sapiens
ggcaacttgggaactaga

SEQ ID NO: 3669447 - DNA, 23 bp, Homo sapiens
ggcaagagaatcgcttgaaccca

SEQ ID NO: 3669448 - DNA, 19 bp, Homo sapiens
ggcaagcgaccgaggccct

SEQ ID NO: 3669449 - DNA, 21 bp, Homo sapiens
ggcaatatagcaagatcccat

SEQ ID NO: 3669450 - DNA, 18 bp, Homo sapiens
ggcaatttcctggccctc

SEQ ID NO: 3669451 - DNA, 18 bp, Homo sapiens
ggcacaagtcctggatgt

SEQ ID NO: 3669452 - DNA, 22 bp, Homo sapiens
ggcacagcggagtctgtcctgt

SEQ ID NO: 3669453 - DNA, 13 bp, Homo sapiens
ggcaccagacacc

SEQ ID NO: 3669454 - DNA, 16 bp, Homo sapiens
ggcaccagacacccag

SEQ ID NO: 3669455 - DNA, 17 bp, Homo sapiens
ggcaccagacacccagg

SEQ ID NO: 3669456 - DNA, 18 bp, Homo sapiens
ggcaccagacacccagga

SEQ ID NO: 3669457 - DNA, 17 bp, Homo sapiens
ggcaccagcagcctgga

SEQ ID NO: 3669458 - DNA, 16 bp, Homo sapiens
ggcacctaatccaggc

SEQ ID NO: 3669459 - DNA, 12 bp, Homo sapiens
ggcacctcttcc

SEQ ID NO: 3669460 - DNA, 14 bp, Homo sapiens
ggcacggctctggg

SEQ ID NO: 3669461 - DNA, 16 bp, Homo sapiens
ggcacggctctggggt

SEQ ID NO: 3669462 - DNA, 18 bp, Homo sapiens
ggcagactctttatgctt

SEQ ID NO: 3669463 - DNA, 16 bp, Homo sapiens
ggcagagctggctctg

SEQ ID NO: 3669464 - DNA, 17 bp, Homo sapiens
ggcagagctggctctga

SEQ ID NO: 3669465 - DNA, 17 bp, Homo sapiens
ggcagagcttctcctga

SEQ ID NO: 3669466 - DNA, 18 bp, Homo sapiens
ggcagagcttctcctgac

SEQ ID NO: 3669467 - DNA, 16 bp, Homo sapiens
ggcagatccaggacta

SEQ ID NO: 3669468 - DNA, 16 bp, Homo sapiens
ggcagatctgtgcccc

SEQ ID NO: 3669469 - DNA, 17 bp, Homo sapiens
ggcagatctgtgcccca

SEQ ID NO: 3669470 - DNA, 20 bp, Homo sapiens
ggcagatctgtgccccatgc

SEQ ID NO: 3669471 - DNA, 21 bp, Homo sapiens
ggcagcacagagacccccgga

SEQ ID NO: 3669472 - DNA, 14 bp, Homo sapiens
ggcagcagactgtg

SEQ ID NO: 3669473 - DNA, 13 bp, Homo sapiens
ggcagccaggctg

SEQ ID NO: 3669474 - DNA, 19 bp, Homo sapiens
ggcagccaggctgccaagg

SEQ ID NO: 3669475 - DNA, 16 bp, Homo sapiens
ggcagcgtgccgagcc

SEQ ID NO: 3669476 - DNA, 19 bp, Homo sapiens
ggcagcgtgccgagccagc

SEQ ID NO: 3669477 - DNA, 20 bp, Homo sapiens
ggcagctctggacagcccca

SEQ ID NO: 3669478 - DNA, 14 bp, Homo sapiens
ggcagctggcagga

SEQ ID NO: 3669479 - DNA, 18 bp, Homo sapiens
ggcagctggcaggagtgg

SEQ ID NO: 3669480 - DNA, 16 bp, Homo sapiens
ggcagctgtgtctgag

SEQ ID NO: 3669481 - DNA, 20 bp, Homo sapiens
ggcagctgtgtctgagccca

SEQ ID NO: 3669482 - DNA, 17 bp, Homo sapiens
ggcaggaagggaagcgt

SEQ ID NO: 3669483 - DNA, 19 bp, Homo sapiens
ggcaggacaacgaggaagc

SEQ ID NO: 3669484 - DNA, 18 bp, Homo sapiens
ggcaggaggatcacttga

SEQ ID NO: 3669485 - DNA, 14 bp, Homo sapiens
ggcaggagggccct

SEQ ID NO: 3669486 - DNA, 10 bp, Homo sapiens
ggcaggcagt

SEQ ID NO: 3669487 - DNA, 16 bp, Homo sapiens
ggcaggcatggccctg

SEQ ID NO: 3669488 - DNA, 11 bp, Homo sapiens
ggcaggctggc

SEQ ID NO: 3669489 - DNA, 17 bp, Homo sapiens
ggcaggtccagctctgt

SEQ ID NO: 3669490 - DNA, 20 bp, Homo sapiens
ggcagtactcctccctgggg

SEQ ID NO: 3669491 - DNA, 23 bp, Homo sapiens
ggcagtactcctccctgggggcg

SEQ ID NO: 3669492 - DNA, 20 bp, Homo sapiens
ggcataggtctctttgcttt

SEQ ID NO: 3669493 - DNA, 23 bp, Homo sapiens
ggcatcaccttaggcagggaagt

SEQ ID NO: 3669494 - DNA, 17 bp, Homo sapiens
ggcatcctctttttcca

SEQ ID NO: 3669495 - DNA, 21 bp, Homo sapiens
ggcatcgcaccattctgactc

SEQ ID NO: 3669496 - DNA, 14 bp, Homo sapiens
ggcatctgcccctc

SEQ ID NO: 3669497 - DNA, 19 bp, Homo sapiens
ggcatctttgccttgggct

SEQ ID NO: 3669498 - DNA, 13 bp, Homo sapiens
ggcatgagaaata

SEQ ID NO: 3669499 - DNA, 15 bp, Homo sapiens
ggcatgatgcgggcc

SEQ ID NO: 3669500 - DNA, 16 bp, Homo sapiens
ggcattgatggggaag

SEQ ID NO: 3669501 - DNA, 21 bp, Homo sapiens
ggcatttttaccatcactgag

SEQ ID NO: 3669502 - DNA, 14 bp, Homo sapiens
ggccaacaaagaac

SEQ ID NO: 3669503 - DNA, 17 bp, Homo sapiens
ggccaacatggcgaaac

SEQ ID NO: 3669504 - DNA, 13 bp, Homo sapiens
ggccaagaggctg

SEQ ID NO: 3669505 - DNA, 13 bp, Homo sapiens
ggccaaggagctg

SEQ ID NO: 3669506 - DNA, 13 bp, Homo sapiens
ggccaccactgca

SEQ ID NO: 3669507 - DNA, 14 bp, Homo sapiens
ggccaccactgcag

SEQ ID NO: 3669508 - DNA, 18 bp, Homo sapiens
ggccaccaggtgcctttc

SEQ ID NO: 3669509 - DNA, 13 bp, Homo sapiens
ggccacctcccca

SEQ ID NO: 3669510 - DNA, 12 bp, Homo sapiens
ggccactgagct

SEQ ID NO: 3669511 - DNA, 18 bp, Homo sapiens
ggccactgagctggctga

SEQ ID NO: 3669512 - DNA, 17 bp, Homo sapiens
ggccagacacaggccct

SEQ ID NO: 3669513 - DNA, 12 bp, Homo sapiens
ggccagagccag

SEQ ID NO: 3669514 - DNA, 13 bp, Homo sapiens
ggccagagccagg

SEQ ID NO: 3669515 - DNA, 14 bp, Homo sapiens
gctgcctccagcct

SEQ ID NO: 3669516 - DNA, 15 bp, Homo sapiens
gctgcgccccaggcc

SEQ ID NO: 3669517 - DNA, 16 bp, Homo sapiens
gctgcgtctgcactga

SEQ ID NO: 3669518 - DNA, 16 bp, Homo sapiens
gctgctatagcctggg

SEQ ID NO: 3669519 - DNA, 17 bp, Homo sapiens
gctgctatatccactgt

SEQ ID NO: 3669520 - DNA, 21 bp, Homo sapiens
gcttttgtctaattaaaacac

SEQ ID NO: 3669521 - DNA, 15 bp, Homo sapiens
ggaaaaatagcctgc

SEQ ID NO: 3669522 - DNA, 16 bp, Homo sapiens
ggaaaataatactgct

SEQ ID NO: 3669523 - DNA, 17 bp, Homo sapiens
ggaaactggatgaggtc

SEQ ID NO: 3669524 - DNA, 14 bp, Homo sapiens
ggaaagcagctcaa

SEQ ID NO: 3669525 - DNA, 19 bp, Homo sapiens
ggaaagcagctcaaaggca

SEQ ID NO: 3669526 - DNA, 16 bp, Homo sapiens
ggaaagccctgtgctc

SEQ ID NO: 3669527 - DNA, 15 bp, Homo sapiens
ggaaaggccagctgg

SEQ ID NO: 3669528 - DNA, 18 bp, Homo sapiens
ggaaaggccagctggcag

SEQ ID NO: 3669529 - DNA, 15 bp, Homo sapiens
ggaacaactctggga

SEQ ID NO: 3669530 - DNA, 19 bp, Homo sapiens
ggaacatgcataagaaatg

SEQ ID NO: 3669531 - DNA, 14 bp, Homo sapiens
ggaacccagactca

SEQ ID NO: 3669532 - DNA, 16 bp, Homo sapiens
ggaaccgcaggaagct

SEQ ID NO: 3669533 - DNA, 15 bp, Homo sapiens
ggaacctcagcctgg

SEQ ID NO: 3669534 - DNA, 23 bp, Homo sapiens
ggaacctcagcctggccagacac

SEQ ID NO: 3669535 - DNA, 14 bp, Homo sapiens
ggaacggcttcctc

SEQ ID NO: 3669536 - DNA, 23 bp, Homo sapiens
ggaactagactcccaagctggac

SEQ ID NO: 3669537 - DNA, 19 bp, Homo sapiens
ggaactcagatccagggac

SEQ ID NO: 3669538 - DNA, 13 bp, Homo sapiens
ggaactgcacact

SEQ ID NO: 3669539 - DNA, 23 bp, Homo sapiens
ggaacttggggagttaagacctg

SEQ ID NO: 3669540 - DNA, 16 bp, Homo sapiens
ggaagacaatgtgaaa

SEQ ID NO: 3669541 - DNA, 16 bp, Homo sapiens
ggaagacacttgctga

SEQ ID NO: 3669542 - DNA, 13 bp, Homo sapiens
ggaagagccttgc

SEQ ID NO: 3669543 - DNA, 15 bp, Homo sapiens
ggaagcaccccatgc

SEQ ID NO: 3669544 - DNA, 13 bp, Homo sapiens
ggaagcccggact

SEQ ID NO: 3669545 - DNA, 20 bp, Homo sapiens
ggaagctttggtgagaacct

SEQ ID NO: 3669546 - DNA, 21 bp, Homo sapiens
ggaagctttggtgagaacctg

SEQ ID NO: 3669547 - DNA, 17 bp, Homo sapiens
ggaaggagagcctgctg

SEQ ID NO: 3669548 - DNA, 21 bp, Homo sapiens
ggaaggcttgttgtgctttta

SEQ ID NO: 3669549 - DNA, 12 bp, Homo sapiens
ggaagggcagga

SEQ ID NO: 3669550 - DNA, 21 bp, Homo sapiens
ggaaggggcccgtgggagtca

SEQ ID NO: 3669551 - DNA, 23 bp, Homo sapiens
ggaagggtggctttgcatttctt

SEQ ID NO: 3669552 - DNA, 15 bp, Homo sapiens
ggaagtctgtctcag

SEQ ID NO: 3669553 - DNA, 14 bp, Homo sapiens
ggaagtgggccagt

SEQ ID NO: 3669554 - DNA, 22 bp, Homo sapiens
ggaagtgggccagtcctggttg

SEQ ID NO: 3669555 - DNA, 18 bp, Homo sapiens
ggaatcccggctccagag

SEQ ID NO: 3669556 - DNA, 21 bp, Homo sapiens
ggaatgcatggggcgggtcct

SEQ ID NO: 3669557 - DNA, 18 bp, Homo sapiens
ggaattcctggaacctgg

SEQ ID NO: 3669558 - DNA, 14 bp, Homo sapiens
ggacaaagaacctt

SEQ ID NO: 3669559 - DNA, 17 bp, Homo sapiens
ggacactcaaaagctgg

SEQ ID NO: 3669560 - DNA, 17 bp, Homo sapiens
ggacagccccaccctgg

SEQ ID NO: 3669561 - DNA, 23 bp, Homo sapiens
ggacagcctcttctgtcccaagt

SEQ ID NO: 3669562 - DNA, 16 bp, Homo sapiens
ggacaggccgcagctc

SEQ ID NO: 3669563 - DNA, 19 bp, Homo sapiens
ggacagggacttcgcagag

SEQ ID NO: 3669564 - DNA, 13 bp, Homo sapiens
ggacagggcttct

SEQ ID NO: 3669565 - DNA, 19 bp, Homo sapiens
ggacataatggggtcctgg

SEQ ID NO: 3669566 - DNA, 23 bp, Homo sapiens
ggacataatggggtcctggccat

SEQ ID NO: 3669567 - DNA, 16 bp, Homo sapiens
ggacatttccaagctg

SEQ ID NO: 3669568 - DNA, 22 bp, Homo sapiens
ggacatttttgtctgtcctaca

SEQ ID NO: 3669569 - DNA, 16 bp, Homo sapiens
ggaccaagcatcttgg

SEQ ID NO: 3669570 - DNA, 22 bp, Homo sapiens
ggaccagctcaggacagatgcc

SEQ ID NO: 3669571 - DNA, 17 bp, Homo sapiens
ggaccatcatcctactg

SEQ ID NO: 3669572 - DNA, 17 bp, Homo sapiens
ggacccagcgggcaggt

SEQ ID NO: 3669573 - DNA, 14 bp, Homo sapiens
ggaccccagccttg

SEQ ID NO: 3669574 - DNA, 16 bp, Homo sapiens
ggacccccgtggggca

SEQ ID NO: 3669575 - DNA, 13 bp, Homo sapiens
ggacccctgccct

SEQ ID NO: 3669576 - DNA, 13 bp, Homo sapiens
ggaccctgaaggg

SEQ ID NO: 3669577 - DNA, 19 bp, Homo sapiens
ggacctcaggtgagaagca

SEQ ID NO: 3669578 - DNA, 12 bp, Homo sapiens
ggacctgtggct

SEQ ID NO: 3669579 - DNA, 19 bp, Homo sapiens
ggacctttccaccacagcc

SEQ ID NO: 3669580 - DNA, 22 bp, Homo sapiens
ggacggcctgatgctccctccc

SEQ ID NO: 3669581 - DNA, 13 bp, Homo sapiens
ggacggggcgggc

SEQ ID NO: 3669582 - DNA, 13 bp, Homo sapiens
ggacggggctccc

SEQ ID NO: 3669583 - DNA, 17 bp, Homo sapiens
ggacggtgcccaagcca

SEQ ID NO: 3669584 - DNA, 19 bp, Homo sapiens
ggacggtgcccaagccaga

SEQ ID NO: 3669585 - DNA, 21 bp, Homo sapiens
ggacggtgcccaagccagagg

SEQ ID NO: 3669586 - DNA, 15 bp, Homo sapiens
ggactcagccctgag

SEQ ID NO: 3669587 - DNA, 17 bp, Homo sapiens
ggactcttccctgggaa

SEQ ID NO: 3669588 - DNA, 23 bp, Homo sapiens
ggactgctacctttcaaagcttg

SEQ ID NO: 3669589 - DNA, 19 bp, Homo sapiens
ggactggctagagtcctca

SEQ ID NO: 3669590 - DNA, 15 bp, Homo sapiens
ggactgtaagggatt

SEQ ID NO: 3669591 - DNA, 19 bp, Homo sapiens
ggacttcctgtccagctcc

SEQ ID NO: 3669592 - DNA, 20 bp, Homo sapiens
ggacttcctgtccagctcca

SEQ ID NO: 3669593 - DNA, 21 bp, Homo sapiens
ggacttcctgtccagctccaa

SEQ ID NO: 3669594 - DNA, 23 bp, Homo sapiens
ggacttcctgtccagctccaacc

SEQ ID NO: 3669595 - DNA, 22 bp, Homo sapiens
ggagaaatctggcttctggcca

SEQ ID NO: 3669596 - DNA, 21 bp, Homo sapiens
ggagaactcctagggtggctg

SEQ ID NO: 3669597 - DNA, 16 bp, Homo sapiens
ggagaagcaccagcaa

SEQ ID NO: 3669598 - DNA, 20 bp, Homo sapiens
ggagaagttgaggggagcat

SEQ ID NO: 3669599 - DNA, 19 bp, Homo sapiens
ggagacggtttccagggag

SEQ ID NO: 3669600 - DNA, 10 bp, Homo sapiens
ggagactaga

SEQ ID NO: 3669601 - DNA, 14 bp, Homo sapiens
ggagactagattgc

SEQ ID NO: 3669602 - DNA, 19 bp, Homo sapiens
ggagactagattgcctttg

SEQ ID NO: 3669603 - DNA, 22 bp, Homo sapiens
ggagactgctgagtcaacccaa

SEQ ID NO: 3669604 - DNA, 22 bp, Homo sapiens
ggagacttagggcaccaggggt

SEQ ID NO: 3669605 - DNA, 12 bp, Homo sapiens
ggagagacagct

SEQ ID NO: 3669606 - DNA, 15 bp, Homo sapiens
ggagagctggtgccc

SEQ ID NO: 3669607 - DNA, 17 bp, Homo sapiens
ggagagctggtgcccgg

SEQ ID NO: 3669608 - DNA, 18 bp, Homo sapiens
ggagagctggtgcccgga

SEQ ID NO: 3669609 - DNA, 15 bp, Homo sapiens
ggagaggggcacagg

SEQ ID NO: 3669610 - DNA, 23 bp, Homo sapiens
ggagataccagagactctgaaac

SEQ ID NO: 3669611 - DNA, 21 bp, Homo sapiens
ggagcaattacggggtgacct

SEQ ID NO: 3669612 - DNA, 20 bp, Homo sapiens
ggagcatgcttccctgcagc

SEQ ID NO: 3669613 - DNA, 16 bp, Homo sapiens
ggagccaatggcccgg

SEQ ID NO: 3669614 - DNA, 21 bp, Homo sapiens
ggagccaatggcccggcccct

SEQ ID NO: 3669615 - DNA, 22 bp, Homo sapiens
ggagccatgcgccccctccgcc

SEQ ID NO: 3669616 - DNA, 17 bp, Homo sapiens
ggagcccactgtcctgg

SEQ ID NO: 3669617 - DNA, 18 bp, Homo sapiens
ggagcccactgtcctggg

SEQ ID NO: 3669618 - DNA, 23 bp, Homo sapiens
ggagcccactgtcctgggcctgc

SEQ ID NO: 3669619 - DNA, 13 bp, Homo sapiens
ggagcctctggaa

SEQ ID NO: 3669620 - DNA, 15 bp, Homo sapiens
ggagcctctggaatg

SEQ ID NO: 3669621 - DNA, 17 bp, Homo sapiens
ggagctccactctgctt

SEQ ID NO: 3669622 - DNA, 16 bp, Homo sapiens
ggagctctgtatggtc

SEQ ID NO: 3669623 - DNA, 16 bp, Homo sapiens
ggagctgagtggggga

SEQ ID NO: 3669624 - DNA, 19 bp, Homo sapiens
ggagctgctatagcctggg

SEQ ID NO: 3669625 - DNA, 15 bp, Homo sapiens
ggagctgctggcttg

SEQ ID NO: 3669626 - DNA, 12 bp, Homo sapiens
ggagctgggccc

SEQ ID NO: 3669627 - DNA, 17 bp, Homo sapiens
ggagctggggatccctc

SEQ ID NO: 3669628 - DNA, 22 bp, Homo sapiens
ggaggacaggcgggaggaggtg

SEQ ID NO: 3669629 - DNA, 22 bp, Homo sapiens
ggaggagccggggactcccagg

SEQ ID NO: 3669630 - DNA, 15 bp, Homo sapiens
ggaggagggttgtgc

SEQ ID NO: 3669631 - DNA, 14 bp, Homo sapiens
ggaggcaagccctg

SEQ ID NO: 3669632 - DNA, 14 bp, Homo sapiens
ggaggcaggcatgg

SEQ ID NO: 3669633 - DNA, 14 bp, Homo sapiens
ggaggccccagggg

SEQ ID NO: 3669634 - DNA, 15 bp, Homo sapiens
ggaggccccaggggg

SEQ ID NO: 3669635 - DNA, 17 bp, Homo sapiens
ggaggcccgtccggcag

SEQ ID NO: 3669636 - DNA, 18 bp, Homo sapiens
ggccagcctggcatcagt

SEQ ID NO: 3669637 - DNA, 15 bp, Homo sapiens
ggccaggagctcttc

SEQ ID NO: 3669638 - DNA, 17 bp, Homo sapiens
ggccaggcggggcgccc

SEQ ID NO: 3669639 - DNA, 23 bp, Homo sapiens
ggccagggcccctcaccctgcct

SEQ ID NO: 3669640 - DNA, 20 bp, Homo sapiens
ggccagtccaccctgcctgc

SEQ ID NO: 3669641 - DNA, 14 bp, Homo sapiens
ggccagtccaggct

SEQ ID NO: 3669642 - DNA, 16 bp, Homo sapiens
ggccagtccaggctgc

SEQ ID NO: 3669643 - DNA, 19 bp, Homo sapiens
ggccagtcctgcctggcca

SEQ ID NO: 3669644 - DNA, 23 bp, Homo sapiens
ggccagtcctggttgtctgaacc

SEQ ID NO: 3669645 - DNA, 13 bp, Homo sapiens
ggccagtctgtgg

SEQ ID NO: 3669646 - DNA, 23 bp, Homo sapiens
ggccagtctgtggatcagagatg

SEQ ID NO: 3669647 - DNA, 15 bp, Homo sapiens
ggccagtgctccagc

SEQ ID NO: 3669648 - DNA, 18 bp, Homo sapiens
ggccatgatggcaacaga

SEQ ID NO: 3669649 - DNA, 15 bp, Homo sapiens
ggccatgctgaggcc

SEQ ID NO: 3669650 - DNA, 18 bp, Homo sapiens
ggccatgctgaggcctgg

SEQ ID NO: 3669651 - DNA, 19 bp, Homo sapiens
ggccatgctgaggcctggg

SEQ ID NO: 3669652 - DNA, 23 bp, Homo sapiens
ggccatgtgcatagtttctttat

SEQ ID NO: 3669653 - DNA, 15 bp, Homo sapiens
ggccatttggccggc

SEQ ID NO: 3669654 - DNA, 16 bp, Homo sapiens
ggccatttggccggct

SEQ ID NO: 3669655 - DNA, 19 bp, Homo sapiens
ggccatttggccggctctg

SEQ ID NO: 3669656 - DNA, 21 bp, Homo sapiens
ggccatttggccggctctggt

SEQ ID NO: 3669657 - DNA, 17 bp, Homo sapiens
ggcccacgtggttgggg

SEQ ID NO: 3669658 - DNA, 13 bp, Homo sapiens
ggcccagagccca

SEQ ID NO: 3669659 - DNA, 14 bp, Homo sapiens
ggcccagagcccag

SEQ ID NO: 3669660 - DNA, 16 bp, Homo sapiens
ggcccagagcccagct

SEQ ID NO: 3669661 - DNA, 18 bp, Homo sapiens
ggcccagagcccagctcc

SEQ ID NO: 3669662 - DNA, 17 bp, Homo sapiens
ggcccagggcccagagc

SEQ ID NO: 3669663 - DNA, 19 bp, Homo sapiens
ggcccagggcccagagccc

SEQ ID NO: 3669664 - DNA, 15 bp, Homo sapiens
ggcccagtgcatggt

SEQ ID NO: 3669665 - DNA, 21 bp, Homo sapiens
ggcccagtgcatggtggccag

SEQ ID NO: 3669666 - DNA, 13 bp, Homo sapiens
ggccccaccctgg

SEQ ID NO: 3669667 - DNA, 21 bp, Homo sapiens
ggccccaccctgggccctggg

SEQ ID NO: 3669668 - DNA, 15 bp, Homo sapiens
ggccccagcacagct

SEQ ID NO: 3669669 - DNA, 16 bp, Homo sapiens
ggcccccacttgcctc

SEQ ID NO: 3669670 - DNA, 18 bp, Homo sapiens
ggcccccacttgcctctt

SEQ ID NO: 3669671 - DNA, 20 bp, Homo sapiens
ggcccccagcccagggctcc

SEQ ID NO: 3669672 - DNA, 11 bp, Homo sapiens
ggcccccttcc

SEQ ID NO: 3669673 - DNA, 23 bp, Homo sapiens
ggcccctcatggcgggactggag

SEQ ID NO: 3669674 - DNA, 14 bp, Homo sapiens
ggcccctcccacac

SEQ ID NO: 3669675 - DNA, 22 bp, Homo sapiens
ggcccctcccacacccaaagct

SEQ ID NO: 3669676 - DNA, 21 bp, Homo sapiens
ggccccttccaaatgtccctc

SEQ ID NO: 3669677 - DNA, 14 bp, Homo sapiens
ggcccggcccctcc

SEQ ID NO: 3669678 - DNA, 16 bp, Homo sapiens
ggcccggcccctcctg

SEQ ID NO: 3669679 - DNA, 22 bp, Homo sapiens
ggccctacctggggaaagcctg

SEQ ID NO: 3669680 - DNA, 16 bp, Homo sapiens
ggccctgcagccagct

SEQ ID NO: 3669681 - DNA, 17 bp, Homo sapiens
ggccctgcagccagctc

SEQ ID NO: 3669682 - DNA, 15 bp, Homo sapiens
ggccctgcctgaggg

SEQ ID NO: 3669683 - DNA, 16 bp, Homo sapiens
ggccctgcctgagggt

SEQ ID NO: 3669684 - DNA, 13 bp, Homo sapiens
ggccctggcctcc

SEQ ID NO: 3669685 - DNA, 14 bp, Homo sapiens
ggccctggcctccc

SEQ ID NO: 3669686 - DNA, 17 bp, Homo sapiens
ggccctggcctcccctg

SEQ ID NO: 3669687 - DNA, 12 bp, Homo sapiens
ggccctgggctg

SEQ ID NO: 3669688 - DNA, 13 bp, Homo sapiens
ggccctgggctgg

SEQ ID NO: 3669689 - DNA, 15 bp, Homo sapiens
ggccctgggctggaa

SEQ ID NO: 3669690 - DNA, 12 bp, Homo sapiens
ggccgagaagca

SEQ ID NO: 3669691 - DNA, 18 bp, Homo sapiens
ggccgagggtcctggctc

SEQ ID NO: 3669692 - DNA, 14 bp, Homo sapiens
ggccgccgcctctt

SEQ ID NO: 3669693 - DNA, 17 bp, Homo sapiens
ggccgctgagtggcagg

SEQ ID NO: 3669694 - DNA, 21 bp, Homo sapiens
ggccgctgccacccacctccc

SEQ ID NO: 3669695 - DNA, 13 bp, Homo sapiens
ggccggctctggt

SEQ ID NO: 3669696 - DNA, 20 bp, Homo sapiens
ggcctaggcctcagccagag

SEQ ID NO: 3669697 - DNA, 10 bp, Homo sapiens
ggcctcagaa

SEQ ID NO: 3669698 - DNA, 15 bp, Homo sapiens
ggcctcagccagaga

SEQ ID NO: 3669699 - DNA, 20 bp, Homo sapiens
ggcctcagccagagaagcta

SEQ ID NO: 3669700 - DNA, 15 bp, Homo sapiens
ggcctcagctgcctc

SEQ ID NO: 3669701 - DNA, 16 bp, Homo sapiens
ggcctcatgtggctgg

SEQ ID NO: 3669702 - DNA, 17 bp, Homo sapiens
ggcctcatgtggctgga

SEQ ID NO: 3669703 - DNA, 15 bp, Homo sapiens
ggcctccctctctct

SEQ ID NO: 3669704 - DNA, 14 bp, Homo sapiens
ggcctcggcccctc

SEQ ID NO: 3669705 - DNA, 16 bp, Homo sapiens
ggcctcttgagcagtg

SEQ ID NO: 3669706 - DNA, 22 bp, Homo sapiens
ggcctcttgagcagtggctggt

SEQ ID NO: 3669707 - DNA, 14 bp, Homo sapiens
ggcctgatgctccc

SEQ ID NO: 3669708 - DNA, 17 bp, Homo sapiens
ggcctgatgctccctcc

SEQ ID NO: 3669709 - DNA, 22 bp, Homo sapiens
ggcctgcataggctccttcctg

SEQ ID NO: 3669710 - DNA, 15 bp, Homo sapiens
ggcctgctccagacc

SEQ ID NO: 3669711 - DNA, 19 bp, Homo sapiens
ggcctgctgcgccccaggc

SEQ ID NO: 3669712 - DNA, 18 bp, Homo sapiens
ggcctggactttcctgca

SEQ ID NO: 3669713 - DNA, 21 bp, Homo sapiens
ggcctggactttcctgcaact

SEQ ID NO: 3669714 - DNA, 17 bp, Homo sapiens
ggcctggagatcctcct

SEQ ID NO: 3669715 - DNA, 19 bp, Homo sapiens
ggcctggagatcctcctgc

SEQ ID NO: 3669716 - DNA, 17 bp, Homo sapiens
ggcctggccaggagctc

SEQ ID NO: 3669717 - DNA, 15 bp, Homo sapiens
ggcctgggccgctgc

SEQ ID NO: 3669718 - DNA, 19 bp, Homo sapiens
ggcctgtctcatccccagg

SEQ ID NO: 3669719 - DNA, 20 bp, Homo sapiens
ggcctgtctcatccccaggg

SEQ ID NO: 3669720 - DNA, 17 bp, Homo sapiens
ggcctgtttgaaagtaa

SEQ ID NO: 3669721 - DNA, 16 bp, Homo sapiens
ggcctttcctggaagc

SEQ ID NO: 3669722 - DNA, 17 bp, Homo sapiens
ggcctttgttctggggg

SEQ ID NO: 3669723 - DNA, 15 bp, Homo sapiens
ggcgaggcccctccc

SEQ ID NO: 3669724 - DNA, 20 bp, Homo sapiens
ggcgccgtctccaggggctg

SEQ ID NO: 3669725 - DNA, 18 bp, Homo sapiens
ggcggcaggggcctggag

SEQ ID NO: 3669726 - DNA, 16 bp, Homo sapiens
ggcggcgggcggctgg

SEQ ID NO: 3669727 - DNA, 22 bp, Homo sapiens
ggcgggtgcctgtaatcccagc

SEQ ID NO: 3669728 - DNA, 17 bp, Homo sapiens
ggcggtgcccacaccgg

SEQ ID NO: 3669729 - DNA, 23 bp, Homo sapiens
ggcgtcacctccaggccgtttct

SEQ ID NO: 3669730 - DNA, 13 bp, Homo sapiens
ggcgtggctctgg

SEQ ID NO: 3669731 - DNA, 14 bp, Homo sapiens
ggcgtggctctggg

SEQ ID NO: 3669732 - DNA, 14 bp, Homo sapiens
ggctagagtcctca

SEQ ID NO: 3669733 - DNA, 18 bp, Homo sapiens
ggctagagtcctcactcc

SEQ ID NO: 3669734 - DNA, 19 bp, Homo sapiens
ggctagagtcctcactccc

SEQ ID NO: 3669735 - DNA, 16 bp, Homo sapiens
ggctagtcaagctcct

SEQ ID NO: 3669736 - DNA, 22 bp, Homo sapiens
ggctagtcaagctcctcctccc

SEQ ID NO: 3669737 - DNA, 20 bp, Homo sapiens
ggctatagctacaggaagca

SEQ ID NO: 3669738 - DNA, 16 bp, Homo sapiens
ggctcacacctgtaat

SEQ ID NO: 3669739 - DNA, 12 bp, Homo sapiens
ggctcagggtgg

SEQ ID NO: 3669740 - DNA, 17 bp, Homo sapiens
ggctcatgcctgtaatc

SEQ ID NO: 3669741 - DNA, 17 bp, Homo sapiens
ggctcccaccctcaagg

SEQ ID NO: 3669742 - DNA, 14 bp, Homo sapiens
ggctcccctggaca

SEQ ID NO: 3669743 - DNA, 14 bp, Homo sapiens
ggctccggcctctg

SEQ ID NO: 3669744 - DNA, 17 bp, Homo sapiens
ggctccggcctctgcct

SEQ ID NO: 3669745 - DNA, 13 bp, Homo sapiens
ggctcctacctgg

SEQ ID NO: 3669746 - DNA, 14 bp, Homo sapiens
ggctcctacctggg

SEQ ID NO: 3669747 - DNA, 15 bp, Homo sapiens
ggctcctacctgggg

SEQ ID NO: 3669748 - DNA, 15 bp, Homo sapiens
ggctcctccctggag

SEQ ID NO: 3669749 - DNA, 13 bp, Homo sapiens
ggctcctgtggta

SEQ ID NO: 3669750 - DNA, 22 bp, Homo sapiens
ggctcctgtggtagtcctccca

SEQ ID NO: 3669751 - DNA, 15 bp, Homo sapiens
ggctccttcctgtgg

SEQ ID NO: 3669752 - DNA, 21 bp, Homo sapiens
ggctccttcctgtgggtgggg

SEQ ID NO: 3669753 - DNA, 13 bp, Homo sapiens
ggctcgaatctct

SEQ ID NO: 3669754 - DNA, 19 bp, Homo sapiens
ggctcgaatctctgtgcct

SEQ ID NO: 3669755 - DNA, 24 bp, Homo sapiens
gtcttttaggacccttcccttgag

SEQ ID NO: 3669756 - DNA, 16 bp, Homo sapiens
gtcttttgacatttta

SEQ ID NO: 3669757 - DNA, 16 bp, Homo sapiens
gtcttttgcttttggc

SEQ ID NO: 3669758 - DNA, 16 bp, Homo sapiens
gtctttttagatgccc

SEQ ID NO: 3669759 - DNA, 21 bp, Homo sapiens
gtgaaagtttttctgaaagtg

SEQ ID NO: 3669760 - DNA, 13 bp, Homo sapiens
gtgaaggaccctt

SEQ ID NO: 3669761 - DNA, 23 bp, Homo sapiens
gtgaataatacagtatctcaggg

SEQ ID NO: 3669762 - DNA, 23 bp, Homo sapiens
gtgaataatcatgtgaaatgttt

SEQ ID NO: 3669763 - DNA, 13 bp, Homo sapiens
gtgaatgctggga

SEQ ID NO: 3669764 - DNA, 12 bp, Homo sapiens
gtgacaaaccat

SEQ ID NO: 3669765 - DNA, 18 bp, Homo sapiens
gtgacacaaacacacaca

SEQ ID NO: 3669766 - DNA, 16 bp, Homo sapiens
gtgacacccaagaggg

SEQ ID NO: 3669767 - DNA, 17 bp, Homo sapiens
gtgacagacaggctctt

SEQ ID NO: 3669768 - DNA, 22 bp, Homo sapiens
gtgacagttgcagcccttgtga

SEQ ID NO: 3669769 - DNA, 15 bp, Homo sapiens
gtgacccatctgtag

SEQ ID NO: 3669770 - DNA, 15 bp, Homo sapiens
gtgaccctctttgct

SEQ ID NO: 3669771 - DNA, 19 bp, Homo sapiens
gtgaccctctttgctgaag

SEQ ID NO: 3669772 - DNA, 16 bp, Homo sapiens
gtgacctgaggaagcg

SEQ ID NO: 3669773 - DNA, 22 bp, Homo sapiens
gtgagaagtgaatgctgggact

SEQ ID NO: 3669774 - DNA, 15 bp, Homo sapiens
gtgagacccccacac

SEQ ID NO: 3669775 - DNA, 22 bp, Homo sapiens
gtgagaccctgtctcaaaaaaa

SEQ ID NO: 3669776 - DNA, 19 bp, Homo sapiens
gtgagcatgtttggaaggg

SEQ ID NO: 3669777 - DNA, 11 bp, Homo sapiens
gtgaggagctg

SEQ ID NO: 3669778 - DNA, 15 bp, Homo sapiens
gtgaggagctgctgg

SEQ ID NO: 3669779 - DNA, 17 bp, Homo sapiens
gtgaggagctgctggct

SEQ ID NO: 3669780 - DNA, 12 bp, Homo sapiens
gtgaggcttgcc

SEQ ID NO: 3669781 - DNA, 19 bp, Homo sapiens
gtgaggcttgcccaggagc

SEQ ID NO: 3669782 - DNA, 13 bp, Homo sapiens
gtgaggggtccct

SEQ ID NO: 3669783 - DNA, 17 bp, Homo sapiens
gtgattgacagctttgc

SEQ ID NO: 3669784 - DNA, 14 bp, Homo sapiens
gtgcaacagggtat

SEQ ID NO: 3669785 - DNA, 24 bp, Homo sapiens
gtgcaacagggtatggactatctg

SEQ ID NO: 3669786 - DNA, 23 bp, Homo sapiens
gtgcaacccttaccccttagcct

SEQ ID NO: 3669787 - DNA, 22 bp, Homo sapiens
gtgcaataaatctgacccagtg

SEQ ID NO: 3669788 - DNA, 13 bp, Homo sapiens
gtgcacagccact

SEQ ID NO: 3669789 - DNA, 21 bp, Homo sapiens
gtgcacatccgcgtgtgcctg

SEQ ID NO: 3669790 - DNA, 15 bp, Homo sapiens
gtgcacgtggagagc

SEQ ID NO: 3669791 - DNA, 21 bp, Homo sapiens
gtgcacgtggagagctggtgc

SEQ ID NO: 3669792 - DNA, 11 bp, Homo sapiens
gtacaataaaa

SEQ ID NO: 3669793 - DNA, 17 bp, Homo sapiens
gtacagacatatttaac

SEQ ID NO: 3669794 - DNA, 12 bp, Homo sapiens
gtacccagccta

SEQ ID NO: 3669795 - DNA, 13 bp, Homo sapiens
gtactagttttag

SEQ ID NO: 3669796 - DNA, 15 bp, Homo sapiens
gtactcctccctggg

SEQ ID NO: 3669797 - DNA, 19 bp, Homo sapiens
gtactcctccctgggggcg

SEQ ID NO: 3669798 - DNA, 13 bp, Homo sapiens
gtactcctgccag

SEQ ID NO: 3669799 - DNA, 14 bp, Homo sapiens
gtactcctgccagg

SEQ ID NO: 3669800 - DNA, 15 bp, Homo sapiens
gtactcctgccaggg

SEQ ID NO: 3669801 - DNA, 16 bp, Homo sapiens
gtacttgtttctctgt

SEQ ID NO: 3669802 - DNA, 17 bp, Homo sapiens
gtacttttcattctctt

SEQ ID NO: 3669803 - DNA, 20 bp, Homo sapiens
gtacttttcattctctttta

SEQ ID NO: 3669804 - DNA, 21 bp, Homo sapiens
gtacttttttaaatattttct

SEQ ID NO: 3669805 - DNA, 12 bp, Homo sapiens
gtagaaaaacat

SEQ ID NO: 3669806 - DNA, 21 bp, Homo sapiens
gtagaaagacagagctgggat

SEQ ID NO: 3669807 - DNA, 18 bp, Homo sapiens
gtagaatacgcagaacta

SEQ ID NO: 3669808 - DNA, 22 bp, Homo sapiens
gtagaccttgttacttctgagg

SEQ ID NO: 3669809 - DNA, 20 bp, Homo sapiens
gtagagtgtagactgtggct

SEQ ID NO: 3669810 - DNA, 22 bp, Homo sapiens
gtagatattggacaaagaacct

SEQ ID NO: 3669811 - DNA, 15 bp, Homo sapiens
gtagccacaccagga

SEQ ID NO: 3669812 - DNA, 18 bp, Homo sapiens
gtagctaacagtgaagat

SEQ ID NO: 3669813 - DNA, 15 bp, Homo sapiens
gtagctgcccctggc

SEQ ID NO: 3669814 - DNA, 20 bp, Homo sapiens
gtaggctgctccctgagggc

SEQ ID NO: 3669815 - DNA, 16 bp, Homo sapiens
gtaggcttctacctgc

SEQ ID NO: 3669816 - DNA, 15 bp, Homo sapiens
gtaggttcagccaag

SEQ ID NO: 3669817 - DNA, 21 bp, Homo sapiens
gtaggttccgtatctccctgg

SEQ ID NO: 3669818 - DNA, 14 bp, Homo sapiens
gtagtaatttattg

SEQ ID NO: 3669819 - DNA, 16 bp, Homo sapiens
gtagtaggcattttta

SEQ ID NO: 3669820 - DNA, 12 bp, Homo sapiens
gtagtccccaac

SEQ ID NO: 3669821 - DNA, 16 bp, Homo sapiens
gtagtccgtgctgaca

SEQ ID NO: 3669822 - DNA, 15 bp, Homo sapiens
gtagtcctcccaagc

SEQ ID NO: 3669823 - DNA, 22 bp, Homo sapiens
gtagtcctcccaagctgtgctg

SEQ ID NO: 3669824 - DNA, 15 bp, Homo sapiens
gtataaaactttcct

SEQ ID NO: 3669825 - DNA, 18 bp, Homo sapiens
gtataaaactttcctcgc

SEQ ID NO: 3669826 - DNA, 19 bp, Homo sapiens
gtataaaactttcctcgcc

SEQ ID NO: 3669827 - DNA, 21 bp, Homo sapiens
gtataaaactttcctcgcctg

SEQ ID NO: 3669828 - DNA, 18 bp, Homo sapiens
gtataatcccacccacct

SEQ ID NO: 3669829 - DNA, 18 bp, Homo sapiens
gtatatatacatatatat

SEQ ID NO: 3669830 - DNA, 14 bp, Homo sapiens
gtatcattaatgta

SEQ ID NO: 3669831 - DNA, 17 bp, Homo sapiens
gtatccccccatcttgc

SEQ ID NO: 3669832 - DNA, 18 bp, Homo sapiens
gtatccccccatcttgct

SEQ ID NO: 3669833 - DNA, 18 bp, Homo sapiens
gtatctaggcaacatagt

SEQ ID NO: 3669834 - DNA, 14 bp, Homo sapiens
gtatctcaggtctg

SEQ ID NO: 3669835 - DNA, 15 bp, Homo sapiens
gtatctccctggaga

SEQ ID NO: 3669836 - DNA, 15 bp, Homo sapiens
gtatctcctcgcaag

SEQ ID NO: 3669837 - DNA, 22 bp, Homo sapiens
gtatctctttcacattgtttgc

SEQ ID NO: 3669838 - DNA, 18 bp, Homo sapiens
gtatgaactaaaaagaga

SEQ ID NO: 3669839 - DNA, 16 bp, Homo sapiens
gtatgtaggagctgca

SEQ ID NO: 3669840 - DNA, 15 bp, Homo sapiens
gtatgtctgtgccat

SEQ ID NO: 3669841 - DNA, 23 bp, Homo sapiens
gtatgtttttgtgtatttgttaa

SEQ ID NO: 3669842 - DNA, 17 bp, Homo sapiens
gtattagtgtttgaaaa

SEQ ID NO: 3669843 - DNA, 19 bp, Homo sapiens
gtattgtaaattatatttg

SEQ ID NO: 3669844 - DNA, 20 bp, Homo sapiens
gtattgtaaattatatttgt

SEQ ID NO: 3669845 - DNA, 15 bp, Homo sapiens
gtatttctgattttg

SEQ ID NO: 3669846 - DNA, 14 bp, Homo sapiens
gtatttgttaatgg

SEQ ID NO: 3669847 - DNA, 20 bp, Homo sapiens
gtattttagtgaacttgaaa

SEQ ID NO: 3669848 - DNA, 14 bp, Homo sapiens
gtattttcatacaa

SEQ ID NO: 3669849 - DNA, 19 bp, Homo sapiens
gtattttgtttttgtctta

SEQ ID NO: 3669850 - DNA, 14 bp, Homo sapiens
gtattttttccttt

SEQ ID NO: 3669851 - DNA, 15 bp, Homo sapiens
gtcaaacaaagccag

SEQ ID NO: 3669852 - DNA, 17 bp, Homo sapiens
gtcaaacaaagccagaa

SEQ ID NO: 3669853 - DNA, 14 bp, Homo sapiens
gtcaaacgtgaaaa

SEQ ID NO: 3669854 - DNA, 23 bp, Homo sapiens
gtcaaactttcacctcagatttt

SEQ ID NO: 3669855 - DNA, 22 bp, Homo sapiens
gtcaacagttttcctatgcttt

SEQ ID NO: 3669856 - DNA, 12 bp, Homo sapiens
gtcaagaagaaa

SEQ ID NO: 3669857 - DNA, 15 bp, Homo sapiens
gtcaagaagaaaaag

SEQ ID NO: 3669858 - DNA, 14 bp, Homo sapiens
gtcaagacatttct

SEQ ID NO: 3669859 - DNA, 13 bp, Homo sapiens
gtcaagctcctcc

SEQ ID NO: 3669860 - DNA, 17 bp, Homo sapiens
gtcaagctcctcctccc

SEQ ID NO: 3669861 - DNA, 15 bp, Homo sapiens
gtcaagtgaaaaagg

SEQ ID NO: 3669862 - DNA, 18 bp, Homo sapiens
gtcaagtgaaaaaggagg

SEQ ID NO: 3669863 - DNA, 21 bp, Homo sapiens
gtcaatacagtacaggcagca

SEQ ID NO: 3669864 - DNA, 18 bp, Homo sapiens
gtcaatcacagtctcagt

SEQ ID NO: 3669865 - DNA, 19 bp, Homo sapiens
gtcaatgggacctgtggct

SEQ ID NO: 3669866 - DNA, 19 bp, Homo sapiens
gtcacatgcccccacttcc

SEQ ID NO: 3669867 - DNA, 23 bp, Homo sapiens
gtcactcagatggaaccgcagga

SEQ ID NO: 3669868 - DNA, 20 bp, Homo sapiens
gtcagctgctccctggcatt

SEQ ID NO: 3669869 - DNA, 23 bp, Homo sapiens
gtcaggagttcgagaccagcctg

SEQ ID NO: 3669870 - DNA, 16 bp, Homo sapiens
gtcaggctgaaaacaa

SEQ ID NO: 3669871 - DNA, 15 bp, Homo sapiens
gtcaggtactcctgc

SEQ ID NO: 3669872 - DNA, 19 bp, Homo sapiens
gtcatagactcctttgcta

SEQ ID NO: 3669873 - DNA, 21 bp, Homo sapiens
gtcatagactcctttgctaat

SEQ ID NO: 3669874 - DNA, 22 bp, Homo sapiens
gtcatatactgccatgtactag

SEQ ID NO: 3669875 - DNA, 16 bp, Homo sapiens
gtcatctcagctggat

SEQ ID NO: 3669876 - DNA, 18 bp, Homo sapiens
gtcatcttgaccaagcag

SEQ ID NO: 3669877 - DNA, 15 bp, Homo sapiens
gtcatcttgcacaca

SEQ ID NO: 3669878 - DNA, 21 bp, Homo sapiens
gtcatggtcctttctggaagt

SEQ ID NO: 3669879 - DNA, 15 bp, Homo sapiens
gtcattgtatgttat

SEQ ID NO: 3669880 - DNA, 14 bp, Homo sapiens
gtccaaactgccta

SEQ ID NO: 3669881 - DNA, 14 bp, Homo sapiens
gtccaaaggaggct

SEQ ID NO: 3669882 - DNA, 23 bp, Homo sapiens
gtccagcaccttgtgcctggggt

SEQ ID NO: 3669883 - DNA, 15 bp, Homo sapiens
gtccagccccccagg

SEQ ID NO: 3669884 - DNA, 16 bp, Homo sapiens
gtccagccccccaggc

SEQ ID NO: 3669885 - DNA, 20 bp, Homo sapiens
gtccagccgccattgccacc

SEQ ID NO: 3669886 - DNA, 11 bp, Homo sapiens
gtccagcctgg

SEQ ID NO: 3669887 - DNA, 10 bp, Homo sapiens
gtccagctct

SEQ ID NO: 3669888 - DNA, 14 bp, Homo sapiens
gtccagctctggag

SEQ ID NO: 3669889 - DNA, 21 bp, Homo sapiens
gtccagctctggaggggaggg

SEQ ID NO: 3669890 - DNA, 17 bp, Homo sapiens
gtccagctctgtgggcc

SEQ ID NO: 3669891 - DNA, 18 bp, Homo sapiens
gtccagctctgtgggccc

SEQ ID NO: 3669892 - DNA, 14 bp, Homo sapiens
gtccaggctgccgt

SEQ ID NO: 3669893 - DNA, 15 bp, Homo sapiens
gtccagggaagctgg

SEQ ID NO: 3669894 - DNA, 16 bp, Homo sapiens
gtcccactcaagccaa

SEQ ID NO: 3669895 - DNA, 22 bp, Homo sapiens
gtcccactcaagccaagcagcc

SEQ ID NO: 3669896 - DNA, 17 bp, Homo sapiens
gtcccagatacttgggg

SEQ ID NO: 3669897 - DNA, 21 bp, Homo sapiens
gtcccagccaccccgggctct

SEQ ID NO: 3669898 - DNA, 23 bp, Homo sapiens
gtcccagccaccccgggctctct

SEQ ID NO: 3669899 - DNA, 16 bp, Homo sapiens
gtcccaggcagggaga

SEQ ID NO: 3669900 - DNA, 17 bp, Homo sapiens
gtcccatgatccctgtg

SEQ ID NO: 3669901 - DNA, 22 bp, Homo sapiens
gtccccaaccgtgtctgtctgg

SEQ ID NO: 3669902 - DNA, 19 bp, Homo sapiens
gtccccaggccccaggaag

SEQ ID NO: 3669903 - DNA, 15 bp, Homo sapiens
gtccccgctgctgtg

SEQ ID NO: 3669904 - DNA, 16 bp, Homo sapiens
gtccccgctgctgtgc

SEQ ID NO: 3669905 - DNA, 20 bp, Homo sapiens
gtccctagcagcccaccctg

SEQ ID NO: 3669906 - DNA, 16 bp, Homo sapiens
gtccctccctttcctc

SEQ ID NO: 3669907 - DNA, 11 bp, Homo sapiens
gtccctctgcc

SEQ ID NO: 3669908 - DNA, 14 bp, Homo sapiens
gtccctctgcccca

SEQ ID NO: 3669909 - DNA, 19 bp, Homo sapiens
gtcccttcccctccctggc

SEQ ID NO: 3669910 - DNA, 13 bp, Homo sapiens
gtcccttgcagct

SEQ ID NO: 3669911 - DNA, 12 bp, Homo sapiens
gtgcagaatgta

SEQ ID NO: 3669912 - DNA, 15 bp, Homo sapiens
gtgcagaggtaccct

SEQ ID NO: 3669913 - DNA, 20 bp, Homo sapiens
gtgcagggagggcagttttc

SEQ ID NO: 3669914 - DNA, 22 bp, Homo sapiens
gtgcatgaaggtttctgaaaat

SEQ ID NO: 3669915 - DNA, 18 bp, Homo sapiens
gtgcatgcagcatctaag

SEQ ID NO: 3669916 - DNA, 18 bp, Homo sapiens
gtgcatgcattgagctgc

SEQ ID NO: 3669917 - DNA, 21 bp, Homo sapiens
gtgcatgcattgagctgcctc

SEQ ID NO: 3669918 - DNA, 11 bp, Homo sapiens
gtgcatttctt

SEQ ID NO: 3669919 - DNA, 20 bp, Homo sapiens
gtgcatttcttggtttatgt

SEQ ID NO: 3669920 - DNA, 23 bp, Homo sapiens
gtgcatttgtgctagaaattttc

SEQ ID NO: 3669921 - DNA, 18 bp, Homo sapiens
gtgccaacttcccctcta

SEQ ID NO: 3669922 - DNA, 14 bp, Homo sapiens
gtgccaccccttcc

SEQ ID NO: 3669923 - DNA, 14 bp, Homo sapiens
gtgccatttctcag

SEQ ID NO: 3669924 - DNA, 21 bp, Homo sapiens
gtgcccacaccggggacaggc

SEQ ID NO: 3669925 - DNA, 14 bp, Homo sapiens
gtgccccaggacca

SEQ ID NO: 3669926 - DNA, 16 bp, Homo sapiens
gtgccccatgcctgtc

SEQ ID NO: 3669927 - DNA, 18 bp, Homo sapiens
gtgcccccactgaccaga

SEQ ID NO: 3669928 - DNA, 21 bp, Homo sapiens
gtgcccctcttccaaaggcag

SEQ ID NO: 3669929 - DNA, 23 bp, Homo sapiens
gtgcccctcttccaaaggcagcg

SEQ ID NO: 3669930 - DNA, 12 bp, Homo sapiens
gtgccctgcccc

SEQ ID NO: 3669931 - DNA, 21 bp, Homo sapiens
gtgcctcgcatcctatgctta

SEQ ID NO: 3669932 - DNA, 13 bp, Homo sapiens
gtgcctgtagcct

SEQ ID NO: 3669933 - DNA, 22 bp, Homo sapiens
gtgcctgtgtccatgcgctcag

SEQ ID NO: 3669934 - DNA, 18 bp, Homo sapiens
gtgcctttcaaatttaga

SEQ ID NO: 3669935 - DNA, 13 bp, Homo sapiens
gtgctatagtatt

SEQ ID NO: 3669936 - DNA, 15 bp, Homo sapiens
gtgctatagtatttg

SEQ ID NO: 3669937 - DNA, 14 bp, Homo sapiens
gtgctatggtgctc

SEQ ID NO: 3669938 - DNA, 18 bp, Homo sapiens
gtgctccctaccacctcc

SEQ ID NO: 3669939 - DNA, 18 bp, Homo sapiens
gtgctgacggccagggag

SEQ ID NO: 3669940 - DNA, 16 bp, Homo sapiens
gtgctgggaagcccgg

SEQ ID NO: 3669941 - DNA, 17 bp, Homo sapiens
gtgctgggaagcccgga

SEQ ID NO: 3669942 - DNA, 17 bp, Homo sapiens
gtgctgtgaggcttgcc

SEQ ID NO: 3669943 - DNA, 12 bp, Homo sapiens
gtgctgtgtgcc

SEQ ID NO: 3669944 - DNA, 18 bp, Homo sapiens
gtggaaaaatagcctgcc

SEQ ID NO: 3669945 - DNA, 20 bp, Homo sapiens
gtggagaagcggctggcagc

SEQ ID NO: 3669946 - DNA, 18 bp, Homo sapiens
gtggagctccactgccat

SEQ ID NO: 3669947 - DNA, 16 bp, Homo sapiens
gtggaggctcctgtgg

SEQ ID NO: 3669948 - DNA, 12 bp, Homo sapiens
gtggagggaggc

SEQ ID NO: 3669949 - DNA, 14 bp, Homo sapiens
gtggatgaggcttc

SEQ ID NO: 3669950 - DNA, 20 bp, Homo sapiens
gtggatgaggcttcttcctg

SEQ ID NO: 3669951 - DNA, 15 bp, Homo sapiens
gtggatggcagtgtg

SEQ ID NO: 3669952 - DNA, 16 bp, Homo sapiens
gtggatggccccagca

SEQ ID NO: 3669953 - DNA, 19 bp, Homo sapiens
gtggattgcacgtggcctc

SEQ ID NO: 3669954 - DNA, 13 bp, Homo sapiens
gtggcaccagcag

SEQ ID NO: 3669955 - DNA, 18 bp, Homo sapiens
gtggcaccagcagcctgg

SEQ ID NO: 3669956 - DNA, 19 bp, Homo sapiens
gtggcaccaggcgctgccc

SEQ ID NO: 3669957 - DNA, 16 bp, Homo sapiens
gtggcaggggacagga

SEQ ID NO: 3669958 - DNA, 18 bp, Homo sapiens
gtggcaggggacaggagt

SEQ ID NO: 3669959 - DNA, 18 bp, Homo sapiens
gtggcagtggaggtgggg

SEQ ID NO: 3669960 - DNA, 14 bp, Homo sapiens
gtggcatcacctta

SEQ ID NO: 3669961 - DNA, 16 bp, Homo sapiens
gtggccaaggagctgc

SEQ ID NO: 3669962 - DNA, 17 bp, Homo sapiens
gtggccaaggagctgct

SEQ ID NO: 3669963 - DNA, 19 bp, Homo sapiens
gtggccactgagctggctg

SEQ ID NO: 3669964 - DNA, 20 bp, Homo sapiens
gtggccactgagctggctga

SEQ ID NO: 3669965 - DNA, 13 bp, Homo sapiens
gtggccagcctgg

SEQ ID NO: 3669966 - DNA, 15 bp, Homo sapiens
gtggccagcctggca

SEQ ID NO: 3669967 - DNA, 21 bp, Homo sapiens
gtggccagcctggcatcagtt

SEQ ID NO: 3669968 - DNA, 18 bp, Homo sapiens
gtggcccaaggctggcag

SEQ ID NO: 3669969 - DNA, 19 bp, Homo sapiens
gtggcccaaggctggcagg

SEQ ID NO: 3669970 - DNA, 18 bp, Homo sapiens
gtggccccaccctgggcc

SEQ ID NO: 3669971 - DNA, 21 bp, Homo sapiens
gtggccccaccctgggccctg

SEQ ID NO: 3669972 - DNA, 23 bp, Homo sapiens
gtggccccaccctgggccctggg

SEQ ID NO: 3669973 - DNA, 17 bp, Homo sapiens
gtggccccgtttctggt

SEQ ID NO: 3669974 - DNA, 17 bp, Homo sapiens
gtggcctcttgagcagt

SEQ ID NO: 3669975 - DNA, 21 bp, Homo sapiens
gtggcctcttgagcagtggct

SEQ ID NO: 3669976 - DNA, 16 bp, Homo sapiens
gtggcctggccaggag

SEQ ID NO: 3669977 - DNA, 20 bp, Homo sapiens
gtggcctggccaggagctct

SEQ ID NO: 3669978 - DNA, 20 bp, Homo sapiens
gtggctagtcaagctcctcc

SEQ ID NO: 3669979 - DNA, 11 bp, Homo sapiens
gtggctctggg

SEQ ID NO: 3669980 - DNA, 23 bp, Homo sapiens
gtggctctgggtgggcggggcac

SEQ ID NO: 3669981 - DNA, 20 bp, Homo sapiens
gtggctctgggtgggcgtgg

SEQ ID NO: 3669982 - DNA, 22 bp, Homo sapiens
gtggctgatggtgtggcctgtg

SEQ ID NO: 3669983 - DNA, 12 bp, Homo sapiens
gtggctggaaga

SEQ ID NO: 3669984 - DNA, 20 bp, Homo sapiens
gtggctggaagatcctgcgg

SEQ ID NO: 3669985 - DNA, 13 bp, Homo sapiens
gtggctgggctgc

SEQ ID NO: 3669986 - DNA, 21 bp, Homo sapiens
gtggctgggtccaggggatgg

SEQ ID NO: 3669987 - DNA, 21 bp, Homo sapiens
gttgccaaatatgtcctgggg

SEQ ID NO: 3669988 - DNA, 19 bp, Homo sapiens
gttgccaagctccaagccc

SEQ ID NO: 3669989 - DNA, 23 bp, Homo sapiens
gttgctgttattatatttgacat

SEQ ID NO: 3669990 - DNA, 14 bp, Homo sapiens
gttggacttcagtc

SEQ ID NO: 3669991 - DNA, 20 bp, Homo sapiens
gttggaggtggggaaggctt

SEQ ID NO: 3669992 - DNA, 13 bp, Homo sapiens
gttggcaggctgg

SEQ ID NO: 3669993 - DNA, 16 bp, Homo sapiens
gttgggcccagatctg

SEQ ID NO: 3669994 - DNA, 17 bp, Homo sapiens
gttgggcccagatctgg

SEQ ID NO: 3669995 - DNA, 18 bp, Homo sapiens
gttgtctctagagcaggg

SEQ ID NO: 3669996 - DNA, 19 bp, Homo sapiens
gttgttatattatttacat

SEQ ID NO: 3669997 - DNA, 22 bp, Homo sapiens
gtttaaacacttatcttctgga

SEQ ID NO: 3669998 - DNA, 13 bp, Homo sapiens
gtttataaatctt

SEQ ID NO: 3669999 - DNA, 13 bp, Homo sapiens
gtttatggcctca

SEQ ID NO: 3670000 - DNA, 15 bp, Homo sapiens
gtttatggcctcagc

SEQ ID NO: 3670001 - DNA, 21 bp, Homo sapiens
gtttattttctacgtttcttt

SEQ ID NO: 3670002 - DNA, 16 bp, Homo sapiens
gtttcaaaataaaaac

SEQ ID NO: 3670003 - DNA, 16 bp, Homo sapiens
gtttccctcctctgca

SEQ ID NO: 3670004 - DNA, 18 bp, Homo sapiens
gtttctccaaactgaagc

SEQ ID NO: 3670005 - DNA, 14 bp, Homo sapiens
gtttctctgtggct

SEQ ID NO: 3670006 - DNA, 18 bp, Homo sapiens
gtttctggtgccatttct

SEQ ID NO: 3670007 - DNA, 21 bp, Homo sapiens
gtttctggtggtctgttggca

SEQ ID NO: 3670008 - DNA, 20 bp, Homo sapiens
gtttctttattttgtgtaaa

SEQ ID NO: 3670009 - DNA, 13 bp, Homo sapiens
gtttgcaaggaag

SEQ ID NO: 3670010 - DNA, 17 bp, Homo sapiens
gtttgctcacctggggt

SEQ ID NO: 3670011 - DNA, 12 bp, Homo sapiens
gtttgctgctat

SEQ ID NO: 3670012 - DNA, 13 bp, Homo sapiens
gtttggctttcag

SEQ ID NO: 3670013 - DNA, 15 bp, Homo sapiens
gtttgtaaatgcctc

SEQ ID NO: 3670014 - DNA, 14 bp, Homo sapiens
gtttgtactcagtg

SEQ ID NO: 3670015 - DNA, 15 bp, Homo sapiens
gtttgtactcagtgg

SEQ ID NO: 3670016 - DNA, 12 bp, Homo sapiens
gtttgtggcctc

SEQ ID NO: 3670017 - DNA, 16 bp, Homo sapiens
gtttgtggcctcagaa

SEQ ID NO: 3670018 - DNA, 20 bp, Homo sapiens
gtttgtggctgggggcagga

SEQ ID NO: 3670019 - DNA, 13 bp, Homo sapiens
gttttaaatgtac

SEQ ID NO: 3670020 - DNA, 21 bp, Homo sapiens
gttttcagaacctcttcccca

SEQ ID NO: 3670021 - DNA, 22 bp, Homo sapiens
gttttcctcccttctgctactg

SEQ ID NO: 3670022 - DNA, 19 bp, Homo sapiens
gttttgtacatgtaacatt

SEQ ID NO: 3670023 - DNA, 19 bp, Homo sapiens
gtttttaaattttgtaatg

SEQ ID NO: 3670024 - DNA, 18 bp, Homo sapiens
gtttttaacaatctaaca

SEQ ID NO: 3670025 - DNA, 15 bp, Homo sapiens
gttttttcaaaatag

SEQ ID NO: 3670026 - DNA, 15 bp, Homo sapiens
gttttttcctcagtg

SEQ ID NO: 3670027 - DNA, 20 bp, Homo sapiens
gttttttcctcagtgcattt

SEQ ID NO: 3670028 - DNA, 13 bp, Homo sapiens
gttttttcctttg

SEQ ID NO: 3670029 - DNA, 14 bp, Homo sapiens
gttttttgtaccaa

SEQ ID NO: 3670030 - DNA, 23 bp, Homo sapiens
gttttttttttttttatgtgatc

SEQ ID NO: 3670031 - DNA, 14 bp, Homo sapiens
taaaaaatattttc

SEQ ID NO: 3670032 - DNA, 14 bp, Homo sapiens
taaaaaccaagaag

SEQ ID NO: 3670033 - DNA, 19 bp, Homo sapiens
taaaaacctgcttggtgtg

SEQ ID NO: 3670034 - DNA, 15 bp, Homo sapiens
taaaaatctcttttc

SEQ ID NO: 3670035 - DNA, 12 bp, Homo sapiens
taactacagaaa

SEQ ID NO: 3670036 - DNA, 15 bp, Homo sapiens
taactagcttggaaa

SEQ ID NO: 3670037 - DNA, 16 bp, Homo sapiens
taactatgttgataaa

SEQ ID NO: 3670038 - DNA, 19 bp, Homo sapiens
taactcctgccattcttct

SEQ ID NO: 3670039 - DNA, 19 bp, Homo sapiens
taactggaacaaattattt

SEQ ID NO: 3670040 - DNA, 12 bp, Homo sapiens
taactgtaaatc

SEQ ID NO: 3670041 - DNA, 14 bp, Homo sapiens
taactgtgaaatac

SEQ ID NO: 3670042 - DNA, 16 bp, Homo sapiens
taactgtgaaatacca

SEQ ID NO: 3670043 - DNA, 22 bp, Homo sapiens
taacttgaatttggtctgtata

SEQ ID NO: 3670044 - DNA, 21 bp, Homo sapiens
taacttggtcagagccactct

SEQ ID NO: 3670045 - DNA, 23 bp, Homo sapiens
taagaaacctactgcccaggcac

SEQ ID NO: 3670046 - DNA, 18 bp, Homo sapiens
taagaaatgtagctgaag

SEQ ID NO: 3670047 - DNA, 22 bp, Homo sapiens
taagaaatgtagctgaagtaga

SEQ ID NO: 3670048 - DNA, 14 bp, Homo sapiens
taagaacctggaac

SEQ ID NO: 3670049 - DNA, 13 bp, Homo sapiens
taagaattgttta

SEQ ID NO: 3670050 - DNA, 19 bp, Homo sapiens
taagaattttaaatatttt

SEQ ID NO: 3670051 - DNA, 17 bp, Homo sapiens
taagacctggcagctct

SEQ ID NO: 3670052 - DNA, 19 bp, Homo sapiens
taagactaacaaaggcagc

SEQ ID NO: 3670053 - DNA, 23 bp, Homo sapiens
taagactaacaaaggcagctgtg

SEQ ID NO: 3670054 - DNA, 19 bp, Homo sapiens
taagagcagtcacaacaga

SEQ ID NO: 3670055 - DNA, 22 bp, Homo sapiens
taagagccatttaggggccact

SEQ ID NO: 3670056 - DNA, 16 bp, Homo sapiens
taagatgtaaattgaa

SEQ ID NO: 3670057 - DNA, 16 bp, Homo sapiens
taagattccattttgg

SEQ ID NO: 3670058 - DNA, 15 bp, Homo sapiens
taagcagaggagggg

SEQ ID NO: 3670059 - DNA, 16 bp, Homo sapiens
taagccccgtctgacc

SEQ ID NO: 3670060 - DNA, 19 bp, Homo sapiens
taaggaaatcaacttgctt

SEQ ID NO: 3670061 - DNA, 12 bp, Homo sapiens
taaggcatgtta

SEQ ID NO: 3670062 - DNA, 20 bp, Homo sapiens
taaggctgaggaaaggccag

SEQ ID NO: 3670063 - DNA, 21 bp, Homo sapiens
taaggctgcaaggtttaggct

SEQ ID NO: 3670064 - DNA, 19 bp, Homo sapiens
taagggcgtggctctgggt

SEQ ID NO: 3670065 - DNA, 18 bp, Homo sapiens
taaggtctttcagtactt

SEQ ID NO: 3670066 - DNA, 21 bp, Homo sapiens
taaggtgtagccacaccagga

SEQ ID NO: 3670067 - DNA, 23 bp, Homo sapiens
taaggttgaaaagacaatagccc

SEQ ID NO: 3670068 - DNA, 14 bp, Homo sapiens
taagtaatggttaa

SEQ ID NO: 3670069 - DNA, 15 bp, Homo sapiens
taagtaccaatggga

SEQ ID NO: 3670070 - DNA, 18 bp, Homo sapiens
taagtaccaatgggaagc

SEQ ID NO: 3670071 - DNA, 19 bp, Homo sapiens
taagtaccaatgggaagca

SEQ ID NO: 3670072 - DNA, 13 bp, Homo sapiens
taagtcatttaac

SEQ ID NO: 3670073 - DNA, 15 bp, Homo sapiens
taagtgaaaatctta

SEQ ID NO: 3670074 - DNA, 19 bp, Homo sapiens
taagtgatattcatttaaa

SEQ ID NO: 3670075 - DNA, 13 bp, Homo sapiens
taagtgcctgctg

SEQ ID NO: 3670076 - DNA, 14 bp, Homo sapiens
taataaaaaggcac

SEQ ID NO: 3670077 - DNA, 20 bp, Homo sapiens
taataaagaattttatttat

SEQ ID NO: 3670078 - DNA, 22 bp, Homo sapiens
taataatttacaggttcttagg

SEQ ID NO: 3670079 - DNA, 19 bp, Homo sapiens
taatataaagttggatgcg

SEQ ID NO: 3670080 - DNA, 16 bp, Homo sapiens
taatatagctgagact

SEQ ID NO: 3670081 - DNA, 21 bp, Homo sapiens
taatatctaaagttatatttc

SEQ ID NO: 3670082 - DNA, 12 bp, Homo sapiens
taatatctcctg

SEQ ID NO: 3670083 - DNA, 16 bp, Homo sapiens
taatatggggatgcag

SEQ ID NO: 3670084 - DNA, 16 bp, Homo sapiens
taatattaaagtcaga

SEQ ID NO: 3670085 - DNA, 17 bp, Homo sapiens
taatcatccaatgctca

SEQ ID NO: 3670086 - DNA, 13 bp, Homo sapiens
taatcatttgttt

SEQ ID NO: 3670087 - DNA, 12 bp, Homo sapiens
gggcctcagttt

SEQ ID NO: 3670088 - DNA, 16 bp, Homo sapiens
gggcctcgctttccca

SEQ ID NO: 3670089 - DNA, 15 bp, Homo sapiens
gggcctgctccagac

SEQ ID NO: 3670090 - DNA, 14 bp, Homo sapiens
gggcggagcgcctc

SEQ ID NO: 3670091 - DNA, 19 bp, Homo sapiens
gggcggagcgcctccttag

SEQ ID NO: 3670092 - DNA, 18 bp, Homo sapiens
gggcgggactcctccctg

SEQ ID NO: 3670093 - DNA, 15 bp, Homo sapiens
gggcgggtcctagct

SEQ ID NO: 3670094 - DNA, 21 bp, Homo sapiens
gggcgtggagggaggccccag

SEQ ID NO: 3670095 - DNA, 14 bp, Homo sapiens
gggcgtggctctgg

SEQ ID NO: 3670096 - DNA, 18 bp, Homo sapiens
gggcgtggctctgggtgg

SEQ ID NO: 3670097 - DNA, 15 bp, Homo sapiens
gggctcctacctggg

SEQ ID NO: 3670098 - DNA, 19 bp, Homo sapiens
gggctcctacctgggggca

SEQ ID NO: 3670099 - DNA, 16 bp, Homo sapiens
gggctcctcctgaagg

SEQ ID NO: 3670100 - DNA, 11 bp, Homo sapiens
gggctcctgca

SEQ ID NO: 3670101 - DNA, 17 bp, Homo sapiens
gggctctaggatggggc

SEQ ID NO: 3670102 - DNA, 19 bp, Homo sapiens
gggctctaggatggggcac

SEQ ID NO: 3670103 - DNA, 14 bp, Homo sapiens
gggctgctcctcat

SEQ ID NO: 3670104 - DNA, 14 bp, Homo sapiens
gggctgctcctgaa

SEQ ID NO: 3670105 - DNA, 17 bp, Homo sapiens
gggctgctgacctccac

SEQ ID NO: 3670106 - DNA, 12 bp, Homo sapiens
gggctgcttcct

SEQ ID NO: 3670107 - DNA, 15 bp, Homo sapiens
gggctgtggctctgg

SEQ ID NO: 3670108 - DNA, 17 bp, Homo sapiens
gggcttcaggtccaggc

SEQ ID NO: 3670109 - DNA, 18 bp, Homo sapiens
gggcttccatgcctgtag

SEQ ID NO: 3670110 - DNA, 22 bp, Homo sapiens
gggcttctctccgcgggtggga

SEQ ID NO: 3670111 - DNA, 13 bp, Homo sapiens
gggcttctctggg

SEQ ID NO: 3670112 - DNA, 19 bp, Homo sapiens
gggcttctctgggaccagg

SEQ ID NO: 3670113 - DNA, 21 bp, Homo sapiens
gggcttctcttgggtgggaca

SEQ ID NO: 3670114 - DNA, 17 bp, Homo sapiens
gggcttttccctgggtg

SEQ ID NO: 3670115 - DNA, 14 bp, Homo sapiens
ggggaaaaaaatgt

SEQ ID NO: 3670116 - DNA, 16 bp, Homo sapiens
ggggaaaatcagcctg

SEQ ID NO: 3670117 - DNA, 16 bp, Homo sapiens
ggggaaagcctgaagg

SEQ ID NO: 3670118 - DNA, 15 bp, Homo sapiens
ggggacccagtgcag

SEQ ID NO: 3670119 - DNA, 21 bp, Homo sapiens
ggggacccagtgcagaatgta

SEQ ID NO: 3670120 - DNA, 23 bp, Homo sapiens
ggggagcatgcttccctgcagct

SEQ ID NO: 3670121 - DNA, 15 bp, Homo sapiens
ggggaggcccatccc

SEQ ID NO: 3670122 - DNA, 15 bp, Homo sapiens
ggggagggattctgg

SEQ ID NO: 3670123 - DNA, 17 bp, Homo sapiens
ggggagttaagacctgg

SEQ ID NO: 3670124 - DNA, 23 bp, Homo sapiens
ggggatccctcccccccatgcac

SEQ ID NO: 3670125 - DNA, 13 bp, Homo sapiens
ggggcacaggagg

SEQ ID NO: 3670126 - DNA, 15 bp, Homo sapiens
ggggcacggctctgg

SEQ ID NO: 3670127 - DNA, 10 bp, Homo sapiens
ggggcaggca

SEQ ID NO: 3670128 - DNA, 11 bp, Homo sapiens
ggggcaggcag

SEQ ID NO: 3670129 - DNA, 19 bp, Homo sapiens
ggggccacttttgactagg

SEQ ID NO: 3670130 - DNA, 12 bp, Homo sapiens
ggggcccagtgc

SEQ ID NO: 3670131 - DNA, 15 bp, Homo sapiens
ggggcccggccagcc

SEQ ID NO: 3670132 - DNA, 15 bp, Homo sapiens
ggggccctacctggg

SEQ ID NO: 3670133 - DNA, 20 bp, Homo sapiens
ggggccggccctgtgtgcag

SEQ ID NO: 3670134 - DNA, 20 bp, Homo sapiens
ggggcctaggcctcagccag

SEQ ID NO: 3670135 - DNA, 19 bp, Homo sapiens
ggggcctggagatcctcct

SEQ ID NO: 3670136 - DNA, 16 bp, Homo sapiens
ggggcgaggcccctcc

SEQ ID NO: 3670137 - DNA, 15 bp, Homo sapiens
ggggcggggcttctc

SEQ ID NO: 3670138 - DNA, 18 bp, Homo sapiens
ggggcgtctgttccccct

SEQ ID NO: 3670139 - DNA, 15 bp, Homo sapiens
ggggctcctacctgg

SEQ ID NO: 3670140 - DNA, 21 bp, Homo sapiens
ggggctcctacctgggggcag

SEQ ID NO: 3670141 - DNA, 13 bp, Homo sapiens
ggggctcctcctg

SEQ ID NO: 3670142 - DNA, 17 bp, Homo sapiens
ggggctcctcctgaagg

SEQ ID NO: 3670143 - DNA, 18 bp, Homo sapiens
ggggctcctcctgaagga

SEQ ID NO: 3670144 - DNA, 24 bp, Homo sapiens
ggggctctcatgttttcaactgcc

SEQ ID NO: 3670145 - DNA, 21 bp, Homo sapiens
ggggctctgcgttggcttctc

SEQ ID NO: 3670146 - DNA, 15 bp, Homo sapiens
ggggctgtggctctg

SEQ ID NO: 3670147 - DNA, 23 bp, Homo sapiens
ggggcttctctccgcgggtggga

SEQ ID NO: 3670148 - DNA, 17 bp, Homo sapiens
ggggcttctcttgggtg

SEQ ID NO: 3670149 - DNA, 18 bp, Homo sapiens
gggggtctcacccatgca

SEQ ID NO: 3670150 - DNA, 13 bp, Homo sapiens
gggggtggccgct

SEQ ID NO: 3670151 - DNA, 19 bp, Homo sapiens
ggggtagctagaggaacca

SEQ ID NO: 3670152 - DNA, 18 bp, Homo sapiens
ggggtcatgccctcctct

SEQ ID NO: 3670153 - DNA, 21 bp, Homo sapiens
ggggtcatgccctcctctccc

SEQ ID NO: 3670154 - DNA, 20 bp, Homo sapiens
ggggtctggagttgatctgg

SEQ ID NO: 3670155 - DNA, 15 bp, Homo sapiens
ggggtgaggagctgg

SEQ ID NO: 3670156 - DNA, 13 bp, Homo sapiens
ggggtgggccagg

SEQ ID NO: 3670157 - DNA, 12 bp, Homo sapiens
ggggtggggctc

SEQ ID NO: 3670158 - DNA, 13 bp, Homo sapiens
ggggtggggctcc

SEQ ID NO: 3670159 - DNA, 18 bp, Homo sapiens
ggggtgttagtggcaccg

SEQ ID NO: 3670160 - DNA, 19 bp, Homo sapiens
ggggttaacttggtcagag

SEQ ID NO: 3670161 - DNA, 22 bp, Homo sapiens
ggggttaacttggtcagagcca

SEQ ID NO: 3670162 - DNA, 23 bp, Homo sapiens
ggggtttaaatatccaggtgtgc

SEQ ID NO: 3670163 - DNA, 20 bp, Homo sapiens
ggggttttatggtggatgag

SEQ ID NO: 3670164 - DNA, 23 bp, Homo sapiens
gggtataaaactttcctcgcctg

SEQ ID NO: 3670165 - DNA, 15 bp, Homo sapiens
gggtatgaactaaaa

SEQ ID NO: 3670166 - DNA, 12 bp, Homo sapiens
gggtcaaggaat

SEQ ID NO: 3670167 - DNA, 20 bp, Homo sapiens
gggtcacacaaaggcatgct

SEQ ID NO: 3670168 - DNA, 21 bp, Homo sapiens
gggtcacacaaaggcatgctg

SEQ ID NO: 3670169 - DNA, 21 bp, Homo sapiens
gggtcatgccctcctctccca

SEQ ID NO: 3670170 - DNA, 17 bp, Homo sapiens
gggtccctagcagccca

SEQ ID NO: 3670171 - DNA, 13 bp, Homo sapiens
gggtcctgctttc

SEQ ID NO: 3670172 - DNA, 15 bp, Homo sapiens
gggtcctggccatcc

SEQ ID NO: 3670173 - DNA, 16 bp, Homo sapiens
gggtcctggccatccc

SEQ ID NO: 3670174 - DNA, 17 bp, Homo sapiens
gggtcgaggcctgccca

SEQ ID NO: 3670175 - DNA, 20 bp, Homo sapiens
gggtctgctctttctctgcc

SEQ ID NO: 3670176 - DNA, 21 bp, Homo sapiens
gggtctgctctttctctgcca

SEQ ID NO: 3670177 - DNA, 22 bp, Homo sapiens
gggtctgctctttctctgccag

SEQ ID NO: 3670178 - DNA, 20 bp, Homo sapiens
gggtctggagttgatctgga

SEQ ID NO: 3670179 - DNA, 22 bp, Homo sapiens
gggtctttgtggtagcttatct

SEQ ID NO: 3670180 - DNA, 17 bp, Homo sapiens
gggtgagaggaagggtg

SEQ ID NO: 3670181 - DNA, 14 bp, Homo sapiens
gggtgaggagctgg

SEQ ID NO: 3670182 - DNA, 16 bp, Homo sapiens
gggtgctccctaccac

SEQ ID NO: 3670183 - DNA, 19 bp, Homo sapiens
gggtgctgtgaggcttgcc

SEQ ID NO: 3670184 - DNA, 16 bp, Homo sapiens
tcattctccttgtaaa

SEQ ID NO: 3670185 - DNA, 17 bp, Homo sapiens
tcattgccttaactgga

SEQ ID NO: 3670186 - DNA, 15 bp, Homo sapiens
tcattgtatgttatt

SEQ ID NO: 3670187 - DNA, 15 bp, Homo sapiens
tcatttacaactgaa

SEQ ID NO: 3670188 - DNA, 19 bp, Homo sapiens
tcatttatatcgctggcca

SEQ ID NO: 3670189 - DNA, 14 bp, Homo sapiens
tcatttttgaatac

SEQ ID NO: 3670190 - DNA, 15 bp, Homo sapiens
tccaaaagaagcccc

SEQ ID NO: 3670191 - DNA, 18 bp, Homo sapiens
tccaaaagaagcccccag

SEQ ID NO: 3670192 - DNA, 14 bp, Homo sapiens
tccaaacctggttc

SEQ ID NO: 3670193 - DNA, 13 bp, Homo sapiens
tccaaaggcagcg

SEQ ID NO: 3670194 - DNA, 22 bp, Homo sapiens
tccaaatgtcctccagaagcct

SEQ ID NO: 3670195 - DNA, 14 bp, Homo sapiens
tccaacaggagctg

SEQ ID NO: 3670196 - DNA, 16 bp, Homo sapiens
tccaacgtggcccaga

SEQ ID NO: 3670197 - DNA, 15 bp, Homo sapiens
tccaagcgcctggct

SEQ ID NO: 3670198 - DNA, 21 bp, Homo sapiens
tccaaggggaatcagaactca

SEQ ID NO: 3670199 - DNA, 16 bp, Homo sapiens
tccaagtcacaaagag

SEQ ID NO: 3670200 - DNA, 18 bp, Homo sapiens
tccaagtcacaaagagat

SEQ ID NO: 3670201 - DNA, 20 bp, Homo sapiens
tccaatggggcggggcttct

SEQ ID NO: 3670202 - DNA, 17 bp, Homo sapiens
tccaattttaatttagt

SEQ ID NO: 3670203 - DNA, 21 bp, Homo sapiens
tccacaagtgccgcaaattgt

SEQ ID NO: 3670204 - DNA, 16 bp, Homo sapiens
tccacacccgtgagaa

SEQ ID NO: 3670205 - DNA, 23 bp, Homo sapiens
tccacagcttcccctctctcctc

SEQ ID NO: 3670206 - DNA, 21 bp, Homo sapiens
tccacccctgcgtcgagctgg

SEQ ID NO: 3670207 - DNA, 13 bp, Homo sapiens
tccacccttggcc

SEQ ID NO: 3670208 - DNA, 15 bp, Homo sapiens
tccacgcgtgccgtg

SEQ ID NO: 3670209 - DNA, 23 bp, Homo sapiens
tccacgggggctgtggctctggg

SEQ ID NO: 3670210 - DNA, 15 bp, Homo sapiens
tccactccattgtcg

SEQ ID NO: 3670211 - DNA, 19 bp, Homo sapiens
tccactctgcttctctgac

SEQ ID NO: 3670212 - DNA, 20 bp, Homo sapiens
tccactctgcttctctgact

SEQ ID NO: 3670213 - DNA, 21 bp, Homo sapiens
tccactctgcttctctgactt

SEQ ID NO: 3670214 - DNA, 23 bp, Homo sapiens
tccactctgcttctctgacttct

SEQ ID NO: 3670215 - DNA, 16 bp, Homo sapiens
tccactgtgctttcag

SEQ ID NO: 3670216 - DNA, 15 bp, Homo sapiens
tccactttgtttcgt

SEQ ID NO: 3670217 - DNA, 18 bp, Homo sapiens
tccactttgtttcgtggg

SEQ ID NO: 3670218 - DNA, 14 bp, Homo sapiens
tccagaaaacaaaa

SEQ ID NO: 3670219 - DNA, 20 bp, Homo sapiens
tccagaacacggctcacgct

SEQ ID NO: 3670220 - DNA, 17 bp, Homo sapiens
tccagattgacgacaag

SEQ ID NO: 3670221 - DNA, 23 bp, Homo sapiens
tccagccaaagcctcctccagcc

SEQ ID NO: 3670222 - DNA, 17 bp, Homo sapiens
tccagccacagaaaaga

SEQ ID NO: 3670223 - DNA, 13 bp, Homo sapiens
tccagccccccag

SEQ ID NO: 3670224 - DNA, 17 bp, Homo sapiens
taggtcttgctggaaga

SEQ ID NO: 3670225 - DNA, 20 bp, Homo sapiens
taggtcttgctggaagacag

SEQ ID NO: 3670226 - DNA, 15 bp, Homo sapiens
taggtgagaaaaaaa

SEQ ID NO: 3670227 - DNA, 21 bp, Homo sapiens
taggttggcaaaaaggcagga

SEQ ID NO: 3670228 - DNA, 11 bp, Homo sapiens
tagtaaatgtt

SEQ ID NO: 3670229 - DNA, 16 bp, Homo sapiens
tagtaggcatttttac

SEQ ID NO: 3670230 - DNA, 12 bp, Homo sapiens
tagtatttgatt

SEQ ID NO: 3670231 - DNA, 13 bp, Homo sapiens
tagtcaagctcct

SEQ ID NO: 3670232 - DNA, 18 bp, Homo sapiens
tagtcaatcaagtctgtt

SEQ ID NO: 3670233 - DNA, 14 bp, Homo sapiens
tagtcccttcccct

SEQ ID NO: 3670234 - DNA, 20 bp, Homo sapiens
tagtcctcccaagctgtgct

SEQ ID NO: 3670235 - DNA, 14 bp, Homo sapiens
tagtcctgggagag

SEQ ID NO: 3670236 - DNA, 17 bp, Homo sapiens
tagtcgccctacagaaa

SEQ ID NO: 3670237 - DNA, 19 bp, Homo sapiens
tagtctgagcttctttagc

SEQ ID NO: 3670238 - DNA, 24 bp, Homo sapiens
tagtgaaaccccatctctactgaa

SEQ ID NO: 3670239 - DNA, 23 bp, Homo sapiens
tagtgagcagtgagcactgaaac

SEQ ID NO: 3670240 - DNA, 16 bp, Homo sapiens
tagtgccacccacctt

SEQ ID NO: 3670241 - DNA, 16 bp, Homo sapiens
tagtgccttctaaagg

SEQ ID NO: 3670242 - DNA, 19 bp, Homo sapiens
tagtgccttctaaaggtgt

SEQ ID NO: 3670243 - DNA, 20 bp, Homo sapiens
tagtggtttatcagcaaaaa

SEQ ID NO: 3670244 - DNA, 15 bp, Homo sapiens
tagtgttctgtttgt

SEQ ID NO: 3670245 - DNA, 14 bp, Homo sapiens
tagttttagttttc

SEQ ID NO: 3670246 - DNA, 20 bp, Homo sapiens
tagtttttacagctgtgtta

SEQ ID NO: 3670247 - DNA, 17 bp, Homo sapiens
tataaaacaggtcaata

SEQ ID NO: 3670248 - DNA, 14 bp, Homo sapiens
tataaacactatat

SEQ ID NO: 3670249 - DNA, 12 bp, Homo sapiens
tataaagaattc

SEQ ID NO: 3670250 - DNA, 18 bp, Homo sapiens
tataaagtagtcctgtga

SEQ ID NO: 3670251 - DNA, 14 bp, Homo sapiens
tataaattcctctt

SEQ ID NO: 3670252 - DNA, 19 bp, Homo sapiens
tataacatatatggaagag

SEQ ID NO: 3670253 - DNA, 18 bp, Homo sapiens
tataagtcattgtatgtt

SEQ ID NO: 3670254 - DNA, 21 bp, Homo sapiens
tatactactttgttaggattt

SEQ ID NO: 3670255 - DNA, 19 bp, Homo sapiens
tatactattaaaaaggttt

SEQ ID NO: 3670256 - DNA, 21 bp, Homo sapiens
tatactattaaaaaggtttac

SEQ ID NO: 3670257 - DNA, 13 bp, Homo sapiens
tatactgtacaat

SEQ ID NO: 3670258 - DNA, 23 bp, Homo sapiens
tatagaaaaataaaaatctcttt

SEQ ID NO: 3670259 - DNA, 22 bp, Homo sapiens
tatagctacaggaagcacccca

SEQ ID NO: 3670260 - DNA, 22 bp, Homo sapiens
tatagttattaagttctttaaa

SEQ ID NO: 3670261 - DNA, 17 bp, Homo sapiens
tatataacatatatgga

SEQ ID NO: 3670262 - DNA, 19 bp, Homo sapiens
tatataatatctaaagtta

SEQ ID NO: 3670263 - DNA, 14 bp, Homo sapiens
tatatctctatttg

SEQ ID NO: 3670264 - DNA, 15 bp, Homo sapiens
tatatctctatttga

SEQ ID NO: 3670265 - DNA, 15 bp, Homo sapiens
tatatggtatatata

SEQ ID NO: 3670266 - DNA, 11 bp, Homo sapiens
tatatgtattt

SEQ ID NO: 3670267 - DNA, 17 bp, Homo sapiens
tatattaatgtacttgt

SEQ ID NO: 3670268 - DNA, 12 bp, Homo sapiens
tatatttgacat

SEQ ID NO: 3670269 - DNA, 13 bp, Homo sapiens
tatatttgacatg

SEQ ID NO: 3670270 - DNA, 17 bp, Homo sapiens
tatatttgtgctatagt

SEQ ID NO: 3670271 - DNA, 13 bp, Homo sapiens
tatcacacttctg

SEQ ID NO: 3670272 - DNA, 18 bp, Homo sapiens
tatcacctcattctgaac

SEQ ID NO: 3670273 - DNA, 21 bp, Homo sapiens
tatcatgtcaaacgtgaaaat

SEQ ID NO: 3670274 - DNA, 14 bp, Homo sapiens
tatccaggtgtgcc

SEQ ID NO: 3670275 - DNA, 20 bp, Homo sapiens
tatccatgtacttgtttgca

SEQ ID NO: 3670276 - DNA, 17 bp, Homo sapiens
tatccccccatcttgct

SEQ ID NO: 3670277 - DNA, 20 bp, Homo sapiens
tatccccccatcttgcttcc

SEQ ID NO: 3670278 - DNA, 18 bp, Homo sapiens
tatccctggttgcctcat

SEQ ID NO: 3670279 - DNA, 23 bp, Homo sapiens
tatcctaagactaacaaaggcag

SEQ ID NO: 3670280 - DNA, 18 bp, Homo sapiens
tatcctcctgttctgaaa

SEQ ID NO: 3670281 - DNA, 12 bp, Homo sapiens
tatctaaagtta

SEQ ID NO: 3670282 - DNA, 13 bp, Homo sapiens
tatctaaagttat

SEQ ID NO: 3670283 - DNA, 19 bp, Homo sapiens
tatctaaagttatatttca

SEQ ID NO: 3670284 - DNA, 17 bp, Homo sapiens
tatctaggcaacatagt

SEQ ID NO: 3670285 - DNA, 13 bp, Homo sapiens
tatctcagggcct

SEQ ID NO: 3670286 - DNA, 21 bp, Homo sapiens
taccactttcttattctgtat

SEQ ID NO: 3670287 - DNA, 21 bp, Homo sapiens
taccatgggtgtggatggcag

SEQ ID NO: 3670288 - DNA, 17 bp, Homo sapiens
taccatttttctggatt

SEQ ID NO: 3670289 - DNA, 16 bp, Homo sapiens
tacccacaatctgagc

SEQ ID NO: 3670290 - DNA, 18 bp, Homo sapiens
tacccacaatctgagcac

SEQ ID NO: 3670291 - DNA, 14 bp, Homo sapiens
taccctcccacccc

SEQ ID NO: 3670292 - DNA, 23 bp, Homo sapiens
taccctcctgctgagctgcccct

SEQ ID NO: 3670293 - DNA, 11 bp, Homo sapiens
taccctgggtg

SEQ ID NO: 3670294 - DNA, 12 bp, Homo sapiens
taccctgggtgt

SEQ ID NO: 3670295 - DNA, 16 bp, Homo sapiens
tacctctgagaagaca

SEQ ID NO: 3670296 - DNA, 16 bp, Homo sapiens
tacctgaaggcagggc

SEQ ID NO: 3670297 - DNA, 22 bp, Homo sapiens
tacctgcaggcggggctcctcc

SEQ ID NO: 3670298 - DNA, 23 bp, Homo sapiens
tacctgcaggcggggctcctcct

SEQ ID NO: 3670299 - DNA, 18 bp, Homo sapiens
tacctgggggcagaactc

SEQ ID NO: 3670300 - DNA, 13 bp, Homo sapiens
tacctgttgagca

SEQ ID NO: 3670301 - DNA, 21 bp, Homo sapiens
taccttttttgttttttcaaa

SEQ ID NO: 3670302 - DNA, 14 bp, Homo sapiens
tacgatacgctact

SEQ ID NO: 3670303 - DNA, 23 bp, Homo sapiens
tacgatacgctactataaagaga

SEQ ID NO: 3670304 - DNA, 13 bp, Homo sapiens
tacgtttctttaa

SEQ ID NO: 3670305 - DNA, 12 bp, Homo sapiens
tactactttgtt

SEQ ID NO: 3670306 - DNA, 23 bp, Homo sapiens
tactaggaagaacgttttttcct

SEQ ID NO: 3670307 - DNA, 15 bp, Homo sapiens
tactagtgttctgtt

SEQ ID NO: 3670308 - DNA, 14 bp, Homo sapiens
tactataaagagaa

SEQ ID NO: 3670309 - DNA, 13 bp, Homo sapiens
tactcaagtacca

SEQ ID NO: 3670310 - DNA, 16 bp, Homo sapiens
tactcccattaggtag

SEQ ID NO: 3670311 - DNA, 14 bp, Homo sapiens
tactcctccctggg

SEQ ID NO: 3670312 - DNA, 16 bp, Homo sapiens
tactcctccctggggg

SEQ ID NO: 3670313 - DNA, 21 bp, Homo sapiens
tactcgcacctcttggctttg

SEQ ID NO: 3670314 - DNA, 16 bp, Homo sapiens
tactctaccctcttag

SEQ ID NO: 3670315 - DNA, 13 bp, Homo sapiens
tactgatttaatt

SEQ ID NO: 3670316 - DNA, 19 bp, Homo sapiens
tactgccatgtactagttt

SEQ ID NO: 3670317 - DNA, 18 bp, Homo sapiens
tactgcgactttctgcct

SEQ ID NO: 3670318 - DNA, 19 bp, Homo sapiens
tactgcgactttctgcctg

SEQ ID NO: 3670319 - DNA, 18 bp, Homo sapiens
tactggcaaaaggatctt

SEQ ID NO: 3670320 - DNA, 22 bp, Homo sapiens
tactggcaaaaggatctttgtg

SEQ ID NO: 3670321 - DNA, 18 bp, Homo sapiens
tactgggccctgagtctg

SEQ ID NO: 3670322 - DNA, 23 bp, Homo sapiens
tactgggccctgagtctgggcag

SEQ ID NO: 3670323 - DNA, 19 bp, Homo sapiens
tacttaactatctgttccc

SEQ ID NO: 3670324 - DNA, 20 bp, Homo sapiens
tacttcactatacaaacaaa

SEQ ID NO: 3670325 - DNA, 13 bp, Homo sapiens
tacttctgaggta

SEQ ID NO: 3670326 - DNA, 16 bp, Homo sapiens
tacttgaagggccaga

SEQ ID NO: 3670327 - DNA, 18 bp, Homo sapiens
tacttgaagggccagagc

SEQ ID NO: 3670328 - DNA, 21 bp, Homo sapiens
tacttgaagggccagagccag

SEQ ID NO: 3670329 - DNA, 16 bp, Homo sapiens
tacttgagcccaggag

SEQ ID NO: 3670330 - DNA, 16 bp, Homo sapiens
tacttgtttctctgtt

SEQ ID NO: 3670331 - DNA, 20 bp, Homo sapiens
tacttgtttctctgttgtaa

SEQ ID NO: 3670332 - DNA, 15 bp, Homo sapiens
tactttgattctgat

SEQ ID NO: 3670333 - DNA, 21 bp, Homo sapiens
tactttgattctgataatgct

SEQ ID NO: 3670334 - DNA, 15 bp, Homo sapiens
tagaaaaataaaaat

SEQ ID NO: 3670335 - DNA, 18 bp, Homo sapiens
tagaaagctgacattgcc

SEQ ID NO: 3670336 - DNA, 14 bp, Homo sapiens
tagaacatccctgc

SEQ ID NO: 3670337 - DNA, 12 bp, Homo sapiens
tagaaccaggca

SEQ ID NO: 3670338 - DNA, 19 bp, Homo sapiens
tagaactccaggccctcct

SEQ ID NO: 3670339 - DNA, 14 bp, Homo sapiens
tagaatagcctgag

SEQ ID NO: 3670340 - DNA, 20 bp, Homo sapiens
tagaatgcatctcatcaact

SEQ ID NO: 3670341 - DNA, 14 bp, Homo sapiens
tagacaagccagaa

SEQ ID NO: 3670342 - DNA, 15 bp, Homo sapiens
tagacaagccagaac

SEQ ID NO: 3670343 - DNA, 23 bp, Homo sapiens
tctcgcataggacctttccacca

SEQ ID NO: 3670344 - DNA, 23 bp, Homo sapiens
tctcggatagttgctatttttgt

SEQ ID NO: 3670345 - DNA, 17 bp, Homo sapiens
tctctaactcctgccat

SEQ ID NO: 3670346 - DNA, 14 bp, Homo sapiens
tctctcctgcggga

SEQ ID NO: 3670347 - DNA, 14 bp, Homo sapiens
tctctctgcccaac

SEQ ID NO: 3670348 - DNA, 16 bp, Homo sapiens
tctctctgcccaaccc

SEQ ID NO: 3670349 - DNA, 11 bp, Homo sapiens
tctctcttctg

SEQ ID NO: 3670350 - DNA, 16 bp, Homo sapiens
tctctgacttctgcct

SEQ ID NO: 3670351 - DNA, 12 bp, Homo sapiens
tctctgcccaac

SEQ ID NO: 3670352 - DNA, 17 bp, Homo sapiens
tctctgctccaccacat

SEQ ID NO: 3670353 - DNA, 19 bp, Homo sapiens
tctctgctccaccacatcc

SEQ ID NO: 3670354 - DNA, 16 bp, Homo sapiens
tctctgctctgctcag

SEQ ID NO: 3670355 - DNA, 17 bp, Homo sapiens
tctctgggaccaggctc

SEQ ID NO: 3670356 - DNA, 16 bp, Homo sapiens
tctctggtggctgggc

SEQ ID NO: 3670357 - DNA, 17 bp, Homo sapiens
tctctggtggctgggct

SEQ ID NO: 3670358 - DNA, 19 bp, Homo sapiens
tctcttccttgctttctct

SEQ ID NO: 3670359 - DNA, 17 bp, Homo sapiens
tctcttctgctccaccc

SEQ ID NO: 3670360 - DNA, 13 bp, Homo sapiens
tctcttgagcctg

SEQ ID NO: 3670361 - DNA, 15 bp, Homo sapiens
tctcttgagcctggg

SEQ ID NO: 3670362 - DNA, 17 bp, Homo sapiens
tctcttgagcctgggag

SEQ ID NO: 3670363 - DNA, 15 bp, Homo sapiens
tctcttgagtttgtc

SEQ ID NO: 3670364 - DNA, 13 bp, Homo sapiens
tctcttgggtggg

SEQ ID NO: 3670365 - DNA, 19 bp, Homo sapiens
tctcttgggtgggacaggg

SEQ ID NO: 3670366 - DNA, 22 bp, Homo sapiens
tctcttgggtgggacagggctt

SEQ ID NO: 3670367 - DNA, 14 bp, Homo sapiens
tctctttaaaatgc

SEQ ID NO: 3670368 - DNA, 22 bp, Homo sapiens
tctcttttccactccattgtcg

SEQ ID NO: 3670369 - DNA, 14 bp, Homo sapiens
tctgaaaaggaacg

SEQ ID NO: 3670370 - DNA, 18 bp, Homo sapiens
tctgaaaattaacactgc

SEQ ID NO: 3670371 - DNA, 15 bp, Homo sapiens
tctgaaaccttagtt

SEQ ID NO: 3670372 - DNA, 18 bp, Homo sapiens
tctgaacccaggcagctg

SEQ ID NO: 3670373 - DNA, 19 bp, Homo sapiens
tctgaacccaggcagctgg

SEQ ID NO: 3670374 - DNA, 16 bp, Homo sapiens
tctgaactttggaagc

SEQ ID NO: 3670375 - DNA, 19 bp, Homo sapiens
tctgaaggggcaaattctt

SEQ ID NO: 3670376 - DNA, 18 bp, Homo sapiens
tctgaatggtgcgtgaag

SEQ ID NO: 3670377 - DNA, 13 bp, Homo sapiens
tctgaccagcagc

SEQ ID NO: 3670378 - DNA, 15 bp, Homo sapiens
tctgacccagtgccc

SEQ ID NO: 3670379 - DNA, 14 bp, Homo sapiens
tctgaccccagccc

SEQ ID NO: 3670380 - DNA, 20 bp, Homo sapiens
tctgaccccagcccagacag

SEQ ID NO: 3670381 - DNA, 21 bp, Homo sapiens
tctgaccccagcccagacagc

SEQ ID NO: 3670382 - DNA, 22 bp, Homo sapiens
tctgaccccagcccagacagca

SEQ ID NO: 3670383 - DNA, 21 bp, Homo sapiens
tctgaccgaaacagcgctggg

SEQ ID NO: 3670384 - DNA, 20 bp, Homo sapiens
tctgactcggtttctccaaa

SEQ ID NO: 3670385 - DNA, 19 bp, Homo sapiens
tctgacttaagcaaaagaa

SEQ ID NO: 3670386 - DNA, 14 bp, Homo sapiens
tctgacttctgcct

SEQ ID NO: 3670387 - DNA, 15 bp, Homo sapiens
tctgacttctgcctg

SEQ ID NO: 3670388 - DNA, 19 bp, Homo sapiens
tctgacttctgcctggaga

SEQ ID NO: 3670389 - DNA, 21 bp, Homo sapiens
tctgagaaacctgttgaagat

SEQ ID NO: 3670390 - DNA, 14 bp, Homo sapiens
tctgagaaactcta

SEQ ID NO: 3670391 - DNA, 18 bp, Homo sapiens
tctgagaagacacaaggt

SEQ ID NO: 3670392 - DNA, 19 bp, Homo sapiens
tctgagcccaacccttcta

SEQ ID NO: 3670393 - DNA, 14 bp, Homo sapiens
tctgagcgcctcca

SEQ ID NO: 3670394 - DNA, 21 bp, Homo sapiens
tctgcaagaattgaagcagga

SEQ ID NO: 3670395 - DNA, 14 bp, Homo sapiens
tctgcacaagctgc

SEQ ID NO: 3670396 - DNA, 18 bp, Homo sapiens
tctgcacccccctgggct

SEQ ID NO: 3670397 - DNA, 20 bp, Homo sapiens
tctgcactactgacatgtgg

SEQ ID NO: 3670398 - DNA, 21 bp, Homo sapiens
tctgcaggaatcccggctcca

SEQ ID NO: 3670399 - DNA, 14 bp, Homo sapiens
tctgcaggcagggc

SEQ ID NO: 3670400 - DNA, 19 bp, Homo sapiens
tctgcatttcggtggctag

SEQ ID NO: 3670401 - DNA, 19 bp, Homo sapiens
tctgccagtgacagacagg

SEQ ID NO: 3670402 - DNA, 24 bp, Homo sapiens
tctgccattgggaccctccagtgc

SEQ ID NO: 3670403 - DNA, 16 bp, Homo sapiens
tctgccggccctgggg

SEQ ID NO: 3670404 - DNA, 17 bp, Homo sapiens
tctgccggccctggggc

SEQ ID NO: 3670405 - DNA, 21 bp, Homo sapiens
tctgcctgccagctgcactga

SEQ ID NO: 3670406 - DNA, 23 bp, Homo sapiens
tctgcctggagacttagggcacc

SEQ ID NO: 3670407 - DNA, 21 bp, Homo sapiens
tctgcctggagtgtatgactg

SEQ ID NO: 3670408 - DNA, 21 bp, Homo sapiens
tctgcgttggcttctccctgg

SEQ ID NO: 3670409 - DNA, 22 bp, Homo sapiens
tctgcgttggcttctccctggg

SEQ ID NO: 3670410 - DNA, 19 bp, Homo sapiens
tctgctcagaggccttgct

SEQ ID NO: 3670411 - DNA, 14 bp, Homo sapiens
tctgctccaccaca

SEQ ID NO: 3670412 - DNA, 14 bp, Homo sapiens
tctgctccaccctt

SEQ ID NO: 3670413 - DNA, 16 bp, Homo sapiens
tctgctccacccttgg

SEQ ID NO: 3670414 - DNA, 15 bp, Homo sapiens
tctgctctttctctg

SEQ ID NO: 3670415 - DNA, 17 bp, Homo sapiens
tctgctctttctctgcc

SEQ ID NO: 3670416 - DNA, 19 bp, Homo sapiens
tctgcttatttcatctgtt

SEQ ID NO: 3670417 - DNA, 23 bp, Homo sapiens
tctgcttatttcatctgttctat

SEQ ID NO: 3670418 - DNA, 19 bp, Homo sapiens
tctgcttctctgacttctg

SEQ ID NO: 3670419 - DNA, 16 bp, Homo sapiens
tctggaaaatgcttct

SEQ ID NO: 3670420 - DNA, 16 bp, Homo sapiens
tctggaacctcagcct

SEQ ID NO: 3670421 - DNA, 18 bp, Homo sapiens
tctggaacctcagcctgg

SEQ ID NO: 3670422 - DNA, 19 bp, Homo sapiens
tctggaacctcagcctggc

SEQ ID NO: 3670423 - DNA, 13 bp, Homo sapiens
tctggaagaaaaa

SEQ ID NO: 3670424 - DNA, 14 bp, Homo sapiens
tctggaagaaaaaa

SEQ ID NO: 3670425 - DNA, 13 bp, Homo sapiens
tctggactatatt

SEQ ID NO: 3670426 - DNA, 15 bp, Homo sapiens
tctggactggctaga

SEQ ID NO: 3670427 - DNA, 17 bp, Homo sapiens
tctggagttgatctgga

SEQ ID NO: 3670428 - DNA, 16 bp, Homo sapiens
tctggccaggaagctt

SEQ ID NO: 3670429 - DNA, 16 bp, Homo sapiens
tctggctagaggccag

SEQ ID NO: 3670430 - DNA, 17 bp, Homo sapiens
tctggctagaggccagc

SEQ ID NO: 3670431 - DNA, 21 bp, Homo sapiens
tctggctagaggccagcccca

SEQ ID NO: 3670432 - DNA, 13 bp, Homo sapiens
tctggctctgtct

SEQ ID NO: 3670433 - DNA, 13 bp, Homo sapiens
tctggcttagtgc

SEQ ID NO: 3670434 - DNA, 15 bp, Homo sapiens
tctggcttctggcca

SEQ ID NO: 3670435 - DNA, 13 bp, Homo sapiens
tctggtcccttgc

SEQ ID NO: 3670436 - DNA, 19 bp, Homo sapiens
tctggtgctactccatgca

SEQ ID NO: 3670437 - DNA, 20 bp, Homo sapiens
tctggtggccactgagctgg

SEQ ID NO: 3670438 - DNA, 16 bp, Homo sapiens
tctggtggctgggctg

SEQ ID NO: 3670439 - DNA, 14 bp, Homo sapiens
tctggtggtggcct

SEQ ID NO: 3670440 - DNA, 12 bp, Homo sapiens
tctggttccagg

SEQ ID NO: 3670441 - DNA, 13 bp, Homo sapiens
tctggttccaggg

SEQ ID NO: 3670442 - DNA, 14 bp, Homo sapiens
tctgtaagaaacct

SEQ ID NO: 3670443 - DNA, 22 bp, Homo sapiens
tctgtaagaaacctactgccca

SEQ ID NO: 3670444 - DNA, 23 bp, Homo sapiens
tctgtagtaatttattgtctgtc

SEQ ID NO: 3670445 - DNA, 15 bp, Homo sapiens
tctgtccaaaggagg

SEQ ID NO: 3670446 - DNA, 23 bp, Homo sapiens
tctgtccaaaggaggctggcagg

SEQ ID NO: 3670447 - DNA, 14 bp, Homo sapiens
tctgtcctcagcct

SEQ ID NO: 3670448 - DNA, 15 bp, Homo sapiens
tctgtcctcagcctt

SEQ ID NO: 3670449 - DNA, 21 bp, Homo sapiens
tctgtcctcagccttgccaga

SEQ ID NO: 3670450 - DNA, 23 bp, Homo sapiens
tctgtcctcagccttgccagaga

SEQ ID NO: 3670451 - DNA, 15 bp, Homo sapiens
tctgtctacatttct

SEQ ID NO: 3670452 - DNA, 20 bp, Homo sapiens
tctgtgacccatctgtagta

SEQ ID NO: 3670453 - DNA, 17 bp, Homo sapiens
tctgtgccccatgcctg

SEQ ID NO: 3670454 - DNA, 22 bp, Homo sapiens
tctgtgccccatgcctgtccag

SEQ ID NO: 3670455 - DNA, 12 bp, Homo sapiens
tctgtgctgtgt

SEQ ID NO: 3670456 - DNA, 15 bp, Homo sapiens
tctgtggccagcctg

SEQ ID NO: 3670457 - DNA, 19 bp, Homo sapiens
tctgtggccagcctggcat

SEQ ID NO: 3670458 - DNA, 14 bp, Homo sapiens
tctgtggccagctg

SEQ ID NO: 3670459 - DNA, 19 bp, Homo sapiens
tctgtgggccctaccctcc

SEQ ID NO: 3670460 - DNA, 20 bp, Homo sapiens
tctgtgggctacatgctggg

SEQ ID NO: 3670461 - DNA, 14 bp, Homo sapiens
tctgtgttgccaag

SEQ ID NO: 3670462 - DNA, 13 bp, Homo sapiens
tctgttccccctt

SEQ ID NO: 3670463 - DNA, 18 bp, Homo sapiens
tctgttcccccttcacaa

SEQ ID NO: 3670464 - DNA, 22 bp, Homo sapiens
tctgttcccttcctctgtgcca

SEQ ID NO: 3670465 - DNA, 18 bp, Homo sapiens
tctgttggcaggctggcc

SEQ ID NO: 3670466 - DNA, 22 bp, Homo sapiens
tctgtttgtttggctgtccagc

SEQ ID NO: 3670467 - DNA, 18 bp, Homo sapiens
tctgttttagtatgtaaa

SEQ ID NO: 3670468 - DNA, 19 bp, Homo sapiens
tctgtttttaatgctattt

SEQ ID NO: 3670469 - DNA, 20 bp, Homo sapiens
tcttaaaacattatgagttt

SEQ ID NO: 3670470 - DNA, 15 bp, Homo sapiens
tcttaacaaactctt

SEQ ID NO: 3670471 - DNA, 20 bp, Homo sapiens
tcttaagtaccaatgggaag

SEQ ID NO: 3670472 - DNA, 22 bp, Homo sapiens
tcttaagtaccaatgggaagca

SEQ ID NO: 3670473 - DNA, 16 bp, Homo sapiens
tcttagcagcttccag

SEQ ID NO: 3670474 - DNA, 23 bp, Homo sapiens
tcttaggttggcaaaaaggcagg

SEQ ID NO: 3670475 - DNA, 13 bp, Homo sapiens
tcttattctgtat

SEQ ID NO: 3670476 - DNA, 16 bp, Homo sapiens
tcttattgcgctgcta

SEQ ID NO: 3670477 - DNA, 18 bp, Homo sapiens
tcttatttaatctccatt

SEQ ID NO: 3670478 - DNA, 18 bp, Homo sapiens
tcttcaggcctccctctc

SEQ ID NO: 3670479 - DNA, 15 bp, Homo sapiens
tcttcagtaagccgt

SEQ ID NO: 3670480 - DNA, 13 bp, Homo sapiens
tcttcagttaatt

SEQ ID NO: 3670481 - DNA, 19 bp, Homo sapiens
tcttcagttaattcttaga

SEQ ID NO: 3670482 - DNA, 21 bp, Homo sapiens
tcttcatattctaaaaccatt

SEQ ID NO: 3670483 - DNA, 18 bp, Homo sapiens
tcttccaaaggcagcgtg

SEQ ID NO: 3670484 - DNA, 21 bp, Homo sapiens
tcttccaacacatttcacttt

SEQ ID NO: 3670485 - DNA, 20 bp, Homo sapiens
tcttccccagaaaggagact

SEQ ID NO: 3670486 - DNA, 19 bp, Homo sapiens
tcttccctacagttgaaaa

SEQ ID NO: 3670487 - DNA, 13 bp, Homo sapiens
tcttccctacctc

SEQ ID NO: 3670488 - DNA, 21 bp, Homo sapiens
tcttccctacctcaggcagga

SEQ ID NO: 3670489 - DNA, 20 bp, Homo sapiens
tcttcctggatggggcagag

SEQ ID NO: 3670490 - DNA, 23 bp, Homo sapiens
tcttcctggatggggcagagctt

SEQ ID NO: 3670491 - DNA, 23 bp, Homo sapiens
tcttccttgaagaactgcaggcc

SEQ ID NO: 3670492 - DNA, 15 bp, Homo sapiens
tcttccttgatgttt

SEQ ID NO: 3670493 - DNA, 12 bp, Homo sapiens
tcttctaaatgg

SEQ ID NO: 3670494 - DNA, 15 bp, Homo sapiens
tcttctaattgctgt

SEQ ID NO: 3670495 - DNA, 18 bp, Homo sapiens
tcttctgccggccctggg

SEQ ID NO: 3670496 - DNA, 17 bp, Homo sapiens
tcttctgctccaccctt

SEQ ID NO: 3670497 - DNA, 20 bp, Homo sapiens
tcttctgctccacccttggc

SEQ ID NO: 3670498 - DNA, 22 bp, Homo sapiens
tcttctgctccacccttggcct

SEQ ID NO: 3670499 - DNA, 23 bp, Homo sapiens
tcttctgctccacccttggcctg

SEQ ID NO: 3670500 - DNA, 21 bp, Homo sapiens
tcttctggtgctactccatgc

SEQ ID NO: 3670501 - DNA, 14 bp, Homo sapiens
tcttctgtcccaag

SEQ ID NO: 3670502 - DNA, 20 bp, Homo sapiens
tcttctgtcccaagtctcca

SEQ ID NO: 3670503 - DNA, 19 bp, Homo sapiens
tcttgaccaagcaggaagc

SEQ ID NO: 3670504 - DNA, 19 bp, Homo sapiens
tcttgagattttgtatatt

SEQ ID NO: 3670505 - DNA, 20 bp, Homo sapiens
tcttgagtttgtcgctcatg

SEQ ID NO: 3670506 - DNA, 21 bp, Homo sapiens
tcttgagtttgtcgctcatgt

SEQ ID NO: 3670507 - DNA, 15 bp, Homo sapiens
tcttgataaagtgga

SEQ ID NO: 3670508 - DNA, 23 bp, Homo sapiens
tcttgcaccccaaagctttcctg

SEQ ID NO: 3670509 - DNA, 19 bp, Homo sapiens
tcttgcctccaggtgcaga

SEQ ID NO: 3670510 - DNA, 13 bp, Homo sapiens
tcttgcctctgtg

SEQ ID NO: 3670511 - DNA, 16 bp, Homo sapiens
tcttgcctctgtgctg

SEQ ID NO: 3670512 - DNA, 11 bp, Homo sapiens
tcttgctctgt

SEQ ID NO: 3670513 - DNA, 13 bp, Homo sapiens
tcttgctggaaga

SEQ ID NO: 3670514 - DNA, 15 bp, Homo sapiens
tcttgctggaagaca

SEQ ID NO: 3670515 - DNA, 21 bp, Homo sapiens
tcttgctggaagacagagaaa

SEQ ID NO: 3670516 - DNA, 14 bp, Homo sapiens
tcttgctgttgaca

SEQ ID NO: 3670517 - DNA, 15 bp, Homo sapiens
tcttgctgttgacat

SEQ ID NO: 3670518 - DNA, 18 bp, Homo sapiens
tcttgctgttgacatatt

SEQ ID NO: 3670519 - DNA, 19 bp, Homo sapiens
tcttgctgttgacatattt

SEQ ID NO: 3670520 - DNA, 22 bp, Homo sapiens
tcttgcttccctaatctatggt

SEQ ID NO: 3670521 - DNA, 19 bp, Homo sapiens
tcttggaagtctgtctcag

SEQ ID NO: 3670522 - DNA, 18 bp, Homo sapiens
tcttggatgggacatttt

SEQ ID NO: 3670523 - DNA, 19 bp, Homo sapiens
tcttggatgggacattttt

SEQ ID NO: 3670524 - DNA, 15 bp, Homo sapiens
tcttggcttaatcat

SEQ ID NO: 3670525 - DNA, 16 bp, Homo sapiens
tcttggcttaatcatt

SEQ ID NO: 3670526 - DNA, 20 bp, Homo sapiens
tcttggcttaatcattttca

SEQ ID NO: 3670527 - DNA, 17 bp, Homo sapiens
tcttggggcccagtgca

SEQ ID NO: 3670528 - DNA, 20 bp, Homo sapiens
tcttgggtgggacagggctt

SEQ ID NO: 3670529 - DNA, 17 bp, Homo sapiens
tcttgtggaagacactt

SEQ ID NO: 3670530 - DNA, 14 bp, Homo sapiens
tcttgttcttgaga

SEQ ID NO: 3670531 - DNA, 11 bp, Homo sapiens
tcttgtttctg

SEQ ID NO: 3670532 - DNA, 12 bp, Homo sapiens
tcttgtttctgc

SEQ ID NO: 3670533 - DNA, 22 bp, Homo sapiens
tcttgtttctgcatctttttga

SEQ ID NO: 3670534 - DNA, 19 bp, Homo sapiens
tctttaaaagatgctttta

SEQ ID NO: 3670535 - DNA, 18 bp, Homo sapiens
tctttaaccttgtataaa

SEQ ID NO: 3670536 - DNA, 12 bp, Homo sapiens
tctttacatcta

SEQ ID NO: 3670537 - DNA, 18 bp, Homo sapiens
tctttagagattataaca

SEQ ID NO: 3670538 - DNA, 20 bp, Homo sapiens
tctttcaagcagtcgtgcct

SEQ ID NO: 3670539 - DNA, 21 bp, Homo sapiens
tctttcaagcagtcgtgcctg

SEQ ID NO: 3670540 - DNA, 18 bp, Homo sapiens
tctttcccatggggaggg

SEQ ID NO: 3670541 - DNA, 13 bp, Homo sapiens
tctttctctgcca

SEQ ID NO: 3670542 - DNA, 17 bp, Homo sapiens
tctttctctgccagtga

SEQ ID NO: 3670543 - DNA, 21 bp, Homo sapiens
tctttgaaatagtctgtgtga

SEQ ID NO: 3670544 - DNA, 23 bp, Homo sapiens
tctttgactgaaaaaaaaaaaga

SEQ ID NO: 3670545 - DNA, 15 bp, Homo sapiens
tctttgcaaagtatt

SEQ ID NO: 3670546 - DNA, 20 bp, Homo sapiens
tctttgccttgggctgctcc

SEQ ID NO: 3670547 - DNA, 14 bp, Homo sapiens
tctttgctgaagaa

SEQ ID NO: 3670548 - DNA, 12 bp, Homo sapiens
tctttgctttgc

SEQ ID NO: 3670549 - DNA, 14 bp, Homo sapiens
tctttgtggccaag

SEQ ID NO: 3670550 - DNA, 23 bp, Homo sapiens
tctttgtggccaaggagctgcta

SEQ ID NO: 3670551 - DNA, 23 bp, Homo sapiens
tctttgttcatagcccagtagac

SEQ ID NO: 3670552 - DNA, 15 bp, Homo sapiens
tctttgtttttttaa

SEQ ID NO: 3670553 - DNA, 20 bp, Homo sapiens
tcttttactgttatagaata

SEQ ID NO: 3670554 - DNA, 14 bp, Homo sapiens
tcttttgaattgtt

SEQ ID NO: 3670555 - DNA, 15 bp, Homo sapiens
tctttttaagttaat

SEQ ID NO: 3670556 - DNA, 15 bp, Homo sapiens
tctttttaataaaaa

SEQ ID NO: 3670557 - DNA, 21 bp, Homo sapiens
tctttttgaccctcattcttt

SEQ ID NO: 3670558 - DNA, 20 bp, Homo sapiens
tgaaaaagctggtctttgag

SEQ ID NO: 3670559 - DNA, 18 bp, Homo sapiens
tgaaaaaggaataaattg

SEQ ID NO: 3670560 - DNA, 20 bp, Homo sapiens
tgaaaagaaaaatgagcctg

SEQ ID NO: 3670561 - DNA, 14 bp, Homo sapiens
tgaaaattaacact

SEQ ID NO: 3670562 - DNA, 23 bp, Homo sapiens
tgaaaattgaccaagtgatgtgt

SEQ ID NO: 3670563 - DNA, 16 bp, Homo sapiens
tgaaacaacttggaaa

SEQ ID NO: 3670564 - DNA, 12 bp, Homo sapiens
tgaaacagaaaa

SEQ ID NO: 3670565 - DNA, 19 bp, Homo sapiens
tgaaagaggctgaggcctg

SEQ ID NO: 3670566 - DNA, 17 bp, Homo sapiens
tgaaaggaacatttttt

SEQ ID NO: 3670567 - DNA, 20 bp, Homo sapiens
tgaaagtgcatttttgtaaa

SEQ ID NO: 3670568 - DNA, 21 bp, Homo sapiens
tgaaagtgcatttttgtaaat

SEQ ID NO: 3670569 - DNA, 23 bp, Homo sapiens
tgaaagtgttgggattggttaag

SEQ ID NO: 3670570 - DNA, 19 bp, Homo sapiens
tgaaagtttttctgaaagt

SEQ ID NO: 3670571 - DNA, 19 bp, Homo sapiens
tgaaataaaactggctttg

SEQ ID NO: 3670572 - DNA, 22 bp, Homo sapiens
tgaaataaaactggctttggct

SEQ ID NO: 3670573 - DNA, 19 bp, Homo sapiens
tgaaataaaattacacagt

SEQ ID NO: 3670574 - DNA, 13 bp, Homo sapiens
tgaaataaatgtt

SEQ ID NO: 3670575 - DNA, 15 bp, Homo sapiens
tgaaattctcctgga

SEQ ID NO: 3670576 - DNA, 14 bp, Homo sapiens
tttgtactcagtgg

SEQ ID NO: 3670577 - DNA, 23 bp, Homo sapiens
tttgtactcagtggacagtgctg

SEQ ID NO: 3670578 - DNA, 12 bp, Homo sapiens
tttgtatgaaat

SEQ ID NO: 3670579 - DNA, 18 bp, Homo sapiens
tttgtatgaaattataat

SEQ ID NO: 3670580 - DNA, 13 bp, Homo sapiens
tttgtctttttgt

SEQ ID NO: 3670581 - DNA, 15 bp, Homo sapiens
tttgtgcaaagccaa

SEQ ID NO: 3670582 - DNA, 20 bp, Homo sapiens
tttgtggccaaggagctgct

SEQ ID NO: 3670583 - DNA, 22 bp, Homo sapiens
tttgtggccaaggagctgctat

SEQ ID NO: 3670584 - DNA, 12 bp, Homo sapiens
tttgtggcctca

SEQ ID NO: 3670585 - DNA, 13 bp, Homo sapiens
tttgttcttatga

SEQ ID NO: 3670586 - DNA, 15 bp, Homo sapiens
tttgttgtaaaacaa

SEQ ID NO: 3670587 - DNA, 16 bp, Homo sapiens
tttgttgtcagctgaa

SEQ ID NO: 3670588 - DNA, 18 bp, Homo sapiens
ttttaaaaaactgctgac

SEQ ID NO: 3670589 - DNA, 17 bp, Homo sapiens
ttttaaaactggacctg

SEQ ID NO: 3670590 - DNA, 18 bp, Homo sapiens
ttttaaaattctgagtga

SEQ ID NO: 3670591 - DNA, 13 bp, Homo sapiens
ttttaaagtgatt

SEQ ID NO: 3670592 - DNA, 17 bp, Homo sapiens
ttttaaatattttctat

SEQ ID NO: 3670593 - DNA, 16 bp, Homo sapiens
ttttaaattttgtaat

SEQ ID NO: 3670594 - DNA, 18 bp, Homo sapiens
ttttaaattttgtaatga

SEQ ID NO: 3670595 - DNA, 13 bp, Homo sapiens
ttttaactcaata

SEQ ID NO: 3670596 - DNA, 18 bp, Homo sapiens
ttttaaggtctttcagta

SEQ ID NO: 3670597 - DNA, 23 bp, Homo sapiens
ttttaaggtctttcagtactttt

SEQ ID NO: 3670598 - DNA, 15 bp, Homo sapiens
ttttaatgatgacaa

SEQ ID NO: 3670599 - DNA, 10 bp, Homo sapiens
ttttaattta

SEQ ID NO: 3670600 - DNA, 12 bp, Homo sapiens
ttttaattttta

SEQ ID NO: 3670601 - DNA, 15 bp, Homo sapiens
ttttaggattctgtc

SEQ ID NO: 3670602 - DNA, 14 bp, Homo sapiens
ttttagtaatttct

SEQ ID NO: 3670603 - DNA, 19 bp, Homo sapiens
ttttagtgaacttgaaata

SEQ ID NO: 3670604 - DNA, 16 bp, Homo sapiens
ttttataatgttgtat

SEQ ID NO: 3670605 - DNA, 20 bp, Homo sapiens
ttttcaaaatagaaaagtta

SEQ ID NO: 3670606 - DNA, 22 bp, Homo sapiens
ttttcaacagtgaagacagaag

SEQ ID NO: 3670607 - DNA, 13 bp, Homo sapiens
ttttcaactgcca

SEQ ID NO: 3670608 - DNA, 23 bp, Homo sapiens
ttttcaactgccaaaatgctcta

SEQ ID NO: 3670609 - DNA, 18 bp, Homo sapiens
ttttcagatgtgaaccat

SEQ ID NO: 3670610 - DNA, 17 bp, Homo sapiens
ttttccaaatgcttcta

SEQ ID NO: 3670611 - DNA, 22 bp, Homo sapiens
ttttccatggcaggaaggcttg

SEQ ID NO: 3670612 - DNA, 19 bp, Homo sapiens
ttttcccagcccaaattct

SEQ ID NO: 3670613 - DNA, 13 bp, Homo sapiens
ttttccctgggtg

SEQ ID NO: 3670614 - DNA, 21 bp, Homo sapiens
ttttctaatgaggagagaaaa

SEQ ID NO: 3670615 - DNA, 22 bp, Homo sapiens
ttttctggaaaatgcttcttgg

SEQ ID NO: 3670616 - DNA, 14 bp, Homo sapiens
ttttgaattgttac

SEQ ID NO: 3670617 - DNA, 15 bp, Homo sapiens
ttttgaattgttaca

SEQ ID NO: 3670618 - DNA, 22 bp, Homo sapiens
ttttgactagggattcaggctg

SEQ ID NO: 3670619 - DNA, 18 bp, Homo sapiens
ttttgacttaatgtgatt

SEQ ID NO: 3670620 - DNA, 15 bp, Homo sapiens
ttttgatgtttgtgg

SEQ ID NO: 3670621 - DNA, 20 bp, Homo sapiens
ttttgcacatgtttcctcta

SEQ ID NO: 3670622 - DNA, 21 bp, Homo sapiens
ttttgcttttggcaaaactct

SEQ ID NO: 3670623 - DNA, 19 bp, Homo sapiens
ttttggcaaaactctactt

SEQ ID NO: 3670624 - DNA, 21 bp, Homo sapiens
ttttggggggcagagaataaa

SEQ ID NO: 3670625 - DNA, 16 bp, Homo sapiens
ttttggtacaaaaata

SEQ ID NO: 3670626 - DNA, 14 bp, Homo sapiens
ttttgtaaagtttc

SEQ ID NO: 3670627 - DNA, 19 bp, Homo sapiens
ttttgtattgattttcaca

SEQ ID NO: 3670628 - DNA, 16 bp, Homo sapiens
ttttgtttttgtctta

SEQ ID NO: 3670629 - DNA, 19 bp, Homo sapiens
ttttgttttttcaaaatag

SEQ ID NO: 3670630 - DNA, 14 bp, Homo sapiens
tttttaaaattctg

SEQ ID NO: 3670631 - DNA, 13 bp, Homo sapiens
tttttaatcagtt

SEQ ID NO: 3670632 - DNA, 13 bp, Homo sapiens
tttttaatgctat

SEQ ID NO: 3670633 - DNA, 14 bp, Homo sapiens
tttttacaagatgt

SEQ ID NO: 3670634 - DNA, 15 bp, Homo sapiens
tttttatattaatgt

SEQ ID NO: 3670635 - DNA, 12 bp, Homo sapiens
tttttatgtgat

SEQ ID NO: 3670636 - DNA, 13 bp, Homo sapiens
tttttatttaaat

SEQ ID NO: 3670637 - DNA, 15 bp, Homo sapiens
tttttcaaaatagaa

SEQ ID NO: 3670638 - DNA, 23 bp, Homo sapiens
tttttgctgctgcctctttccct

SEQ ID NO: 3670639 - DNA, 13 bp, Homo sapiens
tttttggtacaaa

SEQ ID NO: 3670640 - DNA, 17 bp, Homo sapiens
tttttgttttacaatgt

SEQ ID NO: 3670641 - DNA, 16 bp, Homo sapiens
ttttttataagtatgt

SEQ ID NO: 3670642 - DNA, 18 bp, Homo sapiens
ttttttgttttacaatgt

SEQ ID NO: 3670643 - DNA, 14 bp, Homo sapiens
ttttttttaaacta

SEQ ID NO: 3670644 - DNA, 13 bp, Homo sapiens
ttgaaggactaca

SEQ ID NO: 3670645 - DNA, 15 bp, Homo sapiens
ttgaagggccagagc

SEQ ID NO: 3670646 - DNA, 15 bp, Homo sapiens
ttgaatataaacact

SEQ ID NO: 3670647 - DNA, 16 bp, Homo sapiens
ttgacagaacactgtc

SEQ ID NO: 3670648 - DNA, 15 bp, Homo sapiens
ttgacatgggtattt

SEQ ID NO: 3670649 - DNA, 22 bp, Homo sapiens
ttgacatttcattagccatgca

SEQ ID NO: 3670650 - DNA, 14 bp, Homo sapiens
ttgactaattttac

SEQ ID NO: 3670651 - DNA, 20 bp, Homo sapiens
ttgactgaaaaaaaaaaaga

SEQ ID NO: 3670652 - DNA, 21 bp, Homo sapiens
ttgactgccctcttactgttt

SEQ ID NO: 3670653 - DNA, 22 bp, Homo sapiens
ttgactgccctcttactgtttt

SEQ ID NO: 3670654 - DNA, 21 bp, Homo sapiens
ttgacttaatgtgattactgc

SEQ ID NO: 3670655 - DNA, 16 bp, Homo sapiens
ttgagatcctgatagc

SEQ ID NO: 3670656 - DNA, 15 bp, Homo sapiens
ttgagcatcacagaa

SEQ ID NO: 3670657 - DNA, 14 bp, Homo sapiens
ttgagcctgggagg

SEQ ID NO: 3670658 - DNA, 16 bp, Homo sapiens
ttgagctgcctccagc

SEQ ID NO: 3670659 - DNA, 18 bp, Homo sapiens
ttgagctgcctccagcct

SEQ ID NO: 3670660 - DNA, 21 bp, Homo sapiens
ttgagctgcctccagcctggt

SEQ ID NO: 3670661 - DNA, 24 bp, Homo sapiens
ttgaggacttgttaaagagcactg

SEQ ID NO: 3670662 - DNA, 20 bp, Homo sapiens
ttgagttgattcagctctgc

SEQ ID NO: 3670663 - DNA, 19 bp, Homo sapiens
ttgatagggaactggggaa

SEQ ID NO: 3670664 - DNA, 16 bp, Homo sapiens
ttgatcatgtactttt

SEQ ID NO: 3670665 - DNA, 17 bp, Homo sapiens
ttgatcatgtacttttt

SEQ ID NO: 3670666 - DNA, 19 bp, Homo sapiens
ttgatcattttccccccac

SEQ ID NO: 3670667 - DNA, 14 bp, Homo sapiens
ttgatctggaaccc

SEQ ID NO: 3670668 - DNA, 16 bp, Homo sapiens
ttgatctggaacccag

SEQ ID NO: 3670669 - DNA, 19 bp, Homo sapiens
ttgatctggaacccagact

SEQ ID NO: 3670670 - DNA, 20 bp, Homo sapiens
ttgatgagttaactgtgaaa

SEQ ID NO: 3670671 - DNA, 16 bp, Homo sapiens
ttgatgatcactgtga

SEQ ID NO: 3670672 - DNA, 17 bp, Homo sapiens
ttgatgatcactgtgaa

SEQ ID NO: 3670673 - DNA, 13 bp, Homo sapiens
ttgatgtggccct

SEQ ID NO: 3670674 - DNA, 21 bp, Homo sapiens
tatttgacaacgtttcagcga

SEQ ID NO: 3670675 - DNA, 16 bp, Homo sapiens
tatttgagactagttt

SEQ ID NO: 3670676 - DNA, 16 bp, Homo sapiens
tatttgattcaaaata

SEQ ID NO: 3670677 - DNA, 17 bp, Homo sapiens
tatttgcagtcatggag

SEQ ID NO: 3670678 - DNA, 13 bp, Homo sapiens
tatttgtaaagct

SEQ ID NO: 3670679 - DNA, 20 bp, Homo sapiens
tatttgttaatggtttgaat

SEQ ID NO: 3670680 - DNA, 22 bp, Homo sapiens
tattttaaattactatatatgt

SEQ ID NO: 3670681 - DNA, 16 bp, Homo sapiens
tattttaagaattgtt

SEQ ID NO: 3670682 - DNA, 18 bp, Homo sapiens
tattttaagactgatttt

SEQ ID NO: 3670683 - DNA, 23 bp, Homo sapiens
tattttaagactgattttaatag

SEQ ID NO: 3670684 - DNA, 21 bp, Homo sapiens
tattttagtgaacttgaaata

SEQ ID NO: 3670685 - DNA, 22 bp, Homo sapiens
tattttataatgttgtatttaa

SEQ ID NO: 3670686 - DNA, 14 bp, Homo sapiens
tattttcagatgtg

SEQ ID NO: 3670687 - DNA, 16 bp, Homo sapiens
tattttcatacaaatt

SEQ ID NO: 3670688 - DNA, 16 bp, Homo sapiens
tattttccatgaaaat

SEQ ID NO: 3670689 - DNA, 13 bp, Homo sapiens
tattttcttgagt

SEQ ID NO: 3670690 - DNA, 15 bp, Homo sapiens
tatttttaaagatag

SEQ ID NO: 3670691 - DNA, 21 bp, Homo sapiens
tatttttatactcttcctatt

SEQ ID NO: 3670692 - DNA, 18 bp, Homo sapiens
tatttttatataatatct

SEQ ID NO: 3670693 - DNA, 23 bp, Homo sapiens
tatttttatataatatctaaagt

SEQ ID NO: 3670694 - DNA, 13 bp, Homo sapiens
tatttttatttgt

SEQ ID NO: 3670695 - DNA, 13 bp, Homo sapiens
tatttttctgtga

SEQ ID NO: 3670696 - DNA, 23 bp, Homo sapiens
tatttttgtagtgacctgtttat

SEQ ID NO: 3670697 - DNA, 15 bp, Homo sapiens
tattttttaatgttt

SEQ ID NO: 3670698 - DNA, 15 bp, Homo sapiens
tattttttggacttc

SEQ ID NO: 3670699 - DNA, 21 bp, Homo sapiens
tattttttggacttcaaagca

SEQ ID NO: 3670700 - DNA, 15 bp, Homo sapiens
tcaaaaaaagaaaaa

SEQ ID NO: 3670701 - DNA, 16 bp, Homo sapiens
tcaaaagctgggcagg

SEQ ID NO: 3670702 - DNA, 14 bp, Homo sapiens
tcaaaatagaaaag

SEQ ID NO: 3670703 - DNA, 15 bp, Homo sapiens
tcaaaatagaaaagt

SEQ ID NO: 3670704 - DNA, 16 bp, Homo sapiens
tcaaaatatcctaaga

SEQ ID NO: 3670705 - DNA, 21 bp, Homo sapiens
tcaaaatatttaaaaatgtct

SEQ ID NO: 3670706 - DNA, 17 bp, Homo sapiens
tcaaacaaagccagaag

SEQ ID NO: 3670707 - DNA, 22 bp, Homo sapiens
tcaaagtgtaacagatatcagt

SEQ ID NO: 3670708 - DNA, 16 bp, Homo sapiens
tcaaatgcagtatatt

SEQ ID NO: 3670709 - DNA, 19 bp, Homo sapiens
tcaaatgcagtatatttct

SEQ ID NO: 3670710 - DNA, 19 bp, Homo sapiens
tcaaatggggccagatcca

SEQ ID NO: 3670711 - DNA, 23 bp, Homo sapiens
tcaaatttagaaactaattgact

SEQ ID NO: 3670712 - DNA, 15 bp, Homo sapiens
tcaacagtgaagaca

SEQ ID NO: 3670713 - DNA, 17 bp, Homo sapiens
tcaacagtgaagacaga

SEQ ID NO: 3670714 - DNA, 22 bp, Homo sapiens
tcaacagtgaagacagaagttt

SEQ ID NO: 3670715 - DNA, 15 bp, Homo sapiens
tcaacagttttccta

SEQ ID NO: 3670716 - DNA, 20 bp, Homo sapiens
tcaacagttttcctatgctt

SEQ ID NO: 3670717 - DNA, 15 bp, Homo sapiens
tcaacttaaaagtca

SEQ ID NO: 3670718 - DNA, 19 bp, Homo sapiens
tcaacttattaacaattag

SEQ ID NO: 3670719 - DNA, 14 bp, Homo sapiens
tcaacttgcttatc

SEQ ID NO: 3670720 - DNA, 18 bp, Homo sapiens
tcaagaagaaaaaggttt

SEQ ID NO: 3670721 - DNA, 22 bp, Homo sapiens
tcaagcagtcgtgcctgtgtcc

SEQ ID NO: 3670722 - DNA, 14 bp, Homo sapiens
tcaagccaagcagc

SEQ ID NO: 3670723 - DNA, 15 bp, Homo sapiens
tcaagccaagcagcc

SEQ ID NO: 3670724 - DNA, 19 bp, Homo sapiens
tcaagccaagcagccaagc

SEQ ID NO: 3670725 - DNA, 13 bp, Homo sapiens
tcaagccctgcag

SEQ ID NO: 3670726 - DNA, 20 bp, Homo sapiens
tcaagctcctcctccctgca

SEQ ID NO: 3670727 - DNA, 20 bp, Homo sapiens
tcaagcttagtgagcagtga

SEQ ID NO: 3670728 - DNA, 19 bp, Homo sapiens
tcaagtaccaccaagggat

SEQ ID NO: 3670729 - DNA, 15 bp, Homo sapiens
tcaagtgaaaaagga

SEQ ID NO: 3670730 - DNA, 13 bp, Homo sapiens
tcaagtgccaaac

SEQ ID NO: 3670731 - DNA, 16 bp, Homo sapiens
tcaatgggacctgtgg

SEQ ID NO: 3670732 - DNA, 21 bp, Homo sapiens
tcaattgctttgtgacttctt

SEQ ID NO: 3670733 - DNA, 20 bp, Homo sapiens
tcaatttccaagagctgagg

SEQ ID NO: 3670734 - DNA, 19 bp, Homo sapiens
tcacacctgtaatcccaac

SEQ ID NO: 3670735 - DNA, 21 bp, Homo sapiens
tcacagatgtgtgattcacag

SEQ ID NO: 3670736 - DNA, 23 bp, Homo sapiens
tcacagatgtgtgattcacagtg

SEQ ID NO: 3670737 - DNA, 13 bp, Homo sapiens
tcacagcctctga

SEQ ID NO: 3670738 - DNA, 14 bp, Homo sapiens
tcacagggttgggc

SEQ ID NO: 3670739 - DNA, 17 bp, Homo sapiens
tcacagggttgggccca

SEQ ID NO: 3670740 - DNA, 23 bp, Homo sapiens
tcacagggttgggcccagatctg

SEQ ID NO: 3670741 - DNA, 22 bp, Homo sapiens
ttaggcccgccaaacttctgaa

SEQ ID NO: 3670742 - DNA, 16 bp, Homo sapiens
ttaggctggtggccca

SEQ ID NO: 3670743 - DNA, 23 bp, Homo sapiens
ttaggtagatgagaaaacaggct

SEQ ID NO: 3670744 - DNA, 18 bp, Homo sapiens
ttaggtcttgctggaaga

SEQ ID NO: 3670745 - DNA, 18 bp, Homo sapiens
ttaggttggcaaaaaggc

SEQ ID NO: 3670746 - DNA, 12 bp, Homo sapiens
ttagtggcaccg

SEQ ID NO: 3670747 - DNA, 18 bp, Homo sapiens
ttataaatcttatgctct

SEQ ID NO: 3670748 - DNA, 20 bp, Homo sapiens
ttataatgttgtatttaatt

SEQ ID NO: 3670749 - DNA, 15 bp, Homo sapiens
ttatactgtacaata

SEQ ID NO: 3670750 - DNA, 21 bp, Homo sapiens
ttatactttgcaatccaaata

SEQ ID NO: 3670751 - DNA, 14 bp, Homo sapiens
ttatatttgacatg

SEQ ID NO: 3670752 - DNA, 19 bp, Homo sapiens
ttatcacctcattctgaac

SEQ ID NO: 3670753 - DNA, 14 bp, Homo sapiens
ttatcagcaaaaaa

SEQ ID NO: 3670754 - DNA, 12 bp, Homo sapiens
ttatctgtttcc

SEQ ID NO: 3670755 - DNA, 18 bp, Homo sapiens
ttatcttatactgtacaa

SEQ ID NO: 3670756 - DNA, 17 bp, Homo sapiens
ttatgaggagctgcaga

SEQ ID NO: 3670757 - DNA, 21 bp, Homo sapiens
ttatgatgtgggtcaaggaat

SEQ ID NO: 3670758 - DNA, 19 bp, Homo sapiens
ttatgtatttcctggatgt

SEQ ID NO: 3670759 - DNA, 19 bp, Homo sapiens
ttatgtcttgttcttgaga

SEQ ID NO: 3670760 - DNA, 19 bp, Homo sapiens
ttattaacaattaggcaga

SEQ ID NO: 3670761 - DNA, 12 bp, Homo sapiens
ttattagatgtt

SEQ ID NO: 3670762 - DNA, 22 bp, Homo sapiens
ttattatatttgacatgggtat

SEQ ID NO: 3670763 - DNA, 20 bp, Homo sapiens
ttattatttgcagtcatgga

SEQ ID NO: 3670764 - DNA, 23 bp, Homo sapiens
ttattcaagaatgccagtagaaa

SEQ ID NO: 3670765 - DNA, 20 bp, Homo sapiens
ttatttaaactctgttgcaa

SEQ ID NO: 3670766 - DNA, 12 bp, Homo sapiens
ttatttaaatta

SEQ ID NO: 3670767 - DNA, 16 bp, Homo sapiens
ttatttagttccttga

SEQ ID NO: 3670768 - DNA, 17 bp, Homo sapiens
ttatttcctttgtcctt

SEQ ID NO: 3670769 - DNA, 19 bp, Homo sapiens
ttatttcttaaacaaatgt

SEQ ID NO: 3670770 - DNA, 12 bp, Homo sapiens
ttattttacatt

SEQ ID NO: 3670771 - DNA, 14 bp, Homo sapiens
ttatttttaaagat

SEQ ID NO: 3670772 - DNA, 14 bp, Homo sapiens
ttatttttctgtga

SEQ ID NO: 3670773 - DNA, 22 bp, Homo sapiens
ttatttttttaaagtgatttgc

SEQ ID NO: 3670774 - DNA, 21 bp, Homo sapiens
ttcaaaataagtatttctgat

SEQ ID NO: 3670775 - DNA, 15 bp, Homo sapiens
ttcaaactgagacag

SEQ ID NO: 3670776 - DNA, 17 bp, Homo sapiens
ttcaacccacagctact

SEQ ID NO: 3670777 - DNA, 23 bp, Homo sapiens
ttcaagtgcctagactgttactt

SEQ ID NO: 3670778 - DNA, 17 bp, Homo sapiens
ttcaagttaaattttat

SEQ ID NO: 3670779 - DNA, 20 bp, Homo sapiens
ttcaatggtttgcaaggaag

SEQ ID NO: 3670780 - DNA, 23 bp, Homo sapiens
ttcaatggtttgcaaggaagcca

SEQ ID NO: 3670781 - DNA, 20 bp, Homo sapiens
ttcacagttctttgggccag

SEQ ID NO: 3670782 - DNA, 15 bp, Homo sapiens
ttcacattagaagac

SEQ ID NO: 3670783 - DNA, 19 bp, Homo sapiens
ttcacattgtttgctgcta

SEQ ID NO: 3670784 - DNA, 13 bp, Homo sapiens
ttcacggaagagc

SEQ ID NO: 3670785 - DNA, 17 bp, Homo sapiens
ttcacggaagagccttg

SEQ ID NO: 3670786 - DNA, 21 bp, Homo sapiens
ttcactggcgaggtgcggcca

SEQ ID NO: 3670787 - DNA, 20 bp, Homo sapiens
ttcagaagtgcccttcctgc

SEQ ID NO: 3670788 - DNA, 17 bp, Homo sapiens
ttcagatgtaatgtttt

SEQ ID NO: 3670789 - DNA, 15 bp, Homo sapiens
ttcagatgtgaacca

SEQ ID NO: 3670790 - DNA, 15 bp, Homo sapiens
ttcagcactgtccct

SEQ ID NO: 3670791 - DNA, 20 bp, Homo sapiens
ttcagcactgtcccttgcct

SEQ ID NO: 3670792 - DNA, 21 bp, Homo sapiens
ttcagcactgtcccttgcctc

SEQ ID NO: 3670793 - DNA, 17 bp, Homo sapiens
ttcagcattaagctgtt

SEQ ID NO: 3670794 - DNA, 22 bp, Homo sapiens
ttcagcattaagctgttcctgt

SEQ ID NO: 3670795 - DNA, 12 bp, Homo sapiens
ttcagccaggag

SEQ ID NO: 3670796 - DNA, 17 bp, Homo sapiens
ttcagctctgcaagaat

SEQ ID NO: 3670797 - DNA, 21 bp, Homo sapiens
ttcagctggttgaggtttcaa

SEQ ID NO: 3670798 - DNA, 17 bp, Homo sapiens
ttcaggggactcagccc

SEQ ID NO: 3670799 - DNA, 15 bp, Homo sapiens
ttcagtaactgtcag

SEQ ID NO: 3670800 - DNA, 14 bp, Homo sapiens
ttcagtactttttt

SEQ ID NO: 3670801 - DNA, 17 bp, Homo sapiens
ttcagtgtttatttcct

SEQ ID NO: 3670802 - DNA, 21 bp, Homo sapiens
ttcagttcagcggttgaggag

SEQ ID NO: 3670803 - DNA, 13 bp, Homo sapiens
ttcatagcccagt

SEQ ID NO: 3670804 - DNA, 16 bp, Homo sapiens
ttcatgcagtgctctt

SEQ ID NO: 3670805 - DNA, 14 bp, Homo sapiens
ttcattagccatgc

SEQ ID NO: 3670806 - DNA, 16 bp, Homo sapiens
ttcattcctaaagaaa

SEQ ID NO: 3670807 - DNA, 12 bp, Homo sapiens
ttcattctcctt

SEQ ID NO: 3670808 - DNA, 21 bp, Homo sapiens
ttcattgccttaactggagcc

SEQ ID NO: 3670809 - DNA, 18 bp, Homo sapiens
ttccaaaaaggttgctgt

SEQ ID NO: 3670810 - DNA, 18 bp, Homo sapiens
ttccaaaggcagcgtgcc

SEQ ID NO: 3670811 - DNA, 12 bp, Homo sapiens
ttccaaatgctt

SEQ ID NO: 3670812 - DNA, 21 bp, Homo sapiens
ttccaaatgtaataaacttta

SEQ ID NO: 3670813 - DNA, 15 bp, Homo sapiens
ttccaaatgtccctc

SEQ ID NO: 3670814 - DNA, 19 bp, Homo sapiens
ttccaactcgtatagcatg

SEQ ID NO: 3670815 - DNA, 18 bp, Homo sapiens
ttccacaaaatctgtcca

SEQ ID NO: 3670816 - DNA, 16 bp, Homo sapiens
ttccagcagaagacaa

SEQ ID NO: 3670817 - DNA, 22 bp, Homo sapiens
ttccagcagaagacaaaaagac

SEQ ID NO: 3670818 - DNA, 18 bp, Homo sapiens
ttccagggtccctctgtg

SEQ ID NO: 3670819 - DNA, 16 bp, Homo sapiens
ttccatatgctccagg

SEQ ID NO: 3670820 - DNA, 14 bp, Homo sapiens
ttccatctctgact

SEQ ID NO: 3670821 - DNA, 14 bp, Homo sapiens
ttccattttggaaa

SEQ ID NO: 3670822 - DNA, 18 bp, Homo sapiens
ttcccaccaggctgctca

SEQ ID NO: 3670823 - DNA, 11 bp, Homo sapiens
ttcccaccctg

SEQ ID NO: 3670824 - DNA, 14 bp, Homo sapiens
ttcccatggggagg

SEQ ID NO: 3670825 - DNA, 15 bp, Homo sapiens
ttcccattggctttc

SEQ ID NO: 3670826 - DNA, 19 bp, Homo sapiens
ttccccccactctccccac

SEQ ID NO: 3670827 - DNA, 20 bp, Homo sapiens
ttcccctctaactggacagc

SEQ ID NO: 3670828 - DNA, 16 bp, Homo sapiens
ttccccttttgccaat

SEQ ID NO: 3670829 - DNA, 23 bp, Homo sapiens
ttcccgaaccccaaggagggaga

SEQ ID NO: 3670830 - DNA, 13 bp, Homo sapiens
ttccctacctcag

SEQ ID NO: 3670831 - DNA, 14 bp, Homo sapiens
ttccctacctcagg

SEQ ID NO: 3670832 - DNA, 15 bp, Homo sapiens
ttcccttgagccctc

SEQ ID NO: 3670833 - DNA, 14 bp, Homo sapiens
ttcccttggcctca

SEQ ID NO: 3670834 - DNA, 15 bp, Homo sapiens
ttccctttccttcca

SEQ ID NO: 3670835 - DNA, 13 bp, Homo sapiens
ttcccttttaggt

SEQ ID NO: 3670836 - DNA, 15 bp, Homo sapiens
ttccgtatctccctg

SEQ ID NO: 3670837 - DNA, 19 bp, Homo sapiens
ttccgtggtcagagtgcca

SEQ ID NO: 3670838 - DNA, 20 bp, Homo sapiens
ttccgtggtcagagtgccac

SEQ ID NO: 3670839 - DNA, 21 bp, Homo sapiens
ttccgtggtcagagtgccact

SEQ ID NO: 3670840 - DNA, 16 bp, Homo sapiens
ttcctaaatattatga

SEQ ID NO: 3670841 - DNA, 19 bp, Homo sapiens
ttcctaatatcaaatgcag

SEQ ID NO: 3670842 - DNA, 14 bp, Homo sapiens
ttcctatgctttga

SEQ ID NO: 3670843 - DNA, 13 bp, Homo sapiens
ttcctcagcctgg

SEQ ID NO: 3670844 - DNA, 16 bp, Homo sapiens
ttcctcccttctgcta

SEQ ID NO: 3670845 - DNA, 16 bp, Homo sapiens
ttcctctgtgccacgc

SEQ ID NO: 3670846 - DNA, 14 bp, Homo sapiens
ttcctctttgcttt

SEQ ID NO: 3670847 - DNA, 19 bp, Homo sapiens
ttcctgcaactcaaggact

SEQ ID NO: 3670848 - DNA, 13 bp, Homo sapiens
ttcctgccccagg

SEQ ID NO: 3670849 - DNA, 10 bp, Homo sapiens
ttcctggaac

SEQ ID NO: 3670850 - DNA, 22 bp, Homo sapiens
ttcctggaacctggaccccagc

SEQ ID NO: 3670851 - DNA, 14 bp, Homo sapiens
ttcctggaagccag

SEQ ID NO: 3670852 - DNA, 15 bp, Homo sapiens
ttcctgtccagctcc

SEQ ID NO: 3670853 - DNA, 15 bp, Homo sapiens
ttcctgtgggtgggg

SEQ ID NO: 3670854 - DNA, 20 bp, Homo sapiens
ttccttccatccctaccccc

SEQ ID NO: 3670855 - DNA, 15 bp, Homo sapiens
ttccttggggcaggc

SEQ ID NO: 3670856 - DNA, 17 bp, Homo sapiens
ttccttggggcaggcag

SEQ ID NO: 3670857 - DNA, 18 bp, Homo sapiens
ttccttggggcaggcagt

SEQ ID NO: 3670858 - DNA, 16 bp, Homo sapiens
ttccttgtcttgataa

SEQ ID NO: 3670859 - DNA, 15 bp, Homo sapiens
ttcctttaaaaaact

SEQ ID NO: 3670860 - DNA, 23 bp, Homo sapiens
tgttgtaaaacaaaatttgacta

SEQ ID NO: 3670861 - DNA, 22 bp, Homo sapiens
tgttgtagattaggtcttgctg

SEQ ID NO: 3670862 - DNA, 14 bp, Homo sapiens
tgttgtatttaatt

SEQ ID NO: 3670863 - DNA, 13 bp, Homo sapiens
tgttgtcagctga

SEQ ID NO: 3670864 - DNA, 14 bp, Homo sapiens
tgttgtcagctgaa

SEQ ID NO: 3670865 - DNA, 13 bp, Homo sapiens
tgttgtcccttct

SEQ ID NO: 3670866 - DNA, 15 bp, Homo sapiens
tgttgtctcttgagt

SEQ ID NO: 3670867 - DNA, 13 bp, Homo sapiens
tgttgtgctttta

SEQ ID NO: 3670868 - DNA, 12 bp, Homo sapiens
tgttgtgtgtgc

SEQ ID NO: 3670869 - DNA, 13 bp, Homo sapiens
tgttgttggttgt

SEQ ID NO: 3670870 - DNA, 21 bp, Homo sapiens
tgttgtttcctaatatcaaat

SEQ ID NO: 3670871 - DNA, 14 bp, Homo sapiens
tgtttaatctgtta

SEQ ID NO: 3670872 - DNA, 20 bp, Homo sapiens
tgtttaatctgttatgtact

SEQ ID NO: 3670873 - DNA, 20 bp, Homo sapiens
tgtttacatttactgaaatg

SEQ ID NO: 3670874 - DNA, 21 bp, Homo sapiens
tgtttacatttactgaaatgc

SEQ ID NO: 3670875 - DNA, 15 bp, Homo sapiens
tgtttactgcaaggt

SEQ ID NO: 3670876 - DNA, 23 bp, Homo sapiens
tgtttcaaaataagtatttctga

SEQ ID NO: 3670877 - DNA, 16 bp, Homo sapiens
tgtttcacaaggtctt

SEQ ID NO: 3670878 - DNA, 15 bp, Homo sapiens
tgtttcattcatcct

SEQ ID NO: 3670879 - DNA, 15 bp, Homo sapiens
tgtttctgcatcttt

SEQ ID NO: 3670880 - DNA, 21 bp, Homo sapiens
tgtttgaaaaagctggtcttt

SEQ ID NO: 3670881 - DNA, 13 bp, Homo sapiens
tgtttgaaagtag

SEQ ID NO: 3670882 - DNA, 13 bp, Homo sapiens
tgtttgctgctat

SEQ ID NO: 3670883 - DNA, 14 bp, Homo sapiens
tgtttggctttcag

SEQ ID NO: 3670884 - DNA, 15 bp, Homo sapiens
tgtttgtaaatgcct

SEQ ID NO: 3670885 - DNA, 13 bp, Homo sapiens
tgtttgtatgaaa

SEQ ID NO: 3670886 - DNA, 12 bp, Homo sapiens
tgtttgtggcct

SEQ ID NO: 3670887 - DNA, 13 bp, Homo sapiens
tgtttgtggcctc

SEQ ID NO: 3670888 - DNA, 12 bp, Homo sapiens
tgttttaaagaa

SEQ ID NO: 3670889 - DNA, 15 bp, Homo sapiens
tgttttaaatgtaca

SEQ ID NO: 3670890 - DNA, 14 bp, Homo sapiens
tgttttatgagaaa

SEQ ID NO: 3670891 - DNA, 22 bp, Homo sapiens
tgttttcctcccttctgctact

SEQ ID NO: 3670892 - DNA, 20 bp, Homo sapiens
tgttttgatgtttgtggcct

SEQ ID NO: 3670893 - DNA, 12 bp, Homo sapiens
tgttttgttaat

SEQ ID NO: 3670894 - DNA, 16 bp, Homo sapiens
tgtttttgcacatgtt

SEQ ID NO: 3670895 - DNA, 21 bp, Homo sapiens
ttaaaaaaaatcatcattatt

SEQ ID NO: 3670896 - DNA, 16 bp, Homo sapiens
ttaaaaaatattttct

SEQ ID NO: 3670897 - DNA, 14 bp, Homo sapiens
ttaaaacccaagtg

SEQ ID NO: 3670898 - DNA, 14 bp, Homo sapiens
ttaaaactggacct

SEQ ID NO: 3670899 - DNA, 23 bp, Homo sapiens
ttaaaagagagagagagaaaaaa

SEQ ID NO: 3670900 - DNA, 23 bp, Homo sapiens
ttaaaagtcagtatcatattatt

SEQ ID NO: 3670901 - DNA, 18 bp, Homo sapiens
ttaaaatcagactcttta

SEQ ID NO: 3670902 - DNA, 18 bp, Homo sapiens
ttaaaatgcaaaataatg

SEQ ID NO: 3670903 - DNA, 19 bp, Homo sapiens
ttaaaatggtttgtcctga

SEQ ID NO: 3670904 - DNA, 23 bp, Homo sapiens
ttaaacacacagatacacacaca

SEQ ID NO: 3670905 - DNA, 13 bp, Homo sapiens
ttaaactcttaga

SEQ ID NO: 3670906 - DNA, 13 bp, Homo sapiens
ttaaatattttct

SEQ ID NO: 3670907 - DNA, 12 bp, Homo sapiens
ttaaattacaat

SEQ ID NO: 3670908 - DNA, 15 bp, Homo sapiens
ttaaattacaatttt

SEQ ID NO: 3670909 - DNA, 15 bp, Homo sapiens
ttaacaatctaacaa

SEQ ID NO: 3670910 - DNA, 17 bp, Homo sapiens
ttaacaattaggcagac

SEQ ID NO: 3670911 - DNA, 16 bp, Homo sapiens
ttaacacaatgtgaat

SEQ ID NO: 3670912 - DNA, 20 bp, Homo sapiens
ttaacacaatgtgaatttct

SEQ ID NO: 3670913 - DNA, 22 bp, Homo sapiens
ttaacatttgtgtaatatgaaa

SEQ ID NO: 3670914 - DNA, 17 bp, Homo sapiens
ttaaccacttcagctga

SEQ ID NO: 3670915 - DNA, 22 bp, Homo sapiens
ttaaccagatctagtcaatcaa

SEQ ID NO: 3670916 - DNA, 12 bp, Homo sapiens
ttaacctctgca

SEQ ID NO: 3670917 - DNA, 21 bp, Homo sapiens
ttaaccttactaattatacta

SEQ ID NO: 3670918 - DNA, 20 bp, Homo sapiens
ttaactggtgcactttgtaa

SEQ ID NO: 3670919 - DNA, 14 bp, Homo sapiens
ttaacttgaatttg

SEQ ID NO: 3670920 - DNA, 16 bp, Homo sapiens
ttaagaactgctgttt

SEQ ID NO: 3670921 - DNA, 16 bp, Homo sapiens
ttaagacaacaggcat

SEQ ID NO: 3670922 - DNA, 14 bp, Homo sapiens
ttaagacctggcag

SEQ ID NO: 3670923 - DNA, 18 bp, Homo sapiens
ttaagacctggcagctct

SEQ ID NO: 3670924 - DNA, 14 bp, Homo sapiens
ttaagcaacatctt

SEQ ID NO: 3670925 - DNA, 19 bp, Homo sapiens
ttaagcaacatctttttaa

SEQ ID NO: 3670926 - DNA, 21 bp, Homo sapiens
ttaaggaagacaatgtgaaaa

SEQ ID NO: 3670927 - DNA, 15 bp, Homo sapiens
ttaaggtctttattt

SEQ ID NO: 3670928 - DNA, 16 bp, Homo sapiens
ttaaggtctttcagta

SEQ ID NO: 3670929 - DNA, 18 bp, Homo sapiens
ttaagttagggaatggca

SEQ ID NO: 3670930 - DNA, 14 bp, Homo sapiens
ttaataaaaaggca

SEQ ID NO: 3670931 - DNA, 16 bp, Homo sapiens
ttaatatctcctggaa

SEQ ID NO: 3670932 - DNA, 16 bp, Homo sapiens
ttaatatggggatgca

SEQ ID NO: 3670933 - DNA, 17 bp, Homo sapiens
ttaatattaactacaga

SEQ ID NO: 3670934 - DNA, 12 bp, Homo sapiens
ttaatccaatgg

SEQ ID NO: 3670935 - DNA, 14 bp, Homo sapiens
ttaatgctatttga

SEQ ID NO: 3670936 - DNA, 20 bp, Homo sapiens
ttaatgctatttgaacaagt

SEQ ID NO: 3670937 - DNA, 21 bp, Homo sapiens
ttaatgctatttgaacaagtg

SEQ ID NO: 3670938 - DNA, 16 bp, Homo sapiens
ttaatgtggttgaaga

SEQ ID NO: 3670939 - DNA, 23 bp, Homo sapiens
ttaatgttttaaatgtacagaca

SEQ ID NO: 3670940 - DNA, 12 bp, Homo sapiens
ttaattgctttg

SEQ ID NO: 3670941 - DNA, 14 bp, Homo sapiens
ttaatttatgcaga

SEQ ID NO: 3670942 - DNA, 12 bp, Homo sapiens
ttaatttgttgt

SEQ ID NO: 3670943 - DNA, 17 bp, Homo sapiens
ttaattttattcaagaa

SEQ ID NO: 3670944 - DNA, 17 bp, Homo sapiens
ttaattttttggtacaa

SEQ ID NO: 3670945 - DNA, 18 bp, Homo sapiens
ttaattttttggtacaaa

SEQ ID NO: 3670946 - DNA, 20 bp, Homo sapiens
ttaattttttggtacaaaaa

SEQ ID NO: 3670947 - DNA, 15 bp, Homo sapiens
ttacaaacatgtggt

SEQ ID NO: 3670948 - DNA, 18 bp, Homo sapiens
ttacacaatggtttttaa

SEQ ID NO: 3670949 - DNA, 20 bp, Homo sapiens
ttacagaatcttccttttat

SEQ ID NO: 3670950 - DNA, 15 bp, Homo sapiens
ttacagcacaaaatg

SEQ ID NO: 3670951 - DNA, 15 bp, Homo sapiens
ttacaggttcttagg

SEQ ID NO: 3670952 - DNA, 18 bp, Homo sapiens
ttacatcaaggcttcaaa

SEQ ID NO: 3670953 - DNA, 17 bp, Homo sapiens
ttacatgccccgttttt

SEQ ID NO: 3670954 - DNA, 16 bp, Homo sapiens
ttacatgtaatttgat

SEQ ID NO: 3670955 - DNA, 20 bp, Homo sapiens
ttacatgtaatttgatgagg

SEQ ID NO: 3670956 - DNA, 18 bp, Homo sapiens
ttacatttactgaaatgc

SEQ ID NO: 3670957 - DNA, 20 bp, Homo sapiens
ttacatttgatgcatgtctt

SEQ ID NO: 3670958 - DNA, 19 bp, Homo sapiens
ttacatttttgtggttttg

SEQ ID NO: 3670959 - DNA, 11 bp, Homo sapiens
ttaccacactt

SEQ ID NO: 3670960 - DNA, 14 bp, Homo sapiens
ttaccccttagcct

SEQ ID NO: 3670961 - DNA, 12 bp, Homo sapiens
ttacctgccaat

SEQ ID NO: 3670962 - DNA, 20 bp, Homo sapiens
ttacctgccaattgctaccg

SEQ ID NO: 3670963 - DNA, 20 bp, Homo sapiens
ttacggttttccaggtttaa

SEQ ID NO: 3670964 - DNA, 13 bp, Homo sapiens
ttactaaaagatc

SEQ ID NO: 3670965 - DNA, 11 bp, Homo sapiens
ttactgtgtta

SEQ ID NO: 3670966 - DNA, 16 bp, Homo sapiens
ttactgttatagaata

SEQ ID NO: 3670967 - DNA, 17 bp, Homo sapiens
ttactgttttgaggaat

SEQ ID NO: 3670968 - DNA, 18 bp, Homo sapiens
ttacttaggtgtggggga

SEQ ID NO: 3670969 - DNA, 13 bp, Homo sapiens
ttacttggctttt

SEQ ID NO: 3670970 - DNA, 23 bp, Homo sapiens
ttagaagcactacaccttgcctt

SEQ ID NO: 3670971 - DNA, 17 bp, Homo sapiens
ttagaattaaaaaagca

SEQ ID NO: 3670972 - DNA, 21 bp, Homo sapiens
ttagactcatggtgtgttaca

SEQ ID NO: 3670973 - DNA, 16 bp, Homo sapiens
ttagagatgctaaaat

SEQ ID NO: 3670974 - DNA, 21 bp, Homo sapiens
ttagcaactgctggggagaca

SEQ ID NO: 3670975 - DNA, 18 bp, Homo sapiens
ttagccaagtgtggtaga

SEQ ID NO: 3670976 - DNA, 14 bp, Homo sapiens
ttagctcctgtggc

SEQ ID NO: 3670977 - DNA, 17 bp, Homo sapiens
ttaggagaagccaggaa

SEQ ID NO: 3670978 - DNA, 15 bp, Homo sapiens
ttaggcagactcttt

SEQ ID NO: 3670979 - DNA, 14 bp, Homo sapiens
ttaggcagggaagt

SEQ ID NO: 3670980 - DNA, 14 bp, Homo sapiens
tgtctggtggcccc

SEQ ID NO: 3670981 - DNA, 16 bp, Homo sapiens
tgtctggtggccccgt

SEQ ID NO: 3670982 - DNA, 12 bp, Homo sapiens
tgtctgtctaca

SEQ ID NO: 3670983 - DNA, 17 bp, Homo sapiens
tgtctgtctacatttct

SEQ ID NO: 3670984 - DNA, 12 bp, Homo sapiens
tgtctgtgccat

SEQ ID NO: 3670985 - DNA, 20 bp, Homo sapiens
tgtcttggaagtctgtctca

SEQ ID NO: 3670986 - DNA, 14 bp, Homo sapiens
tgtcttgttcttga

SEQ ID NO: 3670987 - DNA, 16 bp, Homo sapiens
tgtcttgttcttgaga

SEQ ID NO: 3670988 - DNA, 17 bp, Homo sapiens
tgtctttaaatgctgct

SEQ ID NO: 3670989 - DNA, 15 bp, Homo sapiens
tgtctttttgttgta

SEQ ID NO: 3670990 - DNA, 17 bp, Homo sapiens
tgtgaaaagaaaaatga

SEQ ID NO: 3670991 - DNA, 23 bp, Homo sapiens
tgtgaaaagaaaaatgagcctgg

SEQ ID NO: 3670992 - DNA, 13 bp, Homo sapiens
tgtgaaataccac

SEQ ID NO: 3670993 - DNA, 19 bp, Homo sapiens
tgtgaactgactttaagta

SEQ ID NO: 3670994 - DNA, 14 bp, Homo sapiens
tgtgaagagaacca

SEQ ID NO: 3670995 - DNA, 14 bp, Homo sapiens
tgtgaaggaccctt

SEQ ID NO: 3670996 - DNA, 17 bp, Homo sapiens
tgtgaatgccactgcct

SEQ ID NO: 3670997 - DNA, 18 bp, Homo sapiens
tgtgaccctctttgctga

SEQ ID NO: 3670998 - DNA, 19 bp, Homo sapiens
tgtgaccctctttgctgaa

SEQ ID NO: 3670999 - DNA, 20 bp, Homo sapiens
tgtgaccctctttgctgaag

SEQ ID NO: 3671000 - DNA, 24 bp, Homo sapiens
tgtgagaagtgaatgctgggactc

SEQ ID NO: 3671001 - DNA, 13 bp, Homo sapiens
tgtgagaccccca

SEQ ID NO: 3671002 - DNA, 18 bp, Homo sapiens
tgtgagacccccacacct

SEQ ID NO: 3671003 - DNA, 15 bp, Homo sapiens
tgtgagactactaag

SEQ ID NO: 3671004 - DNA, 14 bp, Homo sapiens
tgtgagccactgca

SEQ ID NO: 3671005 - DNA, 13 bp, Homo sapiens
tgtgaggagctgc

SEQ ID NO: 3671006 - DNA, 17 bp, Homo sapiens
tgtgaggagctgctggc

SEQ ID NO: 3671007 - DNA, 14 bp, Homo sapiens
tgtgaggctgtcct

SEQ ID NO: 3671008 - DNA, 18 bp, Homo sapiens
tgtgaggcttgcccagga

SEQ ID NO: 3671009 - DNA, 14 bp, Homo sapiens
tgtgattgtgccta

SEQ ID NO: 3671010 - DNA, 15 bp, Homo sapiens
tgtgcagggagggca

SEQ ID NO: 3671011 - DNA, 14 bp, Homo sapiens
tgtgcatagtttct

SEQ ID NO: 3671012 - DNA, 16 bp, Homo sapiens
tgtgcatagtttcttt

SEQ ID NO: 3671013 - DNA, 21 bp, Homo sapiens
tgtgccactaaactacattgt

SEQ ID NO: 3671014 - DNA, 14 bp, Homo sapiens
tgtgccccatgcct

SEQ ID NO: 3671015 - DNA, 23 bp, Homo sapiens
tgtgccccatgcctgtccagcct

SEQ ID NO: 3671016 - DNA, 16 bp, Homo sapiens
tgtgcccctccaagtc

SEQ ID NO: 3671017 - DNA, 16 bp, Homo sapiens
tgtgcctcgcatccta

SEQ ID NO: 3671018 - DNA, 13 bp, Homo sapiens
tgtgcctgtgtgc

SEQ ID NO: 3671019 - DNA, 13 bp, Homo sapiens
tgtgctatagtat

SEQ ID NO: 3671020 - DNA, 18 bp, Homo sapiens
tgtgctatagtatttgat

SEQ ID NO: 3671021 - DNA, 20 bp, Homo sapiens
tgtgctgctcgcgaaggtcc

SEQ ID NO: 3671022 - DNA, 10 bp, Homo sapiens
tgtgctggga

SEQ ID NO: 3671023 - DNA, 21 bp, Homo sapiens
tgtgctgggaagcccggactg

SEQ ID NO: 3671024 - DNA, 12 bp, Homo sapiens
tgtgctgggagc

SEQ ID NO: 3671025 - DNA, 21 bp, Homo sapiens
tgtgcttttcctgataaagca

SEQ ID NO: 3671026 - DNA, 17 bp, Homo sapiens
tgtggaagacacttgct

SEQ ID NO: 3671027 - DNA, 23 bp, Homo sapiens
tgtggaagacacttgctgagtga

SEQ ID NO: 3671028 - DNA, 14 bp, Homo sapiens
tgtggaggctcctg

SEQ ID NO: 3671029 - DNA, 14 bp, Homo sapiens
tgtggatgataaaa

SEQ ID NO: 3671030 - DNA, 12 bp, Homo sapiens
tgtggatggcag

SEQ ID NO: 3671031 - DNA, 13 bp, Homo sapiens
tgtggatggcagt

SEQ ID NO: 3671032 - DNA, 18 bp, Homo sapiens
tgtggcaatctgtgggct

SEQ ID NO: 3671033 - DNA, 19 bp, Homo sapiens
tgtggccaaggagctgcta

SEQ ID NO: 3671034 - DNA, 14 bp, Homo sapiens
tgtggccagctgca

SEQ ID NO: 3671035 - DNA, 12 bp, Homo sapiens
tgtggccccacc

SEQ ID NO: 3671036 - DNA, 13 bp, Homo sapiens
tgtggccccaccc

SEQ ID NO: 3671037 - DNA, 11 bp, Homo sapiens
tgtggcctcag

SEQ ID NO: 3671038 - DNA, 23 bp, Homo sapiens
tgtggcgccgtctccaggggctg

SEQ ID NO: 3671039 - DNA, 22 bp, Homo sapiens
tgtgggatgttcagcactgtcc

SEQ ID NO: 3671040 - DNA, 17 bp, Homo sapiens
tgtgggccctaccctcc

SEQ ID NO: 3671041 - DNA, 21 bp, Homo sapiens
tgtgggccctaccctcctgct

SEQ ID NO: 3671042 - DNA, 16 bp, Homo sapiens
tgtgggtggggcttct

SEQ ID NO: 3671043 - DNA, 21 bp, Homo sapiens
tgtgggtggggcttctctggg

SEQ ID NO: 3671044 - DNA, 14 bp, Homo sapiens
tgtggtagtcctcc

SEQ ID NO: 3671045 - DNA, 21 bp, Homo sapiens
tgtggtagtcctcccaagctg

SEQ ID NO: 3671046 - DNA, 19 bp, Homo sapiens
tgtgtaacctcttcacctt

SEQ ID NO: 3671047 - DNA, 14 bp, Homo sapiens
tgtgtaatatgaaa

SEQ ID NO: 3671048 - DNA, 17 bp, Homo sapiens
tgtgtcaagacatttct

SEQ ID NO: 3671049 - DNA, 19 bp, Homo sapiens
tgtgtcagcatagaagtaa

SEQ ID NO: 3671050 - DNA, 20 bp, Homo sapiens
tgtgtccatgcgctcagggc

SEQ ID NO: 3671051 - DNA, 12 bp, Homo sapiens
tgtgtcccctca

SEQ ID NO: 3671052 - DNA, 23 bp, Homo sapiens
tgtgtctcccaggtgcatttctt

SEQ ID NO: 3671053 - DNA, 15 bp, Homo sapiens
tgtgtgacaattctg

SEQ ID NO: 3671054 - DNA, 12 bp, Homo sapiens
tgtgtgtgtgca

SEQ ID NO: 3671055 - DNA, 14 bp, Homo sapiens
tgtgtgtgtgtgcg

SEQ ID NO: 3671056 - DNA, 16 bp, Homo sapiens
tgtgtgtgtgtgtgca

SEQ ID NO: 3671057 - DNA, 18 bp, Homo sapiens
tgtgtgttgtctcttgag

SEQ ID NO: 3671058 - DNA, 15 bp, Homo sapiens
tgtgttctgtagact

SEQ ID NO: 3671059 - DNA, 16 bp, Homo sapiens
tgtgtttggctttcag

SEQ ID NO: 3671060 - DNA, 17 bp, Homo sapiens
tgttaatggtttgaata

SEQ ID NO: 3671061 - DNA, 21 bp, Homo sapiens
tgttaattttttggtacaaaa

SEQ ID NO: 3671062 - DNA, 22 bp, Homo sapiens
tgttaattttttggtacaaaaa

SEQ ID NO: 3671063 - DNA, 20 bp, Homo sapiens
tgttacaacttgtatttcca

SEQ ID NO: 3671064 - DNA, 16 bp, Homo sapiens
tgttactgtcttcagt

SEQ ID NO: 3671065 - DNA, 19 bp, Homo sapiens
tgttactttggcaatttcc

SEQ ID NO: 3671066 - DNA, 23 bp, Homo sapiens
tgttactttggcaatttcctggc

SEQ ID NO: 3671067 - DNA, 19 bp, Homo sapiens
tgttagattttgcattttt

SEQ ID NO: 3671068 - DNA, 21 bp, Homo sapiens
tgttaggattttcacattctt

SEQ ID NO: 3671069 - DNA, 19 bp, Homo sapiens
tgttatcttatactgtaca

SEQ ID NO: 3671070 - DNA, 22 bp, Homo sapiens
tgttatcttatactgtacaata

SEQ ID NO: 3671071 - DNA, 12 bp, Homo sapiens
tgttatgtattt

SEQ ID NO: 3671072 - DNA, 14 bp, Homo sapiens
tgttatgtatttcc

SEQ ID NO: 3671073 - DNA, 22 bp, Homo sapiens
tgttattgttttgttaattaca

SEQ ID NO: 3671074 - DNA, 18 bp, Homo sapiens
tgttcactgctccttgct

SEQ ID NO: 3671075 - DNA, 13 bp, Homo sapiens
tgttcagcactgt

SEQ ID NO: 3671076 - DNA, 14 bp, Homo sapiens
tgttcatagcccag

SEQ ID NO: 3671077 - DNA, 23 bp, Homo sapiens
tgttcatagcccagtagaccttg

SEQ ID NO: 3671078 - DNA, 14 bp, Homo sapiens
tgttccccagagaa

SEQ ID NO: 3671079 - DNA, 20 bp, Homo sapiens
tgttcccttcctctgtgcca

SEQ ID NO: 3671080 - DNA, 18 bp, Homo sapiens
tgttctatgcttcctcgt

SEQ ID NO: 3671081 - DNA, 15 bp, Homo sapiens
tgttctgaaacctta

SEQ ID NO: 3671082 - DNA, 21 bp, Homo sapiens
tgttctggggggacccagtgc

SEQ ID NO: 3671083 - DNA, 22 bp, Homo sapiens
tgttctggggggacccagtgca

SEQ ID NO: 3671084 - DNA, 18 bp, Homo sapiens
tgttcttgagattttgta

SEQ ID NO: 3671085 - DNA, 16 bp, Homo sapiens
tgttgaaggactacag

SEQ ID NO: 3671086 - DNA, 17 bp, Homo sapiens
tgttgaagggaggtggc

SEQ ID NO: 3671087 - DNA, 15 bp, Homo sapiens
tgttgacatatttaa

SEQ ID NO: 3671088 - DNA, 23 bp, Homo sapiens
tgttgacatatttaatgttttaa

SEQ ID NO: 3671089 - DNA, 16 bp, Homo sapiens
tgttgacgcacctgtg

SEQ ID NO: 3671090 - DNA, 14 bp, Homo sapiens
tgttgagcaagcag

SEQ ID NO: 3671091 - DNA, 17 bp, Homo sapiens
tgttgagcatcacagaa

SEQ ID NO: 3671092 - DNA, 17 bp, Homo sapiens
tgttgatcatgtacttt

SEQ ID NO: 3671093 - DNA, 23 bp, Homo sapiens
tgttgatcatgtactttttagta

SEQ ID NO: 3671094 - DNA, 21 bp, Homo sapiens
tgttgatgctccgccaggaag

SEQ ID NO: 3671095 - DNA, 17 bp, Homo sapiens
tgttgcaagtgcaataa

SEQ ID NO: 3671096 - DNA, 14 bp, Homo sapiens
tgttgcccttctgt

SEQ ID NO: 3671097 - DNA, 16 bp, Homo sapiens
tgttgcttcaaactga

SEQ ID NO: 3671098 - DNA, 13 bp, Homo sapiens
tgttgtaaaacaa

SEQ ID NO: 3671099 - DNA, 19 bp, Homo sapiens
tggtccccaacaatgtgag

SEQ ID NO: 3671100 - DNA, 15 bp, Homo sapiens
tggtcctttctggaa

SEQ ID NO: 3671101 - DNA, 17 bp, Homo sapiens
tggtcctttctggaagt

SEQ ID NO: 3671102 - DNA, 15 bp, Homo sapiens
tggtcgctcctgccc

SEQ ID NO: 3671103 - DNA, 14 bp, Homo sapiens
tggtctgcaggcag

SEQ ID NO: 3671104 - DNA, 14 bp, Homo sapiens
tggtctgttggcag

SEQ ID NO: 3671105 - DNA, 19 bp, Homo sapiens
tggtgcactttgtaaattc

SEQ ID NO: 3671106 - DNA, 20 bp, Homo sapiens
tggtgccatttctgaactgt

SEQ ID NO: 3671107 - DNA, 13 bp, Homo sapiens
tggtgccccagga

SEQ ID NO: 3671108 - DNA, 21 bp, Homo sapiens
tggtgccccaggaccagctca

SEQ ID NO: 3671109 - DNA, 19 bp, Homo sapiens
tggtggcagtggaggtggg

SEQ ID NO: 3671110 - DNA, 17 bp, Homo sapiens
tggtggccactgagctg

SEQ ID NO: 3671111 - DNA, 13 bp, Homo sapiens
tggtggcccagct

SEQ ID NO: 3671112 - DNA, 21 bp, Homo sapiens
tggtggctgggctgctcctga

SEQ ID NO: 3671113 - DNA, 19 bp, Homo sapiens
tggtgggggagcctctgga

SEQ ID NO: 3671114 - DNA, 23 bp, Homo sapiens
tggttaagttttcttgtttctgc

SEQ ID NO: 3671115 - DNA, 20 bp, Homo sapiens
tggttaccatgggtgtggat

SEQ ID NO: 3671116 - DNA, 21 bp, Homo sapiens
tggttccagggtccctctgtg

SEQ ID NO: 3671117 - DNA, 12 bp, Homo sapiens
tggttctgtgac

SEQ ID NO: 3671118 - DNA, 18 bp, Homo sapiens
tggtttatcagcaaaaaa

SEQ ID NO: 3671119 - DNA, 19 bp, Homo sapiens
tggtttatgtcttgttctt

SEQ ID NO: 3671120 - DNA, 15 bp, Homo sapiens
tggtttgcaaggaag

SEQ ID NO: 3671121 - DNA, 20 bp, Homo sapiens
tggtttgggaatatccatgt

SEQ ID NO: 3671122 - DNA, 13 bp, Homo sapiens
tggtttgtcctga

SEQ ID NO: 3671123 - DNA, 17 bp, Homo sapiens
tggttttctttttcctt

SEQ ID NO: 3671124 - DNA, 23 bp, Homo sapiens
tggtttttaaaaaactgctgact

SEQ ID NO: 3671125 - DNA, 21 bp, Homo sapiens
tggtttttaaattttgtaatg

SEQ ID NO: 3671126 - DNA, 19 bp, Homo sapiens
tgtaaaatcctacagtgaa

SEQ ID NO: 3671127 - DNA, 19 bp, Homo sapiens
tgtaaacataccaacatgt

SEQ ID NO: 3671128 - DNA, 22 bp, Homo sapiens
tgtaaacttccgttcattgctc

SEQ ID NO: 3671129 - DNA, 21 bp, Homo sapiens
tgtaaatactgtttttaacaa

SEQ ID NO: 3671130 - DNA, 15 bp, Homo sapiens
tgtaaatatttgact

SEQ ID NO: 3671131 - DNA, 18 bp, Homo sapiens
tgtaaatgcctcttaaat

SEQ ID NO: 3671132 - DNA, 15 bp, Homo sapiens
tgtaaattatatttg

SEQ ID NO: 3671133 - DNA, 14 bp, Homo sapiens
tgtaaattgaagaa

SEQ ID NO: 3671134 - DNA, 18 bp, Homo sapiens
tgtaaattgaagaagcct

SEQ ID NO: 3671135 - DNA, 21 bp, Homo sapiens
tgtaacaagggttttaatgta

SEQ ID NO: 3671136 - DNA, 19 bp, Homo sapiens
tgtaactatttcttcagag

SEQ ID NO: 3671137 - DNA, 22 bp, Homo sapiens
tgtaagaaacacactgaggcag

SEQ ID NO: 3671138 - DNA, 22 bp, Homo sapiens
tgtaagcatactttgtaaatag

SEQ ID NO: 3671139 - DNA, 11 bp, Homo sapiens
tgtaaggttcc

SEQ ID NO: 3671140 - DNA, 15 bp, Homo sapiens
tgtaagttatgtttt

SEQ ID NO: 3671141 - DNA, 13 bp, Homo sapiens
tgtaataaacttt

SEQ ID NO: 3671142 - DNA, 19 bp, Homo sapiens
tgtaatcatttgtttacat

SEQ ID NO: 3671143 - DNA, 14 bp, Homo sapiens
tgtacagacatatt

SEQ ID NO: 3671144 - DNA, 18 bp, Homo sapiens
tgtacagtagattttcca

SEQ ID NO: 3671145 - DNA, 21 bp, Homo sapiens
tgtaccttttttgttttttca

SEQ ID NO: 3671146 - DNA, 14 bp, Homo sapiens
tgtacgtccagcct

SEQ ID NO: 3671147 - DNA, 17 bp, Homo sapiens
tgtacgtccagcctgcc

SEQ ID NO: 3671148 - DNA, 15 bp, Homo sapiens
tgtactaaagccaaa

SEQ ID NO: 3671149 - DNA, 16 bp, Homo sapiens
tgtactaaagccaaac

SEQ ID NO: 3671150 - DNA, 20 bp, Homo sapiens
tgtactaaagccaaacatat

SEQ ID NO: 3671151 - DNA, 19 bp, Homo sapiens
tgtactttctaagagaaag

SEQ ID NO: 3671152 - DNA, 18 bp, Homo sapiens
tgtactttgcttgctcat

SEQ ID NO: 3671153 - DNA, 17 bp, Homo sapiens
tgtacttttcattctct

SEQ ID NO: 3671154 - DNA, 18 bp, Homo sapiens
tgtacttttcattctctt

SEQ ID NO: 3671155 - DNA, 15 bp, Homo sapiens
tgtactttttagtaa

SEQ ID NO: 3671156 - DNA, 14 bp, Homo sapiens
tgtagactgtggct

SEQ ID NO: 3671157 - DNA, 18 bp, Homo sapiens
tgtagccacaccaggata

SEQ ID NO: 3671158 - DNA, 13 bp, Homo sapiens
tgtaggtatgtct

SEQ ID NO: 3671159 - DNA, 13 bp, Homo sapiens
tgtagtaatttat

SEQ ID NO: 3671160 - DNA, 20 bp, Homo sapiens
tgtagtaggcatttttacca

SEQ ID NO: 3671161 - DNA, 15 bp, Homo sapiens
tgtataatattttta

SEQ ID NO: 3671162 - DNA, 20 bp, Homo sapiens
tgtataatcccacccacctc

SEQ ID NO: 3671163 - DNA, 13 bp, Homo sapiens
tgtatacatctta

SEQ ID NO: 3671164 - DNA, 14 bp, Homo sapiens
tgtatataaatgtg

SEQ ID NO: 3671165 - DNA, 20 bp, Homo sapiens
tgtatatggtatatatacat

SEQ ID NO: 3671166 - DNA, 21 bp, Homo sapiens
tgtatatggtatatatacata

SEQ ID NO: 3671167 - DNA, 15 bp, Homo sapiens
tgtatatttaggaaa

SEQ ID NO: 3671168 - DNA, 18 bp, Homo sapiens
tgtattcagacagatgag

SEQ ID NO: 3671169 - DNA, 17 bp, Homo sapiens
tgtattcccagttactt

SEQ ID NO: 3671170 - DNA, 23 bp, Homo sapiens
tgtattgggcagcagactgtgtt

SEQ ID NO: 3671171 - DNA, 14 bp, Homo sapiens
tgtatttgcttttt

SEQ ID NO: 3671172 - DNA, 16 bp, Homo sapiens
tgtcaaacaaagccag

SEQ ID NO: 3671173 - DNA, 22 bp, Homo sapiens
tgtcaaacaaagccagaagctg

SEQ ID NO: 3671174 - DNA, 17 bp, Homo sapiens
tgtcaagagtagttata

SEQ ID NO: 3671175 - DNA, 20 bp, Homo sapiens
tgtcaagcctgtgcaaaaaa

SEQ ID NO: 3671176 - DNA, 15 bp, Homo sapiens
tgtcaatttctgtgt

SEQ ID NO: 3671177 - DNA, 23 bp, Homo sapiens
tgtcacccaaaccggcaggtgcg

SEQ ID NO: 3671178 - DNA, 18 bp, Homo sapiens
tgtcaccggatcctgggt

SEQ ID NO: 3671179 - DNA, 19 bp, Homo sapiens
tgtcaccggatcctgggtg

SEQ ID NO: 3671180 - DNA, 14 bp, Homo sapiens
tgtcactcaaggcg

SEQ ID NO: 3671181 - DNA, 17 bp, Homo sapiens
tgtcactcaaggcggtg

SEQ ID NO: 3671182 - DNA, 15 bp, Homo sapiens
tgtcagttacttttt

SEQ ID NO: 3671183 - DNA, 18 bp, Homo sapiens
tgtcatctgcatgtctac

SEQ ID NO: 3671184 - DNA, 19 bp, Homo sapiens
tgtcatggtcctttctgga

SEQ ID NO: 3671185 - DNA, 23 bp, Homo sapiens
tgtccacgcgtgccgtggcacca

SEQ ID NO: 3671186 - DNA, 19 bp, Homo sapiens
tgtccagcaccttgtgcct

SEQ ID NO: 3671187 - DNA, 20 bp, Homo sapiens
tgtccagcaccttgtgcctg

SEQ ID NO: 3671188 - DNA, 19 bp, Homo sapiens
tgtccagcctgggcagcca

SEQ ID NO: 3671189 - DNA, 12 bp, Homo sapiens
tgtccagctcca

SEQ ID NO: 3671190 - DNA, 20 bp, Homo sapiens
tgtccagctccaacctgcaa

SEQ ID NO: 3671191 - DNA, 20 bp, Homo sapiens
tgtcccactcaagccaagca

SEQ ID NO: 3671192 - DNA, 18 bp, Homo sapiens
tgtcccagccagtgagga

SEQ ID NO: 3671193 - DNA, 14 bp, Homo sapiens
tgtcccaggcaggg

SEQ ID NO: 3671194 - DNA, 18 bp, Homo sapiens
tgtcccatgatccctgtg

SEQ ID NO: 3671195 - DNA, 16 bp, Homo sapiens
tgtccctccaacacag

SEQ ID NO: 3671196 - DNA, 20 bp, Homo sapiens
tgtcctaggagtatcctcat

SEQ ID NO: 3671197 - DNA, 12 bp, Homo sapiens
tgtcctcagcct

SEQ ID NO: 3671198 - DNA, 18 bp, Homo sapiens
tgtcctccagaagcctct

SEQ ID NO: 3671199 - DNA, 20 bp, Homo sapiens
tgtcctccagaagcctctgg

SEQ ID NO: 3671200 - DNA, 21 bp, Homo sapiens
tgtcctccagaagcctctggc

SEQ ID NO: 3671201 - DNA, 18 bp, Homo sapiens
tgtcctctccctgccaag

SEQ ID NO: 3671202 - DNA, 20 bp, Homo sapiens
tgtccttacccatctgcacc

SEQ ID NO: 3671203 - DNA, 14 bp, Homo sapiens
tgtcctttctagag

SEQ ID NO: 3671204 - DNA, 18 bp, Homo sapiens
tgtcctttctagagcact

SEQ ID NO: 3671205 - DNA, 14 bp, Homo sapiens
tgtcgctcatgtgt

SEQ ID NO: 3671206 - DNA, 19 bp, Homo sapiens
tgtcgggcaccagccagcg

SEQ ID NO: 3671207 - DNA, 23 bp, Homo sapiens
tgtcgtgagtgtctcttgtctaa

SEQ ID NO: 3671208 - DNA, 13 bp, Homo sapiens
tgtctaattaaaa

SEQ ID NO: 3671209 - DNA, 14 bp, Homo sapiens
tgtctcaggagcac

SEQ ID NO: 3671210 - DNA, 13 bp, Homo sapiens
tgtctcatcccca

SEQ ID NO: 3671211 - DNA, 13 bp, Homo sapiens
tgtctgaacccag

SEQ ID NO: 3671212 - DNA, 14 bp, Homo sapiens
tgtctgaacccagg

SEQ ID NO: 3671213 - DNA, 20 bp, Homo sapiens
tgtctgaacccaggcagctg

SEQ ID NO: 3671214 - DNA, 21 bp, Homo sapiens
tgtctgaacccaggcagctgg

SEQ ID NO: 3671215 - DNA, 23 bp, Homo sapiens
tgtctgaacccaggcagctggca

SEQ ID NO: 3671216 - DNA, 13 bp, Homo sapiens
tgtctggtggccc

SEQ ID NO: 3671217 - DNA, 14 bp, Homo sapiens
tggcttctccctgg

SEQ ID NO: 3671218 - DNA, 14 bp, Homo sapiens
tggcttctgcagga

SEQ ID NO: 3671219 - DNA, 15 bp, Homo sapiens
tggcttctggccagg

SEQ ID NO: 3671220 - DNA, 17 bp, Homo sapiens
tggcttctggccaggaa

SEQ ID NO: 3671221 - DNA, 18 bp, Homo sapiens
tggcttctggccaggaag

SEQ ID NO: 3671222 - DNA, 22 bp, Homo sapiens
tggcttgttattgcctctactt

SEQ ID NO: 3671223 - DNA, 11 bp, Homo sapiens
tggctttcagg

SEQ ID NO: 3671224 - DNA, 22 bp, Homo sapiens
tggctttctctccttggccttt

SEQ ID NO: 3671225 - DNA, 18 bp, Homo sapiens
tgggaaacttggctcgaa

SEQ ID NO: 3671226 - DNA, 17 bp, Homo sapiens
tgggaaccgccctcctg

SEQ ID NO: 3671227 - DNA, 13 bp, Homo sapiens
tgggaactagact

SEQ ID NO: 3671228 - DNA, 13 bp, Homo sapiens
tgggaagcccgga

SEQ ID NO: 3671229 - DNA, 15 bp, Homo sapiens
tgggacagggcttct

SEQ ID NO: 3671230 - DNA, 16 bp, Homo sapiens
tgggaccaggctccaa

SEQ ID NO: 3671231 - DNA, 14 bp, Homo sapiens
tgggacccccgtgg

SEQ ID NO: 3671232 - DNA, 17 bp, Homo sapiens
tgggacccccgtggggc

SEQ ID NO: 3671233 - DNA, 22 bp, Homo sapiens
tgggacccccgtggggcaggga

SEQ ID NO: 3671234 - DNA, 18 bp, Homo sapiens
tgggactcgtggctgtca

SEQ ID NO: 3671235 - DNA, 18 bp, Homo sapiens
tgggactcttccctggga

SEQ ID NO: 3671236 - DNA, 14 bp, Homo sapiens
tgggacttctaccc

SEQ ID NO: 3671237 - DNA, 16 bp, Homo sapiens
tgggacttctacccag

SEQ ID NO: 3671238 - DNA, 16 bp, Homo sapiens
tgggaggatctcttga

SEQ ID NO: 3671239 - DNA, 18 bp, Homo sapiens
tgggaggatctcttgagc

SEQ ID NO: 3671240 - DNA, 21 bp, Homo sapiens
tgggaggatctcttgagcctg

SEQ ID NO: 3671241 - DNA, 22 bp, Homo sapiens
tgggaggatctcttgagcctgg

SEQ ID NO: 3671242 - DNA, 18 bp, Homo sapiens
tgggaggattgcttgagc

SEQ ID NO: 3671243 - DNA, 18 bp, Homo sapiens
tgggaggccccactgggg

SEQ ID NO: 3671244 - DNA, 17 bp, Homo sapiens
tgggaggtcaaggctgc

SEQ ID NO: 3671245 - DNA, 19 bp, Homo sapiens
tgggaggtcaaggctgcag

SEQ ID NO: 3671246 - DNA, 20 bp, Homo sapiens
tgggaggtcaaggctgcagt

SEQ ID NO: 3671247 - DNA, 16 bp, Homo sapiens
tgggatccgagggccc

SEQ ID NO: 3671248 - DNA, 15 bp, Homo sapiens
tgggatctgaggagt

SEQ ID NO: 3671249 - DNA, 16 bp, Homo sapiens
tgggatgttcagcact

SEQ ID NO: 3671250 - DNA, 22 bp, Homo sapiens
tgggatgttcagcactgtccct

SEQ ID NO: 3671251 - DNA, 14 bp, Homo sapiens
tgggatgtttctgt

SEQ ID NO: 3671252 - DNA, 21 bp, Homo sapiens
tgggattctggacaggatgtg

SEQ ID NO: 3671253 - DNA, 15 bp, Homo sapiens
tgggcaatatagcaa

SEQ ID NO: 3671254 - DNA, 18 bp, Homo sapiens
tgggcagagctggctctg

SEQ ID NO: 3671255 - DNA, 15 bp, Homo sapiens
tgggcagccaggctg

SEQ ID NO: 3671256 - DNA, 18 bp, Homo sapiens
tgggcattgatggggaag

SEQ ID NO: 3671257 - DNA, 23 bp, Homo sapiens
tgggccaacaaagaacactaact

SEQ ID NO: 3671258 - DNA, 21 bp, Homo sapiens
tgggccagtcctggttgtctg

SEQ ID NO: 3671259 - DNA, 16 bp, Homo sapiens
tgggccagtctgtgga

SEQ ID NO: 3671260 - DNA, 20 bp, Homo sapiens
tgggccagtctgtggatcag

SEQ ID NO: 3671261 - DNA, 14 bp, Homo sapiens
tgggcccagatctg

SEQ ID NO: 3671262 - DNA, 16 bp, Homo sapiens
tgggccccgagccacg

SEQ ID NO: 3671263 - DNA, 15 bp, Homo sapiens
tgggcccctggcact

SEQ ID NO: 3671264 - DNA, 19 bp, Homo sapiens
tgggccctaccctcctgct

SEQ ID NO: 3671265 - DNA, 21 bp, Homo sapiens
tgggccctgagtctgggcagc

SEQ ID NO: 3671266 - DNA, 14 bp, Homo sapiens
tgggccgctgccac

SEQ ID NO: 3671267 - DNA, 22 bp, Homo sapiens
tgggccggcccccttcctggcc

SEQ ID NO: 3671268 - DNA, 19 bp, Homo sapiens
tgggccgggacccagggcc

SEQ ID NO: 3671269 - DNA, 13 bp, Homo sapiens
tgggcctcagttt

SEQ ID NO: 3671270 - DNA, 14 bp, Homo sapiens
tgggcctgctccag

SEQ ID NO: 3671271 - DNA, 19 bp, Homo sapiens
tgggcctgctccagacctg

SEQ ID NO: 3671272 - DNA, 14 bp, Homo sapiens
tgggctgctcctga

SEQ ID NO: 3671273 - DNA, 15 bp, Homo sapiens
tgggctgctcctgaa

SEQ ID NO: 3671274 - DNA, 15 bp, Homo sapiens
tgggctgtttctgct

SEQ ID NO: 3671275 - DNA, 15 bp, Homo sapiens
tgggcttccatgcct

SEQ ID NO: 3671276 - DNA, 18 bp, Homo sapiens
tggggaaagcctgaaggg

SEQ ID NO: 3671277 - DNA, 21 bp, Homo sapiens
tggggaaaggggtcggctgac

SEQ ID NO: 3671278 - DNA, 14 bp, Homo sapiens
tggggacggggctc

SEQ ID NO: 3671279 - DNA, 15 bp, Homo sapiens
tggggacggggctcc

SEQ ID NO: 3671280 - DNA, 16 bp, Homo sapiens
tggggacggggctccc

SEQ ID NO: 3671281 - DNA, 23 bp, Homo sapiens
tggggagggcaggtccagctctg

SEQ ID NO: 3671282 - DNA, 15 bp, Homo sapiens
tggggaggggctctg

SEQ ID NO: 3671283 - DNA, 18 bp, Homo sapiens
tggggagttaagacctgg

SEQ ID NO: 3671284 - DNA, 19 bp, Homo sapiens
tggggcacggctctggggt

SEQ ID NO: 3671285 - DNA, 20 bp, Homo sapiens
tggggcacggctctggggta

SEQ ID NO: 3671286 - DNA, 19 bp, Homo sapiens
tggggcagagcttctcctg

SEQ ID NO: 3671287 - DNA, 12 bp, Homo sapiens
tggggcaggcag

SEQ ID NO: 3671288 - DNA, 14 bp, Homo sapiens
tggggcaggcagtg

SEQ ID NO: 3671289 - DNA, 13 bp, Homo sapiens
tggggccagatcc

SEQ ID NO: 3671290 - DNA, 16 bp, Homo sapiens
tggggccagatccagc

SEQ ID NO: 3671291 - DNA, 21 bp, Homo sapiens
tggggccagatccagcctggg

SEQ ID NO: 3671292 - DNA, 22 bp, Homo sapiens
tggggcccagtgcatggtggcc

SEQ ID NO: 3671293 - DNA, 17 bp, Homo sapiens
tggggcctgaggtcatc

SEQ ID NO: 3671294 - DNA, 17 bp, Homo sapiens
tggggctcacacacctg

SEQ ID NO: 3671295 - DNA, 15 bp, Homo sapiens
tggggctcctacctg

SEQ ID NO: 3671296 - DNA, 21 bp, Homo sapiens
tgggggatcacagcctctgaa

SEQ ID NO: 3671297 - DNA, 16 bp, Homo sapiens
tgggggcagaactcct

SEQ ID NO: 3671298 - DNA, 20 bp, Homo sapiens
tgggggcgggactcctccct

SEQ ID NO: 3671299 - DNA, 23 bp, Homo sapiens
tgggggggtggccgctgagtggc

SEQ ID NO: 3671300 - DNA, 15 bp, Homo sapiens
tgggggtggggctcc

SEQ ID NO: 3671301 - DNA, 16 bp, Homo sapiens
tgggggtggggctcct

SEQ ID NO: 3671302 - DNA, 18 bp, Homo sapiens
tgggggtggggctcctac

SEQ ID NO: 3671303 - DNA, 18 bp, Homo sapiens
tggggtcatgccctcctc

SEQ ID NO: 3671304 - DNA, 20 bp, Homo sapiens
tggggtcatgccctcctctc

SEQ ID NO: 3671305 - DNA, 13 bp, Homo sapiens
tggggtccctcta

SEQ ID NO: 3671306 - DNA, 15 bp, Homo sapiens
tggggtcctggccat

SEQ ID NO: 3671307 - DNA, 21 bp, Homo sapiens
tggggtggttatgtttccatg

SEQ ID NO: 3671308 - DNA, 15 bp, Homo sapiens
tggggtgtgctggga

SEQ ID NO: 3671309 - DNA, 15 bp, Homo sapiens
tggggtgtgggaggc

SEQ ID NO: 3671310 - DNA, 18 bp, Homo sapiens
tgggtaatcgatggggga

SEQ ID NO: 3671311 - DNA, 20 bp, Homo sapiens
tgggtatagttcatgtctgc

SEQ ID NO: 3671312 - DNA, 21 bp, Homo sapiens
tgggtatgaactaaaaagaga

SEQ ID NO: 3671313 - DNA, 14 bp, Homo sapiens
tgggtcatatggaa

SEQ ID NO: 3671314 - DNA, 13 bp, Homo sapiens
tgggtgctcccta

SEQ ID NO: 3671315 - DNA, 17 bp, Homo sapiens
tgggtggcaccagcagc

SEQ ID NO: 3671316 - DNA, 21 bp, Homo sapiens
tgggtggggcttctctgggac

SEQ ID NO: 3671317 - DNA, 15 bp, Homo sapiens
tgggtgtggatggca

SEQ ID NO: 3671318 - DNA, 16 bp, Homo sapiens
tgggttcaagagactc

SEQ ID NO: 3671319 - DNA, 24 bp, Homo sapiens
tgggttcaggggactcagccctga

SEQ ID NO: 3671320 - DNA, 16 bp, Homo sapiens
tgggttctgcctgcca

SEQ ID NO: 3671321 - DNA, 21 bp, Homo sapiens
tgggttctgcctgccagctgc

SEQ ID NO: 3671322 - DNA, 17 bp, Homo sapiens
tgggttggaaaacagta

SEQ ID NO: 3671323 - DNA, 23 bp, Homo sapiens
tgggttgggcacggcttatacca

SEQ ID NO: 3671324 - DNA, 14 bp, Homo sapiens
tgggtttttccctg

SEQ ID NO: 3671325 - DNA, 19 bp, Homo sapiens
tggtaaacgctgtccctag

SEQ ID NO: 3671326 - DNA, 21 bp, Homo sapiens
tggtaactgattacctgccaa

SEQ ID NO: 3671327 - DNA, 22 bp, Homo sapiens
tggtaactgattacctgccaat

SEQ ID NO: 3671328 - DNA, 14 bp, Homo sapiens
tggtaattgtacta

SEQ ID NO: 3671329 - DNA, 19 bp, Homo sapiens
tggtacaaaaataaattta

SEQ ID NO: 3671330 - DNA, 15 bp, Homo sapiens
tggtagtcctcccaa

SEQ ID NO: 3671331 - DNA, 14 bp, Homo sapiens
tggtatatatacat

SEQ ID NO: 3671332 - DNA, 19 bp, Homo sapiens
tggtatctcaggtctgaat

SEQ ID NO: 3671333 - DNA, 20 bp, Homo sapiens
tggtatctcaggtctgaatc

SEQ ID NO: 3671334 - DNA, 17 bp, Homo sapiens
tggtccagggaagctgg

SEQ ID NO: 3671335 - DNA, 15 bp, Homo sapiens
tggagcaggactccc

SEQ ID NO: 3671336 - DNA, 15 bp, Homo sapiens
tggagcccagggagc

SEQ ID NO: 3671337 - DNA, 13 bp, Homo sapiens
tggagccccaggg

SEQ ID NO: 3671338 - DNA, 17 bp, Homo sapiens
tggagccgaggcctacc

SEQ ID NO: 3671339 - DNA, 20 bp, Homo sapiens
tggagctagtgtctcctctc

SEQ ID NO: 3671340 - DNA, 22 bp, Homo sapiens
tggagctagtgtctcctctctg

SEQ ID NO: 3671341 - DNA, 17 bp, Homo sapiens
tggagctgaattttctg

SEQ ID NO: 3671342 - DNA, 22 bp, Homo sapiens
tggagctgactacggaactgca

SEQ ID NO: 3671343 - DNA, 13 bp, Homo sapiens
tggagctgactgt

SEQ ID NO: 3671344 - DNA, 12 bp, Homo sapiens
tggagctgagca

SEQ ID NO: 3671345 - DNA, 18 bp, Homo sapiens
tggaggaagagggacaga

SEQ ID NO: 3671346 - DNA, 22 bp, Homo sapiens
tggaggagctcaggacactaat

SEQ ID NO: 3671347 - DNA, 12 bp, Homo sapiens
tggagggaagcc

SEQ ID NO: 3671348 - DNA, 11 bp, Homo sapiens
tggagggaggc

SEQ ID NO: 3671349 - DNA, 16 bp, Homo sapiens
tggagggaggccccag

SEQ ID NO: 3671350 - DNA, 18 bp, Homo sapiens
tggagggaggccccaggg

SEQ ID NO: 3671351 - DNA, 17 bp, Homo sapiens
tggaggttaaggctgag

SEQ ID NO: 3671352 - DNA, 19 bp, Homo sapiens
tggaggttaaggctgagga

SEQ ID NO: 3671353 - DNA, 22 bp, Homo sapiens
tggaggttaaggctgaggaaag

SEQ ID NO: 3671354 - DNA, 13 bp, Homo sapiens
tggagtacccagc

SEQ ID NO: 3671355 - DNA, 17 bp, Homo sapiens
tggagtacccagcctat

SEQ ID NO: 3671356 - DNA, 13 bp, Homo sapiens
tggagtcatcttg

SEQ ID NO: 3671357 - DNA, 13 bp, Homo sapiens
tggagtggccact

SEQ ID NO: 3671358 - DNA, 19 bp, Homo sapiens
tggagtgtatgactgcaca

SEQ ID NO: 3671359 - DNA, 17 bp, Homo sapiens
tggagttgatctggaac

SEQ ID NO: 3671360 - DNA, 22 bp, Homo sapiens
tggagttgatctggaacccaga

SEQ ID NO: 3671361 - DNA, 16 bp, Homo sapiens
tggatctccttgagat

SEQ ID NO: 3671362 - DNA, 20 bp, Homo sapiens
tggatgaaaaatatttctga

SEQ ID NO: 3671363 - DNA, 21 bp, Homo sapiens
tggatgaaaaatatttctgag

SEQ ID NO: 3671364 - DNA, 20 bp, Homo sapiens
tggatgactcggtctgagaa

SEQ ID NO: 3671365 - DNA, 20 bp, Homo sapiens
tggatgaggcttcttcctgg

SEQ ID NO: 3671366 - DNA, 17 bp, Homo sapiens
tggatggccccagcaca

SEQ ID NO: 3671367 - DNA, 21 bp, Homo sapiens
tggatggccccagcacagctt

SEQ ID NO: 3671368 - DNA, 21 bp, Homo sapiens
tggatgggacatttttgtctg

SEQ ID NO: 3671369 - DNA, 22 bp, Homo sapiens
tggatgggggaactcagatcca

SEQ ID NO: 3671370 - DNA, 22 bp, Homo sapiens
tggattccccatctcaggccag

SEQ ID NO: 3671371 - DNA, 21 bp, Homo sapiens
tggattgcacgtggcctcttg

SEQ ID NO: 3671372 - DNA, 15 bp, Homo sapiens
tggcaacagatctgg

SEQ ID NO: 3671373 - DNA, 18 bp, Homo sapiens
tggcaacagatctggaac

SEQ ID NO: 3671374 - DNA, 19 bp, Homo sapiens
tggcaatttcctggccctc

SEQ ID NO: 3671375 - DNA, 14 bp, Homo sapiens
tggcaccagacacc

SEQ ID NO: 3671376 - DNA, 17 bp, Homo sapiens
tggcaccagcagcctgg

SEQ ID NO: 3671377 - DNA, 14 bp, Homo sapiens
tggcactcgctgta

SEQ ID NO: 3671378 - DNA, 13 bp, Homo sapiens
tggcagatgagct

SEQ ID NO: 3671379 - DNA, 12 bp, Homo sapiens
tggcaggaaggc

SEQ ID NO: 3671380 - DNA, 15 bp, Homo sapiens
tggcaggaaggcttg

SEQ ID NO: 3671381 - DNA, 16 bp, Homo sapiens
tggcaggagtggggtg

SEQ ID NO: 3671382 - DNA, 18 bp, Homo sapiens
tggcaggctggccagtcc

SEQ ID NO: 3671383 - DNA, 12 bp, Homo sapiens
tggcagtggagg

SEQ ID NO: 3671384 - DNA, 23 bp, Homo sapiens
tggcagtgtggggagggcaggtc

SEQ ID NO: 3671385 - DNA, 20 bp, Homo sapiens
tggcatcagtttaggccttg

SEQ ID NO: 3671386 - DNA, 21 bp, Homo sapiens
tggcatcgcaccattctgact

SEQ ID NO: 3671387 - DNA, 20 bp, Homo sapiens
tggcatctttgccttgggct

SEQ ID NO: 3671388 - DNA, 13 bp, Homo sapiens
tggcatgagaaat

SEQ ID NO: 3671389 - DNA, 21 bp, Homo sapiens
tggcatgagaaatacaaaaat

SEQ ID NO: 3671390 - DNA, 20 bp, Homo sapiens
tggcatgttagcccttcctc

SEQ ID NO: 3671391 - DNA, 18 bp, Homo sapiens
tggccaaggagctgctat

SEQ ID NO: 3671392 - DNA, 18 bp, Homo sapiens
tggccactaagcagagga

SEQ ID NO: 3671393 - DNA, 18 bp, Homo sapiens
tggccactccgagaggtg

SEQ ID NO: 3671394 - DNA, 14 bp, Homo sapiens
tggccactgagctg

SEQ ID NO: 3671395 - DNA, 15 bp, Homo sapiens
tggccactgagctgg

SEQ ID NO: 3671396 - DNA, 19 bp, Homo sapiens
tggccactgagctggctga

SEQ ID NO: 3671397 - DNA, 20 bp, Homo sapiens
tggccactgagctggctgac

SEQ ID NO: 3671398 - DNA, 15 bp, Homo sapiens
tggccagcctggcat

SEQ ID NO: 3671399 - DNA, 13 bp, Homo sapiens
tggccaggaagct

SEQ ID NO: 3671400 - DNA, 16 bp, Homo sapiens
tggccaggcagatctg

SEQ ID NO: 3671401 - DNA, 20 bp, Homo sapiens
tggccaggcagatctgtgcc

SEQ ID NO: 3671402 - DNA, 17 bp, Homo sapiens
tggcccaaggctggcag

SEQ ID NO: 3671403 - DNA, 18 bp, Homo sapiens
tggcccaaggctggcagg

SEQ ID NO: 3671404 - DNA, 14 bp, Homo sapiens
tggcccactgcatc

SEQ ID NO: 3671405 - DNA, 17 bp, Homo sapiens
tggcccaggaccatcat

SEQ ID NO: 3671406 - DNA, 18 bp, Homo sapiens
tggcccagggcccagagc

SEQ ID NO: 3671407 - DNA, 22 bp, Homo sapiens
tggcccagggcccagagcccag

SEQ ID NO: 3671408 - DNA, 15 bp, Homo sapiens
tggccccgtttctgg

SEQ ID NO: 3671409 - DNA, 16 bp, Homo sapiens
tggccccgtttctggt

SEQ ID NO: 3671410 - DNA, 23 bp, Homo sapiens
tggcccctactttgtggcaatct

SEQ ID NO: 3671411 - DNA, 23 bp, Homo sapiens
tggcccctcatggcgggactgga

SEQ ID NO: 3671412 - DNA, 15 bp, Homo sapiens
tggccctccactcct

SEQ ID NO: 3671413 - DNA, 12 bp, Homo sapiens
tggccctgggcg

SEQ ID NO: 3671414 - DNA, 21 bp, Homo sapiens
tggccctgggcggggcgtggg

SEQ ID NO: 3671415 - DNA, 19 bp, Homo sapiens
tggccgagggtcctggctc

SEQ ID NO: 3671416 - DNA, 20 bp, Homo sapiens
tggccgagggtcctggctcc

SEQ ID NO: 3671417 - DNA, 16 bp, Homo sapiens
tggccggctctggtgg

SEQ ID NO: 3671418 - DNA, 17 bp, Homo sapiens
tggcctcagaattcaca

SEQ ID NO: 3671419 - DNA, 18 bp, Homo sapiens
tggcctcatgtggctgga

SEQ ID NO: 3671420 - DNA, 20 bp, Homo sapiens
tggcctcccctgccaccagg

SEQ ID NO: 3671421 - DNA, 23 bp, Homo sapiens
tggcctcccctgccaccaggcca

SEQ ID NO: 3671422 - DNA, 18 bp, Homo sapiens
tggcctgcataggctcct

SEQ ID NO: 3671423 - DNA, 15 bp, Homo sapiens
tggcctgctgcgccc

SEQ ID NO: 3671424 - DNA, 16 bp, Homo sapiens
tggcctgtctcatccc

SEQ ID NO: 3671425 - DNA, 12 bp, Homo sapiens
tggcctgtggct

SEQ ID NO: 3671426 - DNA, 17 bp, Homo sapiens
tggcgccgtctccaggg

SEQ ID NO: 3671427 - DNA, 13 bp, Homo sapiens
tggcgcttagaga

SEQ ID NO: 3671428 - DNA, 18 bp, Homo sapiens
tggcgtgggagccagcct

SEQ ID NO: 3671429 - DNA, 19 bp, Homo sapiens
tggctagaggccagcccca

SEQ ID NO: 3671430 - DNA, 21 bp, Homo sapiens
tggctagaggccagccccacc

SEQ ID NO: 3671431 - DNA, 18 bp, Homo sapiens
tggctagagtcctcactc

SEQ ID NO: 3671432 - DNA, 15 bp, Homo sapiens
tggctagtcaagctc

SEQ ID NO: 3671433 - DNA, 22 bp, Homo sapiens
tggctagtcaagctcctcctcc

SEQ ID NO: 3671434 - DNA, 20 bp, Homo sapiens
tggctcccatgaccatactg

SEQ ID NO: 3671435 - DNA, 18 bp, Homo sapiens
tggctccggcctctgcct

SEQ ID NO: 3671436 - DNA, 12 bp, Homo sapiens
tggctcctctca

SEQ ID NO: 3671437 - DNA, 13 bp, Homo sapiens
tggctcctctcag

SEQ ID NO: 3671438 - DNA, 14 bp, Homo sapiens
tggctcctctcagt

SEQ ID NO: 3671439 - DNA, 21 bp, Homo sapiens
tggctcgaatctctgtgcctt

SEQ ID NO: 3671440 - DNA, 19 bp, Homo sapiens
tggctctgagcgcctccat

SEQ ID NO: 3671441 - DNA, 12 bp, Homo sapiens
tggctctgggtg

SEQ ID NO: 3671442 - DNA, 13 bp, Homo sapiens
tggctctgggtgg

SEQ ID NO: 3671443 - DNA, 19 bp, Homo sapiens
tggctctgggtgggcgggg

SEQ ID NO: 3671444 - DNA, 19 bp, Homo sapiens
tggctctgggtgggcgtgg

SEQ ID NO: 3671445 - DNA, 16 bp, Homo sapiens
tggctgaaattctcct

SEQ ID NO: 3671446 - DNA, 18 bp, Homo sapiens
tggctgaaattctcctgg

SEQ ID NO: 3671447 - DNA, 19 bp, Homo sapiens
tggctgaaattctcctgga

SEQ ID NO: 3671448 - DNA, 20 bp, Homo sapiens
tggctgaaattctcctggag

SEQ ID NO: 3671449 - DNA, 20 bp, Homo sapiens
tggctgaagacttttgttat

SEQ ID NO: 3671450 - DNA, 11 bp, Homo sapiens
tggctgggctg

SEQ ID NO: 3671451 - DNA, 13 bp, Homo sapiens
tggctgggctgct

SEQ ID NO: 3671452 - DNA, 15 bp, Homo sapiens
tggctggtccagggc

SEQ ID NO: 3671453 - DNA, 22 bp, Homo sapiens
tggctgtaatcatttgtttaca

SEQ ID NO: 3671454 - DNA, 20 bp, Homo sapiens
tgctccagctgttcagctgg

SEQ ID NO: 3671455 - DNA, 22 bp, Homo sapiens
tgctccatttcaattgctttgt

SEQ ID NO: 3671456 - DNA, 19 bp, Homo sapiens
tgctccctcccctgccctg

SEQ ID NO: 3671457 - DNA, 24 bp, Homo sapiens
tgctcctagagggaggggcctagg

SEQ ID NO: 3671458 - DNA, 13 bp, Homo sapiens
tgctcctgaatga

SEQ ID NO: 3671459 - DNA, 18 bp, Homo sapiens
tgctctgtctcccaggct

SEQ ID NO: 3671460 - DNA, 12 bp, Homo sapiens
tgctctttctct

SEQ ID NO: 3671461 - DNA, 15 bp, Homo sapiens
tgctctttctctgcc

SEQ ID NO: 3671462 - DNA, 22 bp, Homo sapiens
tgctctttctctgccagtgaca

SEQ ID NO: 3671463 - DNA, 15 bp, Homo sapiens
tgctgacagctgctc

SEQ ID NO: 3671464 - DNA, 16 bp, Homo sapiens
tgctgactgttttctc

SEQ ID NO: 3671465 - DNA, 21 bp, Homo sapiens
tgctgactgttttctcttgag

SEQ ID NO: 3671466 - DNA, 19 bp, Homo sapiens
tgctgagatacatacagaa

SEQ ID NO: 3671467 - DNA, 16 bp, Homo sapiens
tgctgagctgcccctg

SEQ ID NO: 3671468 - DNA, 17 bp, Homo sapiens
tgctgagctgcccctgc

SEQ ID NO: 3671469 - DNA, 22 bp, Homo sapiens
tgctgagctgcccctgctgctt

SEQ ID NO: 3671470 - DNA, 17 bp, Homo sapiens
tgctgagtgaaggaaat

SEQ ID NO: 3671471 - DNA, 19 bp, Homo sapiens
tgctgcctctttccctagg

SEQ ID NO: 3671472 - DNA, 13 bp, Homo sapiens
tgctgcgccccag

SEQ ID NO: 3671473 - DNA, 16 bp, Homo sapiens
tgctgctggtgcacag

SEQ ID NO: 3671474 - DNA, 18 bp, Homo sapiens
tgctgctggtgcacagcc

SEQ ID NO: 3671475 - DNA, 19 bp, Homo sapiens
tgctgcttaagtgcatgca

SEQ ID NO: 3671476 - DNA, 12 bp, Homo sapiens
tgctgcttgagg

SEQ ID NO: 3671477 - DNA, 18 bp, Homo sapiens
tgctggagtacccagcct

SEQ ID NO: 3671478 - DNA, 19 bp, Homo sapiens
tgctggagtacccagccta

SEQ ID NO: 3671479 - DNA, 12 bp, Homo sapiens
tgctggcccagg

SEQ ID NO: 3671480 - DNA, 13 bp, Homo sapiens
tgctggcccaggg

SEQ ID NO: 3671481 - DNA, 17 bp, Homo sapiens
tgctggcccagggccca

SEQ ID NO: 3671482 - DNA, 18 bp, Homo sapiens
tgctgggaagcccggact

SEQ ID NO: 3671483 - DNA, 19 bp, Homo sapiens
tgctgggaagcccggactg

SEQ ID NO: 3671484 - DNA, 16 bp, Homo sapiens
tgctgggactcagcct

SEQ ID NO: 3671485 - DNA, 23 bp, Homo sapiens
tgctgggactcagccttcagaca

SEQ ID NO: 3671486 - DNA, 16 bp, Homo sapiens
tgctgggagctccact

SEQ ID NO: 3671487 - DNA, 20 bp, Homo sapiens
tgctgggagctccactctgc

SEQ ID NO: 3671488 - DNA, 23 bp, Homo sapiens
tgctgggagctccactctgcttc

SEQ ID NO: 3671489 - DNA, 17 bp, Homo sapiens
tgctgggcttgtctgta

SEQ ID NO: 3671490 - DNA, 21 bp, Homo sapiens
tgctgggtggttctctgggcc

SEQ ID NO: 3671491 - DNA, 13 bp, Homo sapiens
tgctggtccgtgg

SEQ ID NO: 3671492 - DNA, 20 bp, Homo sapiens
tgctggtctcatttgggggc

SEQ ID NO: 3671493 - DNA, 16 bp, Homo sapiens
tgctgtcatggtcctt

SEQ ID NO: 3671494 - DNA, 23 bp, Homo sapiens
tgctgtcatggtcctttctggaa

SEQ ID NO: 3671495 - DNA, 12 bp, Homo sapiens
tgctgtgaggct

SEQ ID NO: 3671496 - DNA, 17 bp, Homo sapiens
tgctgtgaggctgtcct

SEQ ID NO: 3671497 - DNA, 19 bp, Homo sapiens
tgctgtgaggctgtcctgt

SEQ ID NO: 3671498 - DNA, 19 bp, Homo sapiens
tgctgtggagctccactgc

SEQ ID NO: 3671499 - DNA, 23 bp, Homo sapiens
tgctgtggagctccactgccatg

SEQ ID NO: 3671500 - DNA, 19 bp, Homo sapiens
tgctgtgtatatggtatat

SEQ ID NO: 3671501 - DNA, 23 bp, Homo sapiens
tgctgtgtatatggtatatatac

SEQ ID NO: 3671502 - DNA, 11 bp, Homo sapiens
tgctgtgtgcc

SEQ ID NO: 3671503 - DNA, 15 bp, Homo sapiens
tgctgttgacatatt

SEQ ID NO: 3671504 - DNA, 15 bp, Homo sapiens
tgctgttttcctccc

SEQ ID NO: 3671505 - DNA, 17 bp, Homo sapiens
tgcttaataaaagaaca

SEQ ID NO: 3671506 - DNA, 23 bp, Homo sapiens
tgcttaataaaagaacatgcttg

SEQ ID NO: 3671507 - DNA, 19 bp, Homo sapiens
tgcttatttcatctgttct

SEQ ID NO: 3671508 - DNA, 23 bp, Homo sapiens
tgcttatttgacaacgtttcagc

SEQ ID NO: 3671509 - DNA, 13 bp, Homo sapiens
tgcttcaaactga

SEQ ID NO: 3671510 - DNA, 13 bp, Homo sapiens
tgcttccctgcag

SEQ ID NO: 3671511 - DNA, 14 bp, Homo sapiens
tgcttccctgcagc

SEQ ID NO: 3671512 - DNA, 15 bp, Homo sapiens
tgcttccctgcagct

SEQ ID NO: 3671513 - DNA, 16 bp, Homo sapiens
tgcttccctgcagctg

SEQ ID NO: 3671514 - DNA, 15 bp, Homo sapiens
tgcttcctcccaaca

SEQ ID NO: 3671515 - DNA, 23 bp, Homo sapiens
tgcttcctcccaacaagcagctg

SEQ ID NO: 3671516 - DNA, 18 bp, Homo sapiens
tgcttctatttatagaat

SEQ ID NO: 3671517 - DNA, 13 bp, Homo sapiens
tgcttctctgact

SEQ ID NO: 3671518 - DNA, 17 bp, Homo sapiens
tgcttctctgacttctg

SEQ ID NO: 3671519 - DNA, 22 bp, Homo sapiens
tgcttctctgacttctgcctgg

SEQ ID NO: 3671520 - DNA, 15 bp, Homo sapiens
tgcttgagctcagga

SEQ ID NO: 3671521 - DNA, 18 bp, Homo sapiens
tgcttgatagaaatgcca

SEQ ID NO: 3671522 - DNA, 19 bp, Homo sapiens
tgcttgatgggattctgga

SEQ ID NO: 3671523 - DNA, 18 bp, Homo sapiens
tgcttgcctgcagggcca

SEQ ID NO: 3671524 - DNA, 23 bp, Homo sapiens
tgcttgtaggtatgtctgtgcca

SEQ ID NO: 3671525 - DNA, 23 bp, Homo sapiens
tgcttgtttgctcacctggggtg

SEQ ID NO: 3671526 - DNA, 21 bp, Homo sapiens
tgctttgaaacagaaaaatat

SEQ ID NO: 3671527 - DNA, 13 bp, Homo sapiens
tgctttgccaaaa

SEQ ID NO: 3671528 - DNA, 20 bp, Homo sapiens
tgctttgccaaaataccaga

SEQ ID NO: 3671529 - DNA, 13 bp, Homo sapiens
tgctttggaaatc

SEQ ID NO: 3671530 - DNA, 22 bp, Homo sapiens
tgctttggacctaaatggcctc

SEQ ID NO: 3671531 - DNA, 22 bp, Homo sapiens
tgcttttccttggggcaggcag

SEQ ID NO: 3671532 - DNA, 17 bp, Homo sapiens
tgcttttttgttttggc

SEQ ID NO: 3671533 - DNA, 17 bp, Homo sapiens
tggaaaaatagcctgcc

SEQ ID NO: 3671534 - DNA, 15 bp, Homo sapiens
tggaaaatcagtgac

SEQ ID NO: 3671535 - DNA, 13 bp, Homo sapiens
tggaaaatgcttc

SEQ ID NO: 3671536 - DNA, 19 bp, Homo sapiens
tggaaaatgcttcttggct

SEQ ID NO: 3671537 - DNA, 21 bp, Homo sapiens
tggaaactggatgaggtcata

SEQ ID NO: 3671538 - DNA, 20 bp, Homo sapiens
tggaacactagacaagccag

SEQ ID NO: 3671539 - DNA, 21 bp, Homo sapiens
tggaacactagacaagccaga

SEQ ID NO: 3671540 - DNA, 17 bp, Homo sapiens
tggaacccagactcaga

SEQ ID NO: 3671541 - DNA, 23 bp, Homo sapiens
tggaaccgcaggaagctgctccg

SEQ ID NO: 3671542 - DNA, 15 bp, Homo sapiens
tggaacctcagcctg

SEQ ID NO: 3671543 - DNA, 16 bp, Homo sapiens
tggaacctcagcctgg

SEQ ID NO: 3671544 - DNA, 18 bp, Homo sapiens
tggaacctcagcctggcc

SEQ ID NO: 3671545 - DNA, 21 bp, Homo sapiens
tggaagacacttgctgagtga

SEQ ID NO: 3671546 - DNA, 18 bp, Homo sapiens
tggaagacagagaaaact

SEQ ID NO: 3671547 - DNA, 15 bp, Homo sapiens
tggaagaggaaaagg

SEQ ID NO: 3671548 - DNA, 15 bp, Homo sapiens
tggaagtctgtctca

SEQ ID NO: 3671549 - DNA, 18 bp, Homo sapiens
tggaagtgggccagtcct

SEQ ID NO: 3671550 - DNA, 21 bp, Homo sapiens
tggaatcaggaatattttcca

SEQ ID NO: 3671551 - DNA, 21 bp, Homo sapiens
tggaatgcatggggcgggtcc

SEQ ID NO: 3671552 - DNA, 12 bp, Homo sapiens
tggacagcccca

SEQ ID NO: 3671553 - DNA, 21 bp, Homo sapiens
tggacagcctcttctgtccca

SEQ ID NO: 3671554 - DNA, 20 bp, Homo sapiens
tggacagtgctgttgaagat

SEQ ID NO: 3671555 - DNA, 21 bp, Homo sapiens
tggacagtgctgttgaagatt

SEQ ID NO: 3671556 - DNA, 20 bp, Homo sapiens
tggacatcctcctcccaccc

SEQ ID NO: 3671557 - DNA, 14 bp, Homo sapiens
tggaccccagcctt

SEQ ID NO: 3671558 - DNA, 22 bp, Homo sapiens
tggaccccagccttggtggggg

SEQ ID NO: 3671559 - DNA, 23 bp, Homo sapiens
tggaccctgtggatgataaaaca

SEQ ID NO: 3671560 - DNA, 21 bp, Homo sapiens
tggacggggcgggccctgcct

SEQ ID NO: 3671561 - DNA, 22 bp, Homo sapiens
tggacggggcgggccctgcctg

SEQ ID NO: 3671562 - DNA, 14 bp, Homo sapiens
tggactatctgtct

SEQ ID NO: 3671563 - DNA, 15 bp, Homo sapiens
tggactatctgtctg

SEQ ID NO: 3671564 - DNA, 20 bp, Homo sapiens
tggactatctgtctggtggc

SEQ ID NO: 3671565 - DNA, 14 bp, Homo sapiens
tggactggttttca

SEQ ID NO: 3671566 - DNA, 14 bp, Homo sapiens
tggacttcaaagca

SEQ ID NO: 3671567 - DNA, 19 bp, Homo sapiens
tggacttcaaagcaagctg

SEQ ID NO: 3671568 - DNA, 21 bp, Homo sapiens
tggagaaggtattagcaaagc

SEQ ID NO: 3671569 - DNA, 14 bp, Homo sapiens
tggagagctggtgc

SEQ ID NO: 3671570 - DNA, 18 bp, Homo sapiens
tggagaggccctctggag

SEQ ID NO: 3671571 - DNA, 21 bp, Homo sapiens
tcccctccctggctcccatga

SEQ ID NO: 3671572 - DNA, 17 bp, Homo sapiens
tcccctcgtcccatcca

SEQ ID NO: 3671573 - DNA, 20 bp, Homo sapiens
tcccctcgtcccatccagct

SEQ ID NO: 3671574 - DNA, 16 bp, Homo sapiens
tcccctgccaccaggc

SEQ ID NO: 3671575 - DNA, 19 bp, Homo sapiens
tcccctgccaccaggccac

SEQ ID NO: 3671576 - DNA, 13 bp, Homo sapiens
tcccctgccctgg

SEQ ID NO: 3671577 - DNA, 15 bp, Homo sapiens
tcccctgccctggtc

SEQ ID NO: 3671578 - DNA, 17 bp, Homo sapiens
tcccctgccctggtcca

SEQ ID NO: 3671579 - DNA, 24 bp, Homo sapiens
tcccctgccctggtccagggaagc

SEQ ID NO: 3671580 - DNA, 16 bp, Homo sapiens
tcccctggacagaggc

SEQ ID NO: 3671581 - DNA, 17 bp, Homo sapiens
tcccctggacagaggcg

SEQ ID NO: 3671582 - DNA, 18 bp, Homo sapiens
tccccttgaactcttcac

SEQ ID NO: 3671583 - DNA, 23 bp, Homo sapiens
tccccttgatttaaacacacaga

SEQ ID NO: 3671584 - DNA, 17 bp, Homo sapiens
tccccttttattgctgc

SEQ ID NO: 3671585 - DNA, 13 bp, Homo sapiens
tcccgtccctccc

SEQ ID NO: 3671586 - DNA, 22 bp, Homo sapiens
tccctaaggcatgtgtgaaaca

SEQ ID NO: 3671587 - DNA, 18 bp, Homo sapiens
tccctaccacctccccag

SEQ ID NO: 3671588 - DNA, 13 bp, Homo sapiens
tccctacctcagg

SEQ ID NO: 3671589 - DNA, 15 bp, Homo sapiens
tccctagcagcccac

SEQ ID NO: 3671590 - DNA, 14 bp, Homo sapiens
tccctatactgctt

SEQ ID NO: 3671591 - DNA, 18 bp, Homo sapiens
tccctattagagaagaga

SEQ ID NO: 3671592 - DNA, 20 bp, Homo sapiens
tccctcaccttggcaccaga

SEQ ID NO: 3671593 - DNA, 14 bp, Homo sapiens
tccctcccccccat

SEQ ID NO: 3671594 - DNA, 13 bp, Homo sapiens
tccctcccctgcc

SEQ ID NO: 3671595 - DNA, 19 bp, Homo sapiens
tccctcccctgccctggtc

SEQ ID NO: 3671596 - DNA, 21 bp, Homo sapiens
tccctctctcttctgctccac

SEQ ID NO: 3671597 - DNA, 14 bp, Homo sapiens
tccctctgccccgc

SEQ ID NO: 3671598 - DNA, 14 bp, Homo sapiens
tccctgagggcgga

SEQ ID NO: 3671599 - DNA, 11 bp, Homo sapiens
tccctgcagct

SEQ ID NO: 3671600 - DNA, 18 bp, Homo sapiens
tccctgcatctgaccagc

SEQ ID NO: 3671601 - DNA, 19 bp, Homo sapiens
tccctgccaagtctcagaa

SEQ ID NO: 3671602 - DNA, 22 bp, Homo sapiens
tccctgccaagtctcagaagag

SEQ ID NO: 3671603 - DNA, 13 bp, Homo sapiens
tccctgccagctc

SEQ ID NO: 3671604 - DNA, 18 bp, Homo sapiens
tccctgccctcgggtctc

SEQ ID NO: 3671605 - DNA, 17 bp, Homo sapiens
tccctgcgcctgtgatg

SEQ ID NO: 3671606 - DNA, 17 bp, Homo sapiens
tcctgtattcagacaga

SEQ ID NO: 3671607 - DNA, 17 bp, Homo sapiens
tcctgtccagctccaac

SEQ ID NO: 3671608 - DNA, 16 bp, Homo sapiens
tcctgtgaatgccact

SEQ ID NO: 3671609 - DNA, 20 bp, Homo sapiens
tcctgtggtagtcctcccaa

SEQ ID NO: 3671610 - DNA, 22 bp, Homo sapiens
tcctgtggtagtcctcccaagc

SEQ ID NO: 3671611 - DNA, 23 bp, Homo sapiens
tcctgtggtagtcctcccaagct

SEQ ID NO: 3671612 - DNA, 19 bp, Homo sapiens
tcctgtgtgattgacagct

SEQ ID NO: 3671613 - DNA, 18 bp, Homo sapiens
tcctgttcagtaataaaa

SEQ ID NO: 3671614 - DNA, 18 bp, Homo sapiens
tccttaaagagtgtggca

SEQ ID NO: 3671615 - DNA, 18 bp, Homo sapiens
tccttagataccttgaaa

SEQ ID NO: 3671616 - DNA, 17 bp, Homo sapiens
tccttaggagtggggtt

SEQ ID NO: 3671617 - DNA, 21 bp, Homo sapiens
tccttccaacaggagctggga

SEQ ID NO: 3671618 - DNA, 16 bp, Homo sapiens
tccttccatccctacc

SEQ ID NO: 3671619 - DNA, 13 bp, Homo sapiens
tccttcctgtggg

SEQ ID NO: 3671620 - DNA, 23 bp, Homo sapiens
tccttcctgtgggtggggcttct

SEQ ID NO: 3671621 - DNA, 14 bp, Homo sapiens
tccttgctttctct

SEQ ID NO: 3671622 - DNA, 18 bp, Homo sapiens
tccttggcctttcctgga

SEQ ID NO: 3671623 - DNA, 19 bp, Homo sapiens
tccttggcctttcctggaa

SEQ ID NO: 3671624 - DNA, 17 bp, Homo sapiens
tccttggggcaggcagt

SEQ ID NO: 3671625 - DNA, 14 bp, Homo sapiens
tccttgttgttggt

SEQ ID NO: 3671626 - DNA, 14 bp, Homo sapiens
tcctttacgtgttt

SEQ ID NO: 3671627 - DNA, 20 bp, Homo sapiens
tcctttctagagcactgcca

SEQ ID NO: 3671628 - DNA, 19 bp, Homo sapiens
tcgatactgcgactttctg

SEQ ID NO: 3671629 - DNA, 20 bp, Homo sapiens
tcgatactgcgactttctgc

SEQ ID NO: 3671630 - DNA, 13 bp, Homo sapiens
tcgcaagctgggt

SEQ ID NO: 3671631 - DNA, 17 bp, Homo sapiens
tcgcaccattctgactc

SEQ ID NO: 3671632 - DNA, 12 bp, Homo sapiens
tcgcagaggcaa

SEQ ID NO: 3671633 - DNA, 11 bp, Homo sapiens
tcgcctgacaa

SEQ ID NO: 3671634 - DNA, 23 bp, Homo sapiens
tcgctgtgtcagcatagaagtaa

SEQ ID NO: 3671635 - DNA, 14 bp, Homo sapiens
tcgcttcttgcctc

SEQ ID NO: 3671636 - DNA, 21 bp, Homo sapiens
tcgcttcttgcctctgtgctg

SEQ ID NO: 3671637 - DNA, 23 bp, Homo sapiens
tcggatagttgctatttttgtaa

SEQ ID NO: 3671638 - DNA, 18 bp, Homo sapiens
tcggcgtggcccaaggct

SEQ ID NO: 3671639 - DNA, 18 bp, Homo sapiens
tcggctggggactgctac

SEQ ID NO: 3671640 - DNA, 19 bp, Homo sapiens
tcggctggggactgctacc

SEQ ID NO: 3671641 - DNA, 20 bp, Homo sapiens
tcggctggggactgctacct

SEQ ID NO: 3671642 - DNA, 18 bp, Homo sapiens
tcgggaggtttggggggc

SEQ ID NO: 3671643 - DNA, 19 bp, Homo sapiens
tcgggtccccaacccgtgc

SEQ ID NO: 3671644 - DNA, 14 bp, Homo sapiens
tcgtcccatccagc

SEQ ID NO: 3671645 - DNA, 15 bp, Homo sapiens
tcgtctttcccatgg

SEQ ID NO: 3671646 - DNA, 16 bp, Homo sapiens
tcgtgaactgcagtga

SEQ ID NO: 3671647 - DNA, 13 bp, Homo sapiens
tcgtgatggggca

SEQ ID NO: 3671648 - DNA, 12 bp, Homo sapiens
tcgtggctgtca

SEQ ID NO: 3671649 - DNA, 21 bp, Homo sapiens
tctaaaccatatgaacatata

SEQ ID NO: 3671650 - DNA, 17 bp, Homo sapiens
tctaaagttatatttca

SEQ ID NO: 3671651 - DNA, 18 bp, Homo sapiens
tctaacaataatatttca

SEQ ID NO: 3671652 - DNA, 19 bp, Homo sapiens
tctaacaataatatttcaa

SEQ ID NO: 3671653 - DNA, 20 bp, Homo sapiens
tctaacaataatatttcaag

SEQ ID NO: 3671654 - DNA, 13 bp, Homo sapiens
tctaactggacag

SEQ ID NO: 3671655 - DNA, 16 bp, Homo sapiens
tctaactggacagcct

SEQ ID NO: 3671656 - DNA, 22 bp, Homo sapiens
tctaactggacagcctcttctg

SEQ ID NO: 3671657 - DNA, 16 bp, Homo sapiens
tctaagcctgaagggg

SEQ ID NO: 3671658 - DNA, 12 bp, Homo sapiens
tctaatagtctt

SEQ ID NO: 3671659 - DNA, 22 bp, Homo sapiens
tctaatgaggagagaaaatata

SEQ ID NO: 3671660 - DNA, 23 bp, Homo sapiens
tctaattaaccttactaattata

SEQ ID NO: 3671661 - DNA, 16 bp, Homo sapiens
tctaattgctgtgtgt

SEQ ID NO: 3671662 - DNA, 21 bp, Homo sapiens
tctacatgtaactatttcttc

SEQ ID NO: 3671663 - DNA, 16 bp, Homo sapiens
tctacatttctgcaga

SEQ ID NO: 3671664 - DNA, 20 bp, Homo sapiens
tctacatttctgcagatctt

SEQ ID NO: 3671665 - DNA, 15 bp, Homo sapiens
tctaccctcccaccc

SEQ ID NO: 3671666 - DNA, 20 bp, Homo sapiens
tctacctgcaggcggggctc

SEQ ID NO: 3671667 - DNA, 21 bp, Homo sapiens
tctacctgcaggcggggctcc

SEQ ID NO: 3671668 - DNA, 12 bp, Homo sapiens
tctacgtttctt

SEQ ID NO: 3671669 - DNA, 16 bp, Homo sapiens
tctactttgattctga

SEQ ID NO: 3671670 - DNA, 17 bp, Homo sapiens
tctactttgattctgat

SEQ ID NO: 3671671 - DNA, 21 bp, Homo sapiens
tctagaacatccctgccagct

SEQ ID NO: 3671672 - DNA, 14 bp, Homo sapiens
tctagagcactgcc

SEQ ID NO: 3671673 - DNA, 15 bp, Homo sapiens
tctagagcactgcca

SEQ ID NO: 3671674 - DNA, 22 bp, Homo sapiens
tctagggaaaaaccagcgtgtg

SEQ ID NO: 3671675 - DNA, 14 bp, Homo sapiens
tctatgcttcctcg

SEQ ID NO: 3671676 - DNA, 13 bp, Homo sapiens
tctatgtatgtta

SEQ ID NO: 3671677 - DNA, 23 bp, Homo sapiens
tctatgtatgttaatttatttag

SEQ ID NO: 3671678 - DNA, 13 bp, Homo sapiens
tctatgtgtatgt

SEQ ID NO: 3671679 - DNA, 21 bp, Homo sapiens
tctattcccatcgctggaaaa

SEQ ID NO: 3671680 - DNA, 12 bp, Homo sapiens
tctattttaaga

SEQ ID NO: 3671681 - DNA, 14 bp, Homo sapiens
tctcaagtaatata

SEQ ID NO: 3671682 - DNA, 16 bp, Homo sapiens
tctcaatgaagccagc

SEQ ID NO: 3671683 - DNA, 12 bp, Homo sapiens
tctcacagtggg

SEQ ID NO: 3671684 - DNA, 21 bp, Homo sapiens
tctcacagtgggagccagggc

SEQ ID NO: 3671685 - DNA, 23 bp, Homo sapiens
tctcacagtgggagccagggctg

SEQ ID NO: 3671686 - DNA, 23 bp, Homo sapiens
tctcacccatgcaagcagaggac

SEQ ID NO: 3671687 - DNA, 14 bp, Homo sapiens
tctcacctcctgct

SEQ ID NO: 3671688 - DNA, 17 bp, Homo sapiens
tctcacctcctgctggg

SEQ ID NO: 3671689 - DNA, 20 bp, Homo sapiens
tctcactgccatgccagctt

SEQ ID NO: 3671690 - DNA, 20 bp, Homo sapiens
tctcagaaccttgtcccagc

SEQ ID NO: 3671691 - DNA, 19 bp, Homo sapiens
tgactgccctgtttctgtt

SEQ ID NO: 3671692 - DNA, 19 bp, Homo sapiens
tgacttaagcaaaagaaaa

SEQ ID NO: 3671693 - DNA, 13 bp, Homo sapiens
tgacttaatgtga

SEQ ID NO: 3671694 - DNA, 15 bp, Homo sapiens
tgacttctgcctgga

SEQ ID NO: 3671695 - DNA, 14 bp, Homo sapiens
tgacttcttcttct

SEQ ID NO: 3671696 - DNA, 17 bp, Homo sapiens
tgacttgacagaacact

SEQ ID NO: 3671697 - DNA, 19 bp, Homo sapiens
tgacttgacagaacactgt

SEQ ID NO: 3671698 - DNA, 20 bp, Homo sapiens
tgactttagaaagctgacat

SEQ ID NO: 3671699 - DNA, 12 bp, Homo sapiens
tgagaaactcta

SEQ ID NO: 3671700 - DNA, 14 bp, Homo sapiens
tgagaaagccttct

SEQ ID NO: 3671701 - DNA, 15 bp, Homo sapiens
tgagaactgaatttt

SEQ ID NO: 3671702 - DNA, 22 bp, Homo sapiens
tgagaagccatgtactcaagta

SEQ ID NO: 3671703 - DNA, 21 bp, Homo sapiens
tgagaagtgaatgctgggact

SEQ ID NO: 3671704 - DNA, 17 bp, Homo sapiens
tgagacccccacacctc

SEQ ID NO: 3671705 - DNA, 12 bp, Homo sapiens
tgagaccctgtc

SEQ ID NO: 3671706 - DNA, 19 bp, Homo sapiens
tgagactacaagtgtgtgc

SEQ ID NO: 3671707 - DNA, 21 bp, Homo sapiens
tgagactcaaaggtgatgtaa

SEQ ID NO: 3671708 - DNA, 16 bp, Homo sapiens
tgagactcagtgcaga

SEQ ID NO: 3671709 - DNA, 22 bp, Homo sapiens
tgagagtgtcttcacggcagga

SEQ ID NO: 3671710 - DNA, 24 bp, Homo sapiens
tgagagtgtcttcacggcaggaca

SEQ ID NO: 3671711 - DNA, 15 bp, Homo sapiens
tgagatcagcctggg

SEQ ID NO: 3671712 - DNA, 17 bp, Homo sapiens
tgcaatggttaacatct

SEQ ID NO: 3671713 - DNA, 14 bp, Homo sapiens
tgcacaagctgcac

SEQ ID NO: 3671714 - DNA, 23 bp, Homo sapiens
tgcacactcagtgggctgtttct

SEQ ID NO: 3671715 - DNA, 24 bp, Homo sapiens
tgcacatcttggctatgtaattct

SEQ ID NO: 3671716 - DNA, 13 bp, Homo sapiens
tgcacatgtttcc

SEQ ID NO: 3671717 - DNA, 16 bp, Homo sapiens
tgcacatgtttcctct

SEQ ID NO: 3671718 - DNA, 22 bp, Homo sapiens
tgcacccacccaagacaagtga

SEQ ID NO: 3671719 - DNA, 19 bp, Homo sapiens
tgcaccccaaagctttcct

SEQ ID NO: 3671720 - DNA, 22 bp, Homo sapiens
tgcaccccaaagctttcctgcc

SEQ ID NO: 3671721 - DNA, 14 bp, Homo sapiens
tgcacccccctggg

SEQ ID NO: 3671722 - DNA, 16 bp, Homo sapiens
tgcacccccctgggct

SEQ ID NO: 3671723 - DNA, 17 bp, Homo sapiens
tgcaccctcaggcaggt

SEQ ID NO: 3671724 - DNA, 19 bp, Homo sapiens
tgcacgtggcctcttgagc

SEQ ID NO: 3671725 - DNA, 22 bp, Homo sapiens
tgcacgtggcctcttgagcagt

SEQ ID NO: 3671726 - DNA, 14 bp, Homo sapiens
tgcactactgacat

SEQ ID NO: 3671727 - DNA, 15 bp, Homo sapiens
tgcactactgacatg

SEQ ID NO: 3671728 - DNA, 18 bp, Homo sapiens
tgcactactgacatgtgg

SEQ ID NO: 3671729 - DNA, 15 bp, Homo sapiens
tgcactatctttcag

SEQ ID NO: 3671730 - DNA, 14 bp, Homo sapiens
tgcactccagcctg

SEQ ID NO: 3671731 - DNA, 15 bp, Homo sapiens
tgcactccagcctgg

SEQ ID NO: 3671732 - DNA, 14 bp, Homo sapiens
tgcactttgtaaat

SEQ ID NO: 3671733 - DNA, 20 bp, Homo sapiens
tgcagaatgtaagtgggccc

SEQ ID NO: 3671734 - DNA, 21 bp, Homo sapiens
tgcagaatgtaagtgggccca

SEQ ID NO: 3671735 - DNA, 23 bp, Homo sapiens
tgcagaccacgcccgtcctgcct

SEQ ID NO: 3671736 - DNA, 14 bp, Homo sapiens
tgcagaggccagag

SEQ ID NO: 3671737 - DNA, 16 bp, Homo sapiens
tgcagaggggaaagac

SEQ ID NO: 3671738 - DNA, 18 bp, Homo sapiens
tgcagaggggaaagactt

SEQ ID NO: 3671739 - DNA, 18 bp, Homo sapiens
tgcagaggtaccctgggt

SEQ ID NO: 3671740 - DNA, 17 bp, Homo sapiens
tgcagataactttgact

SEQ ID NO: 3671741 - DNA, 17 bp, Homo sapiens
tgcagcaccgaggggcc

SEQ ID NO: 3671742 - DNA, 20 bp, Homo sapiens
tgcagcaccgaggggccttt

SEQ ID NO: 3671743 - DNA, 21 bp, Homo sapiens
tgcagcaccgaggggcctttg

SEQ ID NO: 3671744 - DNA, 13 bp, Homo sapiens
tgcagcagaggac

SEQ ID NO: 3671745 - DNA, 15 bp, Homo sapiens
tgcagcagaggacag

SEQ ID NO: 3671746 - DNA, 16 bp, Homo sapiens
tgcagcagggatgccc

SEQ ID NO: 3671747 - DNA, 22 bp, Homo sapiens
tgcagcagggatgccctggagg

SEQ ID NO: 3671748 - DNA, 22 bp, Homo sapiens
tgcagcaggtggtaatgataaa

SEQ ID NO: 3671749 - DNA, 11 bp, Homo sapiens
tgcagccagct

SEQ ID NO: 3671750 - DNA, 21 bp, Homo sapiens
tgcagcccatgcccacctgcc

SEQ ID NO: 3671751 - DNA, 17 bp, Homo sapiens
tgcagccggcacagggt

SEQ ID NO: 3671752 - DNA, 20 bp, Homo sapiens
tgcagctcaagagatcccaa

SEQ ID NO: 3671753 - DNA, 20 bp, Homo sapiens
tgcagctgcccagcccctcc

SEQ ID NO: 3671754 - DNA, 22 bp, Homo sapiens
tgcaggaatcccggctccagag

SEQ ID NO: 3671755 - DNA, 15 bp, Homo sapiens
tgcaggacctcaggt

SEQ ID NO: 3671756 - DNA, 15 bp, Homo sapiens
tgcaggccctggcct

SEQ ID NO: 3671757 - DNA, 17 bp, Homo sapiens
tgcaggccctggcctcc

SEQ ID NO: 3671758 - DNA, 20 bp, Homo sapiens
tgcaggccctggcctcccct

SEQ ID NO: 3671759 - DNA, 17 bp, Homo sapiens
tgcaggcggggctcctc

SEQ ID NO: 3671760 - DNA, 20 bp, Homo sapiens
tgcaggcggggctcctcctg

SEQ ID NO: 3671761 - DNA, 21 bp, Homo sapiens
tgcaggcggggctcctcctga

SEQ ID NO: 3671762 - DNA, 23 bp, Homo sapiens
tgcaggcggggctcctcctgaag

SEQ ID NO: 3671763 - DNA, 10 bp, Homo sapiens
tgcagggcca

SEQ ID NO: 3671764 - DNA, 19 bp, Homo sapiens
tgcagggccatggctcagg

SEQ ID NO: 3671765 - DNA, 17 bp, Homo sapiens
tgcaggtggatctcctt

SEQ ID NO: 3671766 - DNA, 21 bp, Homo sapiens
tgcaggtggatctccttgaga

SEQ ID NO: 3671767 - DNA, 13 bp, Homo sapiens
tgcagtatatttc

SEQ ID NO: 3671768 - DNA, 14 bp, Homo sapiens
tgcagtatatttct

SEQ ID NO: 3671769 - DNA, 12 bp, Homo sapiens
tgcagtgctctt

SEQ ID NO: 3671770 - DNA, 19 bp, Homo sapiens
tgcagttcttgtggaagac

SEQ ID NO: 3671771 - DNA, 21 bp, Homo sapiens
tgcagttttggtttgatgtaa

SEQ ID NO: 3671772 - DNA, 19 bp, Homo sapiens
tgcataagaaatgtagctg

SEQ ID NO: 3671773 - DNA, 18 bp, Homo sapiens
tgcataagtgaaaatctt

SEQ ID NO: 3671774 - DNA, 18 bp, Homo sapiens
tgcatagaacaaaagatt

SEQ ID NO: 3671775 - DNA, 13 bp, Homo sapiens
tgcatccctgaga

SEQ ID NO: 3671776 - DNA, 14 bp, Homo sapiens
tgcatccctgagac

SEQ ID NO: 3671777 - DNA, 17 bp, Homo sapiens
tgcatcgtttcatcttc

SEQ ID NO: 3671778 - DNA, 15 bp, Homo sapiens
tgcatctgaccagca

SEQ ID NO: 3671779 - DNA, 17 bp, Homo sapiens
tgcatctgaccagcagc

SEQ ID NO: 3671780 - DNA, 22 bp, Homo sapiens
tgcatctgaccagcagcgcctt

SEQ ID NO: 3671781 - DNA, 16 bp, Homo sapiens
tgcatgcattgagctg

SEQ ID NO: 3671782 - DNA, 19 bp, Homo sapiens
tgcatgcattgagctgcct

SEQ ID NO: 3671783 - DNA, 18 bp, Homo sapiens
tgcatggggcgggtccta

SEQ ID NO: 3671784 - DNA, 17 bp, Homo sapiens
tgcatggtgccccagga

SEQ ID NO: 3671785 - DNA, 13 bp, Homo sapiens
tgcatggtggcca

SEQ ID NO: 3671786 - DNA, 14 bp, Homo sapiens
tgcatgtcttttaa

SEQ ID NO: 3671787 - DNA, 14 bp, Homo sapiens
tgcattcttaacaa

SEQ ID NO: 3671788 - DNA, 12 bp, Homo sapiens
tgcatttcttgg

SEQ ID NO: 3671789 - DNA, 23 bp, Homo sapiens
tgcattttggagagtttcctgaa

SEQ ID NO: 3671790 - DNA, 11 bp, Homo sapiens
tgcatttttgt

SEQ ID NO: 3671791 - DNA, 14 bp, Homo sapiens
tgcatttttgtaaa

SEQ ID NO: 3671792 - DNA, 15 bp, Homo sapiens
tgcatttttgtaaat

SEQ ID NO: 3671793 - DNA, 20 bp, Homo sapiens
tgccaaaaaggatacataat

SEQ ID NO: 3671794 - DNA, 19 bp, Homo sapiens
tgccaaaataccagagcct

SEQ ID NO: 3671795 - DNA, 17 bp, Homo sapiens
tgccaaaattcatttct

SEQ ID NO: 3671796 - DNA, 19 bp, Homo sapiens
tgccaaaattcatttctaa

SEQ ID NO: 3671797 - DNA, 13 bp, Homo sapiens
tgccaaacagagt

SEQ ID NO: 3671798 - DNA, 21 bp, Homo sapiens
tgccaaagctagggtggccct

SEQ ID NO: 3671799 - DNA, 22 bp, Homo sapiens
tgccaaagctagggtggccctt

SEQ ID NO: 3671800 - DNA, 18 bp, Homo sapiens
tgccaaatatgtcctggg

SEQ ID NO: 3671801 - DNA, 23 bp, Homo sapiens
tgccaagctccaagccccatctt

SEQ ID NO: 3671802 - DNA, 20 bp, Homo sapiens
tgccaaggccagagtggcct

SEQ ID NO: 3671803 - DNA, 23 bp, Homo sapiens
tgccaatccttaaatatgtgaaa

SEQ ID NO: 3671804 - DNA, 21 bp, Homo sapiens
tgccaattatagtttgacagg

SEQ ID NO: 3671805 - DNA, 15 bp, Homo sapiens
tgccaattgctaccg

SEQ ID NO: 3671806 - DNA, 16 bp, Homo sapiens
tgccacaaggacttcc

SEQ ID NO: 3671807 - DNA, 22 bp, Homo sapiens
tgccacacaaggatagatgctg

SEQ ID NO: 3671808 - DNA, 13 bp, Homo sapiens
tgccaccaggaga

SEQ ID NO: 3671809 - DNA, 22 bp, Homo sapiens
tgccaccaggagaaccactaca

SEQ ID NO: 3671810 - DNA, 17 bp, Homo sapiens
tgccacccacctccctg

SEQ ID NO: 3671811 - DNA, 13 bp, Homo sapiens
tgccacccacctt

SEQ ID NO: 3671812 - DNA, 14 bp, Homo sapiens
tgccaccccttcct

SEQ ID NO: 3671813 - DNA, 16 bp, Homo sapiens
tgccaccccttcctca

SEQ ID NO: 3671814 - DNA, 22 bp, Homo sapiens
tgccaccccttcctcagcctgg

SEQ ID NO: 3671815 - DNA, 15 bp, Homo sapiens
tgccactcactaggc

SEQ ID NO: 3671816 - DNA, 18 bp, Homo sapiens
tgccactcactaggcccc

SEQ ID NO: 3671817 - DNA, 19 bp, Homo sapiens
tgccactcactaggccccc

SEQ ID NO: 3671818 - DNA, 21 bp, Homo sapiens
tgccactgccttcgcttcttg

SEQ ID NO: 3671819 - DNA, 19 bp, Homo sapiens
tgccagcggtttcctggtg

SEQ ID NO: 3671820 - DNA, 15 bp, Homo sapiens
tgccagctgcactga

SEQ ID NO: 3671821 - DNA, 21 bp, Homo sapiens
tgccagggaactggcctgctg

SEQ ID NO: 3671822 - DNA, 11 bp, Homo sapiens
tgccagggagc

SEQ ID NO: 3671823 - DNA, 18 bp, Homo sapiens
tgccagtaacgcgtcttc

SEQ ID NO: 3671824 - DNA, 22 bp, Homo sapiens
tgccagtaacgcgtcttcctga

SEQ ID NO: 3671825 - DNA, 17 bp, Homo sapiens
tgccagtgacagacagg

SEQ ID NO: 3671826 - DNA, 19 bp, Homo sapiens
tgccagtgacagacaggct

SEQ ID NO: 3671827 - DNA, 22 bp, Homo sapiens
tgccatcattgatgatcactgt

SEQ ID NO: 3671828 - DNA, 23 bp, Homo sapiens
tgccatcattgatgatcactgtg

SEQ ID NO: 3671829 - DNA, 17 bp, Homo sapiens
tgccatctagccagccc

SEQ ID NO: 3671830 - DNA, 22 bp, Homo sapiens
tgccatctcacctcctgctggg

SEQ ID NO: 3671831 - DNA, 23 bp, Homo sapiens
tgccatctcacctcctgctgggc

SEQ ID NO: 3671832 - DNA, 20 bp, Homo sapiens
tgccatgatgcctctgtctt

SEQ ID NO: 3671833 - DNA, 21 bp, Homo sapiens
tgccatgttggccaggctggt

SEQ ID NO: 3671834 - DNA, 21 bp, Homo sapiens
tgccattgggaccctccagtg

SEQ ID NO: 3671835 - DNA, 22 bp, Homo sapiens
tgcccaacccttccctcacctt

SEQ ID NO: 3671836 - DNA, 22 bp, Homo sapiens
tgcccaagccagaggctgggtt

SEQ ID NO: 3671837 - DNA, 15 bp, Homo sapiens
tgcccacctgcccat

SEQ ID NO: 3671838 - DNA, 11 bp, Homo sapiens
tgcccacctgt

SEQ ID NO: 3671839 - DNA, 19 bp, Homo sapiens
tgcccacggagtcgtgggg

SEQ ID NO: 3671840 - DNA, 16 bp, Homo sapiens
tgcccagcccctcctc

SEQ ID NO: 3671841 - DNA, 19 bp, Homo sapiens
tgcccagcccctcctccct

SEQ ID NO: 3671842 - DNA, 21 bp, Homo sapiens
tgcccaggagcaagtgaggcc

SEQ ID NO: 3671843 - DNA, 13 bp, Homo sapiens
tgccccagagctg

SEQ ID NO: 3671844 - DNA, 17 bp, Homo sapiens
tgccccagagctgttta

SEQ ID NO: 3671845 - DNA, 14 bp, Homo sapiens
tgccccaggaccag

SEQ ID NO: 3671846 - DNA, 18 bp, Homo sapiens
tgccccaggaccagctca

SEQ ID NO: 3671847 - DNA, 19 bp, Homo sapiens
tgccccatcctccagcagg

SEQ ID NO: 3671848 - DNA, 22 bp, Homo sapiens
tgcccctcccccaacccccacc

SEQ ID NO: 3671849 - DNA, 23 bp, Homo sapiens
tgcccctcccccaacccccaccc

SEQ ID NO: 3671850 - DNA, 22 bp, Homo sapiens
tgcccctcttccaaaggcagcg

SEQ ID NO: 3671851 - DNA, 13 bp, Homo sapiens
tgcccctgggatc

SEQ ID NO: 3671852 - DNA, 18 bp, Homo sapiens
tgcccctgggatccgagg

SEQ ID NO: 3671853 - DNA, 21 bp, Homo sapiens
tgccccttgacaactggcagg

SEQ ID NO: 3671854 - DNA, 13 bp, Homo sapiens
tgcccgggctccc

SEQ ID NO: 3671855 - DNA, 14 bp, Homo sapiens
tgccctcctctccc

SEQ ID NO: 3671856 - DNA, 16 bp, Homo sapiens
tgccctcctctcccat

SEQ ID NO: 3671857 - DNA, 11 bp, Homo sapiens
tgccctgcccc

SEQ ID NO: 3671858 - DNA, 22 bp, Homo sapiens
tgccctggcagggtcatcctgt

SEQ ID NO: 3671859 - DNA, 21 bp, Homo sapiens
tgccctggtccagggaagctg

SEQ ID NO: 3671860 - DNA, 15 bp, Homo sapiens
tgccggtgagaccca

SEQ ID NO: 3671861 - DNA, 15 bp, Homo sapiens
tgcctacgccaggag

SEQ ID NO: 3671862 - DNA, 15 bp, Homo sapiens
tgcctagactgttac

SEQ ID NO: 3671863 - DNA, 17 bp, Homo sapiens
tgcctaggcgattttgt

SEQ ID NO: 3671864 - DNA, 21 bp, Homo sapiens
tgcctaggcgattttgtctac

SEQ ID NO: 3671865 - DNA, 13 bp, Homo sapiens
tgcctcaatgcca

SEQ ID NO: 3671866 - DNA, 22 bp, Homo sapiens
tgcctcactaatttttgtatta

SEQ ID NO: 3671867 - DNA, 14 bp, Homo sapiens
tgcctcagcctccc

SEQ ID NO: 3671868 - DNA, 14 bp, Homo sapiens
tgcctccagcctgg

SEQ ID NO: 3671869 - DNA, 18 bp, Homo sapiens
tgcctccagcctggtggc

SEQ ID NO: 3671870 - DNA, 14 bp, Homo sapiens
tgcctccaggtgca

SEQ ID NO: 3671871 - DNA, 17 bp, Homo sapiens
tgcctcttccttgaaga

SEQ ID NO: 3671872 - DNA, 12 bp, Homo sapiens
tgcctgagggtg

SEQ ID NO: 3671873 - DNA, 14 bp, Homo sapiens
tgcctgagggtggg

SEQ ID NO: 3671874 - DNA, 14 bp, Homo sapiens
tgcctgcagggcca

SEQ ID NO: 3671875 - DNA, 23 bp, Homo sapiens
tgcctgcagggccatggctcagg

SEQ ID NO: 3671876 - DNA, 15 bp, Homo sapiens
tgcctgccagctgca

SEQ ID NO: 3671877 - DNA, 19 bp, Homo sapiens
tgcctgccagctgcactga

SEQ ID NO: 3671878 - DNA, 16 bp, Homo sapiens
tgcctgctgtatccct

SEQ ID NO: 3671879 - DNA, 12 bp, Homo sapiens
tgcctggccagg

SEQ ID NO: 3671880 - DNA, 14 bp, Homo sapiens
tgcctggccaggca

SEQ ID NO: 3671881 - DNA, 19 bp, Homo sapiens
tgcctggggtgttagtggc

SEQ ID NO: 3671882 - DNA, 16 bp, Homo sapiens
tgcctgtagctttcct

SEQ ID NO: 3671883 - DNA, 19 bp, Homo sapiens
tgcctgtagctttcctggt

SEQ ID NO: 3671884 - DNA, 22 bp, Homo sapiens
tgcctgtggcgccgtctccagg

SEQ ID NO: 3671885 - DNA, 15 bp, Homo sapiens
tgcctgtgtccatgc

SEQ ID NO: 3671886 - DNA, 16 bp, Homo sapiens
tgccttaactggagcc

SEQ ID NO: 3671887 - DNA, 15 bp, Homo sapiens
tgccttccagaaaac

SEQ ID NO: 3671888 - DNA, 13 bp, Homo sapiens
tgccttcgcttct

SEQ ID NO: 3671889 - DNA, 14 bp, Homo sapiens
tgccttcgcttctt

SEQ ID NO: 3671890 - DNA, 20 bp, Homo sapiens
tgccttcgcttcttgcctct

SEQ ID NO: 3671891 - DNA, 15 bp, Homo sapiens
tgccttctaaaggtg

SEQ ID NO: 3671892 - DNA, 22 bp, Homo sapiens
tgccttgctgtttgtcctgaga

SEQ ID NO: 3671893 - DNA, 11 bp, Homo sapiens
tgccttgggct

SEQ ID NO: 3671894 - DNA, 15 bp, Homo sapiens
tgccttgggctgctc

SEQ ID NO: 3671895 - DNA, 16 bp, Homo sapiens
tgccttgggctgctcc

SEQ ID NO: 3671896 - DNA, 17 bp, Homo sapiens
tgccttgggctgctcct

SEQ ID NO: 3671897 - DNA, 12 bp, Homo sapiens
tgcctttcaaat

SEQ ID NO: 3671898 - DNA, 17 bp, Homo sapiens
tgcctttcaaatttaga

SEQ ID NO: 3671899 - DNA, 15 bp, Homo sapiens
tgcctttgttttgat

SEQ ID NO: 3671900 - DNA, 21 bp, Homo sapiens
tgcgaccctgggggcacagga

SEQ ID NO: 3671901 - DNA, 16 bp, Homo sapiens
tgcgactttctgcctg

SEQ ID NO: 3671902 - DNA, 15 bp, Homo sapiens
tgcgcatcttgcctc

SEQ ID NO: 3671903 - DNA, 21 bp, Homo sapiens
tgcgccccctccgccctgcca

SEQ ID NO: 3671904 - DNA, 23 bp, Homo sapiens
tgcgcgtgcacgtggagagctgg

SEQ ID NO: 3671905 - DNA, 15 bp, Homo sapiens
tgcgctcagggccat

SEQ ID NO: 3671906 - DNA, 19 bp, Homo sapiens
tgcgctcagggccatgctg

SEQ ID NO: 3671907 - DNA, 23 bp, Homo sapiens
tgcgctcagggccatgctgaggc

SEQ ID NO: 3671908 - DNA, 13 bp, Homo sapiens
tgcggccaccacc

SEQ ID NO: 3671909 - DNA, 20 bp, Homo sapiens
tgctaactagcttggaaact

SEQ ID NO: 3671910 - DNA, 22 bp, Homo sapiens
tgctaactagcttggaaactgg

SEQ ID NO: 3671911 - DNA, 15 bp, Homo sapiens
tgctaatgctatgca

SEQ ID NO: 3671912 - DNA, 20 bp, Homo sapiens
tgctacagatgatagaggat

SEQ ID NO: 3671913 - DNA, 15 bp, Homo sapiens
tgctaccgttgactt

SEQ ID NO: 3671914 - DNA, 17 bp, Homo sapiens
tgctacctctgagaaga

SEQ ID NO: 3671915 - DNA, 18 bp, Homo sapiens
tgctacctctgagaagac

SEQ ID NO: 3671916 - DNA, 13 bp, Homo sapiens
tgctactccatgc

SEQ ID NO: 3671917 - DNA, 20 bp, Homo sapiens
tgctatagtatttgattcaa

SEQ ID NO: 3671918 - DNA, 19 bp, Homo sapiens
tgctatcaacaataaaatt

SEQ ID NO: 3671919 - DNA, 16 bp, Homo sapiens
tgctatttttgtaaag

SEQ ID NO: 3671920 - DNA, 22 bp, Homo sapiens
tgctcagctgcgcccccttctt

SEQ ID NO: 3671921 - DNA, 12 bp, Homo sapiens
tgctcagcttct

SEQ ID NO: 3671922 - DNA, 21 bp, Homo sapiens
tgctcagcttctcctgtgtga

SEQ ID NO: 3671923 - DNA, 18 bp, Homo sapiens
tgctcatctgctggtccg

SEQ ID NO: 3671924 - DNA, 14 bp, Homo sapiens
tgctccaccacatc

SEQ ID NO: 3671925 - DNA, 16 bp, Homo sapiens
tgctccacccttggcc

SEQ ID NO: 3671926 - DNA, 19 bp, Homo sapiens
tgctccacccttggcctgt

SEQ ID NO: 3671927 - DNA, 16 bp, Homo sapiens
tgctccagctgttcag

SEQ ID NO: 3671928 - DNA, 19 bp, Homo sapiens
tgctccagctgttcagctg

SEQ ID NO: 3671929 - DNA, 11 bp, Homo sapiens
aaaaaaaccac

SEQ ID NO: 3671930 - DNA, 12 bp, Homo sapiens
aaaaaaatgaaa

SEQ ID NO: 3671931 - DNA, 22 bp, Homo sapiens
aaaaaactgctgactgttttct

SEQ ID NO: 3671932 - DNA, 11 bp, Homo sapiens
aaaaaatgttg

SEQ ID NO: 3671933 - DNA, 14 bp, Homo sapiens
aaaaacatattctt

SEQ ID NO: 3671934 - DNA, 16 bp, Homo sapiens
aaaaaccacacaaaga

SEQ ID NO: 3671935 - DNA, 19 bp, Homo sapiens
aaaaaccaccaaaaacaaa

SEQ ID NO: 3671936 - DNA, 19 bp, Homo sapiens
aaaaacttcagtaagtacg

SEQ ID NO: 3671937 - DNA, 13 bp, Homo sapiens
aaaaagacaaaca

SEQ ID NO: 3671938 - DNA, 10 bp, Homo sapiens
aaaaagatat

SEQ ID NO: 3671939 - DNA, 16 bp, Homo sapiens
aaaaagtccaatttta

SEQ ID NO: 3671940 - DNA, 14 bp, Homo sapiens
aaaaatactcagat

SEQ ID NO: 3671941 - DNA, 17 bp, Homo sapiens
aaaaatagcaacttgtg

SEQ ID NO: 3671942 - DNA, 11 bp, Homo sapiens
aaaaattaaaa

SEQ ID NO: 3671943 - DNA, 17 bp, Homo sapiens
aaaaattaaaatggatg

SEQ ID NO: 3671944 - DNA, 19 bp, Homo sapiens
aaaacaatctggaagaaaa

SEQ ID NO: 3671945 - DNA, 23 bp, Homo sapiens
aaaacattgcaaatttattttat

SEQ ID NO: 3671946 - DNA, 18 bp, Homo sapiens
aaaaccaaatgtttattt

SEQ ID NO: 3671947 - DNA, 15 bp, Homo sapiens
aaaaccacacaaaga

SEQ ID NO: 3671948 - DNA, 19 bp, Homo sapiens
aaaacgatgaagttatgct

SEQ ID NO: 3671949 - DNA, 12 bp, Homo sapiens
aaaactctactt

SEQ ID NO: 3671950 - DNA, 15 bp, Homo sapiens
aaaactctacttaat

SEQ ID NO: 3671951 - DNA, 19 bp, Homo sapiens
aaaactctacttaatccaa

SEQ ID NO: 3671952 - DNA, 14 bp, Homo sapiens
aaaactgcatttca

SEQ ID NO: 3671953 - DNA, 16 bp, Homo sapiens
aaaactttcctcgcct

SEQ ID NO: 3671954 - DNA, 16 bp, Homo sapiens
aaaagaaaaatgaaga

SEQ ID NO: 3671955 - DNA, 13 bp, Homo sapiens
aaaagatgcttct

SEQ ID NO: 3671956 - DNA, 15 bp, Homo sapiens
aaaaggatacataat

SEQ ID NO: 3671957 - DNA, 14 bp, Homo sapiens
aaaaggctgagaag

SEQ ID NO: 3671958 - DNA, 17 bp, Homo sapiens
aaaaggctgagaaggaa

SEQ ID NO: 3671959 - DNA, 13 bp, Homo sapiens
aaaaggtttacag

SEQ ID NO: 3671960 - DNA, 13 bp, Homo sapiens
aaaagtccaattt

SEQ ID NO: 3671961 - DNA, 13 bp, Homo sapiens
aaaagtgtccttc

SEQ ID NO: 3671962 - DNA, 11 bp, Homo sapiens
aaaataaaaac

SEQ ID NO: 3671963 - DNA, 14 bp, Homo sapiens
aaaataaatttata

SEQ ID NO: 3671964 - DNA, 17 bp, Homo sapiens
aaaatacaaaaatttgc

SEQ ID NO: 3671965 - DNA, 22 bp, Homo sapiens
aaaataccagagccttcaagtg

SEQ ID NO: 3671966 - DNA, 15 bp, Homo sapiens
aaaatagaaaagtta

SEQ ID NO: 3671967 - DNA, 14 bp, Homo sapiens
aaaatatatgtatt

SEQ ID NO: 3671968 - DNA, 16 bp, Homo sapiens
aaaatatatgtatttt

SEQ ID NO: 3671969 - DNA, 12 bp, Homo sapiens
aaaatatttaaa

SEQ ID NO: 3671970 - DNA, 16 bp, Homo sapiens
aaaatattttcctgcc

SEQ ID NO: 3671971 - DNA, 18 bp, Homo sapiens
aaaatcctacagtgaaat

SEQ ID NO: 3671972 - DNA, 14 bp, Homo sapiens
aaaatgagcctggc

SEQ ID NO: 3671973 - DNA, 18 bp, Homo sapiens
aaaatgcaacaacatgta

SEQ ID NO: 3671974 - DNA, 18 bp, Homo sapiens
aaaatgcagcagggatgc

SEQ ID NO: 3671975 - DNA, 23 bp, Homo sapiens
aaaatgccatgatgcctctgtct

SEQ ID NO: 3671976 - DNA, 12 bp, Homo sapiens
aaaatgcttctt

SEQ ID NO: 3671977 - DNA, 12 bp, Homo sapiens
aaaatgttttaa

SEQ ID NO: 3671978 - DNA, 17 bp, Homo sapiens
aaaattacttggctttt

SEQ ID NO: 3671979 - DNA, 21 bp, Homo sapiens
aaaattcagcaaaccattttt

SEQ ID NO: 3671980 - DNA, 15 bp, Homo sapiens
aaaattcatttctaa

SEQ ID NO: 3671981 - DNA, 20 bp, Homo sapiens
aaaattgttaatttttccta

SEQ ID NO: 3671982 - DNA, 13 bp, Homo sapiens
aaaatttgtattt

SEQ ID NO: 3671983 - DNA, 23 bp, Homo sapiens
aaacaagccaagaaagatgtata

SEQ ID NO: 3671984 - DNA, 16 bp, Homo sapiens
aaacaataattttaac

SEQ ID NO: 3671985 - DNA, 19 bp, Homo sapiens
aaacacaaacgggctcagc

SEQ ID NO: 3671986 - DNA, 21 bp, Homo sapiens
aaacacacagatacacacaca

SEQ ID NO: 3671987 - DNA, 16 bp, Homo sapiens
aaacacactgaggcag

SEQ ID NO: 3671988 - DNA, 19 bp, Homo sapiens
aaacacactgaggcaggga

SEQ ID NO: 3671989 - DNA, 21 bp, Homo sapiens
aaacacttatcttctggatta

SEQ ID NO: 3671990 - DNA, 15 bp, Homo sapiens
aaacacttgcaacct

SEQ ID NO: 3671991 - DNA, 22 bp, Homo sapiens
aaacagttaagacaacaggcat

SEQ ID NO: 3671992 - DNA, 17 bp, Homo sapiens
aaacataccaacatgtt

SEQ ID NO: 3671993 - DNA, 14 bp, Homo sapiens
aaacatagaaatgg

SEQ ID NO: 3671994 - DNA, 18 bp, Homo sapiens
aaacattgcctttgaatg

SEQ ID NO: 3671995 - DNA, 23 bp, Homo sapiens
aaaccatccagtgacaaaccatc

SEQ ID NO: 3671996 - DNA, 16 bp, Homo sapiens
aaactatagaataaag

SEQ ID NO: 3671997 - DNA, 19 bp, Homo sapiens
aaactctgttgcaagtgca

SEQ ID NO: 3671998 - DNA, 12 bp, Homo sapiens
aaactcttaaaa

SEQ ID NO: 3671999 - DNA, 18 bp, Homo sapiens
aaactcttagagaataag

SEQ ID NO: 3672000 - DNA, 16 bp, Homo sapiens
aaactcttcagttaat

SEQ ID NO: 3672001 - DNA, 23 bp, Homo sapiens
aaactgcataagtgaaaatctta

SEQ ID NO: 3672002 - DNA, 19 bp, Homo sapiens
aaactgtctttaaaagaga

SEQ ID NO: 3672003 - DNA, 18 bp, Homo sapiens
aaacttctgaactttgga

SEQ ID NO: 3672004 - DNA, 19 bp, Homo sapiens
aaagaagaagaagaaggag

SEQ ID NO: 3672005 - DNA, 15 bp, Homo sapiens
aaagacaaacagtag

SEQ ID NO: 3672006 - DNA, 14 bp, Homo sapiens
aaagacagagctgg

SEQ ID NO: 3672007 - DNA, 20 bp, Homo sapiens
aaagacattgattcagcctg

SEQ ID NO: 3672008 - DNA, 15 bp, Homo sapiens
aaagagactgtgcca

SEQ ID NO: 3672009 - DNA, 22 bp, Homo sapiens
aaagagctttcttcccgaaccc

SEQ ID NO: 3672010 - DNA, 20 bp, Homo sapiens
aaagatgcaaggaccaggac

SEQ ID NO: 3672011 - DNA, 13 bp, Homo sapiens
aaagatgtatata

SEQ ID NO: 3672012 - DNA, 13 bp, Homo sapiens
aaagcaaatgata

SEQ ID NO: 3672013 - DNA, 19 bp, Homo sapiens
aaagcagctcaaaggcaca

SEQ ID NO: 3672014 - DNA, 13 bp, Homo sapiens
aaagccctgtgct

SEQ ID NO: 3672015 - DNA, 11 bp, Homo sapiens
aaagccttctt

SEQ ID NO: 3672016 - DNA, 15 bp, Homo sapiens
aaagctgagcctgca

SEQ ID NO: 3672017 - DNA, 14 bp, Homo sapiens
aaagctttcctgcc

SEQ ID NO: 3672018 - DNA, 23 bp, Homo sapiens
aaagctttcctgccccaggcctg

SEQ ID NO: 3672019 - DNA, 15 bp, Homo sapiens
aaaggaagcactctg

SEQ ID NO: 3672020 - DNA, 17 bp, Homo sapiens
aaaggagagctagcagc

SEQ ID NO: 3672021 - DNA, 18 bp, Homo sapiens
aaaggatctttgtggcca

SEQ ID NO: 3672022 - DNA, 19 bp, Homo sapiens
aaaggatctttgtggccaa

SEQ ID NO: 3672023 - DNA, 12 bp, Homo sapiens
aaaggcacagtg

SEQ ID NO: 3672024 - DNA, 20 bp, Homo sapiens
aaaggcacctataaaacagg

SEQ ID NO: 3672025 - DNA, 21 bp, Homo sapiens
aaaggcacctataaaacaggt

SEQ ID NO: 3672026 - DNA, 21 bp, Homo sapiens
aaaggcagctgtgtctgagcc

SEQ ID NO: 3672027 - DNA, 20 bp, Homo sapiens
aaaggcaggaagggaagcgt

SEQ ID NO: 3672028 - DNA, 12 bp, Homo sapiens
aaaggcatgctg

SEQ ID NO: 3672029 - DNA, 20 bp, Homo sapiens
aaaggccagctggcagcaga

SEQ ID NO: 3672030 - DNA, 13 bp, Homo sapiens
aaaggctgagaag

SEQ ID NO: 3672031 - DNA, 24 bp, Homo sapiens
aaaggggtcggctgaccatgctca

SEQ ID NO: 3672032 - DNA, 16 bp, Homo sapiens
aaagggtcctgctttc

SEQ ID NO: 3672033 - DNA, 13 bp, Homo sapiens
aaagtatcacttt

SEQ ID NO: 3672034 - DNA, 23 bp, Homo sapiens
aaagtattgtaaattatatttgt

SEQ ID NO: 3672035 - DNA, 21 bp, Homo sapiens
aaagtggcgtgggagccagcc

SEQ ID NO: 3672036 - DNA, 22 bp, Homo sapiens
aaagtggcgtgggagccagcct

SEQ ID NO: 3672037 - DNA, 15 bp, Homo sapiens
aaagtgtaacagata

SEQ ID NO: 3672038 - DNA, 17 bp, Homo sapiens
aaagtgtcttttgacat

SEQ ID NO: 3672039 - DNA, 14 bp, Homo sapiens
aaagttatatttca

SEQ ID NO: 3672040 - DNA, 18 bp, Homo sapiens
aaagttattagtggttta

SEQ ID NO: 3672041 - DNA, 17 bp, Homo sapiens
aaagtttctaatattaa

SEQ ID NO: 3672042 - DNA, 22 bp, Homo sapiens
aaataaaattaaagctgaaaac

SEQ ID NO: 3672043 - DNA, 14 bp, Homo sapiens
aaataaatttatat

SEQ ID NO: 3672044 - DNA, 17 bp, Homo sapiens
aaataaatttatatgaa

SEQ ID NO: 3672045 - DNA, 22 bp, Homo sapiens
aaataccacaagcctgagaact

SEQ ID NO: 3672046 - DNA, 14 bp, Homo sapiens
aaataccagagcct

SEQ ID NO: 3672047 - DNA, 22 bp, Homo sapiens
aaatactgtttttaacaactat

SEQ ID NO: 3672048 - DNA, 16 bp, Homo sapiens
aaatagaaaagttatt

SEQ ID NO: 3672049 - DNA, 15 bp, Homo sapiens
aaatagatgctgtgt

SEQ ID NO: 3672050 - DNA, 16 bp, Homo sapiens
aaataggatttttaga

SEQ ID NO: 3672051 - DNA, 16 bp, Homo sapiens
aaatagtaaaaataaa

SEQ ID NO: 3672052 - DNA, 15 bp, Homo sapiens
aaatagtatttgcat

SEQ ID NO: 3672053 - DNA, 22 bp, Homo sapiens
aaatagtgacataatatattct

SEQ ID NO: 3672054 - DNA, 22 bp, Homo sapiens
aaatatatgtatttttatataa

SEQ ID NO: 3672055 - DNA, 22 bp, Homo sapiens
aaatatgtgaaaggaacatttt

SEQ ID NO: 3672056 - DNA, 16 bp, Homo sapiens
aaatattatgagatgc

SEQ ID NO: 3672057 - DNA, 17 bp, Homo sapiens
aaatattatgagatgct

SEQ ID NO: 3672058 - DNA, 17 bp, Homo sapiens
aaatattcactggcccc

SEQ ID NO: 3672059 - DNA, 14 bp, Homo sapiens
aaatatttaaaaat

SEQ ID NO: 3672060 - DNA, 12 bp, Homo sapiens
aaatatttctga

SEQ ID NO: 3672061 - DNA, 19 bp, Homo sapiens
aaatattttctattttaag

SEQ ID NO: 3672062 - DNA, 20 bp, Homo sapiens
aaatcaccacaaactgtaat

SEQ ID NO: 3672063 - DNA, 18 bp, Homo sapiens
aaatcacccaatcccagt

SEQ ID NO: 3672064 - DNA, 19 bp, Homo sapiens
aaatccttagatctggcat

SEQ ID NO: 3672065 - DNA, 15 bp, Homo sapiens
aaatctcagaacctt

SEQ ID NO: 3672066 - DNA, 18 bp, Homo sapiens
aaatctgacccagtgccc

SEQ ID NO: 3672067 - DNA, 14 bp, Homo sapiens
aaatctggcttctg

SEQ ID NO: 3672068 - DNA, 13 bp, Homo sapiens
aaatcttacaaca

SEQ ID NO: 3672069 - DNA, 13 bp, Homo sapiens
aaatgagcctggc

SEQ ID NO: 3672070 - DNA, 19 bp, Homo sapiens
aaatgagcctggcaagaat

SEQ ID NO: 3672071 - DNA, 10 bp, Homo sapiens
aaatgctgct

SEQ ID NO: 3672072 - DNA, 17 bp, Homo sapiens
aaatggatgccttgaat

SEQ ID NO: 3672073 - DNA, 22 bp, Homo sapiens
aaatggatgccttgaataataa

SEQ ID NO: 3672074 - DNA, 11 bp, Homo sapiens
aaatggcctca

SEQ ID NO: 3672075 - DNA, 17 bp, Homo sapiens
aaatggggccagatcca

SEQ ID NO: 3672076 - DNA, 22 bp, Homo sapiens
aaatggggccagatccagcctg

SEQ ID NO: 3672077 - DNA, 16 bp, Homo sapiens
aaatgtacagacatat

SEQ ID NO: 3672078 - DNA, 11 bp, Homo sapiens
aaatgtccctc

SEQ ID NO: 3672079 - DNA, 22 bp, Homo sapiens
aaatgtcttgctgttgacatat

SEQ ID NO: 3672080 - DNA, 13 bp, Homo sapiens
aaatgtgtacata

SEQ ID NO: 3672081 - DNA, 20 bp, Homo sapiens
aaatgttaagttgatggtga

SEQ ID NO: 3672082 - DNA, 21 bp, Homo sapiens
aaatgttatcttatactgtac

SEQ ID NO: 3672083 - DNA, 23 bp, Homo sapiens
aaatgttatcttatactgtacaa

SEQ ID NO: 3672084 - DNA, 20 bp, Homo sapiens
aaatgtttatgttttcaact

SEQ ID NO: 3672085 - DNA, 21 bp, Homo sapiens
aaatgtttttctgccagggag

SEQ ID NO: 3672086 - DNA, 23 bp, Homo sapiens
aaatgtttttctgccagggagct

SEQ ID NO: 3672087 - DNA, 14 bp, Homo sapiens
aaattaaaatggat

SEQ ID NO: 3672088 - DNA, 17 bp, Homo sapiens
aaattaaagctgaaaac

SEQ ID NO: 3672089 - DNA, 13 bp, Homo sapiens
aaattaacactgc

SEQ ID NO: 3672090 - DNA, 16 bp, Homo sapiens
aagaatgtacgtccag

SEQ ID NO: 3672091 - DNA, 19 bp, Homo sapiens
aagacaatgtgaaaagaaa

SEQ ID NO: 3672092 - DNA, 21 bp, Homo sapiens
aagacacaaggtgatttcaga

SEQ ID NO: 3672093 - DNA, 21 bp, Homo sapiens
aagacacttgctgagtgaagg

SEQ ID NO: 3672094 - DNA, 20 bp, Homo sapiens
aagacagagaaaacttgcct

SEQ ID NO: 3672095 - DNA, 20 bp, Homo sapiens
aagacagatgccccagagct

SEQ ID NO: 3672096 - DNA, 11 bp, Homo sapiens
aagacatttct

SEQ ID NO: 3672097 - DNA, 22 bp, Homo sapiens
aagaccaagcttagtcctggga

SEQ ID NO: 3672098 - DNA, 18 bp, Homo sapiens
aagacgtcccttttttct

SEQ ID NO: 3672099 - DNA, 18 bp, Homo sapiens
aagactaacaaaggcagc

SEQ ID NO: 3672100 - DNA, 20 bp, Homo sapiens
aagactaacaaaggcagctg

SEQ ID NO: 3672101 - DNA, 18 bp, Homo sapiens
aagactgagccagcttag

SEQ ID NO: 3672102 - DNA, 13 bp, Homo sapiens
aagagactctcct

SEQ ID NO: 3672103 - DNA, 20 bp, Homo sapiens
aagagagagagagaaaaaaa

SEQ ID NO: 3672104 - DNA, 16 bp, Homo sapiens
aagagcagtcacaaca

SEQ ID NO: 3672105 - DNA, 11 bp, Homo sapiens
aagagctgagg

SEQ ID NO: 3672106 - DNA, 18 bp, Homo sapiens
aagagctgaggcaattct

SEQ ID NO: 3672107 - DNA, 22 bp, Homo sapiens
aagaggacataatggggtcctg

SEQ ID NO: 3672108 - DNA, 18 bp, Homo sapiens
aagaggctgaggcctgga

SEQ ID NO: 3672109 - DNA, 18 bp, Homo sapiens
aagaggttttaaaaaaat

SEQ ID NO: 3672110 - DNA, 19 bp, Homo sapiens
aagataatattaaggaaga

SEQ ID NO: 3672111 - DNA, 21 bp, Homo sapiens
aagataatattaaggaagaca

SEQ ID NO: 3672112 - DNA, 19 bp, Homo sapiens
aagatctgtcctcagcctt

SEQ ID NO: 3672113 - DNA, 16 bp, Homo sapiens
aagatgcttctcactg

SEQ ID NO: 3672114 - DNA, 19 bp, Homo sapiens
aagatgcttctcactgcca

SEQ ID NO: 3672115 - DNA, 18 bp, Homo sapiens
aagatgtaaattgaagaa

SEQ ID NO: 3672116 - DNA, 14 bp, Homo sapiens
aagatgtatatagg

SEQ ID NO: 3672117 - DNA, 13 bp, Homo sapiens
aagattcaattta

SEQ ID NO: 3672118 - DNA, 16 bp, Homo sapiens
aagattccattttgga

SEQ ID NO: 3672119 - DNA, 17 bp, Homo sapiens
aagattccattttggaa

SEQ ID NO: 3672120 - DNA, 14 bp, Homo sapiens
aagattgagaagcc

SEQ ID NO: 3672121 - DNA, 15 bp, Homo sapiens
aagattgagaagcca

SEQ ID NO: 3672122 - DNA, 19 bp, Homo sapiens
aagatttgtgaactggaag

SEQ ID NO: 3672123 - DNA, 13 bp, Homo sapiens
aagcaaaagaaaa

SEQ ID NO: 3672124 - DNA, 14 bp, Homo sapiens
aagcaaaagaaaaa

SEQ ID NO: 3672125 - DNA, 15 bp, Homo sapiens
aagcaaaagaaaaag

SEQ ID NO: 3672126 - DNA, 20 bp, Homo sapiens
aagcaacaaagattgagaag

SEQ ID NO: 3672127 - DNA, 21 bp, Homo sapiens
aagcaacaaagattgagaagc

SEQ ID NO: 3672128 - DNA, 23 bp, Homo sapiens
aagcactacaccttgccttgctg

SEQ ID NO: 3672129 - DNA, 14 bp, Homo sapiens
aagcagaggaagga

SEQ ID NO: 3672130 - DNA, 15 bp, Homo sapiens
aagcagaggaccagg

SEQ ID NO: 3672131 - DNA, 16 bp, Homo sapiens
aagcagatgcaaagag

SEQ ID NO: 3672132 - DNA, 18 bp, Homo sapiens
aagcagatgcaaagaggc

SEQ ID NO: 3672133 - DNA, 16 bp, Homo sapiens
aagcagcctctcccca

SEQ ID NO: 3672134 - DNA, 17 bp, Homo sapiens
aagcagcctctccccag

SEQ ID NO: 3672135 - DNA, 18 bp, Homo sapiens
aagcagctcaaaggcaca

SEQ ID NO: 3672136 - DNA, 19 bp, Homo sapiens
aagcaggatggagctgact

SEQ ID NO: 3672137 - DNA, 17 bp, Homo sapiens
aagcagtcgtgcctgtg

SEQ ID NO: 3672138 - DNA, 22 bp, Homo sapiens
aagcataaaaacattttaaaaa

SEQ ID NO: 3672139 - DNA, 14 bp, Homo sapiens
aagcatactttgta

SEQ ID NO: 3672140 - DNA, 18 bp, Homo sapiens
aagcatactttgtaaata

SEQ ID NO: 3672141 - DNA, 19 bp, Homo sapiens
aagccaagggaacctgtgt

SEQ ID NO: 3672142 - DNA, 14 bp, Homo sapiens
aagccacagctggt

SEQ ID NO: 3672143 - DNA, 14 bp, Homo sapiens
aagccagaagctga

SEQ ID NO: 3672144 - DNA, 17 bp, Homo sapiens
aagccagaagctgagca

SEQ ID NO: 3672145 - DNA, 23 bp, Homo sapiens
aagccaggaatttcccaggaccc

SEQ ID NO: 3672146 - DNA, 23 bp, Homo sapiens
aagccaggtgtggtggtatgtgc

SEQ ID NO: 3672147 - DNA, 17 bp, Homo sapiens
aagcccaaggtgctgat

SEQ ID NO: 3672148 - DNA, 13 bp, Homo sapiens
aagccccgtctga

SEQ ID NO: 3672149 - DNA, 20 bp, Homo sapiens
aagccccgtctgaccccagc

SEQ ID NO: 3672150 - DNA, 16 bp, Homo sapiens
aagcccggactgacca

SEQ ID NO: 3672151 - DNA, 21 bp, Homo sapiens
aagccgtgattttcattgctg

SEQ ID NO: 3672152 - DNA, 16 bp, Homo sapiens
aagccgtgcctgtagc

SEQ ID NO: 3672153 - DNA, 20 bp, Homo sapiens
aagcctaacttcatagaaac

SEQ ID NO: 3672154 - DNA, 11 bp, Homo sapiens
aagcctgaagg

SEQ ID NO: 3672155 - DNA, 24 bp, Homo sapiens
aagcctgaaggggcgtctgttccc

SEQ ID NO: 3672156 - DNA, 16 bp, Homo sapiens
aagcctgtgcaaaaaa

SEQ ID NO: 3672157 - DNA, 18 bp, Homo sapiens
aagcctgtgcaaaaaaat

SEQ ID NO: 3672158 - DNA, 16 bp, Homo sapiens
aagccttcattgcctt

SEQ ID NO: 3672159 - DNA, 15 bp, Homo sapiens
aagctagggtggccc

SEQ ID NO: 3672160 - DNA, 17 bp, Homo sapiens
aagctatttatgggccc

SEQ ID NO: 3672161 - DNA, 17 bp, Homo sapiens
aagctcctcctccctgc

SEQ ID NO: 3672162 - DNA, 21 bp, Homo sapiens
aagctcctcctccctgcatct

SEQ ID NO: 3672163 - DNA, 19 bp, Homo sapiens
aagctcctctccccagccc

SEQ ID NO: 3672164 - DNA, 23 bp, Homo sapiens
aagctcctctccccagcccagag

SEQ ID NO: 3672165 - DNA, 22 bp, Homo sapiens
aagctgacattgccaaaaagga

SEQ ID NO: 3672166 - DNA, 18 bp, Homo sapiens
aagctgagagtgctatga

SEQ ID NO: 3672167 - DNA, 13 bp, Homo sapiens
aagctgagcctgc

SEQ ID NO: 3672168 - DNA, 15 bp, Homo sapiens
aagctgagcctgcag

SEQ ID NO: 3672169 - DNA, 19 bp, Homo sapiens
aagctgcaccctcaggcag

SEQ ID NO: 3672170 - DNA, 20 bp, Homo sapiens
aagctgccgaaccaaaagaa

SEQ ID NO: 3672171 - DNA, 21 bp, Homo sapiens
aagctgccgaaccaaaagaat

SEQ ID NO: 3672172 - DNA, 22 bp, Homo sapiens
aagctggccgagggtcctggct

SEQ ID NO: 3672173 - DNA, 11 bp, Homo sapiens
aagctgggcag

SEQ ID NO: 3672174 - DNA, 15 bp, Homo sapiens
aagctgggcaggttg

SEQ ID NO: 3672175 - DNA, 17 bp, Homo sapiens
aagctgtgctgggaagc

SEQ ID NO: 3672176 - DNA, 22 bp, Homo sapiens
aagctgtgctgggaagcccgga

SEQ ID NO: 3672177 - DNA, 18 bp, Homo sapiens
aagctgttactgtcttca

SEQ ID NO: 3672178 - DNA, 19 bp, Homo sapiens
aagcttagtgagcagtgag

SEQ ID NO: 3672179 - DNA, 18 bp, Homo sapiens
aagctttcctgccccagg

SEQ ID NO: 3672180 - DNA, 17 bp, Homo sapiens
aaggaaggtggatggcc

SEQ ID NO: 3672181 - DNA, 17 bp, Homo sapiens
aaggacttcctgtccag

SEQ ID NO: 3672182 - DNA, 20 bp, Homo sapiens
aaggacttcctgtccagctc

SEQ ID NO: 3672183 - DNA, 19 bp, Homo sapiens
aaggagagagcaaagggtg

SEQ ID NO: 3672184 - DNA, 17 bp, Homo sapiens
aaggaggggaaaaaaat

SEQ ID NO: 3672185 - DNA, 22 bp, Homo sapiens
aaggaggggaaaaaaatgttgt

SEQ ID NO: 3672186 - DNA, 16 bp, Homo sapiens
aaggatctttgtggcc

SEQ ID NO: 3672187 - DNA, 20 bp, Homo sapiens
aaggatctttgtggccaagg

SEQ ID NO: 3672188 - DNA, 21 bp, Homo sapiens
aaggcagcgtgccgagccagc

SEQ ID NO: 3672189 - DNA, 12 bp, Homo sapiens
aaggcagctgtg

SEQ ID NO: 3672190 - DNA, 15 bp, Homo sapiens
aaggcagctgtgtct

SEQ ID NO: 3672191 - DNA, 20 bp, Homo sapiens
aaggcagctgtgtctgagcc

SEQ ID NO: 3672192 - DNA, 22 bp, Homo sapiens
aaggcagctgtgtctgagccca

SEQ ID NO: 3672193 - DNA, 23 bp, Homo sapiens
aaggcagggctcctccctggagc

SEQ ID NO: 3672194 - DNA, 13 bp, Homo sapiens
aaggcatgctgga

SEQ ID NO: 3672195 - DNA, 15 bp, Homo sapiens
aaggcatgtgtgaaa

SEQ ID NO: 3672196 - DNA, 18 bp, Homo sapiens
aaggcatgtgtgaaacat

SEQ ID NO: 3672197 - DNA, 17 bp, Homo sapiens
aaggccagagtggcctg

SEQ ID NO: 3672198 - DNA, 19 bp, Homo sapiens
aaggccagagtggcctggc

SEQ ID NO: 3672199 - DNA, 22 bp, Homo sapiens
aaggccagagtggcctggccag

SEQ ID NO: 3672200 - DNA, 14 bp, Homo sapiens
aaggccagctggca

SEQ ID NO: 3672201 - DNA, 17 bp, Homo sapiens
aaggccagctggcagca

SEQ ID NO: 3672202 - DNA, 18 bp, Homo sapiens
aaggccgagaagcaagaa

SEQ ID NO: 3672203 - DNA, 15 bp, Homo sapiens
aaggcgtggcttctg

SEQ ID NO: 3672204 - DNA, 18 bp, Homo sapiens
aaggcgtggcttctgcag

SEQ ID NO: 3672205 - DNA, 21 bp, Homo sapiens
aaggctcttctccttggagga

SEQ ID NO: 3672206 - DNA, 13 bp, Homo sapiens
aaggctggcaggt

SEQ ID NO: 3672207 - DNA, 22 bp, Homo sapiens
aaggctgtccttacccatctgc

SEQ ID NO: 3672208 - DNA, 22 bp, Homo sapiens
aagggaaagcttcattctcctt

SEQ ID NO: 3672209 - DNA, 15 bp, Homo sapiens
aagggaacctgtgtc

SEQ ID NO: 3672210 - DNA, 20 bp, Homo sapiens
aagggaagcgtatatactta

SEQ ID NO: 3672211 - DNA, 22 bp, Homo sapiens
aagggcaggaaggagagcctgc

SEQ ID NO: 3672212 - DNA, 11 bp, Homo sapiens
aagggccagag

SEQ ID NO: 3672213 - DNA, 12 bp, Homo sapiens
aagggccagagc

SEQ ID NO: 3672214 - DNA, 16 bp, Homo sapiens
aagggccagagccagg

SEQ ID NO: 3672215 - DNA, 16 bp, Homo sapiens
aagggctatgtaaata

SEQ ID NO: 3672216 - DNA, 13 bp, Homo sapiens
aaggggagcccac

SEQ ID NO: 3672217 - DNA, 15 bp, Homo sapiens
aaggggcccgtggga

SEQ ID NO: 3672218 - DNA, 22 bp, Homo sapiens
aaggggcttcaggtccaggctg

SEQ ID NO: 3672219 - DNA, 18 bp, Homo sapiens
aagggtcctgctttctcc

SEQ ID NO: 3672220 - DNA, 22 bp, Homo sapiens
aagggtggctttgcatttcttg

SEQ ID NO: 3672221 - DNA, 22 bp, Homo sapiens
aaggtaaaatgccatgatgcct

SEQ ID NO: 3672222 - DNA, 15 bp, Homo sapiens
aaggtattagcaaag

SEQ ID NO: 3672223 - DNA, 18 bp, Homo sapiens
aaggtgctgacggccagg

SEQ ID NO: 3672224 - DNA, 19 bp, Homo sapiens
aaggtggatggccccagca

SEQ ID NO: 3672225 - DNA, 23 bp, Homo sapiens
aaggtgtggaggctcctgtggta

SEQ ID NO: 3672226 - DNA, 19 bp, Homo sapiens
aaggtttaggctggtggcc

SEQ ID NO: 3672227 - DNA, 21 bp, Homo sapiens
aaggtttaggctggtggccca

SEQ ID NO: 3672228 - DNA, 20 bp, Homo sapiens
aagtaagatgtaaattgaag

SEQ ID NO: 3672229 - DNA, 22 bp, Homo sapiens
aagtacttgtcatagactcctt

SEQ ID NO: 3672230 - DNA, 16 bp, Homo sapiens
aagtagaagcatgttt

SEQ ID NO: 3672231 - DNA, 14 bp, Homo sapiens
aagtagtcctgtga

SEQ ID NO: 3672232 - DNA, 13 bp, Homo sapiens
aagtattgtaaat

SEQ ID NO: 3672233 - DNA, 14 bp, Homo sapiens
aagtattgtaaatt

SEQ ID NO: 3672234 - DNA, 17 bp, Homo sapiens
aagtattgtaaattata

SEQ ID NO: 3672235 - DNA, 20 bp, Homo sapiens
aagtattgtaaattatattt

SEQ ID NO: 3672236 - DNA, 22 bp, Homo sapiens
aagtattgtaaattatatttgt

SEQ ID NO: 3672237 - DNA, 12 bp, Homo sapiens
aagtatttctga

SEQ ID NO: 3672238 - DNA, 20 bp, Homo sapiens
aagtcagctccagctttctg

SEQ ID NO: 3672239 - DNA, 21 bp, Homo sapiens
aagtcatgcgtttaatcacat

SEQ ID NO: 3672240 - DNA, 19 bp, Homo sapiens
aagtccaattttaatttag

SEQ ID NO: 3672241 - DNA, 21 bp, Homo sapiens
aagtccccaggccccaggaag

SEQ ID NO: 3672242 - DNA, 13 bp, Homo sapiens
aagtctgtttact

SEQ ID NO: 3672243 - DNA, 15 bp, Homo sapiens
aagtgaatgctggga

SEQ ID NO: 3672244 - DNA, 19 bp, Homo sapiens
aagtgactaatggcatgag

SEQ ID NO: 3672245 - DNA, 22 bp, Homo sapiens
aagtgcaataaatctgacccag

SEQ ID NO: 3672246 - DNA, 23 bp, Homo sapiens
aagtgcaataaatctgacccagt

SEQ ID NO: 3672247 - DNA, 15 bp, Homo sapiens
aagtgccgcaaattg

SEQ ID NO: 3672248 - DNA, 16 bp, Homo sapiens
aagtgccgcaaattgt

SEQ ID NO: 3672249 - DNA, 19 bp, Homo sapiens
aagtgccgcaaattgtacc

SEQ ID NO: 3672250 - DNA, 18 bp, Homo sapiens
aagtgcctagactgttac

SEQ ID NO: 3672251 - DNA, 21 bp, Homo sapiens
aagtggaaaaatagcctgcct

SEQ ID NO: 3672252 - DNA, 20 bp, Homo sapiens
aagtggcgtgggagccagcc

SEQ ID NO: 3672253 - DNA, 11 bp, Homo sapiens
aagtgggccca

SEQ ID NO: 3672254 - DNA, 15 bp, Homo sapiens
aagtgggcccacccg

SEQ ID NO: 3672255 - DNA, 18 bp, Homo sapiens
aagtgtccacaagaaggg

SEQ ID NO: 3672256 - DNA, 14 bp, Homo sapiens
aagtgtccttcttg

SEQ ID NO: 3672257 - DNA, 14 bp, Homo sapiens
aagttaaattttat

SEQ ID NO: 3672258 - DNA, 12 bp, Homo sapiens
aagttaatagat

SEQ ID NO: 3672259 - DNA, 17 bp, Homo sapiens
aagttatatttcagatg

SEQ ID NO: 3672260 - DNA, 23 bp, Homo sapiens
aagttatatttcagatgtaatgt

SEQ ID NO: 3672261 - DNA, 17 bp, Homo sapiens
aagttattagtggttta

SEQ ID NO: 3672262 - DNA, 20 bp, Homo sapiens
aagttattagtggtttatca

SEQ ID NO: 3672263 - DNA, 20 bp, Homo sapiens
aagtttctggtgccatttct

SEQ ID NO: 3672264 - DNA, 23 bp, Homo sapiens
aagttttcagaacctcttcccca

SEQ ID NO: 3672265 - DNA, 20 bp, Homo sapiens
aagttttcctacacttgaga

SEQ ID NO: 3672266 - DNA, 18 bp, Homo sapiens
aagttttcttgtttctgc

SEQ ID NO: 3672267 - DNA, 15 bp, Homo sapiens
aataaatctgaccca

SEQ ID NO: 3672268 - DNA, 15 bp, Homo sapiens
aataacaaagccctt

SEQ ID NO: 3672269 - DNA, 11 bp, Homo sapiens
aataacattta

SEQ ID NO: 3672270 - DNA, 13 bp, Homo sapiens
aataacatttaaa

SEQ ID NO: 3672271 - DNA, 20 bp, Homo sapiens
aataacatttaaattccaca

SEQ ID NO: 3672272 - DNA, 21 bp, Homo sapiens
aataactggaacaaattattt

SEQ ID NO: 3672273 - DNA, 18 bp, Homo sapiens
aataagtatttctgattt

SEQ ID NO: 3672274 - DNA, 16 bp, Homo sapiens
aatacagtacaggcag

SEQ ID NO: 3672275 - DNA, 20 bp, Homo sapiens
aatacagtatctcagggcct

SEQ ID NO: 3672276 - DNA, 15 bp, Homo sapiens
aatacctcatgcttc

SEQ ID NO: 3672277 - DNA, 15 bp, Homo sapiens
aatactgctgagata

SEQ ID NO: 3672278 - DNA, 18 bp, Homo sapiens
aatactgctgagatacat

SEQ ID NO: 3672279 - DNA, 16 bp, Homo sapiens
aatactttttctaatg

SEQ ID NO: 3672280 - DNA, 14 bp, Homo sapiens
aatagaaaagttat

SEQ ID NO: 3672281 - DNA, 15 bp, Homo sapiens
aatagaaaagttatt

SEQ ID NO: 3672282 - DNA, 23 bp, Homo sapiens
aatagccactgcataccaacctg

SEQ ID NO: 3672283 - DNA, 22 bp, Homo sapiens
aatagcgctgtttttgttgtgt

SEQ ID NO: 3672284 - DNA, 22 bp, Homo sapiens
aataggcattaacacaaaggag

SEQ ID NO: 3672285 - DNA, 14 bp, Homo sapiens
aatagtctagatgg

SEQ ID NO: 3672286 - DNA, 16 bp, Homo sapiens
aatagtctttgccagt

SEQ ID NO: 3672287 - DNA, 14 bp, Homo sapiens
aatagttgttgatt

SEQ ID NO: 3672288 - DNA, 23 bp, Homo sapiens
aatatcctaagactaacaaaggc

SEQ ID NO: 3672289 - DNA, 20 bp, Homo sapiens
aatatctaaagttatatttc

SEQ ID NO: 3672290 - DNA, 19 bp, Homo sapiens
aatatgactttttataaaa

SEQ ID NO: 3672291 - DNA, 20 bp, Homo sapiens
aatatgactttttataaaat

SEQ ID NO: 3672292 - DNA, 19 bp, Homo sapiens
aatatgtaccaagaatctt

SEQ ID NO: 3672293 - DNA, 21 bp, Homo sapiens
aatattaaagtcagaatatta

SEQ ID NO: 3672294 - DNA, 13 bp, Homo sapiens
aatatttcaagtg

SEQ ID NO: 3672295 - DNA, 14 bp, Homo sapiens
aatatttcaagtgc

SEQ ID NO: 3672296 - DNA, 16 bp, Homo sapiens
aatatttcaagtgcct

SEQ ID NO: 3672297 - DNA, 11 bp, Homo sapiens
aatatttctga

SEQ ID NO: 3672298 - DNA, 19 bp, Homo sapiens
aatatttgactttagtgaa

SEQ ID NO: 3672299 - DNA, 16 bp, Homo sapiens
aatattttctatttta

SEQ ID NO: 3672300 - DNA, 22 bp, Homo sapiens
aatattttctctgtacttttca

SEQ ID NO: 3672301 - DNA, 13 bp, Homo sapiens
aatcaacttgctt

SEQ ID NO: 3672302 - DNA, 23 bp, Homo sapiens
aatcaagttggcttctaatcaaa

SEQ ID NO: 3672303 - DNA, 17 bp, Homo sapiens
aatcacccaatcccagt

SEQ ID NO: 3672304 - DNA, 11 bp, Homo sapiens
aatcagaactc

SEQ ID NO: 3672305 - DNA, 12 bp, Homo sapiens
aatcagaactca

SEQ ID NO: 3672306 - DNA, 11 bp, Homo sapiens
aatcagcctgc

SEQ ID NO: 3672307 - DNA, 13 bp, Homo sapiens
aatcagcctgctc

SEQ ID NO: 3672308 - DNA, 18 bp, Homo sapiens
aatcaggaatattttcca

SEQ ID NO: 3672309 - DNA, 16 bp, Homo sapiens
aatcagtgacatctga

SEQ ID NO: 3672310 - DNA, 23 bp, Homo sapiens
aatcatgttgatcatgtactttt

SEQ ID NO: 3672311 - DNA, 13 bp, Homo sapiens
aatcattttcatt

SEQ ID NO: 3672312 - DNA, 18 bp, Homo sapiens
aatcccagttcttcctgc

SEQ ID NO: 3672313 - DNA, 16 bp, Homo sapiens
aatcccgattcaccct

SEQ ID NO: 3672314 - DNA, 13 bp, Homo sapiens
aatcctacagtga

SEQ ID NO: 3672315 - DNA, 17 bp, Homo sapiens
aatctaacaataatatt

SEQ ID NO: 3672316 - DNA, 20 bp, Homo sapiens
aatctaacaataatatttca

SEQ ID NO: 3672317 - DNA, 22 bp, Homo sapiens
aatctagatatcgacttgtttt

SEQ ID NO: 3672318 - DNA, 14 bp, Homo sapiens
aatctgacccagtg

SEQ ID NO: 3672319 - DNA, 18 bp, Homo sapiens
aatctgagaaactctaca

SEQ ID NO: 3672320 - DNA, 23 bp, Homo sapiens
aatctgagcacgctaccaaatct

SEQ ID NO: 3672321 - DNA, 20 bp, Homo sapiens
aatctgtccaaaggaggctg

SEQ ID NO: 3672322 - DNA, 21 bp, Homo sapiens
aatctgtccaaaggaggctgg

SEQ ID NO: 3672323 - DNA, 19 bp, Homo sapiens
aatcttaaggtgtagccac

SEQ ID NO: 3672324 - DNA, 18 bp, Homo sapiens
aatcttaatacttgaact

SEQ ID NO: 3672325 - DNA, 19 bp, Homo sapiens
aatcttaatacttgaactg

SEQ ID NO: 3672326 - DNA, 16 bp, Homo sapiens
aaattacaattttatc

SEQ ID NO: 3672327 - DNA, 21 bp, Homo sapiens
aaattcagcaaaccattttta

SEQ ID NO: 3672328 - DNA, 14 bp, Homo sapiens
aaattcctctttgc

SEQ ID NO: 3672329 - DNA, 19 bp, Homo sapiens
aaattctattacagtatgt

SEQ ID NO: 3672330 - DNA, 14 bp, Homo sapiens
aaatttatatgaaa

SEQ ID NO: 3672331 - DNA, 20 bp, Homo sapiens
aaatttgactaattttacat

SEQ ID NO: 3672332 - DNA, 13 bp, Homo sapiens
aaattttcagcat

SEQ ID NO: 3672333 - DNA, 21 bp, Homo sapiens
aaattttgctatcaacaataa

SEQ ID NO: 3672334 - DNA, 14 bp, Homo sapiens
aaattttgtaatga

SEQ ID NO: 3672335 - DNA, 12 bp, Homo sapiens
aacaaaaaccaa

SEQ ID NO: 3672336 - DNA, 10 bp, Homo sapiens
aacaaaccat

SEQ ID NO: 3672337 - DNA, 12 bp, Homo sapiens
aacaaagccaga

SEQ ID NO: 3672338 - DNA, 14 bp, Homo sapiens
aacaaagccagaag

SEQ ID NO: 3672339 - DNA, 13 bp, Homo sapiens
aacaaaggcagct

SEQ ID NO: 3672340 - DNA, 12 bp, Homo sapiens
aacaaatttttc

SEQ ID NO: 3672341 - DNA, 19 bp, Homo sapiens
aacaaatttttcaaatcat

SEQ ID NO: 3672342 - DNA, 18 bp, Homo sapiens
aacacactgaggcaggga

SEQ ID NO: 3672343 - DNA, 19 bp, Homo sapiens
aacacctctgcacaagctg

SEQ ID NO: 3672344 - DNA, 16 bp, Homo sapiens
aacacgcgtatttaca

SEQ ID NO: 3672345 - DNA, 16 bp, Homo sapiens
aacacttatcttctgg

SEQ ID NO: 3672346 - DNA, 17 bp, Homo sapiens
aacagatatcagtgtct

SEQ ID NO: 3672347 - DNA, 12 bp, Homo sapiens
aacagcctgtgt

SEQ ID NO: 3672348 - DNA, 15 bp, Homo sapiens
aacagcctgtgtctt

SEQ ID NO: 3672349 - DNA, 20 bp, Homo sapiens
aacagcctttgggaaatgct

SEQ ID NO: 3672350 - DNA, 13 bp, Homo sapiens
aacagcgctgggt

SEQ ID NO: 3672351 - DNA, 19 bp, Homo sapiens
aacagctatgggagcccca

SEQ ID NO: 3672352 - DNA, 23 bp, Homo sapiens
aacagtataacaactatttacat

SEQ ID NO: 3672353 - DNA, 16 bp, Homo sapiens
aacagtctaaagaaga

SEQ ID NO: 3672354 - DNA, 16 bp, Homo sapiens
aacagtgaagacagaa

SEQ ID NO: 3672355 - DNA, 17 bp, Homo sapiens
aacagtgaagacagaag

SEQ ID NO: 3672356 - DNA, 20 bp, Homo sapiens
aacagttttcctatgctttg

SEQ ID NO: 3672357 - DNA, 15 bp, Homo sapiens
aacatatatatacta

SEQ ID NO: 3672358 - DNA, 19 bp, Homo sapiens
aacatcattactataagaa

SEQ ID NO: 3672359 - DNA, 21 bp, Homo sapiens
aacatctttttaacctgcaaa

SEQ ID NO: 3672360 - DNA, 21 bp, Homo sapiens
aacatgagcgctactcttgga

SEQ ID NO: 3672361 - DNA, 17 bp, Homo sapiens
aacatgtataatatttt

SEQ ID NO: 3672362 - DNA, 14 bp, Homo sapiens
aacatttaaattcc

SEQ ID NO: 3672363 - DNA, 22 bp, Homo sapiens
aacattttaaaaacatagaaaa

SEQ ID NO: 3672364 - DNA, 15 bp, Homo sapiens
aaccaaatgtttatt

SEQ ID NO: 3672365 - DNA, 21 bp, Homo sapiens
aaccaaatgtttattttctac

SEQ ID NO: 3672366 - DNA, 23 bp, Homo sapiens
aaccacaccacatctaagcctga

SEQ ID NO: 3672367 - DNA, 16 bp, Homo sapiens
aaccaccaaaaacaaa

SEQ ID NO: 3672368 - DNA, 17 bp, Homo sapiens
aaccactctgtggccag

SEQ ID NO: 3672369 - DNA, 23 bp, Homo sapiens
aaccactctgtggccagcctggc

SEQ ID NO: 3672370 - DNA, 16 bp, Homo sapiens
aaccaggcacctcttc

SEQ ID NO: 3672371 - DNA, 18 bp, Homo sapiens
aacccagactcagacatt

SEQ ID NO: 3672372 - DNA, 17 bp, Homo sapiens
aacccaggcagctggca

SEQ ID NO: 3672373 - DNA, 21 bp, Homo sapiens
aacccaggcagctggcaggag

SEQ ID NO: 3672374 - DNA, 13 bp, Homo sapiens
aacccccacccca

SEQ ID NO: 3672375 - DNA, 17 bp, Homo sapiens
aacccccaccccacact

SEQ ID NO: 3672376 - DNA, 18 bp, Homo sapiens
aaccccccgactgtgctg

SEQ ID NO: 3672377 - DNA, 17 bp, Homo sapiens
aacccgacagagggaag

SEQ ID NO: 3672378 - DNA, 16 bp, Homo sapiens
aacccgaggcccgcat

SEQ ID NO: 3672379 - DNA, 15 bp, Homo sapiens
aaccctattggtaaa

SEQ ID NO: 3672380 - DNA, 21 bp, Homo sapiens
aacccttaccccttagcctcc

SEQ ID NO: 3672381 - DNA, 21 bp, Homo sapiens
aaccgcaggaagctgctccgt

SEQ ID NO: 3672382 - DNA, 13 bp, Homo sapiens
aaccgccctcctg

SEQ ID NO: 3672383 - DNA, 16 bp, Homo sapiens
aacctcagcctggcca

SEQ ID NO: 3672384 - DNA, 12 bp, Homo sapiens
aacctcttcccc

SEQ ID NO: 3672385 - DNA, 14 bp, Homo sapiens
aacctcttccccag

SEQ ID NO: 3672386 - DNA, 21 bp, Homo sapiens
aacctgcaaaaaatacttttt

SEQ ID NO: 3672387 - DNA, 16 bp, Homo sapiens
aaccttgtcccagcca

SEQ ID NO: 3672388 - DNA, 12 bp, Homo sapiens
aacctttctgtg

SEQ ID NO: 3672389 - DNA, 19 bp, Homo sapiens
aacggaggcctgcgaccct

SEQ ID NO: 3672390 - DNA, 23 bp, Homo sapiens
aacggaggcctgcgaccctgggg

SEQ ID NO: 3672391 - DNA, 18 bp, Homo sapiens
aactaattgactttagaa

SEQ ID NO: 3672392 - DNA, 20 bp, Homo sapiens
aactacaaccaatggaatgt

SEQ ID NO: 3672393 - DNA, 12 bp, Homo sapiens
aactacagaaaa

SEQ ID NO: 3672394 - DNA, 23 bp, Homo sapiens
aactagactcccaagctggacta

SEQ ID NO: 3672395 - DNA, 14 bp, Homo sapiens
aactagtgtacatt

SEQ ID NO: 3672396 - DNA, 21 bp, Homo sapiens
aactatctgttcccttcctct

SEQ ID NO: 3672397 - DNA, 23 bp, Homo sapiens
aactatgcatggtgccccaggac

SEQ ID NO: 3672398 - DNA, 15 bp, Homo sapiens
aactatgttgataaa

SEQ ID NO: 3672399 - DNA, 14 bp, Homo sapiens
aactatttcttcag

SEQ ID NO: 3672400 - DNA, 18 bp, Homo sapiens
aactcaaatggggccaga

SEQ ID NO: 3672401 - DNA, 23 bp, Homo sapiens
aactcaaatggggccagatccag

SEQ ID NO: 3672402 - DNA, 22 bp, Homo sapiens
aactcagatccagggacagagg

SEQ ID NO: 3672403 - DNA, 22 bp, Homo sapiens
aactcctacctgaaggcagggc

SEQ ID NO: 3672404 - DNA, 15 bp, Homo sapiens
aactcttcactcttc

SEQ ID NO: 3672405 - DNA, 20 bp, Homo sapiens
aactgaagcagcctctcccc

SEQ ID NO: 3672406 - DNA, 16 bp, Homo sapiens
aactgcacactcagtg

SEQ ID NO: 3672407 - DNA, 14 bp, Homo sapiens
aactgcaggccctg

SEQ ID NO: 3672408 - DNA, 18 bp, Homo sapiens
aactgcaggccctggcct

SEQ ID NO: 3672409 - DNA, 19 bp, Homo sapiens
aactgcaggccctggcctc

SEQ ID NO: 3672410 - DNA, 16 bp, Homo sapiens
aactgcagtgatgtat

SEQ ID NO: 3672411 - DNA, 20 bp, Homo sapiens
aactgctgactgttttctct

SEQ ID NO: 3672412 - DNA, 15 bp, Homo sapiens
aactggaagaaagca

SEQ ID NO: 3672413 - DNA, 21 bp, Homo sapiens
aactggtgcactttgtaaatt

SEQ ID NO: 3672414 - DNA, 13 bp, Homo sapiens
aactgtaatacaa

SEQ ID NO: 3672415 - DNA, 23 bp, Homo sapiens
aactgttacaacttgtatttcca

SEQ ID NO: 3672416 - DNA, 20 bp, Homo sapiens
aacttagtgacaaaatagac

SEQ ID NO: 3672417 - DNA, 13 bp, Homo sapiens
aacttcccctcta

SEQ ID NO: 3672418 - DNA, 19 bp, Homo sapiens
aacttctgaactttggaag

SEQ ID NO: 3672419 - DNA, 15 bp, Homo sapiens
aacttgaccctgagc

SEQ ID NO: 3672420 - DNA, 19 bp, Homo sapiens
aacttgaccctgagctgac

SEQ ID NO: 3672421 - DNA, 18 bp, Homo sapiens
aacttgcttatcaacttc

SEQ ID NO: 3672422 - DNA, 12 bp, Homo sapiens
aacttgggaact

SEQ ID NO: 3672423 - DNA, 23 bp, Homo sapiens
aacttggtcagagccactctatg

SEQ ID NO: 3672424 - DNA, 15 bp, Homo sapiens
aacttgtaaatgtgg

SEQ ID NO: 3672425 - DNA, 15 bp, Homo sapiens
aacttgtatttccaa

SEQ ID NO: 3672426 - DNA, 18 bp, Homo sapiens
aagaaaaagaaaaagaaa

SEQ ID NO: 3672427 - DNA, 16 bp, Homo sapiens
aagaaaacctcatgga

SEQ ID NO: 3672428 - DNA, 17 bp, Homo sapiens
aagaaaacctcatggag

SEQ ID NO: 3672429 - DNA, 13 bp, Homo sapiens
aagaaaagacctt

SEQ ID NO: 3672430 - DNA, 22 bp, Homo sapiens
aagaaacacactgaggcaggga

SEQ ID NO: 3672431 - DNA, 15 bp, Homo sapiens
aagaaacctactgcc

SEQ ID NO: 3672432 - DNA, 17 bp, Homo sapiens
aagaaagatgtatatag

SEQ ID NO: 3672433 - DNA, 16 bp, Homo sapiens
aagaaattaaggaaca

SEQ ID NO: 3672434 - DNA, 17 bp, Homo sapiens
aagaaccagtcccccca

SEQ ID NO: 3672435 - DNA, 18 bp, Homo sapiens
aagaactgcaggccctgg

SEQ ID NO: 3672436 - DNA, 20 bp, Homo sapiens
aagaactgtcatgtaaacat

SEQ ID NO: 3672437 - DNA, 22 bp, Homo sapiens
aagaactgtcatgtaaacatac

SEQ ID NO: 3672438 - DNA, 20 bp, Homo sapiens
aagaactttgagctactgcc

SEQ ID NO: 3672439 - DNA, 13 bp, Homo sapiens
aagaagaagaagg

SEQ ID NO: 3672440 - DNA, 15 bp, Homo sapiens
aagaagaaggagagc

SEQ ID NO: 3672441 - DNA, 13 bp, Homo sapiens
aagaagacttttt

SEQ ID NO: 3672442 - DNA, 19 bp, Homo sapiens
aagaagcccccagctaaga

SEQ ID NO: 3672443 - DNA, 19 bp, Homo sapiens
aagaataggcattaacaca

SEQ ID NO: 3672444 - DNA, 14 bp, Homo sapiens
aagaatatgacttt

SEQ ID NO: 3672445 - DNA, 13 bp, Homo sapiens
aatcttggtttgc

SEQ ID NO: 3672446 - DNA, 14 bp, Homo sapiens
aatgaagttggggt

SEQ ID NO: 3672447 - DNA, 19 bp, Homo sapiens
aatgaatctttgactgaag

SEQ ID NO: 3672448 - DNA, 17 bp, Homo sapiens
aatgaatgcataaaatg

SEQ ID NO: 3672449 - DNA, 13 bp, Homo sapiens
aatgaatggggag

SEQ ID NO: 3672450 - DNA, 21 bp, Homo sapiens
aatgaattcctagaattaaac

SEQ ID NO: 3672451 - DNA, 21 bp, Homo sapiens
aatgactgccctgtttctgtt

SEQ ID NO: 3672452 - DNA, 11 bp, Homo sapiens
aatgagcctgg

SEQ ID NO: 3672453 - DNA, 13 bp, Homo sapiens
aatgagcctggca

SEQ ID NO: 3672454 - DNA, 19 bp, Homo sapiens
aatgaggagagaaaatata

SEQ ID NO: 3672455 - DNA, 19 bp, Homo sapiens
aatgaggcggagctccagg

SEQ ID NO: 3672456 - DNA, 19 bp, Homo sapiens
aatgatcctgtattcagac

SEQ ID NO: 3672457 - DNA, 13 bp, Homo sapiens
aatgatttttaaa

SEQ ID NO: 3672458 - DNA, 16 bp, Homo sapiens
aatgcataaaatgtta

SEQ ID NO: 3672459 - DNA, 20 bp, Homo sapiens
aatgcatctcatcaacttaa

SEQ ID NO: 3672460 - DNA, 23 bp, Homo sapiens
aatgccagtaacgcgtcttcctg

SEQ ID NO: 3672461 - DNA, 22 bp, Homo sapiens
aatgccatgatgcctctgtctt

SEQ ID NO: 3672462 - DNA, 22 bp, Homo sapiens
aatgcctgactagggagccatg

SEQ ID NO: 3672463 - DNA, 23 bp, Homo sapiens
aatgctataactatgttgataaa

SEQ ID NO: 3672464 - DNA, 12 bp, Homo sapiens
aatgctccaggc

SEQ ID NO: 3672465 - DNA, 11 bp, Homo sapiens
aatgctctagt

SEQ ID NO: 3672466 - DNA, 21 bp, Homo sapiens
aatggaatgtgatgttcatgg

SEQ ID NO: 3672467 - DNA, 16 bp, Homo sapiens
aatggagctttctgta

SEQ ID NO: 3672468 - DNA, 19 bp, Homo sapiens
aatggcacagcccaaagaa

SEQ ID NO: 3672469 - DNA, 12 bp, Homo sapiens
aatgggaagcag

SEQ ID NO: 3672470 - DNA, 16 bp, Homo sapiens
aatgggaagcagggaa

SEQ ID NO: 3672471 - DNA, 13 bp, Homo sapiens
aatggggccagat

SEQ ID NO: 3672472 - DNA, 18 bp, Homo sapiens
aatggggtcctggccatc

SEQ ID NO: 3672473 - DNA, 19 bp, Homo sapiens
aatggtccgctttcctgga

SEQ ID NO: 3672474 - DNA, 17 bp, Homo sapiens
aatggtttgcaaggaag

SEQ ID NO: 3672475 - DNA, 14 bp, Homo sapiens
aatgtaaagccatg

SEQ ID NO: 3672476 - DNA, 16 bp, Homo sapiens
aatgtaggcttagttt

SEQ ID NO: 3672477 - DNA, 16 bp, Homo sapiens
aatgtattataacttt

SEQ ID NO: 3672478 - DNA, 18 bp, Homo sapiens
aatgtcatatactgccat

SEQ ID NO: 3672479 - DNA, 17 bp, Homo sapiens
aatgtcctccagaagcc

SEQ ID NO: 3672480 - DNA, 17 bp, Homo sapiens
aatgtcttgctgttgac

SEQ ID NO: 3672481 - DNA, 23 bp, Homo sapiens
aatgtcttgctgttgacatattt

SEQ ID NO: 3672482 - DNA, 15 bp, Homo sapiens
aatgtgaaaagaaaa

SEQ ID NO: 3672483 - DNA, 19 bp, Homo sapiens
aatgttatcttatactgta

SEQ ID NO: 3672484 - DNA, 21 bp, Homo sapiens
aatgttatcttatactgtaca

SEQ ID NO: 3672485 - DNA, 19 bp, Homo sapiens
aatgttgattacagtgcag

SEQ ID NO: 3672486 - DNA, 22 bp, Homo sapiens
aatgttgtttcctaatatcaaa

SEQ ID NO: 3672487 - DNA, 23 bp, Homo sapiens
aatgttgtttcctaatatcaaat

SEQ ID NO: 3672488 - DNA, 13 bp, Homo sapiens
aatgtttaaaaca

SEQ ID NO: 3672489 - DNA, 15 bp, Homo sapiens
aatgtttaaacattt

SEQ ID NO: 3672490 - DNA, 14 bp, Homo sapiens
aatgttttaaatgt

SEQ ID NO: 3672491 - DNA, 13 bp, Homo sapiens
aatgttttctttg

SEQ ID NO: 3672492 - DNA, 16 bp, Homo sapiens
aatgttttctttgcaa

SEQ ID NO: 3672493 - DNA, 17 bp, Homo sapiens
aatgttttctttgcaaa

SEQ ID NO: 3672494 - DNA, 18 bp, Homo sapiens
aattaatcatctggattt

SEQ ID NO: 3672495 - DNA, 14 bp, Homo sapiens
aattacaattttat

SEQ ID NO: 3672496 - DNA, 23 bp, Homo sapiens
aattacacagtaagtcatttaac

SEQ ID NO: 3672497 - DNA, 14 bp, Homo sapiens
aattacttggcttt

SEQ ID NO: 3672498 - DNA, 18 bp, Homo sapiens
aattatagtttgacaggg

SEQ ID NO: 3672499 - DNA, 12 bp, Homo sapiens
aattcactctga

SEQ ID NO: 3672500 - DNA, 23 bp, Homo sapiens
aattcactctgagtgttttatga

SEQ ID NO: 3672501 - DNA, 14 bp, Homo sapiens
aattccccaccctg

SEQ ID NO: 3672502 - DNA, 18 bp, Homo sapiens
aattcctctttgctttgc

SEQ ID NO: 3672503 - DNA, 19 bp, Homo sapiens
aattcctctttgctttgct

SEQ ID NO: 3672504 - DNA, 13 bp, Homo sapiens
aattcctggaacc

SEQ ID NO: 3672505 - DNA, 18 bp, Homo sapiens
aattcctggaacctggac

SEQ ID NO: 3672506 - DNA, 19 bp, Homo sapiens
aattcctggaacctggacc

SEQ ID NO: 3672507 - DNA, 12 bp, Homo sapiens
aattctctttct

SEQ ID NO: 3672508 - DNA, 14 bp, Homo sapiens
aattctgtttttct

SEQ ID NO: 3672509 - DNA, 20 bp, Homo sapiens
aattcttaaaaaattgaaaa

SEQ ID NO: 3672510 - DNA, 21 bp, Homo sapiens
aattgaagaagcctcacacgt

SEQ ID NO: 3672511 - DNA, 11 bp, Homo sapiens
aattgctttga

SEQ ID NO: 3672512 - DNA, 23 bp, Homo sapiens
aattgctttgccaaaataccaga

SEQ ID NO: 3672513 - DNA, 16 bp, Homo sapiens
aattgctttgtgactt

SEQ ID NO: 3672514 - DNA, 22 bp, Homo sapiens
aattgtaccttttttgtttttt

SEQ ID NO: 3672515 - DNA, 16 bp, Homo sapiens
aattgtactaaagcca

SEQ ID NO: 3672516 - DNA, 20 bp, Homo sapiens
aattgttgaacaggtgtttt

SEQ ID NO: 3672517 - DNA, 20 bp, Homo sapiens
aattgtttcaaaataaaaac

SEQ ID NO: 3672518 - DNA, 15 bp, Homo sapiens
aatttaagcttaagc

SEQ ID NO: 3672519 - DNA, 22 bp, Homo sapiens
aatttagaaactaattgacttt

SEQ ID NO: 3672520 - DNA, 15 bp, Homo sapiens
aatttagtaaatgtt

SEQ ID NO: 3672521 - DNA, 20 bp, Homo sapiens
aatttagtaaatgttatctt

SEQ ID NO: 3672522 - DNA, 20 bp, Homo sapiens
aatttagtttgtactcagtg

SEQ ID NO: 3672523 - DNA, 21 bp, Homo sapiens
aatttagtttgtactcagtgg

SEQ ID NO: 3672524 - DNA, 17 bp, Homo sapiens
aatttatcacacttctg

SEQ ID NO: 3672525 - DNA, 17 bp, Homo sapiens
aatttattgtctgtcta

SEQ ID NO: 3672526 - DNA, 20 bp, Homo sapiens
aatttattgtctgtctacat

SEQ ID NO: 3672527 - DNA, 16 bp, Homo sapiens
aatttcccaggaccct

SEQ ID NO: 3672528 - DNA, 21 bp, Homo sapiens
aatttcctggccctccactcc

SEQ ID NO: 3672529 - DNA, 12 bp, Homo sapiens
aattttaattta

SEQ ID NO: 3672530 - DNA, 14 bp, Homo sapiens
aattttaatttagt

SEQ ID NO: 3672531 - DNA, 20 bp, Homo sapiens
aattttacatgtttataaat

SEQ ID NO: 3672532 - DNA, 12 bp, Homo sapiens
aattttatttat

SEQ ID NO: 3672533 - DNA, 21 bp, Homo sapiens
aattttctttttaataaaaag

SEQ ID NO: 3672534 - DNA, 13 bp, Homo sapiens
aattttgtaatga

SEQ ID NO: 3672535 - DNA, 11 bp, Homo sapiens
aattttttcct

SEQ ID NO: 3672536 - DNA, 20 bp, Homo sapiens
aattttttggtacaaaaata

SEQ ID NO: 3672537 - DNA, 20 bp, Homo sapiens
acaaaaaccaaatgtttatt

SEQ ID NO: 3672538 - DNA, 15 bp, Homo sapiens
acaaaaagacaaaca

SEQ ID NO: 3672539 - DNA, 20 bp, Homo sapiens
acaaaaataaatttatatga

SEQ ID NO: 3672540 - DNA, 19 bp, Homo sapiens
acaaacatgtggttaatgc

SEQ ID NO: 3672541 - DNA, 17 bp, Homo sapiens
acaaactgtaatacaat

SEQ ID NO: 3672542 - DNA, 15 bp, Homo sapiens
acaaagacattgatt

SEQ ID NO: 3672543 - DNA, 16 bp, Homo sapiens
acaaagccagaagctg

SEQ ID NO: 3672544 - DNA, 11 bp, Homo sapiens
acaaagcccaa

SEQ ID NO: 3672545 - DNA, 13 bp, Homo sapiens
acaaagcccaagg

SEQ ID NO: 3672546 - DNA, 12 bp, Homo sapiens
acaaaggcagct

SEQ ID NO: 3672547 - DNA, 14 bp, Homo sapiens
acaaaggcagctgt

SEQ ID NO: 3672548 - DNA, 23 bp, Homo sapiens
acaaaggcagctgtgtctgagcc

SEQ ID NO: 3672549 - DNA, 14 bp, Homo sapiens
acaaatgtaaacat

SEQ ID NO: 3672550 - DNA, 13 bp, Homo sapiens
acaaatgtatgat

SEQ ID NO: 3672551 - DNA, 14 bp, Homo sapiens
acaacgaggaagcc

SEQ ID NO: 3672552 - DNA, 15 bp, Homo sapiens
acaacgaggaagccc

SEQ ID NO: 3672553 - DNA, 13 bp, Homo sapiens
acaacggaggcct

SEQ ID NO: 3672554 - DNA, 15 bp, Homo sapiens
acaactattttcaga

SEQ ID NO: 3672555 - DNA, 19 bp, Homo sapiens
acaactgaaacctaggaag

SEQ ID NO: 3672556 - DNA, 19 bp, Homo sapiens
acaactggcaggcaggctc

SEQ ID NO: 3672557 - DNA, 17 bp, Homo sapiens
acaactttaagaggaca

SEQ ID NO: 3672558 - DNA, 16 bp, Homo sapiens
acaagagcagcctgtg

SEQ ID NO: 3672559 - DNA, 14 bp, Homo sapiens
acaagccagaactt

SEQ ID NO: 3672560 - DNA, 14 bp, Homo sapiens
acaagcctgagaac

SEQ ID NO: 3672561 - DNA, 15 bp, Homo sapiens
acaaggacttcctgt

SEQ ID NO: 3672562 - DNA, 18 bp, Homo sapiens
acaaggatagatgctggc

SEQ ID NO: 3672563 - DNA, 22 bp, Homo sapiens
acaagtcagctccagctttctg

SEQ ID NO: 3672564 - DNA, 14 bp, Homo sapiens
acaagtgctgaaca

SEQ ID NO: 3672565 - DNA, 14 bp, Homo sapiens
acaataaaattttt

SEQ ID NO: 3672566 - DNA, 15 bp, Homo sapiens
acaatctagtaatgt

SEQ ID NO: 3672567 - DNA, 20 bp, Homo sapiens
acaatctggcttagtgccac

SEQ ID NO: 3672568 - DNA, 18 bp, Homo sapiens
acaatggtttttaaattt

SEQ ID NO: 3672569 - DNA, 19 bp, Homo sapiens
acaatgtgaaaagaaaaat

SEQ ID NO: 3672570 - DNA, 15 bp, Homo sapiens
acaattctgttttta

SEQ ID NO: 3672571 - DNA, 15 bp, Homo sapiens
acacaaaggcatgct

SEQ ID NO: 3672572 - DNA, 23 bp, Homo sapiens
acacaaggatagatgctggccca

SEQ ID NO: 3672573 - DNA, 15 bp, Homo sapiens
acacaaggtgatttc

SEQ ID NO: 3672574 - DNA, 17 bp, Homo sapiens
acacaaggtgatttcag

SEQ ID NO: 3672575 - DNA, 18 bp, Homo sapiens
acacaaggtgatttcaga

SEQ ID NO: 3672576 - DNA, 23 bp, Homo sapiens
acacaatggtttttaaattttgt

SEQ ID NO: 3672577 - DNA, 13 bp, Homo sapiens
acacacacaaacc

SEQ ID NO: 3672578 - DNA, 10 bp, Homo sapiens
acacacacac

SEQ ID NO: 3672579 - DNA, 15 bp, Homo sapiens
acacacacacaaacc

SEQ ID NO: 3672580 - DNA, 15 bp, Homo sapiens
acacacagatacaca

SEQ ID NO: 3672581 - DNA, 18 bp, Homo sapiens
acacaccattttgtaagt

SEQ ID NO: 3672582 - DNA, 11 bp, Homo sapiens
acacacctgta

SEQ ID NO: 3672583 - DNA, 16 bp, Homo sapiens
acacactgaggcaggg

SEQ ID NO: 3672584 - DNA, 18 bp, Homo sapiens
acacactgaggcagggaa

SEQ ID NO: 3672585 - DNA, 23 bp, Homo sapiens
acacagacattctgccaggcccc

SEQ ID NO: 3672586 - DNA, 15 bp, Homo sapiens
acacaggtctttcct

SEQ ID NO: 3672587 - DNA, 18 bp, Homo sapiens
acacatttcacttttctg

SEQ ID NO: 3672588 - DNA, 19 bp, Homo sapiens
acaccagcattccttttga

SEQ ID NO: 3672589 - DNA, 15 bp, Homo sapiens
acacccaagagggct

SEQ ID NO: 3672590 - DNA, 20 bp, Homo sapiens
acaccgccatcctctgcctc

SEQ ID NO: 3672591 - DNA, 21 bp, Homo sapiens
acacctcagttcccttggcct

SEQ ID NO: 3672592 - DNA, 19 bp, Homo sapiens
acacctctgcacaagctgc

SEQ ID NO: 3672593 - DNA, 15 bp, Homo sapiens
acaccttatatttac

SEQ ID NO: 3672594 - DNA, 21 bp, Homo sapiens
acactcagtgggctgtttctg

SEQ ID NO: 3672595 - DNA, 14 bp, Homo sapiens
acactccatcagct

SEQ ID NO: 3672596 - DNA, 16 bp, Homo sapiens
acactccatcagctta

SEQ ID NO: 3672597 - DNA, 19 bp, Homo sapiens
acactgcttgtgtttttaa

SEQ ID NO: 3672598 - DNA, 14 bp, Homo sapiens
acactgttctgaaa

SEQ ID NO: 3672599 - DNA, 19 bp, Homo sapiens
acacttatcttctggatta

SEQ ID NO: 3672600 - DNA, 23 bp, Homo sapiens
acacttgatggagtgtgagccac

SEQ ID NO: 3672601 - DNA, 13 bp, Homo sapiens
acacttgcaacct

SEQ ID NO: 3672602 - DNA, 20 bp, Homo sapiens
acacttgttccagctctttg

SEQ ID NO: 3672603 - DNA, 15 bp, Homo sapiens
acagaagtttgcact

SEQ ID NO: 3672604 - DNA, 18 bp, Homo sapiens
acagaatgtgataaggaa

SEQ ID NO: 3672605 - DNA, 13 bp, Homo sapiens
acagacaggctct

SEQ ID NO: 3672606 - DNA, 15 bp, Homo sapiens
acagacaggctctta

SEQ ID NO: 3672607 - DNA, 17 bp, Homo sapiens
acagagaaaacttgcct

SEQ ID NO: 3672608 - DNA, 21 bp, Homo sapiens
acagagcaagtgagaccctgt

SEQ ID NO: 3672609 - DNA, 22 bp, Homo sapiens
acagaggccccagcctccctga

SEQ ID NO: 3672610 - DNA, 15 bp, Homo sapiens
acagagggaagaaaa

SEQ ID NO: 3672611 - DNA, 16 bp, Homo sapiens
acagagggaagaaaag

SEQ ID NO: 3672612 - DNA, 20 bp, Homo sapiens
acagatctggaacctcagcc

SEQ ID NO: 3672613 - DNA, 17 bp, Homo sapiens
acagatgccccagagct

SEQ ID NO: 3672614 - DNA, 19 bp, Homo sapiens
acagatgccccagagctgt

SEQ ID NO: 3672615 - DNA, 19 bp, Homo sapiens
acagatggaaaaactgagg

SEQ ID NO: 3672616 - DNA, 19 bp, Homo sapiens
acagattgggcggggcttc

SEQ ID NO: 3672617 - DNA, 19 bp, Homo sapiens
acagcaaggtgtggaggct

SEQ ID NO: 3672618 - DNA, 22 bp, Homo sapiens
acagcaaggtgtggaggctcct

SEQ ID NO: 3672619 - DNA, 16 bp, Homo sapiens
acagcacttcaaagaa

SEQ ID NO: 3672620 - DNA, 13 bp, Homo sapiens
acagccagcacct

SEQ ID NO: 3672621 - DNA, 16 bp, Homo sapiens
acagccagcacctggc

SEQ ID NO: 3672622 - DNA, 19 bp, Homo sapiens
acagcccaaagaaggaaaa

SEQ ID NO: 3672623 - DNA, 12 bp, Homo sapiens
acagcgctgggt

SEQ ID NO: 3672624 - DNA, 13 bp, Homo sapiens
acagctagcccca

SEQ ID NO: 3672625 - DNA, 10 bp, Homo sapiens
acagctgctc

SEQ ID NO: 3672626 - DNA, 18 bp, Homo sapiens
acagcttcagccaggagc

SEQ ID NO: 3672627 - DNA, 21 bp, Homo sapiens
acagcttcagccaggagctgg

SEQ ID NO: 3672628 - DNA, 22 bp, Homo sapiens
acagcttcagccaggagctggg

SEQ ID NO: 3672629 - DNA, 20 bp, Homo sapiens
acagcttcccctctctcctc

SEQ ID NO: 3672630 - DNA, 19 bp, Homo sapiens
acagcttgacctgaggctg

SEQ ID NO: 3672631 - DNA, 23 bp, Homo sapiens
acagcttgacctgaggctgtggt

SEQ ID NO: 3672632 - DNA, 12 bp, Homo sapiens
acagctttgctg

SEQ ID NO: 3672633 - DNA, 15 bp, Homo sapiens
acagctttgctgctg

SEQ ID NO: 3672634 - DNA, 20 bp, Homo sapiens
acaggaagcaccccatgcca

SEQ ID NO: 3672635 - DNA, 22 bp, Homo sapiens
acaggagagttagtcgccctac

SEQ ID NO: 3672636 - DNA, 14 bp, Homo sapiens
acaggagctgggat

SEQ ID NO: 3672637 - DNA, 16 bp, Homo sapiens
acaggatgtgtttgct

SEQ ID NO: 3672638 - DNA, 21 bp, Homo sapiens
acaggatgtgtttgctttctg

SEQ ID NO: 3672639 - DNA, 13 bp, Homo sapiens
acaggcagcacag

SEQ ID NO: 3672640 - DNA, 22 bp, Homo sapiens
acaggccctccctgttccccag

SEQ ID NO: 3672641 - DNA, 23 bp, Homo sapiens
acaggccctccctgttccccaga

SEQ ID NO: 3672642 - DNA, 13 bp, Homo sapiens
acaggctcttagc

SEQ ID NO: 3672643 - DNA, 13 bp, Homo sapiens
acagggcttctcc

SEQ ID NO: 3672644 - DNA, 22 bp, Homo sapiens
acagggtctgctctttctctgc

SEQ ID NO: 3672645 - DNA, 24 bp, Homo sapiens
acagggtctgctctttctctgcca

SEQ ID NO: 3672646 - DNA, 15 bp, Homo sapiens
acagggtgggcctcg

SEQ ID NO: 3672647 - DNA, 22 bp, Homo sapiens
acaggtcaatacagtacaggca

SEQ ID NO: 3672648 - DNA, 19 bp, Homo sapiens
acaggtgaaagtttttctg

SEQ ID NO: 3672649 - DNA, 17 bp, Homo sapiens
acaggtgttggtgacaa

SEQ ID NO: 3672650 - DNA, 16 bp, Homo sapiens
acagtacaggcagcac

SEQ ID NO: 3672651 - DNA, 18 bp, Homo sapiens
acagtgaagacagaagtt

SEQ ID NO: 3672652 - DNA, 20 bp, Homo sapiens
acagtggagctgaattttct

SEQ ID NO: 3672653 - DNA, 21 bp, Homo sapiens
acagtggagctgaattttctg

SEQ ID NO: 3672654 - DNA, 17 bp, Homo sapiens
acagtgggagccagggc

SEQ ID NO: 3672655 - DNA, 22 bp, Homo sapiens
acagttctttgggccagacatg

SEQ ID NO: 3672656 - DNA, 20 bp, Homo sapiens
acataattcactctgagtgt

SEQ ID NO: 3672657 - DNA, 13 bp, Homo sapiens
acatacaccagca

SEQ ID NO: 3672658 - DNA, 15 bp, Homo sapiens
acatacaccagcatt

SEQ ID NO: 3672659 - DNA, 18 bp, Homo sapiens
acatacagaattactgta

SEQ ID NO: 3672660 - DNA, 16 bp, Homo sapiens
acatacttgaagggcc

SEQ ID NO: 3672661 - DNA, 20 bp, Homo sapiens
acatacttgaagggccagag

SEQ ID NO: 3672662 - DNA, 12 bp, Homo sapiens
acatagaaatgg

SEQ ID NO: 3672663 - DNA, 20 bp, Homo sapiens
acatagaaatggaaattttg

SEQ ID NO: 3672664 - DNA, 22 bp, Homo sapiens
acatagaaatggaaattttgct

SEQ ID NO: 3672665 - DNA, 14 bp, Homo sapiens
acatagtattcatg

SEQ ID NO: 3672666 - DNA, 14 bp, Homo sapiens
acatatttaactgg

SEQ ID NO: 3672667 - DNA, 20 bp, Homo sapiens
acatatttaactggtgcact

SEQ ID NO: 3672668 - DNA, 14 bp, Homo sapiens
acatatttaatgtt

SEQ ID NO: 3672669 - DNA, 16 bp, Homo sapiens
acatatttaatgtttt

SEQ ID NO: 3672670 - DNA, 21 bp, Homo sapiens
acatatttaatgttttaaatg

SEQ ID NO: 3672671 - DNA, 15 bp, Homo sapiens
acatcacagggtggg

SEQ ID NO: 3672672 - DNA, 18 bp, Homo sapiens
acatcacagggtgggcct

SEQ ID NO: 3672673 - DNA, 17 bp, Homo sapiens
acatccgcgtgtgcctg

SEQ ID NO: 3672674 - DNA, 15 bp, Homo sapiens
acatcctcctcccac

SEQ ID NO: 3672675 - DNA, 16 bp, Homo sapiens
acatctatgtgtatgt

SEQ ID NO: 3672676 - DNA, 17 bp, Homo sapiens
acatctatgtgtatgtt

SEQ ID NO: 3672677 - DNA, 16 bp, Homo sapiens
acatcttatagatgca

SEQ ID NO: 3672678 - DNA, 18 bp, Homo sapiens
acatgagcgctactcttg

SEQ ID NO: 3672679 - DNA, 18 bp, Homo sapiens
acatgcagcccatgccca

SEQ ID NO: 3672680 - DNA, 14 bp, Homo sapiens
acatggatatgtat

SEQ ID NO: 3672681 - DNA, 22 bp, Homo sapiens
acatggctccggcctctgcctt

SEQ ID NO: 3672682 - DNA, 21 bp, Homo sapiens
acatggtaaacgctgtcccta

SEQ ID NO: 3672683 - DNA, 23 bp, Homo sapiens
acatgtccagcaccttgtgcctg

SEQ ID NO: 3672684 - DNA, 18 bp, Homo sapiens
acatgtggggccaggtca

SEQ ID NO: 3672685 - DNA, 13 bp, Homo sapiens
acatgtttataaa

SEQ ID NO: 3672686 - DNA, 15 bp, Homo sapiens
acattagaagacaat

SEQ ID NO: 3672687 - DNA, 21 bp, Homo sapiens
acattagaagacaattgacaa

SEQ ID NO: 3672688 - DNA, 22 bp, Homo sapiens
acattccaactcgtatagcatg

SEQ ID NO: 3672689 - DNA, 17 bp, Homo sapiens
acattgcctttgaatgt

SEQ ID NO: 3672690 - DNA, 23 bp, Homo sapiens
acattgcctttgaatgttaattt

SEQ ID NO: 3672691 - DNA, 21 bp, Homo sapiens
acattggcacctaatccaggc

SEQ ID NO: 3672692 - DNA, 22 bp, Homo sapiens
acattgtctcctatatatttct

SEQ ID NO: 3672693 - DNA, 15 bp, Homo sapiens
acatttcattagcca

SEQ ID NO: 3672694 - DNA, 15 bp, Homo sapiens
acatttctataaata

SEQ ID NO: 3672695 - DNA, 20 bp, Homo sapiens
acatttctctaactcctgcc

SEQ ID NO: 3672696 - DNA, 16 bp, Homo sapiens
acatttttgtctgtcc

SEQ ID NO: 3672697 - DNA, 12 bp, Homo sapiens
accaaaaacaaa

SEQ ID NO: 3672698 - DNA, 20 bp, Homo sapiens
accaaaccccacttcccctc

SEQ ID NO: 3672699 - DNA, 15 bp, Homo sapiens
accaaatctggaagc

SEQ ID NO: 3672700 - DNA, 15 bp, Homo sapiens
accaagaaagctcac

SEQ ID NO: 3672701 - DNA, 24 bp, Homo sapiens
accaagcaggaagctcagactggt

SEQ ID NO: 3672702 - DNA, 20 bp, Homo sapiens
accaagccaagggaacctgt

SEQ ID NO: 3672703 - DNA, 17 bp, Homo sapiens
accaagcttagtcctgg

SEQ ID NO: 3672704 - DNA, 19 bp, Homo sapiens
accaagcttagtcctggga

SEQ ID NO: 3672705 - DNA, 21 bp, Homo sapiens
accaagcttagtcctgggaga

SEQ ID NO: 3672706 - DNA, 14 bp, Homo sapiens
accaatgggaagca

SEQ ID NO: 3672707 - DNA, 18 bp, Homo sapiens
accacaaactgtaataca

SEQ ID NO: 3672708 - DNA, 22 bp, Homo sapiens
accacaaactgtaatacaatga

SEQ ID NO: 3672709 - DNA, 14 bp, Homo sapiens
accacacaaagaca

SEQ ID NO: 3672710 - DNA, 17 bp, Homo sapiens
accacagccagcacctg

SEQ ID NO: 3672711 - DNA, 20 bp, Homo sapiens
accacagccagcacctggca

SEQ ID NO: 3672712 - DNA, 16 bp, Homo sapiens
accacatctaagcctg

SEQ ID NO: 3672713 - DNA, 20 bp, Homo sapiens
accacatctaagcctgaagg

SEQ ID NO: 3672714 - DNA, 20 bp, Homo sapiens
accaccctagtcccttcccc

SEQ ID NO: 3672715 - DNA, 18 bp, Homo sapiens
accacgcccgtcctgcct

SEQ ID NO: 3672716 - DNA, 18 bp, Homo sapiens
accacggccaccactgca

SEQ ID NO: 3672717 - DNA, 17 bp, Homo sapiens
accactcgtgcatccct

SEQ ID NO: 3672718 - DNA, 13 bp, Homo sapiens
accactctgtggc

SEQ ID NO: 3672719 - DNA, 21 bp, Homo sapiens
accactctgtggccagcctgg

SEQ ID NO: 3672720 - DNA, 23 bp, Homo sapiens
accactctgtggccagcctggca

SEQ ID NO: 3672721 - DNA, 14 bp, Homo sapiens
accacttcagctga

SEQ ID NO: 3672722 - DNA, 15 bp, Homo sapiens
accacttcagctgac

SEQ ID NO: 3672723 - DNA, 21 bp, Homo sapiens
accactttcttattctgtatc

SEQ ID NO: 3672724 - DNA, 14 bp, Homo sapiens
accagacacccagg

SEQ ID NO: 3672725 - DNA, 16 bp, Homo sapiens
accagacacccaggac

SEQ ID NO: 3672726 - DNA, 11 bp, Homo sapiens
accagacaggt

SEQ ID NO: 3672727 - DNA, 19 bp, Homo sapiens
accagagccttcaagtgcc

SEQ ID NO: 3672728 - DNA, 20 bp, Homo sapiens
accagagccttcaagtgcca

SEQ ID NO: 3672729 - DNA, 23 bp, Homo sapiens
accagagccttcaagtgccaaac

SEQ ID NO: 3672730 - DNA, 23 bp, Homo sapiens
accagcaattctctttcttttac

SEQ ID NO: 3672731 - DNA, 17 bp, Homo sapiens
accagcagcctggaccc

SEQ ID NO: 3672732 - DNA, 18 bp, Homo sapiens
accagcagcgcctttccc

SEQ ID NO: 3672733 - DNA, 16 bp, Homo sapiens
accagccacctcatcc

SEQ ID NO: 3672734 - DNA, 19 bp, Homo sapiens
accagccgtgagcatgttt

SEQ ID NO: 3672735 - DNA, 11 bp, Homo sapiens
accagcctggc

SEQ ID NO: 3672736 - DNA, 13 bp, Homo sapiens
accagctcaggac

SEQ ID NO: 3672737 - DNA, 14 bp, Homo sapiens
accagctcaggaca

SEQ ID NO: 3672738 - DNA, 16 bp, Homo sapiens
accaggactccctcct

SEQ ID NO: 3672739 - DNA, 16 bp, Homo sapiens
accaggatagagactg

SEQ ID NO: 3672740 - DNA, 17 bp, Homo sapiens
accaggatagagactgg

SEQ ID NO: 3672741 - DNA, 12 bp, Homo sapiens
accaggccacct

SEQ ID NO: 3672742 - DNA, 14 bp, Homo sapiens
accaggccacctcc

SEQ ID NO: 3672743 - DNA, 19 bp, Homo sapiens
accaggctgctcagggctg

SEQ ID NO: 3672744 - DNA, 10 bp, Homo sapiens
accagggaca

SEQ ID NO: 3672745 - DNA, 14 bp, Homo sapiens
accagggcaaggcc

SEQ ID NO: 3672746 - DNA, 17 bp, Homo sapiens
accaggggccctacctg

SEQ ID NO: 3672747 - DNA, 17 bp, Homo sapiens
accaggggtttctcgca

SEQ ID NO: 3672748 - DNA, 17 bp, Homo sapiens
accaggtgcctttcaaa

SEQ ID NO: 3672749 - DNA, 20 bp, Homo sapiens
accagtatcgctcatagatc

SEQ ID NO: 3672750 - DNA, 17 bp, Homo sapiens
accagtccccccaccct

SEQ ID NO: 3672751 - DNA, 22 bp, Homo sapiens
accatccactctaccctcccac

SEQ ID NO: 3672752 - DNA, 23 bp, Homo sapiens
accatccactctaccctcccacc

SEQ ID NO: 3672753 - DNA, 14 bp, Homo sapiens
accatcctggctgc

SEQ ID NO: 3672754 - DNA, 20 bp, Homo sapiens
accatgcctcactaattttt

SEQ ID NO: 3672755 - DNA, 13 bp, Homo sapiens
accattctgactc

SEQ ID NO: 3672756 - DNA, 15 bp, Homo sapiens
accatttgtgttttg

SEQ ID NO: 3672757 - DNA, 17 bp, Homo sapiens
acccaaagctgagcctg

SEQ ID NO: 3672758 - DNA, 22 bp, Homo sapiens
acccaaagctgagcctgcaggg

SEQ ID NO: 3672759 - DNA, 15 bp, Homo sapiens
acccaacggccctgc

SEQ ID NO: 3672760 - DNA, 12 bp, Homo sapiens
acccaccactgg

SEQ ID NO: 3672761 - DNA, 16 bp, Homo sapiens
acccaccactggaagc

SEQ ID NO: 3672762 - DNA, 13 bp, Homo sapiens
acccacctccctg

SEQ ID NO: 3672763 - DNA, 16 bp, Homo sapiens
acccacctccctgcct

SEQ ID NO: 3672764 - DNA, 18 bp, Homo sapiens
acccacctccctgcctcc

SEQ ID NO: 3672765 - DNA, 21 bp, Homo sapiens
acccacctttgccacaaagct

SEQ ID NO: 3672766 - DNA, 11 bp, Homo sapiens
acccaggcagc

SEQ ID NO: 3672767 - DNA, 17 bp, Homo sapiens
acccatccccgcagtgt

SEQ ID NO: 3672768 - DNA, 20 bp, Homo sapiens
acccatctgcacccccctgg

SEQ ID NO: 3672769 - DNA, 21 bp, Homo sapiens
acccatctgcacccccctggg

SEQ ID NO: 3672770 - DNA, 18 bp, Homo sapiens
acccatgcaagcagagga

SEQ ID NO: 3672771 - DNA, 15 bp, Homo sapiens
accccaaagctttcc

SEQ ID NO: 3672772 - DNA, 17 bp, Homo sapiens
accccaagaccaagctt

SEQ ID NO: 3672773 - DNA, 17 bp, Homo sapiens
accccagattcttcagc

SEQ ID NO: 3672774 - DNA, 13 bp, Homo sapiens
accccagcccaga

SEQ ID NO: 3672775 - DNA, 14 bp, Homo sapiens
accccagcccagac

SEQ ID NO: 3672776 - DNA, 13 bp, Homo sapiens
accccagccttgg

SEQ ID NO: 3672777 - DNA, 23 bp, Homo sapiens
accccatgtcaccggatcctggg

SEQ ID NO: 3672778 - DNA, 15 bp, Homo sapiens
acccccacacctcag

SEQ ID NO: 3672779 - DNA, 14 bp, Homo sapiens
acccccaccccaca

SEQ ID NO: 3672780 - DNA, 17 bp, Homo sapiens
acccccaccccacactt

SEQ ID NO: 3672781 - DNA, 12 bp, Homo sapiens
acccccctgggc

SEQ ID NO: 3672782 - DNA, 20 bp, Homo sapiens
acccccgtggggcagggagc

SEQ ID NO: 3672783 - DNA, 24 bp, Homo sapiens
accccctgtaaggttccatccacc

SEQ ID NO: 3672784 - DNA, 18 bp, Homo sapiens
acccccttctctgctcca

SEQ ID NO: 3672785 - DNA, 18 bp, Homo sapiens
accccgcagacaccttgg

SEQ ID NO: 3672786 - DNA, 20 bp, Homo sapiens
accccgcagacaccttggac

SEQ ID NO: 3672787 - DNA, 13 bp, Homo sapiens
accccgggctctc

SEQ ID NO: 3672788 - DNA, 21 bp, Homo sapiens
accccgggctctctgctgtac

SEQ ID NO: 3672789 - DNA, 16 bp, Homo sapiens
acccctgcccttgtcc

SEQ ID NO: 3672790 - DNA, 17 bp, Homo sapiens
acccctgcgtcgagctg

SEQ ID NO: 3672791 - DNA, 20 bp, Homo sapiens
acccctgcgtcgagctggga

SEQ ID NO: 3672792 - DNA, 17 bp, Homo sapiens
accccttagcctccctg

SEQ ID NO: 3672793 - DNA, 14 bp, Homo sapiens
accccttcctcagc

SEQ ID NO: 3672794 - DNA, 21 bp, Homo sapiens
accccttcctcagcctggggt

SEQ ID NO: 3672795 - DNA, 13 bp, Homo sapiens
acccgaggaaact

SEQ ID NO: 3672796 - DNA, 14 bp, Homo sapiens
acccggctgcagag

SEQ ID NO: 3672797 - DNA, 13 bp, Homo sapiens
accctattgctgc

SEQ ID NO: 3672798 - DNA, 22 bp, Homo sapiens
accctcaaggtgcggggagaag

SEQ ID NO: 3672799 - DNA, 13 bp, Homo sapiens
accctcaggcagg

SEQ ID NO: 3672800 - DNA, 17 bp, Homo sapiens
accctcattctactgaa

SEQ ID NO: 3672801 - DNA, 12 bp, Homo sapiens
accctcccaccc

SEQ ID NO: 3672802 - DNA, 20 bp, Homo sapiens
accctgatttaggagaagcc

SEQ ID NO: 3672803 - DNA, 10 bp, Homo sapiens
accctgcccc

SEQ ID NO: 3672804 - DNA, 14 bp, Homo sapiens
accctgccttatct

SEQ ID NO: 3672805 - DNA, 22 bp, Homo sapiens
accctgggccctgggctggaat

SEQ ID NO: 3672806 - DNA, 14 bp, Homo sapiens
accctgggggcaca

SEQ ID NO: 3672807 - DNA, 16 bp, Homo sapiens
accctgggggcacagg

SEQ ID NO: 3672808 - DNA, 22 bp, Homo sapiens
accctgggggcacaggaggcag

SEQ ID NO: 3672809 - DNA, 20 bp, Homo sapiens
accctgggtgtccccgctgc

SEQ ID NO: 3672810 - DNA, 15 bp, Homo sapiens
accctggtgggccaa

SEQ ID NO: 3672811 - DNA, 19 bp, Homo sapiens
accctggtggttgctgttt

SEQ ID NO: 3672812 - DNA, 14 bp, Homo sapiens
accctgtcttctta

SEQ ID NO: 3672813 - DNA, 22 bp, Homo sapiens
acccttaccccttagcctccct

SEQ ID NO: 3672814 - DNA, 19 bp, Homo sapiens
acccttcccttgagccctc

SEQ ID NO: 3672815 - DNA, 18 bp, Homo sapiens
accgagaaggtttatccc

SEQ ID NO: 3672816 - DNA, 13 bp, Homo sapiens
accgcaggaagct

SEQ ID NO: 3672817 - DNA, 14 bp, Homo sapiens
accgccatcctctg

SEQ ID NO: 3672818 - DNA, 17 bp, Homo sapiens
accgccatcctctgcct

SEQ ID NO: 3672819 - DNA, 15 bp, Homo sapiens
accggacttttctgc

SEQ ID NO: 3672820 - DNA, 16 bp, Homo sapiens
accggacttttctgca

SEQ ID NO: 3672821 - DNA, 14 bp, Homo sapiens
accggatcctgggt

SEQ ID NO: 3672822 - DNA, 21 bp, Homo sapiens
accggccgcggctccccctgg

SEQ ID NO: 3672823 - DNA, 15 bp, Homo sapiens
acctaaatggcctca

SEQ ID NO: 3672824 - DNA, 15 bp, Homo sapiens
acctaatccaggcag

SEQ ID NO: 3672825 - DNA, 22 bp, Homo sapiens
acctagagaacaggtggttttt

SEQ ID NO: 3672826 - DNA, 22 bp, Homo sapiens
acctagtaagtgcctgctgtat

SEQ ID NO: 3672827 - DNA, 15 bp, Homo sapiens
acctatcacttacat

SEQ ID NO: 3672828 - DNA, 15 bp, Homo sapiens
acctcagcctggcca

SEQ ID NO: 3672829 - DNA, 17 bp, Homo sapiens
acctcagcctggccaga

SEQ ID NO: 3672830 - DNA, 15 bp, Homo sapiens
acctcaggcaggaag

SEQ ID NO: 3672831 - DNA, 18 bp, Homo sapiens
acctcaggtgagaagcag

SEQ ID NO: 3672832 - DNA, 18 bp, Homo sapiens
acctcagttattacatgt

SEQ ID NO: 3672833 - DNA, 16 bp, Homo sapiens
acctcagttcccttgg

SEQ ID NO: 3672834 - DNA, 17 bp, Homo sapiens
acctcagttcccttggc

SEQ ID NO: 3672835 - DNA, 20 bp, Homo sapiens
acctcagttcccttggcctc

SEQ ID NO: 3672836 - DNA, 19 bp, Homo sapiens
acctccacacccgtgagaa

SEQ ID NO: 3672837 - DNA, 11 bp, Homo sapiens
acctccacagc

SEQ ID NO: 3672838 - DNA, 14 bp, Homo sapiens
acctccacagcttc

SEQ ID NO: 3672839 - DNA, 15 bp, Homo sapiens
acctccacttgctta

SEQ ID NO: 3672840 - DNA, 17 bp, Homo sapiens
acctccaggccgtttct

SEQ ID NO: 3672841 - DNA, 23 bp, Homo sapiens
acctccccagcattccagcccct

SEQ ID NO: 3672842 - DNA, 14 bp, Homo sapiens
acctccctgcctcc

SEQ ID NO: 3672843 - DNA, 21 bp, Homo sapiens
acctcctccctaatgctcacc

SEQ ID NO: 3672844 - DNA, 11 bp, Homo sapiens
acctcctgctg

SEQ ID NO: 3672845 - DNA, 21 bp, Homo sapiens
acctcctttcctatctttaca

SEQ ID NO: 3672846 - DNA, 12 bp, Homo sapiens
acctctgagaag

SEQ ID NO: 3672847 - DNA, 21 bp, Homo sapiens
acctctgcacaagctgcaccc

SEQ ID NO: 3672848 - DNA, 21 bp, Homo sapiens
acctctgcactactgacatgt

SEQ ID NO: 3672849 - DNA, 15 bp, Homo sapiens
acctctggactggct

SEQ ID NO: 3672850 - DNA, 13 bp, Homo sapiens
acctcttccccag

SEQ ID NO: 3672851 - DNA, 19 bp, Homo sapiens
acctgaagatgggagcctt

SEQ ID NO: 3672852 - DNA, 17 bp, Homo sapiens
acctgaaggcagggctc

SEQ ID NO: 3672853 - DNA, 23 bp, Homo sapiens
acctgaaggcagggctcctccct

SEQ ID NO: 3672854 - DNA, 13 bp, Homo sapiens
acctgaggaagcg

SEQ ID NO: 3672855 - DNA, 13 bp, Homo sapiens
acctgatcctgga

SEQ ID NO: 3672856 - DNA, 20 bp, Homo sapiens
acctgatcctggaggcccag

SEQ ID NO: 3672857 - DNA, 15 bp, Homo sapiens
acctgcaaagatctg

SEQ ID NO: 3672858 - DNA, 16 bp, Homo sapiens
acctgcaggcggggct

SEQ ID NO: 3672859 - DNA, 18 bp, Homo sapiens
acctgcaggcggggctcc

SEQ ID NO: 3672860 - DNA, 22 bp, Homo sapiens
acctgcaggcggggctcctcct

SEQ ID NO: 3672861 - DNA, 14 bp, Homo sapiens
acctggaccccagc

SEQ ID NO: 3672862 - DNA, 18 bp, Homo sapiens
acctggaccccagccttg

SEQ ID NO: 3672863 - DNA, 22 bp, Homo sapiens
acctgggagaaatctggcttct

SEQ ID NO: 3672864 - DNA, 11 bp, Homo sapiens
acctgggggca

SEQ ID NO: 3672865 - DNA, 22 bp, Homo sapiens
acctgggggcagaactcctacc

SEQ ID NO: 3672866 - DNA, 18 bp, Homo sapiens
acctggggtgtgggaggc

SEQ ID NO: 3672867 - DNA, 22 bp, Homo sapiens
acctgggttccctttccttcca

SEQ ID NO: 3672868 - DNA, 16 bp, Homo sapiens
acctgggttgcagaca

SEQ ID NO: 3672869 - DNA, 14 bp, Homo sapiens
acctgtaatcccag

SEQ ID NO: 3672870 - DNA, 24 bp, Homo sapiens
acctgtcaaacaaagccagaagct

SEQ ID NO: 3672871 - DNA, 14 bp, Homo sapiens
acctgttgaagatt

SEQ ID NO: 3672872 - DNA, 19 bp, Homo sapiens
accttagtttcaagagtct

SEQ ID NO: 3672873 - DNA, 18 bp, Homo sapiens
accttatgagaaactgca

SEQ ID NO: 3672874 - DNA, 18 bp, Homo sapiens
accttcatgcccttctga

SEQ ID NO: 3672875 - DNA, 23 bp, Homo sapiens
accttctctatggggcatcctct

SEQ ID NO: 3672876 - DNA, 17 bp, Homo sapiens
accttgaaaggcaggaa

SEQ ID NO: 3672877 - DNA, 16 bp, Homo sapiens
accttggcttgttatt

SEQ ID NO: 3672878 - DNA, 16 bp, Homo sapiens
accttgttacttctga

SEQ ID NO: 3672879 - DNA, 15 bp, Homo sapiens
acgactgcccggcag

SEQ ID NO: 3672880 - DNA, 19 bp, Homo sapiens
acgagatcaagagatcaag

SEQ ID NO: 3672881 - DNA, 21 bp, Homo sapiens
acgaggggtgtcttgggcaga

SEQ ID NO: 3672882 - DNA, 11 bp, Homo sapiens
acgccaggaga

SEQ ID NO: 3672883 - DNA, 22 bp, Homo sapiens
acgccaggagaagttgagggga

SEQ ID NO: 3672884 - DNA, 18 bp, Homo sapiens
acgcccgtcctgcctgtg

SEQ ID NO: 3672885 - DNA, 23 bp, Homo sapiens
acgcctgtgccaccccttcctca

SEQ ID NO: 3672886 - DNA, 13 bp, Homo sapiens
acgcgtcttcctg

SEQ ID NO: 3672887 - DNA, 15 bp, Homo sapiens
acgcgtcttcctgag

SEQ ID NO: 3672888 - DNA, 17 bp, Homo sapiens
acggacactcaaaagct

SEQ ID NO: 3672889 - DNA, 20 bp, Homo sapiens
acggaggcctgcgaccctgg

SEQ ID NO: 3672890 - DNA, 15 bp, Homo sapiens
acggccaagaatgta

SEQ ID NO: 3672891 - DNA, 23 bp, Homo sapiens
acggccaagaatgtacgtccagc

SEQ ID NO: 3672892 - DNA, 13 bp, Homo sapiens
acggccaccactg

SEQ ID NO: 3672893 - DNA, 18 bp, Homo sapiens
acggccctgcagccagct

SEQ ID NO: 3672894 - DNA, 19 bp, Homo sapiens
acggcgttgtacctgtagg

SEQ ID NO: 3672895 - DNA, 23 bp, Homo sapiens
acggcttcctcattccttgtctt

SEQ ID NO: 3672896 - DNA, 18 bp, Homo sapiens
acggcttttacttaaacc

SEQ ID NO: 3672897 - DNA, 19 bp, Homo sapiens
acgggacatcacagggtgg

SEQ ID NO: 3672898 - DNA, 23 bp, Homo sapiens
acgggacatcacagggtgggcct

SEQ ID NO: 3672899 - DNA, 22 bp, Homo sapiens
acggggcagtactcctccctgg

SEQ ID NO: 3672900 - DNA, 21 bp, Homo sapiens
acggggcccttacctgtgacc

SEQ ID NO: 3672901 - DNA, 22 bp, Homo sapiens
acggggcgggccctgcctgagg

SEQ ID NO: 3672902 - DNA, 15 bp, Homo sapiens
acggggctcccctgg

SEQ ID NO: 3672903 - DNA, 15 bp, Homo sapiens
acggtgcccaagcca

SEQ ID NO: 3672904 - DNA, 15 bp, Homo sapiens
acggtgttttgccat

SEQ ID NO: 3672905 - DNA, 14 bp, Homo sapiens
acggtttccaggga

SEQ ID NO: 3672906 - DNA, 17 bp, Homo sapiens
acggtttccagggaggg

SEQ ID NO: 3672907 - DNA, 21 bp, Homo sapiens
acgtccaggttcaacccacag

SEQ ID NO: 3672908 - DNA, 23 bp, Homo sapiens
acgtgagagtgtcttcacggcag

SEQ ID NO: 3672909 - DNA, 19 bp, Homo sapiens
acgtggagagctggtgccc

SEQ ID NO: 3672910 - DNA, 20 bp, Homo sapiens
acgtttctttaaccttgtat

SEQ ID NO: 3672911 - DNA, 17 bp, Homo sapiens
actaaaaagagactgtg

SEQ ID NO: 3672912 - DNA, 21 bp, Homo sapiens
actaaaaagagactgtgccat

SEQ ID NO: 3672913 - DNA, 16 bp, Homo sapiens
actaaagccaaacata

SEQ ID NO: 3672914 - DNA, 23 bp, Homo sapiens
actaaagccaaacatatatatac

SEQ ID NO: 3672915 - DNA, 24 bp, Homo sapiens
actaacaaaggcagctgtgtctga

SEQ ID NO: 3672916 - DNA, 21 bp, Homo sapiens
actaagccccgtctgacccca

SEQ ID NO: 3672917 - DNA, 23 bp, Homo sapiens
actaagtaacctctacaggcatt

SEQ ID NO: 3672918 - DNA, 12 bp, Homo sapiens
actaatggcatg

SEQ ID NO: 3672919 - DNA, 21 bp, Homo sapiens
actaatggcatgagaaataca

SEQ ID NO: 3672920 - DNA, 22 bp, Homo sapiens
actaatggcatgagaaatacaa

SEQ ID NO: 3672921 - DNA, 21 bp, Homo sapiens
actacaccttgccttgctgtt

SEQ ID NO: 3672922 - DNA, 14 bp, Homo sapiens
actagaatttagtt

SEQ ID NO: 3672923 - DNA, 15 bp, Homo sapiens
actagagtctgaaca

SEQ ID NO: 3672924 - DNA, 17 bp, Homo sapiens
actagttttagttttct

SEQ ID NO: 3672925 - DNA, 12 bp, Homo sapiens
actataaagaga

SEQ ID NO: 3672926 - DNA, 13 bp, Homo sapiens
actataagaactt

SEQ ID NO: 3672927 - DNA, 18 bp, Homo sapiens
actataagaactttgagc

SEQ ID NO: 3672928 - DNA, 21 bp, Homo sapiens
actatctgttcccttcctctg

SEQ ID NO: 3672929 - DNA, 18 bp, Homo sapiens
actatctttcagctccag

SEQ ID NO: 3672930 - DNA, 15 bp, Homo sapiens
actatgatttggaaa

SEQ ID NO: 3672931 - DNA, 16 bp, Homo sapiens
actatgatttggaaaa

SEQ ID NO: 3672932 - DNA, 16 bp, Homo sapiens
actatgggatgtatat

SEQ ID NO: 3672933 - DNA, 18 bp, Homo sapiens
actattccttttctgtat

SEQ ID NO: 3672934 - DNA, 19 bp, Homo sapiens
actattccttttctgtata

SEQ ID NO: 3672935 - DNA, 21 bp, Homo sapiens
actattgggtatgaactaaaa

SEQ ID NO: 3672936 - DNA, 15 bp, Homo sapiens
actatttcttcagag

SEQ ID NO: 3672937 - DNA, 17 bp, Homo sapiens
actcaaactcttaaaac

SEQ ID NO: 3672938 - DNA, 17 bp, Homo sapiens
actcaaatggggccaga

SEQ ID NO: 3672939 - DNA, 17 bp, Homo sapiens
actcaagccaagcagcc

SEQ ID NO: 3672940 - DNA, 17 bp, Homo sapiens
actcaaggactttgcag

SEQ ID NO: 3672941 - DNA, 18 bp, Homo sapiens
actcaaggcggtgcttga

SEQ ID NO: 3672942 - DNA, 15 bp, Homo sapiens
actcaatattttcca

SEQ ID NO: 3672943 - DNA, 21 bp, Homo sapiens
actcaatattttccatgaaaa

SEQ ID NO: 3672944 - DNA, 23 bp, Homo sapiens
actcaatattttccatgaaaatg

SEQ ID NO: 3672945 - DNA, 16 bp, Homo sapiens
actcacatggctatgt

SEQ ID NO: 3672946 - DNA, 15 bp, Homo sapiens
actcactaggccccc

SEQ ID NO: 3672947 - DNA, 21 bp, Homo sapiens
actcactttcccttgtgtcaa

SEQ ID NO: 3672948 - DNA, 18 bp, Homo sapiens
actcagacattggcacct

SEQ ID NO: 3672949 - DNA, 12 bp, Homo sapiens
actcagatccag

SEQ ID NO: 3672950 - DNA, 17 bp, Homo sapiens
actcagatccagggaca

SEQ ID NO: 3672951 - DNA, 11 bp, Homo sapiens
actcagccttc

SEQ ID NO: 3672952 - DNA, 23 bp, Homo sapiens
actcagccttcagacagagagga

SEQ ID NO: 3672953 - DNA, 21 bp, Homo sapiens
actcagggttaggaatcctag

SEQ ID NO: 3672954 - DNA, 14 bp, Homo sapiens
actcagtggacagt

SEQ ID NO: 3672955 - DNA, 18 bp, Homo sapiens
actcatagatgttatgca

SEQ ID NO: 3672956 - DNA, 19 bp, Homo sapiens
actccagcctggcgacaga

SEQ ID NO: 3672957 - DNA, 20 bp, Homo sapiens
actccagctgggttggaaaa

SEQ ID NO: 3672958 - DNA, 15 bp, Homo sapiens
actcccaagctggac

SEQ ID NO: 3672959 - DNA, 13 bp, Homo sapiens
actcccaggctgg

SEQ ID NO: 3672960 - DNA, 22 bp, Homo sapiens
actcccagtccaaatgtcctcc

SEQ ID NO: 3672961 - DNA, 18 bp, Homo sapiens
actccgttggccactccg

SEQ ID NO: 3672962 - DNA, 12 bp, Homo sapiens
actcctacctga

SEQ ID NO: 3672963 - DNA, 19 bp, Homo sapiens
actcctttgctaatgctat

SEQ ID NO: 3672964 - DNA, 19 bp, Homo sapiens
actcgcacctcttggcttt

SEQ ID NO: 3672965 - DNA, 20 bp, Homo sapiens
actcgcacctcttggctttg

SEQ ID NO: 3672966 - DNA, 18 bp, Homo sapiens
actctacatgtaactatt

SEQ ID NO: 3672967 - DNA, 19 bp, Homo sapiens
actctaccctcccaccccc

SEQ ID NO: 3672968 - DNA, 18 bp, Homo sapiens
actctaccctcttagaaa

SEQ ID NO: 3672969 - DNA, 17 bp, Homo sapiens
actctaggtgcccttgg

SEQ ID NO: 3672970 - DNA, 10 bp, Homo sapiens
actctcccca

SEQ ID NO: 3672971 - DNA, 22 bp, Homo sapiens
actctgaaaaggaacggcttcc

SEQ ID NO: 3672972 - DNA, 21 bp, Homo sapiens
actctgagtgttttatgagaa

SEQ ID NO: 3672973 - DNA, 15 bp, Homo sapiens
actctgcttctctga

SEQ ID NO: 3672974 - DNA, 22 bp, Homo sapiens
actctgcttctctgacttctgc

SEQ ID NO: 3672975 - DNA, 13 bp, Homo sapiens
actctgtggccag

SEQ ID NO: 3672976 - DNA, 23 bp, Homo sapiens
actctgtggccagcctggcatca

SEQ ID NO: 3672977 - DNA, 20 bp, Homo sapiens
actctgttgcaagtgcaata

SEQ ID NO: 3672978 - DNA, 21 bp, Homo sapiens
actcttcagttaattcttaga

SEQ ID NO: 3672979 - DNA, 16 bp, Homo sapiens
actcttccctgggaac

SEQ ID NO: 3672980 - DNA, 13 bp, Homo sapiens
actgaaacattat

SEQ ID NO: 3672981 - DNA, 17 bp, Homo sapiens
actgaaacctaggaagc

SEQ ID NO: 3672982 - DNA, 22 bp, Homo sapiens
actgaagccgtgcctgtagcct

SEQ ID NO: 3672983 - DNA, 18 bp, Homo sapiens
actgaattttgggacttc

SEQ ID NO: 3672984 - DNA, 19 bp, Homo sapiens
actgaattttgggacttct

SEQ ID NO: 3672985 - DNA, 12 bp, Homo sapiens
actgaccagaac

SEQ ID NO: 3672986 - DNA, 23 bp, Homo sapiens
actgaccatccactctaccctcc

SEQ ID NO: 3672987 - DNA, 16 bp, Homo sapiens
actgactagagtgatg

SEQ ID NO: 3672988 - DNA, 14 bp, Homo sapiens
actgactttaagta

SEQ ID NO: 3672989 - DNA, 20 bp, Homo sapiens
actgagacagatgggactta

SEQ ID NO: 3672990 - DNA, 14 bp, Homo sapiens
actgaggcagggaa

SEQ ID NO: 3672991 - DNA, 15 bp, Homo sapiens
actgaggcagggaag

SEQ ID NO: 3672992 - DNA, 13 bp, Homo sapiens
actgagttttcca

SEQ ID NO: 3672993 - DNA, 16 bp, Homo sapiens
actgatctcgatgcag

SEQ ID NO: 3672994 - DNA, 20 bp, Homo sapiens
actgatctttgtatattaca

SEQ ID NO: 3672995 - DNA, 11 bp, Homo sapiens
actgatgctgc

SEQ ID NO: 3672996 - DNA, 14 bp, Homo sapiens
actgatgctgcccc

SEQ ID NO: 3672997 - DNA, 15 bp, Homo sapiens
actgatgctgcccct

SEQ ID NO: 3672998 - DNA, 19 bp, Homo sapiens
actgatgctgcccctcatc

SEQ ID NO: 3672999 - DNA, 15 bp, Homo sapiens
actgattacctgcca

SEQ ID NO: 3673000 - DNA, 15 bp, Homo sapiens
actgcacactcagtg

SEQ ID NO: 3673001 - DNA, 17 bp, Homo sapiens
actgcactccagcctgg

SEQ ID NO: 3673002 - DNA, 20 bp, Homo sapiens
actgcactccagcctgggtg

SEQ ID NO: 3673003 - DNA, 13 bp, Homo sapiens
actgcaggccctg

SEQ ID NO: 3673004 - DNA, 14 bp, Homo sapiens
actgcaggccctgg

SEQ ID NO: 3673005 - DNA, 17 bp, Homo sapiens
actgcaggccctggcct

SEQ ID NO: 3673006 - DNA, 18 bp, Homo sapiens
actgcaggccctggcctc

SEQ ID NO: 3673007 - DNA, 22 bp, Homo sapiens
actgcaggccctggcctcccct

SEQ ID NO: 3673008 - DNA, 20 bp, Homo sapiens
actgcagtgatgtatacatc

SEQ ID NO: 3673009 - DNA, 23 bp, Homo sapiens
actgcagtgatgtatacatctta

SEQ ID NO: 3673010 - DNA, 20 bp, Homo sapiens
actgcataccaacctgggca

SEQ ID NO: 3673011 - DNA, 18 bp, Homo sapiens
actgccaaaatgctctag

SEQ ID NO: 3673012 - DNA, 14 bp, Homo sapiens
actgcctaagccct

SEQ ID NO: 3673013 - DNA, 23 bp, Homo sapiens
actgccttcgcttcttgcctctg

SEQ ID NO: 3673014 - DNA, 17 bp, Homo sapiens
actgcgactttctgcct

SEQ ID NO: 3673015 - DNA, 18 bp, Homo sapiens
actgcgactttctgcctg

SEQ ID NO: 3673016 - DNA, 17 bp, Homo sapiens
actgcgggagctctgta

SEQ ID NO: 3673017 - DNA, 23 bp, Homo sapiens
actgcgggagctctgtatggtca

SEQ ID NO: 3673018 - DNA, 18 bp, Homo sapiens
actgctgagatacataca

SEQ ID NO: 3673019 - DNA, 20 bp, Homo sapiens
actgctgagatacatacaga

SEQ ID NO: 3673020 - DNA, 22 bp, Homo sapiens
actgctgagatacatacagaat

SEQ ID NO: 3673021 - DNA, 16 bp, Homo sapiens
actgcttggagctgag

SEQ ID NO: 3673022 - DNA, 16 bp, Homo sapiens
actgcttgtgttttta

SEQ ID NO: 3673023 - DNA, 22 bp, Homo sapiens
actggaacactagacaagccag

SEQ ID NO: 3673024 - DNA, 12 bp, Homo sapiens
actggcaaaagg

SEQ ID NO: 3673025 - DNA, 21 bp, Homo sapiens
actggctagagtcctcactcc

SEQ ID NO: 3673026 - DNA, 13 bp, Homo sapiens
actggctttggct

SEQ ID NO: 3673027 - DNA, 18 bp, Homo sapiens
actggctttggcttcttg

SEQ ID NO: 3673028 - DNA, 14 bp, Homo sapiens
actgggccctgagt

SEQ ID NO: 3673029 - DNA, 19 bp, Homo sapiens
actggtgtttgaaagtagg

SEQ ID NO: 3673030 - DNA, 14 bp, Homo sapiens
actggttttcacat

SEQ ID NO: 3673031 - DNA, 11 bp, Homo sapiens
actgtacaata

SEQ ID NO: 3673032 - DNA, 23 bp, Homo sapiens
actgtatctaggcaacatagtat

SEQ ID NO: 3673033 - DNA, 19 bp, Homo sapiens
actgtcctgggcctgcaga

SEQ ID NO: 3673034 - DNA, 14 bp, Homo sapiens
actgtgaaatacca

SEQ ID NO: 3673035 - DNA, 20 bp, Homo sapiens
actgtgaaataccacaagcc

SEQ ID NO: 3673036 - DNA, 16 bp, Homo sapiens
actgtgaaggaccctt

SEQ ID NO: 3673037 - DNA, 19 bp, Homo sapiens
agacaattgacaacagtta

SEQ ID NO: 3673038 - DNA, 22 bp, Homo sapiens
agacacaaggtgatttcagact

SEQ ID NO: 3673039 - DNA, 12 bp, Homo sapiens
agacacccagga

SEQ ID NO: 3673040 - DNA, 14 bp, Homo sapiens
agacacctggttgc

SEQ ID NO: 3673041 - DNA, 14 bp, Homo sapiens
agacacttgctgag

SEQ ID NO: 3673042 - DNA, 17 bp, Homo sapiens
agacacttgctgagtga

SEQ ID NO: 3673043 - DNA, 17 bp, Homo sapiens
agacagagaaaacttgc

SEQ ID NO: 3673044 - DNA, 20 bp, Homo sapiens
agacagagaggactgtaggg

SEQ ID NO: 3673045 - DNA, 14 bp, Homo sapiens
agacagatgcccca

SEQ ID NO: 3673046 - DNA, 15 bp, Homo sapiens
agacaggctcttagc

SEQ ID NO: 3673047 - DNA, 20 bp, Homo sapiens
agacaggctcttagcagctt

SEQ ID NO: 3673048 - DNA, 14 bp, Homo sapiens
agacatacttgaag

SEQ ID NO: 3673049 - DNA, 23 bp, Homo sapiens
agacatgccacaaggacttcctg

SEQ ID NO: 3673050 - DNA, 21 bp, Homo sapiens
agaccacgcccgtcctgcctg

SEQ ID NO: 3673051 - DNA, 15 bp, Homo sapiens
agaccatagtgacca

SEQ ID NO: 3673052 - DNA, 17 bp, Homo sapiens
agaccatgtcttatctt

SEQ ID NO: 3673053 - DNA, 15 bp, Homo sapiens
agacctccacttgct

SEQ ID NO: 3673054 - DNA, 17 bp, Homo sapiens
agacctccacttgctta

SEQ ID NO: 3673055 - DNA, 16 bp, Homo sapiens
agacctgatcctggag

SEQ ID NO: 3673056 - DNA, 17 bp, Homo sapiens
agacctggcagctctgg

SEQ ID NO: 3673057 - DNA, 16 bp, Homo sapiens
agactaacaaaggcag

SEQ ID NO: 3673058 - DNA, 17 bp, Homo sapiens
agactaacaaaggcagc

SEQ ID NO: 3673059 - DNA, 19 bp, Homo sapiens
agactaacaaaggcagctg

SEQ ID NO: 3673060 - DNA, 19 bp, Homo sapiens
agactattccttttctgta

SEQ ID NO: 3673061 - DNA, 20 bp, Homo sapiens
agactattccttttctgtat

SEQ ID NO: 3673062 - DNA, 18 bp, Homo sapiens
agactcagtgcagatgga

SEQ ID NO: 3673063 - DNA, 21 bp, Homo sapiens
agactccagctgggttggaaa

SEQ ID NO: 3673064 - DNA, 16 bp, Homo sapiens
agactcccaagctgga

SEQ ID NO: 3673065 - DNA, 19 bp, Homo sapiens
agactcccattcctgaaga

SEQ ID NO: 3673066 - DNA, 14 bp, Homo sapiens
agactctttatgct

SEQ ID NO: 3673067 - DNA, 11 bp, Homo sapiens
agactgtgcca

SEQ ID NO: 3673068 - DNA, 19 bp, Homo sapiens
agactgtggctagtgacaa

SEQ ID NO: 3673069 - DNA, 17 bp, Homo sapiens
agacttagggcaccagg

SEQ ID NO: 3673070 - DNA, 22 bp, Homo sapiens
agacttgtcaagcctgtgcaaa

SEQ ID NO: 3673071 - DNA, 19 bp, Homo sapiens
agactttgtttttaaaatg

SEQ ID NO: 3673072 - DNA, 16 bp, Homo sapiens
agagaaaatatatgta

SEQ ID NO: 3673073 - DNA, 19 bp, Homo sapiens
agagaattgtttgaacccg

SEQ ID NO: 3673074 - DNA, 17 bp, Homo sapiens
agagacatacttgaagg

SEQ ID NO: 3673075 - DNA, 23 bp, Homo sapiens
agagacatacttgaagggccaga

SEQ ID NO: 3673076 - DNA, 17 bp, Homo sapiens
agagactctcctgcctc

SEQ ID NO: 3673077 - DNA, 14 bp, Homo sapiens
agagactgtgccat

SEQ ID NO: 3673078 - DNA, 16 bp, Homo sapiens
agagactgtgccatgg

SEQ ID NO: 3673079 - DNA, 19 bp, Homo sapiens
agagacttgtgctcaagga

SEQ ID NO: 3673080 - DNA, 19 bp, Homo sapiens
agagagaaaaaaaaaatag

SEQ ID NO: 3673081 - DNA, 18 bp, Homo sapiens
agagagggaggcaagccc

SEQ ID NO: 3673082 - DNA, 13 bp, Homo sapiens
agagcactgccac

SEQ ID NO: 3673083 - DNA, 14 bp, Homo sapiens
agagcactgccacc

SEQ ID NO: 3673084 - DNA, 18 bp, Homo sapiens
agagcactgccaccagta

SEQ ID NO: 3673085 - DNA, 22 bp, Homo sapiens
agagcactgggtcatatggaaa

SEQ ID NO: 3673086 - DNA, 16 bp, Homo sapiens
agagcagcctgtggca

SEQ ID NO: 3673087 - DNA, 17 bp, Homo sapiens
agagcagcctgtggcat

SEQ ID NO: 3673088 - DNA, 16 bp, Homo sapiens
agagccactctatgag

SEQ ID NO: 3673089 - DNA, 14 bp, Homo sapiens
agagcccagctcca

SEQ ID NO: 3673090 - DNA, 15 bp, Homo sapiens
agagcccagctccaa

SEQ ID NO: 3673091 - DNA, 12 bp, Homo sapiens
agagcctgctgc

SEQ ID NO: 3673092 - DNA, 17 bp, Homo sapiens
agagcctgctgcatggg

SEQ ID NO: 3673093 - DNA, 17 bp, Homo sapiens
agagccttcaagtgcca

SEQ ID NO: 3673094 - DNA, 14 bp, Homo sapiens
agagcgcctgcccc

SEQ ID NO: 3673095 - DNA, 23 bp, Homo sapiens
agagcgcctgcccctcccagaac

SEQ ID NO: 3673096 - DNA, 11 bp, Homo sapiens
agagctgaggc

SEQ ID NO: 3673097 - DNA, 13 bp, Homo sapiens
agagctgctgggc

SEQ ID NO: 3673098 - DNA, 12 bp, Homo sapiens
agagctggctct

SEQ ID NO: 3673099 - DNA, 15 bp, Homo sapiens
agagctggtgcccgg

SEQ ID NO: 3673100 - DNA, 19 bp, Homo sapiens
agagctgtttatggcctca

SEQ ID NO: 3673101 - DNA, 21 bp, Homo sapiens
agagcttctcctgaccagggc

SEQ ID NO: 3673102 - DNA, 14 bp, Homo sapiens
agaggaaccaaccc

SEQ ID NO: 3673103 - DNA, 16 bp, Homo sapiens
agaggaaggagaggag

SEQ ID NO: 3673104 - DNA, 13 bp, Homo sapiens
agaggaagggtgg

SEQ ID NO: 3673105 - DNA, 12 bp, Homo sapiens
agaggacaggga

SEQ ID NO: 3673106 - DNA, 14 bp, Homo sapiens
agaggaccagggcc

SEQ ID NO: 3673107 - DNA, 15 bp, Homo sapiens
agaggaccagggcct

SEQ ID NO: 3673108 - DNA, 23 bp, Homo sapiens
agaggagttcaggaacccttctc

SEQ ID NO: 3673109 - DNA, 19 bp, Homo sapiens
agaggcaagcgaccgaggc

SEQ ID NO: 3673110 - DNA, 18 bp, Homo sapiens
agaggccaaaggctggtg

SEQ ID NO: 3673111 - DNA, 14 bp, Homo sapiens
agaggcccccagcc

SEQ ID NO: 3673112 - DNA, 20 bp, Homo sapiens
agaggcccgccctgcccggg

SEQ ID NO: 3673113 - DNA, 14 bp, Homo sapiens
agaggccctctgga

SEQ ID NO: 3673114 - DNA, 21 bp, Homo sapiens
agaggccctctggagtggcca

SEQ ID NO: 3673115 - DNA, 22 bp, Homo sapiens
agaggccctctggagtggccac

SEQ ID NO: 3673116 - DNA, 23 bp, Homo sapiens
agaggccctctggagtggccact

SEQ ID NO: 3673117 - DNA, 19 bp, Homo sapiens
agaggctgaggcctggact

SEQ ID NO: 3673118 - DNA, 14 bp, Homo sapiens
agaggctgggttca

SEQ ID NO: 3673119 - DNA, 14 bp, Homo sapiens
agagggaagaaaag

SEQ ID NO: 3673120 - DNA, 17 bp, Homo sapiens
agagggaggcaagccct

SEQ ID NO: 3673121 - DNA, 18 bp, Homo sapiens
agagggaggcaagccctg

SEQ ID NO: 3673122 - DNA, 16 bp, Homo sapiens
agagggaggggcctag

SEQ ID NO: 3673123 - DNA, 18 bp, Homo sapiens
agagggaggggcctaggc

SEQ ID NO: 3673124 - DNA, 20 bp, Homo sapiens
agagggagtagaatacgcag

SEQ ID NO: 3673125 - DNA, 14 bp, Homo sapiens
agaggtaccctggg

SEQ ID NO: 3673126 - DNA, 15 bp, Homo sapiens
agaggtaccctgggt

SEQ ID NO: 3673127 - DNA, 23 bp, Homo sapiens
agagtagttatataattgttgaa

SEQ ID NO: 3673128 - DNA, 13 bp, Homo sapiens
agagtcctcactc

SEQ ID NO: 3673129 - DNA, 12 bp, Homo sapiens
agagtctgaaca

SEQ ID NO: 3673130 - DNA, 17 bp, Homo sapiens
agagtctgaacagctgt

SEQ ID NO: 3673131 - DNA, 22 bp, Homo sapiens
agagtgacacccaagagggctg

SEQ ID NO: 3673132 - DNA, 11 bp, Homo sapiens
agagtggcctg

SEQ ID NO: 3673133 - DNA, 12 bp, Homo sapiens
agagtggcctgg

SEQ ID NO: 3673134 - DNA, 13 bp, Homo sapiens
agagtggcctggc

SEQ ID NO: 3673135 - DNA, 17 bp, Homo sapiens
agagtggcctggccagg

SEQ ID NO: 3673136 - DNA, 22 bp, Homo sapiens
agagtggcctggccaggagctc

SEQ ID NO: 3673137 - DNA, 11 bp, Homo sapiens
agagtgggagc

SEQ ID NO: 3673138 - DNA, 15 bp, Homo sapiens
agagtgtggaggctg

SEQ ID NO: 3673139 - DNA, 15 bp, Homo sapiens
agatacatacagaat

SEQ ID NO: 3673140 - DNA, 23 bp, Homo sapiens
agatacttctgaaataaatgttc

SEQ ID NO: 3673141 - DNA, 14 bp, Homo sapiens
agatatcagtgtct

SEQ ID NO: 3673142 - DNA, 20 bp, Homo sapiens
agatcagcaaaccggggcct

SEQ ID NO: 3673143 - DNA, 18 bp, Homo sapiens
agatccaaaagaagcccc

SEQ ID NO: 3673144 - DNA, 14 bp, Homo sapiens
agatctggaacctc

SEQ ID NO: 3673145 - DNA, 19 bp, Homo sapiens
agatctggaacctcagcct

SEQ ID NO: 3673146 - DNA, 14 bp, Homo sapiens
agatctgtcctcag

SEQ ID NO: 3673147 - DNA, 17 bp, Homo sapiens
agatctgtcctcagcct

SEQ ID NO: 3673148 - DNA, 12 bp, Homo sapiens
agatctgtgccc

SEQ ID NO: 3673149 - DNA, 18 bp, Homo sapiens
agatcttccgtggtcaga

SEQ ID NO: 3673150 - DNA, 22 bp, Homo sapiens
agatcttccgtggtcagagtgc

SEQ ID NO: 3673151 - DNA, 15 bp, Homo sapiens
agatgcaaagaggca

SEQ ID NO: 3673152 - DNA, 20 bp, Homo sapiens
agatgcaaagaggcaagagg

SEQ ID NO: 3673153 - DNA, 18 bp, Homo sapiens
agatgcaaggaccaggac

SEQ ID NO: 3673154 - DNA, 23 bp, Homo sapiens
agatgcaccaccaagccaaggga

SEQ ID NO: 3673155 - DNA, 22 bp, Homo sapiens
agatgccttttttgtagttttt

SEQ ID NO: 3673156 - DNA, 11 bp, Homo sapiens
ctgtgctggga

SEQ ID NO: 3673157 - DNA, 22 bp, Homo sapiens
ctgtgctgggaagcccggactg

SEQ ID NO: 3673158 - DNA, 13 bp, Homo sapiens
ctgtgctgtgtgt

SEQ ID NO: 3673159 - DNA, 18 bp, Homo sapiens
ctgtgctgtgtgtgacgt

SEQ ID NO: 3673160 - DNA, 17 bp, Homo sapiens
ctgtgcttcctcctgcc

SEQ ID NO: 3673161 - DNA, 12 bp, Homo sapiens
ctgtggccagcc

SEQ ID NO: 3673162 - DNA, 17 bp, Homo sapiens
ctgtggccagcctggca

SEQ ID NO: 3673163 - DNA, 18 bp, Homo sapiens
ctgtggccagcctggcat

SEQ ID NO: 3673164 - DNA, 14 bp, Homo sapiens
ctgtggccagctgc

SEQ ID NO: 3673165 - DNA, 16 bp, Homo sapiens
ctgtggccccaccctg

SEQ ID NO: 3673166 - DNA, 21 bp, Homo sapiens
ctgtggccccaccctgggccc

SEQ ID NO: 3673167 - DNA, 17 bp, Homo sapiens
ctgtggcgccgtctcca

SEQ ID NO: 3673168 - DNA, 19 bp, Homo sapiens
ctgtggcgccgtctccagg

SEQ ID NO: 3673169 - DNA, 21 bp, Homo sapiens
ctgtggcgccgtctccagggg

SEQ ID NO: 3673170 - DNA, 15 bp, Homo sapiens
ctgtggctagtgaca

SEQ ID NO: 3673171 - DNA, 16 bp, Homo sapiens
ctgtggctctgggtgg

SEQ ID NO: 3673172 - DNA, 15 bp, Homo sapiens
ctgtgggccctaccc

SEQ ID NO: 3673173 - DNA, 18 bp, Homo sapiens
ctgtgggccctaccctcc

SEQ ID NO: 3673174 - DNA, 20 bp, Homo sapiens
ctgtgggccctaccctcctg

SEQ ID NO: 3673175 - DNA, 18 bp, Homo sapiens
ctgtgggtggggcttctc

SEQ ID NO: 3673176 - DNA, 14 bp, Homo sapiens
ctgtgtatttgctt

SEQ ID NO: 3673177 - DNA, 15 bp, Homo sapiens
ctgtgtatttgcttt

SEQ ID NO: 3673178 - DNA, 18 bp, Homo sapiens
ctgtgtctgagcccaacc

SEQ ID NO: 3673179 - DNA, 19 bp, Homo sapiens
ctgtgtctttaaatgctgc

SEQ ID NO: 3673180 - DNA, 21 bp, Homo sapiens
ctgtgtgattgacagctttgc

SEQ ID NO: 3673181 - DNA, 23 bp, Homo sapiens
ctgtgtgattgacagctttgctg

SEQ ID NO: 3673182 - DNA, 18 bp, Homo sapiens
ctgtgtgtcccaggcagg

SEQ ID NO: 3673183 - DNA, 19 bp, Homo sapiens
ctgtgtgtcccaggcaggg

SEQ ID NO: 3673184 - DNA, 16 bp, Homo sapiens
ctgtgttgccaagctc

SEQ ID NO: 3673185 - DNA, 18 bp, Homo sapiens
ctgtgttggtgtggccca

SEQ ID NO: 3673186 - DNA, 14 bp, Homo sapiens
ctgttactgggccc

SEQ ID NO: 3673187 - DNA, 16 bp, Homo sapiens
ctgttactgggccctg

SEQ ID NO: 3673188 - DNA, 13 bp, Homo sapiens
ctgttactgtctt

SEQ ID NO: 3673189 - DNA, 12 bp, Homo sapiens
ctgttcagctgg

SEQ ID NO: 3673190 - DNA, 13 bp, Homo sapiens
ctgttccccagag

SEQ ID NO: 3673191 - DNA, 15 bp, Homo sapiens
ctgttcccttcctct

SEQ ID NO: 3673192 - DNA, 17 bp, Homo sapiens
ctgttcccttcctctgt

SEQ ID NO: 3673193 - DNA, 17 bp, Homo sapiens
ctgttctatgcttcctc

SEQ ID NO: 3673194 - DNA, 18 bp, Homo sapiens
ctgttgaagatttgagga

SEQ ID NO: 3673195 - DNA, 22 bp, Homo sapiens
ctgttgaagatttgaggacttg

SEQ ID NO: 3673196 - DNA, 21 bp, Homo sapiens
ctgttgacatatttaatgttt

SEQ ID NO: 3673197 - DNA, 18 bp, Homo sapiens
ctgttgacgcacctgtgg

SEQ ID NO: 3673198 - DNA, 16 bp, Homo sapiens
ctgttggcaggctggc

SEQ ID NO: 3673199 - DNA, 15 bp, Homo sapiens
ctgtttactgcaagg

SEQ ID NO: 3673200 - DNA, 18 bp, Homo sapiens
ctgtttgaaagtaaaaac

SEQ ID NO: 3673201 - DNA, 16 bp, Homo sapiens
ctgtttgtcctgagat

SEQ ID NO: 3673202 - DNA, 17 bp, Homo sapiens
ctgttttcctcccttct

SEQ ID NO: 3673203 - DNA, 14 bp, Homo sapiens
ctgttttgaggaat

SEQ ID NO: 3673204 - DNA, 14 bp, Homo sapiens
ctgtttttgttgtg

SEQ ID NO: 3673205 - DNA, 22 bp, Homo sapiens
cttaaacctcctgctgtgcctc

SEQ ID NO: 3673206 - DNA, 18 bp, Homo sapiens
cttaagattccattttgg

SEQ ID NO: 3673207 - DNA, 14 bp, Homo sapiens
cttaagcaaaagaa

SEQ ID NO: 3673208 - DNA, 21 bp, Homo sapiens
cttaaggtgtagccacaccag

SEQ ID NO: 3673209 - DNA, 22 bp, Homo sapiens
cttaagtaccaatgggaagcag

SEQ ID NO: 3673210 - DNA, 19 bp, Homo sapiens
cttaataaaagaacatgct

SEQ ID NO: 3673211 - DNA, 20 bp, Homo sapiens
cttaatcattttcattccta

SEQ ID NO: 3673212 - DNA, 23 bp, Homo sapiens
cttacccatctgcacccccctgg

SEQ ID NO: 3673213 - DNA, 20 bp, Homo sapiens
cttaccccttagcctccctg

SEQ ID NO: 3673214 - DNA, 19 bp, Homo sapiens
cttacctcggtgccttcct

SEQ ID NO: 3673215 - DNA, 13 bp, Homo sapiens
cttacctgtgacc

SEQ ID NO: 3673216 - DNA, 17 bp, Homo sapiens
cttagaacctttctgtg

SEQ ID NO: 3673217 - DNA, 18 bp, Homo sapiens
cttagaatgcatctcatc

SEQ ID NO: 3673218 - DNA, 18 bp, Homo sapiens
cttagatacactaaaaat

SEQ ID NO: 3673219 - DNA, 15 bp, Homo sapiens
cttagatctggcatg

SEQ ID NO: 3673220 - DNA, 16 bp, Homo sapiens
cttagatgtttcacac

SEQ ID NO: 3673221 - DNA, 15 bp, Homo sapiens
cttagcagcttccag

SEQ ID NO: 3673222 - DNA, 17 bp, Homo sapiens
cttagcagcttccagat

SEQ ID NO: 3673223 - DNA, 14 bp, Homo sapiens
cttaggcagggaag

SEQ ID NO: 3673224 - DNA, 19 bp, Homo sapiens
cttagggaagaaaaagcaa

SEQ ID NO: 3673225 - DNA, 23 bp, Homo sapiens
cttaggttggcaaaaaggcagga

SEQ ID NO: 3673226 - DNA, 14 bp, Homo sapiens
cttagtcctgggag

SEQ ID NO: 3673227 - DNA, 17 bp, Homo sapiens
cttagtcctgggagagg

SEQ ID NO: 3673228 - DNA, 16 bp, Homo sapiens
cttatactgtacaata

SEQ ID NO: 3673229 - DNA, 18 bp, Homo sapiens
cttatactgtacaataaa

SEQ ID NO: 3673230 - DNA, 21 bp, Homo sapiens
cttatagatgcaaagtatttt

SEQ ID NO: 3673231 - DNA, 13 bp, Homo sapiens
cttatcttctgga

SEQ ID NO: 3673232 - DNA, 13 bp, Homo sapiens
cttatggtaccag

SEQ ID NO: 3673233 - DNA, 22 bp, Homo sapiens
cttattgacaaccgagaaggtt

SEQ ID NO: 3673234 - DNA, 17 bp, Homo sapiens
cttattgcgctgctacc

SEQ ID NO: 3673235 - DNA, 16 bp, Homo sapiens
cttatttaatctccat

SEQ ID NO: 3673236 - DNA, 17 bp, Homo sapiens
cttatttcaaaaggaag

SEQ ID NO: 3673237 - DNA, 14 bp, Homo sapiens
cttatttcatctgt

SEQ ID NO: 3673238 - DNA, 15 bp, Homo sapiens
cttatttttctgtga

SEQ ID NO: 3673239 - DNA, 15 bp, Homo sapiens
cttcaaactgagaca

SEQ ID NO: 3673240 - DNA, 16 bp, Homo sapiens
cttcacggcaggacaa

SEQ ID NO: 3673241 - DNA, 20 bp, Homo sapiens
cttcagacagagaggactgt

SEQ ID NO: 3673242 - DNA, 18 bp, Homo sapiens
cttcagccaggagctggg

SEQ ID NO: 3673243 - DNA, 11 bp, Homo sapiens
cttcagctgac

SEQ ID NO: 3673244 - DNA, 19 bp, Homo sapiens
cttcagctgacttttctgt

SEQ ID NO: 3673245 - DNA, 15 bp, Homo sapiens
cttcaggggaggcca

SEQ ID NO: 3673246 - DNA, 18 bp, Homo sapiens
cttcaggtcaggagttcg

SEQ ID NO: 3673247 - DNA, 17 bp, Homo sapiens
cttcaggtccaggctgt

SEQ ID NO: 3673248 - DNA, 18 bp, Homo sapiens
cttcaggtccaggctgtg

SEQ ID NO: 3673249 - DNA, 20 bp, Homo sapiens
cttcatattctaaaaccatt

SEQ ID NO: 3673250 - DNA, 13 bp, Homo sapiens
cttcattctcctt

SEQ ID NO: 3673251 - DNA, 16 bp, Homo sapiens
cttcattttcagagtg

SEQ ID NO: 3673252 - DNA, 16 bp, Homo sapiens
cttccaaaggcagcgt

SEQ ID NO: 3673253 - DNA, 15 bp, Homo sapiens
cttccaaatgtccct

SEQ ID NO: 3673254 - DNA, 14 bp, Homo sapiens
cttccacgggggct

SEQ ID NO: 3673255 - DNA, 16 bp, Homo sapiens
cttccagaaaacaaaa

SEQ ID NO: 3673256 - DNA, 13 bp, Homo sapiens
cttccagcattta

SEQ ID NO: 3673257 - DNA, 15 bp, Homo sapiens
cttccatccctaccc

SEQ ID NO: 3673258 - DNA, 13 bp, Homo sapiens
cttcccaccctgc

SEQ ID NO: 3673259 - DNA, 20 bp, Homo sapiens
cttcccctccctggctccca

SEQ ID NO: 3673260 - DNA, 23 bp, Homo sapiens
cttcccctctaactggacagcct

SEQ ID NO: 3673261 - DNA, 20 bp, Homo sapiens
cttcccctctctcctcctgc

SEQ ID NO: 3673262 - DNA, 16 bp, Homo sapiens
cttccctacctcaggc

SEQ ID NO: 3673263 - DNA, 17 bp, Homo sapiens
cttccctacctcaggca

SEQ ID NO: 3673264 - DNA, 20 bp, Homo sapiens
cttccctacctcaggcagga

SEQ ID NO: 3673265 - DNA, 22 bp, Homo sapiens
cttccgtggtcagagtgccact

SEQ ID NO: 3673266 - DNA, 19 bp, Homo sapiens
cttcctaaatattatgaga

SEQ ID NO: 3673267 - DNA, 12 bp, Homo sapiens
cttcctcctgga

SEQ ID NO: 3673268 - DNA, 18 bp, Homo sapiens
cttcctgcaaccactctg

SEQ ID NO: 3673269 - DNA, 21 bp, Homo sapiens
cttcctggatggggcagagct

SEQ ID NO: 3673270 - DNA, 19 bp, Homo sapiens
cttcctggcccctcatggc

SEQ ID NO: 3673271 - DNA, 16 bp, Homo sapiens
cttcctgtccagctcc

SEQ ID NO: 3673272 - DNA, 13 bp, Homo sapiens
cttcgcagaggca

SEQ ID NO: 3673273 - DNA, 17 bp, Homo sapiens
cttcgcataaagaagaa

SEQ ID NO: 3673274 - DNA, 17 bp, Homo sapiens
cttcgcttcttgcctct

SEQ ID NO: 3673275 - DNA, 22 bp, Homo sapiens
cttcgtctttcccatggggagg

SEQ ID NO: 3673276 - DNA, 12 bp, Homo sapiens
cttctacccaga

SEQ ID NO: 3673277 - DNA, 13 bp, Homo sapiens
cttctacttctgc

SEQ ID NO: 3673278 - DNA, 12 bp, Homo sapiens
cttctccctggg

SEQ ID NO: 3673279 - DNA, 13 bp, Homo sapiens
cttctccctgggg

SEQ ID NO: 3673280 - DNA, 15 bp, Homo sapiens
cttctccctggggac

SEQ ID NO: 3673281 - DNA, 23 bp, Homo sapiens
cttctccctggggacggggctcc

SEQ ID NO: 3673282 - DNA, 20 bp, Homo sapiens
cttctcctacttagggaaga

SEQ ID NO: 3673283 - DNA, 21 bp, Homo sapiens
cttctcctgcgggggcgaggc

SEQ ID NO: 3673284 - DNA, 14 bp, Homo sapiens
cttctccttggagg

SEQ ID NO: 3673285 - DNA, 22 bp, Homo sapiens
cttctctgacttctgcctggag

SEQ ID NO: 3673286 - DNA, 11 bp, Homo sapiens
cttctctgctc

SEQ ID NO: 3673287 - DNA, 13 bp, Homo sapiens
cttctctgctcca

SEQ ID NO: 3673288 - DNA, 18 bp, Homo sapiens
cttctcttgggtgggaca

SEQ ID NO: 3673289 - DNA, 18 bp, Homo sapiens
cttctgaactttggaagc

SEQ ID NO: 3673290 - DNA, 14 bp, Homo sapiens
cttctgaatatttt

SEQ ID NO: 3673291 - DNA, 13 bp, Homo sapiens
cttctgcctggag

SEQ ID NO: 3673292 - DNA, 14 bp, Homo sapiens
cttctgcctggaga

SEQ ID NO: 3673293 - DNA, 15 bp, Homo sapiens
cttctgcctggagac

SEQ ID NO: 3673294 - DNA, 13 bp, Homo sapiens
cttctgctactgg

SEQ ID NO: 3673295 - DNA, 10 bp, Homo sapiens
cttctgctcc

SEQ ID NO: 3673296 - DNA, 13 bp, Homo sapiens
cttctgctccacc

SEQ ID NO: 3673297 - DNA, 15 bp, Homo sapiens
cttctgctccaccct

SEQ ID NO: 3673298 - DNA, 23 bp, Homo sapiens
cttctgctccacccttggcctgt

SEQ ID NO: 3673299 - DNA, 13 bp, Homo sapiens
cttctggccagga

SEQ ID NO: 3673300 - DNA, 15 bp, Homo sapiens
cttctggccaggaag

SEQ ID NO: 3673301 - DNA, 19 bp, Homo sapiens
cttctgggttcaagcgatt

SEQ ID NO: 3673302 - DNA, 13 bp, Homo sapiens
cttctgtgtatct

SEQ ID NO: 3673303 - DNA, 22 bp, Homo sapiens
cttctgtgtatctctttcacat

SEQ ID NO: 3673304 - DNA, 16 bp, Homo sapiens
cttctgtttagtctcc

SEQ ID NO: 3673305 - DNA, 16 bp, Homo sapiens
cttcttacgcaatgct

SEQ ID NO: 3673306 - DNA, 13 bp, Homo sapiens
cttcttcctggat

SEQ ID NO: 3673307 - DNA, 14 bp, Homo sapiens
cttcttcttctttg

SEQ ID NO: 3673308 - DNA, 12 bp, Homo sapiens
cttcttgaaggt

SEQ ID NO: 3673309 - DNA, 15 bp, Homo sapiens
cttcttgcctctgtg

SEQ ID NO: 3673310 - DNA, 22 bp, Homo sapiens
cttcttggggcccagtgcatgg

SEQ ID NO: 3673311 - DNA, 18 bp, Homo sapiens
cttgaactcctggactca

SEQ ID NO: 3673312 - DNA, 15 bp, Homo sapiens
cttgaactgttgccc

SEQ ID NO: 3673313 - DNA, 17 bp, Homo sapiens
cttgaactgttgccctt

SEQ ID NO: 3673314 - DNA, 22 bp, Homo sapiens
cttgaagaactgcaggccctgg

SEQ ID NO: 3673315 - DNA, 22 bp, Homo sapiens
cttgaaggtgctgacggccagg

SEQ ID NO: 3673316 - DNA, 14 bp, Homo sapiens
cttgacaactggca

SEQ ID NO: 3673317 - DNA, 17 bp, Homo sapiens
cttgacagaacactgtc

SEQ ID NO: 3673318 - DNA, 12 bp, Homo sapiens
cttgaccaagca

SEQ ID NO: 3673319 - DNA, 13 bp, Homo sapiens
cttgaccctgagc

SEQ ID NO: 3673320 - DNA, 14 bp, Homo sapiens
cttgacctgaggct

SEQ ID NO: 3673321 - DNA, 20 bp, Homo sapiens
cttgacctgaggctgtggtc

SEQ ID NO: 3673322 - DNA, 23 bp, Homo sapiens
cttgacctgaggctgtggtcaca

SEQ ID NO: 3673323 - DNA, 15 bp, Homo sapiens
cttgagattttgtat

SEQ ID NO: 3673324 - DNA, 13 bp, Homo sapiens
cttgagcagtggc

SEQ ID NO: 3673325 - DNA, 16 bp, Homo sapiens
cttgagcagtggctgg

SEQ ID NO: 3673326 - DNA, 21 bp, Homo sapiens
cttgagcagtggctggtccag

SEQ ID NO: 3673327 - DNA, 12 bp, Homo sapiens
cttgagcctggg

SEQ ID NO: 3673328 - DNA, 13 bp, Homo sapiens
cttgagctcagga

SEQ ID NO: 3673329 - DNA, 21 bp, Homo sapiens
cttgagtcaaaaaacatgagc

SEQ ID NO: 3673330 - DNA, 13 bp, Homo sapiens
cttgagtttgtcg

SEQ ID NO: 3673331 - DNA, 22 bp, Homo sapiens
cttgatagaaatgccaagcact

SEQ ID NO: 3673332 - DNA, 19 bp, Homo sapiens
cttgatcatgaatcactgc

SEQ ID NO: 3673333 - DNA, 23 bp, Homo sapiens
cttgatggaagtgggccagtcct

SEQ ID NO: 3673334 - DNA, 18 bp, Homo sapiens
cttgatttaaacacacag

SEQ ID NO: 3673335 - DNA, 16 bp, Homo sapiens
cttgcacacactttca

SEQ ID NO: 3673336 - DNA, 22 bp, Homo sapiens
cttgcaccccaaagctttcctg

SEQ ID NO: 3673337 - DNA, 23 bp, Homo sapiens
cttgcaccccaaagctttcctgc

SEQ ID NO: 3673338 - DNA, 18 bp, Homo sapiens
cttgcagttcagcaccac

SEQ ID NO: 3673339 - DNA, 22 bp, Homo sapiens
cttgcagttcagcaccacccta

SEQ ID NO: 3673340 - DNA, 11 bp, Homo sapiens
cttgcccagga

SEQ ID NO: 3673341 - DNA, 15 bp, Homo sapiens
cttgcctcaatgcca

SEQ ID NO: 3673342 - DNA, 18 bp, Homo sapiens
cttgcctcaatgccagta

SEQ ID NO: 3673343 - DNA, 16 bp, Homo sapiens
cttgcctccaggtgca

SEQ ID NO: 3673344 - DNA, 19 bp, Homo sapiens
cttgcctccaggtgcagag

SEQ ID NO: 3673345 - DNA, 15 bp, Homo sapiens
cttgcctctgtgctg

SEQ ID NO: 3673346 - DNA, 19 bp, Homo sapiens
cttgcctctgtgctgtgtg

SEQ ID NO: 3673347 - DNA, 20 bp, Homo sapiens
cttgcctctgtgctgtgtgt

SEQ ID NO: 3673348 - DNA, 12 bp, Homo sapiens
cttgcctcttcc

SEQ ID NO: 3673349 - DNA, 16 bp, Homo sapiens
cttgcctgcagggcca

SEQ ID NO: 3673350 - DNA, 17 bp, Homo sapiens
cttgcctgcagggccat

SEQ ID NO: 3673351 - DNA, 12 bp, Homo sapiens
cttgctggaaga

SEQ ID NO: 3673352 - DNA, 14 bp, Homo sapiens
cttgctggaagaca

SEQ ID NO: 3673353 - DNA, 15 bp, Homo sapiens
cttgctggaagacag

SEQ ID NO: 3673354 - DNA, 18 bp, Homo sapiens
cttgctgtggagctccac

SEQ ID NO: 3673355 - DNA, 21 bp, Homo sapiens
cttgctgttgacatatttaat

SEQ ID NO: 3673356 - DNA, 19 bp, Homo sapiens
cttgctgtttgtcctgaga

SEQ ID NO: 3673357 - DNA, 15 bp, Homo sapiens
cttgcttatttgaca

SEQ ID NO: 3673358 - DNA, 21 bp, Homo sapiens
cttggaaactggatgaggtca

SEQ ID NO: 3673359 - DNA, 17 bp, Homo sapiens
cttggacatcctcctcc

SEQ ID NO: 3673360 - DNA, 19 bp, Homo sapiens
cttggacatcctcctccca

SEQ ID NO: 3673361 - DNA, 22 bp, Homo sapiens
cttggacatcctcctcccaccc

SEQ ID NO: 3673362 - DNA, 14 bp, Homo sapiens
cttggagctgagca

SEQ ID NO: 3673363 - DNA, 17 bp, Homo sapiens
cttggagctgagcaaat

SEQ ID NO: 3673364 - DNA, 12 bp, Homo sapiens
cttggaggacag

SEQ ID NO: 3673365 - DNA, 14 bp, Homo sapiens
cttggaggacagtg

SEQ ID NO: 3673366 - DNA, 15 bp, Homo sapiens
cttggaggacagtgg

SEQ ID NO: 3673367 - DNA, 16 bp, Homo sapiens
cttggcaccagacacc

SEQ ID NO: 3673368 - DNA, 20 bp, Homo sapiens
cttggcaccagacacccagg

SEQ ID NO: 3673369 - DNA, 22 bp, Homo sapiens
cttggcctgtctcatccccagg

SEQ ID NO: 3673370 - DNA, 19 bp, Homo sapiens
cttggctcgaatctctgtg

SEQ ID NO: 3673371 - DNA, 21 bp, Homo sapiens
cttggcttgatggaagtgggc

SEQ ID NO: 3673372 - DNA, 22 bp, Homo sapiens
cttggctttgttgatgctccgc

SEQ ID NO: 3673373 - DNA, 22 bp, Homo sapiens
cttgggaaaggtggtgtttctg

SEQ ID NO: 3673374 - DNA, 18 bp, Homo sapiens
cttgggccactgtgaaga

SEQ ID NO: 3673375 - DNA, 23 bp, Homo sapiens
cttggggagttaagacctggcag

SEQ ID NO: 3673376 - DNA, 12 bp, Homo sapiens
cttggggcccag

SEQ ID NO: 3673377 - DNA, 15 bp, Homo sapiens
cttggggcccagtgc

SEQ ID NO: 3673378 - DNA, 13 bp, Homo sapiens
cttgggtgggaca

SEQ ID NO: 3673379 - DNA, 16 bp, Homo sapiens
cttgggtgggacaggg

SEQ ID NO: 3673380 - DNA, 18 bp, Homo sapiens
cttgggtgggacagggct

SEQ ID NO: 3673381 - DNA, 19 bp, Homo sapiens
cttgggtgggacagggctt

SEQ ID NO: 3673382 - DNA, 20 bp, Homo sapiens
cttgggtgggacagggcttc

SEQ ID NO: 3673383 - DNA, 13 bp, Homo sapiens
cttggtcagagcc

SEQ ID NO: 3673384 - DNA, 15 bp, Homo sapiens
cttggtttgccttcc

SEQ ID NO: 3673385 - DNA, 23 bp, Homo sapiens
cttgtaaattattaatttatgca

SEQ ID NO: 3673386 - DNA, 16 bp, Homo sapiens
cttgtaatttttattt

SEQ ID NO: 3673387 - DNA, 20 bp, Homo sapiens
cttgtaggtatgtctgtgcc

SEQ ID NO: 3673388 - DNA, 14 bp, Homo sapiens
cttgtataaattat

SEQ ID NO: 3673389 - DNA, 19 bp, Homo sapiens
cttgtcccactcaagccaa

SEQ ID NO: 3673390 - DNA, 21 bp, Homo sapiens
cttgtcccactcaagccaagc

SEQ ID NO: 3673391 - DNA, 21 bp, Homo sapiens
cttgtcccctcctcactccct

SEQ ID NO: 3673392 - DNA, 14 bp, Homo sapiens
cttgtctcaggact

SEQ ID NO: 3673393 - DNA, 13 bp, Homo sapiens
cttgtctgtagat

SEQ ID NO: 3673394 - DNA, 20 bp, Homo sapiens
ctgaggtcccctcgtcccat

SEQ ID NO: 3673395 - DNA, 19 bp, Homo sapiens
ctgaggtgaaagggagcta

SEQ ID NO: 3673396 - DNA, 12 bp, Homo sapiens
ctgaggtgggag

SEQ ID NO: 3673397 - DNA, 17 bp, Homo sapiens
ctgagtagctctcctga

SEQ ID NO: 3673398 - DNA, 13 bp, Homo sapiens
ctgagtggcaggg

SEQ ID NO: 3673399 - DNA, 20 bp, Homo sapiens
ctgagttgacttgacagaac

SEQ ID NO: 3673400 - DNA, 18 bp, Homo sapiens
ctgagttttccatggcag

SEQ ID NO: 3673401 - DNA, 19 bp, Homo sapiens
ctgagttttccatggcagg

SEQ ID NO: 3673402 - DNA, 15 bp, Homo sapiens
ctgatcctggaggcc

SEQ ID NO: 3673403 - DNA, 18 bp, Homo sapiens
ctgatcctggaggcccag

SEQ ID NO: 3673404 - DNA, 21 bp, Homo sapiens
ctgatcctggaggcccagttc

SEQ ID NO: 3673405 - DNA, 12 bp, Homo sapiens
ctgatgctccct

SEQ ID NO: 3673406 - DNA, 17 bp, Homo sapiens
ctgatgctccctcccct

SEQ ID NO: 3673407 - DNA, 22 bp, Homo sapiens
ctgatgctgctatatccactgt

SEQ ID NO: 3673408 - DNA, 19 bp, Homo sapiens
ctgatgcttttgtctaatt

SEQ ID NO: 3673409 - DNA, 22 bp, Homo sapiens
ctgatgtcaatttctgtgttgc

SEQ ID NO: 3673410 - DNA, 15 bp, Homo sapiens
ctgattccgcaccct

SEQ ID NO: 3673411 - DNA, 17 bp, Homo sapiens
ctgattccgcaccctgc

SEQ ID NO: 3673412 - DNA, 18 bp, Homo sapiens
ctgattccgcaccctgcc

SEQ ID NO: 3673413 - DNA, 17 bp, Homo sapiens
ctgattggtgcaaccct

SEQ ID NO: 3673414 - DNA, 22 bp, Homo sapiens
ctgatttaggagaagccaggaa

SEQ ID NO: 3673415 - DNA, 23 bp, Homo sapiens
ctgcaaaaaatactttttctaat

SEQ ID NO: 3673416 - DNA, 14 bp, Homo sapiens
ctgcaaccactctg

SEQ ID NO: 3673417 - DNA, 19 bp, Homo sapiens
ctgcaaccactctgtggcc

SEQ ID NO: 3673418 - DNA, 23 bp, Homo sapiens
ctgcaactcaaggactttgcagc

SEQ ID NO: 3673419 - DNA, 22 bp, Homo sapiens
ctgcaaggtttaggctggtggc

SEQ ID NO: 3673420 - DNA, 23 bp, Homo sapiens
ctgcaaggtttaggctggtggcc

SEQ ID NO: 3673421 - DNA, 15 bp, Homo sapiens
ctgcacactcagtgg

SEQ ID NO: 3673422 - DNA, 22 bp, Homo sapiens
ctgcacatgactcgggggtggg

SEQ ID NO: 3673423 - DNA, 15 bp, Homo sapiens
ctgcacccccctggg

SEQ ID NO: 3673424 - DNA, 17 bp, Homo sapiens
ctgcacccccctgggct

SEQ ID NO: 3673425 - DNA, 16 bp, Homo sapiens
ctgcaccctcaggcag

SEQ ID NO: 3673426 - DNA, 17 bp, Homo sapiens
ctgcaccctcaggcagg

SEQ ID NO: 3673427 - DNA, 14 bp, Homo sapiens
ctgcactactgaca

SEQ ID NO: 3673428 - DNA, 17 bp, Homo sapiens
ctgcactgatgctgccc

SEQ ID NO: 3673429 - DNA, 20 bp, Homo sapiens
ctgcagaggccagaggcccc

SEQ ID NO: 3673430 - DNA, 22 bp, Homo sapiens
ctgcagaggggaaagacttcca

SEQ ID NO: 3673431 - DNA, 16 bp, Homo sapiens
ctgcagatcttccgtg

SEQ ID NO: 3673432 - DNA, 16 bp, Homo sapiens
ctgcagcaccgagggg

SEQ ID NO: 3673433 - DNA, 18 bp, Homo sapiens
ctgcagcaccgaggggcc

SEQ ID NO: 3673434 - DNA, 19 bp, Homo sapiens
ctgcagcaccgaggggcct

SEQ ID NO: 3673435 - DNA, 14 bp, Homo sapiens
ctgcagccagctca

SEQ ID NO: 3673436 - DNA, 21 bp, Homo sapiens
ctgcaggaatcccggctccag

SEQ ID NO: 3673437 - DNA, 13 bp, Homo sapiens
ctgcaggccctgg

SEQ ID NO: 3673438 - DNA, 13 bp, Homo sapiens
ctgcaggcggggc

SEQ ID NO: 3673439 - DNA, 15 bp, Homo sapiens
ctgcaggcggggctc

SEQ ID NO: 3673440 - DNA, 17 bp, Homo sapiens
ctgcaggcggggctcct

SEQ ID NO: 3673441 - DNA, 13 bp, Homo sapiens
ctgcagtcacagc

SEQ ID NO: 3673442 - DNA, 22 bp, Homo sapiens
ctgcagtcatcttgaccaagca

SEQ ID NO: 3673443 - DNA, 14 bp, Homo sapiens
ctgcagttcttgtg

SEQ ID NO: 3673444 - DNA, 13 bp, Homo sapiens
ctgcataggctcc

SEQ ID NO: 3673445 - DNA, 23 bp, Homo sapiens
ctgcataggctccttcctgtggg

SEQ ID NO: 3673446 - DNA, 16 bp, Homo sapiens
ctgcatctgaccagca

SEQ ID NO: 3673447 - DNA, 20 bp, Homo sapiens
ctgcatctgaccagcagcgc

SEQ ID NO: 3673448 - DNA, 14 bp, Homo sapiens
ctgcatctttttga

SEQ ID NO: 3673449 - DNA, 14 bp, Homo sapiens
ctgcattcttaaca

SEQ ID NO: 3673450 - DNA, 18 bp, Homo sapiens
ctgcatttcggtggctag

SEQ ID NO: 3673451 - DNA, 22 bp, Homo sapiens
ctgccaaggccagagtggcctg

SEQ ID NO: 3673452 - DNA, 23 bp, Homo sapiens
ctgccaaggccagagtggcctgg

SEQ ID NO: 3673453 - DNA, 17 bp, Homo sapiens
ctgccaataacattctt

SEQ ID NO: 3673454 - DNA, 17 bp, Homo sapiens
ctgccaccaggccacct

SEQ ID NO: 3673455 - DNA, 22 bp, Homo sapiens
ctgccacccacctccctgcctc

SEQ ID NO: 3673456 - DNA, 23 bp, Homo sapiens
ctgccacccacctccctgcctcc

SEQ ID NO: 3673457 - DNA, 11 bp, Homo sapiens
ctgccagctgc

SEQ ID NO: 3673458 - DNA, 13 bp, Homo sapiens
ctgccaggccccc

SEQ ID NO: 3673459 - DNA, 18 bp, Homo sapiens
ctgccaggcccccaagcc

SEQ ID NO: 3673460 - DNA, 22 bp, Homo sapiens
ctgccaggcccccaagcctgca

SEQ ID NO: 3673461 - DNA, 20 bp, Homo sapiens
ctgccagggaactggcctgc

SEQ ID NO: 3673462 - DNA, 21 bp, Homo sapiens
ctgccagggaactggcctgct

SEQ ID NO: 3673463 - DNA, 12 bp, Homo sapiens
ctgccagggagc

SEQ ID NO: 3673464 - DNA, 13 bp, Homo sapiens
ctgccagggagct

SEQ ID NO: 3673465 - DNA, 16 bp, Homo sapiens
ctgccagtgacagaca

SEQ ID NO: 3673466 - DNA, 17 bp, Homo sapiens
ctgccatctagccagcc

SEQ ID NO: 3673467 - DNA, 20 bp, Homo sapiens
ctgccatctcacctcctgct

SEQ ID NO: 3673468 - DNA, 15 bp, Homo sapiens
ctgccatgccagctt

SEQ ID NO: 3673469 - DNA, 19 bp, Homo sapiens
ctgccatgccagcttatct

SEQ ID NO: 3673470 - DNA, 19 bp, Homo sapiens
ctgccatgtactagtttta

SEQ ID NO: 3673471 - DNA, 22 bp, Homo sapiens
ctgccattcttctggtgctact

SEQ ID NO: 3673472 - DNA, 14 bp, Homo sapiens
ctgccattgggacc

SEQ ID NO: 3673473 - DNA, 21 bp, Homo sapiens
ctgccattgggaccctccagt

SEQ ID NO: 3673474 - DNA, 20 bp, Homo sapiens
ctgcccaacccttccctcac

SEQ ID NO: 3673475 - DNA, 12 bp, Homo sapiens
ctgcccacctgc

SEQ ID NO: 3673476 - DNA, 18 bp, Homo sapiens
ctgcccagagctgctggt

SEQ ID NO: 3673477 - DNA, 15 bp, Homo sapiens
ctgcccatcacaggg

SEQ ID NO: 3673478 - DNA, 14 bp, Homo sapiens
ctgccccaggcctg

SEQ ID NO: 3673479 - DNA, 18 bp, Homo sapiens
ctgccccatcctccagca

SEQ ID NO: 3673480 - DNA, 21 bp, Homo sapiens
ctgccccatcctccagcaggg

SEQ ID NO: 3673481 - DNA, 12 bp, Homo sapiens
ctgcccctgctg

SEQ ID NO: 3673482 - DNA, 14 bp, Homo sapiens
ctgcccctgctgct

SEQ ID NO: 3673483 - DNA, 11 bp, Homo sapiens
ctgcccctggc

SEQ ID NO: 3673484 - DNA, 16 bp, Homo sapiens
ctgcccctggctctga

SEQ ID NO: 3673485 - DNA, 20 bp, Homo sapiens
ctgcccggcagggtcctaga

SEQ ID NO: 3673486 - DNA, 15 bp, Homo sapiens
ctgcccgggctccca

SEQ ID NO: 3673487 - DNA, 16 bp, Homo sapiens
ctgccctcgggtctcc

SEQ ID NO: 3673488 - DNA, 14 bp, Homo sapiens
ctgccctggtccag

SEQ ID NO: 3673489 - DNA, 15 bp, Homo sapiens
ctgccctggtccagg

SEQ ID NO: 3673490 - DNA, 15 bp, Homo sapiens
ctgccctgtttctgt

SEQ ID NO: 3673491 - DNA, 18 bp, Homo sapiens
ctgcccttgtcccactca

SEQ ID NO: 3673492 - DNA, 15 bp, Homo sapiens
ctgccggccctgggg

SEQ ID NO: 3673493 - DNA, 19 bp, Homo sapiens
ctgccgtcagtgctgtgct

SEQ ID NO: 3673494 - DNA, 13 bp, Homo sapiens
ctgccgtggggcc

SEQ ID NO: 3673495 - DNA, 13 bp, Homo sapiens
ctgcctaagccct

SEQ ID NO: 3673496 - DNA, 19 bp, Homo sapiens
ctgcctcaaattctgcgtt

SEQ ID NO: 3673497 - DNA, 23 bp, Homo sapiens
ctgcctcacttcctacaagagca

SEQ ID NO: 3673498 - DNA, 14 bp, Homo sapiens
ctgcctccagcctg

SEQ ID NO: 3673499 - DNA, 20 bp, Homo sapiens
ctgcctccagcctggtggcc

SEQ ID NO: 3673500 - DNA, 13 bp, Homo sapiens
ctgcctcccatgc

SEQ ID NO: 3673501 - DNA, 15 bp, Homo sapiens
ctgcctcttctctac

SEQ ID NO: 3673502 - DNA, 14 bp, Homo sapiens
ctgcctctttccct

SEQ ID NO: 3673503 - DNA, 18 bp, Homo sapiens
ctgcctctttccctagga

SEQ ID NO: 3673504 - DNA, 11 bp, Homo sapiens
ctgcctgaggg

SEQ ID NO: 3673505 - DNA, 16 bp, Homo sapiens
ctgcctgagggtgggc

SEQ ID NO: 3673506 - DNA, 17 bp, Homo sapiens
ctgcctggccaggcaga

SEQ ID NO: 3673507 - DNA, 21 bp, Homo sapiens
ctgcctggccaggcagatctg

SEQ ID NO: 3673508 - DNA, 14 bp, Homo sapiens
ctgccttcgcttct

SEQ ID NO: 3673509 - DNA, 14 bp, Homo sapiens
ctgcctttgcacca

SEQ ID NO: 3673510 - DNA, 14 bp, Homo sapiens
ctgcgaccctgggg

SEQ ID NO: 3673511 - DNA, 21 bp, Homo sapiens
ctgcgaccctgggggcacagg

SEQ ID NO: 3673512 - DNA, 16 bp, Homo sapiens
ctgcgactttctgcct

SEQ ID NO: 3673513 - DNA, 15 bp, Homo sapiens
ctgggccgctgccac

SEQ ID NO: 3673514 - DNA, 20 bp, Homo sapiens
ctgggccgggacccagggcc

SEQ ID NO: 3673515 - DNA, 23 bp, Homo sapiens
ctgggcgtagtggctcacacctg

SEQ ID NO: 3673516 - DNA, 16 bp, Homo sapiens
ctgggctgctcctgaa

SEQ ID NO: 3673517 - DNA, 17 bp, Homo sapiens
ctggggaaataacagct

SEQ ID NO: 3673518 - DNA, 22 bp, Homo sapiens
ctggggaaataacagctgtggc

SEQ ID NO: 3673519 - DNA, 15 bp, Homo sapiens
ctggggacggggctc

SEQ ID NO: 3673520 - DNA, 20 bp, Homo sapiens
ctggggactgctacctctga

SEQ ID NO: 3673521 - DNA, 21 bp, Homo sapiens
ctgggggcagaactcctacct

SEQ ID NO: 3673522 - DNA, 23 bp, Homo sapiens
ctgggggcagaactcctacctga

SEQ ID NO: 3673523 - DNA, 14 bp, Homo sapiens
ctgggggcaggagg

SEQ ID NO: 3673524 - DNA, 19 bp, Homo sapiens
ctgggggcaggagggccct

SEQ ID NO: 3673525 - DNA, 21 bp, Homo sapiens
ctgggggcgggactcctccct

SEQ ID NO: 3673526 - DNA, 23 bp, Homo sapiens
ctgggggcgggactcctccctgg

SEQ ID NO: 3673527 - DNA, 14 bp, Homo sapiens
ctggggggacccag

SEQ ID NO: 3673528 - DNA, 17 bp, Homo sapiens
ctggggggacccagtgc

SEQ ID NO: 3673529 - DNA, 16 bp, Homo sapiens
ctgggggtgggccagg

SEQ ID NO: 3673530 - DNA, 14 bp, Homo sapiens
ctgggggtggggct

SEQ ID NO: 3673531 - DNA, 21 bp, Homo sapiens
ctgggggtggggctcctacct

SEQ ID NO: 3673532 - DNA, 16 bp, Homo sapiens
ctggggtaggctgctc

SEQ ID NO: 3673533 - DNA, 20 bp, Homo sapiens
ctggggtataaaactttcct

SEQ ID NO: 3673534 - DNA, 14 bp, Homo sapiens
ctggggtggggtca

SEQ ID NO: 3673535 - DNA, 16 bp, Homo sapiens
ctggggtgtgggaggc

SEQ ID NO: 3673536 - DNA, 21 bp, Homo sapiens
ctggggtttgaccacccacct

SEQ ID NO: 3673537 - DNA, 15 bp, Homo sapiens
ctgggtaagaagaaa

SEQ ID NO: 3673538 - DNA, 18 bp, Homo sapiens
ctgggtggcaccagcagc

SEQ ID NO: 3673539 - DNA, 21 bp, Homo sapiens
ctgggtggcaccagcagcctg

SEQ ID NO: 3673540 - DNA, 19 bp, Homo sapiens
ctgggtgggcgtggcctgc

SEQ ID NO: 3673541 - DNA, 17 bp, Homo sapiens
ctgggtggttctctggg

SEQ ID NO: 3673542 - DNA, 14 bp, Homo sapiens
ctgggttccctttc

SEQ ID NO: 3673543 - DNA, 16 bp, Homo sapiens
ctgggttccctttcct

SEQ ID NO: 3673544 - DNA, 20 bp, Homo sapiens
ctgggttccctttccttcca

SEQ ID NO: 3673545 - DNA, 18 bp, Homo sapiens
ctgggttggaaaacagta

SEQ ID NO: 3673546 - DNA, 16 bp, Homo sapiens
ctggtacaacggaggc

SEQ ID NO: 3673547 - DNA, 15 bp, Homo sapiens
ctggtaggaccaagc

SEQ ID NO: 3673548 - DNA, 18 bp, Homo sapiens
ctggtaggaccaagcatc

SEQ ID NO: 3673549 - DNA, 21 bp, Homo sapiens
ctggtccagggaagctggccg

SEQ ID NO: 3673550 - DNA, 17 bp, Homo sapiens
ctggtcccttgcagcta

SEQ ID NO: 3673551 - DNA, 21 bp, Homo sapiens
ctggtcccttgcagctagttt

SEQ ID NO: 3673552 - DNA, 21 bp, Homo sapiens
ctggtccgtgggacggtgccc

SEQ ID NO: 3673553 - DNA, 17 bp, Homo sapiens
ctggtcctacccatccc

SEQ ID NO: 3673554 - DNA, 12 bp, Homo sapiens
ctggtctttgag

SEQ ID NO: 3673555 - DNA, 17 bp, Homo sapiens
ctggtgctactccatgc

SEQ ID NO: 3673556 - DNA, 17 bp, Homo sapiens
ctggtggccactgagct

SEQ ID NO: 3673557 - DNA, 21 bp, Homo sapiens
ctggtggccactgagctggct

SEQ ID NO: 3673558 - DNA, 11 bp, Homo sapiens
ctggtggccca

SEQ ID NO: 3673559 - DNA, 12 bp, Homo sapiens
ctggtggcccag

SEQ ID NO: 3673560 - DNA, 14 bp, Homo sapiens
ctggtggcccagct

SEQ ID NO: 3673561 - DNA, 20 bp, Homo sapiens
ctggtggccccgtttctggt

SEQ ID NO: 3673562 - DNA, 22 bp, Homo sapiens
ctggtggccccgtttctggtgg

SEQ ID NO: 3673563 - DNA, 22 bp, Homo sapiens
ctggtggctgggctgctcctga

SEQ ID NO: 3673564 - DNA, 18 bp, Homo sapiens
ctggtggtctgttggcag

SEQ ID NO: 3673565 - DNA, 16 bp, Homo sapiens
ctggttataagcagca

SEQ ID NO: 3673566 - DNA, 20 bp, Homo sapiens
ctggttattgatgtggccct

SEQ ID NO: 3673567 - DNA, 13 bp, Homo sapiens
ctggttccagggt

SEQ ID NO: 3673568 - DNA, 22 bp, Homo sapiens
ctggttccagggtccctctgtg

SEQ ID NO: 3673569 - DNA, 19 bp, Homo sapiens
ctggttgtctgaacccagg

SEQ ID NO: 3673570 - DNA, 21 bp, Homo sapiens
ctggttgtctgaacccaggca

SEQ ID NO: 3673571 - DNA, 22 bp, Homo sapiens
ctggttgtctgaacccaggcag

SEQ ID NO: 3673572 - DNA, 11 bp, Homo sapiens
ctgtaaatcat

SEQ ID NO: 3673573 - DNA, 19 bp, Homo sapiens
ctgtaatcctagcactttg

SEQ ID NO: 3673574 - DNA, 15 bp, Homo sapiens
ctgtagactgccatc

SEQ ID NO: 3673575 - DNA, 15 bp, Homo sapiens
ctgtagagtgggagc

SEQ ID NO: 3673576 - DNA, 22 bp, Homo sapiens
ctgtagtaggcatttttaccat

SEQ ID NO: 3673577 - DNA, 19 bp, Homo sapiens
ctgtatatttgtaaagcta

SEQ ID NO: 3673578 - DNA, 19 bp, Homo sapiens
ctgtatccctacattacac

SEQ ID NO: 3673579 - DNA, 17 bp, Homo sapiens
ctgtattagtcacagag

SEQ ID NO: 3673580 - DNA, 19 bp, Homo sapiens
ctgtattagtcacagagat

SEQ ID NO: 3673581 - DNA, 17 bp, Homo sapiens
ctgtcaaacaaagccag

SEQ ID NO: 3673582 - DNA, 22 bp, Homo sapiens
ctgtcaaacaaagccagaagct

SEQ ID NO: 3673583 - DNA, 19 bp, Homo sapiens
ctgtcaagagtagttatat

SEQ ID NO: 3673584 - DNA, 14 bp, Homo sapiens
ctgtcaatcacagt

SEQ ID NO: 3673585 - DNA, 15 bp, Homo sapiens
ctgtcaatgggacct

SEQ ID NO: 3673586 - DNA, 19 bp, Homo sapiens
ctgtcaatgggacctgtgg

SEQ ID NO: 3673587 - DNA, 17 bp, Homo sapiens
ctgtccaaaggaggctg

SEQ ID NO: 3673588 - DNA, 13 bp, Homo sapiens
ctgtccacagccc

SEQ ID NO: 3673589 - DNA, 19 bp, Homo sapiens
ctgtccacgcgtgccgtgg

SEQ ID NO: 3673590 - DNA, 13 bp, Homo sapiens
ctgtccagcctgg

SEQ ID NO: 3673591 - DNA, 20 bp, Homo sapiens
ctgtccagcgatcagccatg

SEQ ID NO: 3673592 - DNA, 21 bp, Homo sapiens
ctgtccattttcttttaaagt

SEQ ID NO: 3673593 - DNA, 13 bp, Homo sapiens
ctgtcccaagtct

SEQ ID NO: 3673594 - DNA, 18 bp, Homo sapiens
ctgtcccttgcttgcctg

SEQ ID NO: 3673595 - DNA, 23 bp, Homo sapiens
ctgtcccttgcttgcctgcaggg

SEQ ID NO: 3673596 - DNA, 15 bp, Homo sapiens
ctgtccgagctttga

SEQ ID NO: 3673597 - DNA, 13 bp, Homo sapiens
ctgtcctgggcct

SEQ ID NO: 3673598 - DNA, 12 bp, Homo sapiens
ctgtcctgtgac

SEQ ID NO: 3673599 - DNA, 19 bp, Homo sapiens
ctgtccttacccatctgca

SEQ ID NO: 3673600 - DNA, 20 bp, Homo sapiens
ctgtcctttctagagcactg

SEQ ID NO: 3673601 - DNA, 23 bp, Homo sapiens
ctgtcctttctagagcactgcca

SEQ ID NO: 3673602 - DNA, 15 bp, Homo sapiens
ctgtcggtgggacct

SEQ ID NO: 3673603 - DNA, 20 bp, Homo sapiens
ctgtctacatttctgcagat

SEQ ID NO: 3673604 - DNA, 15 bp, Homo sapiens
ctgtctcatccccag

SEQ ID NO: 3673605 - DNA, 16 bp, Homo sapiens
ctgtctcatccccagg

SEQ ID NO: 3673606 - DNA, 21 bp, Homo sapiens
ctgtctcatccccaggggtcc

SEQ ID NO: 3673607 - DNA, 13 bp, Homo sapiens
ctgtctggtggcc

SEQ ID NO: 3673608 - DNA, 16 bp, Homo sapiens
ctgtcttggaagtctg

SEQ ID NO: 3673609 - DNA, 22 bp, Homo sapiens
ctgtcttggaagtctgtctcag

SEQ ID NO: 3673610 - DNA, 17 bp, Homo sapiens
ctgtctttaaaagagag

SEQ ID NO: 3673611 - DNA, 24 bp, Homo sapiens
ctgtgaaataccacaagcctgaga

SEQ ID NO: 3673612 - DNA, 18 bp, Homo sapiens
ctgtgaaccggctcccac

SEQ ID NO: 3673613 - DNA, 14 bp, Homo sapiens
ctgtgaaggaccct

SEQ ID NO: 3673614 - DNA, 20 bp, Homo sapiens
ctgtgaatgccactgccttc

SEQ ID NO: 3673615 - DNA, 14 bp, Homo sapiens
ctgtgaccctcttt

SEQ ID NO: 3673616 - DNA, 16 bp, Homo sapiens
ctgtgagacccccaca

SEQ ID NO: 3673617 - DNA, 17 bp, Homo sapiens
ctgtgagacccccacac

SEQ ID NO: 3673618 - DNA, 20 bp, Homo sapiens
ctgtgagacccccacacctc

SEQ ID NO: 3673619 - DNA, 14 bp, Homo sapiens
ctgtgaggcttgcc

SEQ ID NO: 3673620 - DNA, 19 bp, Homo sapiens
ctgtgaggcttgcccagga

SEQ ID NO: 3673621 - DNA, 21 bp, Homo sapiens
ctgtgaggcttgcccaggagc

SEQ ID NO: 3673622 - DNA, 22 bp, Homo sapiens
ctgtgaggcttgcccaggagca

SEQ ID NO: 3673623 - DNA, 14 bp, Homo sapiens
ctgtgatgctgggc

SEQ ID NO: 3673624 - DNA, 16 bp, Homo sapiens
ctgtgcaaaaaaatta

SEQ ID NO: 3673625 - DNA, 23 bp, Homo sapiens
ctgtgccaccccttcctcagcct

SEQ ID NO: 3673626 - DNA, 24 bp, Homo sapiens
ctgtgccaccccttcctcagcctg

SEQ ID NO: 3673627 - DNA, 19 bp, Homo sapiens
ctgtgctatggtgctctgt

SEQ ID NO: 3673628 - DNA, 19 bp, Homo sapiens
ctgtgctccatggctgcca

SEQ ID NO: 3673629 - DNA, 21 bp, Homo sapiens
ctgtgctcggaggccatctcg

SEQ ID NO: 3673630 - DNA, 16 bp, Homo sapiens
ctctggtcgctcctgc

SEQ ID NO: 3673631 - DNA, 15 bp, Homo sapiens
ctctggtggccactg

SEQ ID NO: 3673632 - DNA, 20 bp, Homo sapiens
ctctggtggccactgagctg

SEQ ID NO: 3673633 - DNA, 21 bp, Homo sapiens
ctctggtggccactgagctgg

SEQ ID NO: 3673634 - DNA, 22 bp, Homo sapiens
ctctgtacttttcattctcttt

SEQ ID NO: 3673635 - DNA, 17 bp, Homo sapiens
ctctgtctcccaggctg

SEQ ID NO: 3673636 - DNA, 23 bp, Homo sapiens
ctctgtcttctttgcccacaatg

SEQ ID NO: 3673637 - DNA, 11 bp, Homo sapiens
ctctgtgccac

SEQ ID NO: 3673638 - DNA, 13 bp, Homo sapiens
ctctgtgctgtgt

SEQ ID NO: 3673639 - DNA, 12 bp, Homo sapiens
ctctgtggccag

SEQ ID NO: 3673640 - DNA, 18 bp, Homo sapiens
ctctgtggccagcctggc

SEQ ID NO: 3673641 - DNA, 20 bp, Homo sapiens
ctctgtggccagcctggcat

SEQ ID NO: 3673642 - DNA, 21 bp, Homo sapiens
ctctgtggccagcctggcatc

SEQ ID NO: 3673643 - DNA, 15 bp, Homo sapiens
ctctgtggccagctg

SEQ ID NO: 3673644 - DNA, 20 bp, Homo sapiens
ctctgtggccagctgcatct

SEQ ID NO: 3673645 - DNA, 21 bp, Homo sapiens
ctcttaaattatatatttatt

SEQ ID NO: 3673646 - DNA, 14 bp, Homo sapiens
ctcttactgttttg

SEQ ID NO: 3673647 - DNA, 18 bp, Homo sapiens
ctcttagcagcttccaga

SEQ ID NO: 3673648 - DNA, 14 bp, Homo sapiens
ctcttcaggcctcc

SEQ ID NO: 3673649 - DNA, 17 bp, Homo sapiens
ctcttcaggcctccctc

SEQ ID NO: 3673650 - DNA, 20 bp, Homo sapiens
ctcttccaaaggcagcgtgc

SEQ ID NO: 3673651 - DNA, 16 bp, Homo sapiens
ctcttcctatttttgt

SEQ ID NO: 3673652 - DNA, 20 bp, Homo sapiens
ctcttctgccggccctgggg

SEQ ID NO: 3673653 - DNA, 13 bp, Homo sapiens
ctcttctgctcca

SEQ ID NO: 3673654 - DNA, 15 bp, Homo sapiens
ctcttctgctccacc

SEQ ID NO: 3673655 - DNA, 16 bp, Homo sapiens
ctcttctgtcccaagt

SEQ ID NO: 3673656 - DNA, 16 bp, Homo sapiens
ctcttcttggggccca

SEQ ID NO: 3673657 - DNA, 22 bp, Homo sapiens
ctcttgagcagtggctggtcca

SEQ ID NO: 3673658 - DNA, 23 bp, Homo sapiens
ctcttgagtttgtcgctcatgtg

SEQ ID NO: 3673659 - DNA, 21 bp, Homo sapiens
ctcttggatgggacatttttg

SEQ ID NO: 3673660 - DNA, 13 bp, Homo sapiens
ctcttgggtggga

SEQ ID NO: 3673661 - DNA, 18 bp, Homo sapiens
ctcttgggtgggacaggg

SEQ ID NO: 3673662 - DNA, 20 bp, Homo sapiens
ctcttgggtgggacagggct

SEQ ID NO: 3673663 - DNA, 21 bp, Homo sapiens
ctcttgggtgggacagggctt

SEQ ID NO: 3673664 - DNA, 16 bp, Homo sapiens
ctctttaatttgttgt

SEQ ID NO: 3673665 - DNA, 20 bp, Homo sapiens
ctctttaatttgttgtagat

SEQ ID NO: 3673666 - DNA, 21 bp, Homo sapiens
ctctttatgcttgcaaaaact

SEQ ID NO: 3673667 - DNA, 15 bp, Homo sapiens
ctctttcacattgtt

SEQ ID NO: 3673668 - DNA, 16 bp, Homo sapiens
ctctttccctaggaaa

SEQ ID NO: 3673669 - DNA, 12 bp, Homo sapiens
ctctttctctgc

SEQ ID NO: 3673670 - DNA, 13 bp, Homo sapiens
ctctttctctgcc

SEQ ID NO: 3673671 - DNA, 15 bp, Homo sapiens
ctctttctctgccag

SEQ ID NO: 3673672 - DNA, 13 bp, Homo sapiens
ctctttgctgaag

SEQ ID NO: 3673673 - DNA, 12 bp, Homo sapiens
ctctttgctttc

SEQ ID NO: 3673674 - DNA, 13 bp, Homo sapiens
ctctttgctttgc

SEQ ID NO: 3673675 - DNA, 16 bp, Homo sapiens
ctctttgctttgcttt

SEQ ID NO: 3673676 - DNA, 23 bp, Homo sapiens
ctcttttccactccattgtcgta

SEQ ID NO: 3673677 - DNA, 12 bp, Homo sapiens
ctctttttccaa

SEQ ID NO: 3673678 - DNA, 18 bp, Homo sapiens
ctgaaaaaaaaaaagaag

SEQ ID NO: 3673679 - DNA, 19 bp, Homo sapiens
ctgaaaaaaaaaaagaaga

SEQ ID NO: 3673680 - DNA, 21 bp, Homo sapiens
ctgaaaaaaaaaaagaagaag

SEQ ID NO: 3673681 - DNA, 13 bp, Homo sapiens
ctgaaaaggaacg

SEQ ID NO: 3673682 - DNA, 22 bp, Homo sapiens
ctgaaaatgtttttctgccagg

SEQ ID NO: 3673683 - DNA, 16 bp, Homo sapiens
ctgaaagccctgagct

SEQ ID NO: 3673684 - DNA, 23 bp, Homo sapiens
ctgaaagccctgagctttctgct

SEQ ID NO: 3673685 - DNA, 20 bp, Homo sapiens
ctgaaattctcctggaggtc

SEQ ID NO: 3673686 - DNA, 13 bp, Homo sapiens
ctgaacagctgta

SEQ ID NO: 3673687 - DNA, 13 bp, Homo sapiens
ctgaacccaggca

SEQ ID NO: 3673688 - DNA, 15 bp, Homo sapiens
ctgaacccaggcagc

SEQ ID NO: 3673689 - DNA, 16 bp, Homo sapiens
ctgaacccaggcagct

SEQ ID NO: 3673690 - DNA, 18 bp, Homo sapiens
ctgaacccaggcagctgg

SEQ ID NO: 3673691 - DNA, 21 bp, Homo sapiens
ctgaacctgggtaactaggga

SEQ ID NO: 3673692 - DNA, 14 bp, Homo sapiens
ctgaactttggaag

SEQ ID NO: 3673693 - DNA, 15 bp, Homo sapiens
ctgaactttggaagc

SEQ ID NO: 3673694 - DNA, 15 bp, Homo sapiens
ctgaagaaccagtcc

SEQ ID NO: 3673695 - DNA, 17 bp, Homo sapiens
ctgaagatgggagcctt

SEQ ID NO: 3673696 - DNA, 20 bp, Homo sapiens
ctgaaggaggcggggctcta

SEQ ID NO: 3673697 - DNA, 17 bp, Homo sapiens
ctgaaggcagggctcct

SEQ ID NO: 3673698 - DNA, 22 bp, Homo sapiens
ctgaaggcagggctcctccctg

SEQ ID NO: 3673699 - DNA, 21 bp, Homo sapiens
ctgaagggcctcccagccccc

SEQ ID NO: 3673700 - DNA, 15 bp, Homo sapiens
ctgaaggggccatga

SEQ ID NO: 3673701 - DNA, 17 bp, Homo sapiens
ctgaaggggttctcaca

SEQ ID NO: 3673702 - DNA, 17 bp, Homo sapiens
ctgaagtttttttgctg

SEQ ID NO: 3673703 - DNA, 14 bp, Homo sapiens
ctgacagctgctcc

SEQ ID NO: 3673704 - DNA, 19 bp, Homo sapiens
ctgacagctgctcctagag

SEQ ID NO: 3673705 - DNA, 19 bp, Homo sapiens
ctgacatgtggggccaggt

SEQ ID NO: 3673706 - DNA, 22 bp, Homo sapiens
ctgaccaaatcacccaatccca

SEQ ID NO: 3673707 - DNA, 13 bp, Homo sapiens
ctgaccagaacta

SEQ ID NO: 3673708 - DNA, 13 bp, Homo sapiens
ctgaccagcagcg

SEQ ID NO: 3673709 - DNA, 20 bp, Homo sapiens
ctgaccagcagcgcctttcc

SEQ ID NO: 3673710 - DNA, 22 bp, Homo sapiens
ctgaccagcagcgcctttccca

SEQ ID NO: 3673711 - DNA, 20 bp, Homo sapiens
ctgaccagccgtgagcatgt

SEQ ID NO: 3673712 - DNA, 21 bp, Homo sapiens
ctgaccagggcaaggcccctt

SEQ ID NO: 3673713 - DNA, 19 bp, Homo sapiens
ctgaccatccactctaccc

SEQ ID NO: 3673714 - DNA, 15 bp, Homo sapiens
ctgaccatgctcatc

SEQ ID NO: 3673715 - DNA, 20 bp, Homo sapiens
ctgaccatgctcatctgctg

SEQ ID NO: 3673716 - DNA, 10 bp, Homo sapiens
ctgacccagt

SEQ ID NO: 3673717 - DNA, 18 bp, Homo sapiens
ctgacccagtgcccccac

SEQ ID NO: 3673718 - DNA, 14 bp, Homo sapiens
ctgacctccacagc

SEQ ID NO: 3673719 - DNA, 22 bp, Homo sapiens
ctgactagaagggccagtcctg

SEQ ID NO: 3673720 - DNA, 21 bp, Homo sapiens
ctgactagggagccatgtttc

SEQ ID NO: 3673721 - DNA, 22 bp, Homo sapiens
ctgactcatccgcctggcccgg

SEQ ID NO: 3673722 - DNA, 16 bp, Homo sapiens
ctgactcggtttctcc

SEQ ID NO: 3673723 - DNA, 15 bp, Homo sapiens
ctgactgttcttggt

SEQ ID NO: 3673724 - DNA, 19 bp, Homo sapiens
ctgacttaagcaaaagaaa

SEQ ID NO: 3673725 - DNA, 12 bp, Homo sapiens
ctgacttctgcc

SEQ ID NO: 3673726 - DNA, 13 bp, Homo sapiens
ctgacttctgcct

SEQ ID NO: 3673727 - DNA, 18 bp, Homo sapiens
ctgacttctgcctggaga

SEQ ID NO: 3673728 - DNA, 14 bp, Homo sapiens
ctgacttctgttta

SEQ ID NO: 3673729 - DNA, 21 bp, Homo sapiens
ctgacttttaatgtcatttgt

SEQ ID NO: 3673730 - DNA, 15 bp, Homo sapiens
ctgagaactgaattt

SEQ ID NO: 3673731 - DNA, 22 bp, Homo sapiens
ctgagaactgaattttgggact

SEQ ID NO: 3673732 - DNA, 17 bp, Homo sapiens
ctgagacaaatggaggc

SEQ ID NO: 3673733 - DNA, 13 bp, Homo sapiens
ctgagacagatgg

SEQ ID NO: 3673734 - DNA, 23 bp, Homo sapiens
ctgagatcttctctgttattcct

SEQ ID NO: 3673735 - DNA, 13 bp, Homo sapiens
ctgagcaccaggg

SEQ ID NO: 3673736 - DNA, 22 bp, Homo sapiens
ctgagcccctgtctagagaggg

SEQ ID NO: 3673737 - DNA, 22 bp, Homo sapiens
ctgagcgcctccatccaaggcc

SEQ ID NO: 3673738 - DNA, 17 bp, Homo sapiens
ctgagctgcccctgctg

SEQ ID NO: 3673739 - DNA, 20 bp, Homo sapiens
ctgaggaaaggccagctggc

SEQ ID NO: 3673740 - DNA, 20 bp, Homo sapiens
ctgaggcctggactttcctg

SEQ ID NO: 3673741 - DNA, 15 bp, Homo sapiens
ctgaggcctgggccg

SEQ ID NO: 3673742 - DNA, 22 bp, Homo sapiens
ctgaggcctgggccgctgccac

SEQ ID NO: 3673743 - DNA, 23 bp, Homo sapiens
ctgaggcctgggccgctgccacg

SEQ ID NO: 3673744 - DNA, 13 bp, Homo sapiens
ctgaggctgtggt

SEQ ID NO: 3673745 - DNA, 18 bp, Homo sapiens
ctgaggggcatctgcccc

SEQ ID NO: 3673746 - DNA, 19 bp, Homo sapiens
ctgaggggcatctgcccct

SEQ ID NO: 3673747 - DNA, 22 bp, Homo sapiens
ctgagggtgggcttttccctgg

SEQ ID NO: 3673748 - DNA, 19 bp, Homo sapiens
cgggactcctccctggggg

SEQ ID NO: 3673749 - DNA, 13 bp, Homo sapiens
cgggaggaggtgt

SEQ ID NO: 3673750 - DNA, 16 bp, Homo sapiens
cgggaggtcgaggcag

SEQ ID NO: 3673751 - DNA, 18 bp, Homo sapiens
cgggaggtcgaggcagga

SEQ ID NO: 3673752 - DNA, 15 bp, Homo sapiens
cgggcaccagccagc

SEQ ID NO: 3673753 - DNA, 14 bp, Homo sapiens
cgggccagtgctcc

SEQ ID NO: 3673754 - DNA, 13 bp, Homo sapiens
cgggccctgcctg

SEQ ID NO: 3673755 - DNA, 15 bp, Homo sapiens
cgggccctgcctgag

SEQ ID NO: 3673756 - DNA, 20 bp, Homo sapiens
cgggcgcgatcccacacagg

SEQ ID NO: 3673757 - DNA, 14 bp, Homo sapiens
cgggctctctgctg

SEQ ID NO: 3673758 - DNA, 19 bp, Homo sapiens
cggggagaagaagcggcca

SEQ ID NO: 3673759 - DNA, 20 bp, Homo sapiens
cggggcagtactcctccctg

SEQ ID NO: 3673760 - DNA, 22 bp, Homo sapiens
cggggcagtactcctccctggg

SEQ ID NO: 3673761 - DNA, 17 bp, Homo sapiens
cggggctcccctggaca

SEQ ID NO: 3673762 - DNA, 14 bp, Homo sapiens
cggggctcctcctg

SEQ ID NO: 3673763 - DNA, 23 bp, Homo sapiens
cggggctctaggatggggcacgg

SEQ ID NO: 3673764 - DNA, 22 bp, Homo sapiens
cggggcttctctccgcgggtgg

SEQ ID NO: 3673765 - DNA, 13 bp, Homo sapiens
cggggcttctctt

SEQ ID NO: 3673766 - DNA, 21 bp, Homo sapiens
cggggcttctcttgggtggga

SEQ ID NO: 3673767 - DNA, 17 bp, Homo sapiens
cgggggctgtggctctg

SEQ ID NO: 3673768 - DNA, 18 bp, Homo sapiens
cgggggctgtggctctgg

SEQ ID NO: 3673769 - DNA, 21 bp, Homo sapiens
cgggggctgtggctctgggtg

SEQ ID NO: 3673770 - DNA, 18 bp, Homo sapiens
cggggtcttgctctgtct

SEQ ID NO: 3673771 - DNA, 22 bp, Homo sapiens
cgggtcacacaaaggcatgctg

SEQ ID NO: 3673772 - DNA, 16 bp, Homo sapiens
cgggtcctagctgtta

SEQ ID NO: 3673773 - DNA, 15 bp, Homo sapiens
cggtctcctgactgg

SEQ ID NO: 3673774 - DNA, 15 bp, Homo sapiens
cggtgcccaagccag

SEQ ID NO: 3673775 - DNA, 18 bp, Homo sapiens
cggtgggacccccgtggg

SEQ ID NO: 3673776 - DNA, 14 bp, Homo sapiens
cggtgtccccagag

SEQ ID NO: 3673777 - DNA, 13 bp, Homo sapiens
cggtttccaggga

SEQ ID NO: 3673778 - DNA, 16 bp, Homo sapiens
cggttttactgcagct

SEQ ID NO: 3673779 - DNA, 23 bp, Homo sapiens
cgtagatattggacaaagaacct

SEQ ID NO: 3673780 - DNA, 16 bp, Homo sapiens
cgtataggcatgtaaa

SEQ ID NO: 3673781 - DNA, 14 bp, Homo sapiens
cgtcagtgctgtgc

SEQ ID NO: 3673782 - DNA, 13 bp, Homo sapiens
cgtccagcctgcc

SEQ ID NO: 3673783 - DNA, 15 bp, Homo sapiens
cgtcccgtccctccc

SEQ ID NO: 3673784 - DNA, 17 bp, Homo sapiens
cgtccctccctttcctc

SEQ ID NO: 3673785 - DNA, 13 bp, Homo sapiens
cgtcctgcctgtg

SEQ ID NO: 3673786 - DNA, 19 bp, Homo sapiens
cgtctccaggggctgcttc

SEQ ID NO: 3673787 - DNA, 14 bp, Homo sapiens
cgtctgttccccct

SEQ ID NO: 3673788 - DNA, 19 bp, Homo sapiens
cgtgaaagtgcatttttgt

SEQ ID NO: 3673789 - DNA, 14 bp, Homo sapiens
cgtgaactgcagtg

SEQ ID NO: 3673790 - DNA, 15 bp, Homo sapiens
cgtgaactgcagtga

SEQ ID NO: 3673791 - DNA, 23 bp, Homo sapiens
cgtgagagtgtcttcacggcagg

SEQ ID NO: 3673792 - DNA, 17 bp, Homo sapiens
cgtgcacgtggagagct

SEQ ID NO: 3673793 - DNA, 21 bp, Homo sapiens
cgtgcacgtggagagctggtg

SEQ ID NO: 3673794 - DNA, 16 bp, Homo sapiens
cgtgcccctgggatcc

SEQ ID NO: 3673795 - DNA, 15 bp, Homo sapiens
cgtgctgacagctgc

SEQ ID NO: 3673796 - DNA, 17 bp, Homo sapiens
cgtggagagctggtgcc

SEQ ID NO: 3673797 - DNA, 15 bp, Homo sapiens
cgtggagggaggccc

SEQ ID NO: 3673798 - DNA, 18 bp, Homo sapiens
cgtggcactcgctgtatg

SEQ ID NO: 3673799 - DNA, 16 bp, Homo sapiens
cgtggcctcttgagca

SEQ ID NO: 3673800 - DNA, 20 bp, Homo sapiens
cgtggcctgcataggctcct

SEQ ID NO: 3673801 - DNA, 21 bp, Homo sapiens
cgtggcctgcataggctcctt

SEQ ID NO: 3673802 - DNA, 20 bp, Homo sapiens
cgtgggacggtgcccaagcc

SEQ ID NO: 3673803 - DNA, 22 bp, Homo sapiens
cgtggggcagggagctgggccc

SEQ ID NO: 3673804 - DNA, 17 bp, Homo sapiens
cgtggggtgtgctggga

SEQ ID NO: 3673805 - DNA, 18 bp, Homo sapiens
cgtggggtgtgctgggag

SEQ ID NO: 3673806 - DNA, 12 bp, Homo sapiens
cgtgtcctctcc

SEQ ID NO: 3673807 - DNA, 22 bp, Homo sapiens
cgtgtctgtatttatgtgtgag

SEQ ID NO: 3673808 - DNA, 15 bp, Homo sapiens
cgtgtgcctgtgtgc

SEQ ID NO: 3673809 - DNA, 14 bp, Homo sapiens
cgttagctcctgtg

SEQ ID NO: 3673810 - DNA, 11 bp, Homo sapiens
cgttatattaa

SEQ ID NO: 3673811 - DNA, 14 bp, Homo sapiens
cgttcattgctctc

SEQ ID NO: 3673812 - DNA, 20 bp, Homo sapiens
cgttctgtactgttactggg

SEQ ID NO: 3673813 - DNA, 22 bp, Homo sapiens
cgttcttatttaatctccattt

SEQ ID NO: 3673814 - DNA, 16 bp, Homo sapiens
cgttggagaagcccgt

SEQ ID NO: 3673815 - DNA, 16 bp, Homo sapiens
cgttggcttctccctg

SEQ ID NO: 3673816 - DNA, 21 bp, Homo sapiens
cgtttctttaaccttgtataa

SEQ ID NO: 3673817 - DNA, 22 bp, Homo sapiens
cgtttctttaaccttgtataaa

SEQ ID NO: 3673818 - DNA, 20 bp, Homo sapiens
ctaaaaagagactgtgccat

SEQ ID NO: 3673819 - DNA, 21 bp, Homo sapiens
ctaaaagttctcaaatattgg

SEQ ID NO: 3673820 - DNA, 18 bp, Homo sapiens
ctaaacacgtgacacaaa

SEQ ID NO: 3673821 - DNA, 19 bp, Homo sapiens
ctaaaccccagattcttca

SEQ ID NO: 3673822 - DNA, 21 bp, Homo sapiens
ctaaagaaggtttcagaaaga

SEQ ID NO: 3673823 - DNA, 19 bp, Homo sapiens
ctaaaggtgttgtcccttc

SEQ ID NO: 3673824 - DNA, 20 bp, Homo sapiens
ctaaaggtgttgtcccttct

SEQ ID NO: 3673825 - DNA, 14 bp, Homo sapiens
ctaaagttatattt

SEQ ID NO: 3673826 - DNA, 18 bp, Homo sapiens
ctaaataagaaaataaca

SEQ ID NO: 3673827 - DNA, 20 bp, Homo sapiens
ctaaatattatgagatgctg

SEQ ID NO: 3673828 - DNA, 17 bp, Homo sapiens
ctaaatggcctcatgtg

SEQ ID NO: 3673829 - DNA, 19 bp, Homo sapiens
ctaaatggcctcatgtggc

SEQ ID NO: 3673830 - DNA, 16 bp, Homo sapiens
ctaaattttctgaaac

SEQ ID NO: 3673831 - DNA, 19 bp, Homo sapiens
ctaacaaaggcagctgtgt

SEQ ID NO: 3673832 - DNA, 15 bp, Homo sapiens
ctaacaataatattt

SEQ ID NO: 3673833 - DNA, 17 bp, Homo sapiens
ctaacaataatatttca

SEQ ID NO: 3673834 - DNA, 22 bp, Homo sapiens
ctaactcctgccattcttctgg

SEQ ID NO: 3673835 - DNA, 12 bp, Homo sapiens
ctaactggacag

SEQ ID NO: 3673836 - DNA, 15 bp, Homo sapiens
ctaactggacagcct

SEQ ID NO: 3673837 - DNA, 23 bp, Homo sapiens
ctaactggacagcctcttctgtc

SEQ ID NO: 3673838 - DNA, 18 bp, Homo sapiens
ctaactgtaaatcatgtt

SEQ ID NO: 3673839 - DNA, 15 bp, Homo sapiens
ctaagaacctggaac

SEQ ID NO: 3673840 - DNA, 17 bp, Homo sapiens
ctaagactaacaaaggc

SEQ ID NO: 3673841 - DNA, 21 bp, Homo sapiens
ctaagactaacaaaggcagct

SEQ ID NO: 3673842 - DNA, 20 bp, Homo sapiens
ctaagagccatttaggggcc

SEQ ID NO: 3673843 - DNA, 12 bp, Homo sapiens
ctaagagtgtcc

SEQ ID NO: 3673844 - DNA, 12 bp, Homo sapiens
ctaagcagagga

SEQ ID NO: 3673845 - DNA, 14 bp, Homo sapiens
ctaagcagaggagg

SEQ ID NO: 3673846 - DNA, 23 bp, Homo sapiens
ctaagcagaggaggggccgctgc

SEQ ID NO: 3673847 - DNA, 20 bp, Homo sapiens
ctaagccccgtctgacccca

SEQ ID NO: 3673848 - DNA, 17 bp, Homo sapiens
ctaagcctgaaggggcg

SEQ ID NO: 3673849 - DNA, 21 bp, Homo sapiens
ctaaggaggggaaaaaaatgt

SEQ ID NO: 3673850 - DNA, 22 bp, Homo sapiens
ctaaggggcccggccagccatg

SEQ ID NO: 3673851 - DNA, 21 bp, Homo sapiens
ctaagtaacctctacaggcat

SEQ ID NO: 3673852 - DNA, 15 bp, Homo sapiens
ctaatatcaaatgca

SEQ ID NO: 3673853 - DNA, 19 bp, Homo sapiens
ctaatccaggcagatccag

SEQ ID NO: 3673854 - DNA, 20 bp, Homo sapiens
ctaatccaggcagatccagg

SEQ ID NO: 3673855 - DNA, 20 bp, Homo sapiens
ctaatctatggtcgggagac

SEQ ID NO: 3673856 - DNA, 22 bp, Homo sapiens
ctaatgaatgcataaaatgtta

SEQ ID NO: 3673857 - DNA, 18 bp, Homo sapiens
ctaatgaggagagaaaat

SEQ ID NO: 3673858 - DNA, 20 bp, Homo sapiens
ctaatgaggagagaaaatat

SEQ ID NO: 3673859 - DNA, 21 bp, Homo sapiens
ctaatgaggagagaaaatata

SEQ ID NO: 3673860 - DNA, 18 bp, Homo sapiens
ctaattatactactttgt

SEQ ID NO: 3673861 - DNA, 21 bp, Homo sapiens
ctaattatactactttgttag

SEQ ID NO: 3673862 - DNA, 12 bp, Homo sapiens
ctaattgacttt

SEQ ID NO: 3673863 - DNA, 14 bp, Homo sapiens
ctaatttaaagaga

SEQ ID NO: 3673864 - DNA, 12 bp, Homo sapiens
ctaatttttcca

SEQ ID NO: 3673865 - DNA, 18 bp, Homo sapiens
ctacaagagcagcctgtg

SEQ ID NO: 3673866 - DNA, 20 bp, Homo sapiens
ctacaggaagcaccccatgc

SEQ ID NO: 3673867 - DNA, 22 bp, Homo sapiens
ctacaggaagcaccccatgcca

SEQ ID NO: 3673868 - DNA, 22 bp, Homo sapiens
ctacagttgaaaaacagctgag

SEQ ID NO: 3673869 - DNA, 14 bp, Homo sapiens
ctacatgcagccca

SEQ ID NO: 3673870 - DNA, 15 bp, Homo sapiens
ctacatgcagcccat

SEQ ID NO: 3673871 - DNA, 17 bp, Homo sapiens
ctacatgcagcccatgc

SEQ ID NO: 3673872 - DNA, 23 bp, Homo sapiens
ctacatgcagcccatgcccacct

SEQ ID NO: 3673873 - DNA, 15 bp, Homo sapiens
ctacatgctggggtc

SEQ ID NO: 3673874 - DNA, 14 bp, Homo sapiens
ctaccaccacggcc

SEQ ID NO: 3673875 - DNA, 11 bp, Homo sapiens
ctaccacctcc

SEQ ID NO: 3673876 - DNA, 16 bp, Homo sapiens
ctaccacctccccagc

SEQ ID NO: 3673877 - DNA, 18 bp, Homo sapiens
ctacccagcgtggcctcc

SEQ ID NO: 3673878 - DNA, 17 bp, Homo sapiens
ctacccccagctgtgct

SEQ ID NO: 3673879 - DNA, 19 bp, Homo sapiens
ctaccctcccacccccttc

SEQ ID NO: 3673880 - DNA, 13 bp, Homo sapiens
ctaccctcctgct

SEQ ID NO: 3673881 - DNA, 15 bp, Homo sapiens
ctaccctcctgctga

SEQ ID NO: 3673882 - DNA, 17 bp, Homo sapiens
ctaccctcctgctgagc

SEQ ID NO: 3673883 - DNA, 20 bp, Homo sapiens
ctaccctcctgctgagctgc

SEQ ID NO: 3673884 - DNA, 21 bp, Homo sapiens
ctaccctcctgctgagctgcc

SEQ ID NO: 3673885 - DNA, 17 bp, Homo sapiens
ctacctctgagaagaca

SEQ ID NO: 3673886 - DNA, 19 bp, Homo sapiens
ctacctgcaggcggggctc

SEQ ID NO: 3673887 - DNA, 19 bp, Homo sapiens
ctacctggggaaagcctga

SEQ ID NO: 3673888 - DNA, 11 bp, Homo sapiens
ctacctggggg

SEQ ID NO: 3673889 - DNA, 22 bp, Homo sapiens
ctacctgttgagcatcacagaa

SEQ ID NO: 3673890 - DNA, 20 bp, Homo sapiens
ctacgtttctttaaccttgt

SEQ ID NO: 3673891 - DNA, 22 bp, Homo sapiens
ctactagagtctgaacagctgt

SEQ ID NO: 3673892 - DNA, 15 bp, Homo sapiens
ctactcagcatttga

SEQ ID NO: 3673893 - DNA, 15 bp, Homo sapiens
ctactgacatgtggg

SEQ ID NO: 3673894 - DNA, 15 bp, Homo sapiens
ctactgcccaggcac

SEQ ID NO: 3673895 - DNA, 21 bp, Homo sapiens
ctactgccgtcagtgctgtgc

SEQ ID NO: 3673896 - DNA, 22 bp, Homo sapiens
ctacttagggaagaaaaagcaa

SEQ ID NO: 3673897 - DNA, 17 bp, Homo sapiens
ctacttcattttcagag

SEQ ID NO: 3673898 - DNA, 19 bp, Homo sapiens
ctacttcattttcagagtg

SEQ ID NO: 3673899 - DNA, 19 bp, Homo sapiens
ctacttctcacctgggcct

SEQ ID NO: 3673900 - DNA, 15 bp, Homo sapiens
ctacttgagaggctg

SEQ ID NO: 3673901 - DNA, 14 bp, Homo sapiens
ctacttgctcaggt

SEQ ID NO: 3673902 - DNA, 12 bp, Homo sapiens
ctagaaattttc

SEQ ID NO: 3673903 - DNA, 18 bp, Homo sapiens
ctagaacatccctgccag

SEQ ID NO: 3673904 - DNA, 13 bp, Homo sapiens
ctagacaagccag

SEQ ID NO: 3673905 - DNA, 21 bp, Homo sapiens
ctagagagggaggcaagccct

SEQ ID NO: 3673906 - DNA, 22 bp, Homo sapiens
ctagagagggaggcaagccctg

SEQ ID NO: 3673907 - DNA, 14 bp, Homo sapiens
ctagagcactgcca

SEQ ID NO: 3673908 - DNA, 21 bp, Homo sapiens
ctagaggccagccccacccag

SEQ ID NO: 3673909 - DNA, 23 bp, Homo sapiens
ctagaggccagccccacccagga

SEQ ID NO: 3673910 - DNA, 15 bp, Homo sapiens
ctagagggaggggcc

SEQ ID NO: 3673911 - DNA, 18 bp, Homo sapiens
ctagagttttatagcctg

SEQ ID NO: 3673912 - DNA, 14 bp, Homo sapiens
ctagatatcgactt

SEQ ID NO: 3673913 - DNA, 21 bp, Homo sapiens
ctagatatcgacttgtttttg

SEQ ID NO: 3673914 - DNA, 17 bp, Homo sapiens
ctagcactttgggaggc

SEQ ID NO: 3673915 - DNA, 22 bp, Homo sapiens
ctagcggagttccagcaaacaa

SEQ ID NO: 3673916 - DNA, 12 bp, Homo sapiens
ctagctgggggt

SEQ ID NO: 3673917 - DNA, 20 bp, Homo sapiens
ctagctgggggtgggccagg

SEQ ID NO: 3673918 - DNA, 18 bp, Homo sapiens
ctaggagaaccaaatctg

SEQ ID NO: 3673919 - DNA, 23 bp, Homo sapiens
ctaggagaaccaaatctggaagc

SEQ ID NO: 3673920 - DNA, 19 bp, Homo sapiens
ctaggcccccacttgcctc

SEQ ID NO: 3673921 - DNA, 20 bp, Homo sapiens
ctaggcccccacttgcctct

SEQ ID NO: 3673922 - DNA, 23 bp, Homo sapiens
ctaggcccccacttgcctcttcc

SEQ ID NO: 3673923 - DNA, 17 bp, Homo sapiens
ctaggcctcagccagag

SEQ ID NO: 3673924 - DNA, 12 bp, Homo sapiens
ctaggcctgggg

SEQ ID NO: 3673925 - DNA, 15 bp, Homo sapiens
ctaggctggagccca

SEQ ID NO: 3673926 - DNA, 15 bp, Homo sapiens
ctagggattcaggct

SEQ ID NO: 3673927 - DNA, 16 bp, Homo sapiens
ctagggattcaggctg

SEQ ID NO: 3673928 - DNA, 20 bp, Homo sapiens
ctagggattcaggctgcttg

SEQ ID NO: 3673929 - DNA, 13 bp, Homo sapiens
ctagggtggccct

SEQ ID NO: 3673930 - DNA, 20 bp, Homo sapiens
ctaggtaggcttctacctgc

SEQ ID NO: 3673931 - DNA, 18 bp, Homo sapiens
ctaggtgcccttggaggc

SEQ ID NO: 3673932 - DNA, 22 bp, Homo sapiens
ctaggtgcccttggaggccagc

SEQ ID NO: 3673933 - DNA, 15 bp, Homo sapiens
ctagtcaagctcctc

SEQ ID NO: 3673934 - DNA, 22 bp, Homo sapiens
ctagtcaagctcctcctccctg

SEQ ID NO: 3673935 - DNA, 16 bp, Homo sapiens
ctagtcaatcaagtct

SEQ ID NO: 3673936 - DNA, 22 bp, Homo sapiens
ctagtcccttcccctccctggc

SEQ ID NO: 3673937 - DNA, 23 bp, Homo sapiens
ctagtcccttcccctccctggct

SEQ ID NO: 3673938 - DNA, 19 bp, Homo sapiens
ctagtgacttgtgtcccat

SEQ ID NO: 3673939 - DNA, 15 bp, Homo sapiens
ctataaattcctctt

SEQ ID NO: 3673940 - DNA, 17 bp, Homo sapiens
ctataaattcctctttg

SEQ ID NO: 3673941 - DNA, 19 bp, Homo sapiens
ctataaattcctctttgct

SEQ ID NO: 3673942 - DNA, 23 bp, Homo sapiens
ctataaattcctctttgctttgc

SEQ ID NO: 3673943 - DNA, 19 bp, Homo sapiens
ctatagacccgaggaaact

SEQ ID NO: 3673944 - DNA, 18 bp, Homo sapiens
ctatagtatttgattcaa

SEQ ID NO: 3673945 - DNA, 14 bp, Homo sapiens
ctatattgtacaca

SEQ ID NO: 3673946 - DNA, 19 bp, Homo sapiens
ctatcaacaataaaatttt

SEQ ID NO: 3673947 - DNA, 23 bp, Homo sapiens
ctatcaggtgcccctcttccaaa

SEQ ID NO: 3673948 - DNA, 18 bp, Homo sapiens
ctatctgtctggtggccc

SEQ ID NO: 3673949 - DNA, 21 bp, Homo sapiens
ctatctgtctggtggccccgt

SEQ ID NO: 3673950 - DNA, 19 bp, Homo sapiens
ctatgcaaaaaattcttta

SEQ ID NO: 3673951 - DNA, 19 bp, Homo sapiens
ctatgcatggtgccccagg

SEQ ID NO: 3673952 - DNA, 23 bp, Homo sapiens
ctatgcatggtgccccaggacca

SEQ ID NO: 3673953 - DNA, 20 bp, Homo sapiens
ctatgcttaataaaagaaca

SEQ ID NO: 3673954 - DNA, 21 bp, Homo sapiens
ctatgcttaataaaagaacat

SEQ ID NO: 3673955 - DNA, 22 bp, Homo sapiens
ctatgcttaataaaagaacatg

SEQ ID NO: 3673956 - DNA, 17 bp, Homo sapiens
ctatgcttcctcgtgcc

SEQ ID NO: 3673957 - DNA, 23 bp, Homo sapiens
ctatggtgctctgtctacttgct

SEQ ID NO: 3673958 - DNA, 23 bp, Homo sapiens
ctattcccatcgctggaaaacag

SEQ ID NO: 3673959 - DNA, 16 bp, Homo sapiens
ctattccttttctgta

SEQ ID NO: 3673960 - DNA, 18 bp, Homo sapiens
ctattccttttctgtata

SEQ ID NO: 3673961 - DNA, 11 bp, Homo sapiens
ctattttaaga

SEQ ID NO: 3673962 - DNA, 18 bp, Homo sapiens
ctcaaaagctgggcaggt

SEQ ID NO: 3673963 - DNA, 17 bp, Homo sapiens
ctcaaaatatcctaaga

SEQ ID NO: 3673964 - DNA, 20 bp, Homo sapiens
ctcaaatggggccagatcca

SEQ ID NO: 3673965 - DNA, 19 bp, Homo sapiens
ctcaagagatcccaagtag

SEQ ID NO: 3673966 - DNA, 21 bp, Homo sapiens
ctcaagccaagcagccaagct

SEQ ID NO: 3673967 - DNA, 17 bp, Homo sapiens
ctcaatatatttttgct

SEQ ID NO: 3673968 - DNA, 18 bp, Homo sapiens
ctcaatattttccatgaa

SEQ ID NO: 3673969 - DNA, 21 bp, Homo sapiens
ctcaccgtggctaagagtgtc

SEQ ID NO: 3673970 - DNA, 21 bp, Homo sapiens
ctcacctggggtgtgggaggc

SEQ ID NO: 3673971 - DNA, 16 bp, Homo sapiens
ctcaccttggcaccag

SEQ ID NO: 3673972 - DNA, 17 bp, Homo sapiens
ctcaccttggcaccaga

SEQ ID NO: 3673973 - DNA, 19 bp, Homo sapiens
ctcaccttggcaccagaca

SEQ ID NO: 3673974 - DNA, 19 bp, Homo sapiens
ctcacgcacctcccatcct

SEQ ID NO: 3673975 - DNA, 15 bp, Homo sapiens
ctcactaggccccca

SEQ ID NO: 3673976 - DNA, 18 bp, Homo sapiens
ctcactaggcccccactt

SEQ ID NO: 3673977 - DNA, 22 bp, Homo sapiens
ctcactaggcccccacttgcct

SEQ ID NO: 3673978 - DNA, 22 bp, Homo sapiens
ctcactcgggtttctctgtggc

SEQ ID NO: 3673979 - DNA, 19 bp, Homo sapiens
ctcactgccatgccagctt

SEQ ID NO: 3673980 - DNA, 22 bp, Homo sapiens
ctcactgccatgccagcttatc

SEQ ID NO: 3673981 - DNA, 21 bp, Homo sapiens
ctcacttatcccaagagaatg

SEQ ID NO: 3673982 - DNA, 20 bp, Homo sapiens
ctcactttcccttgtgtcaa

SEQ ID NO: 3673983 - DNA, 17 bp, Homo sapiens
ctcagaaccttgtccca

SEQ ID NO: 3673984 - DNA, 21 bp, Homo sapiens
ctcagaaccttgtcccagcca

SEQ ID NO: 3673985 - DNA, 22 bp, Homo sapiens
ctcagaaccttgtcccagccag

SEQ ID NO: 3673986 - DNA, 21 bp, Homo sapiens
ctcagagcggatgggcacaca

SEQ ID NO: 3673987 - DNA, 23 bp, Homo sapiens
ctcagagcggatgggcacacaca

SEQ ID NO: 3673988 - DNA, 16 bp, Homo sapiens
ctcagaggccttgctg

SEQ ID NO: 3673989 - DNA, 23 bp, Homo sapiens
ctcagaggtttacctagagaaca

SEQ ID NO: 3673990 - DNA, 21 bp, Homo sapiens
ctcagatggaaccgcaggaag

SEQ ID NO: 3673991 - DNA, 12 bp, Homo sapiens
ctcagccagaga

SEQ ID NO: 3673992 - DNA, 13 bp, Homo sapiens
ctcagccctgagg

SEQ ID NO: 3673993 - DNA, 14 bp, Homo sapiens
ctcagcctggccag

SEQ ID NO: 3673994 - DNA, 20 bp, Homo sapiens
ctcagcctggccagacacag

SEQ ID NO: 3673995 - DNA, 15 bp, Homo sapiens
ctcagccttcagaca

SEQ ID NO: 3673996 - DNA, 16 bp, Homo sapiens
ctcagccttgccagag

SEQ ID NO: 3673997 - DNA, 18 bp, Homo sapiens
ctcagccttgccagagat

SEQ ID NO: 3673998 - DNA, 21 bp, Homo sapiens
ctcagccttgccagagatcca

SEQ ID NO: 3673999 - DNA, 22 bp, Homo sapiens
ctcagccttgccagagatccaa

SEQ ID NO: 3674000 - DNA, 18 bp, Homo sapiens
ctcagctgcctcacttcc

SEQ ID NO: 3674001 - DNA, 19 bp, Homo sapiens
ctcagctgcgcccccttct

SEQ ID NO: 3674002 - DNA, 16 bp, Homo sapiens
ctcagcttctcctgtg

SEQ ID NO: 3674003 - DNA, 19 bp, Homo sapiens
ctcaggacagatgccacac

SEQ ID NO: 3674004 - DNA, 17 bp, Homo sapiens
ctcaggccagagccaag

SEQ ID NO: 3674005 - DNA, 14 bp, Homo sapiens
ctcagggcctggtc

SEQ ID NO: 3674006 - DNA, 14 bp, Homo sapiens
ctcaggtgagaagc

SEQ ID NO: 3674007 - DNA, 20 bp, Homo sapiens
ctcagtactttggaggcccc

SEQ ID NO: 3674008 - DNA, 23 bp, Homo sapiens
ctcagtactttggaggcccctat

SEQ ID NO: 3674009 - DNA, 12 bp, Homo sapiens
ctcagtgcagat

SEQ ID NO: 3674010 - DNA, 21 bp, Homo sapiens
ctcagtgggctgtttctgctt

SEQ ID NO: 3674011 - DNA, 23 bp, Homo sapiens
ctcagttattacatgtaatttga

SEQ ID NO: 3674012 - DNA, 18 bp, Homo sapiens
ctcagttgattttctgga

SEQ ID NO: 3674013 - DNA, 20 bp, Homo sapiens
ctcagttgattttctggatt

SEQ ID NO: 3674014 - DNA, 22 bp, Homo sapiens
ctcataactctgtgatcttgct

SEQ ID NO: 3674015 - DNA, 16 bp, Homo sapiens
ctcatgggaaggggag

SEQ ID NO: 3674016 - DNA, 12 bp, Homo sapiens
ctcatgtggctg

SEQ ID NO: 3674017 - DNA, 14 bp, Homo sapiens
ctcattccttgtct

SEQ ID NO: 3674018 - DNA, 14 bp, Homo sapiens
ctcatttgggggcg

SEQ ID NO: 3674019 - DNA, 13 bp, Homo sapiens
ctccaacctgcaa

SEQ ID NO: 3674020 - DNA, 21 bp, Homo sapiens
ctccaacctgcaaagatctgt

SEQ ID NO: 3674021 - DNA, 18 bp, Homo sapiens
ctccaagccccatcttct

SEQ ID NO: 3674022 - DNA, 20 bp, Homo sapiens
ctccaaggggaatcagaact

SEQ ID NO: 3674023 - DNA, 20 bp, Homo sapiens
ctccaatggggcggggcttc

SEQ ID NO: 3674024 - DNA, 13 bp, Homo sapiens
ctccacccttggc

SEQ ID NO: 3674025 - DNA, 12 bp, Homo sapiens
ctccactctgct

SEQ ID NO: 3674026 - DNA, 15 bp, Homo sapiens
ctccactctgcttct

SEQ ID NO: 3674027 - DNA, 17 bp, Homo sapiens
ctccactctgcttctct

SEQ ID NO: 3674028 - DNA, 14 bp, Homo sapiens
ctccagaagcctct

SEQ ID NO: 3674029 - DNA, 16 bp, Homo sapiens
ctccagaagcctctgg

SEQ ID NO: 3674030 - DNA, 19 bp, Homo sapiens
ctccagaagcctctggcta

SEQ ID NO: 3674031 - DNA, 20 bp, Homo sapiens
ctccagaagcctctggctag

SEQ ID NO: 3674032 - DNA, 11 bp, Homo sapiens
ctccagacctg

SEQ ID NO: 3674033 - DNA, 23 bp, Homo sapiens
ctccagacctgatcctggaggcc

SEQ ID NO: 3674034 - DNA, 21 bp, Homo sapiens
ctccagagagaaatcaggcct

SEQ ID NO: 3674035 - DNA, 23 bp, Homo sapiens
ctccagagcaggaaattcagccc

SEQ ID NO: 3674036 - DNA, 14 bp, Homo sapiens
ctccagcctggtgg

SEQ ID NO: 3674037 - DNA, 15 bp, Homo sapiens
ctccagcctggtggc

SEQ ID NO: 3674038 - DNA, 12 bp, Homo sapiens
ctccaggaacca

SEQ ID NO: 3674039 - DNA, 19 bp, Homo sapiens
ctccaggatggggaggggc

SEQ ID NO: 3674040 - DNA, 21 bp, Homo sapiens
ctccaggatggggaggggctc

SEQ ID NO: 3674041 - DNA, 23 bp, Homo sapiens
ctccaggatggggaggggctctg

SEQ ID NO: 3674042 - DNA, 12 bp, Homo sapiens
ctccaggccaaa

SEQ ID NO: 3674043 - DNA, 15 bp, Homo sapiens
ctccaggtgcagagg

SEQ ID NO: 3674044 - DNA, 22 bp, Homo sapiens
ctccatacccacaatctgagca

SEQ ID NO: 3674045 - DNA, 18 bp, Homo sapiens
ctccatccaaggccaggt

SEQ ID NO: 3674046 - DNA, 20 bp, Homo sapiens
ctccatcgctgtcatctcag

SEQ ID NO: 3674047 - DNA, 11 bp, Homo sapiens
ctccatttcaa

SEQ ID NO: 3674048 - DNA, 13 bp, Homo sapiens
ctcccaagctgtg

SEQ ID NO: 3674049 - DNA, 16 bp, Homo sapiens
ctcccaagctgtgctg

SEQ ID NO: 3674050 - DNA, 19 bp, Homo sapiens
ctcccaatttcagactccc

SEQ ID NO: 3674051 - DNA, 18 bp, Homo sapiens
ctcccacacccaaagctg

SEQ ID NO: 3674052 - DNA, 21 bp, Homo sapiens
ctcccacacccaaagctgagc

SEQ ID NO: 3674053 - DNA, 18 bp, Homo sapiens
ctcccacccccttctctg

SEQ ID NO: 3674054 - DNA, 12 bp, Homo sapiens
ctcccaggctgg

SEQ ID NO: 3674055 - DNA, 15 bp, Homo sapiens
ctcccaggctggaga

SEQ ID NO: 3674056 - DNA, 16 bp, Homo sapiens
ctcccaggctggagtg

SEQ ID NO: 3674057 - DNA, 19 bp, Homo sapiens
ctcccattcctgaagaacc

SEQ ID NO: 3674058 - DNA, 19 bp, Homo sapiens
ctcccattgtccctctgcc

SEQ ID NO: 3674059 - DNA, 22 bp, Homo sapiens
ctcccattgtccctctgcccca

SEQ ID NO: 3674060 - DNA, 21 bp, Homo sapiens
ctccccacactaacctgggtt

SEQ ID NO: 3674061 - DNA, 22 bp, Homo sapiens
ctccccagcattccagcccctc

SEQ ID NO: 3674062 - DNA, 16 bp, Homo sapiens
ctccccagcccagaga

SEQ ID NO: 3674063 - DNA, 17 bp, Homo sapiens
ctccccaggtccagctc

SEQ ID NO: 3674064 - DNA, 20 bp, Homo sapiens
ctccccaggtccagctctgg

SEQ ID NO: 3674065 - DNA, 21 bp, Homo sapiens
ctccccaggtccagctctgga

SEQ ID NO: 3674066 - DNA, 23 bp, Homo sapiens
ctcccccaacccccaccccacac

SEQ ID NO: 3674067 - DNA, 12 bp, Homo sapiens
ctcccctgccac

SEQ ID NO: 3674068 - DNA, 18 bp, Homo sapiens
ctcccctgccaccaggcc

SEQ ID NO: 3674069 - DNA, 23 bp, Homo sapiens
ctcccctgccaccaggccacctc

SEQ ID NO: 3674070 - DNA, 14 bp, Homo sapiens
ctcccctgccctgg

SEQ ID NO: 3674071 - DNA, 18 bp, Homo sapiens
ctcccctggacagaggcg

SEQ ID NO: 3674072 - DNA, 20 bp, Homo sapiens
ctcccctggacagaggcggg

SEQ ID NO: 3674073 - DNA, 23 bp, Homo sapiens
ctccccttgatttaaacacacag

SEQ ID NO: 3674074 - DNA, 21 bp, Homo sapiens
ctccctaaggcatgtgtgaaa

SEQ ID NO: 3674075 - DNA, 18 bp, Homo sapiens
ctccctatactgcttgga

SEQ ID NO: 3674076 - DNA, 18 bp, Homo sapiens
ctccctcctcacctctgg

SEQ ID NO: 3674077 - DNA, 21 bp, Homo sapiens
ctccctcctcacctctggact

SEQ ID NO: 3674078 - DNA, 15 bp, Homo sapiens
ctccctctctcttct

SEQ ID NO: 3674079 - DNA, 16 bp, Homo sapiens
ctccctctctcttctg

SEQ ID NO: 3674080 - DNA, 13 bp, Homo sapiens
ctccctgagggcg

SEQ ID NO: 3674081 - DNA, 17 bp, Homo sapiens
ctccctgccaagtctca

SEQ ID NO: 3674082 - DNA, 19 bp, Homo sapiens
ctccctgccctcgggtctc

SEQ ID NO: 3674083 - DNA, 20 bp, Homo sapiens
ctccctgccctcgggtctcc

SEQ ID NO: 3674084 - DNA, 14 bp, Homo sapiens
ctccctgcctccag

SEQ ID NO: 3674085 - DNA, 22 bp, Homo sapiens
ctccctggagctagtgtctcct

SEQ ID NO: 3674086 - DNA, 14 bp, Homo sapiens
ctccctgggggtgg

SEQ ID NO: 3674087 - DNA, 19 bp, Homo sapiens
ctccctgggggtggggctc

SEQ ID NO: 3674088 - DNA, 21 bp, Homo sapiens
ctccctgggggtggggctcct

SEQ ID NO: 3674089 - DNA, 19 bp, Homo sapiens
ctccctggtagctgggatt

SEQ ID NO: 3674090 - DNA, 19 bp, Homo sapiens
ctccctgttccccagagaa

SEQ ID NO: 3674091 - DNA, 19 bp, Homo sapiens
ctccctttcctccgcctgt

SEQ ID NO: 3674092 - DNA, 20 bp, Homo sapiens
ctcccttttaatcctggctg

SEQ ID NO: 3674093 - DNA, 15 bp, Homo sapiens
ctccgagaggtgggc

SEQ ID NO: 3674094 - DNA, 17 bp, Homo sapiens
ctccgagaggtgggcca

SEQ ID NO: 3674095 - DNA, 18 bp, Homo sapiens
ctccgagaggtgggccag

SEQ ID NO: 3674096 - DNA, 23 bp, Homo sapiens
ctccgccattctcaagccctgca

SEQ ID NO: 3674097 - DNA, 15 bp, Homo sapiens
ctccgccctgccact

SEQ ID NO: 3674098 - DNA, 14 bp, Homo sapiens
ctccgcctcctggg

SEQ ID NO: 3674099 - DNA, 22 bp, Homo sapiens
ctccgtccagccgccattgcca

SEQ ID NO: 3674100 - DNA, 17 bp, Homo sapiens
ctccgttagctcctgtg

SEQ ID NO: 3674101 - DNA, 13 bp, Homo sapiens
ctcctacctgggg

SEQ ID NO: 3674102 - DNA, 18 bp, Homo sapiens
ctcctacttagggaagaa

SEQ ID NO: 3674103 - DNA, 13 bp, Homo sapiens
ctcctagagggag

SEQ ID NO: 3674104 - DNA, 19 bp, Homo sapiens
ctcctagagggaggggcct

SEQ ID NO: 3674105 - DNA, 15 bp, Homo sapiens
ctcctatatatttct

SEQ ID NO: 3674106 - DNA, 17 bp, Homo sapiens
ctcctatatatttctat

SEQ ID NO: 3674107 - DNA, 14 bp, Homo sapiens
ctcctcacctctgg

SEQ ID NO: 3674108 - DNA, 15 bp, Homo sapiens
ctcctcacctctgga

SEQ ID NO: 3674109 - DNA, 22 bp, Homo sapiens
ctcctcacctctggactggcta

SEQ ID NO: 3674110 - DNA, 15 bp, Homo sapiens
ctcctcccacccggc

SEQ ID NO: 3674111 - DNA, 22 bp, Homo sapiens
ctcctcccacccggctgcagag

SEQ ID NO: 3674112 - DNA, 18 bp, Homo sapiens
ctcctccctgcatctgac

SEQ ID NO: 3674113 - DNA, 23 bp, Homo sapiens
ctcctccctgcatctgaccagca

SEQ ID NO: 3674114 - DNA, 19 bp, Homo sapiens
ctcctccctgccctcgggt

SEQ ID NO: 3674115 - DNA, 15 bp, Homo sapiens
ctcctccctggagct

SEQ ID NO: 3674116 - DNA, 15 bp, Homo sapiens
ctcctccctgggggc

SEQ ID NO: 3674117 - DNA, 16 bp, Homo sapiens
ctcctccctgggggcg

SEQ ID NO: 3674118 - DNA, 21 bp, Homo sapiens
ctcctccctgggggtggggct

SEQ ID NO: 3674119 - DNA, 13 bp, Homo sapiens
ctcctcctccctg

SEQ ID NO: 3674120 - DNA, 12 bp, Homo sapiens
ctcctcctgaag

SEQ ID NO: 3674121 - DNA, 15 bp, Homo sapiens
ctcctcctttttcct

SEQ ID NO: 3674122 - DNA, 20 bp, Homo sapiens
ctcctcgtgaaagtgcattt

SEQ ID NO: 3674123 - DNA, 23 bp, Homo sapiens
ctcctctcccattgtccctctgc

SEQ ID NO: 3674124 - DNA, 14 bp, Homo sapiens
ctcctctccccagc

SEQ ID NO: 3674125 - DNA, 15 bp, Homo sapiens
ctcctctccccagcc

SEQ ID NO: 3674126 - DNA, 17 bp, Homo sapiens
ctcctctccccagccca

SEQ ID NO: 3674127 - DNA, 21 bp, Homo sapiens
ctcctctccccagcccagaga

SEQ ID NO: 3674128 - DNA, 20 bp, Homo sapiens
ctcctgaaggaggcggggct

SEQ ID NO: 3674129 - DNA, 22 bp, Homo sapiens
ctcctgaaggaggcggggctct

SEQ ID NO: 3674130 - DNA, 20 bp, Homo sapiens
ctcctgaatgaggcggagct

SEQ ID NO: 3674131 - DNA, 18 bp, Homo sapiens
ctcctgaccagggcaagg

SEQ ID NO: 3674132 - DNA, 19 bp, Homo sapiens
ctcctgaccagggcaaggc

SEQ ID NO: 3674133 - DNA, 19 bp, Homo sapiens
ctcctgactcatccgcctg

SEQ ID NO: 3674134 - DNA, 16 bp, Homo sapiens
ctcctgaggggcatct

SEQ ID NO: 3674135 - DNA, 19 bp, Homo sapiens
ctcctgaggggcatctgcc

SEQ ID NO: 3674136 - DNA, 20 bp, Homo sapiens
ctcctgaggggcatctgccc

SEQ ID NO: 3674137 - DNA, 22 bp, Homo sapiens
ctcctgaggggcatctgcccct

SEQ ID NO: 3674138 - DNA, 23 bp, Homo sapiens
ctcctgaggggcatctgcccctc

SEQ ID NO: 3674139 - DNA, 22 bp, Homo sapiens
ctcctgcacttacttgcttatt

SEQ ID NO: 3674140 - DNA, 13 bp, Homo sapiens
ctcctgcccacgg

SEQ ID NO: 3674141 - DNA, 17 bp, Homo sapiens
ctcctgcccacggagtc

SEQ ID NO: 3674142 - DNA, 18 bp, Homo sapiens
ctcctgcgggggcgaggc

SEQ ID NO: 3674143 - DNA, 15 bp, Homo sapiens
ctcctgctgagctgc

SEQ ID NO: 3674144 - DNA, 17 bp, Homo sapiens
ctcctgctgagctgccc

SEQ ID NO: 3674145 - DNA, 21 bp, Homo sapiens
ctcctgctgagctgcccctgc

SEQ ID NO: 3674146 - DNA, 16 bp, Homo sapiens
ctcctggcccactgca

SEQ ID NO: 3674147 - DNA, 13 bp, Homo sapiens
ctcctgtggcccc

SEQ ID NO: 3674148 - DNA, 20 bp, Homo sapiens
ctcctgtggccccaccctgg

SEQ ID NO: 3674149 - DNA, 21 bp, Homo sapiens
ctcctgtggccccaccctggg

SEQ ID NO: 3674150 - DNA, 11 bp, Homo sapiens
ctcctgtggta

SEQ ID NO: 3674151 - DNA, 13 bp, Homo sapiens
ctcctgttctgaa

SEQ ID NO: 3674152 - DNA, 14 bp, Homo sapiens
ctccttgagatcct

SEQ ID NO: 3674153 - DNA, 17 bp, Homo sapiens
ctccttgagatcctgat

SEQ ID NO: 3674154 - DNA, 15 bp, Homo sapiens
ctccttggaggacag

SEQ ID NO: 3674155 - DNA, 14 bp, Homo sapiens
ctcgaatctctgtg

SEQ ID NO: 3674156 - DNA, 17 bp, Homo sapiens
ctcgaatctctgtgcct

SEQ ID NO: 3674157 - DNA, 18 bp, Homo sapiens
ctcgcataggacctttcc

SEQ ID NO: 3674158 - DNA, 22 bp, Homo sapiens
ctcgcataggacctttccacca

SEQ ID NO: 3674159 - DNA, 15 bp, Homo sapiens
ctcgcatcctatgct

SEQ ID NO: 3674160 - DNA, 20 bp, Homo sapiens
ctcgcgaaggtcccacagcc

SEQ ID NO: 3674161 - DNA, 18 bp, Homo sapiens
ctcggatagttgctattt

SEQ ID NO: 3674162 - DNA, 22 bp, Homo sapiens
ctcggatagttgctatttttgt

SEQ ID NO: 3674163 - DNA, 16 bp, Homo sapiens
ctcggtgtggagaagc

SEQ ID NO: 3674164 - DNA, 14 bp, Homo sapiens
ctcgtatagcatgc

SEQ ID NO: 3674165 - DNA, 19 bp, Homo sapiens
ctcgtgcatccctgagaca

SEQ ID NO: 3674166 - DNA, 16 bp, Homo sapiens
ctctaactcctgccat

SEQ ID NO: 3674167 - DNA, 17 bp, Homo sapiens
ctctaactggacagcct

SEQ ID NO: 3674168 - DNA, 15 bp, Homo sapiens
ctctaatacattcca

SEQ ID NO: 3674169 - DNA, 13 bp, Homo sapiens
ctctagagcaggg

SEQ ID NO: 3674170 - DNA, 23 bp, Homo sapiens
ctctagctgggggtgggccaggc

SEQ ID NO: 3674171 - DNA, 16 bp, Homo sapiens
ctctagtgccttctaa

SEQ ID NO: 3674172 - DNA, 14 bp, Homo sapiens
ctctatttgagaat

SEQ ID NO: 3674173 - DNA, 13 bp, Homo sapiens
ctctccactgtgc

SEQ ID NO: 3674174 - DNA, 19 bp, Homo sapiens
ctctccactgtgctttcag

SEQ ID NO: 3674175 - DNA, 19 bp, Homo sapiens
ctctcccattgtccctctg

SEQ ID NO: 3674176 - DNA, 15 bp, Homo sapiens
ctctccccacactaa

SEQ ID NO: 3674177 - DNA, 13 bp, Homo sapiens
ctctccccagccc

SEQ ID NO: 3674178 - DNA, 21 bp, Homo sapiens
ctctccctgccaagtctcaga

SEQ ID NO: 3674179 - DNA, 20 bp, Homo sapiens
ctctccgcgggtgggactct

SEQ ID NO: 3674180 - DNA, 19 bp, Homo sapiens
ctctcctcctgcccacctg

SEQ ID NO: 3674181 - DNA, 21 bp, Homo sapiens
ctctcctgacttttaatgtca

SEQ ID NO: 3674182 - DNA, 17 bp, Homo sapiens
ctctctcctcctgccca

SEQ ID NO: 3674183 - DNA, 21 bp, Homo sapiens
ctctctcttctgctccaccct

SEQ ID NO: 3674184 - DNA, 17 bp, Homo sapiens
ctctctggtggctgggc

SEQ ID NO: 3674185 - DNA, 20 bp, Homo sapiens
ctctctggtggctgggctgc

SEQ ID NO: 3674186 - DNA, 12 bp, Homo sapiens
ctctcttctgct

SEQ ID NO: 3674187 - DNA, 16 bp, Homo sapiens
ctctcttctgctccac

SEQ ID NO: 3674188 - DNA, 13 bp, Homo sapiens
ctctgaaaaggaa

SEQ ID NO: 3674189 - DNA, 17 bp, Homo sapiens
ctctgaccgaaacagcg

SEQ ID NO: 3674190 - DNA, 23 bp, Homo sapiens
ctctgaccgaaacagcgctgggt

SEQ ID NO: 3674191 - DNA, 15 bp, Homo sapiens
ctctgacttctgcct

SEQ ID NO: 3674192 - DNA, 16 bp, Homo sapiens
ctctgacttctgcctg

SEQ ID NO: 3674193 - DNA, 17 bp, Homo sapiens
ctctgacttctgcctgg

SEQ ID NO: 3674194 - DNA, 21 bp, Homo sapiens
ctctgacttctgcctggagac

SEQ ID NO: 3674195 - DNA, 16 bp, Homo sapiens
ctctgagtatctcctc

SEQ ID NO: 3674196 - DNA, 13 bp, Homo sapiens
ctctgcacaagct

SEQ ID NO: 3674197 - DNA, 16 bp, Homo sapiens
ctctgcacaagctgca

SEQ ID NO: 3674198 - DNA, 18 bp, Homo sapiens
ctctgcactactgacatg

SEQ ID NO: 3674199 - DNA, 20 bp, Homo sapiens
ctctgcactactgacatgtg

SEQ ID NO: 3674200 - DNA, 20 bp, Homo sapiens
ctctgcccaacccttccctc

SEQ ID NO: 3674201 - DNA, 15 bp, Homo sapiens
ctctgccccatcctc

SEQ ID NO: 3674202 - DNA, 18 bp, Homo sapiens
ctctgcgttggcttctcc

SEQ ID NO: 3674203 - DNA, 19 bp, Homo sapiens
ctctgcgttggcttctccc

SEQ ID NO: 3674204 - DNA, 21 bp, Homo sapiens
ctctgctcagctgcgccccct

SEQ ID NO: 3674205 - DNA, 12 bp, Homo sapiens
ctctgctccacc

SEQ ID NO: 3674206 - DNA, 13 bp, Homo sapiens
ctctgctccacca

SEQ ID NO: 3674207 - DNA, 14 bp, Homo sapiens
ctctgctccaccac

SEQ ID NO: 3674208 - DNA, 16 bp, Homo sapiens
ctctgcttctctgact

SEQ ID NO: 3674209 - DNA, 17 bp, Homo sapiens
ctctgcttctctgactt

SEQ ID NO: 3674210 - DNA, 16 bp, Homo sapiens
ctctggaatgcatggg

SEQ ID NO: 3674211 - DNA, 13 bp, Homo sapiens
ctctggactggct

SEQ ID NO: 3674212 - DNA, 14 bp, Homo sapiens
ctctggactggcta

SEQ ID NO: 3674213 - DNA, 15 bp, Homo sapiens
ctctggactggctag

SEQ ID NO: 3674214 - DNA, 14 bp, Homo sapiens
ctctggaggggagg

SEQ ID NO: 3674215 - DNA, 16 bp, Homo sapiens
ctctggctagaggcca

SEQ ID NO: 3674216 - DNA, 20 bp, Homo sapiens
ctctggctagaggccagccc

SEQ ID NO: 3674217 - DNA, 18 bp, Homo sapiens
ctctgggaccaggctcca

SEQ ID NO: 3674218 - DNA, 22 bp, Homo sapiens
ctctgggatttatgctcatgaa

SEQ ID NO: 3674219 - DNA, 12 bp, Homo sapiens
ctctgggtgggc

SEQ ID NO: 3674220 - DNA, 12 bp, Homo sapiens
cctgctccagac

SEQ ID NO: 3674221 - DNA, 22 bp, Homo sapiens
cctgctccagctgttcagctgg

SEQ ID NO: 3674222 - DNA, 19 bp, Homo sapiens
cctgctgagctgcccctgc

SEQ ID NO: 3674223 - DNA, 20 bp, Homo sapiens
cctgctgagctgcccctgct

SEQ ID NO: 3674224 - DNA, 14 bp, Homo sapiens
cctgctgctggtgc

SEQ ID NO: 3674225 - DNA, 19 bp, Homo sapiens
cctgctgctggtgcacagc

SEQ ID NO: 3674226 - DNA, 12 bp, Homo sapiens
cctgctgtgcct

SEQ ID NO: 3674227 - DNA, 18 bp, Homo sapiens
cctgctgtgcctcgcatc

SEQ ID NO: 3674228 - DNA, 12 bp, Homo sapiens
cctggaacctgg

SEQ ID NO: 3674229 - DNA, 14 bp, Homo sapiens
cctggaacctggac

SEQ ID NO: 3674230 - DNA, 13 bp, Homo sapiens
cctggacagaggc

SEQ ID NO: 3674231 - DNA, 14 bp, Homo sapiens
cctggacagaggcg

SEQ ID NO: 3674232 - DNA, 22 bp, Homo sapiens
cctggacggggcgggccctgcc

SEQ ID NO: 3674233 - DNA, 14 bp, Homo sapiens
cctggactgctacc

SEQ ID NO: 3674234 - DNA, 15 bp, Homo sapiens
cctggactgctacct

SEQ ID NO: 3674235 - DNA, 16 bp, Homo sapiens
cctggagaagcaccag

SEQ ID NO: 3674236 - DNA, 23 bp, Homo sapiens
cctggagacttagggcaccaggg

SEQ ID NO: 3674237 - DNA, 13 bp, Homo sapiens
cctggagatcctc

SEQ ID NO: 3674238 - DNA, 18 bp, Homo sapiens
cctggagatcctcctgca

SEQ ID NO: 3674239 - DNA, 21 bp, Homo sapiens
cctggagatcctcctgcagac

SEQ ID NO: 3674240 - DNA, 22 bp, Homo sapiens
cctggagctagtgtctcctctc

SEQ ID NO: 3674241 - DNA, 22 bp, Homo sapiens
cctggaggtggctgagcccctg

SEQ ID NO: 3674242 - DNA, 23 bp, Homo sapiens
cctggaggtggctgagcccctgt

SEQ ID NO: 3674243 - DNA, 22 bp, Homo sapiens
cctggagtgtatgactgcacat

SEQ ID NO: 3674244 - DNA, 19 bp, Homo sapiens
cctggatggggcagagctt

SEQ ID NO: 3674245 - DNA, 13 bp, Homo sapiens
cctggcagctctg

SEQ ID NO: 3674246 - DNA, 17 bp, Homo sapiens
cctggcagctctggaca

SEQ ID NO: 3674247 - DNA, 23 bp, Homo sapiens
cctggcagctctggacagcccca

SEQ ID NO: 3674248 - DNA, 20 bp, Homo sapiens
cctggcatcagtttaggcct

SEQ ID NO: 3674249 - DNA, 23 bp, Homo sapiens
cctggcatcgcaccattctgact

SEQ ID NO: 3674250 - DNA, 12 bp, Homo sapiens
cctggccagaca

SEQ ID NO: 3674251 - DNA, 13 bp, Homo sapiens
cctggccagacac

SEQ ID NO: 3674252 - DNA, 16 bp, Homo sapiens
cctggccagacacagg

SEQ ID NO: 3674253 - DNA, 19 bp, Homo sapiens
cctggccagacacaggccc

SEQ ID NO: 3674254 - DNA, 16 bp, Homo sapiens
cctggccaggagctct

SEQ ID NO: 3674255 - DNA, 22 bp, Homo sapiens
cctggccaggcagatctgtgcc

SEQ ID NO: 3674256 - DNA, 13 bp, Homo sapiens
cctggccctccac

SEQ ID NO: 3674257 - DNA, 17 bp, Homo sapiens
cctggcctcccctgcca

SEQ ID NO: 3674258 - DNA, 16 bp, Homo sapiens
cctgggccgctgccac

SEQ ID NO: 3674259 - DNA, 18 bp, Homo sapiens
cctggggaaagcctgaag

SEQ ID NO: 3674260 - DNA, 16 bp, Homo sapiens
cctggggacggggctc

SEQ ID NO: 3674261 - DNA, 17 bp, Homo sapiens
cctggggacggggctcc

SEQ ID NO: 3674262 - DNA, 20 bp, Homo sapiens
cctggggctaggctggagcc

SEQ ID NO: 3674263 - DNA, 22 bp, Homo sapiens
cctggggctaggctggagccca

SEQ ID NO: 3674264 - DNA, 16 bp, Homo sapiens
cctgggggctctcatg

SEQ ID NO: 3674265 - DNA, 13 bp, Homo sapiens
cctgggggtgggg

SEQ ID NO: 3674266 - DNA, 17 bp, Homo sapiens
cctgggggtggggctcc

SEQ ID NO: 3674267 - DNA, 20 bp, Homo sapiens
cctgggggtggggctcctac

SEQ ID NO: 3674268 - DNA, 23 bp, Homo sapiens
cctgggggtggggctcctacctg

SEQ ID NO: 3674269 - DNA, 21 bp, Homo sapiens
cctggggtataaaactttcct

SEQ ID NO: 3674270 - DNA, 18 bp, Homo sapiens
cctggggtgttagtggca

SEQ ID NO: 3674271 - DNA, 20 bp, Homo sapiens
cctggggtgttagtggcacc

SEQ ID NO: 3674272 - DNA, 21 bp, Homo sapiens
cctggggtgttagtggcaccg

SEQ ID NO: 3674273 - DNA, 23 bp, Homo sapiens
cctggggtttgaccacccacctg

SEQ ID NO: 3674274 - DNA, 16 bp, Homo sapiens
cctgggtggagcagga

SEQ ID NO: 3674275 - DNA, 19 bp, Homo sapiens
cctgggtggagcaggactc

SEQ ID NO: 3674276 - DNA, 14 bp, Homo sapiens
cctgggtgtccccg

SEQ ID NO: 3674277 - DNA, 20 bp, Homo sapiens
cctggtagctgggattacag

SEQ ID NO: 3674278 - DNA, 13 bp, Homo sapiens
cctggtggcccag

SEQ ID NO: 3674279 - DNA, 15 bp, Homo sapiens
cctggtggcccagct

SEQ ID NO: 3674280 - DNA, 17 bp, Homo sapiens
cctggtggcccagctat

SEQ ID NO: 3674281 - DNA, 14 bp, Homo sapiens
cctggtgggccaac

SEQ ID NO: 3674282 - DNA, 22 bp, Homo sapiens
cctggttcatatttatactttg

SEQ ID NO: 3674283 - DNA, 16 bp, Homo sapiens
cctggttgcctcatgg

SEQ ID NO: 3674284 - DNA, 13 bp, Homo sapiens
cctggttgtctga

SEQ ID NO: 3674285 - DNA, 19 bp, Homo sapiens
cctggttgtctgaacccag

SEQ ID NO: 3674286 - DNA, 22 bp, Homo sapiens
cctggttgtctgaacccaggca

SEQ ID NO: 3674287 - DNA, 20 bp, Homo sapiens
cctgtacagtagattttcca

SEQ ID NO: 3674288 - DNA, 15 bp, Homo sapiens
cctgtagagtgggag

SEQ ID NO: 3674289 - DNA, 16 bp, Homo sapiens
cctgtagagtgggagc

SEQ ID NO: 3674290 - DNA, 21 bp, Homo sapiens
cctgtagagtgggagctgagt

SEQ ID NO: 3674291 - DNA, 20 bp, Homo sapiens
cctgtagccttggggaggcc

SEQ ID NO: 3674292 - DNA, 17 bp, Homo sapiens
cctgtagctttcctggt

SEQ ID NO: 3674293 - DNA, 20 bp, Homo sapiens
cctgtagctttcctggtccc

SEQ ID NO: 3674294 - DNA, 15 bp, Homo sapiens
cctgtattcagacag

SEQ ID NO: 3674295 - DNA, 18 bp, Homo sapiens
cctgtcaaacaaagccag

SEQ ID NO: 3674296 - DNA, 17 bp, Homo sapiens
cctgtccaaactgccta

SEQ ID NO: 3674297 - DNA, 23 bp, Homo sapiens
cctgtccaaactgcctaagccct

SEQ ID NO: 3674298 - DNA, 14 bp, Homo sapiens
cctgtccacagccc

SEQ ID NO: 3674299 - DNA, 12 bp, Homo sapiens
cctgtccagcct

SEQ ID NO: 3674300 - DNA, 14 bp, Homo sapiens
cctgtccagcctgg

SEQ ID NO: 3674301 - DNA, 19 bp, Homo sapiens
cctgtccagctccaacctg

SEQ ID NO: 3674302 - DNA, 20 bp, Homo sapiens
cctgtctcatccccaggggt

SEQ ID NO: 3674303 - DNA, 17 bp, Homo sapiens
cctgtgaatgccactgc

SEQ ID NO: 3674304 - DNA, 19 bp, Homo sapiens
cctgtgaatgccactgcct

SEQ ID NO: 3674305 - DNA, 21 bp, Homo sapiens
cctgtgaatgccactgccttc

SEQ ID NO: 3674306 - DNA, 16 bp, Homo sapiens
cctgtgatgctgggca

SEQ ID NO: 3674307 - DNA, 16 bp, Homo sapiens
cctgtggccccaccct

SEQ ID NO: 3674308 - DNA, 18 bp, Homo sapiens
cctgtggccccaccctgg

SEQ ID NO: 3674309 - DNA, 13 bp, Homo sapiens
cctgtggctgtcg

SEQ ID NO: 3674310 - DNA, 18 bp, Homo sapiens
cctgtgggtggggcttct

SEQ ID NO: 3674311 - DNA, 20 bp, Homo sapiens
cctgtgggtggggcttctct

SEQ ID NO: 3674312 - DNA, 22 bp, Homo sapiens
cctgtggtagtcctcccaagct

SEQ ID NO: 3674313 - DNA, 22 bp, Homo sapiens
cctgtgtgattgacagctttgc

SEQ ID NO: 3674314 - DNA, 22 bp, Homo sapiens
cctgtgttgtctctagagcagg

SEQ ID NO: 3674315 - DNA, 15 bp, Homo sapiens
cctgttccccagaga

SEQ ID NO: 3674316 - DNA, 16 bp, Homo sapiens
cctgttccccagagaa

SEQ ID NO: 3674317 - DNA, 17 bp, Homo sapiens
cctgttgacacaggtct

SEQ ID NO: 3674318 - DNA, 14 bp, Homo sapiens
ccttacccatctgc

SEQ ID NO: 3674319 - DNA, 15 bp, Homo sapiens
ccttaccccttagcc

SEQ ID NO: 3674320 - DNA, 16 bp, Homo sapiens
ccttaccccttagcct

SEQ ID NO: 3674321 - DNA, 14 bp, Homo sapiens
ccttactaattata

SEQ ID NO: 3674322 - DNA, 16 bp, Homo sapiens
ccttagcaaattctgt

SEQ ID NO: 3674323 - DNA, 16 bp, Homo sapiens
ccttagtttcaagagt

SEQ ID NO: 3674324 - DNA, 13 bp, Homo sapiens
ccttcaagtgcca

SEQ ID NO: 3674325 - DNA, 18 bp, Homo sapiens
ccttcacaaagcccaagg

SEQ ID NO: 3674326 - DNA, 19 bp, Homo sapiens
ccttcattctgagaccaaa

SEQ ID NO: 3674327 - DNA, 20 bp, Homo sapiens
ccttcattgccttaactgga

SEQ ID NO: 3674328 - DNA, 23 bp, Homo sapiens
ccttcattgccttaactggagcc

SEQ ID NO: 3674329 - DNA, 21 bp, Homo sapiens
ccttccacttcagggttctaa

SEQ ID NO: 3674330 - DNA, 19 bp, Homo sapiens
ccttcccctccctggctcc

SEQ ID NO: 3674331 - DNA, 15 bp, Homo sapiens
ccttcctgctgcgca

SEQ ID NO: 3674332 - DNA, 16 bp, Homo sapiens
ccttcgcttcttgcct

SEQ ID NO: 3674333 - DNA, 17 bp, Homo sapiens
ccttcgcttcttgcctc

SEQ ID NO: 3674334 - DNA, 18 bp, Homo sapiens
ccttcgcttcttgcctct

SEQ ID NO: 3674335 - DNA, 20 bp, Homo sapiens
ccttcgcttcttgcctctgt

SEQ ID NO: 3674336 - DNA, 20 bp, Homo sapiens
ccttcggacaactcagtccc

SEQ ID NO: 3674337 - DNA, 19 bp, Homo sapiens
ccttcgtccccagttgccg

SEQ ID NO: 3674338 - DNA, 18 bp, Homo sapiens
ccttctaaacggtgacct

SEQ ID NO: 3674339 - DNA, 13 bp, Homo sapiens
ccttctaaaggtg

SEQ ID NO: 3674340 - DNA, 17 bp, Homo sapiens
ccttctgcctttgatgt

SEQ ID NO: 3674341 - DNA, 13 bp, Homo sapiens
ccttctgctactg

SEQ ID NO: 3674342 - DNA, 21 bp, Homo sapiens
ccttgaagaactgcaggccct

SEQ ID NO: 3674343 - DNA, 13 bp, Homo sapiens
ccttgaataataa

SEQ ID NO: 3674344 - DNA, 16 bp, Homo sapiens
ccttgacaactggcag

SEQ ID NO: 3674345 - DNA, 23 bp, Homo sapiens
ccttgagttgattcagctctgca

SEQ ID NO: 3674346 - DNA, 15 bp, Homo sapiens
ccttgcagctagttt

SEQ ID NO: 3674347 - DNA, 20 bp, Homo sapiens
ccttgcagttcagcaccacc

SEQ ID NO: 3674348 - DNA, 13 bp, Homo sapiens
ccttgccagagat

SEQ ID NO: 3674349 - DNA, 16 bp, Homo sapiens
ccttgcctcaatgcca

SEQ ID NO: 3674350 - DNA, 20 bp, Homo sapiens
ccttgcctcaatgccagtaa

SEQ ID NO: 3674351 - DNA, 13 bp, Homo sapiens
ccttggaggacag

SEQ ID NO: 3674352 - DNA, 20 bp, Homo sapiens
ccttggcaccagacacccag

SEQ ID NO: 3674353 - DNA, 15 bp, Homo sapiens
ccttggcctgtctca

SEQ ID NO: 3674354 - DNA, 17 bp, Homo sapiens
ccttggcctttcctgga

SEQ ID NO: 3674355 - DNA, 20 bp, Homo sapiens
ccttggcctttcctggaagc

SEQ ID NO: 3674356 - DNA, 15 bp, Homo sapiens
ccttgggctgctcct

SEQ ID NO: 3674357 - DNA, 15 bp, Homo sapiens
ccttggggcaggcag

SEQ ID NO: 3674358 - DNA, 19 bp, Homo sapiens
ccttggtgggggagcctct

SEQ ID NO: 3674359 - DNA, 20 bp, Homo sapiens
ccttggtgggggagcctctg

SEQ ID NO: 3674360 - DNA, 14 bp, Homo sapiens
ccttgtgcctgggg

SEQ ID NO: 3674361 - DNA, 15 bp, Homo sapiens
ccttgtgtgatttta

SEQ ID NO: 3674362 - DNA, 19 bp, Homo sapiens
cctttacgtgtttaaaaaa

SEQ ID NO: 3674363 - DNA, 19 bp, Homo sapiens
cctttatcaagcttagtga

SEQ ID NO: 3674364 - DNA, 16 bp, Homo sapiens
cctttcaaatttagaa

SEQ ID NO: 3674365 - DNA, 18 bp, Homo sapiens
cctttccttccatcccta

SEQ ID NO: 3674366 - DNA, 17 bp, Homo sapiens
cctttctggaagtttct

SEQ ID NO: 3674367 - DNA, 19 bp, Homo sapiens
cctttctggaagtttctgg

SEQ ID NO: 3674368 - DNA, 13 bp, Homo sapiens
cctttgctctttc

SEQ ID NO: 3674369 - DNA, 17 bp, Homo sapiens
cctttgctgtgaggctg

SEQ ID NO: 3674370 - DNA, 19 bp, Homo sapiens
cctttgtctgtcaatcaca

SEQ ID NO: 3674371 - DNA, 15 bp, Homo sapiens
cctttgttctggggg

SEQ ID NO: 3674372 - DNA, 22 bp, Homo sapiens
ccttttataggtgagaaaaaaa

SEQ ID NO: 3674373 - DNA, 14 bp, Homo sapiens
ccttttttcccagc

SEQ ID NO: 3674374 - DNA, 13 bp, Homo sapiens
cgaaccccaagga

SEQ ID NO: 3674375 - DNA, 14 bp, Homo sapiens
cgaacttgctgggt

SEQ ID NO: 3674376 - DNA, 16 bp, Homo sapiens
cgaacttgctgggtgg

SEQ ID NO: 3674377 - DNA, 16 bp, Homo sapiens
cgaaggtcccacagcc

SEQ ID NO: 3674378 - DNA, 22 bp, Homo sapiens
cgaaggtcccacagccctgaga

SEQ ID NO: 3674379 - DNA, 12 bp, Homo sapiens
cgaatctctgtg

SEQ ID NO: 3674380 - DNA, 19 bp, Homo sapiens
cgaattatttttttaaagt

SEQ ID NO: 3674381 - DNA, 17 bp, Homo sapiens
cgactgcccggcagggt

SEQ ID NO: 3674382 - DNA, 13 bp, Homo sapiens
cgagaagcaagaa

SEQ ID NO: 3674383 - DNA, 15 bp, Homo sapiens
cgagaagcaagaaag

SEQ ID NO: 3674384 - DNA, 20 bp, Homo sapiens
cgagattgcaccactgcact

SEQ ID NO: 3674385 - DNA, 14 bp, Homo sapiens
cgaggaaactcaga

SEQ ID NO: 3674386 - DNA, 11 bp, Homo sapiens
cgaggaagccc

SEQ ID NO: 3674387 - DNA, 15 bp, Homo sapiens
cgaggcccctcccag

SEQ ID NO: 3674388 - DNA, 16 bp, Homo sapiens
cgaggcccctcccagt

SEQ ID NO: 3674389 - DNA, 13 bp, Homo sapiens
cgaggcccgcatg

SEQ ID NO: 3674390 - DNA, 17 bp, Homo sapiens
cgaggccctcccaaaga

SEQ ID NO: 3674391 - DNA, 16 bp, Homo sapiens
cgagggtcctggctcc

SEQ ID NO: 3674392 - DNA, 21 bp, Homo sapiens
cgagtgcttccgctgcggtga

SEQ ID NO: 3674393 - DNA, 20 bp, Homo sapiens
cgatactgcgactttctgcc

SEQ ID NO: 3674394 - DNA, 16 bp, Homo sapiens
cgattcaccctgtcca

SEQ ID NO: 3674395 - DNA, 14 bp, Homo sapiens
cgattttgtctacc

SEQ ID NO: 3674396 - DNA, 13 bp, Homo sapiens
cgcaggaagctgc

SEQ ID NO: 3674397 - DNA, 13 bp, Homo sapiens
cgcatcagacaga

SEQ ID NO: 3674398 - DNA, 14 bp, Homo sapiens
cgcatcctatgctt

SEQ ID NO: 3674399 - DNA, 23 bp, Homo sapiens
cgccaaacttctgaactttggaa

SEQ ID NO: 3674400 - DNA, 13 bp, Homo sapiens
cgccaaggctggg

SEQ ID NO: 3674401 - DNA, 18 bp, Homo sapiens
cgccaccgccacccgcag

SEQ ID NO: 3674402 - DNA, 12 bp, Homo sapiens
cgccatcctctg

SEQ ID NO: 3674403 - DNA, 18 bp, Homo sapiens
cgccattgccaccaggag

SEQ ID NO: 3674404 - DNA, 20 bp, Homo sapiens
cgcccaggctggagtgcagt

SEQ ID NO: 3674405 - DNA, 17 bp, Homo sapiens
cgccccctccgccctgc

SEQ ID NO: 3674406 - DNA, 12 bp, Homo sapiens
cgcccgtcctgc

SEQ ID NO: 3674407 - DNA, 11 bp, Homo sapiens
cgccctgccac

SEQ ID NO: 3674408 - DNA, 20 bp, Homo sapiens
cgccgatagagggacggcca

SEQ ID NO: 3674409 - DNA, 12 bp, Homo sapiens
cgccgcctcttt

SEQ ID NO: 3674410 - DNA, 15 bp, Homo sapiens
cgcctctttcaagca

SEQ ID NO: 3674411 - DNA, 15 bp, Homo sapiens
cgcctgtgatgctgg

SEQ ID NO: 3674412 - DNA, 19 bp, Homo sapiens
cgcctgtgccaccccttcc

SEQ ID NO: 3674413 - DNA, 14 bp, Homo sapiens
cgcctttcccaact

SEQ ID NO: 3674414 - DNA, 23 bp, Homo sapiens
cgcgggagccatgcgccccctcc

SEQ ID NO: 3674415 - DNA, 13 bp, Homo sapiens
cgcgggtgggact

SEQ ID NO: 3674416 - DNA, 12 bp, Homo sapiens
cgcgtcttcctg

SEQ ID NO: 3674417 - DNA, 17 bp, Homo sapiens
cgctactataaagagaa

SEQ ID NO: 3674418 - DNA, 16 bp, Homo sapiens
cgctgagtggcagggg

SEQ ID NO: 3674419 - DNA, 17 bp, Homo sapiens
cgctgccacccacctcc

SEQ ID NO: 3674420 - DNA, 23 bp, Homo sapiens
cgctgtccctagtaaaaatacaa

SEQ ID NO: 3674421 - DNA, 17 bp, Homo sapiens
cgcttcttgcctctgtg

SEQ ID NO: 3674422 - DNA, 19 bp, Homo sapiens
cggaaactagtgtacattt

SEQ ID NO: 3674423 - DNA, 17 bp, Homo sapiens
cggaaagccctgtgctc

SEQ ID NO: 3674424 - DNA, 15 bp, Homo sapiens
cggaacaagcctaaa

SEQ ID NO: 3674425 - DNA, 13 bp, Homo sapiens
cggaagagccttg

SEQ ID NO: 3674426 - DNA, 20 bp, Homo sapiens
cggacccggaggccgaggcc

SEQ ID NO: 3674427 - DNA, 16 bp, Homo sapiens
cggacttttctgcaaa

SEQ ID NO: 3674428 - DNA, 12 bp, Homo sapiens
cggagaggagtt

SEQ ID NO: 3674429 - DNA, 15 bp, Homo sapiens
cggagaggagttcag

SEQ ID NO: 3674430 - DNA, 13 bp, Homo sapiens
cggagctccagga

SEQ ID NO: 3674431 - DNA, 18 bp, Homo sapiens
cggaggcctgcgaccctg

SEQ ID NO: 3674432 - DNA, 21 bp, Homo sapiens
cggaggcctgcgaccctgggg

SEQ ID NO: 3674433 - DNA, 14 bp, Homo sapiens
cggatcctgggtgg

SEQ ID NO: 3674434 - DNA, 14 bp, Homo sapiens
cggcacagggtctg

SEQ ID NO: 3674435 - DNA, 22 bp, Homo sapiens
cggcaggacaacgaggaagccc

SEQ ID NO: 3674436 - DNA, 14 bp, Homo sapiens
cggcaggggcctgg

SEQ ID NO: 3674437 - DNA, 19 bp, Homo sapiens
cggcaggggcctggagatc

SEQ ID NO: 3674438 - DNA, 16 bp, Homo sapiens
cggcagttctgggtgc

SEQ ID NO: 3674439 - DNA, 14 bp, Homo sapiens
cggccaccactgca

SEQ ID NO: 3674440 - DNA, 15 bp, Homo sapiens
cggcccccttcctgg

SEQ ID NO: 3674441 - DNA, 20 bp, Homo sapiens
cggcccccttcctggcccct

SEQ ID NO: 3674442 - DNA, 14 bp, Homo sapiens
cggcccctcctgac

SEQ ID NO: 3674443 - DNA, 17 bp, Homo sapiens
cggccctgcagccagct

SEQ ID NO: 3674444 - DNA, 15 bp, Homo sapiens
cggccctgtgtgcag

SEQ ID NO: 3674445 - DNA, 13 bp, Homo sapiens
cggcctctgcctt

SEQ ID NO: 3674446 - DNA, 16 bp, Homo sapiens
cggcctgatgctccct

SEQ ID NO: 3674447 - DNA, 17 bp, Homo sapiens
cggcctgatgctccctc

SEQ ID NO: 3674448 - DNA, 16 bp, Homo sapiens
cggctccagagcagga

SEQ ID NO: 3674449 - DNA, 14 bp, Homo sapiens
cggctccccctgga

SEQ ID NO: 3674450 - DNA, 17 bp, Homo sapiens
cggctccccctggacgg

SEQ ID NO: 3674451 - DNA, 20 bp, Homo sapiens
cggctctggggtaggctgct

SEQ ID NO: 3674452 - DNA, 23 bp, Homo sapiens
cggctctggtggccactgagctg

SEQ ID NO: 3674453 - DNA, 16 bp, Homo sapiens
cggctgaccatgctca

SEQ ID NO: 3674454 - DNA, 14 bp, Homo sapiens
cggctttgcagtgc

SEQ ID NO: 3674455 - DNA, 21 bp, Homo sapiens
cgggacatcacagggtgggcc

SEQ ID NO: 3674456 - DNA, 14 bp, Homo sapiens
cgggacccagggcc

SEQ ID NO: 3674457 - DNA, 16 bp, Homo sapiens
cgggactcctccctgg

SEQ ID NO: 3674458 - DNA, 21 bp, Homo sapiens
cccactggggaaataacagct

SEQ ID NO: 3674459 - DNA, 19 bp, Homo sapiens
cccactgtatctaggcaac

SEQ ID NO: 3674460 - DNA, 15 bp, Homo sapiens
cccactgtcctgggc

SEQ ID NO: 3674461 - DNA, 13 bp, Homo sapiens
cccacttgcctct

SEQ ID NO: 3674462 - DNA, 19 bp, Homo sapiens
cccagacagcaaggtgtgg

SEQ ID NO: 3674463 - DNA, 22 bp, Homo sapiens
cccagagaaaggggagcccact

SEQ ID NO: 3674464 - DNA, 13 bp, Homo sapiens
cccagagctgttt

SEQ ID NO: 3674465 - DNA, 22 bp, Homo sapiens
cccagagctgtttatggcctca

SEQ ID NO: 3674466 - DNA, 22 bp, Homo sapiens
cccagcattccagcccctctgg

SEQ ID NO: 3674467 - DNA, 16 bp, Homo sapiens
cccagcccagacagca

SEQ ID NO: 3674468 - DNA, 21 bp, Homo sapiens
cccagcccccaaccccaagac

SEQ ID NO: 3674469 - DNA, 16 bp, Homo sapiens
cccagcctccctgaag

SEQ ID NO: 3674470 - DNA, 17 bp, Homo sapiens
cccagcctccctgaagc

SEQ ID NO: 3674471 - DNA, 18 bp, Homo sapiens
cccagcctccctgaagcc

SEQ ID NO: 3674472 - DNA, 12 bp, Homo sapiens
cccagccttggt

SEQ ID NO: 3674473 - DNA, 22 bp, Homo sapiens
cccagcgggcaggttctgcctg

SEQ ID NO: 3674474 - DNA, 15 bp, Homo sapiens
cccagcgtggcctcc

SEQ ID NO: 3674475 - DNA, 16 bp, Homo sapiens
cccagctaagaacctg

SEQ ID NO: 3674476 - DNA, 17 bp, Homo sapiens
cccagctaagaacctgg

SEQ ID NO: 3674477 - DNA, 18 bp, Homo sapiens
cccagctaagaacctgga

SEQ ID NO: 3674478 - DNA, 19 bp, Homo sapiens
cccagctaagaacctggaa

SEQ ID NO: 3674479 - DNA, 20 bp, Homo sapiens
cccagctaagaacctggaac

SEQ ID NO: 3674480 - DNA, 12 bp, Homo sapiens
cccaggaagccg

SEQ ID NO: 3674481 - DNA, 12 bp, Homo sapiens
cccaggaccctg

SEQ ID NO: 3674482 - DNA, 16 bp, Homo sapiens
cccaggcagctggcag

SEQ ID NO: 3674483 - DNA, 17 bp, Homo sapiens
cccaggctgcccagagc

SEQ ID NO: 3674484 - DNA, 19 bp, Homo sapiens
cccaggctgcccagagctg

SEQ ID NO: 3674485 - DNA, 20 bp, Homo sapiens
cccaggctgcccagagctgc

SEQ ID NO: 3674486 - DNA, 13 bp, Homo sapiens
cccaggctggagt

SEQ ID NO: 3674487 - DNA, 22 bp, Homo sapiens
cccaggctggagtgcagtgaca

SEQ ID NO: 3674488 - DNA, 15 bp, Homo sapiens
cccagggagcggaaa

SEQ ID NO: 3674489 - DNA, 20 bp, Homo sapiens
cccagggagcggaaagcagc

SEQ ID NO: 3674490 - DNA, 21 bp, Homo sapiens
cccagggagcggaaagcagct

SEQ ID NO: 3674491 - DNA, 16 bp, Homo sapiens
cccagggcccagagcc

SEQ ID NO: 3674492 - DNA, 19 bp, Homo sapiens
cccagggcccagagcccag

SEQ ID NO: 3674493 - DNA, 20 bp, Homo sapiens
cccagggcccagagcccagc

SEQ ID NO: 3674494 - DNA, 16 bp, Homo sapiens
cccaggggacaaggga

SEQ ID NO: 3674495 - DNA, 20 bp, Homo sapiens
cccaggtgcatttcttggtt

SEQ ID NO: 3674496 - DNA, 14 bp, Homo sapiens
cccagtaagggcgt

SEQ ID NO: 3674497 - DNA, 19 bp, Homo sapiens
cccagtccaaatgtcctcc

SEQ ID NO: 3674498 - DNA, 10 bp, Homo sapiens
cccagtgcag

SEQ ID NO: 3674499 - DNA, 12 bp, Homo sapiens
cccagtgcagaa

SEQ ID NO: 3674500 - DNA, 17 bp, Homo sapiens
cccagtgcagaatgtaa

SEQ ID NO: 3674501 - DNA, 18 bp, Homo sapiens
cccagtgcatggtggcca

SEQ ID NO: 3674502 - DNA, 18 bp, Homo sapiens
cccagttcttcctgcaac

SEQ ID NO: 3674503 - DNA, 20 bp, Homo sapiens
cccatcccccacctgccagc

SEQ ID NO: 3674504 - DNA, 11 bp, Homo sapiens
cccatctcagg

SEQ ID NO: 3674505 - DNA, 16 bp, Homo sapiens
cccatctcaggccaga

SEQ ID NO: 3674506 - DNA, 17 bp, Homo sapiens
cccatgcaagcagagga

SEQ ID NO: 3674507 - DNA, 12 bp, Homo sapiens
cccatgcactgt

SEQ ID NO: 3674508 - DNA, 14 bp, Homo sapiens
cccatgcactgtga

SEQ ID NO: 3674509 - DNA, 16 bp, Homo sapiens
cccatgcactgtgaag

SEQ ID NO: 3674510 - DNA, 18 bp, Homo sapiens
cccatgcccacctgccca

SEQ ID NO: 3674511 - DNA, 14 bp, Homo sapiens
cccatgcctgtcca

SEQ ID NO: 3674512 - DNA, 20 bp, Homo sapiens
cccatgcctgtccagcctgg

SEQ ID NO: 3674513 - DNA, 19 bp, Homo sapiens
cccatggggagggattctg

SEQ ID NO: 3674514 - DNA, 18 bp, Homo sapiens
cccattagaccaagcttg

SEQ ID NO: 3674515 - DNA, 15 bp, Homo sapiens
cccattgtccctctg

SEQ ID NO: 3674516 - DNA, 18 bp, Homo sapiens
cccattgtccctctgccc

SEQ ID NO: 3674517 - DNA, 12 bp, Homo sapiens
ccccacccagga

SEQ ID NO: 3674518 - DNA, 16 bp, Homo sapiens
ccccaccccacacttg

SEQ ID NO: 3674519 - DNA, 19 bp, Homo sapiens
ccccacccctgggggctct

SEQ ID NO: 3674520 - DNA, 12 bp, Homo sapiens
ccccaccctggg

SEQ ID NO: 3674521 - DNA, 15 bp, Homo sapiens
ccccaccctgggccc

SEQ ID NO: 3674522 - DNA, 12 bp, Homo sapiens
ccccagagctgt

SEQ ID NO: 3674523 - DNA, 21 bp, Homo sapiens
ccccagagctgtttatggcct

SEQ ID NO: 3674524 - DNA, 19 bp, Homo sapiens
ccccagcattccagcccct

SEQ ID NO: 3674525 - DNA, 12 bp, Homo sapiens
ccccagcccaga

SEQ ID NO: 3674526 - DNA, 18 bp, Homo sapiens
ccccaggaccagctcagg

SEQ ID NO: 3674527 - DNA, 19 bp, Homo sapiens
ccccaggctgcccagagct

SEQ ID NO: 3674528 - DNA, 19 bp, Homo sapiens
ccccagggtcttccctacc

SEQ ID NO: 3674529 - DNA, 17 bp, Homo sapiens
ccccaggtccagctctg

SEQ ID NO: 3674530 - DNA, 22 bp, Homo sapiens
ccccaggtccagctctggaggg

SEQ ID NO: 3674531 - DNA, 14 bp, Homo sapiens
ccccatctcaggcc

SEQ ID NO: 3674532 - DNA, 12 bp, Homo sapiens
ccccatcttgct

SEQ ID NO: 3674533 - DNA, 14 bp, Homo sapiens
ccccatcttgcttc

SEQ ID NO: 3674534 - DNA, 12 bp, Homo sapiens
ccccatgcctgt

SEQ ID NO: 3674535 - DNA, 13 bp, Homo sapiens
ccccatgcctgtc

SEQ ID NO: 3674536 - DNA, 15 bp, Homo sapiens
ccccatgcctgtcca

SEQ ID NO: 3674537 - DNA, 18 bp, Homo sapiens
ccccatgcctgtccagcc

SEQ ID NO: 3674538 - DNA, 21 bp, Homo sapiens
ccccatgcctgtccagcctgg

SEQ ID NO: 3674539 - DNA, 23 bp, Homo sapiens
ccccatgcctgtccagcctgggc

SEQ ID NO: 3674540 - DNA, 13 bp, Homo sapiens
cccccaagcctgc

SEQ ID NO: 3674541 - DNA, 18 bp, Homo sapiens
cccccagctaagaacctg

SEQ ID NO: 3674542 - DNA, 17 bp, Homo sapiens
cccccaggctgcccaga

SEQ ID NO: 3674543 - DNA, 21 bp, Homo sapiens
cccccaggctgcccagagctg

SEQ ID NO: 3674544 - DNA, 14 bp, Homo sapiens
cccccatgcactgt

SEQ ID NO: 3674545 - DNA, 18 bp, Homo sapiens
cccccatgcactgtgaag

SEQ ID NO: 3674546 - DNA, 11 bp, Homo sapiens
ccccccactct

SEQ ID NO: 3674547 - DNA, 12 bp, Homo sapiens
ccccccactctc

SEQ ID NO: 3674548 - DNA, 14 bp, Homo sapiens
ccccccatgcactg

SEQ ID NO: 3674549 - DNA, 19 bp, Homo sapiens
ccccctggacggggcgggc

SEQ ID NO: 3674550 - DNA, 13 bp, Homo sapiens
cccccttcctggc

SEQ ID NO: 3674551 - DNA, 20 bp, Homo sapiens
cccccttctttgcagctgcc

SEQ ID NO: 3674552 - DNA, 21 bp, Homo sapiens
ccccggcatgagactcagtgc

SEQ ID NO: 3674553 - DNA, 13 bp, Homo sapiens
ccccgtggggcag

SEQ ID NO: 3674554 - DNA, 18 bp, Homo sapiens
cccctcacgcaagtgcca

SEQ ID NO: 3674555 - DNA, 11 bp, Homo sapiens
cccctcccagt

SEQ ID NO: 3674556 - DNA, 15 bp, Homo sapiens
cccctccctggctcc

SEQ ID NO: 3674557 - DNA, 22 bp, Homo sapiens
cccctccctggctcccatgacc

SEQ ID NO: 3674558 - DNA, 17 bp, Homo sapiens
cccctccgccctgccac

SEQ ID NO: 3674559 - DNA, 18 bp, Homo sapiens
cccctcgtcccatccagc

SEQ ID NO: 3674560 - DNA, 12 bp, Homo sapiens
cccctctggtcg

SEQ ID NO: 3674561 - DNA, 12 bp, Homo sapiens
cccctgccacca

SEQ ID NO: 3674562 - DNA, 16 bp, Homo sapiens
cccctgcgtcgagctg

SEQ ID NO: 3674563 - DNA, 11 bp, Homo sapiens
cccctgctgct

SEQ ID NO: 3674564 - DNA, 19 bp, Homo sapiens
cccctggacggggcgggcc

SEQ ID NO: 3674565 - DNA, 15 bp, Homo sapiens
cccctgtaaggttcc

SEQ ID NO: 3674566 - DNA, 18 bp, Homo sapiens
ccccttccaaatgtccct

SEQ ID NO: 3674567 - DNA, 21 bp, Homo sapiens
ccccttcctcagcctggggtt

SEQ ID NO: 3674568 - DNA, 11 bp, Homo sapiens
ccccttcctgg

SEQ ID NO: 3674569 - DNA, 12 bp, Homo sapiens
ccccttcctggc

SEQ ID NO: 3674570 - DNA, 12 bp, Homo sapiens
ccccttctctgc

SEQ ID NO: 3674571 - DNA, 12 bp, Homo sapiens
cccgacatggct

SEQ ID NO: 3674572 - DNA, 13 bp, Homo sapiens
cccgactgtgctg

SEQ ID NO: 3674573 - DNA, 15 bp, Homo sapiens
cccgaggcccgcatg

SEQ ID NO: 3674574 - DNA, 15 bp, Homo sapiens
cccgcagacaccttg

SEQ ID NO: 3674575 - DNA, 22 bp, Homo sapiens
cccgcagtgtgcactaaggggc

SEQ ID NO: 3674576 - DNA, 16 bp, Homo sapiens
cccgccgatagaggga

SEQ ID NO: 3674577 - DNA, 16 bp, Homo sapiens
cccggcagggtcctag

SEQ ID NO: 3674578 - DNA, 15 bp, Homo sapiens
cccggctccagagca

SEQ ID NO: 3674579 - DNA, 17 bp, Homo sapiens
cccgggctctctgctgt

SEQ ID NO: 3674580 - DNA, 14 bp, Homo sapiens
cccgtcctgcctgt

SEQ ID NO: 3674581 - DNA, 17 bp, Homo sapiens
cccgtcctgcctgtggc

SEQ ID NO: 3674582 - DNA, 16 bp, Homo sapiens
cccgtgcccctgggat

SEQ ID NO: 3674583 - DNA, 14 bp, Homo sapiens
cccgtgtcctctcc

SEQ ID NO: 3674584 - DNA, 20 bp, Homo sapiens
cccgtgtcctctccctgcca

SEQ ID NO: 3674585 - DNA, 18 bp, Homo sapiens
ccctaaggcatgtgtgaa

SEQ ID NO: 3674586 - DNA, 22 bp, Homo sapiens
ccctaatctatggtcgggagac

SEQ ID NO: 3674587 - DNA, 17 bp, Homo sapiens
ccctaccacctccccag

SEQ ID NO: 3674588 - DNA, 14 bp, Homo sapiens
ccctaccctcctgc

SEQ ID NO: 3674589 - DNA, 16 bp, Homo sapiens
ccctaccctcctgctg

SEQ ID NO: 3674590 - DNA, 18 bp, Homo sapiens
ccctaccctcctgctgag

SEQ ID NO: 3674591 - DNA, 14 bp, Homo sapiens
ccctacctggggaa

SEQ ID NO: 3674592 - DNA, 19 bp, Homo sapiens
ccctacttcattttcagag

SEQ ID NO: 3674593 - DNA, 22 bp, Homo sapiens
ccctacttcattttcagagtga

SEQ ID NO: 3674594 - DNA, 23 bp, Homo sapiens
ccctagcagcccaccctgctgct

SEQ ID NO: 3674595 - DNA, 18 bp, Homo sapiens
ccctattagagaagagat

SEQ ID NO: 3674596 - DNA, 20 bp, Homo sapiens
ccctcaaggtgcggggagaa

SEQ ID NO: 3674597 - DNA, 17 bp, Homo sapiens
ccctcagcctctgccac

SEQ ID NO: 3674598 - DNA, 17 bp, Homo sapiens
ccctcataagtttgttt

SEQ ID NO: 3674599 - DNA, 18 bp, Homo sapiens
ccctccactcctcatccc

SEQ ID NO: 3674600 - DNA, 12 bp, Homo sapiens
ccctcccacccc

SEQ ID NO: 3674601 - DNA, 19 bp, Homo sapiens
ccctccctggctcccatga

SEQ ID NO: 3674602 - DNA, 19 bp, Homo sapiens
ccctccctgttccccagag

SEQ ID NO: 3674603 - DNA, 18 bp, Homo sapiens
ccctccgccaggcgagat

SEQ ID NO: 3674604 - DNA, 13 bp, Homo sapiens
ccctccgccctgc

SEQ ID NO: 3674605 - DNA, 18 bp, Homo sapiens
ccctcctcacctctggac

SEQ ID NO: 3674606 - DNA, 23 bp, Homo sapiens
ccctcctcacctctggactggct

SEQ ID NO: 3674607 - DNA, 13 bp, Homo sapiens
ccctcctctccca

SEQ ID NO: 3674608 - DNA, 19 bp, Homo sapiens
ccctcctgactcatccgcc

SEQ ID NO: 3674609 - DNA, 23 bp, Homo sapiens
ccctcctgactcatccgcctggc

SEQ ID NO: 3674610 - DNA, 16 bp, Homo sapiens
ccctcctgctgagctg

SEQ ID NO: 3674611 - DNA, 20 bp, Homo sapiens
ccctcgggtctccccacctg

SEQ ID NO: 3674612 - DNA, 20 bp, Homo sapiens
ccctctccaagcgcctggct

SEQ ID NO: 3674613 - DNA, 14 bp, Homo sapiens
ccctctctcttctg

SEQ ID NO: 3674614 - DNA, 15 bp, Homo sapiens
ccctctctcttctgc

SEQ ID NO: 3674615 - DNA, 18 bp, Homo sapiens
ccctctctcttctgctcc

SEQ ID NO: 3674616 - DNA, 21 bp, Homo sapiens
ccctctggagtggccactaag

SEQ ID NO: 3674617 - DNA, 18 bp, Homo sapiens
ccctctggtcgctcctgc

SEQ ID NO: 3674618 - DNA, 20 bp, Homo sapiens
ccctctggtcgctcctgccc

SEQ ID NO: 3674619 - DNA, 19 bp, Homo sapiens
ccctcttccaaaggcagcg

SEQ ID NO: 3674620 - DNA, 16 bp, Homo sapiens
ccctctttgctgaaga

SEQ ID NO: 3674621 - DNA, 14 bp, Homo sapiens
ccctgagatgggcc

SEQ ID NO: 3674622 - DNA, 16 bp, Homo sapiens
ccctgagtctgggcag

SEQ ID NO: 3674623 - DNA, 14 bp, Homo sapiens
ccctgcagccagct

SEQ ID NO: 3674624 - DNA, 13 bp, Homo sapiens
ccctgcagctgac

SEQ ID NO: 3674625 - DNA, 19 bp, Homo sapiens
ccctgcatctgaccagcag

SEQ ID NO: 3674626 - DNA, 18 bp, Homo sapiens
ccctgccactcactaggc

SEQ ID NO: 3674627 - DNA, 13 bp, Homo sapiens
ccctgccagctct

SEQ ID NO: 3674628 - DNA, 22 bp, Homo sapiens
ccctgccttatcttgcacccca

SEQ ID NO: 3674629 - DNA, 17 bp, Homo sapiens
ccctgcgtcgagctggg

SEQ ID NO: 3674630 - DNA, 18 bp, Homo sapiens
ccctgcgtcgagctggga

SEQ ID NO: 3674631 - DNA, 19 bp, Homo sapiens
ccctgctgctggtgcacag

SEQ ID NO: 3674632 - DNA, 16 bp, Homo sapiens
ccctggacggggcggg

SEQ ID NO: 3674633 - DNA, 13 bp, Homo sapiens
ccctggcctcccc

SEQ ID NO: 3674634 - DNA, 14 bp, Homo sapiens
ccctggctcccatg

SEQ ID NO: 3674635 - DNA, 23 bp, Homo sapiens
ccctggctcccatgaccatactg

SEQ ID NO: 3674636 - DNA, 20 bp, Homo sapiens
ccctgggatccgagggcccc

SEQ ID NO: 3674637 - DNA, 19 bp, Homo sapiens
ccctgggccctgggctgga

SEQ ID NO: 3674638 - DNA, 21 bp, Homo sapiens
ccctggggctaggctggagcc

SEQ ID NO: 3674639 - DNA, 14 bp, Homo sapiens
ccctgggggcggga

SEQ ID NO: 3674640 - DNA, 16 bp, Homo sapiens
ccctgggggcgggact

SEQ ID NO: 3674641 - DNA, 10 bp, Homo sapiens
ccctgggtgg

SEQ ID NO: 3674642 - DNA, 19 bp, Homo sapiens
ccctgggtggagcaggact

SEQ ID NO: 3674643 - DNA, 22 bp, Homo sapiens
ccctgggtgtccccgctgctgt

SEQ ID NO: 3674644 - DNA, 23 bp, Homo sapiens
ccctgggtgtccccgctgctgtg

SEQ ID NO: 3674645 - DNA, 16 bp, Homo sapiens
ccctggtgggccaaca

SEQ ID NO: 3674646 - DNA, 23 bp, Homo sapiens
ccctggtgggccaacaaagaaca

SEQ ID NO: 3674647 - DNA, 16 bp, Homo sapiens
ccctggtggttgctgt

SEQ ID NO: 3674648 - DNA, 14 bp, Homo sapiens
ccctgtccaaactg

SEQ ID NO: 3674649 - DNA, 23 bp, Homo sapiens
ccctgtctcaaaaaaagaaaaag

SEQ ID NO: 3674650 - DNA, 11 bp, Homo sapiens
ccctgtgtgca

SEQ ID NO: 3674651 - DNA, 13 bp, Homo sapiens
ccctgtgttgtct

SEQ ID NO: 3674652 - DNA, 16 bp, Homo sapiens
ccctgtgttgtctcta

SEQ ID NO: 3674653 - DNA, 16 bp, Homo sapiens
ccctgttccccagaga

SEQ ID NO: 3674654 - DNA, 19 bp, Homo sapiens
cccttacctcggtgccttc

SEQ ID NO: 3674655 - DNA, 17 bp, Homo sapiens
cccttagcctccctgaa

SEQ ID NO: 3674656 - DNA, 16 bp, Homo sapiens
cccttcccctccctgg

SEQ ID NO: 3674657 - DNA, 17 bp, Homo sapiens
cccttcctcagcctggg

SEQ ID NO: 3674658 - DNA, 18 bp, Homo sapiens
cccttcctcagcctgggg

SEQ ID NO: 3674659 - DNA, 17 bp, Homo sapiens
cccttctctgctccacc

SEQ ID NO: 3674660 - DNA, 18 bp, Homo sapiens
cccttgacaactggcagg

SEQ ID NO: 3674661 - DNA, 20 bp, Homo sapiens
cccttgatttaaacacacag

SEQ ID NO: 3674662 - DNA, 16 bp, Homo sapiens
cccttgcagctagttt

SEQ ID NO: 3674663 - DNA, 19 bp, Homo sapiens
cccttgcagttcagcacca

SEQ ID NO: 3674664 - DNA, 21 bp, Homo sapiens
cccttgcagttcagcaccacc

SEQ ID NO: 3674665 - DNA, 17 bp, Homo sapiens
cccttggaggccagcca

SEQ ID NO: 3674666 - DNA, 12 bp, Homo sapiens
cccttggcctca

SEQ ID NO: 3674667 - DNA, 14 bp, Homo sapiens
cccttgtgtcaaga

SEQ ID NO: 3674668 - DNA, 18 bp, Homo sapiens
ccctttccttccatccct

SEQ ID NO: 3674669 - DNA, 23 bp, Homo sapiens
ccctttgctgtgaggctgtcctg

SEQ ID NO: 3674670 - DNA, 23 bp, Homo sapiens
ccctttgtctgtcaatcacagtc

SEQ ID NO: 3674671 - DNA, 13 bp, Homo sapiens
ccgagaagcaaga

SEQ ID NO: 3674672 - DNA, 17 bp, Homo sapiens
ccgagaaggaagcctcc

SEQ ID NO: 3674673 - DNA, 15 bp, Homo sapiens
ccgagattgcaccac

SEQ ID NO: 3674674 - DNA, 21 bp, Homo sapiens
ccgagattgcaccactgcact

SEQ ID NO: 3674675 - DNA, 21 bp, Homo sapiens
ccgcaccctgcctacgccagg

SEQ ID NO: 3674676 - DNA, 15 bp, Homo sapiens
ccgcaggaagctgct

SEQ ID NO: 3674677 - DNA, 22 bp, Homo sapiens
ccgcagtgtgcactaaggggcc

SEQ ID NO: 3674678 - DNA, 16 bp, Homo sapiens
ccgcatgcggcccagg

SEQ ID NO: 3674679 - DNA, 12 bp, Homo sapiens
ccgccaggcgag

SEQ ID NO: 3674680 - DNA, 15 bp, Homo sapiens
ccgccatcctctgcc

SEQ ID NO: 3674681 - DNA, 17 bp, Homo sapiens
ccgccatcctctgcctc

SEQ ID NO: 3674682 - DNA, 14 bp, Homo sapiens
ccgccattgccacc

SEQ ID NO: 3674683 - DNA, 17 bp, Homo sapiens
ccgcccgtctctgctct

SEQ ID NO: 3674684 - DNA, 14 bp, Homo sapiens
ccgccctgccactc

SEQ ID NO: 3674685 - DNA, 17 bp, Homo sapiens
ccgctgaacccacccgg

SEQ ID NO: 3674686 - DNA, 20 bp, Homo sapiens
ccgctgccacccacctccct

SEQ ID NO: 3674687 - DNA, 17 bp, Homo sapiens
ccggagattggacggcc

SEQ ID NO: 3674688 - DNA, 21 bp, Homo sapiens
ccggagattggacggcctgat

SEQ ID NO: 3674689 - DNA, 20 bp, Homo sapiens
ccggcacagggtctgctctt

SEQ ID NO: 3674690 - DNA, 22 bp, Homo sapiens
ccggcatgagactcagtgcaga

SEQ ID NO: 3674691 - DNA, 15 bp, Homo sapiens
ccggccagccatgtc

SEQ ID NO: 3674692 - DNA, 18 bp, Homo sapiens
ccggcccatatccctggt

SEQ ID NO: 3674693 - DNA, 20 bp, Homo sapiens
ccggcccatatccctggttg

SEQ ID NO: 3674694 - DNA, 21 bp, Homo sapiens
ccggcccatatccctggttgc

SEQ ID NO: 3674695 - DNA, 16 bp, Homo sapiens
ccggcccccttcctgg

SEQ ID NO: 3674696 - DNA, 20 bp, Homo sapiens
ccggcccccttcctggcccc

SEQ ID NO: 3674697 - DNA, 14 bp, Homo sapiens
ccggcccctcctga

SEQ ID NO: 3674698 - DNA, 16 bp, Homo sapiens
ccggctccagagcagg

SEQ ID NO: 3674699 - DNA, 22 bp, Homo sapiens
ccggctctggtggccactgagc

SEQ ID NO: 3674700 - DNA, 18 bp, Homo sapiens
ccgggaatgaatggggag

SEQ ID NO: 3674701 - DNA, 19 bp, Homo sapiens
ccgggaatgaatggggagg

SEQ ID NO: 3674702 - DNA, 13 bp, Homo sapiens
ccgggctctctgc

SEQ ID NO: 3674703 - DNA, 19 bp, Homo sapiens
ccgggtcacacaaaggcat

SEQ ID NO: 3674704 - DNA, 19 bp, Homo sapiens
ccggtcacctagcaagctg

SEQ ID NO: 3674705 - DNA, 22 bp, Homo sapiens
ccggtgggacccccgtggggca

SEQ ID NO: 3674706 - DNA, 12 bp, Homo sapiens
ccgtcagtgctg

SEQ ID NO: 3674707 - DNA, 11 bp, Homo sapiens
ccgtccctccc

SEQ ID NO: 3674708 - DNA, 13 bp, Homo sapiens
ccgtcctgcctgt

SEQ ID NO: 3674709 - DNA, 15 bp, Homo sapiens
ccgtctctgctctgc

SEQ ID NO: 3674710 - DNA, 19 bp, Homo sapiens
ccgtctgaccccagcccag

SEQ ID NO: 3674711 - DNA, 15 bp, Homo sapiens
ccgtgcccctgggat

SEQ ID NO: 3674712 - DNA, 16 bp, Homo sapiens
ccgtgcccctgggatc

SEQ ID NO: 3674713 - DNA, 16 bp, Homo sapiens
ccgtgctgacagctgc

SEQ ID NO: 3674714 - DNA, 17 bp, Homo sapiens
ccgtgctgacagctgct

SEQ ID NO: 3674715 - DNA, 19 bp, Homo sapiens
ccgtgctgacagctgctcc

SEQ ID NO: 3674716 - DNA, 20 bp, Homo sapiens
ccgtgctgacagctgctcct

SEQ ID NO: 3674717 - DNA, 19 bp, Homo sapiens
ccgtggattgcacgtggcc

SEQ ID NO: 3674718 - DNA, 20 bp, Homo sapiens
ccgtggattgcacgtggcct

SEQ ID NO: 3674719 - DNA, 13 bp, Homo sapiens
ccgtggggcaggg

SEQ ID NO: 3674720 - DNA, 15 bp, Homo sapiens
ccgtggggcagggag

SEQ ID NO: 3674721 - DNA, 22 bp, Homo sapiens
ccgtggggcagggagctgggcc

SEQ ID NO: 3674722 - DNA, 14 bp, Homo sapiens
ccgtgtcctctccc

SEQ ID NO: 3674723 - DNA, 17 bp, Homo sapiens
ccgtgtcctctccctgc

SEQ ID NO: 3674724 - DNA, 16 bp, Homo sapiens
ccgtgtctgtctggca

SEQ ID NO: 3674725 - DNA, 17 bp, Homo sapiens
ccgtgtctgtctggcac

SEQ ID NO: 3674726 - DNA, 23 bp, Homo sapiens
ccgtgtgagaagtgaatgctggg

SEQ ID NO: 3674727 - DNA, 13 bp, Homo sapiens
cctaaacctcagt

SEQ ID NO: 3674728 - DNA, 16 bp, Homo sapiens
cctaaacggggcagta

SEQ ID NO: 3674729 - DNA, 22 bp, Homo sapiens
cctaaagaaaaatatcttggcc

SEQ ID NO: 3674730 - DNA, 14 bp, Homo sapiens
cctaaatggcctca

SEQ ID NO: 3674731 - DNA, 18 bp, Homo sapiens
cctaaatggcctcatgtg

SEQ ID NO: 3674732 - DNA, 21 bp, Homo sapiens
cctaagactaacaaaggcagc

SEQ ID NO: 3674733 - DNA, 18 bp, Homo sapiens
cctaatccaggcagatcc

SEQ ID NO: 3674734 - DNA, 21 bp, Homo sapiens
cctaatccaggcagatccagg

SEQ ID NO: 3674735 - DNA, 18 bp, Homo sapiens
cctacaagagcagcctgt

SEQ ID NO: 3674736 - DNA, 19 bp, Homo sapiens
cctacaagagcagcctgtg

SEQ ID NO: 3674737 - DNA, 21 bp, Homo sapiens
cctacagttgaaaaacagctg

SEQ ID NO: 3674738 - DNA, 18 bp, Homo sapiens
cctaccacctccccagcc

SEQ ID NO: 3674739 - DNA, 14 bp, Homo sapiens
cctacccatccccg

SEQ ID NO: 3674740 - DNA, 13 bp, Homo sapiens
cctaccctcctgc

SEQ ID NO: 3674741 - DNA, 15 bp, Homo sapiens
cctaccctcctgctg

SEQ ID NO: 3674742 - DNA, 16 bp, Homo sapiens
cctaccctcctgctga

SEQ ID NO: 3674743 - DNA, 21 bp, Homo sapiens
cctaccctcctgctgagctgc

SEQ ID NO: 3674744 - DNA, 18 bp, Homo sapiens
cctacctgaaggcagggc

SEQ ID NO: 3674745 - DNA, 22 bp, Homo sapiens
cctacctggggaaagcctgaag

SEQ ID NO: 3674746 - DNA, 13 bp, Homo sapiens
cctactgcccagg

SEQ ID NO: 3674747 - DNA, 16 bp, Homo sapiens
cctactgcccaggcac

SEQ ID NO: 3674748 - DNA, 18 bp, Homo sapiens
cctagactgttactttgg

SEQ ID NO: 3674749 - DNA, 13 bp, Homo sapiens
cctagagggaggg

SEQ ID NO: 3674750 - DNA, 15 bp, Homo sapiens
cctagagggaggggc

SEQ ID NO: 3674751 - DNA, 16 bp, Homo sapiens
cctagagggaggggcc

SEQ ID NO: 3674752 - DNA, 20 bp, Homo sapiens
cctagcagcccaccctgctg

SEQ ID NO: 3674753 - DNA, 22 bp, Homo sapiens
cctagcagcccaccctgctgct

SEQ ID NO: 3674754 - DNA, 23 bp, Homo sapiens
cctaggcatttgctgaatacaga

SEQ ID NO: 3674755 - DNA, 23 bp, Homo sapiens
cctaggcgattttgtctaccatt

SEQ ID NO: 3674756 - DNA, 14 bp, Homo sapiens
cctaggtctccagt

SEQ ID NO: 3674757 - DNA, 23 bp, Homo sapiens
cctataaaacaggtcaatacagt

SEQ ID NO: 3674758 - DNA, 23 bp, Homo sapiens
cctatactgcttggagctgagca

SEQ ID NO: 3674759 - DNA, 15 bp, Homo sapiens
cctatatatttctat

SEQ ID NO: 3674760 - DNA, 17 bp, Homo sapiens
cctatcacttacatttt

SEQ ID NO: 3674761 - DNA, 16 bp, Homo sapiens
cctatcaggtgcccct

SEQ ID NO: 3674762 - DNA, 19 bp, Homo sapiens
cctatcaggtgcccctctt

SEQ ID NO: 3674763 - DNA, 18 bp, Homo sapiens
cctatgcttaataaaaga

SEQ ID NO: 3674764 - DNA, 13 bp, Homo sapiens
cctatttttgtag

SEQ ID NO: 3674765 - DNA, 12 bp, Homo sapiens
cctcacctctgg

SEQ ID NO: 3674766 - DNA, 13 bp, Homo sapiens
cctcacctctgga

SEQ ID NO: 3674767 - DNA, 16 bp, Homo sapiens
cctcaccttggcacca

SEQ ID NO: 3674768 - DNA, 22 bp, Homo sapiens
cctcacgcaagtgccagggctg

SEQ ID NO: 3674769 - DNA, 14 bp, Homo sapiens
cctcacgcacctcc

SEQ ID NO: 3674770 - DNA, 17 bp, Homo sapiens
cctcacgcacctcccat

SEQ ID NO: 3674771 - DNA, 15 bp, Homo sapiens
cctcagccagagaag

SEQ ID NO: 3674772 - DNA, 17 bp, Homo sapiens
cctcagccagagaagct

SEQ ID NO: 3674773 - DNA, 14 bp, Homo sapiens
cctcagcctctgcc

SEQ ID NO: 3674774 - DNA, 15 bp, Homo sapiens
cctcagcctctgcca

SEQ ID NO: 3674775 - DNA, 20 bp, Homo sapiens
cctcagcctctgccactgtg

SEQ ID NO: 3674776 - DNA, 21 bp, Homo sapiens
cctcagcctggccagacacag

SEQ ID NO: 3674777 - DNA, 23 bp, Homo sapiens
cctcagcctggggtttgaccacc

SEQ ID NO: 3674778 - DNA, 20 bp, Homo sapiens
cctcagccttgccagagatc

SEQ ID NO: 3674779 - DNA, 15 bp, Homo sapiens
cctcagctgcctcac

SEQ ID NO: 3674780 - DNA, 19 bp, Homo sapiens
cctcaggcaggaagggcag

SEQ ID NO: 3674781 - DNA, 15 bp, Homo sapiens
cctcagttcccttgg

SEQ ID NO: 3674782 - DNA, 17 bp, Homo sapiens
cctcagttcccttggcc

SEQ ID NO: 3674783 - DNA, 21 bp, Homo sapiens
cctcagttcccttggcctcag

SEQ ID NO: 3674784 - DNA, 17 bp, Homo sapiens
cctcatctctctgccca

SEQ ID NO: 3674785 - DNA, 21 bp, Homo sapiens
cctcatggccagcgcccctca

SEQ ID NO: 3674786 - DNA, 17 bp, Homo sapiens
cctcatggcgggactgg

SEQ ID NO: 3674787 - DNA, 18 bp, Homo sapiens
cctcatggcgggactgga

SEQ ID NO: 3674788 - DNA, 23 bp, Homo sapiens
cctcatgtggctggaagatcctg

SEQ ID NO: 3674789 - DNA, 20 bp, Homo sapiens
cctcatttggggtagctaga

SEQ ID NO: 3674790 - DNA, 11 bp, Homo sapiens
cctccacagct

SEQ ID NO: 3674791 - DNA, 17 bp, Homo sapiens
cctccaccaaaccccac

SEQ ID NO: 3674792 - DNA, 13 bp, Homo sapiens
cctccagaagcct

SEQ ID NO: 3674793 - DNA, 19 bp, Homo sapiens
cctccagaagcctctggct

SEQ ID NO: 3674794 - DNA, 21 bp, Homo sapiens
cctccagaagcctctggctag

SEQ ID NO: 3674795 - DNA, 13 bp, Homo sapiens
cctccagcaggga

SEQ ID NO: 3674796 - DNA, 16 bp, Homo sapiens
cctccagcctggtggc

SEQ ID NO: 3674797 - DNA, 20 bp, Homo sapiens
cctccagcctggtggcccag

SEQ ID NO: 3674798 - DNA, 15 bp, Homo sapiens
cctccaggaaccaca

SEQ ID NO: 3674799 - DNA, 18 bp, Homo sapiens
cctccaggtgcagaggta

SEQ ID NO: 3674800 - DNA, 14 bp, Homo sapiens
cctcccaaagaggc

SEQ ID NO: 3674801 - DNA, 12 bp, Homo sapiens
cctcccaagctg

SEQ ID NO: 3674802 - DNA, 17 bp, Homo sapiens
cctcccagaacacactc

SEQ ID NO: 3674803 - DNA, 19 bp, Homo sapiens
cctcccccaacccccaccc

SEQ ID NO: 3674804 - DNA, 19 bp, Homo sapiens
cctcccccccatgcactgt

SEQ ID NO: 3674805 - DNA, 17 bp, Homo sapiens
cctcccctgccaccagg

SEQ ID NO: 3674806 - DNA, 13 bp, Homo sapiens
cctcccctgccct

SEQ ID NO: 3674807 - DNA, 16 bp, Homo sapiens
cctcccctgccctggt

SEQ ID NO: 3674808 - DNA, 13 bp, Homo sapiens
cctccctctctct

SEQ ID NO: 3674809 - DNA, 20 bp, Homo sapiens
cctccctctctcttctgctc

SEQ ID NO: 3674810 - DNA, 22 bp, Homo sapiens
cctccctctctcttctgctcca

SEQ ID NO: 3674811 - DNA, 22 bp, Homo sapiens
cctccctgcatctgaccagcag

SEQ ID NO: 3674812 - DNA, 14 bp, Homo sapiens
cctccctggagcta

SEQ ID NO: 3674813 - DNA, 20 bp, Homo sapiens
cctccctgggggcgggactc

SEQ ID NO: 3674814 - DNA, 18 bp, Homo sapiens
cctccctgttccccagag

SEQ ID NO: 3674815 - DNA, 13 bp, Homo sapiens
cctcccttctgct

SEQ ID NO: 3674816 - DNA, 16 bp, Homo sapiens
cctccgccaggcgaga

SEQ ID NO: 3674817 - DNA, 12 bp, Homo sapiens
cctccgccctgc

SEQ ID NO: 3674818 - DNA, 14 bp, Homo sapiens
cctccgccctgcca

SEQ ID NO: 3674819 - DNA, 16 bp, Homo sapiens
cctccgccctgccact

SEQ ID NO: 3674820 - DNA, 13 bp, Homo sapiens
cctccgcctcctg

SEQ ID NO: 3674821 - DNA, 12 bp, Homo sapiens
cctccgcctgtc

SEQ ID NO: 3674822 - DNA, 12 bp, Homo sapiens
cctcctcacctc

SEQ ID NO: 3674823 - DNA, 22 bp, Homo sapiens
cctcctcacctctggactggct

SEQ ID NO: 3674824 - DNA, 14 bp, Homo sapiens
cctcctcactccct

SEQ ID NO: 3674825 - DNA, 17 bp, Homo sapiens
cctcctccaatggaaat

SEQ ID NO: 3674826 - DNA, 16 bp, Homo sapiens
cctcctcccacccggc

SEQ ID NO: 3674827 - DNA, 13 bp, Homo sapiens
cctcctccctgca

SEQ ID NO: 3674828 - DNA, 14 bp, Homo sapiens
cctcctccctgcat

SEQ ID NO: 3674829 - DNA, 24 bp, Homo sapiens
cctcctgattaaggcgtggcttct

SEQ ID NO: 3674830 - DNA, 19 bp, Homo sapiens
cctcctgcagaccacgccc

SEQ ID NO: 3674831 - DNA, 12 bp, Homo sapiens
cctcctgcccac

SEQ ID NO: 3674832 - DNA, 15 bp, Homo sapiens
cctcctgctgagctg

SEQ ID NO: 3674833 - DNA, 17 bp, Homo sapiens
cctcctgctgagctgcc

SEQ ID NO: 3674834 - DNA, 18 bp, Homo sapiens
cctcctgctgagctgccc

SEQ ID NO: 3674835 - DNA, 17 bp, Homo sapiens
cctcgcgcttgctggcc

SEQ ID NO: 3674836 - DNA, 13 bp, Homo sapiens
cctcgggtctccc

SEQ ID NO: 3674837 - DNA, 14 bp, Homo sapiens
cctcgtcccatcca

SEQ ID NO: 3674838 - DNA, 15 bp, Homo sapiens
cctcgtcccatccag

SEQ ID NO: 3674839 - DNA, 19 bp, Homo sapiens
cctctaactggacagcctc

SEQ ID NO: 3674840 - DNA, 20 bp, Homo sapiens
cctctaactggacagcctct

SEQ ID NO: 3674841 - DNA, 19 bp, Homo sapiens
cctctactttgattctgat

SEQ ID NO: 3674842 - DNA, 14 bp, Homo sapiens
cctctcacctcagc

SEQ ID NO: 3674843 - DNA, 18 bp, Homo sapiens
cctctccaagcgcctggc

SEQ ID NO: 3674844 - DNA, 19 bp, Homo sapiens
cctctcccattgtccctct

SEQ ID NO: 3674845 - DNA, 17 bp, Homo sapiens
cctctccccagcccaga

SEQ ID NO: 3674846 - DNA, 21 bp, Homo sapiens
cctctccccagcccagagaca

SEQ ID NO: 3674847 - DNA, 19 bp, Homo sapiens
cctctcgtcccgtccctcc

SEQ ID NO: 3674848 - DNA, 16 bp, Homo sapiens
cctctctcttctgctc

SEQ ID NO: 3674849 - DNA, 20 bp, Homo sapiens
cctctctcttctgctccacc

SEQ ID NO: 3674850 - DNA, 21 bp, Homo sapiens
cctctctggtggctgggctgc

SEQ ID NO: 3674851 - DNA, 23 bp, Homo sapiens
cctctgaaaaccaatgttctctc

SEQ ID NO: 3674852 - DNA, 20 bp, Homo sapiens
cctctgcacaagctgcaccc

SEQ ID NO: 3674853 - DNA, 21 bp, Homo sapiens
cctctgcactactgacatgtg

SEQ ID NO: 3674854 - DNA, 16 bp, Homo sapiens
cctctggactggctag

SEQ ID NO: 3674855 - DNA, 22 bp, Homo sapiens
cctctggctagaggccagcccc

SEQ ID NO: 3674856 - DNA, 23 bp, Homo sapiens
cctctggctagaggccagcccca

SEQ ID NO: 3674857 - DNA, 24 bp, Homo sapiens
cctctggctagaggccagccccac

SEQ ID NO: 3674858 - DNA, 16 bp, Homo sapiens
cctctggtcgctcctg

SEQ ID NO: 3674859 - DNA, 15 bp, Homo sapiens
cctctgtcttctgga

SEQ ID NO: 3674860 - DNA, 13 bp, Homo sapiens
cctctgtgctgtg

SEQ ID NO: 3674861 - DNA, 15 bp, Homo sapiens
cctctgtgctgtgtg

SEQ ID NO: 3674862 - DNA, 17 bp, Homo sapiens
cctctgtggccagctgc

SEQ ID NO: 3674863 - DNA, 22 bp, Homo sapiens
cctctgtggccagctgcatctg

SEQ ID NO: 3674864 - DNA, 18 bp, Homo sapiens
cctctgtgtatttgcttt

SEQ ID NO: 3674865 - DNA, 14 bp, Homo sapiens
cctcttaaattata

SEQ ID NO: 3674866 - DNA, 19 bp, Homo sapiens
cctcttaaattatatattt

SEQ ID NO: 3674867 - DNA, 14 bp, Homo sapiens
cctcttagaaaaac

SEQ ID NO: 3674868 - DNA, 18 bp, Homo sapiens
cctcttcatggatggggg

SEQ ID NO: 3674869 - DNA, 20 bp, Homo sapiens
cctcttccaaaggcagcgtg

SEQ ID NO: 3674870 - DNA, 19 bp, Homo sapiens
cctcttgagcagtggctgg

SEQ ID NO: 3674871 - DNA, 12 bp, Homo sapiens
cctcttggcttt

SEQ ID NO: 3674872 - DNA, 22 bp, Homo sapiens
cctgaaaatgtttttctgccag

SEQ ID NO: 3674873 - DNA, 14 bp, Homo sapiens
cctgaaagccctga

SEQ ID NO: 3674874 - DNA, 16 bp, Homo sapiens
cctgaagaaccagtcc

SEQ ID NO: 3674875 - DNA, 17 bp, Homo sapiens
cctgaaggaggcggggc

SEQ ID NO: 3674876 - DNA, 13 bp, Homo sapiens
cctgaagggcctc

SEQ ID NO: 3674877 - DNA, 14 bp, Homo sapiens
cctgaaggggcgtc

SEQ ID NO: 3674878 - DNA, 22 bp, Homo sapiens
cctgaaggggcgtctgttcccc

SEQ ID NO: 3674879 - DNA, 18 bp, Homo sapiens
cctgaatgaggcggagct

SEQ ID NO: 3674880 - DNA, 22 bp, Homo sapiens
cctgaatgaggcggagctccag

SEQ ID NO: 3674881 - DNA, 18 bp, Homo sapiens
cctgacaaccactggtct

SEQ ID NO: 3674882 - DNA, 14 bp, Homo sapiens
cctgaccaggggcc

SEQ ID NO: 3674883 - DNA, 19 bp, Homo sapiens
cctgactagggagccatgt

SEQ ID NO: 3674884 - DNA, 12 bp, Homo sapiens
cctgactggtgc

SEQ ID NO: 3674885 - DNA, 23 bp, Homo sapiens
cctgaggaagcgtgaaggccgag

SEQ ID NO: 3674886 - DNA, 14 bp, Homo sapiens
cctgaggctgtggt

SEQ ID NO: 3674887 - DNA, 18 bp, Homo sapiens
cctgaggggcatctgccc

SEQ ID NO: 3674888 - DNA, 23 bp, Homo sapiens
cctgaggggcatctgcccctccc

SEQ ID NO: 3674889 - DNA, 13 bp, Homo sapiens
cctgagggtgggc

SEQ ID NO: 3674890 - DNA, 15 bp, Homo sapiens
cctgagggtgggctt

SEQ ID NO: 3674891 - DNA, 13 bp, Homo sapiens
cctgagtctgggc

SEQ ID NO: 3674892 - DNA, 17 bp, Homo sapiens
cctgagtctgggcagct

SEQ ID NO: 3674893 - DNA, 16 bp, Homo sapiens
cctgagtggtgccaaa

SEQ ID NO: 3674894 - DNA, 13 bp, Homo sapiens
cctgatcctggag

SEQ ID NO: 3674895 - DNA, 20 bp, Homo sapiens
cctgatcctggaggcccagt

SEQ ID NO: 3674896 - DNA, 16 bp, Homo sapiens
cctgatgagattttta

SEQ ID NO: 3674897 - DNA, 20 bp, Homo sapiens
cctgatgctccctcccctgc

SEQ ID NO: 3674898 - DNA, 23 bp, Homo sapiens
cctgatgctccctcccctgccct

SEQ ID NO: 3674899 - DNA, 18 bp, Homo sapiens
cctgatttaggagaagcc

SEQ ID NO: 3674900 - DNA, 19 bp, Homo sapiens
cctgatttaggagaagcca

SEQ ID NO: 3674901 - DNA, 22 bp, Homo sapiens
cctgatttaggagaagccagga

SEQ ID NO: 3674902 - DNA, 14 bp, Homo sapiens
cctgcaaaaaatac

SEQ ID NO: 3674903 - DNA, 15 bp, Homo sapiens
cctgcaaccactctg

SEQ ID NO: 3674904 - DNA, 22 bp, Homo sapiens
cctgcaaccactctgtggccag

SEQ ID NO: 3674905 - DNA, 17 bp, Homo sapiens
cctgcacttacttgctt

SEQ ID NO: 3674906 - DNA, 16 bp, Homo sapiens
cctgcagaatttgggt

SEQ ID NO: 3674907 - DNA, 14 bp, Homo sapiens
cctgcagctgaccg

SEQ ID NO: 3674908 - DNA, 17 bp, Homo sapiens
cctgcaggcggggctcc

SEQ ID NO: 3674909 - DNA, 19 bp, Homo sapiens
cctgcaggcggggctcctc

SEQ ID NO: 3674910 - DNA, 19 bp, Homo sapiens
cctgcagggccatggctca

SEQ ID NO: 3674911 - DNA, 20 bp, Homo sapiens
cctgcagggccatggctcag

SEQ ID NO: 3674912 - DNA, 15 bp, Homo sapiens
cctgcagtcacagct

SEQ ID NO: 3674913 - DNA, 12 bp, Homo sapiens
cctgccaccagg

SEQ ID NO: 3674914 - DNA, 13 bp, Homo sapiens
cctgccaccaggc

SEQ ID NO: 3674915 - DNA, 14 bp, Homo sapiens
cctgccaccaggcc

SEQ ID NO: 3674916 - DNA, 13 bp, Homo sapiens
cctgccactcact

SEQ ID NO: 3674917 - DNA, 22 bp, Homo sapiens
cctgccactcactaggccccca

SEQ ID NO: 3674918 - DNA, 20 bp, Homo sapiens
cctgccagcggtttcctggt

SEQ ID NO: 3674919 - DNA, 14 bp, Homo sapiens
cctgccagctgcac

SEQ ID NO: 3674920 - DNA, 20 bp, Homo sapiens
cctgccagggaactggcctg

SEQ ID NO: 3674921 - DNA, 17 bp, Homo sapiens
cctgccattcttctggt

SEQ ID NO: 3674922 - DNA, 18 bp, Homo sapiens
cctgccccaggcctgaaa

SEQ ID NO: 3674923 - DNA, 15 bp, Homo sapiens
cctgcccctcccaga

SEQ ID NO: 3674924 - DNA, 18 bp, Homo sapiens
cctgcctacgccaggaga

SEQ ID NO: 3674925 - DNA, 15 bp, Homo sapiens
cctgcctccaggaac

SEQ ID NO: 3674926 - DNA, 20 bp, Homo sapiens
cctgcctccaggaaccacac

SEQ ID NO: 3674927 - DNA, 15 bp, Homo sapiens
cctgcctcttctcta

SEQ ID NO: 3674928 - DNA, 19 bp, Homo sapiens
cctgcctgagggtgggctt

SEQ ID NO: 3674929 - DNA, 14 bp, Homo sapiens
cctgcctggccagg

SEQ ID NO: 3674930 - DNA, 22 bp, Homo sapiens
cctgcctggccaggcagatctg

SEQ ID NO: 3674931 - DNA, 14 bp, Homo sapiens
cctgcgaccctggg

SEQ ID NO: 3674932 - DNA, 20 bp, Homo sapiens
cctgcgggtggggcttgggg

SEQ ID NO: 3674933 - DNA, 19 bp, Homo sapiens
cagaagctgagcaccaggg

SEQ ID NO: 3674934 - DNA, 17 bp, Homo sapiens
cagaagtggagatttca

SEQ ID NO: 3674935 - DNA, 20 bp, Homo sapiens
cagaagtttgagatcagcct

SEQ ID NO: 3674936 - DNA, 22 bp, Homo sapiens
cagaagtttgagatcagcctgg

SEQ ID NO: 3674937 - DNA, 16 bp, Homo sapiens
cagaagtttgcactat

SEQ ID NO: 3674938 - DNA, 22 bp, Homo sapiens
cagaatgtaagtgggcccaccc

SEQ ID NO: 3674939 - DNA, 23 bp, Homo sapiens
cagaattggatacatacaccagc

SEQ ID NO: 3674940 - DNA, 14 bp, Homo sapiens
cagacacaggccct

SEQ ID NO: 3674941 - DNA, 13 bp, Homo sapiens
cagacacccagga

SEQ ID NO: 3674942 - DNA, 14 bp, Homo sapiens
cagacacccaggac

SEQ ID NO: 3674943 - DNA, 17 bp, Homo sapiens
cagacagatgaggcttt

SEQ ID NO: 3674944 - DNA, 22 bp, Homo sapiens
cagacagcaaggtgtggaggct

SEQ ID NO: 3674945 - DNA, 13 bp, Homo sapiens
cagacatatttaa

SEQ ID NO: 3674946 - DNA, 18 bp, Homo sapiens
cagacatgccacaaggac

SEQ ID NO: 3674947 - DNA, 14 bp, Homo sapiens
cagacattggcacc

SEQ ID NO: 3674948 - DNA, 14 bp, Homo sapiens
cagacctgatcctg

SEQ ID NO: 3674949 - DNA, 18 bp, Homo sapiens
cagactctttatgcttgc

SEQ ID NO: 3674950 - DNA, 16 bp, Homo sapiens
cagactggggcatcct

SEQ ID NO: 3674951 - DNA, 21 bp, Homo sapiens
cagactggggcatcctgtgcc

SEQ ID NO: 3674952 - DNA, 23 bp, Homo sapiens
cagactggttgagttcaggtagc

SEQ ID NO: 3674953 - DNA, 21 bp, Homo sapiens
cagactgtgtttcgtgaactg

SEQ ID NO: 3674954 - DNA, 21 bp, Homo sapiens
cagagaagctataaattcctc

SEQ ID NO: 3674955 - DNA, 19 bp, Homo sapiens
cagagacatacttgaaggg

SEQ ID NO: 3674956 - DNA, 18 bp, Homo sapiens
cagagagaaatcaggcct

SEQ ID NO: 3674957 - DNA, 21 bp, Homo sapiens
cagagatgcaccaccaagcca

SEQ ID NO: 3674958 - DNA, 20 bp, Homo sapiens
cagagccaaggggcttcagg

SEQ ID NO: 3674959 - DNA, 23 bp, Homo sapiens
cagagccaggggggtgaggagct

SEQ ID NO: 3674960 - DNA, 16 bp, Homo sapiens
cagagccttcaagtgc

SEQ ID NO: 3674961 - DNA, 20 bp, Homo sapiens
cagagccttcaagtgccaaa

SEQ ID NO: 3674962 - DNA, 13 bp, Homo sapiens
cagagctggctct

SEQ ID NO: 3674963 - DNA, 17 bp, Homo sapiens
cagagctggctctgagc

SEQ ID NO: 3674964 - DNA, 18 bp, Homo sapiens
cagagctggctctgagcg

SEQ ID NO: 3674965 - DNA, 15 bp, Homo sapiens
cagagcttctcctga

SEQ ID NO: 3674966 - DNA, 22 bp, Homo sapiens
cagagcttctcctgaccagggc

SEQ ID NO: 3674967 - DNA, 20 bp, Homo sapiens
cagagctttggtctgtgtgt

SEQ ID NO: 3674968 - DNA, 16 bp, Homo sapiens
cagaggaccagggcct

SEQ ID NO: 3674969 - DNA, 21 bp, Homo sapiens
cagaggccttgctgtggagct

SEQ ID NO: 3674970 - DNA, 16 bp, Homo sapiens
cagaggtaccctgggt

SEQ ID NO: 3674971 - DNA, 18 bp, Homo sapiens
cagaggttgtgcactgtt

SEQ ID NO: 3674972 - DNA, 23 bp, Homo sapiens
cagagtgacacccaagagggctg

SEQ ID NO: 3674973 - DNA, 13 bp, Homo sapiens
cagagtggcctgg

SEQ ID NO: 3674974 - DNA, 17 bp, Homo sapiens
cagagtggcctggccag

SEQ ID NO: 3674975 - DNA, 22 bp, Homo sapiens
cagagtggcctggccaggagct

SEQ ID NO: 3674976 - DNA, 14 bp, Homo sapiens
cagatcacagtgtc

SEQ ID NO: 3674977 - DNA, 14 bp, Homo sapiens
cagatctggaacct

SEQ ID NO: 3674978 - DNA, 22 bp, Homo sapiens
cagatctggaacctcagcctgg

SEQ ID NO: 3674979 - DNA, 17 bp, Homo sapiens
cagatctggtcccttgc

SEQ ID NO: 3674980 - DNA, 20 bp, Homo sapiens
cagatctgtgccccatgcct

SEQ ID NO: 3674981 - DNA, 16 bp, Homo sapiens
cagatgcaaagaggca

SEQ ID NO: 3674982 - DNA, 18 bp, Homo sapiens
cagatgcaaagaggcaag

SEQ ID NO: 3674983 - DNA, 23 bp, Homo sapiens
cagatgcaaagaggcaagaggct

SEQ ID NO: 3674984 - DNA, 13 bp, Homo sapiens
cagatggaaaaat

SEQ ID NO: 3674985 - DNA, 14 bp, Homo sapiens
cagatggaaccgca

SEQ ID NO: 3674986 - DNA, 21 bp, Homo sapiens
cagatggaaccgcaggaagct

SEQ ID NO: 3674987 - DNA, 22 bp, Homo sapiens
cagatggaaccgcaggaagctg

SEQ ID NO: 3674988 - DNA, 12 bp, Homo sapiens
cagattcttcag

SEQ ID NO: 3674989 - DNA, 17 bp, Homo sapiens
cagattgggcggggctt

SEQ ID NO: 3674990 - DNA, 13 bp, Homo sapiens
cagatttaataca

SEQ ID NO: 3674991 - DNA, 18 bp, Homo sapiens
cagcaaaaaagtccaatt

SEQ ID NO: 3674992 - DNA, 12 bp, Homo sapiens
cagcaaaccatt

SEQ ID NO: 3674993 - DNA, 16 bp, Homo sapiens
cagcaaaccggggcct

SEQ ID NO: 3674994 - DNA, 23 bp, Homo sapiens
cagcaaggtgtggaggctcctgt

SEQ ID NO: 3674995 - DNA, 15 bp, Homo sapiens
cagcaattctctttc

SEQ ID NO: 3674996 - DNA, 16 bp, Homo sapiens
cagcacagagaccccc

SEQ ID NO: 3674997 - DNA, 13 bp, Homo sapiens
cagcacagcttga

SEQ ID NO: 3674998 - DNA, 12 bp, Homo sapiens
cagcacctggca

SEQ ID NO: 3674999 - DNA, 14 bp, Homo sapiens
cagcactgtccctt

SEQ ID NO: 3675000 - DNA, 16 bp, Homo sapiens
cagcactgtcccttgc

SEQ ID NO: 3675001 - DNA, 18 bp, Homo sapiens
cagcactgtcccttgcct

SEQ ID NO: 3675002 - DNA, 20 bp, Homo sapiens
cagcactgtcccttgcctca

SEQ ID NO: 3675003 - DNA, 15 bp, Homo sapiens
cagcagaagacaaaa

SEQ ID NO: 3675004 - DNA, 13 bp, Homo sapiens
cagcagactgtgt

SEQ ID NO: 3675005 - DNA, 21 bp, Homo sapiens
cagcagaggacagtctggaga

SEQ ID NO: 3675006 - DNA, 22 bp, Homo sapiens
cagcagaggacagtctggagaa

SEQ ID NO: 3675007 - DNA, 13 bp, Homo sapiens
cagcagagtgtgg

SEQ ID NO: 3675008 - DNA, 15 bp, Homo sapiens
cagcagcctggaccc

SEQ ID NO: 3675009 - DNA, 17 bp, Homo sapiens
cagcagcgcctttccca

SEQ ID NO: 3675010 - DNA, 22 bp, Homo sapiens
cagcagggaaaatgcagcaggg

SEQ ID NO: 3675011 - DNA, 20 bp, Homo sapiens
cagcagggagggcttctgcc

SEQ ID NO: 3675012 - DNA, 15 bp, Homo sapiens
cagcagggatgccct

SEQ ID NO: 3675013 - DNA, 22 bp, Homo sapiens
cagcagggatgccctggaggtg

SEQ ID NO: 3675014 - DNA, 19 bp, Homo sapiens
cagcatccccttgaactct

SEQ ID NO: 3675015 - DNA, 20 bp, Homo sapiens
cagcatccccttgaactctt

SEQ ID NO: 3675016 - DNA, 22 bp, Homo sapiens
cagcatttagctggccacatgg

SEQ ID NO: 3675017 - DNA, 15 bp, Homo sapiens
cagccaaagcctcct

SEQ ID NO: 3675018 - DNA, 18 bp, Homo sapiens
cagccaaagcctcctcca

SEQ ID NO: 3675019 - DNA, 17 bp, Homo sapiens
cagccaccccgggctct

SEQ ID NO: 3675020 - DNA, 15 bp, Homo sapiens
cagccacctcatccc

SEQ ID NO: 3675021 - DNA, 16 bp, Homo sapiens
cagccactccccggca

SEQ ID NO: 3675022 - DNA, 14 bp, Homo sapiens
cagccagcacctgg

SEQ ID NO: 3675023 - DNA, 16 bp, Homo sapiens
cagccagcacctggca

SEQ ID NO: 3675024 - DNA, 15 bp, Homo sapiens
cagccaggagctggg

SEQ ID NO: 3675025 - DNA, 13 bp, Homo sapiens
cagccaggctgcc

SEQ ID NO: 3675026 - DNA, 21 bp, Homo sapiens
cagccagtgacctgaggaagc

SEQ ID NO: 3675027 - DNA, 16 bp, Homo sapiens
cagcccaaattctcct

SEQ ID NO: 3675028 - DNA, 18 bp, Homo sapiens
cagcccaaattctcctct

SEQ ID NO: 3675029 - DNA, 14 bp, Homo sapiens
cagcccaagattct

SEQ ID NO: 3675030 - DNA, 16 bp, Homo sapiens
cagcccaccctgctgc

SEQ ID NO: 3675031 - DNA, 13 bp, Homo sapiens
cagcccagagaca

SEQ ID NO: 3675032 - DNA, 21 bp, Homo sapiens
cagcccagagacatacttgaa

SEQ ID NO: 3675033 - DNA, 17 bp, Homo sapiens
cagcccagggctcctgc

SEQ ID NO: 3675034 - DNA, 21 bp, Homo sapiens
cagcccagggctcctgcactt

SEQ ID NO: 3675035 - DNA, 15 bp, Homo sapiens
cagcccatgcccacc

SEQ ID NO: 3675036 - DNA, 24 bp, Homo sapiens
cagcccatgcccacctgcccatca

SEQ ID NO: 3675037 - DNA, 14 bp, Homo sapiens
cagccccacccagg

SEQ ID NO: 3675038 - DNA, 15 bp, Homo sapiens
cagccccacccagga

SEQ ID NO: 3675039 - DNA, 16 bp, Homo sapiens
cagccccacccaggag

SEQ ID NO: 3675040 - DNA, 22 bp, Homo sapiens
cagccccacccaggagggaggg

SEQ ID NO: 3675041 - DNA, 15 bp, Homo sapiens
cagcccctcctccct

SEQ ID NO: 3675042 - DNA, 13 bp, Homo sapiens
cagcccctctggt

SEQ ID NO: 3675043 - DNA, 21 bp, Homo sapiens
cagcccctctggtcgctcctg

SEQ ID NO: 3675044 - DNA, 22 bp, Homo sapiens
cagcccctctggtcgctcctgc

SEQ ID NO: 3675045 - DNA, 15 bp, Homo sapiens
cagccccttaaggga

SEQ ID NO: 3675046 - DNA, 12 bp, Homo sapiens
cagccctgaggt

SEQ ID NO: 3675047 - DNA, 23 bp, Homo sapiens
cagccgccatgctcctggcccac

SEQ ID NO: 3675048 - DNA, 19 bp, Homo sapiens
cagccgccattgccaccag

SEQ ID NO: 3675049 - DNA, 21 bp, Homo sapiens
cagccgccattgccaccagga

SEQ ID NO: 3675050 - DNA, 15 bp, Homo sapiens
cagccggcacagggt

SEQ ID NO: 3675051 - DNA, 21 bp, Homo sapiens
cagccgtgtaaccatggaccc

SEQ ID NO: 3675052 - DNA, 14 bp, Homo sapiens
cagcctccctgaag

SEQ ID NO: 3675053 - DNA, 12 bp, Homo sapiens
cagcctgctcca

SEQ ID NO: 3675054 - DNA, 15 bp, Homo sapiens
cagcctgctccagct

SEQ ID NO: 3675055 - DNA, 15 bp, Homo sapiens
cagcctggccagaca

SEQ ID NO: 3675056 - DNA, 16 bp, Homo sapiens
cagcctgggcaatgtg

SEQ ID NO: 3675057 - DNA, 18 bp, Homo sapiens
cagcctgggcagccaggc

SEQ ID NO: 3675058 - DNA, 21 bp, Homo sapiens
cagcctgggcagccaggctgc

SEQ ID NO: 3675059 - DNA, 11 bp, Homo sapiens
cagcctggggt

SEQ ID NO: 3675060 - DNA, 15 bp, Homo sapiens
cagcctggggtctgg

SEQ ID NO: 3675061 - DNA, 18 bp, Homo sapiens
cagcctggtggcccagct

SEQ ID NO: 3675062 - DNA, 21 bp, Homo sapiens
cagcctgtggcatctttgcct

SEQ ID NO: 3675063 - DNA, 23 bp, Homo sapiens
cagcctttgatcaggtggggagt

SEQ ID NO: 3675064 - DNA, 23 bp, Homo sapiens
cagcgcccctcagcctctgccac

SEQ ID NO: 3675065 - DNA, 12 bp, Homo sapiens
cagcgcctttcc

SEQ ID NO: 3675066 - DNA, 19 bp, Homo sapiens
cagcgctgggtccacccca

SEQ ID NO: 3675067 - DNA, 21 bp, Homo sapiens
cagcggaaagccctgtgctcc

SEQ ID NO: 3675068 - DNA, 17 bp, Homo sapiens
cagcggagtctgtcctg

SEQ ID NO: 3675069 - DNA, 21 bp, Homo sapiens
cagcggagtctgtcctgtgac

SEQ ID NO: 3675070 - DNA, 15 bp, Homo sapiens
cagcggttgaggaga

SEQ ID NO: 3675071 - DNA, 16 bp, Homo sapiens
cagcggtttcctggtg

SEQ ID NO: 3675072 - DNA, 17 bp, Homo sapiens
cagcgtgccgagccagc

SEQ ID NO: 3675073 - DNA, 15 bp, Homo sapiens
cagctaacaagtagc

SEQ ID NO: 3675074 - DNA, 13 bp, Homo sapiens
cagctaagaacct

SEQ ID NO: 3675075 - DNA, 18 bp, Homo sapiens
cagctaagaacctggaac

SEQ ID NO: 3675076 - DNA, 23 bp, Homo sapiens
cagctaagaacctggaacttggg

SEQ ID NO: 3675077 - DNA, 19 bp, Homo sapiens
cagctacttgggaggctga

SEQ ID NO: 3675078 - DNA, 19 bp, Homo sapiens
cagctacttggtttgtgtt

SEQ ID NO: 3675079 - DNA, 13 bp, Homo sapiens
cagctatgggagc

SEQ ID NO: 3675080 - DNA, 21 bp, Homo sapiens
cagctatgggagccccagggt

SEQ ID NO: 3675081 - DNA, 16 bp, Homo sapiens
cagctattaccacact

SEQ ID NO: 3675082 - DNA, 13 bp, Homo sapiens
cagctatttttat

SEQ ID NO: 3675083 - DNA, 22 bp, Homo sapiens
cagctcaagagatcccaagtag

SEQ ID NO: 3675084 - DNA, 14 bp, Homo sapiens
cagctcactgtgac

SEQ ID NO: 3675085 - DNA, 18 bp, Homo sapiens
cagctcaggacagatgcc

SEQ ID NO: 3675086 - DNA, 14 bp, Homo sapiens
cagctccagctgct

SEQ ID NO: 3675087 - DNA, 18 bp, Homo sapiens
cagctctggacagcccca

SEQ ID NO: 3675088 - DNA, 16 bp, Homo sapiens
cagctctgtgggccct

SEQ ID NO: 3675089 - DNA, 22 bp, Homo sapiens
cagctcttctgccggccctggg

SEQ ID NO: 3675090 - DNA, 22 bp, Homo sapiens
cagctctttgaaatagtctgtg

SEQ ID NO: 3675091 - DNA, 21 bp, Homo sapiens
cagctgacttttctgtccgag

SEQ ID NO: 3675092 - DNA, 18 bp, Homo sapiens
cagctgcactgatgctgc

SEQ ID NO: 3675093 - DNA, 18 bp, Homo sapiens
cagctgctcctagaggga

SEQ ID NO: 3675094 - DNA, 23 bp, Homo sapiens
cagctgctcctagagggaggggc

SEQ ID NO: 3675095 - DNA, 18 bp, Homo sapiens
cagctggcagcagagtgt

SEQ ID NO: 3675096 - DNA, 17 bp, Homo sapiens
cagctgggttggaaaac

SEQ ID NO: 3675097 - DNA, 13 bp, Homo sapiens
cagctgtgtctga

SEQ ID NO: 3675098 - DNA, 15 bp, Homo sapiens
cagcttcagccagga

SEQ ID NO: 3675099 - DNA, 22 bp, Homo sapiens
cagcttcccctctctcctcctg

SEQ ID NO: 3675100 - DNA, 15 bp, Homo sapiens
cagcttgacctgagg

SEQ ID NO: 3675101 - DNA, 17 bp, Homo sapiens
cagcttgacctgaggct

SEQ ID NO: 3675102 - DNA, 19 bp, Homo sapiens
cagcttgacctgaggctgt

SEQ ID NO: 3675103 - DNA, 20 bp, Homo sapiens
cagcttgacctgaggctgtg

SEQ ID NO: 3675104 - DNA, 21 bp, Homo sapiens
cagctttcatctttgtggatg

SEQ ID NO: 3675105 - DNA, 22 bp, Homo sapiens
cagctttgtttgttgtcagctg

SEQ ID NO: 3675106 - DNA, 16 bp, Homo sapiens
caggaaattcagccca

SEQ ID NO: 3675107 - DNA, 14 bp, Homo sapiens
caggaagcacccca

SEQ ID NO: 3675108 - DNA, 17 bp, Homo sapiens
caggaagctcagactgg

SEQ ID NO: 3675109 - DNA, 12 bp, Homo sapiens
caggaaggagag

SEQ ID NO: 3675110 - DNA, 13 bp, Homo sapiens
caggaaggagagc

SEQ ID NO: 3675111 - DNA, 16 bp, Homo sapiens
caggaaggccacttgt

SEQ ID NO: 3675112 - DNA, 19 bp, Homo sapiens
caggaaggctgagaggaga

SEQ ID NO: 3675113 - DNA, 13 bp, Homo sapiens
caggaaggcttgt

SEQ ID NO: 3675114 - DNA, 21 bp, Homo sapiens
caggaatcccggctccagagc

SEQ ID NO: 3675115 - DNA, 16 bp, Homo sapiens
caggaatttcccagga

SEQ ID NO: 3675116 - DNA, 17 bp, Homo sapiens
caggaatttcccaggac

SEQ ID NO: 3675117 - DNA, 18 bp, Homo sapiens
caggaatttcccaggacc

SEQ ID NO: 3675118 - DNA, 20 bp, Homo sapiens
caggaccagctcaggacaga

SEQ ID NO: 3675119 - DNA, 20 bp, Homo sapiens
caggacccaccactggaagc

SEQ ID NO: 3675120 - DNA, 16 bp, Homo sapiens
caggaccctgaagggg

SEQ ID NO: 3675121 - DNA, 17 bp, Homo sapiens
caggaccctgaaggggc

SEQ ID NO: 3675122 - DNA, 18 bp, Homo sapiens
caggaccctgaaggggcc

SEQ ID NO: 3675123 - DNA, 23 bp, Homo sapiens
caggacctcaggtgagaagcaga

SEQ ID NO: 3675124 - DNA, 20 bp, Homo sapiens
caggactccctcctcacctc

SEQ ID NO: 3675125 - DNA, 17 bp, Homo sapiens
caggagaaccactacat

SEQ ID NO: 3675126 - DNA, 20 bp, Homo sapiens
caggagcaccctgtcttctt

SEQ ID NO: 3675127 - DNA, 19 bp, Homo sapiens
caggagctcttcaggcctc

SEQ ID NO: 3675128 - DNA, 12 bp, Homo sapiens
caggagctgggc

SEQ ID NO: 3675129 - DNA, 12 bp, Homo sapiens
caggagggaggg

SEQ ID NO: 3675130 - DNA, 12 bp, Homo sapiens
caggagggccct

SEQ ID NO: 3675131 - DNA, 16 bp, Homo sapiens
caggagttggaagtgt

SEQ ID NO: 3675132 - DNA, 22 bp, Homo sapiens
caggagtttgagaccaacctgg

SEQ ID NO: 3675133 - DNA, 23 bp, Homo sapiens
caggagtttgagaccaacctggg

SEQ ID NO: 3675134 - DNA, 15 bp, Homo sapiens
caggatggagctgac

SEQ ID NO: 3675135 - DNA, 23 bp, Homo sapiens
caggatggccgggcgcggtggct

SEQ ID NO: 3675136 - DNA, 20 bp, Homo sapiens
caggatggggaggggctctg

SEQ ID NO: 3675137 - DNA, 15 bp, Homo sapiens
caggatgtgtttgct

SEQ ID NO: 3675138 - DNA, 20 bp, Homo sapiens
caggatgtgtttgctttctg

SEQ ID NO: 3675139 - DNA, 21 bp, Homo sapiens
caggcactgcaaaccgccacc

SEQ ID NO: 3675140 - DNA, 15 bp, Homo sapiens
caggcagatccagga

SEQ ID NO: 3675141 - DNA, 15 bp, Homo sapiens
caggcagatctgtgc

SEQ ID NO: 3675142 - DNA, 17 bp, Homo sapiens
caggcagatctgtgccc

SEQ ID NO: 3675143 - DNA, 22 bp, Homo sapiens
caggcagatctgtgccccatgc

SEQ ID NO: 3675144 - DNA, 14 bp, Homo sapiens
caggcagctggcag

SEQ ID NO: 3675145 - DNA, 15 bp, Homo sapiens
caggcagctggcagg

SEQ ID NO: 3675146 - DNA, 15 bp, Homo sapiens
caggcaggtgggatg

SEQ ID NO: 3675147 - DNA, 15 bp, Homo sapiens
caggcatggccctgg

SEQ ID NO: 3675148 - DNA, 16 bp, Homo sapiens
caggcatggccctggg

SEQ ID NO: 3675149 - DNA, 17 bp, Homo sapiens
caggcatggccctgggc

SEQ ID NO: 3675150 - DNA, 11 bp, Homo sapiens
caggccacctc

SEQ ID NO: 3675151 - DNA, 15 bp, Homo sapiens
caggccacctcccca

SEQ ID NO: 3675152 - DNA, 16 bp, Homo sapiens
caggccacctccccag

SEQ ID NO: 3675153 - DNA, 13 bp, Homo sapiens
caggccagagcca

SEQ ID NO: 3675154 - DNA, 21 bp, Homo sapiens
caggcccacagcgtgggaact

SEQ ID NO: 3675155 - DNA, 22 bp, Homo sapiens
caggcccacagcgtgggaactc

SEQ ID NO: 3675156 - DNA, 13 bp, Homo sapiens
caggccccaggaa

SEQ ID NO: 3675157 - DNA, 14 bp, Homo sapiens
caggccctcctctc

SEQ ID NO: 3675158 - DNA, 15 bp, Homo sapiens
caggccctggcctcc

SEQ ID NO: 3675159 - DNA, 18 bp, Homo sapiens
caggccctggcctcccct

SEQ ID NO: 3675160 - DNA, 15 bp, Homo sapiens
caggcctccctctct

SEQ ID NO: 3675161 - DNA, 20 bp, Homo sapiens
caggcctgaaagaggctgag

SEQ ID NO: 3675162 - DNA, 16 bp, Homo sapiens
caggcgggaggaggtg

SEQ ID NO: 3675163 - DNA, 19 bp, Homo sapiens
caggcggggcgccccaaga

SEQ ID NO: 3675164 - DNA, 22 bp, Homo sapiens
caggcggggcgccccaagagcc

SEQ ID NO: 3675165 - DNA, 17 bp, Homo sapiens
caggcggggctcctcct

SEQ ID NO: 3675166 - DNA, 14 bp, Homo sapiens
caggctcccaggga

SEQ ID NO: 3675167 - DNA, 18 bp, Homo sapiens
caggctcttagcagcttc

SEQ ID NO: 3675168 - DNA, 21 bp, Homo sapiens
caggctgccaaggccagagtg

SEQ ID NO: 3675169 - DNA, 16 bp, Homo sapiens
caggctgccgtggggc

SEQ ID NO: 3675170 - DNA, 15 bp, Homo sapiens
caggctgcttgggat

SEQ ID NO: 3675171 - DNA, 19 bp, Homo sapiens
caggctggagagcactgcc

SEQ ID NO: 3675172 - DNA, 17 bp, Homo sapiens
caggctggagtgcagtg

SEQ ID NO: 3675173 - DNA, 22 bp, Homo sapiens
caggctggagtgcagtgacaca

SEQ ID NO: 3675174 - DNA, 18 bp, Homo sapiens
caggctggccagtccagg

SEQ ID NO: 3675175 - DNA, 21 bp, Homo sapiens
caggctggccagtccaggctg

SEQ ID NO: 3675176 - DNA, 21 bp, Homo sapiens
caggcttatgaatatatttaa

SEQ ID NO: 3675177 - DNA, 18 bp, Homo sapiens
cagggaacattggagctg

SEQ ID NO: 3675178 - DNA, 15 bp, Homo sapiens
cagggaactggcctg

SEQ ID NO: 3675179 - DNA, 22 bp, Homo sapiens
cagggaagccccacatgtccag

SEQ ID NO: 3675180 - DNA, 14 bp, Homo sapiens
cagggaagctggcc

SEQ ID NO: 3675181 - DNA, 14 bp, Homo sapiens
cagggaagtcccca

SEQ ID NO: 3675182 - DNA, 17 bp, Homo sapiens
cagggaagtccccaggc

SEQ ID NO: 3675183 - DNA, 16 bp, Homo sapiens
cagggaattcctgggg

SEQ ID NO: 3675184 - DNA, 17 bp, Homo sapiens
cagggacacctgggaga

SEQ ID NO: 3675185 - DNA, 22 bp, Homo sapiens
cagggacacctgggagaaatct

SEQ ID NO: 3675186 - DNA, 16 bp, Homo sapiens
cagggacagaggcccc

SEQ ID NO: 3675187 - DNA, 19 bp, Homo sapiens
cagggacagaggccccagc

SEQ ID NO: 3675188 - DNA, 21 bp, Homo sapiens
cagggacagaggccccagcct

SEQ ID NO: 3675189 - DNA, 16 bp, Homo sapiens
cagggacttcgcagag

SEQ ID NO: 3675190 - DNA, 16 bp, Homo sapiens
cagggagcggaaagca

SEQ ID NO: 3675191 - DNA, 18 bp, Homo sapiens
cagggagcggaaagcagc

SEQ ID NO: 3675192 - DNA, 22 bp, Homo sapiens
cagggagcggaaagcagctcaa

SEQ ID NO: 3675193 - DNA, 22 bp, Homo sapiens
cagggagctgggcccgacatgg

SEQ ID NO: 3675194 - DNA, 12 bp, Homo sapiens
cagggaggggcc

SEQ ID NO: 3675195 - DNA, 14 bp, Homo sapiens
cagggaggtggctg

SEQ ID NO: 3675196 - DNA, 16 bp, Homo sapiens
cagggatgccctggag

SEQ ID NO: 3675197 - DNA, 17 bp, Homo sapiens
cagggattaacctctgc

SEQ ID NO: 3675198 - DNA, 20 bp, Homo sapiens
cagggattaacctctgcact

SEQ ID NO: 3675199 - DNA, 17 bp, Homo sapiens
cagggccatgctgaggc

SEQ ID NO: 3675200 - DNA, 18 bp, Homo sapiens
cagggccatgctgaggcc

SEQ ID NO: 3675201 - DNA, 18 bp, Homo sapiens
cagggcccagagcccagc

SEQ ID NO: 3675202 - DNA, 22 bp, Homo sapiens
cagggcccagagcccagctcca

SEQ ID NO: 3675203 - DNA, 15 bp, Homo sapiens
cagggctcctccctg

SEQ ID NO: 3675204 - DNA, 18 bp, Homo sapiens
cagggctcctccctggag

SEQ ID NO: 3675205 - DNA, 14 bp, Homo sapiens
cagggctcctgcac

SEQ ID NO: 3675206 - DNA, 19 bp, Homo sapiens
caggggaaaatcagcctgc

SEQ ID NO: 3675207 - DNA, 21 bp, Homo sapiens
caggggactcagccctgaggt

SEQ ID NO: 3675208 - DNA, 16 bp, Homo sapiens
caggggccctacctgg

SEQ ID NO: 3675209 - DNA, 19 bp, Homo sapiens
caggggccctacctgggga

SEQ ID NO: 3675210 - DNA, 13 bp, Homo sapiens
caggggcctggag

SEQ ID NO: 3675211 - DNA, 22 bp, Homo sapiens
caggggctgcttcctcctggaa

SEQ ID NO: 3675212 - DNA, 18 bp, Homo sapiens
caggggggtgaggagctg

SEQ ID NO: 3675213 - DNA, 19 bp, Homo sapiens
caggggggtgaggagctgg

SEQ ID NO: 3675214 - DNA, 23 bp, Homo sapiens
cagggtatggactatctgtctgg

SEQ ID NO: 3675215 - DNA, 20 bp, Homo sapiens
cagggtattccagagtgggg

SEQ ID NO: 3675216 - DNA, 21 bp, Homo sapiens
cagggtattccagagtgggga

SEQ ID NO: 3675217 - DNA, 13 bp, Homo sapiens
cagggtcttccct

SEQ ID NO: 3675218 - DNA, 22 bp, Homo sapiens
cagggtcttccctacctcaggc

SEQ ID NO: 3675219 - DNA, 15 bp, Homo sapiens
cagggtgttggaaga

SEQ ID NO: 3675220 - DNA, 20 bp, Homo sapiens
cagggttgggcccagatctg

SEQ ID NO: 3675221 - DNA, 17 bp, Homo sapiens
caggtactcctgccagg

SEQ ID NO: 3675222 - DNA, 19 bp, Homo sapiens
caggtactcctgccaggga

SEQ ID NO: 3675223 - DNA, 20 bp, Homo sapiens
caggtactcctgccagggaa

SEQ ID NO: 3675224 - DNA, 19 bp, Homo sapiens
caggtagaacacaaggtca

SEQ ID NO: 3675225 - DNA, 20 bp, Homo sapiens
caggtagctgcccctggctc

SEQ ID NO: 3675226 - DNA, 21 bp, Homo sapiens
caggtagctgcccctggctct

SEQ ID NO: 3675227 - DNA, 23 bp, Homo sapiens
caggtatggaagggtttgtggct

SEQ ID NO: 3675228 - DNA, 17 bp, Homo sapiens
caggtccagctctggag

SEQ ID NO: 3675229 - DNA, 19 bp, Homo sapiens
caggtccagctctggaggg

SEQ ID NO: 3675230 - DNA, 15 bp, Homo sapiens
caggtccagctctgt

SEQ ID NO: 3675231 - DNA, 17 bp, Homo sapiens
caggtccagctctgtgg

SEQ ID NO: 3675232 - DNA, 16 bp, Homo sapiens
caggtgcagaggtacc

SEQ ID NO: 3675233 - DNA, 12 bp, Homo sapiens
caggtgcccctc

SEQ ID NO: 3675234 - DNA, 14 bp, Homo sapiens
caggtgcccctctt

SEQ ID NO: 3675235 - DNA, 19 bp, Homo sapiens
caggtgcccctcttccaaa

SEQ ID NO: 3675236 - DNA, 14 bp, Homo sapiens
caggtgcctttcaa

SEQ ID NO: 3675237 - DNA, 17 bp, Homo sapiens
caggtgcctttcaaatt

SEQ ID NO: 3675238 - DNA, 15 bp, Homo sapiens
caggtggatctcctt

SEQ ID NO: 3675239 - DNA, 16 bp, Homo sapiens
caggtggcaaagtact

SEQ ID NO: 3675240 - DNA, 16 bp, Homo sapiens
caggtgtgagccactg

SEQ ID NO: 3675241 - DNA, 18 bp, Homo sapiens
caggtgtgagccactgca

SEQ ID NO: 3675242 - DNA, 20 bp, Homo sapiens
caggtgtgcccctccaagtc

SEQ ID NO: 3675243 - DNA, 13 bp, Homo sapiens
caggtgttgccaa

SEQ ID NO: 3675244 - DNA, 14 bp, Homo sapiens
caggtgttgccaaa

SEQ ID NO: 3675245 - DNA, 16 bp, Homo sapiens
caggttcaacccacag

SEQ ID NO: 3675246 - DNA, 22 bp, Homo sapiens
caggttctccgttagctcctgt

SEQ ID NO: 3675247 - DNA, 15 bp, Homo sapiens
caggttctgcctgct

SEQ ID NO: 3675248 - DNA, 16 bp, Homo sapiens
caggtttaagctgtta

SEQ ID NO: 3675249 - DNA, 18 bp, Homo sapiens
caggtttaagctgttact

SEQ ID NO: 3675250 - DNA, 19 bp, Homo sapiens
cagtaacgcgtcttcctga

SEQ ID NO: 3675251 - DNA, 21 bp, Homo sapiens
cagtaagggcgtggctctggg

SEQ ID NO: 3675252 - DNA, 21 bp, Homo sapiens
cagtaattaatatctcctgga

SEQ ID NO: 3675253 - DNA, 13 bp, Homo sapiens
cagtacaggcagc

SEQ ID NO: 3675254 - DNA, 16 bp, Homo sapiens
cagtactcctccctgg

SEQ ID NO: 3675255 - DNA, 19 bp, Homo sapiens
cagtactcctccctggggg

SEQ ID NO: 3675256 - DNA, 14 bp, Homo sapiens
cagtagaactccag

SEQ ID NO: 3675257 - DNA, 20 bp, Homo sapiens
cagtagggtttgacatttca

SEQ ID NO: 3675258 - DNA, 20 bp, Homo sapiens
cagtaggttatttagcttgg

SEQ ID NO: 3675259 - DNA, 22 bp, Homo sapiens
cagtagtagcctccaggtttcc

SEQ ID NO: 3675260 - DNA, 15 bp, Homo sapiens
cagtatcatattatt

SEQ ID NO: 3675261 - DNA, 15 bp, Homo sapiens
cagtatctcagggcc

SEQ ID NO: 3675262 - DNA, 12 bp, Homo sapiens
cagtattgacac

SEQ ID NO: 3675263 - DNA, 14 bp, Homo sapiens
cagtattgacactg

SEQ ID NO: 3675264 - DNA, 13 bp, Homo sapiens
cagtcaagaagaa

SEQ ID NO: 3675265 - DNA, 22 bp, Homo sapiens
cagtcacaacagagtgaaaaat

SEQ ID NO: 3675266 - DNA, 18 bp, Homo sapiens
cagtcatcttgaccaagc

SEQ ID NO: 3675267 - DNA, 18 bp, Homo sapiens
cagtccaccctgcctgcc

SEQ ID NO: 3675268 - DNA, 14 bp, Homo sapiens
cagtccccccaccc

SEQ ID NO: 3675269 - DNA, 15 bp, Homo sapiens
cagtcctgcctggcc

SEQ ID NO: 3675270 - DNA, 21 bp, Homo sapiens
cagtcctgcctggccaggcag

SEQ ID NO: 3675271 - DNA, 10 bp, Homo sapiens
cagtcctggt

SEQ ID NO: 3675272 - DNA, 20 bp, Homo sapiens
cagtcctggttgtctgaacc

SEQ ID NO: 3675273 - DNA, 13 bp, Homo sapiens
cagtcgtgcctgt

SEQ ID NO: 3675274 - DNA, 18 bp, Homo sapiens
cagtctcagttctcttgc

SEQ ID NO: 3675275 - DNA, 15 bp, Homo sapiens
cagtctgtggatcag

SEQ ID NO: 3675276 - DNA, 13 bp, Homo sapiens
cagtgaaagcatc

SEQ ID NO: 3675277 - DNA, 14 bp, Homo sapiens
cagtgaaagcatca

SEQ ID NO: 3675278 - DNA, 16 bp, Homo sapiens
cagtgaagacagaagt

SEQ ID NO: 3675279 - DNA, 20 bp, Homo sapiens
cagtgaagatattttatttc

SEQ ID NO: 3675280 - DNA, 16 bp, Homo sapiens
cagtgacacaatctca

SEQ ID NO: 3675281 - DNA, 14 bp, Homo sapiens
cagtgacacccaga

SEQ ID NO: 3675282 - DNA, 17 bp, Homo sapiens
cagtgacagacaggctc

SEQ ID NO: 3675283 - DNA, 17 bp, Homo sapiens
cagtgacctgaggaagc

SEQ ID NO: 3675284 - DNA, 16 bp, Homo sapiens
cagtgagcactgaaac

SEQ ID NO: 3675285 - DNA, 24 bp, Homo sapiens
cagtgagccgagattgcaccactg

SEQ ID NO: 3675286 - DNA, 14 bp, Homo sapiens
cagtgaggatgaca

SEQ ID NO: 3675287 - DNA, 14 bp, Homo sapiens
cagtgcagcagagg

SEQ ID NO: 3675288 - DNA, 12 bp, Homo sapiens
cagtgcccccac

SEQ ID NO: 3675289 - DNA, 17 bp, Homo sapiens
cagtgcccccactgacc

SEQ ID NO: 3675290 - DNA, 20 bp, Homo sapiens
cagtgcccccactgaccaga

SEQ ID NO: 3675291 - DNA, 15 bp, Homo sapiens
cagtgccgagaagga

SEQ ID NO: 3675292 - DNA, 19 bp, Homo sapiens
cagtgctgtgctgtgctat

SEQ ID NO: 3675293 - DNA, 19 bp, Homo sapiens
cagtgcttgattgcgtgga

SEQ ID NO: 3675294 - DNA, 21 bp, Homo sapiens
cagtggagctgaattttctgg

SEQ ID NO: 3675295 - DNA, 15 bp, Homo sapiens
cagtggaggaagagg

SEQ ID NO: 3675296 - DNA, 15 bp, Homo sapiens
cagtggaggtttgtc

SEQ ID NO: 3675297 - DNA, 19 bp, Homo sapiens
cagtggctggtccagggct

SEQ ID NO: 3675298 - DNA, 17 bp, Homo sapiens
cagtgggctgtttctgc

SEQ ID NO: 3675299 - DNA, 15 bp, Homo sapiens
cagtgtggggagggc

SEQ ID NO: 3675300 - DNA, 18 bp, Homo sapiens
cagtgtggggagggcagg

SEQ ID NO: 3675301 - DNA, 20 bp, Homo sapiens
cagttacttttttagtaaca

SEQ ID NO: 3675302 - DNA, 16 bp, Homo sapiens
cagttcagcaccaccc

SEQ ID NO: 3675303 - DNA, 23 bp, Homo sapiens
cagttcagtaataaactgtgttt

SEQ ID NO: 3675304 - DNA, 14 bp, Homo sapiens
cagttcccttggcc

SEQ ID NO: 3675305 - DNA, 16 bp, Homo sapiens
cagttcccttggcctc

SEQ ID NO: 3675306 - DNA, 15 bp, Homo sapiens
cagttcttcctgcaa

SEQ ID NO: 3675307 - DNA, 16 bp, Homo sapiens
cagttcttgtggaaga

SEQ ID NO: 3675308 - DNA, 18 bp, Homo sapiens
cagttctttgggccagac

SEQ ID NO: 3675309 - DNA, 22 bp, Homo sapiens
cagttctttgggccagacatgc

SEQ ID NO: 3675310 - DNA, 18 bp, Homo sapiens
cagttgaaaaacagctga

SEQ ID NO: 3675311 - DNA, 20 bp, Homo sapiens
cagttgcagcccttgtgatg

SEQ ID NO: 3675312 - DNA, 20 bp, Homo sapiens
cagtttaggccttggcttga

SEQ ID NO: 3675313 - DNA, 18 bp, Homo sapiens
cagtttatttttaaagat

SEQ ID NO: 3675314 - DNA, 14 bp, Homo sapiens
cataaagtcttgcc

SEQ ID NO: 3675315 - DNA, 13 bp, Homo sapiens
cataaatcttaat

SEQ ID NO: 3675316 - DNA, 19 bp, Homo sapiens
cataagaaatgtagctgaa

SEQ ID NO: 3675317 - DNA, 21 bp, Homo sapiens
cataagaaatgtagctgaagt

SEQ ID NO: 3675318 - DNA, 22 bp, Homo sapiens
cataagctatagacccgaggaa

SEQ ID NO: 3675319 - DNA, 18 bp, Homo sapiens
cataatgctaatttaaag

SEQ ID NO: 3675320 - DNA, 20 bp, Homo sapiens
cataatgctaatttaaagag

SEQ ID NO: 3675321 - DNA, 23 bp, Homo sapiens
cataattcactctgagtgtttta

SEQ ID NO: 3675322 - DNA, 14 bp, Homo sapiens
cataattgctttgc

SEQ ID NO: 3675323 - DNA, 18 bp, Homo sapiens
catacaccagcattcctt

SEQ ID NO: 3675324 - DNA, 20 bp, Homo sapiens
catactgagggaccaactgg

SEQ ID NO: 3675325 - DNA, 13 bp, Homo sapiens
catacttgaaggg

SEQ ID NO: 3675326 - DNA, 14 bp, Homo sapiens
catacttgaagggc

SEQ ID NO: 3675327 - DNA, 14 bp, Homo sapiens
catactttgtaaat

SEQ ID NO: 3675328 - DNA, 15 bp, Homo sapiens
catactttgtaaata

SEQ ID NO: 3675329 - DNA, 22 bp, Homo sapiens
catactttgtaaataggatttt

SEQ ID NO: 3675330 - DNA, 23 bp, Homo sapiens
catagaaatggaaattttgctat

SEQ ID NO: 3675331 - DNA, 11 bp, Homo sapiens
catagcccagt

SEQ ID NO: 3675332 - DNA, 15 bp, Homo sapiens
catagcccagtagac

SEQ ID NO: 3675333 - DNA, 21 bp, Homo sapiens
catagcttgataaagggccaa

SEQ ID NO: 3675334 - DNA, 13 bp, Homo sapiens
cataggctccttc

SEQ ID NO: 3675335 - DNA, 18 bp, Homo sapiens
cataggctccttcctgtg

SEQ ID NO: 3675336 - DNA, 19 bp, Homo sapiens
cataggtctctttgctttc

SEQ ID NO: 3675337 - DNA, 21 bp, Homo sapiens
cataggtctctttgctttctg

SEQ ID NO: 3675338 - DNA, 13 bp, Homo sapiens
catagtagttttt

SEQ ID NO: 3675339 - DNA, 21 bp, Homo sapiens
catataggaaaacaataattt

SEQ ID NO: 3675340 - DNA, 14 bp, Homo sapiens
catatatatactat

SEQ ID NO: 3675341 - DNA, 16 bp, Homo sapiens
catatatattacaagg

SEQ ID NO: 3675342 - DNA, 16 bp, Homo sapiens
catatattttttagaa

SEQ ID NO: 3675343 - DNA, 18 bp, Homo sapiens
catatccctggttgcctc

SEQ ID NO: 3675344 - DNA, 21 bp, Homo sapiens
catatgctccaggatctttga

SEQ ID NO: 3675345 - DNA, 18 bp, Homo sapiens
catatggaaaaaatgtat

SEQ ID NO: 3675346 - DNA, 10 bp, Homo sapiens
catatttaat

SEQ ID NO: 3675347 - DNA, 15 bp, Homo sapiens
catatttaatgtttt

SEQ ID NO: 3675348 - DNA, 16 bp, Homo sapiens
catatttaatgtttta

SEQ ID NO: 3675349 - DNA, 15 bp, Homo sapiens
catcaacttaaaagt

SEQ ID NO: 3675350 - DNA, 18 bp, Homo sapiens
catcacagggtgggcctc

SEQ ID NO: 3675351 - DNA, 19 bp, Homo sapiens
catcacagggttgggccca

SEQ ID NO: 3675352 - DNA, 22 bp, Homo sapiens
catcaccttaggcagggaagtg

SEQ ID NO: 3675353 - DNA, 16 bp, Homo sapiens
catcagtttaggcctt

SEQ ID NO: 3675354 - DNA, 22 bp, Homo sapiens
catcatgctggaacctgcaaaa

SEQ ID NO: 3675355 - DNA, 21 bp, Homo sapiens
catccaaggccaggttctccg

SEQ ID NO: 3675356 - DNA, 23 bp, Homo sapiens
catccaatgctcaagaaacaact

SEQ ID NO: 3675357 - DNA, 22 bp, Homo sapiens
catccacccctgcgtcgagctg

SEQ ID NO: 3675358 - DNA, 15 bp, Homo sapiens
catccactctaccct

SEQ ID NO: 3675359 - DNA, 15 bp, Homo sapiens
catcccacaagtggt

SEQ ID NO: 3675360 - DNA, 18 bp, Homo sapiens
catccccaggggtcccag

SEQ ID NO: 3675361 - DNA, 21 bp, Homo sapiens
catccccaggggtcccagcca

SEQ ID NO: 3675362 - DNA, 19 bp, Homo sapiens
catccccgcagtgtgcact

SEQ ID NO: 3675363 - DNA, 19 bp, Homo sapiens
catccccttgaactcttca

SEQ ID NO: 3675364 - DNA, 21 bp, Homo sapiens
catccctgccagctcttctgc

SEQ ID NO: 3675365 - DNA, 16 bp, Homo sapiens
catccgcgtgtgcctg

SEQ ID NO: 3675366 - DNA, 20 bp, Homo sapiens
catccgcgtgtgcctgtgtg

SEQ ID NO: 3675367 - DNA, 22 bp, Homo sapiens
catcctatgcttaataaaagaa

SEQ ID NO: 3675368 - DNA, 13 bp, Homo sapiens
catcctccagcag

SEQ ID NO: 3675369 - DNA, 16 bp, Homo sapiens
catcctccagcaggga

SEQ ID NO: 3675370 - DNA, 12 bp, Homo sapiens
catcctgaccaa

SEQ ID NO: 3675371 - DNA, 23 bp, Homo sapiens
catcctgtgccactaaactacat

SEQ ID NO: 3675372 - DNA, 17 bp, Homo sapiens
catcctgtttgtatgaa

SEQ ID NO: 3675373 - DNA, 20 bp, Homo sapiens
catcctgtttgtatgaaatt

SEQ ID NO: 3675374 - DNA, 23 bp, Homo sapiens
catcctgtttgtatgaaattata

SEQ ID NO: 3675375 - DNA, 16 bp, Homo sapiens
catcgcaccattctga

SEQ ID NO: 3675376 - DNA, 15 bp, Homo sapiens
catcggcgtggccca

SEQ ID NO: 3675377 - DNA, 12 bp, Homo sapiens
catctaagcctg

SEQ ID NO: 3675378 - DNA, 16 bp, Homo sapiens
catctaagcctgaagg

SEQ ID NO: 3675379 - DNA, 21 bp, Homo sapiens
catctagccagcccctcttcc

SEQ ID NO: 3675380 - DNA, 16 bp, Homo sapiens
catctcacctcctgct

SEQ ID NO: 3675381 - DNA, 15 bp, Homo sapiens
catctctctgcccaa

SEQ ID NO: 3675382 - DNA, 18 bp, Homo sapiens
catctctctgcccaaccc

SEQ ID NO: 3675383 - DNA, 17 bp, Homo sapiens
catctgaccagcagcgc

SEQ ID NO: 3675384 - DNA, 19 bp, Homo sapiens
catctgcacccccctgggc

SEQ ID NO: 3675385 - DNA, 17 bp, Homo sapiens
catctgcatgtctactc

SEQ ID NO: 3675386 - DNA, 13 bp, Homo sapiens
catctgcccctcc

SEQ ID NO: 3675387 - DNA, 15 bp, Homo sapiens
catctgcccctcccc

SEQ ID NO: 3675388 - DNA, 16 bp, Homo sapiens
catctgcccctccccc

SEQ ID NO: 3675389 - DNA, 17 bp, Homo sapiens
catctgcccctccccca

SEQ ID NO: 3675390 - DNA, 19 bp, Homo sapiens
catctgcccctcccccaac

SEQ ID NO: 3675391 - DNA, 16 bp, Homo sapiens
catctgttctatgctt

SEQ ID NO: 3675392 - DNA, 23 bp, Homo sapiens
catcttatagatgcaaagtattt

SEQ ID NO: 3675393 - DNA, 16 bp, Homo sapiens
catcttgaccaagcag

SEQ ID NO: 3675394 - DNA, 17 bp, Homo sapiens
catcttgaccaagcagg

SEQ ID NO: 3675395 - DNA, 18 bp, Homo sapiens
catcttgaccaagcagga

SEQ ID NO: 3675396 - DNA, 21 bp, Homo sapiens
catcttgaccaagcaggaagc

SEQ ID NO: 3675397 - DNA, 22 bp, Homo sapiens
catcttgaccaagcaggaagct

SEQ ID NO: 3675398 - DNA, 23 bp, Homo sapiens
catcttgaccaagcaggaagctc

SEQ ID NO: 3675399 - DNA, 24 bp, Homo sapiens
catcttgaccaagcaggaagctca

SEQ ID NO: 3675400 - DNA, 17 bp, Homo sapiens
catcttgcacacacttt

SEQ ID NO: 3675401 - DNA, 14 bp, Homo sapiens
catcttgcttccct

SEQ ID NO: 3675402 - DNA, 23 bp, Homo sapiens
catctttctgattccgcaccctg

SEQ ID NO: 3675403 - DNA, 23 bp, Homo sapiens
catctttgccttgggctgctcct

SEQ ID NO: 3675404 - DNA, 22 bp, Homo sapiens
catctttttgaccctcattctt

SEQ ID NO: 3675405 - DNA, 13 bp, Homo sapiens
catgaaaatgcaa

SEQ ID NO: 3675406 - DNA, 22 bp, Homo sapiens
catgaaaatgcaacaacatgta

SEQ ID NO: 3675407 - DNA, 17 bp, Homo sapiens
catgactcgggggtggg

SEQ ID NO: 3675408 - DNA, 18 bp, Homo sapiens
catgagaaatacaaaaat

SEQ ID NO: 3675409 - DNA, 22 bp, Homo sapiens
catgagaaatacaaaaatactc

SEQ ID NO: 3675410 - DNA, 19 bp, Homo sapiens
catgagactcagtgcagat

SEQ ID NO: 3675411 - DNA, 22 bp, Homo sapiens
catgatccctgtgttgtctcta

SEQ ID NO: 3675412 - DNA, 24 bp, Homo sapiens
catgattaaccacttcagctgact

SEQ ID NO: 3675413 - DNA, 14 bp, Homo sapiens
catgcaacatggat

SEQ ID NO: 3675414 - DNA, 22 bp, Homo sapiens
catgcaacatggatatgtattg

SEQ ID NO: 3675415 - DNA, 10 bp, Homo sapiens
catgcactgt

SEQ ID NO: 3675416 - DNA, 16 bp, Homo sapiens
catgcactgtgaagga

SEQ ID NO: 3675417 - DNA, 17 bp, Homo sapiens
catgcactgtgaaggac

SEQ ID NO: 3675418 - DNA, 16 bp, Homo sapiens
catgcagcccatgccc

SEQ ID NO: 3675419 - DNA, 22 bp, Homo sapiens
catgcagcccatgcccacctgc

SEQ ID NO: 3675420 - DNA, 19 bp, Homo sapiens
catgcaggggtcagtgcag

SEQ ID NO: 3675421 - DNA, 17 bp, Homo sapiens
catgcattgagctgcct

SEQ ID NO: 3675422 - DNA, 20 bp, Homo sapiens
catgccagcttatctcaggg

SEQ ID NO: 3675423 - DNA, 13 bp, Homo sapiens
catgcccacctgc

SEQ ID NO: 3675424 - DNA, 16 bp, Homo sapiens
catgcccacctgccca

SEQ ID NO: 3675425 - DNA, 16 bp, Homo sapiens
catgccccgtttttga

SEQ ID NO: 3675426 - DNA, 23 bp, Homo sapiens
catgccccgtttttgagactgat

SEQ ID NO: 3675427 - DNA, 14 bp, Homo sapiens
catgccctcctctc

SEQ ID NO: 3675428 - DNA, 17 bp, Homo sapiens
catgccctcctctccca

SEQ ID NO: 3675429 - DNA, 16 bp, Homo sapiens
catgccgtctgccgga

SEQ ID NO: 3675430 - DNA, 18 bp, Homo sapiens
catgcctcactaattttt

SEQ ID NO: 3675431 - DNA, 21 bp, Homo sapiens
catgcctgtagctttcctggt

SEQ ID NO: 3675432 - DNA, 17 bp, Homo sapiens
catgcctgtccagcctg

SEQ ID NO: 3675433 - DNA, 15 bp, Homo sapiens
catgcgctcagggcc

SEQ ID NO: 3675434 - DNA, 22 bp, Homo sapiens
catgcgctcagggccatgctga

SEQ ID NO: 3675435 - DNA, 19 bp, Homo sapiens
catgctcatctgctggtcc

SEQ ID NO: 3675436 - DNA, 20 bp, Homo sapiens
catgctcctggcccactgca

SEQ ID NO: 3675437 - DNA, 15 bp, Homo sapiens
catgctgaggcctgg

SEQ ID NO: 3675438 - DNA, 16 bp, Homo sapiens
catgctgaggcctggg

SEQ ID NO: 3675439 - DNA, 19 bp, Homo sapiens
catgctgaggcctgggccg

SEQ ID NO: 3675440 - DNA, 23 bp, Homo sapiens
catgctggaaaataatactgctg

SEQ ID NO: 3675441 - DNA, 22 bp, Homo sapiens
catgctggaacctgcaaaaaat

SEQ ID NO: 3675442 - DNA, 17 bp, Homo sapiens
catgcttccctgcagct

SEQ ID NO: 3675443 - DNA, 19 bp, Homo sapiens
catgcttccctgcagctga

SEQ ID NO: 3675444 - DNA, 20 bp, Homo sapiens
catggagaaccacctacccc

SEQ ID NO: 3675445 - DNA, 19 bp, Homo sapiens
catggatgggggaactcag

SEQ ID NO: 3675446 - DNA, 13 bp, Homo sapiens
catggccctgggc

SEQ ID NO: 3675447 - DNA, 16 bp, Homo sapiens
catggctcagggtggt

SEQ ID NO: 3675448 - DNA, 16 bp, Homo sapiens
catgggaaggggagga

SEQ ID NO: 3675449 - DNA, 18 bp, Homo sapiens
catggtcctttctggaag

SEQ ID NO: 3675450 - DNA, 18 bp, Homo sapiens
catggtgccccaggacca

SEQ ID NO: 3675451 - DNA, 13 bp, Homo sapiens
catggtggccaga

SEQ ID NO: 3675452 - DNA, 19 bp, Homo sapiens
catggtgggttcaggggac

SEQ ID NO: 3675453 - DNA, 16 bp, Homo sapiens
catggtgtttttataa

SEQ ID NO: 3675454 - DNA, 17 bp, Homo sapiens
catgtaaccggcatgtt

SEQ ID NO: 3675455 - DNA, 21 bp, Homo sapiens
catgtaactatttcttcagag

SEQ ID NO: 3675456 - DNA, 22 bp, Homo sapiens
catgtactagttttagttttct

SEQ ID NO: 3675457 - DNA, 18 bp, Homo sapiens
catgtataatatttttaa

SEQ ID NO: 3675458 - DNA, 19 bp, Homo sapiens
catgtcaaacgtgaaaatg

SEQ ID NO: 3675459 - DNA, 21 bp, Homo sapiens
catgtccagcaccttgtgcct

SEQ ID NO: 3675460 - DNA, 22 bp, Homo sapiens
catgtccagcaccttgtgcctg

SEQ ID NO: 3675461 - DNA, 21 bp, Homo sapiens
catgtcctttgcgcctgtgac

SEQ ID NO: 3675462 - DNA, 23 bp, Homo sapiens
catgtctgcatttcggtggctag

SEQ ID NO: 3675463 - DNA, 12 bp, Homo sapiens
catgtggctgga

SEQ ID NO: 3675464 - DNA, 22 bp, Homo sapiens
catgtggttaatgccatggaca

SEQ ID NO: 3675465 - DNA, 18 bp, Homo sapiens
catgtgtgcaacagggta

SEQ ID NO: 3675466 - DNA, 20 bp, Homo sapiens
catgttgatcatgtactttt

SEQ ID NO: 3675467 - DNA, 21 bp, Homo sapiens
catgttggccaggctggtctt

SEQ ID NO: 3675468 - DNA, 22 bp, Homo sapiens
catgtttggaaggggtctgtag

SEQ ID NO: 3675469 - DNA, 15 bp, Homo sapiens
catgttttgtttacg

SEQ ID NO: 3675470 - DNA, 20 bp, Homo sapiens
cattaaaggcataaatgact

SEQ ID NO: 3675471 - DNA, 15 bp, Homo sapiens
cattactataagaac

SEQ ID NO: 3675472 - DNA, 23 bp, Homo sapiens
cattactataagaactttgagct

SEQ ID NO: 3675473 - DNA, 19 bp, Homo sapiens
cattagaaaaatagcaact

SEQ ID NO: 3675474 - DNA, 21 bp, Homo sapiens
cattatgatgtgggtcaagga

SEQ ID NO: 3675475 - DNA, 22 bp, Homo sapiens
cattatgatgtgggtcaaggaa

SEQ ID NO: 3675476 - DNA, 22 bp, Homo sapiens
cattcacagttctttgggccag

SEQ ID NO: 3675477 - DNA, 13 bp, Homo sapiens
cattcctgaagaa

SEQ ID NO: 3675478 - DNA, 20 bp, Homo sapiens
cattcctgaagaaccagtcc

SEQ ID NO: 3675479 - DNA, 15 bp, Homo sapiens
cattctactgaaaag

SEQ ID NO: 3675480 - DNA, 17 bp, Homo sapiens
cattctaggctcactgc

SEQ ID NO: 3675481 - DNA, 14 bp, Homo sapiens
cattctcaagccct

SEQ ID NO: 3675482 - DNA, 13 bp, Homo sapiens
cattctcttttaa

SEQ ID NO: 3675483 - DNA, 14 bp, Homo sapiens
cattctcttttaat

SEQ ID NO: 3675484 - DNA, 16 bp, Homo sapiens
cattctgactcggttt

SEQ ID NO: 3675485 - DNA, 18 bp, Homo sapiens
cattcttctggtgctact

SEQ ID NO: 3675486 - DNA, 12 bp, Homo sapiens
cattcttggctt

SEQ ID NO: 3675487 - DNA, 20 bp, Homo sapiens
cattgagctgcctccagcct

SEQ ID NO: 3675488 - DNA, 21 bp, Homo sapiens
cattgagctgcctccagcctg

SEQ ID NO: 3675489 - DNA, 19 bp, Homo sapiens
cattgatccaggagataat

SEQ ID NO: 3675490 - DNA, 15 bp, Homo sapiens
cattgattcagcctg

SEQ ID NO: 3675491 - DNA, 15 bp, Homo sapiens
cattgccaaaaagga

SEQ ID NO: 3675492 - DNA, 17 bp, Homo sapiens
cattgccttaactggag

SEQ ID NO: 3675493 - DNA, 12 bp, Homo sapiens
cattggagctga

SEQ ID NO: 3675494 - DNA, 21 bp, Homo sapiens
cattggcacctaatccaggca

SEQ ID NO: 3675495 - DNA, 11 bp, Homo sapiens
cattggctttc

SEQ ID NO: 3675496 - DNA, 16 bp, Homo sapiens
cattgtaaatatttga

SEQ ID NO: 3675497 - DNA, 19 bp, Homo sapiens
cattgtacttaaacctcct

SEQ ID NO: 3675498 - DNA, 19 bp, Homo sapiens
cattgtccctctgccccat

SEQ ID NO: 3675499 - DNA, 22 bp, Homo sapiens
cattgtgggatgttcagcactg

SEQ ID NO: 3675500 - DNA, 14 bp, Homo sapiens
cattgtttgctgct

SEQ ID NO: 3675501 - DNA, 13 bp, Homo sapiens
catttaaattcca

SEQ ID NO: 3675502 - DNA, 21 bp, Homo sapiens
catttagctggccacatggcg

SEQ ID NO: 3675503 - DNA, 15 bp, Homo sapiens
catttcacttttctg

SEQ ID NO: 3675504 - DNA, 17 bp, Homo sapiens
catttcattagccatgc

SEQ ID NO: 3675505 - DNA, 16 bp, Homo sapiens
catttccaagctgtta

SEQ ID NO: 3675506 - DNA, 13 bp, Homo sapiens
catttctaattaa

SEQ ID NO: 3675507 - DNA, 14 bp, Homo sapiens
catttctataaata

SEQ ID NO: 3675508 - DNA, 15 bp, Homo sapiens
catttctcagggaag

SEQ ID NO: 3675509 - DNA, 16 bp, Homo sapiens
catttcttgtgttctg

SEQ ID NO: 3675510 - DNA, 19 bp, Homo sapiens
catttgatgcatgtctttt

SEQ ID NO: 3675511 - DNA, 14 bp, Homo sapiens
catttgattaacat

SEQ ID NO: 3675512 - DNA, 13 bp, Homo sapiens
catttgctgaata

SEQ ID NO: 3675513 - DNA, 14 bp, Homo sapiens
catttggattgggg

SEQ ID NO: 3675514 - DNA, 16 bp, Homo sapiens
catttgtctgtgtttg

SEQ ID NO: 3675515 - DNA, 21 bp, Homo sapiens
cattttaaaaacatagaaaaa

SEQ ID NO: 3675516 - DNA, 22 bp, Homo sapiens
cattttaatttattaattgctt

SEQ ID NO: 3675517 - DNA, 23 bp, Homo sapiens
cattttaatttattaattgcttt

SEQ ID NO: 3675518 - DNA, 16 bp, Homo sapiens
cattttcagagtgaca

SEQ ID NO: 3675519 - DNA, 14 bp, Homo sapiens
cattttcattccta

SEQ ID NO: 3675520 - DNA, 14 bp, Homo sapiens
cattttccccccac

SEQ ID NO: 3675521 - DNA, 23 bp, Homo sapiens
cattttcttattgcgctgctacc

SEQ ID NO: 3675522 - DNA, 19 bp, Homo sapiens
catttttgtggttttgaga

SEQ ID NO: 3675523 - DNA, 22 bp, Homo sapiens
ccaaaaaattctacaacacaca

SEQ ID NO: 3675524 - DNA, 23 bp, Homo sapiens
ccaaaaaggttgctgtttcacaa

SEQ ID NO: 3675525 - DNA, 12 bp, Homo sapiens
ccaaaacaaaca

SEQ ID NO: 3675526 - DNA, 18 bp, Homo sapiens
ccaaaacaaacaaacaga

SEQ ID NO: 3675527 - DNA, 22 bp, Homo sapiens
ccaaaagaagcccccagctaag

SEQ ID NO: 3675528 - DNA, 22 bp, Homo sapiens
ccaaaatgctctagtgccttct

SEQ ID NO: 3675529 - DNA, 18 bp, Homo sapiens
ccaaaccggcaggtgcga

SEQ ID NO: 3675530 - DNA, 20 bp, Homo sapiens
ccaaagacctccacttgctt

SEQ ID NO: 3675531 - DNA, 17 bp, Homo sapiens
ccaaagcctcctccagc

SEQ ID NO: 3675532 - DNA, 18 bp, Homo sapiens
ccaaagctagggtggccc

SEQ ID NO: 3675533 - DNA, 12 bp, Homo sapiens
ccaaaggctggt

SEQ ID NO: 3675534 - DNA, 19 bp, Homo sapiens
ccaaagtgtcttttgacat

SEQ ID NO: 3675535 - DNA, 13 bp, Homo sapiens
ccaaatatgtcct

SEQ ID NO: 3675536 - DNA, 16 bp, Homo sapiens
ccaaatcacccaatcc

SEQ ID NO: 3675537 - DNA, 20 bp, Homo sapiens
ccaaatccttagatctggca

SEQ ID NO: 3675538 - DNA, 15 bp, Homo sapiens
ccaaatgtccctcca

SEQ ID NO: 3675539 - DNA, 11 bp, Homo sapiens
ccaacaaacca

SEQ ID NO: 3675540 - DNA, 16 bp, Homo sapiens
ccaacaaaccatccag

SEQ ID NO: 3675541 - DNA, 14 bp, Homo sapiens
ccaacaagcagctg

SEQ ID NO: 3675542 - DNA, 12 bp, Homo sapiens
ccaacacttcca

SEQ ID NO: 3675543 - DNA, 23 bp, Homo sapiens
ccaacaggagctgggatcctaag

SEQ ID NO: 3675544 - DNA, 19 bp, Homo sapiens
ccaaccccaagaccaagct

SEQ ID NO: 3675545 - DNA, 18 bp, Homo sapiens
ccaacccccaccccacac

SEQ ID NO: 3675546 - DNA, 17 bp, Homo sapiens
ccaacccgaggcccgca

SEQ ID NO: 3675547 - DNA, 17 bp, Homo sapiens
ccaacccgtgcccctgg

SEQ ID NO: 3675548 - DNA, 21 bp, Homo sapiens
ccaacccgtgcccctgggatc

SEQ ID NO: 3675549 - DNA, 21 bp, Homo sapiens
ccaacggagagcgcctgcccc

SEQ ID NO: 3675550 - DNA, 22 bp, Homo sapiens
ccaagaaagatgtatataggtg

SEQ ID NO: 3675551 - DNA, 21 bp, Homo sapiens
ccaagaaagctcactgtagct

SEQ ID NO: 3675552 - DNA, 11 bp, Homo sapiens
ccaagaatctt

SEQ ID NO: 3675553 - DNA, 15 bp, Homo sapiens
ccaagacaagtgatt

SEQ ID NO: 3675554 - DNA, 19 bp, Homo sapiens
ccaagacagatgccccaga

SEQ ID NO: 3675555 - DNA, 21 bp, Homo sapiens
ccaagacagatgccccagagc

SEQ ID NO: 3675556 - DNA, 23 bp, Homo sapiens
ccaagaccaagcttagtcctggg

SEQ ID NO: 3675557 - DNA, 21 bp, Homo sapiens
ccaagaggctgttcccaccag

SEQ ID NO: 3675558 - DNA, 12 bp, Homo sapiens
ccaagcaggaag

SEQ ID NO: 3675559 - DNA, 13 bp, Homo sapiens
ccaagcaggaagc

SEQ ID NO: 3675560 - DNA, 17 bp, Homo sapiens
ccaagcaggaagctcag

SEQ ID NO: 3675561 - DNA, 23 bp, Homo sapiens
ccaagccaagggaacctgtgtcc

SEQ ID NO: 3675562 - DNA, 13 bp, Homo sapiens
ccaagctccaagc

SEQ ID NO: 3675563 - DNA, 17 bp, Homo sapiens
ccaagctccaagcccca

SEQ ID NO: 3675564 - DNA, 17 bp, Homo sapiens
ccaagctccttgggagg

SEQ ID NO: 3675565 - DNA, 12 bp, Homo sapiens
ccaagctgtgct

SEQ ID NO: 3675566 - DNA, 14 bp, Homo sapiens
ccaagctgtgctgg

SEQ ID NO: 3675567 - DNA, 18 bp, Homo sapiens
ccaagcttagtcctggga

SEQ ID NO: 3675568 - DNA, 21 bp, Homo sapiens
ccaagcttagtcctgggagag

SEQ ID NO: 3675569 - DNA, 16 bp, Homo sapiens
ccaaggagctgctata

SEQ ID NO: 3675570 - DNA, 15 bp, Homo sapiens
ccaaggccagagtgg

SEQ ID NO: 3675571 - DNA, 18 bp, Homo sapiens
ccaaggccagagtggcct

SEQ ID NO: 3675572 - DNA, 19 bp, Homo sapiens
ccaaggggaatcagaactc

SEQ ID NO: 3675573 - DNA, 16 bp, Homo sapiens
ccaaggggcttcaggt

SEQ ID NO: 3675574 - DNA, 19 bp, Homo sapiens
ccaaggttttataaggctg

SEQ ID NO: 3675575 - DNA, 20 bp, Homo sapiens
ccaagtcaagtgaaaaagga

SEQ ID NO: 3675576 - DNA, 19 bp, Homo sapiens
ccaagtcacaaagagatgt

SEQ ID NO: 3675577 - DNA, 14 bp, Homo sapiens
ccaataacattctt

SEQ ID NO: 3675578 - DNA, 23 bp, Homo sapiens
ccaataataaatgccctcttctc

SEQ ID NO: 3675579 - DNA, 17 bp, Homo sapiens
ccaatatttaccagacc

SEQ ID NO: 3675580 - DNA, 22 bp, Homo sapiens
ccaatcccagttcttcctgcaa

SEQ ID NO: 3675581 - DNA, 20 bp, Homo sapiens
ccaatggaatgtgatgttca

SEQ ID NO: 3675582 - DNA, 22 bp, Homo sapiens
ccaatggaatgtgatgttcatg

SEQ ID NO: 3675583 - DNA, 13 bp, Homo sapiens
ccaatgggaagca

SEQ ID NO: 3675584 - DNA, 14 bp, Homo sapiens
ccaatgggaagcag

SEQ ID NO: 3675585 - DNA, 14 bp, Homo sapiens
ccaatggggcgggg

SEQ ID NO: 3675586 - DNA, 17 bp, Homo sapiens
ccaatggggcggggctt

SEQ ID NO: 3675587 - DNA, 13 bp, Homo sapiens
ccaattgctaccg

SEQ ID NO: 3675588 - DNA, 16 bp, Homo sapiens
ccaatttcagactccc

SEQ ID NO: 3675589 - DNA, 21 bp, Homo sapiens
ccaattttaatttagtaaatg

SEQ ID NO: 3675590 - DNA, 14 bp, Homo sapiens
ccacaaactgtaat

SEQ ID NO: 3675591 - DNA, 17 bp, Homo sapiens
ccacaagcctgagaact

SEQ ID NO: 3675592 - DNA, 15 bp, Homo sapiens
ccacaagtggtggta

SEQ ID NO: 3675593 - DNA, 21 bp, Homo sapiens
ccacaagtggtggtaaccctg

SEQ ID NO: 3675594 - DNA, 22 bp, Homo sapiens
ccacaagtggtggtaaccctgg

SEQ ID NO: 3675595 - DNA, 14 bp, Homo sapiens
ccacaatctgagca

SEQ ID NO: 3675596 - DNA, 16 bp, Homo sapiens
ccacacagcacttcaa

SEQ ID NO: 3675597 - DNA, 13 bp, Homo sapiens
ccacaccacatct

SEQ ID NO: 3675598 - DNA, 15 bp, Homo sapiens
ccacacccaaagctg

SEQ ID NO: 3675599 - DNA, 19 bp, Homo sapiens
ccacacctcagttcccttg

SEQ ID NO: 3675600 - DNA, 16 bp, Homo sapiens
ccacactaacctgggt

SEQ ID NO: 3675601 - DNA, 22 bp, Homo sapiens
ccacactaacctgggttccctt

SEQ ID NO: 3675602 - DNA, 18 bp, Homo sapiens
ccacagccagcacctggc

SEQ ID NO: 3675603 - DNA, 19 bp, Homo sapiens
ccacagccagcacctggca

SEQ ID NO: 3675604 - DNA, 20 bp, Homo sapiens
ccacatcctccgtccagccg

SEQ ID NO: 3675605 - DNA, 15 bp, Homo sapiens
ccacatctaagcctg

SEQ ID NO: 3675606 - DNA, 21 bp, Homo sapiens
ccaccacagccagcacctggc

SEQ ID NO: 3675607 - DNA, 13 bp, Homo sapiens
ccaccaggagaac

SEQ ID NO: 3675608 - DNA, 14 bp, Homo sapiens
ccaccaggagaacc

SEQ ID NO: 3675609 - DNA, 13 bp, Homo sapiens
ccaccaggccacc

SEQ ID NO: 3675610 - DNA, 22 bp, Homo sapiens
ccaccaggctgctcagggctgg

SEQ ID NO: 3675611 - DNA, 18 bp, Homo sapiens
ccaccatcaccagacagg

SEQ ID NO: 3675612 - DNA, 14 bp, Homo sapiens
ccacccaagtatac

SEQ ID NO: 3675613 - DNA, 18 bp, Homo sapiens
ccacccaggagggagggg

SEQ ID NO: 3675614 - DNA, 23 bp, Homo sapiens
ccacccaggagggagggggctat

SEQ ID NO: 3675615 - DNA, 13 bp, Homo sapiens
ccaccccacactt

SEQ ID NO: 3675616 - DNA, 18 bp, Homo sapiens
ccacccccttctctgctc

SEQ ID NO: 3675617 - DNA, 20 bp, Homo sapiens
ccacccccttctctgctcca

SEQ ID NO: 3675618 - DNA, 21 bp, Homo sapiens
ccacccggcccatatccctgg

SEQ ID NO: 3675619 - DNA, 23 bp, Homo sapiens
ccaccctacttcattttcagagt

SEQ ID NO: 3675620 - DNA, 17 bp, Homo sapiens
ccaccctgaaagccctg

SEQ ID NO: 3675621 - DNA, 18 bp, Homo sapiens
ccaccctgaaagccctga

SEQ ID NO: 3675622 - DNA, 16 bp, Homo sapiens
ccaccctgctgctggt

SEQ ID NO: 3675623 - DNA, 12 bp, Homo sapiens
ccaccctgggcc

SEQ ID NO: 3675624 - DNA, 15 bp, Homo sapiens
ccaccctgggccctg

SEQ ID NO: 3675625 - DNA, 15 bp, Homo sapiens
ccacccttggcctgt

SEQ ID NO: 3675626 - DNA, 14 bp, Homo sapiens
ccacctccctgcct

SEQ ID NO: 3675627 - DNA, 18 bp, Homo sapiens
ccacctccctgcctccag

SEQ ID NO: 3675628 - DNA, 20 bp, Homo sapiens
ccacctgcccatcacagggt

SEQ ID NO: 3675629 - DNA, 16 bp, Homo sapiens
ccacggccaccactgc

SEQ ID NO: 3675630 - DNA, 20 bp, Homo sapiens
ccacgttggagaagcccgtg

SEQ ID NO: 3675631 - DNA, 16 bp, Homo sapiens
ccactaagcagaggag

SEQ ID NO: 3675632 - DNA, 15 bp, Homo sapiens
ccactaagtaacctc

SEQ ID NO: 3675633 - DNA, 12 bp, Homo sapiens
ccactcaagcca

SEQ ID NO: 3675634 - DNA, 16 bp, Homo sapiens
ccactcaagccaagca

SEQ ID NO: 3675635 - DNA, 18 bp, Homo sapiens
ccactcaagccaagcagc

SEQ ID NO: 3675636 - DNA, 18 bp, Homo sapiens
ccactcactaggccccca

SEQ ID NO: 3675637 - DNA, 16 bp, Homo sapiens
ccactccgagaggtgg

SEQ ID NO: 3675638 - DNA, 19 bp, Homo sapiens
ccactccgagaggtgggcc

SEQ ID NO: 3675639 - DNA, 12 bp, Homo sapiens
ccactctcccca

SEQ ID NO: 3675640 - DNA, 15 bp, Homo sapiens
ccactctccccacac

SEQ ID NO: 3675641 - DNA, 19 bp, Homo sapiens
ccactctgcttctctgact

SEQ ID NO: 3675642 - DNA, 20 bp, Homo sapiens
ccactctgcttctctgactt

SEQ ID NO: 3675643 - DNA, 16 bp, Homo sapiens
ccactctgtggccagc

SEQ ID NO: 3675644 - DNA, 20 bp, Homo sapiens
ccactctgtggccagcctgg

SEQ ID NO: 3675645 - DNA, 21 bp, Homo sapiens
ccactctgtggccagcctggc

SEQ ID NO: 3675646 - DNA, 14 bp, Homo sapiens
ccactgaaatctgt

SEQ ID NO: 3675647 - DNA, 13 bp, Homo sapiens
ccactgaccagaa

SEQ ID NO: 3675648 - DNA, 12 bp, Homo sapiens
ccactgagctgg

SEQ ID NO: 3675649 - DNA, 19 bp, Homo sapiens
ccactgcactccagcctgg

SEQ ID NO: 3675650 - DNA, 16 bp, Homo sapiens
ccactgccatgtaccc

SEQ ID NO: 3675651 - DNA, 21 bp, Homo sapiens
ccactgcgggagctctgtatg

SEQ ID NO: 3675652 - DNA, 21 bp, Homo sapiens
ccactgtcctgggcctgcaga

SEQ ID NO: 3675653 - DNA, 15 bp, Homo sapiens
ccactgtgaagagaa

SEQ ID NO: 3675654 - DNA, 13 bp, Homo sapiens
ccactgtggtggc

SEQ ID NO: 3675655 - DNA, 13 bp, Homo sapiens
ccacttcagctga

SEQ ID NO: 3675656 - DNA, 15 bp, Homo sapiens
ccacttcccaccctg

SEQ ID NO: 3675657 - DNA, 12 bp, Homo sapiens
ccacttgcctct

SEQ ID NO: 3675658 - DNA, 13 bp, Homo sapiens
ccagaaaacaaaa

SEQ ID NO: 3675659 - DNA, 20 bp, Homo sapiens
ccagaacacggctcacgctt

SEQ ID NO: 3675660 - DNA, 20 bp, Homo sapiens
ccagaacttgaccctgagct

SEQ ID NO: 3675661 - DNA, 15 bp, Homo sapiens
ccagaagcctctggc

SEQ ID NO: 3675662 - DNA, 16 bp, Homo sapiens
ccagaagcctctggct

SEQ ID NO: 3675663 - DNA, 22 bp, Homo sapiens
ccagaagtttgagatcagcctg

SEQ ID NO: 3675664 - DNA, 15 bp, Homo sapiens
ccagacacccaggac

SEQ ID NO: 3675665 - DNA, 23 bp, Homo sapiens
ccagacactgaccatccactcta

SEQ ID NO: 3675666 - DNA, 20 bp, Homo sapiens
ccagacatgccacaaggact

SEQ ID NO: 3675667 - DNA, 17 bp, Homo sapiens
ccagacctgatcctgga

SEQ ID NO: 3675668 - DNA, 16 bp, Homo sapiens
ccagagaaaggggagc

SEQ ID NO: 3675669 - DNA, 19 bp, Homo sapiens
ccagagaaaggggagccca

SEQ ID NO: 3675670 - DNA, 23 bp, Homo sapiens
ccagagaaaggggagcccactgt

SEQ ID NO: 3675671 - DNA, 17 bp, Homo sapiens
ccagagacatacttgaa

SEQ ID NO: 3675672 - DNA, 13 bp, Homo sapiens
ccagagcccagct

SEQ ID NO: 3675673 - DNA, 17 bp, Homo sapiens
ccagagctgctggtctc

SEQ ID NO: 3675674 - DNA, 20 bp, Homo sapiens
ccagagctgtttatggcctc

SEQ ID NO: 3675675 - DNA, 21 bp, Homo sapiens
ccagagctgtttatggcctca

SEQ ID NO: 3675676 - DNA, 23 bp, Homo sapiens
ccagagctgtttatggcctcagc

SEQ ID NO: 3675677 - DNA, 15 bp, Homo sapiens
ccagaggcccccagc

SEQ ID NO: 3675678 - DNA, 21 bp, Homo sapiens
ccagaggcccccagcccaggg

SEQ ID NO: 3675679 - DNA, 21 bp, Homo sapiens
ccagagtggcctggccaggag

SEQ ID NO: 3675680 - DNA, 19 bp, Homo sapiens
ccagatctggtcccttgca

SEQ ID NO: 3675681 - DNA, 18 bp, Homo sapiens
ccagatggaaaaataaca

SEQ ID NO: 3675682 - DNA, 18 bp, Homo sapiens
ccagattgacgacaagtg

SEQ ID NO: 3675683 - DNA, 19 bp, Homo sapiens
ccagattgacgacaagtgc

SEQ ID NO: 3675684 - DNA, 12 bp, Homo sapiens
ccagatttgtct

SEQ ID NO: 3675685 - DNA, 13 bp, Homo sapiens
ccagcacagcttg

SEQ ID NO: 3675686 - DNA, 17 bp, Homo sapiens
ccagcacagcttgacct

SEQ ID NO: 3675687 - DNA, 14 bp, Homo sapiens
ccagcaccttgtgc

SEQ ID NO: 3675688 - DNA, 20 bp, Homo sapiens
ccagcaccttgtgcctgggg

SEQ ID NO: 3675689 - DNA, 11 bp, Homo sapiens
ccagcagcctg

SEQ ID NO: 3675690 - DNA, 20 bp, Homo sapiens
ccagcagcctggaccctgtg

SEQ ID NO: 3675691 - DNA, 12 bp, Homo sapiens
ccagcagcgcct

SEQ ID NO: 3675692 - DNA, 18 bp, Homo sapiens
ccagcagcgcctttccca

SEQ ID NO: 3675693 - DNA, 19 bp, Homo sapiens
ccagcagcgcctttcccaa

SEQ ID NO: 3675694 - DNA, 17 bp, Homo sapiens
ccagcattccagcccct

SEQ ID NO: 3675695 - DNA, 16 bp, Homo sapiens
ccagcatttagctggc

SEQ ID NO: 3675696 - DNA, 17 bp, Homo sapiens
ccagcatttagctggcc

SEQ ID NO: 3675697 - DNA, 19 bp, Homo sapiens
ccagcatttagctggccac

SEQ ID NO: 3675698 - DNA, 22 bp, Homo sapiens
ccagccagtgaggatgacagtg

SEQ ID NO: 3675699 - DNA, 16 bp, Homo sapiens
ccagccatgtctgcat

SEQ ID NO: 3675700 - DNA, 18 bp, Homo sapiens
ccagccatgtctgcattt

SEQ ID NO: 3675701 - DNA, 13 bp, Homo sapiens
ccagcccagacag

SEQ ID NO: 3675702 - DNA, 13 bp, Homo sapiens
ccagcccagagac

SEQ ID NO: 3675703 - DNA, 17 bp, Homo sapiens
ccagcccagggctcctg

SEQ ID NO: 3675704 - DNA, 16 bp, Homo sapiens
ccagccccacccagga

SEQ ID NO: 3675705 - DNA, 18 bp, Homo sapiens
ccagccccccaggctgcc

SEQ ID NO: 3675706 - DNA, 21 bp, Homo sapiens
ccagccccccaggctgcccag

SEQ ID NO: 3675707 - DNA, 14 bp, Homo sapiens
ccagcccctcctcc

SEQ ID NO: 3675708 - DNA, 15 bp, Homo sapiens
ccagcccctcctccc

SEQ ID NO: 3675709 - DNA, 14 bp, Homo sapiens
ccagcccctctggt

SEQ ID NO: 3675710 - DNA, 17 bp, Homo sapiens
ccagcccctcttcccca

SEQ ID NO: 3675711 - DNA, 21 bp, Homo sapiens
ccagcctatcaggtgcccctc

SEQ ID NO: 3675712 - DNA, 11 bp, Homo sapiens
ccagcctccct

SEQ ID NO: 3675713 - DNA, 19 bp, Homo sapiens
ccagcctggcatcagttta

SEQ ID NO: 3675714 - DNA, 17 bp, Homo sapiens
ccagcctggccaacatg

SEQ ID NO: 3675715 - DNA, 16 bp, Homo sapiens
ccagcctgggcagcca

SEQ ID NO: 3675716 - DNA, 18 bp, Homo sapiens
ccagcctgggcagccagg

SEQ ID NO: 3675717 - DNA, 22 bp, Homo sapiens
ccagcctgggcagccaggctgc

SEQ ID NO: 3675718 - DNA, 13 bp, Homo sapiens
ccagcctggggtc

SEQ ID NO: 3675719 - DNA, 13 bp, Homo sapiens
ccagcctgggtga

SEQ ID NO: 3675720 - DNA, 19 bp, Homo sapiens
ccagcgatctctccactgt

SEQ ID NO: 3675721 - DNA, 20 bp, Homo sapiens
ccagcgatctctccactgtg

SEQ ID NO: 3675722 - DNA, 15 bp, Homo sapiens
ccagcggtttcctgg

SEQ ID NO: 3675723 - DNA, 15 bp, Homo sapiens
ccagctaagaacctg

SEQ ID NO: 3675724 - DNA, 13 bp, Homo sapiens
ccagctaccacca

SEQ ID NO: 3675725 - DNA, 20 bp, Homo sapiens
ccagctattaccacacttgg

SEQ ID NO: 3675726 - DNA, 13 bp, Homo sapiens
ccagctcacagtg

SEQ ID NO: 3675727 - DNA, 20 bp, Homo sapiens
ccagctcaggacagatgcca

SEQ ID NO: 3675728 - DNA, 14 bp, Homo sapiens
ccagctccaacctg

SEQ ID NO: 3675729 - DNA, 15 bp, Homo sapiens
ccagctccaacctgc

SEQ ID NO: 3675730 - DNA, 13 bp, Homo sapiens
ccagctctgtggg

SEQ ID NO: 3675731 - DNA, 14 bp, Homo sapiens
ccagctctgtgggc

SEQ ID NO: 3675732 - DNA, 14 bp, Homo sapiens
ccagctgcactgat

SEQ ID NO: 3675733 - DNA, 18 bp, Homo sapiens
ccagctgcactgatgctg

SEQ ID NO: 3675734 - DNA, 19 bp, Homo sapiens
ccagctgcactgatgctgc

SEQ ID NO: 3675735 - DNA, 16 bp, Homo sapiens
ccagctggcagcagag

SEQ ID NO: 3675736 - DNA, 14 bp, Homo sapiens
ccaggaatttccca

SEQ ID NO: 3675737 - DNA, 16 bp, Homo sapiens
ccaggaatttcccagg

SEQ ID NO: 3675738 - DNA, 13 bp, Homo sapiens
ccaggaccagctc

SEQ ID NO: 3675739 - DNA, 20 bp, Homo sapiens
ccaggacccaccactggaag

SEQ ID NO: 3675740 - DNA, 18 bp, Homo sapiens
ccaggaccctgaaggggc

SEQ ID NO: 3675741 - DNA, 23 bp, Homo sapiens
ccaggaccctgaaggggccatga

SEQ ID NO: 3675742 - DNA, 20 bp, Homo sapiens
ccaggactatatttgggcct

SEQ ID NO: 3675743 - DNA, 14 bp, Homo sapiens
ccaggactccctcc

SEQ ID NO: 3675744 - DNA, 21 bp, Homo sapiens
ccaggacttatttaaactctg

SEQ ID NO: 3675745 - DNA, 19 bp, Homo sapiens
ccaggagaaccactacatg

SEQ ID NO: 3675746 - DNA, 17 bp, Homo sapiens
ccaggagaagttgaggg

SEQ ID NO: 3675747 - DNA, 21 bp, Homo sapiens
ccaggagctgggcagaaggcc

SEQ ID NO: 3675748 - DNA, 16 bp, Homo sapiens
ccaggatagagactgg

SEQ ID NO: 3675749 - DNA, 17 bp, Homo sapiens
ccaggatctttgactga

SEQ ID NO: 3675750 - DNA, 11 bp, Homo sapiens
ccaggatgggg

SEQ ID NO: 3675751 - DNA, 13 bp, Homo sapiens
ccaggatggggag

SEQ ID NO: 3675752 - DNA, 17 bp, Homo sapiens
ccaggatggggaggggc

SEQ ID NO: 3675753 - DNA, 17 bp, Homo sapiens
ccaggcaacttgggaac

SEQ ID NO: 3675754 - DNA, 13 bp, Homo sapiens
ccaggcagatcca

SEQ ID NO: 3675755 - DNA, 16 bp, Homo sapiens
ccaggcagatccagga

SEQ ID NO: 3675756 - DNA, 17 bp, Homo sapiens
ccaggcagatccaggac

SEQ ID NO: 3675757 - DNA, 17 bp, Homo sapiens
ccaggcagatctgtgcc

SEQ ID NO: 3675758 - DNA, 12 bp, Homo sapiens
ccaggcagctgg

SEQ ID NO: 3675759 - DNA, 15 bp, Homo sapiens
ccaggcagctggcag

SEQ ID NO: 3675760 - DNA, 16 bp, Homo sapiens
ccaggcagctggcagg

SEQ ID NO: 3675761 - DNA, 17 bp, Homo sapiens
ccaggcagctggcagga

SEQ ID NO: 3675762 - DNA, 16 bp, Homo sapiens
ccaggccacctcccca

SEQ ID NO: 3675763 - DNA, 19 bp, Homo sapiens
ccaggccctcctctcccat

SEQ ID NO: 3675764 - DNA, 15 bp, Homo sapiens
ccaggccggcaggcc

SEQ ID NO: 3675765 - DNA, 14 bp, Homo sapiens
ccaggctccaatgg

SEQ ID NO: 3675766 - DNA, 19 bp, Homo sapiens
ccaggctgccaaggccaga

SEQ ID NO: 3675767 - DNA, 20 bp, Homo sapiens
ccaggctgccaaggccagag

SEQ ID NO: 3675768 - DNA, 15 bp, Homo sapiens
ccaggctgcccagag

SEQ ID NO: 3675769 - DNA, 19 bp, Homo sapiens
ccagggcaaggccccttcc

SEQ ID NO: 3675770 - DNA, 14 bp, Homo sapiens
ccagggcccagagc

SEQ ID NO: 3675771 - DNA, 15 bp, Homo sapiens
ccagggcccagagcc

SEQ ID NO: 3675772 - DNA, 17 bp, Homo sapiens
ccagggcccagagccca

SEQ ID NO: 3675773 - DNA, 18 bp, Homo sapiens
ccagggcccagagcccag

SEQ ID NO: 3675774 - DNA, 21 bp, Homo sapiens
ccagggcccagagcccagctc

SEQ ID NO: 3675775 - DNA, 21 bp, Homo sapiens
ccagggcccctcaccctgcct

SEQ ID NO: 3675776 - DNA, 12 bp, Homo sapiens
ccagggcctttt

SEQ ID NO: 3675777 - DNA, 16 bp, Homo sapiens
ccagggctagtgactt

SEQ ID NO: 3675778 - DNA, 19 bp, Homo sapiens
ccagggctagtgacttgtg

SEQ ID NO: 3675779 - DNA, 12 bp, Homo sapiens
ccagggctcctg

SEQ ID NO: 3675780 - DNA, 18 bp, Homo sapiens
ccaggggatgagtggagg

SEQ ID NO: 3675781 - DNA, 16 bp, Homo sapiens
ccaggggatgggaggt

SEQ ID NO: 3675782 - DNA, 22 bp, Homo sapiens
ccaggggctgcttcctcctgga

SEQ ID NO: 3675783 - DNA, 14 bp, Homo sapiens
ccaggggtcccagc

SEQ ID NO: 3675784 - DNA, 23 bp, Homo sapiens
ccaggggtggaacaactctggga

SEQ ID NO: 3675785 - DNA, 23 bp, Homo sapiens
ccaggtgcagaggtaccctgggt

SEQ ID NO: 3675786 - DNA, 20 bp, Homo sapiens
ccaggtgcctttcaaattta

SEQ ID NO: 3675787 - DNA, 15 bp, Homo sapiens
ccaggtgtgcccctc

SEQ ID NO: 3675788 - DNA, 21 bp, Homo sapiens
ccaggtgtgcccctccaagtc

SEQ ID NO: 3675789 - DNA, 20 bp, Homo sapiens
ccaggttcaacccacagcta

SEQ ID NO: 3675790 - DNA, 22 bp, Homo sapiens
ccagtagggtttgacatttcat

SEQ ID NO: 3675791 - DNA, 13 bp, Homo sapiens
ccagtatcgctca

SEQ ID NO: 3675792 - DNA, 15 bp, Homo sapiens
ccagtccaggctgcc

SEQ ID NO: 3675793 - DNA, 15 bp, Homo sapiens
ccagtccccccaccc

SEQ ID NO: 3675794 - DNA, 14 bp, Homo sapiens
ccagtcctgcctgg

SEQ ID NO: 3675795 - DNA, 15 bp, Homo sapiens
ccagtcctgcctggc

SEQ ID NO: 3675796 - DNA, 16 bp, Homo sapiens
ccagtcctgcctggcc

SEQ ID NO: 3675797 - DNA, 14 bp, Homo sapiens
ccagtcctggttgt

SEQ ID NO: 3675798 - DNA, 12 bp, Homo sapiens
ccagtctgtgga

SEQ ID NO: 3675799 - DNA, 13 bp, Homo sapiens
ccagtctgtggat

SEQ ID NO: 3675800 - DNA, 18 bp, Homo sapiens
ccagtgacctgaggaagc

SEQ ID NO: 3675801 - DNA, 19 bp, Homo sapiens
ccagtgacctgaggaagcg

SEQ ID NO: 3675802 - DNA, 18 bp, Homo sapiens
ccagtgaggatgacagtg

SEQ ID NO: 3675803 - DNA, 18 bp, Homo sapiens
ccagtgcatggtggccag

SEQ ID NO: 3675804 - DNA, 16 bp, Homo sapiens
ccagttcttcctgcaa

SEQ ID NO: 3675805 - DNA, 18 bp, Homo sapiens
ccagttcttcctgcaacc

SEQ ID NO: 3675806 - DNA, 21 bp, Homo sapiens
ccagttcttcctgcaaccact

SEQ ID NO: 3675807 - DNA, 23 bp, Homo sapiens
ccagttggagttttttgtaccaa

SEQ ID NO: 3675808 - DNA, 19 bp, Homo sapiens
ccatacccacaatctgagc

SEQ ID NO: 3675809 - DNA, 12 bp, Homo sapiens
ccatatgctcca

SEQ ID NO: 3675810 - DNA, 15 bp, Homo sapiens
ccatatgctccagga

SEQ ID NO: 3675811 - DNA, 13 bp, Homo sapiens
ccatcacagggtt

SEQ ID NO: 3675812 - DNA, 16 bp, Homo sapiens
ccatcccctgtagagt

SEQ ID NO: 3675813 - DNA, 22 bp, Homo sapiens
ccatcctaatcatccaatgctc

SEQ ID NO: 3675814 - DNA, 13 bp, Homo sapiens
ccatcctccagca

SEQ ID NO: 3675815 - DNA, 21 bp, Homo sapiens
ccatctcacctcctgctgggc

SEQ ID NO: 3675816 - DNA, 21 bp, Homo sapiens
ccatctgtagtaatttattgt

SEQ ID NO: 3675817 - DNA, 17 bp, Homo sapiens
ccatcttaaatttctaa

SEQ ID NO: 3675818 - DNA, 14 bp, Homo sapiens
ccatgatggcaaca

SEQ ID NO: 3675819 - DNA, 14 bp, Homo sapiens
ccatgcaacatgga

SEQ ID NO: 3675820 - DNA, 13 bp, Homo sapiens
ccatgcactgtga

SEQ ID NO: 3675821 - DNA, 19 bp, Homo sapiens
ccatgcactgtgaaggacc

SEQ ID NO: 3675822 - DNA, 13 bp, Homo sapiens
ccatgcccacctg

SEQ ID NO: 3675823 - DNA, 15 bp, Homo sapiens
ccatgcccacctgcc

SEQ ID NO: 3675824 - DNA, 18 bp, Homo sapiens
ccatgcccacctgcccat

SEQ ID NO: 3675825 - DNA, 13 bp, Homo sapiens
ccatgcgctcagg

SEQ ID NO: 3675826 - DNA, 15 bp, Homo sapiens
ccatgcgctcagggc

SEQ ID NO: 3675827 - DNA, 16 bp, Homo sapiens
ccatgcgctcagggcc

SEQ ID NO: 3675828 - DNA, 13 bp, Homo sapiens
ccatgctcctggc

SEQ ID NO: 3675829 - DNA, 11 bp, Homo sapiens
ccatgggacca

SEQ ID NO: 3675830 - DNA, 18 bp, Homo sapiens
ccatgggtgtggatggca

SEQ ID NO: 3675831 - DNA, 18 bp, Homo sapiens
ccatgtactcaagtacca

SEQ ID NO: 3675832 - DNA, 12 bp, Homo sapiens
ccattctgactc

SEQ ID NO: 3675833 - DNA, 15 bp, Homo sapiens
ccattcttctggtgc

SEQ ID NO: 3675834 - DNA, 17 bp, Homo sapiens
ccattgccaccaggaga

SEQ ID NO: 3675835 - DNA, 11 bp, Homo sapiens
ccattgggacc

SEQ ID NO: 3675836 - DNA, 15 bp, Homo sapiens
ccattgtccctctgc

SEQ ID NO: 3675837 - DNA, 19 bp, Homo sapiens
ccattgtccctctgcccca

SEQ ID NO: 3675838 - DNA, 22 bp, Homo sapiens
ccattgtccctctgccccatcc

SEQ ID NO: 3675839 - DNA, 19 bp, Homo sapiens
ccatttggccggctctggt

SEQ ID NO: 3675840 - DNA, 14 bp, Homo sapiens
ccattttggaaaat

SEQ ID NO: 3675841 - DNA, 15 bp, Homo sapiens
cccaaagctttcctg

SEQ ID NO: 3675842 - DNA, 17 bp, Homo sapiens
cccaaagctttcctgcc

SEQ ID NO: 3675843 - DNA, 13 bp, Homo sapiens
cccaaccccaaga

SEQ ID NO: 3675844 - DNA, 18 bp, Homo sapiens
cccaagacagatgcccca

SEQ ID NO: 3675845 - DNA, 12 bp, Homo sapiens
cccaagagggct

SEQ ID NO: 3675846 - DNA, 13 bp, Homo sapiens
cccaagagggctg

SEQ ID NO: 3675847 - DNA, 11 bp, Homo sapiens
cccaagattct

SEQ ID NO: 3675848 - DNA, 14 bp, Homo sapiens
cccaagccagaggc

SEQ ID NO: 3675849 - DNA, 9 bp, Homo sapiens
cccaagctg

SEQ ID NO: 3675850 - DNA, 14 bp, Homo sapiens
cccaagctgtgctg

SEQ ID NO: 3675851 - DNA, 23 bp, Homo sapiens
cccaagggatctggtcctaccca

SEQ ID NO: 3675852 - DNA, 21 bp, Homo sapiens
cccaatcccagttcttcctgc

SEQ ID NO: 3675853 - DNA, 22 bp, Homo sapiens
cccaatcccagttcttcctgca

SEQ ID NO: 3675854 - DNA, 15 bp, Homo sapiens
cccaatttcagactc

SEQ ID NO: 3675855 - DNA, 14 bp, Homo sapiens
cccacaagtggtgg

SEQ ID NO: 3675856 - DNA, 20 bp, Homo sapiens
cccacaagtggtggtaaccc

SEQ ID NO: 3675857 - DNA, 22 bp, Homo sapiens
cccacaagtggtggtaaccctg

SEQ ID NO: 3675858 - DNA, 16 bp, Homo sapiens
cccacaatctgagcac

SEQ ID NO: 3675859 - DNA, 22 bp, Homo sapiens
cccacaatctggcttagtgcca

SEQ ID NO: 3675860 - DNA, 16 bp, Homo sapiens
cccacacccaaagctg

SEQ ID NO: 3675861 - DNA, 22 bp, Homo sapiens
cccacacctcagttcccttggc

SEQ ID NO: 3675862 - DNA, 13 bp, Homo sapiens
cccaccaggctgc

SEQ ID NO: 3675863 - DNA, 16 bp, Homo sapiens
cccaccaggctgctca

SEQ ID NO: 3675864 - DNA, 12 bp, Homo sapiens
cccacccaggag

SEQ ID NO: 3675865 - DNA, 16 bp, Homo sapiens
cccacccccttctctg

SEQ ID NO: 3675866 - DNA, 22 bp, Homo sapiens
cccacccccttctctgctccac

SEQ ID NO: 3675867 - DNA, 12 bp, Homo sapiens
cccacccctggg

SEQ ID NO: 3675868 - DNA, 14 bp, Homo sapiens
cccacccggcccat

SEQ ID NO: 3675869 - DNA, 13 bp, Homo sapiens
cccacccggtggg

SEQ ID NO: 3675870 - DNA, 18 bp, Homo sapiens
cccaccctcaaggtgcgg

SEQ ID NO: 3675871 - DNA, 15 bp, Homo sapiens
cccaccctgctgctg

SEQ ID NO: 3675872 - DNA, 12 bp, Homo sapiens
cccacctccctg

SEQ ID NO: 3675873 - DNA, 16 bp, Homo sapiens
cccacctccctgcctc

SEQ ID NO: 3675874 - DNA, 12 bp, Homo sapiens
cccacctgcact

SEQ ID NO: 3675875 - DNA, 20 bp, Homo sapiens
cccacctgcccatcacaggg

SEQ ID NO: 3675876 - DNA, 23 bp, Homo sapiens
cccacctgcccatcacagggttg

SEQ ID NO: 3675877 - DNA, 22 bp, Homo sapiens
cccacctgtcaaacaaagccag

SEQ ID NO: 3675878 - DNA, 20 bp, Homo sapiens
cccacgactgcccggcaggg

SEQ ID NO: 3675879 - DNA, 20 bp, Homo sapiens
cccactcaagccaagcagcc

SEQ ID NO: 3675880 - DNA, 17 bp, Homo sapiens
cccactctccccacact

SEQ ID NO: 3675881 - DNA, 14 bp, Homo sapiens
cccactgaccagaa

SEQ ID NO: 3675882 - DNA, 22 bp, Homo sapiens
actgtgacctccgcctcctggg

SEQ ID NO: 3675883 - DNA, 21 bp, Homo sapiens
actgttacaacttgtatttcc

SEQ ID NO: 3675884 - DNA, 18 bp, Homo sapiens
actgttgcccttctgtcc

SEQ ID NO: 3675885 - DNA, 22 bp, Homo sapiens
actgtttgtttttatttaaatt

SEQ ID NO: 3675886 - DNA, 22 bp, Homo sapiens
acttaaaagtcagtatcatatt

SEQ ID NO: 3675887 - DNA, 15 bp, Homo sapiens
acttaagcaaaagaa

SEQ ID NO: 3675888 - DNA, 14 bp, Homo sapiens
acttacttgcttat

SEQ ID NO: 3675889 - DNA, 21 bp, Homo sapiens
acttagggaagaaaaagcaag

SEQ ID NO: 3675890 - DNA, 16 bp, Homo sapiens
acttagggcaccaggg

SEQ ID NO: 3675891 - DNA, 18 bp, Homo sapiens
acttagtgacaaaataga

SEQ ID NO: 3675892 - DNA, 14 bp, Homo sapiens
acttatcttctgga

SEQ ID NO: 3675893 - DNA, 17 bp, Homo sapiens
acttatcttctggatta

SEQ ID NO: 3675894 - DNA, 17 bp, Homo sapiens
acttcaaagaagctgtc

SEQ ID NO: 3675895 - DNA, 15 bp, Homo sapiens
acttcaaagcaagct

SEQ ID NO: 3675896 - DNA, 16 bp, Homo sapiens
acttcaaagcaagctg

SEQ ID NO: 3675897 - DNA, 11 bp, Homo sapiens
acttcagctga

SEQ ID NO: 3675898 - DNA, 18 bp, Homo sapiens
acttcagtcttgcctagg

SEQ ID NO: 3675899 - DNA, 17 bp, Homo sapiens
acttcatagaaacctct

SEQ ID NO: 3675900 - DNA, 15 bp, Homo sapiens
acttcattttcagag

SEQ ID NO: 3675901 - DNA, 13 bp, Homo sapiens
acttccccacagg

SEQ ID NO: 3675902 - DNA, 20 bp, Homo sapiens
acttccccacaggtgaaagt

SEQ ID NO: 3675903 - DNA, 19 bp, Homo sapiens
acttccccctcttcagcat

SEQ ID NO: 3675904 - DNA, 20 bp, Homo sapiens
acttcctaaatattatgaga

SEQ ID NO: 3675905 - DNA, 23 bp, Homo sapiens
acttcctgtccagctccaacctg

SEQ ID NO: 3675906 - DNA, 17 bp, Homo sapiens
acttcgggaggtcgagg

SEQ ID NO: 3675907 - DNA, 20 bp, Homo sapiens
acttcgggaggtcgaggcag

SEQ ID NO: 3675908 - DNA, 16 bp, Homo sapiens
acttctgggtctccag

SEQ ID NO: 3675909 - DNA, 23 bp, Homo sapiens
acttctgtgagacccccacacct

SEQ ID NO: 3675910 - DNA, 15 bp, Homo sapiens
acttctgtttagtct

SEQ ID NO: 3675911 - DNA, 16 bp, Homo sapiens
acttcttgaaggtgct

SEQ ID NO: 3675912 - DNA, 19 bp, Homo sapiens
acttgaactgttgcccttc

SEQ ID NO: 3675913 - DNA, 20 bp, Homo sapiens
acttgaactgttgcccttct

SEQ ID NO: 3675914 - DNA, 22 bp, Homo sapiens
acttgaactgttgcccttctgt

SEQ ID NO: 3675915 - DNA, 19 bp, Homo sapiens
acttgaagggccagagcca

SEQ ID NO: 3675916 - DNA, 18 bp, Homo sapiens
acttgacagaacactgtc

SEQ ID NO: 3675917 - DNA, 18 bp, Homo sapiens
acttgaccctgagctgac

SEQ ID NO: 3675918 - DNA, 22 bp, Homo sapiens
acttgctgggtggttctctggg

SEQ ID NO: 3675919 - DNA, 19 bp, Homo sapiens
acttgcttatcaacttcct

SEQ ID NO: 3675920 - DNA, 23 bp, Homo sapiens
acttggctcgaatctctgtgcct

SEQ ID NO: 3675921 - DNA, 21 bp, Homo sapiens
acttggggagttaagacctgg

SEQ ID NO: 3675922 - DNA, 23 bp, Homo sapiens
acttggggagttaagacctggca

SEQ ID NO: 3675923 - DNA, 16 bp, Homo sapiens
acttggtttttaaaaa

SEQ ID NO: 3675924 - DNA, 14 bp, Homo sapiens
acttgtatttccaa

SEQ ID NO: 3675925 - DNA, 18 bp, Homo sapiens
acttgtcaagcctgtgca

SEQ ID NO: 3675926 - DNA, 20 bp, Homo sapiens
acttgtcaagcctgtgcaaa

SEQ ID NO: 3675927 - DNA, 16 bp, Homo sapiens
acttgttccagctctt

SEQ ID NO: 3675928 - DNA, 19 bp, Homo sapiens
acttgtttctctgttgtaa

SEQ ID NO: 3675929 - DNA, 14 bp, Homo sapiens
actttaagaggaca

SEQ ID NO: 3675930 - DNA, 18 bp, Homo sapiens
actttcagtgaaagcatc

SEQ ID NO: 3675931 - DNA, 14 bp, Homo sapiens
actttctgcctgga

SEQ ID NO: 3675932 - DNA, 17 bp, Homo sapiens
actttcttattctgtat

SEQ ID NO: 3675933 - DNA, 14 bp, Homo sapiens
actttcttctgaat

SEQ ID NO: 3675934 - DNA, 18 bp, Homo sapiens
actttcttctgaatattt

SEQ ID NO: 3675935 - DNA, 18 bp, Homo sapiens
actttggcaatttcctgg

SEQ ID NO: 3675936 - DNA, 12 bp, Homo sapiens
actttgtaaata

SEQ ID NO: 3675937 - DNA, 12 bp, Homo sapiens
actttgtaaatt

SEQ ID NO: 3675938 - DNA, 16 bp, Homo sapiens
actttttaaaattctg

SEQ ID NO: 3675939 - DNA, 23 bp, Homo sapiens
acttttttgctatccagctattt

SEQ ID NO: 3675940 - DNA, 18 bp, Homo sapiens
agaaaaaaaccacacaaa

SEQ ID NO: 3675941 - DNA, 19 bp, Homo sapiens
agaaaaataaaaatctctt

SEQ ID NO: 3675942 - DNA, 16 bp, Homo sapiens
agaaaaatatgtacca

SEQ ID NO: 3675943 - DNA, 18 bp, Homo sapiens
agaaaaatgagcctggca

SEQ ID NO: 3675944 - DNA, 14 bp, Homo sapiens
agaaaacttgcctt

SEQ ID NO: 3675945 - DNA, 12 bp, Homo sapiens
agaaaagttatt

SEQ ID NO: 3675946 - DNA, 13 bp, Homo sapiens
agaaaagttatta

SEQ ID NO: 3675947 - DNA, 15 bp, Homo sapiens
agaaagacagagctg

SEQ ID NO: 3675948 - DNA, 19 bp, Homo sapiens
agaaagagtattgttatgt

SEQ ID NO: 3675949 - DNA, 17 bp, Homo sapiens
agaaaggggagcccact

SEQ ID NO: 3675950 - DNA, 14 bp, Homo sapiens
agaaagtacagcag

SEQ ID NO: 3675951 - DNA, 11 bp, Homo sapiens
agaaatgccaa

SEQ ID NO: 3675952 - DNA, 21 bp, Homo sapiens
agaaatgccaagcacttcttt

SEQ ID NO: 3675953 - DNA, 21 bp, Homo sapiens
agaaatggtccgctttcctgg

SEQ ID NO: 3675954 - DNA, 22 bp, Homo sapiens
agaaatggtccgctttcctgga

SEQ ID NO: 3675955 - DNA, 11 bp, Homo sapiens
agaaattttca

SEQ ID NO: 3675956 - DNA, 14 bp, Homo sapiens
agaacacgcgtatt

SEQ ID NO: 3675957 - DNA, 16 bp, Homo sapiens
agaacatccctgccag

SEQ ID NO: 3675958 - DNA, 17 bp, Homo sapiens
agaacatccctgccagc

SEQ ID NO: 3675959 - DNA, 11 bp, Homo sapiens
agaacattgta

SEQ ID NO: 3675960 - DNA, 13 bp, Homo sapiens
agaaccaaatctg

SEQ ID NO: 3675961 - DNA, 18 bp, Homo sapiens
agaaccaaatctggaagc

SEQ ID NO: 3675962 - DNA, 21 bp, Homo sapiens
agaacctcacgcacctcccat

SEQ ID NO: 3675963 - DNA, 14 bp, Homo sapiens
agaacctcttcccc

SEQ ID NO: 3675964 - DNA, 12 bp, Homo sapiens
agaaccttctct

SEQ ID NO: 3675965 - DNA, 20 bp, Homo sapiens
agaacgttttttcctcagtg

SEQ ID NO: 3675966 - DNA, 17 bp, Homo sapiens
agaactccaggccctcc

SEQ ID NO: 3675967 - DNA, 14 bp, Homo sapiens
agaactcctacctg

SEQ ID NO: 3675968 - DNA, 11 bp, Homo sapiens
agaactcctag

SEQ ID NO: 3675969 - DNA, 18 bp, Homo sapiens
agaactgcaggccctggc

SEQ ID NO: 3675970 - DNA, 15 bp, Homo sapiens
agaacttgaccctga

SEQ ID NO: 3675971 - DNA, 15 bp, Homo sapiens
agaactttgagctac

SEQ ID NO: 3675972 - DNA, 15 bp, Homo sapiens
agaagaagaagaagg

SEQ ID NO: 3675973 - DNA, 13 bp, Homo sapiens
agaagaaggcagc

SEQ ID NO: 3675974 - DNA, 13 bp, Homo sapiens
agaagacaaaaag

SEQ ID NO: 3675975 - DNA, 15 bp, Homo sapiens
agaagacaattgaca

SEQ ID NO: 3675976 - DNA, 22 bp, Homo sapiens
agaagacacaaggtgatttcag

SEQ ID NO: 3675977 - DNA, 22 bp, Homo sapiens
agaagagagtccatatttcaat

SEQ ID NO: 3675978 - DNA, 12 bp, Homo sapiens
agaagcccccag

SEQ ID NO: 3675979 - DNA, 21 bp, Homo sapiens
agaagccgagagccttttgtg

SEQ ID NO: 3675980 - DNA, 16 bp, Homo sapiens
agaagcctctggctag

SEQ ID NO: 3675981 - DNA, 23 bp, Homo sapiens
agaagcctctggctagaggccag

SEQ ID NO: 3675982 - DNA, 23 bp, Homo sapiens
agaagctcctctccccagcccag

SEQ ID NO: 3675983 - DNA, 18 bp, Homo sapiens
agaaggtttcagaaagaa

SEQ ID NO: 3675984 - DNA, 16 bp, Homo sapiens
agaagtgaatgctggg

SEQ ID NO: 3675985 - DNA, 21 bp, Homo sapiens
agaagtgaatgctgggactca

SEQ ID NO: 3675986 - DNA, 22 bp, Homo sapiens
agaagtggagatttcagttcag

SEQ ID NO: 3675987 - DNA, 22 bp, Homo sapiens
agaagtttgagatcagcctggg

SEQ ID NO: 3675988 - DNA, 16 bp, Homo sapiens
agaagtttgcactatc

SEQ ID NO: 3675989 - DNA, 23 bp, Homo sapiens
agaagtttgcactatctttcagc

SEQ ID NO: 3675990 - DNA, 19 bp, Homo sapiens
agaataggcattaacacaa

SEQ ID NO: 3675991 - DNA, 16 bp, Homo sapiens
agaatattaatacaat

SEQ ID NO: 3675992 - DNA, 20 bp, Homo sapiens
agaatatttaaccccacaca

SEQ ID NO: 3675993 - DNA, 20 bp, Homo sapiens
agaatcttggtttgccttcc

SEQ ID NO: 3675994 - DNA, 16 bp, Homo sapiens
agaatgccggttaaat

SEQ ID NO: 3675995 - DNA, 14 bp, Homo sapiens
agaattaatttatt

SEQ ID NO: 3675996 - DNA, 22 bp, Homo sapiens
agaattgatcattttcccccca

SEQ ID NO: 3675997 - DNA, 23 bp, Homo sapiens
agaatttagtttgtactcagtgg

SEQ ID NO: 3675998 - DNA, 17 bp, Homo sapiens
agaattttaaatatttt

SEQ ID NO: 3675999 - DNA, 13 bp, Homo sapiens
agacaacaggcat

SEQ ID NO: 3676000 - DNA, 16 bp, Homo sapiens
aggccagagtggcctg

SEQ ID NO: 3676001 - DNA, 17 bp, Homo sapiens
aggccagagtggcctgg

SEQ ID NO: 3676002 - DNA, 19 bp, Homo sapiens
aggccagagtggcctggcc

SEQ ID NO: 3676003 - DNA, 17 bp, Homo sapiens
aggccagccccacccag

SEQ ID NO: 3676004 - DNA, 17 bp, Homo sapiens
aggccagctggcagcag

SEQ ID NO: 3676005 - DNA, 18 bp, Homo sapiens
aggccagctggcagcaga

SEQ ID NO: 3676006 - DNA, 20 bp, Homo sapiens
aggccagctggcagcagagt

SEQ ID NO: 3676007 - DNA, 14 bp, Homo sapiens
aggccatgtgcata

SEQ ID NO: 3676008 - DNA, 20 bp, Homo sapiens
aggccatgtgcatagtttct

SEQ ID NO: 3676009 - DNA, 17 bp, Homo sapiens
aggcccagttcaccctg

SEQ ID NO: 3676010 - DNA, 13 bp, Homo sapiens
aggccccactggg

SEQ ID NO: 3676011 - DNA, 17 bp, Homo sapiens
aggccccactggggaaa

SEQ ID NO: 3676012 - DNA, 15 bp, Homo sapiens
aggccccaggaagcc

SEQ ID NO: 3676013 - DNA, 16 bp, Homo sapiens
aggccccaggaagccg

SEQ ID NO: 3676014 - DNA, 17 bp, Homo sapiens
aggcccccacttgcctc

SEQ ID NO: 3676015 - DNA, 23 bp, Homo sapiens
aggcccccagcccagggctcctg

SEQ ID NO: 3676016 - DNA, 18 bp, Homo sapiens
aggcccgccctgcccggg

SEQ ID NO: 3676017 - DNA, 22 bp, Homo sapiens
aggccctccctgttccccagag

SEQ ID NO: 3676018 - DNA, 22 bp, Homo sapiens
aggccctggcctcccctgccac

SEQ ID NO: 3676019 - DNA, 19 bp, Homo sapiens
aggccggagaggagttcag

SEQ ID NO: 3676020 - DNA, 23 bp, Homo sapiens
aggccggagaggagttcaggaac

SEQ ID NO: 3676021 - DNA, 19 bp, Homo sapiens
aggcctaccccgcagacac

SEQ ID NO: 3676022 - DNA, 20 bp, Homo sapiens
aggcctgcgaccctgggggc

SEQ ID NO: 3676023 - DNA, 21 bp, Homo sapiens
aggcctgcgaccctgggggca

SEQ ID NO: 3676024 - DNA, 22 bp, Homo sapiens
aggcctggactttcctgcaact

SEQ ID NO: 3676025 - DNA, 22 bp, Homo sapiens
aggccttggcttgatggaagtg

SEQ ID NO: 3676026 - DNA, 13 bp, Homo sapiens
aggcggggctcct

SEQ ID NO: 3676027 - DNA, 17 bp, Homo sapiens
aggcgtggcttctgcag

SEQ ID NO: 3676028 - DNA, 18 bp, Homo sapiens
aggcgtggcttctgcagg

SEQ ID NO: 3676029 - DNA, 19 bp, Homo sapiens
aggctcctgtggtagtcct

SEQ ID NO: 3676030 - DNA, 15 bp, Homo sapiens
aggctccttcctgtg

SEQ ID NO: 3676031 - DNA, 20 bp, Homo sapiens
aggctccttcctgtgggtgg

SEQ ID NO: 3676032 - DNA, 21 bp, Homo sapiens
aggctccttcctgtgggtggg

SEQ ID NO: 3676033 - DNA, 22 bp, Homo sapiens
aggctcttagcagcttccagat

SEQ ID NO: 3676034 - DNA, 18 bp, Homo sapiens
aggctgaggaaaggccag

SEQ ID NO: 3676035 - DNA, 19 bp, Homo sapiens
aggctgaggaaaggccagc

SEQ ID NO: 3676036 - DNA, 16 bp, Homo sapiens
aggctgaggcctggac

SEQ ID NO: 3676037 - DNA, 17 bp, Homo sapiens
aggctgaggcctggact

SEQ ID NO: 3676038 - DNA, 21 bp, Homo sapiens
aggctgcaaggtttaggctgg

SEQ ID NO: 3676039 - DNA, 19 bp, Homo sapiens
aggctgcagtgagccgaga

SEQ ID NO: 3676040 - DNA, 14 bp, Homo sapiens
aggctgcccagagc

SEQ ID NO: 3676041 - DNA, 16 bp, Homo sapiens
aggctgcccagagctg

SEQ ID NO: 3676042 - DNA, 19 bp, Homo sapiens
aggctgctccctgagggcg

SEQ ID NO: 3676043 - DNA, 22 bp, Homo sapiens
aggctggattttgaattttctt

SEQ ID NO: 3676044 - DNA, 12 bp, Homo sapiens
aggctggcaggt

SEQ ID NO: 3676045 - DNA, 17 bp, Homo sapiens
aggctggccagtccagg

SEQ ID NO: 3676046 - DNA, 20 bp, Homo sapiens
aggctggcttgtcccctcct

SEQ ID NO: 3676047 - DNA, 22 bp, Homo sapiens
aggctgggggaagaagctctct

SEQ ID NO: 3676048 - DNA, 19 bp, Homo sapiens
aggctggtacaacggaggc

SEQ ID NO: 3676049 - DNA, 13 bp, Homo sapiens
aggctggtggccc

SEQ ID NO: 3676050 - DNA, 15 bp, Homo sapiens
aggctggtggcccag

SEQ ID NO: 3676051 - DNA, 17 bp, Homo sapiens
aggctggtggcccagga

SEQ ID NO: 3676052 - DNA, 16 bp, Homo sapiens
aggctgtcctgtacat

SEQ ID NO: 3676053 - DNA, 22 bp, Homo sapiens
aggctgtgtccctcttctcttc

SEQ ID NO: 3676054 - DNA, 22 bp, Homo sapiens
aggctgtgtttggctttcaggg

SEQ ID NO: 3676055 - DNA, 16 bp, Homo sapiens
aggcttaggcatgttc

SEQ ID NO: 3676056 - DNA, 13 bp, Homo sapiens
aggcttcttcctg

SEQ ID NO: 3676057 - DNA, 18 bp, Homo sapiens
aggcttcttcctggatgg

SEQ ID NO: 3676058 - DNA, 13 bp, Homo sapiens
aggcttgcccagg

SEQ ID NO: 3676059 - DNA, 18 bp, Homo sapiens
aggctttcccacttccca

SEQ ID NO: 3676060 - DNA, 22 bp, Homo sapiens
aggctttcccacttcccaccct

SEQ ID NO: 3676061 - DNA, 17 bp, Homo sapiens
agggaaaatgcagcagg

SEQ ID NO: 3676062 - DNA, 19 bp, Homo sapiens
agggaaaggtaggaagaga

SEQ ID NO: 3676063 - DNA, 21 bp, Homo sapiens
agggaaaggtaggaagagagg

SEQ ID NO: 3676064 - DNA, 22 bp, Homo sapiens
agggaacccagctctaatacat

SEQ ID NO: 3676065 - DNA, 20 bp, Homo sapiens
agggaagaaaaagcaagtgt

SEQ ID NO: 3676066 - DNA, 23 bp, Homo sapiens
agggaagaaaaagcaagtgttca

SEQ ID NO: 3676067 - DNA, 17 bp, Homo sapiens
agggacacatttctctg

SEQ ID NO: 3676068 - DNA, 14 bp, Homo sapiens
agggacacctggga

SEQ ID NO: 3676069 - DNA, 17 bp, Homo sapiens
agggacagaggccccag

SEQ ID NO: 3676070 - DNA, 20 bp, Homo sapiens
agggacagaggccccagcct

SEQ ID NO: 3676071 - DNA, 22 bp, Homo sapiens
agggacagatgaatgccgtgga

SEQ ID NO: 3676072 - DNA, 22 bp, Homo sapiens
agggaccttcatgcccttctga

SEQ ID NO: 3676073 - DNA, 17 bp, Homo sapiens
agggacgctttgtctgt

SEQ ID NO: 3676074 - DNA, 14 bp, Homo sapiens
agggagcggaaagc

SEQ ID NO: 3676075 - DNA, 16 bp, Homo sapiens
agggaggcaagccctg

SEQ ID NO: 3676076 - DNA, 16 bp, Homo sapiens
agggaggccccagggg

SEQ ID NO: 3676077 - DNA, 18 bp, Homo sapiens
agggaggggccggccctg

SEQ ID NO: 3676078 - DNA, 19 bp, Homo sapiens
agggaggggccggccctgt

SEQ ID NO: 3676079 - DNA, 22 bp, Homo sapiens
agggatctggtcctacccatcc

SEQ ID NO: 3676080 - DNA, 15 bp, Homo sapiens
agggatgccctggag

SEQ ID NO: 3676081 - DNA, 19 bp, Homo sapiens
agggatgccctggaggtgg

SEQ ID NO: 3676082 - DNA, 21 bp, Homo sapiens
agggatgccctggaggtggct

SEQ ID NO: 3676083 - DNA, 19 bp, Homo sapiens
agggattcaggctgcttgg

SEQ ID NO: 3676084 - DNA, 16 bp, Homo sapiens
agggcaaggccccttc

SEQ ID NO: 3676085 - DNA, 21 bp, Homo sapiens
agggcacaccgccatcctctg

SEQ ID NO: 3676086 - DNA, 14 bp, Homo sapiens
agggcaccaggggt

SEQ ID NO: 3676087 - DNA, 19 bp, Homo sapiens
agggcaccaggggtttctc

SEQ ID NO: 3676088 - DNA, 20 bp, Homo sapiens
agggcagactggggcatcct

SEQ ID NO: 3676089 - DNA, 18 bp, Homo sapiens
agggcaggtccagctctg

SEQ ID NO: 3676090 - DNA, 20 bp, Homo sapiens
agggcaggtccagctctgtg

SEQ ID NO: 3676091 - DNA, 22 bp, Homo sapiens
agggcaggtccagctctgtggg

SEQ ID NO: 3676092 - DNA, 13 bp, Homo sapiens
agggcagttttct

SEQ ID NO: 3676093 - DNA, 23 bp, Homo sapiens
agggccactggtccccaacaatg

SEQ ID NO: 3676094 - DNA, 12 bp, Homo sapiens
agggccagagcc

SEQ ID NO: 3676095 - DNA, 17 bp, Homo sapiens
agggccagtcctgcctg

SEQ ID NO: 3676096 - DNA, 18 bp, Homo sapiens
agggccagtcctgcctgg

SEQ ID NO: 3676097 - DNA, 23 bp, Homo sapiens
agggccagtcctgcctggccagg

SEQ ID NO: 3676098 - DNA, 23 bp, Homo sapiens
agggccatgctgaggcctgggcc

SEQ ID NO: 3676099 - DNA, 14 bp, Homo sapiens
agggccatggctca

SEQ ID NO: 3676100 - DNA, 12 bp, Homo sapiens
agggcccagagc

SEQ ID NO: 3676101 - DNA, 14 bp, Homo sapiens
agggcccagagccc

SEQ ID NO: 3676102 - DNA, 19 bp, Homo sapiens
agggcccagagcccagctc

SEQ ID NO: 3676103 - DNA, 16 bp, Homo sapiens
agggcccctctccaag

SEQ ID NO: 3676104 - DNA, 23 bp, Homo sapiens
agggcccctctccaagcgcctgg

SEQ ID NO: 3676105 - DNA, 16 bp, Homo sapiens
agggcggcaggggcct

SEQ ID NO: 3676106 - DNA, 19 bp, Homo sapiens
agggcggcaggggcctgga

SEQ ID NO: 3676107 - DNA, 23 bp, Homo sapiens
agggcggcaggggcctggagatc

SEQ ID NO: 3676108 - DNA, 22 bp, Homo sapiens
agggctagtgacttgtgtccca

SEQ ID NO: 3676109 - DNA, 24 bp, Homo sapiens
agggctagtgacttgtgtcccatg

SEQ ID NO: 3676110 - DNA, 13 bp, Homo sapiens
agggctcctccct

SEQ ID NO: 3676111 - DNA, 16 bp, Homo sapiens
agggctcctccctgga

SEQ ID NO: 3676112 - DNA, 18 bp, Homo sapiens
agggctcctccctggagc

SEQ ID NO: 3676113 - DNA, 14 bp, Homo sapiens
agggcttctcctgc

SEQ ID NO: 3676114 - DNA, 23 bp, Homo sapiens
agggcttctcctgcgggggcgag

SEQ ID NO: 3676115 - DNA, 23 bp, Homo sapiens
agggcttctgccatttctgagat

SEQ ID NO: 3676116 - DNA, 20 bp, Homo sapiens
aggggaaagacttccatcta

SEQ ID NO: 3676117 - DNA, 15 bp, Homo sapiens
aggggaatcagaact

SEQ ID NO: 3676118 - DNA, 21 bp, Homo sapiens
aggggactaattcactggcga

SEQ ID NO: 3676119 - DNA, 14 bp, Homo sapiens
aggggactcagccc

SEQ ID NO: 3676120 - DNA, 17 bp, Homo sapiens
aggggactcagccctga

SEQ ID NO: 3676121 - DNA, 23 bp, Homo sapiens
aggggagcatgcttccctgcagc

SEQ ID NO: 3676122 - DNA, 12 bp, Homo sapiens
aggggagcccac

SEQ ID NO: 3676123 - DNA, 21 bp, Homo sapiens
aggggagcccactgtcctggg

SEQ ID NO: 3676124 - DNA, 15 bp, Homo sapiens
aggggcacagggtct

SEQ ID NO: 3676125 - DNA, 14 bp, Homo sapiens
aggggcatctgccc

SEQ ID NO: 3676126 - DNA, 19 bp, Homo sapiens
aggggcatctgcccctccc

SEQ ID NO: 3676127 - DNA, 20 bp, Homo sapiens
aggggcatctgcccctcccc

SEQ ID NO: 3676128 - DNA, 15 bp, Homo sapiens
aggggcccggccagc

SEQ ID NO: 3676129 - DNA, 21 bp, Homo sapiens
aggggcccggccagccatgtc

SEQ ID NO: 3676130 - DNA, 23 bp, Homo sapiens
aggggcccggccagccatgtctg

SEQ ID NO: 3676131 - DNA, 15 bp, Homo sapiens
aggggccctacctgg

SEQ ID NO: 3676132 - DNA, 17 bp, Homo sapiens
aggggccctacctgggg

SEQ ID NO: 3676133 - DNA, 18 bp, Homo sapiens
aggggccctacctgggga

SEQ ID NO: 3676134 - DNA, 16 bp, Homo sapiens
aggggcctaggcctca

SEQ ID NO: 3676135 - DNA, 21 bp, Homo sapiens
aggggcctggagatcctcctg

SEQ ID NO: 3676136 - DNA, 18 bp, Homo sapiens
aggggctgcttcctcctg

SEQ ID NO: 3676137 - DNA, 20 bp, Homo sapiens
aggggctgcttcctcctgga

SEQ ID NO: 3676138 - DNA, 21 bp, Homo sapiens
aggggctgcttcctcctggaa

SEQ ID NO: 3676139 - DNA, 16 bp, Homo sapiens
agggggaattcctgga

SEQ ID NO: 3676140 - DNA, 17 bp, Homo sapiens
agggggaattcctggaa

SEQ ID NO: 3676141 - DNA, 19 bp, Homo sapiens
agggggatccgactgcttt

SEQ ID NO: 3676142 - DNA, 15 bp, Homo sapiens
aggggtcccagccac

SEQ ID NO: 3676143 - DNA, 15 bp, Homo sapiens
aggggtcggctgacc

SEQ ID NO: 3676144 - DNA, 14 bp, Homo sapiens
aggggtgtcttggg

SEQ ID NO: 3676145 - DNA, 24 bp, Homo sapiens
aggggtgtcttgggcagagctggc

SEQ ID NO: 3676146 - DNA, 18 bp, Homo sapiens
aggggttaacttggtcag

SEQ ID NO: 3676147 - DNA, 19 bp, Homo sapiens
aggggttggtatctcaggt

SEQ ID NO: 3676148 - DNA, 17 bp, Homo sapiens
agggtcctggctcctga

SEQ ID NO: 3676149 - DNA, 19 bp, Homo sapiens
agggtcctggctcctgagg

SEQ ID NO: 3676150 - DNA, 14 bp, Homo sapiens
agggtctgctcttt

SEQ ID NO: 3676151 - DNA, 23 bp, Homo sapiens
agggtctgctctttctctgccag

SEQ ID NO: 3676152 - DNA, 15 bp, Homo sapiens
agggtcttccctacc

SEQ ID NO: 3676153 - DNA, 19 bp, Homo sapiens
agggtggctttgcatttct

SEQ ID NO: 3676154 - DNA, 19 bp, Homo sapiens
agggttctaacctttctaa

SEQ ID NO: 3676155 - DNA, 17 bp, Homo sapiens
agggtttgacatttcat

SEQ ID NO: 3676156 - DNA, 22 bp, Homo sapiens
aggtaaaatgccatgatgcctc

SEQ ID NO: 3676157 - DNA, 22 bp, Homo sapiens
aggtactgtcatgggctaggca

SEQ ID NO: 3676158 - DNA, 20 bp, Homo sapiens
aggtatgaccttctaggaag

SEQ ID NO: 3676159 - DNA, 22 bp, Homo sapiens
aggtatggaagggtttgtggct

SEQ ID NO: 3676160 - DNA, 15 bp, Homo sapiens
aggtatgtctgtgcc

SEQ ID NO: 3676161 - DNA, 22 bp, Homo sapiens
aggtcaatacagtacaggcagc

SEQ ID NO: 3676162 - DNA, 15 bp, Homo sapiens
aggtcaccctttgct

SEQ ID NO: 3676163 - DNA, 13 bp, Homo sapiens
aggtccagctctg

SEQ ID NO: 3676164 - DNA, 17 bp, Homo sapiens
aggtccagctctggagg

SEQ ID NO: 3676165 - DNA, 20 bp, Homo sapiens
aggtccagctctgtgggccc

SEQ ID NO: 3676166 - DNA, 22 bp, Homo sapiens
aggtcccctcgtcccatccagc

SEQ ID NO: 3676167 - DNA, 22 bp, Homo sapiens
aggtcggtaggttcagccaagg

SEQ ID NO: 3676168 - DNA, 16 bp, Homo sapiens
aggtcttgctggaaga

SEQ ID NO: 3676169 - DNA, 18 bp, Homo sapiens
aggtctttcagtactttt

SEQ ID NO: 3676170 - DNA, 14 bp, Homo sapiens
aggtgaaagggagc

SEQ ID NO: 3676171 - DNA, 23 bp, Homo sapiens
aggtgagaagcagaggaaggaga

SEQ ID NO: 3676172 - DNA, 13 bp, Homo sapiens
aggtgagggttgg

SEQ ID NO: 3676173 - DNA, 11 bp, Homo sapiens
aggtgcagagg

SEQ ID NO: 3676174 - DNA, 20 bp, Homo sapiens
aggtgcccttggaggccagc

SEQ ID NO: 3676175 - DNA, 21 bp, Homo sapiens
aggtgcccttggaggccagcc

SEQ ID NO: 3676176 - DNA, 22 bp, Homo sapiens
aggtgcccttggaggccagcca

SEQ ID NO: 3676177 - DNA, 19 bp, Homo sapiens
aggtgcctttcaaatttag

SEQ ID NO: 3676178 - DNA, 18 bp, Homo sapiens
aggtggatctccttgaga

SEQ ID NO: 3676179 - DNA, 16 bp, Homo sapiens
aggtggatggccccag

SEQ ID NO: 3676180 - DNA, 17 bp, Homo sapiens
aggtggttatggagagg

SEQ ID NO: 3676181 - DNA, 15 bp, Homo sapiens
aggtgtgcccctcca

SEQ ID NO: 3676182 - DNA, 22 bp, Homo sapiens
aggtgttgccaaatatgtcctg

SEQ ID NO: 3676183 - DNA, 23 bp, Homo sapiens
aggtgttgccaaatatgtcctgg

SEQ ID NO: 3676184 - DNA, 18 bp, Homo sapiens
aggtgttggtgacaattg

SEQ ID NO: 3676185 - DNA, 14 bp, Homo sapiens
aggttcaacttatt

SEQ ID NO: 3676186 - DNA, 16 bp, Homo sapiens
aggttccatccacccc

SEQ ID NO: 3676187 - DNA, 16 bp, Homo sapiens
aggttccgatgttatt

SEQ ID NO: 3676188 - DNA, 22 bp, Homo sapiens
aggttctccgttagctcctgtg

SEQ ID NO: 3676189 - DNA, 16 bp, Homo sapiens
aggttgctgtttcaca

SEQ ID NO: 3676190 - DNA, 20 bp, Homo sapiens
aggttggcaaaaaggcagga

SEQ ID NO: 3676191 - DNA, 18 bp, Homo sapiens
aggttgggcttccatgcc

SEQ ID NO: 3676192 - DNA, 18 bp, Homo sapiens
aggtttaggctggtggcc

SEQ ID NO: 3676193 - DNA, 23 bp, Homo sapiens
aggtttctgaaaattaacactgc

SEQ ID NO: 3676194 - DNA, 21 bp, Homo sapiens
agtaacaattcagatccagtg

SEQ ID NO: 3676195 - DNA, 23 bp, Homo sapiens
agtaactgtcaggctgaaaacaa

SEQ ID NO: 3676196 - DNA, 22 bp, Homo sapiens
agtaatttattgtctgtctaca

SEQ ID NO: 3676197 - DNA, 14 bp, Homo sapiens
agtaatttcttttt

SEQ ID NO: 3676198 - DNA, 21 bp, Homo sapiens
agtaatttctttttttccttt

SEQ ID NO: 3676199 - DNA, 19 bp, Homo sapiens
agtacaggcagcacagaga

SEQ ID NO: 3676200 - DNA, 13 bp, Homo sapiens
agtactcctccct

SEQ ID NO: 3676201 - DNA, 16 bp, Homo sapiens
agtactcctccctggg

SEQ ID NO: 3676202 - DNA, 12 bp, Homo sapiens
agtacttatctt

SEQ ID NO: 3676203 - DNA, 13 bp, Homo sapiens
agtacttttttaa

SEQ ID NO: 3676204 - DNA, 20 bp, Homo sapiens
agtagaaagacagagctggg

SEQ ID NO: 3676205 - DNA, 21 bp, Homo sapiens
agtagaaagacagagctggga

SEQ ID NO: 3676206 - DNA, 14 bp, Homo sapiens
agtagaatctcagt

SEQ ID NO: 3676207 - DNA, 14 bp, Homo sapiens
agtagggtttgaca

SEQ ID NO: 3676208 - DNA, 12 bp, Homo sapiens
agtagtcctgtg

SEQ ID NO: 3676209 - DNA, 17 bp, Homo sapiens
agtatacctatcactta

SEQ ID NO: 3676210 - DNA, 21 bp, Homo sapiens
agtatccatgctcttgacctt

SEQ ID NO: 3676211 - DNA, 18 bp, Homo sapiens
agtatctcctcgcaagct

SEQ ID NO: 3676212 - DNA, 19 bp, Homo sapiens
agtatctcctcgcaagctg

SEQ ID NO: 3676213 - DNA, 12 bp, Homo sapiens
agtattgtaaat

SEQ ID NO: 3676214 - DNA, 13 bp, Homo sapiens
agtattgtaaatt

SEQ ID NO: 3676215 - DNA, 15 bp, Homo sapiens
agtattgtaaattat

SEQ ID NO: 3676216 - DNA, 17 bp, Homo sapiens
agtattgtaaattatat

SEQ ID NO: 3676217 - DNA, 22 bp, Homo sapiens
agtattgtaaattatatttgtg

SEQ ID NO: 3676218 - DNA, 11 bp, Homo sapiens
agtatttctga

SEQ ID NO: 3676219 - DNA, 13 bp, Homo sapiens
agtatttgattca

SEQ ID NO: 3676220 - DNA, 20 bp, Homo sapiens
agtatttgattcaaaatatt

SEQ ID NO: 3676221 - DNA, 18 bp, Homo sapiens
agtattttagtgaacttg

SEQ ID NO: 3676222 - DNA, 14 bp, Homo sapiens
agtcaagaagaaaa

SEQ ID NO: 3676223 - DNA, 15 bp, Homo sapiens
agtcaagctcctcct

SEQ ID NO: 3676224 - DNA, 16 bp, Homo sapiens
agtcaagtgaaaaagg

SEQ ID NO: 3676225 - DNA, 18 bp, Homo sapiens
agtcaatcaagtctgttt

SEQ ID NO: 3676226 - DNA, 15 bp, Homo sapiens
agtcatctcaaccat

SEQ ID NO: 3676227 - DNA, 21 bp, Homo sapiens
agtcatcttgaccaagcagga

SEQ ID NO: 3676228 - DNA, 18 bp, Homo sapiens
agtcatggagaaccacct

SEQ ID NO: 3676229 - DNA, 13 bp, Homo sapiens
agtcattcagcag

SEQ ID NO: 3676230 - DNA, 19 bp, Homo sapiens
agtccaaatgtcctccaga

SEQ ID NO: 3676231 - DNA, 14 bp, Homo sapiens
agtccaattttaat

SEQ ID NO: 3676232 - DNA, 16 bp, Homo sapiens
agtccaccctgcctgc

SEQ ID NO: 3676233 - DNA, 17 bp, Homo sapiens
agtccaccctgcctgcc

SEQ ID NO: 3676234 - DNA, 18 bp, Homo sapiens
agtccaggctgccgtggg

SEQ ID NO: 3676235 - DNA, 13 bp, Homo sapiens
agtcccttcccct

SEQ ID NO: 3676236 - DNA, 17 bp, Homo sapiens
agtcccttcccctccct

SEQ ID NO: 3676237 - DNA, 20 bp, Homo sapiens
agtcccttcccctccctggc

SEQ ID NO: 3676238 - DNA, 21 bp, Homo sapiens
agtccgtgctgacagctgctc

SEQ ID NO: 3676239 - DNA, 16 bp, Homo sapiens
agtcctcccaagctgt

SEQ ID NO: 3676240 - DNA, 21 bp, Homo sapiens
agtcctcccaagctgtgctgg

SEQ ID NO: 3676241 - DNA, 14 bp, Homo sapiens
agtcctctgtggcc

SEQ ID NO: 3676242 - DNA, 14 bp, Homo sapiens
agtcctgcctggcc

SEQ ID NO: 3676243 - DNA, 16 bp, Homo sapiens
agtcctgcctggccag

SEQ ID NO: 3676244 - DNA, 23 bp, Homo sapiens
agtcctggttgtctgaacccagg

SEQ ID NO: 3676245 - DNA, 20 bp, Homo sapiens
agtcggaacggagaaaggtg

SEQ ID NO: 3676246 - DNA, 12 bp, Homo sapiens
agtcgtgcctgt

SEQ ID NO: 3676247 - DNA, 17 bp, Homo sapiens
agtcgtggggtgtgctg

SEQ ID NO: 3676248 - DNA, 19 bp, Homo sapiens
agtcgtggggtgtgctggg

SEQ ID NO: 3676249 - DNA, 17 bp, Homo sapiens
agtctagatggctcctc

SEQ ID NO: 3676250 - DNA, 14 bp, Homo sapiens
agtctgaagcagat

SEQ ID NO: 3676251 - DNA, 15 bp, Homo sapiens
agtctgtcctgtgac

SEQ ID NO: 3676252 - DNA, 16 bp, Homo sapiens
agtcttgaatttctga

SEQ ID NO: 3676253 - DNA, 20 bp, Homo sapiens
agtgaaaaaggaggaagaga

SEQ ID NO: 3676254 - DNA, 14 bp, Homo sapiens
agtgaagacagaag

SEQ ID NO: 3676255 - DNA, 15 bp, Homo sapiens
agtgaatgctgggac

SEQ ID NO: 3676256 - DNA, 24 bp, Homo sapiens
agtgacaaataaattaggaccaag

SEQ ID NO: 3676257 - DNA, 23 bp, Homo sapiens
agtgacacaatctcagctcactg

SEQ ID NO: 3676258 - DNA, 21 bp, Homo sapiens
agtgacacccaagagggctgc

SEQ ID NO: 3676259 - DNA, 19 bp, Homo sapiens
agtgacagttgcagccctt

SEQ ID NO: 3676260 - DNA, 22 bp, Homo sapiens
agtgacataatatattctattt

SEQ ID NO: 3676261 - DNA, 15 bp, Homo sapiens
agtgacctgaggaag

SEQ ID NO: 3676262 - DNA, 18 bp, Homo sapiens
agtgacctgaggaagcgt

SEQ ID NO: 3676263 - DNA, 18 bp, Homo sapiens
agtgacttgtgtcccatg

SEQ ID NO: 3676264 - DNA, 15 bp, Homo sapiens
agtgagcactgaaac

SEQ ID NO: 3676265 - DNA, 17 bp, Homo sapiens
agtgatagtcttttgct

SEQ ID NO: 3676266 - DNA, 12 bp, Homo sapiens
agtgatccaggg

SEQ ID NO: 3676267 - DNA, 17 bp, Homo sapiens
agtgatgtatacatctt

SEQ ID NO: 3676268 - DNA, 17 bp, Homo sapiens
agtgatgtgtttacatt

SEQ ID NO: 3676269 - DNA, 15 bp, Homo sapiens
agtgattttcattgt

SEQ ID NO: 3676270 - DNA, 23 bp, Homo sapiens
agtgcagcagaggacagtctgga

SEQ ID NO: 3676271 - DNA, 20 bp, Homo sapiens
agtgcatgcattgagctgcc

SEQ ID NO: 3676272 - DNA, 19 bp, Homo sapiens
agtgcatggtggccagagg

SEQ ID NO: 3676273 - DNA, 17 bp, Homo sapiens
agtgcatttttgtaaat

SEQ ID NO: 3676274 - DNA, 16 bp, Homo sapiens
agtgccttctaaaggt

SEQ ID NO: 3676275 - DNA, 15 bp, Homo sapiens
agtgctgaacagtgg

SEQ ID NO: 3676276 - DNA, 11 bp, Homo sapiens
agtggaaaaat

SEQ ID NO: 3676277 - DNA, 14 bp, Homo sapiens
agtggaggtttgtc

SEQ ID NO: 3676278 - DNA, 14 bp, Homo sapiens
agtggccactaagc

SEQ ID NO: 3676279 - DNA, 20 bp, Homo sapiens
agtggccactaagcagagga

SEQ ID NO: 3676280 - DNA, 17 bp, Homo sapiens
agtggctggtccagggc

SEQ ID NO: 3676281 - DNA, 14 bp, Homo sapiens
agtgggagccaggg

SEQ ID NO: 3676282 - DNA, 18 bp, Homo sapiens
agtgggcccacccggtgg

SEQ ID NO: 3676283 - DNA, 20 bp, Homo sapiens
agtgggctgtttctgcttat

SEQ ID NO: 3676284 - DNA, 18 bp, Homo sapiens
agtggtggtaaccctggt

SEQ ID NO: 3676285 - DNA, 20 bp, Homo sapiens
agtgtacatttctataaata

SEQ ID NO: 3676286 - DNA, 22 bp, Homo sapiens
agtgtgcactaaggggcccggc

SEQ ID NO: 3676287 - DNA, 15 bp, Homo sapiens
agtgtggcaaaataa

SEQ ID NO: 3676288 - DNA, 17 bp, Homo sapiens
agtgtggggagggcagg

SEQ ID NO: 3676289 - DNA, 23 bp, Homo sapiens
agtgttcacaacctggaagtgct

SEQ ID NO: 3676290 - DNA, 22 bp, Homo sapiens
agtgttctgtttgttattgttt

SEQ ID NO: 3676291 - DNA, 14 bp, Homo sapiens
agtgtttgaaaaag

SEQ ID NO: 3676292 - DNA, 14 bp, Homo sapiens
agttaactgtgaaa

SEQ ID NO: 3676293 - DNA, 16 bp, Homo sapiens
agttaagacctggcag

SEQ ID NO: 3676294 - DNA, 17 bp, Homo sapiens
agttaagacctggcagc

SEQ ID NO: 3676295 - DNA, 22 bp, Homo sapiens
agttatatttcagatgtaatgt

SEQ ID NO: 3676296 - DNA, 23 bp, Homo sapiens
agttatatttcagatgtaatgtt

SEQ ID NO: 3676297 - DNA, 13 bp, Homo sapiens
agttatgttttac

SEQ ID NO: 3676298 - DNA, 19 bp, Homo sapiens
agttatgttttacatgccc

SEQ ID NO: 3676299 - DNA, 20 bp, Homo sapiens
agttattacatgtaatttga

SEQ ID NO: 3676300 - DNA, 15 bp, Homo sapiens
agttcagcaccaccc

SEQ ID NO: 3676301 - DNA, 20 bp, Homo sapiens
agttcaggaacccttctcca

SEQ ID NO: 3676302 - DNA, 16 bp, Homo sapiens
agttcatgtctgctat

SEQ ID NO: 3676303 - DNA, 13 bp, Homo sapiens
agttcccttggcc

SEQ ID NO: 3676304 - DNA, 15 bp, Homo sapiens
agttcccttggcctc

SEQ ID NO: 3676305 - DNA, 16 bp, Homo sapiens
agttcccttggcctca

SEQ ID NO: 3676306 - DNA, 18 bp, Homo sapiens
agttcccttggcctcaga

SEQ ID NO: 3676307 - DNA, 15 bp, Homo sapiens
agttcttgtggaaga

SEQ ID NO: 3676308 - DNA, 17 bp, Homo sapiens
agttcttgtggaagaca

SEQ ID NO: 3676309 - DNA, 17 bp, Homo sapiens
agttctttaaaatgtaa

SEQ ID NO: 3676310 - DNA, 16 bp, Homo sapiens
agttctttgggccaga

SEQ ID NO: 3676311 - DNA, 21 bp, Homo sapiens
agttctttgggccagacatgc

SEQ ID NO: 3676312 - DNA, 17 bp, Homo sapiens
agttgaaaaacagctga

SEQ ID NO: 3676313 - DNA, 17 bp, Homo sapiens
agttgaagactttgttt

SEQ ID NO: 3676314 - DNA, 15 bp, Homo sapiens
agttgaagtttagga

SEQ ID NO: 3676315 - DNA, 13 bp, Homo sapiens
agttgatctggaa

SEQ ID NO: 3676316 - DNA, 17 bp, Homo sapiens
agttgatctggaaccca

SEQ ID NO: 3676317 - DNA, 19 bp, Homo sapiens
agttgatctggaacccaga

SEQ ID NO: 3676318 - DNA, 13 bp, Homo sapiens
agttgattcagct

SEQ ID NO: 3676319 - DNA, 17 bp, Homo sapiens
agttgattcagctctgc

SEQ ID NO: 3676320 - DNA, 18 bp, Homo sapiens
agttgatttaaactctta

SEQ ID NO: 3676321 - DNA, 16 bp, Homo sapiens
agttgattttctggat

SEQ ID NO: 3676322 - DNA, 13 bp, Homo sapiens
agttgctattttt

SEQ ID NO: 3676323 - DNA, 19 bp, Homo sapiens
agttgctatttttgtaaag

SEQ ID NO: 3676324 - DNA, 13 bp, Homo sapiens
agtttaggccttg

SEQ ID NO: 3676325 - DNA, 12 bp, Homo sapiens
agtttcctgaaa

SEQ ID NO: 3676326 - DNA, 16 bp, Homo sapiens
agtttctttattttgt

SEQ ID NO: 3676327 - DNA, 22 bp, Homo sapiens
agtttctttattttgtgtaaaa

SEQ ID NO: 3676328 - DNA, 23 bp, Homo sapiens
agtttgctagcagaaatctagaa

SEQ ID NO: 3676329 - DNA, 17 bp, Homo sapiens
agtttgtcgctcatgtg

SEQ ID NO: 3676330 - DNA, 16 bp, Homo sapiens
agttttcctatgcttt

SEQ ID NO: 3676331 - DNA, 18 bp, Homo sapiens
agttttcctatgctttga

SEQ ID NO: 3676332 - DNA, 12 bp, Homo sapiens
agttttctctta

SEQ ID NO: 3676333 - DNA, 23 bp, Homo sapiens
agttttgttttaaaactggacct

SEQ ID NO: 3676334 - DNA, 17 bp, Homo sapiens
agtttttacaagatgta

SEQ ID NO: 3676335 - DNA, 18 bp, Homo sapiens
agtttttattccttgtga

SEQ ID NO: 3676336 - DNA, 14 bp, Homo sapiens
agtttttctgaaag

SEQ ID NO: 3676337 - DNA, 16 bp, Homo sapiens
agtttttctgaaagtg

SEQ ID NO: 3676338 - DNA, 22 bp, Homo sapiens
agtttttggagtgttatgtatt

SEQ ID NO: 3676339 - DNA, 23 bp, Homo sapiens
agtttttggagtgttatgtattt

SEQ ID NO: 3676340 - DNA, 21 bp, Homo sapiens
ataaaaaggcacctataaaac

SEQ ID NO: 3676341 - DNA, 18 bp, Homo sapiens
ataaaaattactgtgtta

SEQ ID NO: 3676342 - DNA, 16 bp, Homo sapiens
ataaaacaggtcaata

SEQ ID NO: 3676343 - DNA, 15 bp, Homo sapiens
ataaaactggctttg

SEQ ID NO: 3676344 - DNA, 16 bp, Homo sapiens
ataaaatactaaacta

SEQ ID NO: 3676345 - DNA, 16 bp, Homo sapiens
ataaactgtgtttact

SEQ ID NO: 3676346 - DNA, 16 bp, Homo sapiens
ataaacttaaaaagaa

SEQ ID NO: 3676347 - DNA, 20 bp, Homo sapiens
ataaactttaatataaagta

SEQ ID NO: 3676348 - DNA, 21 bp, Homo sapiens
ataaagataacccttattcca

SEQ ID NO: 3676349 - DNA, 14 bp, Homo sapiens
ataaagggaacaaa

SEQ ID NO: 3676350 - DNA, 17 bp, Homo sapiens
ataaagtagtcctgtga

SEQ ID NO: 3676351 - DNA, 13 bp, Homo sapiens
ataaatacagcta

SEQ ID NO: 3676352 - DNA, 21 bp, Homo sapiens
ataaatagatgctgtgtatat

SEQ ID NO: 3676353 - DNA, 16 bp, Homo sapiens
ataaatctgacccagt

SEQ ID NO: 3676354 - DNA, 18 bp, Homo sapiens
ataaatctgacccagtgc

SEQ ID NO: 3676355 - DNA, 19 bp, Homo sapiens
ataaatctgacccagtgcc

SEQ ID NO: 3676356 - DNA, 13 bp, Homo sapiens
ataaattcctctt

SEQ ID NO: 3676357 - DNA, 15 bp, Homo sapiens
ataaatttatatgaa

SEQ ID NO: 3676358 - DNA, 18 bp, Homo sapiens
ataacaactatttacata

SEQ ID NO: 3676359 - DNA, 14 bp, Homo sapiens
ataacatatatgga

SEQ ID NO: 3676360 - DNA, 15 bp, Homo sapiens
ataagagcagtcaca

SEQ ID NO: 3676361 - DNA, 17 bp, Homo sapiens
ataataagcaggatgtt

SEQ ID NO: 3676362 - DNA, 22 bp, Homo sapiens
ataatactgctgagatacatac

SEQ ID NO: 3676363 - DNA, 14 bp, Homo sapiens
ataatatctaaagt

SEQ ID NO: 3676364 - DNA, 19 bp, Homo sapiens
ataatatctaaagttatat

SEQ ID NO: 3676365 - DNA, 14 bp, Homo sapiens
ataatatttttaat

SEQ ID NO: 3676366 - DNA, 17 bp, Homo sapiens
ataatgctaatttaaag

SEQ ID NO: 3676367 - DNA, 23 bp, Homo sapiens
ataatgggccactgaaatctgtc

SEQ ID NO: 3676368 - DNA, 15 bp, Homo sapiens
atacaaaaatttgcc

SEQ ID NO: 3676369 - DNA, 14 bp, Homo sapiens
atacactaaaaatc

SEQ ID NO: 3676370 - DNA, 16 bp, Homo sapiens
atacagaggcaactgc

SEQ ID NO: 3676371 - DNA, 15 bp, Homo sapiens
atacagtacaggcag

SEQ ID NO: 3676372 - DNA, 15 bp, Homo sapiens
atacatacaccagca

SEQ ID NO: 3676373 - DNA, 17 bp, Homo sapiens
atacatacagaattact

SEQ ID NO: 3676374 - DNA, 20 bp, Homo sapiens
atacatatatatatataaca

SEQ ID NO: 3676375 - DNA, 20 bp, Homo sapiens
ataccacaagcctgagaact

SEQ ID NO: 3676376 - DNA, 15 bp, Homo sapiens
ataccagagccttca

SEQ ID NO: 3676377 - DNA, 19 bp, Homo sapiens
ataccaggttacctcactt

SEQ ID NO: 3676378 - DNA, 19 bp, Homo sapiens
atacccacaatctgagcac

SEQ ID NO: 3676379 - DNA, 17 bp, Homo sapiens
atacggggtcttgctct

SEQ ID NO: 3676380 - DNA, 14 bp, Homo sapiens
atactgagggacca

SEQ ID NO: 3676381 - DNA, 22 bp, Homo sapiens
atactgagggaccaactgggcc

SEQ ID NO: 3676382 - DNA, 19 bp, Homo sapiens
atactgcgactttctgcct

SEQ ID NO: 3676383 - DNA, 22 bp, Homo sapiens
atactgcgactttctgcctgga

SEQ ID NO: 3676384 - DNA, 19 bp, Homo sapiens
atactgctgagatacatac

SEQ ID NO: 3676385 - DNA, 15 bp, Homo sapiens
atactgcttggagct

SEQ ID NO: 3676386 - DNA, 13 bp, Homo sapiens
atactgcttgtca

SEQ ID NO: 3676387 - DNA, 11 bp, Homo sapiens
atacttaagaa

SEQ ID NO: 3676388 - DNA, 14 bp, Homo sapiens
atacttaagaatac

SEQ ID NO: 3676389 - DNA, 18 bp, Homo sapiens
atacttgaactgttgccc

SEQ ID NO: 3676390 - DNA, 16 bp, Homo sapiens
atacttgaagggccag

SEQ ID NO: 3676391 - DNA, 18 bp, Homo sapiens
atacttgaagggccagag

SEQ ID NO: 3676392 - DNA, 19 bp, Homo sapiens
atacttgaagggccagagc

SEQ ID NO: 3676393 - DNA, 22 bp, Homo sapiens
atacttgaagggccagagccag

SEQ ID NO: 3676394 - DNA, 23 bp, Homo sapiens
atacttgaagggccagagccagg

SEQ ID NO: 3676395 - DNA, 18 bp, Homo sapiens
atactttgcaatccaaat

SEQ ID NO: 3676396 - DNA, 17 bp, Homo sapiens
atactttttctaatgag

SEQ ID NO: 3676397 - DNA, 13 bp, Homo sapiens
atagaaaagttat

SEQ ID NO: 3676398 - DNA, 12 bp, Homo sapiens
atagaaatgcca

SEQ ID NO: 3676399 - DNA, 16 bp, Homo sapiens
atagaaatgccaagca

SEQ ID NO: 3676400 - DNA, 17 bp, Homo sapiens
atagaaatgccaagcac

SEQ ID NO: 3676401 - DNA, 19 bp, Homo sapiens
atagaaatgccaagcactt

SEQ ID NO: 3676402 - DNA, 16 bp, Homo sapiens
atagactcctttgcta

SEQ ID NO: 3676403 - DNA, 22 bp, Homo sapiens
atagcccaaagccaagaaagaa

SEQ ID NO: 3676404 - DNA, 11 bp, Homo sapiens
atagcctggac

SEQ ID NO: 3676405 - DNA, 21 bp, Homo sapiens
atagcgctgtttttgttgtgt

SEQ ID NO: 3676406 - DNA, 13 bp, Homo sapiens
ataggctccttcc

SEQ ID NO: 3676407 - DNA, 17 bp, Homo sapiens
atagggaatatatctct

SEQ ID NO: 3676408 - DNA, 13 bp, Homo sapiens
atagtaaaaataa

SEQ ID NO: 3676409 - DNA, 21 bp, Homo sapiens
atagtatttgattcaaaatat

SEQ ID NO: 3676410 - DNA, 13 bp, Homo sapiens
atagtctgtgtga

SEQ ID NO: 3676411 - DNA, 16 bp, Homo sapiens
atagtcttttgctttt

SEQ ID NO: 3676412 - DNA, 22 bp, Homo sapiens
atatactattaaaaaggtttac

SEQ ID NO: 3676413 - DNA, 18 bp, Homo sapiens
atataggacaaaatgtta

SEQ ID NO: 3676414 - DNA, 16 bp, Homo sapiens
atatatctctatttga

SEQ ID NO: 3676415 - DNA, 15 bp, Homo sapiens
atatatggaagagga

SEQ ID NO: 3676416 - DNA, 13 bp, Homo sapiens
atatatgtatttt

SEQ ID NO: 3676417 - DNA, 13 bp, Homo sapiens
atatattgtatta

SEQ ID NO: 3676418 - DNA, 12 bp, Homo sapiens
atatatttctat

SEQ ID NO: 3676419 - DNA, 13 bp, Homo sapiens
atatatttctatt

SEQ ID NO: 3676420 - DNA, 13 bp, Homo sapiens
atatcagtttgct

SEQ ID NO: 3676421 - DNA, 14 bp, Homo sapiens
atatctaaagttat

SEQ ID NO: 3676422 - DNA, 19 bp, Homo sapiens
atatctatatatataattt

SEQ ID NO: 3676423 - DNA, 13 bp, Homo sapiens
atatctcctggaa

SEQ ID NO: 3676424 - DNA, 14 bp, Homo sapiens
atatctctatttga

SEQ ID NO: 3676425 - DNA, 15 bp, Homo sapiens
atatgactttttata

SEQ ID NO: 3676426 - DNA, 20 bp, Homo sapiens
atatggggatgcagcattat

SEQ ID NO: 3676427 - DNA, 16 bp, Homo sapiens
atattaagaactgctg

SEQ ID NO: 3676428 - DNA, 14 bp, Homo sapiens
atattatgagatgc

SEQ ID NO: 3676429 - DNA, 15 bp, Homo sapiens
atattatgagatgct

SEQ ID NO: 3676430 - DNA, 16 bp, Homo sapiens
atattctaaaaccatt

SEQ ID NO: 3676431 - DNA, 15 bp, Homo sapiens
atattcttgtgcttt

SEQ ID NO: 3676432 - DNA, 14 bp, Homo sapiens
atatttaaaaatgt

SEQ ID NO: 3676433 - DNA, 13 bp, Homo sapiens
atatttaactggt

SEQ ID NO: 3676434 - DNA, 16 bp, Homo sapiens
atatttaactggtgca

SEQ ID NO: 3676435 - DNA, 14 bp, Homo sapiens
atatttaatgtttt

SEQ ID NO: 3676436 - DNA, 15 bp, Homo sapiens
atatttaatgtttta

SEQ ID NO: 3676437 - DNA, 21 bp, Homo sapiens
atatttaatgttttaaatgta

SEQ ID NO: 3676438 - DNA, 22 bp, Homo sapiens
atatttaatgttttaaatgtac

SEQ ID NO: 3676439 - DNA, 19 bp, Homo sapiens
atatttattttattctatg

SEQ ID NO: 3676440 - DNA, 19 bp, Homo sapiens
atatttcttcgttcttttt

SEQ ID NO: 3676441 - DNA, 12 bp, Homo sapiens
atatttgacatg

SEQ ID NO: 3676442 - DNA, 15 bp, Homo sapiens
atatttgtaaagcta

SEQ ID NO: 3676443 - DNA, 18 bp, Homo sapiens
atattttccatgaaaatg

SEQ ID NO: 3676444 - DNA, 18 bp, Homo sapiens
atattttctctgtacttt

SEQ ID NO: 3676445 - DNA, 15 bp, Homo sapiens
atatttttaattaaa

SEQ ID NO: 3676446 - DNA, 19 bp, Homo sapiens
atcaaagaggttttaaaaa

SEQ ID NO: 3676447 - DNA, 23 bp, Homo sapiens
atcaaagaggttttaaaaaaatc

SEQ ID NO: 3676448 - DNA, 22 bp, Homo sapiens
atcaacaataaaatttttttaa

SEQ ID NO: 3676449 - DNA, 14 bp, Homo sapiens
atcaaggtgaaata

SEQ ID NO: 3676450 - DNA, 15 bp, Homo sapiens
atcaagtctgtttac

SEQ ID NO: 3676451 - DNA, 23 bp, Homo sapiens
atcaagtctgtttactgcaaggt

SEQ ID NO: 3676452 - DNA, 14 bp, Homo sapiens
atcacacttctgtg

SEQ ID NO: 3676453 - DNA, 16 bp, Homo sapiens
atcacacttctgtgag

SEQ ID NO: 3676454 - DNA, 21 bp, Homo sapiens
atcacagcttcagccaggagc

SEQ ID NO: 3676455 - DNA, 17 bp, Homo sapiens
atcacagggtgggcctc

SEQ ID NO: 3676456 - DNA, 16 bp, Homo sapiens
atcaccttaggcaggg

SEQ ID NO: 3676457 - DNA, 17 bp, Homo sapiens
atcaccttaggcaggga

SEQ ID NO: 3676458 - DNA, 17 bp, Homo sapiens
atcactgtgaaaattga

SEQ ID NO: 3676459 - DNA, 16 bp, Homo sapiens
atcacttacatttttg

SEQ ID NO: 3676460 - DNA, 23 bp, Homo sapiens
atcagaactcaaatggggccaga

SEQ ID NO: 3676461 - DNA, 17 bp, Homo sapiens
atcagattttaacagct

SEQ ID NO: 3676462 - DNA, 21 bp, Homo sapiens
atcagcaaaccggggcctact

SEQ ID NO: 3676463 - DNA, 20 bp, Homo sapiens
atcagcctgggcaatgtgat

SEQ ID NO: 3676464 - DNA, 18 bp, Homo sapiens
atcagctccactttcagt

SEQ ID NO: 3676465 - DNA, 19 bp, Homo sapiens
atcaggaatattttccaaa

SEQ ID NO: 3676466 - DNA, 14 bp, Homo sapiens
atcagtgacatctg

SEQ ID NO: 3676467 - DNA, 23 bp, Homo sapiens
atcagtgacatctgattggcaga

SEQ ID NO: 3676468 - DNA, 15 bp, Homo sapiens
atcagtttaggcctt

SEQ ID NO: 3676469 - DNA, 20 bp, Homo sapiens
atcagtttaggccttggctt

SEQ ID NO: 3676470 - DNA, 15 bp, Homo sapiens
atcatcattattatt

SEQ ID NO: 3676471 - DNA, 19 bp, Homo sapiens
atcatgctggaacctgcaa

SEQ ID NO: 3676472 - DNA, 11 bp, Homo sapiens
atcattttcat

SEQ ID NO: 3676473 - DNA, 14 bp, Homo sapiens
atccaaataaagat

SEQ ID NO: 3676474 - DNA, 18 bp, Homo sapiens
atccactctaccctccca

SEQ ID NO: 3676475 - DNA, 19 bp, Homo sapiens
atccactctaccctcccac

SEQ ID NO: 3676476 - DNA, 15 bp, Homo sapiens
atccaggcagatcca

SEQ ID NO: 3676477 - DNA, 22 bp, Homo sapiens
atccaggcagatccaggactat

SEQ ID NO: 3676478 - DNA, 22 bp, Homo sapiens
atccagggtatgacctagggaa

SEQ ID NO: 3676479 - DNA, 18 bp, Homo sapiens
atccaggtgtgcccctcc

SEQ ID NO: 3676480 - DNA, 22 bp, Homo sapiens
atcccaaccaggcacctcttcc

SEQ ID NO: 3676481 - DNA, 17 bp, Homo sapiens
atcccaagtagaatctc

SEQ ID NO: 3676482 - DNA, 17 bp, Homo sapiens
atcccagttcttcctgc

SEQ ID NO: 3676483 - DNA, 20 bp, Homo sapiens
atcccagttcttcctgcaac

SEQ ID NO: 3676484 - DNA, 21 bp, Homo sapiens
atcccagttcttcctgcaacc

SEQ ID NO: 3676485 - DNA, 16 bp, Homo sapiens
atccccaaccccctgt

SEQ ID NO: 3676486 - DNA, 23 bp, Homo sapiens
atccccaggggtcccagccaccc

SEQ ID NO: 3676487 - DNA, 12 bp, Homo sapiens
atccccttgaac

SEQ ID NO: 3676488 - DNA, 17 bp, Homo sapiens
atcccggctccagagca

SEQ ID NO: 3676489 - DNA, 18 bp, Homo sapiens
atcccggctccagagcag

SEQ ID NO: 3676490 - DNA, 22 bp, Homo sapiens
atccctaccccctaagagccat

SEQ ID NO: 3676491 - DNA, 17 bp, Homo sapiens
atccctggttgcctcat

SEQ ID NO: 3676492 - DNA, 21 bp, Homo sapiens
atccctggttgcctcatggcc

SEQ ID NO: 3676493 - DNA, 18 bp, Homo sapiens
atccctgtgttgtctcta

SEQ ID NO: 3676494 - DNA, 15 bp, Homo sapiens
atccgcgtgtgcctg

SEQ ID NO: 3676495 - DNA, 19 bp, Homo sapiens
atcctaatcatccaatgct

SEQ ID NO: 3676496 - DNA, 21 bp, Homo sapiens
atcctacagtgaaatgagcag

SEQ ID NO: 3676497 - DNA, 16 bp, Homo sapiens
atcctaggcatttgct

SEQ ID NO: 3676498 - DNA, 14 bp, Homo sapiens
atcctatgcttaat

SEQ ID NO: 3676499 - DNA, 13 bp, Homo sapiens
atcctccagcagg

SEQ ID NO: 3676500 - DNA, 16 bp, Homo sapiens
atcctccgtccagccg

SEQ ID NO: 3676501 - DNA, 11 bp, Homo sapiens
atcctcctgca

SEQ ID NO: 3676502 - DNA, 16 bp, Homo sapiens
atcctctcacctcagc

SEQ ID NO: 3676503 - DNA, 15 bp, Homo sapiens
atcctggaggcccag

SEQ ID NO: 3676504 - DNA, 20 bp, Homo sapiens
atcctggaggcccagttcac

SEQ ID NO: 3676505 - DNA, 16 bp, Homo sapiens
atccttaaatatgtga

SEQ ID NO: 3676506 - DNA, 21 bp, Homo sapiens
atcgacttgtttttgcacatg

SEQ ID NO: 3676507 - DNA, 18 bp, Homo sapiens
atcgcaccattctgactc

SEQ ID NO: 3676508 - DNA, 16 bp, Homo sapiens
atcgctgtgatgctgg

SEQ ID NO: 3676509 - DNA, 14 bp, Homo sapiens
atcgtctaaacttt

SEQ ID NO: 3676510 - DNA, 12 bp, Homo sapiens
atctaaagttat

SEQ ID NO: 3676511 - DNA, 15 bp, Homo sapiens
atctaaagttatatt

SEQ ID NO: 3676512 - DNA, 22 bp, Homo sapiens
atctaacaataatatttcaagt

SEQ ID NO: 3676513 - DNA, 13 bp, Homo sapiens
atctaagcctgaa

SEQ ID NO: 3676514 - DNA, 23 bp, Homo sapiens
atctattcccatcgctggaaaac

SEQ ID NO: 3676515 - DNA, 15 bp, Homo sapiens
atctcacctcctgct

SEQ ID NO: 3676516 - DNA, 12 bp, Homo sapiens
atctcagaacct

SEQ ID NO: 3676517 - DNA, 14 bp, Homo sapiens
atctcaggccagag

SEQ ID NO: 3676518 - DNA, 16 bp, Homo sapiens
atctcagggcctggtc

SEQ ID NO: 3676519 - DNA, 19 bp, Homo sapiens
atctcagttgattttctgg

SEQ ID NO: 3676520 - DNA, 17 bp, Homo sapiens
atctcctggaacactat

SEQ ID NO: 3676521 - DNA, 17 bp, Homo sapiens
atctctgctttggaaat

SEQ ID NO: 3676522 - DNA, 13 bp, Homo sapiens
atctctgtgcctt

SEQ ID NO: 3676523 - DNA, 15 bp, Homo sapiens
atctcttgagcctgg

SEQ ID NO: 3676524 - DNA, 13 bp, Homo sapiens
atctctttcacat

SEQ ID NO: 3676525 - DNA, 19 bp, Homo sapiens
atctctttcacattgtttg

SEQ ID NO: 3676526 - DNA, 10 bp, Homo sapiens
atctcttttc

SEQ ID NO: 3676527 - DNA, 23 bp, Homo sapiens
atctcttttccactccattgtcg

SEQ ID NO: 3676528 - DNA, 21 bp, Homo sapiens
atctgaaggggcaaattcttt

SEQ ID NO: 3676529 - DNA, 14 bp, Homo sapiens
atctgaccagcagc

SEQ ID NO: 3676530 - DNA, 18 bp, Homo sapiens
atctgatgcaagcaagaa

SEQ ID NO: 3676531 - DNA, 17 bp, Homo sapiens
atctgcacccccctggg

SEQ ID NO: 3676532 - DNA, 19 bp, Homo sapiens
atctgcacccccctgggct

SEQ ID NO: 3676533 - DNA, 15 bp, Homo sapiens
atctgcatgtctact

SEQ ID NO: 3676534 - DNA, 22 bp, Homo sapiens
atctgccattgggaccctccag

SEQ ID NO: 3676535 - DNA, 12 bp, Homo sapiens
atctgcccctcc

SEQ ID NO: 3676536 - DNA, 15 bp, Homo sapiens
atctgcccctccccc

SEQ ID NO: 3676537 - DNA, 17 bp, Homo sapiens
atctgcccctcccccaa

SEQ ID NO: 3676538 - DNA, 15 bp, Homo sapiens
atctggaacccagac

SEQ ID NO: 3676539 - DNA, 17 bp, Homo sapiens
atctggaacccagactc

SEQ ID NO: 3676540 - DNA, 11 bp, Homo sapiens
atctggaacct

SEQ ID NO: 3676541 - DNA, 17 bp, Homo sapiens
atctggaacctcagcct

SEQ ID NO: 3676542 - DNA, 18 bp, Homo sapiens
atctggaacctcagcctg

SEQ ID NO: 3676543 - DNA, 19 bp, Homo sapiens
atctggaacctcagcctgg

SEQ ID NO: 3676544 - DNA, 14 bp, Homo sapiens
atctggaagaaaaa

SEQ ID NO: 3676545 - DNA, 16 bp, Homo sapiens
atctggcttagtgcca

SEQ ID NO: 3676546 - DNA, 23 bp, Homo sapiens
atctggcttagtgccacccacct

SEQ ID NO: 3676547 - DNA, 12 bp, Homo sapiens
atctggcttctg

SEQ ID NO: 3676548 - DNA, 22 bp, Homo sapiens
atctggcttctggccaggaagc

SEQ ID NO: 3676549 - DNA, 17 bp, Homo sapiens
atctggtcctacccatc

SEQ ID NO: 3676550 - DNA, 18 bp, Homo sapiens
atctggtcctacccatcc

SEQ ID NO: 3676551 - DNA, 19 bp, Homo sapiens
atctgtccaaaggaggctg

SEQ ID NO: 3676552 - DNA, 21 bp, Homo sapiens
atctgtccaaaggaggctggc

SEQ ID NO: 3676553 - DNA, 15 bp, Homo sapiens
atctgtcctcagcct

SEQ ID NO: 3676554 - DNA, 21 bp, Homo sapiens
atctgtcctcagccttgccag

SEQ ID NO: 3676555 - DNA, 14 bp, Homo sapiens
atctgtctggtggc

SEQ ID NO: 3676556 - DNA, 16 bp, Homo sapiens
atctgtctggtggccc

SEQ ID NO: 3676557 - DNA, 12 bp, Homo sapiens
atctgtgcccca

SEQ ID NO: 3676558 - DNA, 15 bp, Homo sapiens
atctgtgccccatgc

SEQ ID NO: 3676559 - DNA, 23 bp, Homo sapiens
atctgtgccccatgcctgtccag

SEQ ID NO: 3676560 - DNA, 23 bp, Homo sapiens
atctgttcccttcctctgtgcca

SEQ ID NO: 3676561 - DNA, 14 bp, Homo sapiens
atctgttctaacat

SEQ ID NO: 3676562 - DNA, 16 bp, Homo sapiens
atctgttctaacatgt

SEQ ID NO: 3676563 - DNA, 15 bp, Homo sapiens
atctgttctatgctt

SEQ ID NO: 3676564 - DNA, 19 bp, Homo sapiens
atcttaaagtttcatgtga

SEQ ID NO: 3676565 - DNA, 15 bp, Homo sapiens
atcttaatacttgaa

SEQ ID NO: 3676566 - DNA, 16 bp, Homo sapiens
atcttaatacttgaac

SEQ ID NO: 3676567 - DNA, 19 bp, Homo sapiens
atcttatactgtacaataa

SEQ ID NO: 3676568 - DNA, 23 bp, Homo sapiens
atcttccgtggtcagagtgccac

SEQ ID NO: 3676569 - DNA, 21 bp, Homo sapiens
atcttgaccaagcaggaagct

SEQ ID NO: 3676570 - DNA, 23 bp, Homo sapiens
atcttgaccaagcaggaagctca

SEQ ID NO: 3676571 - DNA, 24 bp, Homo sapiens
atcttgcaccccaaagctttcctg

SEQ ID NO: 3676572 - DNA, 15 bp, Homo sapiens
atcttgcctccaggt

SEQ ID NO: 3676573 - DNA, 21 bp, Homo sapiens
atcttggcctaaacctcagtt

SEQ ID NO: 3676574 - DNA, 13 bp, Homo sapiens
atcttggctatgt

SEQ ID NO: 3676575 - DNA, 21 bp, Homo sapiens
atcttggctatgtaattcttg

SEQ ID NO: 3676576 - DNA, 20 bp, Homo sapiens
atcttgggggggtggccgct

SEQ ID NO: 3676577 - DNA, 23 bp, Homo sapiens
atcttgggggggtggccgctgag

SEQ ID NO: 3676578 - DNA, 21 bp, Homo sapiens
atcttggtttgccttccagaa

SEQ ID NO: 3676579 - DNA, 21 bp, Homo sapiens
atctttaaaagatgcttttaa

SEQ ID NO: 3676580 - DNA, 14 bp, Homo sapiens
atctttaagaaaaa

SEQ ID NO: 3676581 - DNA, 13 bp, Homo sapiens
atctttacatcta

SEQ ID NO: 3676582 - DNA, 22 bp, Homo sapiens
atctttgaatttcttgattttt

SEQ ID NO: 3676583 - DNA, 15 bp, Homo sapiens
atctttgactgaagc

SEQ ID NO: 3676584 - DNA, 19 bp, Homo sapiens
atctttgtggccaaggagc

SEQ ID NO: 3676585 - DNA, 23 bp, Homo sapiens
atctttgtggccaaggagctgct

SEQ ID NO: 3676586 - DNA, 17 bp, Homo sapiens
atctttttgaccctcat

SEQ ID NO: 3676587 - DNA, 21 bp, Homo sapiens
atctttttgaccctcattctt

SEQ ID NO: 3676588 - DNA, 19 bp, Homo sapiens
atgaactaaaaagagactg

SEQ ID NO: 3676589 - DNA, 12 bp, Homo sapiens
atgaatggggag

SEQ ID NO: 3676590 - DNA, 19 bp, Homo sapiens
atgagaaagccttcttttg

SEQ ID NO: 3676591 - DNA, 22 bp, Homo sapiens
atgagaaatacaaaaatactca

SEQ ID NO: 3676592 - DNA, 14 bp, Homo sapiens
atgagatgctggct

SEQ ID NO: 3676593 - DNA, 22 bp, Homo sapiens
atgagatgctggcttgggcagc

SEQ ID NO: 3676594 - DNA, 20 bp, Homo sapiens
atgagatttttaaaaaatat

SEQ ID NO: 3676595 - DNA, 12 bp, Homo sapiens
atgagcctggca

SEQ ID NO: 3676596 - DNA, 19 bp, Homo sapiens
atgaggcggagctccagga

SEQ ID NO: 3676597 - DNA, 17 bp, Homo sapiens
atgaggcttcttcctgg

SEQ ID NO: 3676598 - DNA, 18 bp, Homo sapiens
atgaggcttcttcctgga

SEQ ID NO: 3676599 - DNA, 19 bp, Homo sapiens
atgaggcttcttcctggat

SEQ ID NO: 3676600 - DNA, 20 bp, Homo sapiens
atgagggggaattcctggaa

SEQ ID NO: 3676601 - DNA, 17 bp, Homo sapiens
atgagttaactgtgaaa

SEQ ID NO: 3676602 - DNA, 22 bp, Homo sapiens
atgagttaactgtgaaatacca

SEQ ID NO: 3676603 - DNA, 18 bp, Homo sapiens
atgagttggacttcagtc

SEQ ID NO: 3676604 - DNA, 16 bp, Homo sapiens
atgatattaagaactg

SEQ ID NO: 3676605 - DNA, 13 bp, Homo sapiens
atgatccctgtgt

SEQ ID NO: 3676606 - DNA, 15 bp, Homo sapiens
atgatcctaatgaat

SEQ ID NO: 3676607 - DNA, 15 bp, Homo sapiens
atgatcttttcaagt

SEQ ID NO: 3676608 - DNA, 15 bp, Homo sapiens
atgatgatcctaggc

SEQ ID NO: 3676609 - DNA, 22 bp, Homo sapiens
atgattaggcccgccaaacttc

SEQ ID NO: 3676610 - DNA, 14 bp, Homo sapiens
atgcaaaaggttta

SEQ ID NO: 3676611 - DNA, 14 bp, Homo sapiens
atgcaaagaggcaa

SEQ ID NO: 3676612 - DNA, 16 bp, Homo sapiens
atgcaaagaggcaaga

SEQ ID NO: 3676613 - DNA, 21 bp, Homo sapiens
atgcaagcagaggaccagggc

SEQ ID NO: 3676614 - DNA, 15 bp, Homo sapiens
atgcaccaccaagcc

SEQ ID NO: 3676615 - DNA, 19 bp, Homo sapiens
atgcactgtgaaggaccct

SEQ ID NO: 3676616 - DNA, 19 bp, Homo sapiens
atgcagaatgttgattaca

SEQ ID NO: 3676617 - DNA, 17 bp, Homo sapiens
atgcagcatctaagtaa

SEQ ID NO: 3676618 - DNA, 23 bp, Homo sapiens
atgcagcccatgcccacctgccc

SEQ ID NO: 3676619 - DNA, 13 bp, Homo sapiens
atgcagctcaaga

SEQ ID NO: 3676620 - DNA, 14 bp, Homo sapiens
atgcataagaaatg

SEQ ID NO: 3676621 - DNA, 12 bp, Homo sapiens
atgcatctgttt

SEQ ID NO: 3676622 - DNA, 16 bp, Homo sapiens
atgcatggtgccccag

SEQ ID NO: 3676623 - DNA, 17 bp, Homo sapiens
atgcatggtgccccagg

SEQ ID NO: 3676624 - DNA, 15 bp, Homo sapiens
atgcatgtcttttaa

SEQ ID NO: 3676625 - DNA, 14 bp, Homo sapiens
atgcattgagctgc

SEQ ID NO: 3676626 - DNA, 18 bp, Homo sapiens
atgccaaagctagggtgg

SEQ ID NO: 3676627 - DNA, 16 bp, Homo sapiens
atgccacaaggacttc

SEQ ID NO: 3676628 - DNA, 19 bp, Homo sapiens
atgccacaaggacttcctg

SEQ ID NO: 3676629 - DNA, 15 bp, Homo sapiens
atgccactgccttcg

SEQ ID NO: 3676630 - DNA, 17 bp, Homo sapiens
atgccactgccttcgct

SEQ ID NO: 3676631 - DNA, 15 bp, Homo sapiens
atgcccacctgccca

SEQ ID NO: 3676632 - DNA, 16 bp, Homo sapiens
atgcccacctgcccat

SEQ ID NO: 3676633 - DNA, 21 bp, Homo sapiens
atgcccacctgcccatcacag

SEQ ID NO: 3676634 - DNA, 13 bp, Homo sapiens
atgccctcctctc

SEQ ID NO: 3676635 - DNA, 14 bp, Homo sapiens
atgccctcctctcc

SEQ ID NO: 3676636 - DNA, 15 bp, Homo sapiens
atgccctcctctccc

SEQ ID NO: 3676637 - DNA, 16 bp, Homo sapiens
atgccctggaggtggc

SEQ ID NO: 3676638 - DNA, 16 bp, Homo sapiens
atgcccttctgattcc

SEQ ID NO: 3676639 - DNA, 23 bp, Homo sapiens
atgcccttctgattcccctccac

SEQ ID NO: 3676640 - DNA, 15 bp, Homo sapiens
atgcctcactaattt

SEQ ID NO: 3676641 - DNA, 20 bp, Homo sapiens
atgcctcactaatttttgta

SEQ ID NO: 3676642 - DNA, 19 bp, Homo sapiens
atgcctctgtcttctggac

SEQ ID NO: 3676643 - DNA, 21 bp, Homo sapiens
atgcctgtagctttcctggtc

SEQ ID NO: 3676644 - DNA, 17 bp, Homo sapiens
atgcctgtccagcctgg

SEQ ID NO: 3676645 - DNA, 15 bp, Homo sapiens
atgccttgaataata

SEQ ID NO: 3676646 - DNA, 15 bp, Homo sapiens
atgcgctcagggcca

SEQ ID NO: 3676647 - DNA, 23 bp, Homo sapiens
atgcgctcagggccatgctgagg

SEQ ID NO: 3676648 - DNA, 16 bp, Homo sapiens
atgctaatttaaagag

SEQ ID NO: 3676649 - DNA, 17 bp, Homo sapiens
atgctaatttaaagaga

SEQ ID NO: 3676650 - DNA, 16 bp, Homo sapiens
atgctacattaatgtt

SEQ ID NO: 3676651 - DNA, 22 bp, Homo sapiens
atgctccaggatctttgactga

SEQ ID NO: 3676652 - DNA, 22 bp, Homo sapiens
atgctccctcccctgccctggt

SEQ ID NO: 3676653 - DNA, 14 bp, Homo sapiens
atgctcctggccca

SEQ ID NO: 3676654 - DNA, 15 bp, Homo sapiens
atgctgaggcctggg

SEQ ID NO: 3676655 - DNA, 17 bp, Homo sapiens
atgctgaggcctgggcc

SEQ ID NO: 3676656 - DNA, 12 bp, Homo sapiens
atgctgcccctc

SEQ ID NO: 3676657 - DNA, 16 bp, Homo sapiens
atgctggcccagggcc

SEQ ID NO: 3676658 - DNA, 15 bp, Homo sapiens
atgctgggactcagc

SEQ ID NO: 3676659 - DNA, 16 bp, Homo sapiens
atgctgggactcagcc

SEQ ID NO: 3676660 - DNA, 23 bp, Homo sapiens
atgctgtgtatatggtatatata

SEQ ID NO: 3676661 - DNA, 18 bp, Homo sapiens
atgcttaataaaagaaca

SEQ ID NO: 3676662 - DNA, 19 bp, Homo sapiens
atgcttaataaaagaacat

SEQ ID NO: 3676663 - DNA, 16 bp, Homo sapiens
atgcttgcaaaaacta

SEQ ID NO: 3676664 - DNA, 13 bp, Homo sapiens
atgcttttgtcta

SEQ ID NO: 3676665 - DNA, 18 bp, Homo sapiens
atggaaaagtgtccttct

SEQ ID NO: 3676666 - DNA, 22 bp, Homo sapiens
atggaaaatcagtgacatctga

SEQ ID NO: 3676667 - DNA, 17 bp, Homo sapiens
atggaaccgcaggaagc

SEQ ID NO: 3676668 - DNA, 19 bp, Homo sapiens
atggaaccgcaggaagctg

SEQ ID NO: 3676669 - DNA, 14 bp, Homo sapiens
atggaagccaacac

SEQ ID NO: 3676670 - DNA, 16 bp, Homo sapiens
atggaagggtttgtgg

SEQ ID NO: 3676671 - DNA, 15 bp, Homo sapiens
atggaagtgggccag

SEQ ID NO: 3676672 - DNA, 22 bp, Homo sapiens
atggaagtgggccagtcctggt

SEQ ID NO: 3676673 - DNA, 15 bp, Homo sapiens
atggaagttttccta

SEQ ID NO: 3676674 - DNA, 20 bp, Homo sapiens
atggacagaagaaggcagca

SEQ ID NO: 3676675 - DNA, 17 bp, Homo sapiens
atggactatctgtctgg

SEQ ID NO: 3676676 - DNA, 19 bp, Homo sapiens
atggatgggggaactcaga

SEQ ID NO: 3676677 - DNA, 14 bp, Homo sapiens
atggcaacagatct

SEQ ID NO: 3676678 - DNA, 15 bp, Homo sapiens
atggcaacagatctg

SEQ ID NO: 3676679 - DNA, 17 bp, Homo sapiens
atggcaacagatctgga

SEQ ID NO: 3676680 - DNA, 21 bp, Homo sapiens
atggcagtgtggggagggcag

SEQ ID NO: 3676681 - DNA, 18 bp, Homo sapiens
atggcatgagaaatacaa

SEQ ID NO: 3676682 - DNA, 19 bp, Homo sapiens
atggcatgagaaatacaaa

SEQ ID NO: 3676683 - DNA, 20 bp, Homo sapiens
atggccccagcacagcttga

SEQ ID NO: 3676684 - DNA, 13 bp, Homo sapiens
atggcctcagctg

SEQ ID NO: 3676685 - DNA, 15 bp, Homo sapiens
atggcctcagctgcc

SEQ ID NO: 3676686 - DNA, 13 bp, Homo sapiens
atggcgggactgg

SEQ ID NO: 3676687 - DNA, 13 bp, Homo sapiens
atggctcagggtg

SEQ ID NO: 3676688 - DNA, 12 bp, Homo sapiens
atgggaagcagg

SEQ ID NO: 3676689 - DNA, 18 bp, Homo sapiens
atgggccggcccccttcc

SEQ ID NO: 3676690 - DNA, 16 bp, Homo sapiens
atggggaaggaggctg

SEQ ID NO: 3676691 - DNA, 16 bp, Homo sapiens
atggggcacggctctg

SEQ ID NO: 3676692 - DNA, 18 bp, Homo sapiens
atggggcacggctctggg

SEQ ID NO: 3676693 - DNA, 21 bp, Homo sapiens
atggggccagatccagcctgg

SEQ ID NO: 3676694 - DNA, 22 bp, Homo sapiens
atggggccagatccagcctggg

SEQ ID NO: 3676695 - DNA, 16 bp, Homo sapiens
atggggcggggcttct

SEQ ID NO: 3676696 - DNA, 21 bp, Homo sapiens
atgggggaactcagatccagg

SEQ ID NO: 3676697 - DNA, 20 bp, Homo sapiens
atgggggagtctgaagcaga

SEQ ID NO: 3676698 - DNA, 18 bp, Homo sapiens
atgggtgtggatggcagt

SEQ ID NO: 3676699 - DNA, 22 bp, Homo sapiens
atgggtttttccctgtacagta

SEQ ID NO: 3676700 - DNA, 19 bp, Homo sapiens
atggtgcattacgtgggca

SEQ ID NO: 3676701 - DNA, 16 bp, Homo sapiens
atggtgccccaggacc

SEQ ID NO: 3676702 - DNA, 19 bp, Homo sapiens
atggtgccccaggaccagc

SEQ ID NO: 3676703 - DNA, 20 bp, Homo sapiens
atggtgccccaggaccagct

SEQ ID NO: 3676704 - DNA, 14 bp, Homo sapiens
atggtgtgttacac

SEQ ID NO: 3676705 - DNA, 17 bp, Homo sapiens
atgtaaaatcctacagt

SEQ ID NO: 3676706 - DNA, 15 bp, Homo sapiens
atgtaaattgaagaa

SEQ ID NO: 3676707 - DNA, 15 bp, Homo sapiens
atgtaagtgggccca

SEQ ID NO: 3676708 - DNA, 18 bp, Homo sapiens
atgtacgtccagcctgcc

SEQ ID NO: 3676709 - DNA, 20 bp, Homo sapiens
atgtactagtgttctgtttg

SEQ ID NO: 3676710 - DNA, 22 bp, Homo sapiens
atgtactagtgttctgtttgtt

SEQ ID NO: 3676711 - DNA, 21 bp, Homo sapiens
atgtactagttttagttttct

SEQ ID NO: 3676712 - DNA, 14 bp, Homo sapiens
atgtactttttagt

SEQ ID NO: 3676713 - DNA, 23 bp, Homo sapiens
atgtaggggttaacttggtcaga

SEQ ID NO: 3676714 - DNA, 18 bp, Homo sapiens
atgtagtattcaatgatt

SEQ ID NO: 3676715 - DNA, 13 bp, Homo sapiens
atgtatgtaaagt

SEQ ID NO: 3676716 - DNA, 14 bp, Homo sapiens
atgtattaatgtat

SEQ ID NO: 3676717 - DNA, 14 bp, Homo sapiens
atgtattataactt

SEQ ID NO: 3676718 - DNA, 22 bp, Homo sapiens
atgtcatatactgccatgtact

SEQ ID NO: 3676719 - DNA, 21 bp, Homo sapiens
atgtccttgtaatattccctt

SEQ ID NO: 3676720 - DNA, 19 bp, Homo sapiens
atgtcttgctgttgacata

SEQ ID NO: 3676721 - DNA, 22 bp, Homo sapiens
atgtcttgctgttgacatattt

SEQ ID NO: 3676722 - DNA, 13 bp, Homo sapiens
atgtcttttaaaa

SEQ ID NO: 3676723 - DNA, 12 bp, Homo sapiens
atgtgaaccatt

SEQ ID NO: 3676724 - DNA, 19 bp, Homo sapiens
atgtgaggggtccctagca

SEQ ID NO: 3676725 - DNA, 18 bp, Homo sapiens
atgtgataaggaaatcaa

SEQ ID NO: 3676726 - DNA, 18 bp, Homo sapiens
atgtgcatagtttcttta

SEQ ID NO: 3676727 - DNA, 22 bp, Homo sapiens
atgtgccccttcgcagctgaag

SEQ ID NO: 3676728 - DNA, 22 bp, Homo sapiens
atgtggccctggctgccggcac

SEQ ID NO: 3676729 - DNA, 13 bp, Homo sapiens
atgtggctggaag

SEQ ID NO: 3676730 - DNA, 20 bp, Homo sapiens
atgtggctggaagatcctgc

SEQ ID NO: 3676731 - DNA, 13 bp, Homo sapiens
atgtggggccagg

SEQ ID NO: 3676732 - DNA, 16 bp, Homo sapiens
atgtggggccaggtca

SEQ ID NO: 3676733 - DNA, 12 bp, Homo sapiens
atgtgtctccca

SEQ ID NO: 3676734 - DNA, 15 bp, Homo sapiens
atgtgtgaggagctg

SEQ ID NO: 3676735 - DNA, 17 bp, Homo sapiens
atgtgtgttcctgcttt

SEQ ID NO: 3676736 - DNA, 12 bp, Homo sapiens
atgtgtttacat

SEQ ID NO: 3676737 - DNA, 23 bp, Homo sapiens
atgttaagcagctaaattttctg

SEQ ID NO: 3676738 - DNA, 23 bp, Homo sapiens
atgttaattttttggtacaaaaa

SEQ ID NO: 3676739 - DNA, 21 bp, Homo sapiens
atgttatcttatactgtacaa

SEQ ID NO: 3676740 - DNA, 15 bp, Homo sapiens
atgttattagatgtt

SEQ ID NO: 3676741 - DNA, 16 bp, Homo sapiens
atgttcagcactgtcc

SEQ ID NO: 3676742 - DNA, 17 bp, Homo sapiens
atgttctctcttctcca

SEQ ID NO: 3676743 - DNA, 20 bp, Homo sapiens
atgtttaaaaagtttctaat

SEQ ID NO: 3676744 - DNA, 14 bp, Homo sapiens
atgtttaaaacatc

SEQ ID NO: 3676745 - DNA, 21 bp, Homo sapiens
atgtttcacaccggaaggttt

SEQ ID NO: 3676746 - DNA, 13 bp, Homo sapiens
atgtttccagcag

SEQ ID NO: 3676747 - DNA, 22 bp, Homo sapiens
atgtttccatggttaccatggg

SEQ ID NO: 3676748 - DNA, 20 bp, Homo sapiens
atgtttcctctagttctttg

SEQ ID NO: 3676749 - DNA, 12 bp, Homo sapiens
atgtttggggtc

SEQ ID NO: 3676750 - DNA, 16 bp, Homo sapiens
atgtttgtggcctcag

SEQ ID NO: 3676751 - DNA, 16 bp, Homo sapiens
atgttttctttgcaaa

SEQ ID NO: 3676752 - DNA, 21 bp, Homo sapiens
atgtttttctgccagggagct

SEQ ID NO: 3676753 - DNA, 18 bp, Homo sapiens
attaaaaaggtttacaga

SEQ ID NO: 3676754 - DNA, 19 bp, Homo sapiens
attaaaaaggtttacagaa

SEQ ID NO: 3676755 - DNA, 14 bp, Homo sapiens
attaagatgtatat

SEQ ID NO: 3676756 - DNA, 20 bp, Homo sapiens
attaatattaactacagaaa

SEQ ID NO: 3676757 - DNA, 23 bp, Homo sapiens
attaatgtacttgtttctctgtt

SEQ ID NO: 3676758 - DNA, 14 bp, Homo sapiens
attaattgctttga

SEQ ID NO: 3676759 - DNA, 18 bp, Homo sapiens
attacaattttatctgtt

SEQ ID NO: 3676760 - DNA, 16 bp, Homo sapiens
attacatgtaatttga

SEQ ID NO: 3676761 - DNA, 18 bp, Homo sapiens
attacctgccaattgcta

SEQ ID NO: 3676762 - DNA, 14 bp, Homo sapiens
attactcccaggat

SEQ ID NO: 3676763 - DNA, 21 bp, Homo sapiens
attagaaaaatagcaacttgt

SEQ ID NO: 3676764 - DNA, 16 bp, Homo sapiens
attaggtcttgctgga

SEQ ID NO: 3676765 - DNA, 17 bp, Homo sapiens
attataacaagtgtgtc

SEQ ID NO: 3676766 - DNA, 14 bp, Homo sapiens
attatatttgacat

SEQ ID NO: 3676767 - DNA, 18 bp, Homo sapiens
attatcctcctgttctga

SEQ ID NO: 3676768 - DNA, 21 bp, Homo sapiens
attatcctcctgttctgaaac

SEQ ID NO: 3676769 - DNA, 21 bp, Homo sapiens
attatgatgtgggtcaaggaa

SEQ ID NO: 3676770 - DNA, 12 bp, Homo sapiens
attatgctgctt

SEQ ID NO: 3676771 - DNA, 17 bp, Homo sapiens
attatgctgctttaaca

SEQ ID NO: 3676772 - DNA, 14 bp, Homo sapiens
attatttttgtaga

SEQ ID NO: 3676773 - DNA, 15 bp, Homo sapiens
attcaaaatatttaa

SEQ ID NO: 3676774 - DNA, 14 bp, Homo sapiens
attcagacagatga

SEQ ID NO: 3676775 - DNA, 20 bp, Homo sapiens
attcagatccagtgtaaact

SEQ ID NO: 3676776 - DNA, 13 bp, Homo sapiens
attcaggctgctt

SEQ ID NO: 3676777 - DNA, 22 bp, Homo sapiens
attcatctctctttaatataaa

SEQ ID NO: 3676778 - DNA, 16 bp, Homo sapiens
attccccatctcaggc

SEQ ID NO: 3676779 - DNA, 17 bp, Homo sapiens
attcccgtgttgcttca

SEQ ID NO: 3676780 - DNA, 18 bp, Homo sapiens
attcccttttaggtgagg

SEQ ID NO: 3676781 - DNA, 17 bp, Homo sapiens
attcctaaagaaaaata

SEQ ID NO: 3676782 - DNA, 21 bp, Homo sapiens
attcctagaattaaaccagat

SEQ ID NO: 3676783 - DNA, 17 bp, Homo sapiens
attcctctttgctttgc

SEQ ID NO: 3676784 - DNA, 18 bp, Homo sapiens
attcctctttgctttgct

SEQ ID NO: 3676785 - DNA, 16 bp, Homo sapiens
attcctgaagaaccag

SEQ ID NO: 3676786 - DNA, 12 bp, Homo sapiens
attcctggaacc

SEQ ID NO: 3676787 - DNA, 19 bp, Homo sapiens
attcctggaacctggaccc

SEQ ID NO: 3676788 - DNA, 14 bp, Homo sapiens
attccttttctgta

SEQ ID NO: 3676789 - DNA, 21 bp, Homo sapiens
attcggtatccccccatcttg

SEQ ID NO: 3676790 - DNA, 14 bp, Homo sapiens
attctaaaaccatt

SEQ ID NO: 3676791 - DNA, 19 bp, Homo sapiens
attctaacttttttgctat

SEQ ID NO: 3676792 - DNA, 15 bp, Homo sapiens
attctcaagccctgc

SEQ ID NO: 3676793 - DNA, 16 bp, Homo sapiens
attctcaagccctgca

SEQ ID NO: 3676794 - DNA, 18 bp, Homo sapiens
attctccttgttgttggt

SEQ ID NO: 3676795 - DNA, 12 bp, Homo sapiens
attctcttttaa

SEQ ID NO: 3676796 - DNA, 18 bp, Homo sapiens
attctgactcggtttctc

SEQ ID NO: 3676797 - DNA, 15 bp, Homo sapiens
attctggacaggatg

SEQ ID NO: 3676798 - DNA, 16 bp, Homo sapiens
attcttaacaaactct

SEQ ID NO: 3676799 - DNA, 23 bp, Homo sapiens
attcttagatacactaaaaatct

SEQ ID NO: 3676800 - DNA, 13 bp, Homo sapiens
attcttcagtctg

SEQ ID NO: 3676801 - DNA, 18 bp, Homo sapiens
attcttcgcataaagaag

SEQ ID NO: 3676802 - DNA, 22 bp, Homo sapiens
attcttctggtgctactccatg

SEQ ID NO: 3676803 - DNA, 12 bp, Homo sapiens
attcttgtgctt

SEQ ID NO: 3676804 - DNA, 18 bp, Homo sapiens
attcttgtgcttttcctg

SEQ ID NO: 3676805 - DNA, 19 bp, Homo sapiens
attgacaaccgagaaggtt

SEQ ID NO: 3676806 - DNA, 19 bp, Homo sapiens
attgacagctttgctgctg

SEQ ID NO: 3676807 - DNA, 21 bp, Homo sapiens
attgacgacaagtgctgaaca

SEQ ID NO: 3676808 - DNA, 15 bp, Homo sapiens
attgactgccctctt

SEQ ID NO: 3676809 - DNA, 20 bp, Homo sapiens
attgagctgcctccagcctg

SEQ ID NO: 3676810 - DNA, 19 bp, Homo sapiens
attgatcattttcccccca

SEQ ID NO: 3676811 - DNA, 16 bp, Homo sapiens
attgatggggaaggag

SEQ ID NO: 3676812 - DNA, 14 bp, Homo sapiens
attgattttcacag

SEQ ID NO: 3676813 - DNA, 12 bp, Homo sapiens
attgcaccactg

SEQ ID NO: 3676814 - DNA, 20 bp, Homo sapiens
attgcactccagcctgggtg

SEQ ID NO: 3676815 - DNA, 20 bp, Homo sapiens
attgcagataactttgactt

SEQ ID NO: 3676816 - DNA, 16 bp, Homo sapiens
attgcatatatacata

SEQ ID NO: 3676817 - DNA, 15 bp, Homo sapiens
attgccaaaaaggat

SEQ ID NO: 3676818 - DNA, 21 bp, Homo sapiens
attgccaccaggagaaccact

SEQ ID NO: 3676819 - DNA, 18 bp, Homo sapiens
attgccttaactggagcc

SEQ ID NO: 3676820 - DNA, 16 bp, Homo sapiens
attgcctttgaatgtt

SEQ ID NO: 3676821 - DNA, 18 bp, Homo sapiens
attgcctttgaatgttaa

SEQ ID NO: 3676822 - DNA, 17 bp, Homo sapiens
attgctaccgagaaggt

SEQ ID NO: 3676823 - DNA, 18 bp, Homo sapiens
attgcttgagctcaggag

SEQ ID NO: 3676824 - DNA, 12 bp, Homo sapiens
attgctttgcca

SEQ ID NO: 3676825 - DNA, 20 bp, Homo sapiens
attgctttgccaaaatacca

SEQ ID NO: 3676826 - DNA, 17 bp, Homo sapiens
attggagctgactgttc

SEQ ID NO: 3676827 - DNA, 20 bp, Homo sapiens
attggcacctaatccaggca

SEQ ID NO: 3676828 - DNA, 15 bp, Homo sapiens
attgtaaatatttga

SEQ ID NO: 3676829 - DNA, 13 bp, Homo sapiens
atttaaaaatgtc

SEQ ID NO: 3676830 - DNA, 15 bp, Homo sapiens
atttaaaaatgtctt

SEQ ID NO: 3676831 - DNA, 18 bp, Homo sapiens
atttaaaaatgtcttgct

SEQ ID NO: 3676832 - DNA, 15 bp, Homo sapiens
atttaaacacacaga

SEQ ID NO: 3676833 - DNA, 21 bp, Homo sapiens
atttaaaggcttaggcatgtt

SEQ ID NO: 3676834 - DNA, 18 bp, Homo sapiens
atttaactggtgcacttt

SEQ ID NO: 3676835 - DNA, 21 bp, Homo sapiens
atttaactggtgcactttgta

SEQ ID NO: 3676836 - DNA, 22 bp, Homo sapiens
atttaactggtgcactttgtaa

SEQ ID NO: 3676837 - DNA, 15 bp, Homo sapiens
atttaatctccattt

SEQ ID NO: 3676838 - DNA, 23 bp, Homo sapiens
atttacagccagtgggagatgtt

SEQ ID NO: 3676839 - DNA, 17 bp, Homo sapiens
atttacctcgttctgct

SEQ ID NO: 3676840 - DNA, 18 bp, Homo sapiens
atttacctcgttctgctc

SEQ ID NO: 3676841 - DNA, 22 bp, Homo sapiens
atttagaaactaattgacttta

SEQ ID NO: 3676842 - DNA, 14 bp, Homo sapiens
atttaggagaagcc

SEQ ID NO: 3676843 - DNA, 14 bp, Homo sapiens
atttagtttttaac

SEQ ID NO: 3676844 - DNA, 16 bp, Homo sapiens
atttatcacacttctg

SEQ ID NO: 3676845 - DNA, 18 bp, Homo sapiens
atttatgtgtgaggagct

SEQ ID NO: 3676846 - DNA, 18 bp, Homo sapiens
atttattaaatgtattat

SEQ ID NO: 3676847 - DNA, 16 bp, Homo sapiens
atttattaattgcttt

SEQ ID NO: 3676848 - DNA, 16 bp, Homo sapiens
atttattgtctgtcta

SEQ ID NO: 3676849 - DNA, 19 bp, Homo sapiens
atttattgtctgtctacat

SEQ ID NO: 3676850 - DNA, 16 bp, Homo sapiens
atttattttattctat

SEQ ID NO: 3676851 - DNA, 18 bp, Homo sapiens
atttattttattctatgt

SEQ ID NO: 3676852 - DNA, 21 bp, Homo sapiens
atttattttattctatgtatg

SEQ ID NO: 3676853 - DNA, 21 bp, Homo sapiens
atttattttatttatttaatt

SEQ ID NO: 3676854 - DNA, 14 bp, Homo sapiens
atttcaaaaggaag

SEQ ID NO: 3676855 - DNA, 11 bp, Homo sapiens
atttcaagtgc

SEQ ID NO: 3676856 - DNA, 12 bp, Homo sapiens
atttcaagtgcc

SEQ ID NO: 3676857 - DNA, 23 bp, Homo sapiens
atttcaagtgcctagactgttac

SEQ ID NO: 3676858 - DNA, 21 bp, Homo sapiens
atttcaatttccaagagctga

SEQ ID NO: 3676859 - DNA, 16 bp, Homo sapiens
atttcacttttctgta

SEQ ID NO: 3676860 - DNA, 12 bp, Homo sapiens
atttcagactcc

SEQ ID NO: 3676861 - DNA, 18 bp, Homo sapiens
atttcagactcccattcc

SEQ ID NO: 3676862 - DNA, 16 bp, Homo sapiens
atttcagactgcagag

SEQ ID NO: 3676863 - DNA, 14 bp, Homo sapiens
atttcagatgtaat

SEQ ID NO: 3676864 - DNA, 19 bp, Homo sapiens
atttcatctgttctatgct

SEQ ID NO: 3676865 - DNA, 16 bp, Homo sapiens
atttccaagagctgag

SEQ ID NO: 3676866 - DNA, 13 bp, Homo sapiens
atttccaagctgt

SEQ ID NO: 3676867 - DNA, 12 bp, Homo sapiens
atttcccaggac

SEQ ID NO: 3676868 - DNA, 14 bp, Homo sapiens
atttcctggatgtt

SEQ ID NO: 3676869 - DNA, 21 bp, Homo sapiens
atttctagaacatccctgcca

SEQ ID NO: 3676870 - DNA, 14 bp, Homo sapiens
atttctattattaa

SEQ ID NO: 3676871 - DNA, 21 bp, Homo sapiens
atttcttaaacaaatgtatga

SEQ ID NO: 3676872 - DNA, 13 bp, Homo sapiens
atttcttgtgttc

SEQ ID NO: 3676873 - DNA, 15 bp, Homo sapiens
atttcttgtgttctg

SEQ ID NO: 3676874 - DNA, 17 bp, Homo sapiens
atttcttgtgttctgta

SEQ ID NO: 3676875 - DNA, 12 bp, Homo sapiens
atttgaggactt

SEQ ID NO: 3676876 - DNA, 21 bp, Homo sapiens
atttgaggacttgttaaagag

SEQ ID NO: 3676877 - DNA, 20 bp, Homo sapiens
atttgagttaacctttaaga

SEQ ID NO: 3676878 - DNA, 17 bp, Homo sapiens
atttgattaacatttgt

SEQ ID NO: 3676879 - DNA, 15 bp, Homo sapiens
atttgattcaaaata

SEQ ID NO: 3676880 - DNA, 16 bp, Homo sapiens
atttgattcaaaatat

SEQ ID NO: 3676881 - DNA, 9 bp, Homo sapiens
atttgcagt

SEQ ID NO: 3676882 - DNA, 11 bp, Homo sapiens
atttgcttttt

SEQ ID NO: 3676883 - DNA, 13 bp, Homo sapiens
atttggaaaataa

SEQ ID NO: 3676884 - DNA, 21 bp, Homo sapiens
atttgggcctgctccagacct

SEQ ID NO: 3676885 - DNA, 23 bp, Homo sapiens
atttgggcctgctccagacctga

SEQ ID NO: 3676886 - DNA, 21 bp, Homo sapiens
atttgtgctatagtatttgat

SEQ ID NO: 3676887 - DNA, 12 bp, Homo sapiens
atttgtgttttg

SEQ ID NO: 3676888 - DNA, 14 bp, Homo sapiens
atttgttaaaatac

SEQ ID NO: 3676889 - DNA, 12 bp, Homo sapiens
atttgttaatgg

SEQ ID NO: 3676890 - DNA, 12 bp, Homo sapiens
atttgttcaagt

SEQ ID NO: 3676891 - DNA, 16 bp, Homo sapiens
attttaagactgattt

SEQ ID NO: 3676892 - DNA, 22 bp, Homo sapiens
attttagtggataaaatttgta

SEQ ID NO: 3676893 - DNA, 22 bp, Homo sapiens
attttatctgtttcctgacatt

SEQ ID NO: 3676894 - DNA, 14 bp, Homo sapiens
attttattctatgt

SEQ ID NO: 3676895 - DNA, 20 bp, Homo sapiens
attttcacagctttgaggaa

SEQ ID NO: 3676896 - DNA, 21 bp, Homo sapiens
attttcacagctttgaggaac

SEQ ID NO: 3676897 - DNA, 15 bp, Homo sapiens
attttcacattcttg

SEQ ID NO: 3676898 - DNA, 19 bp, Homo sapiens
attttcacattcttggctt

SEQ ID NO: 3676899 - DNA, 20 bp, Homo sapiens
attttcagcattaagctgtt

SEQ ID NO: 3676900 - DNA, 16 bp, Homo sapiens
attttcatcaagtagc

SEQ ID NO: 3676901 - DNA, 14 bp, Homo sapiens
attttccaaagagt

SEQ ID NO: 3676902 - DNA, 14 bp, Homo sapiens
attttccaaatgta

SEQ ID NO: 3676903 - DNA, 15 bp, Homo sapiens
attttccatgaaaat

SEQ ID NO: 3676904 - DNA, 14 bp, Homo sapiens
attttccccccact

SEQ ID NO: 3676905 - DNA, 15 bp, Homo sapiens
attttccccccactc

SEQ ID NO: 3676906 - DNA, 16 bp, Homo sapiens
attttcctgccaggca

SEQ ID NO: 3676907 - DNA, 19 bp, Homo sapiens
attttcttattgcgctgct

SEQ ID NO: 3676908 - DNA, 20 bp, Homo sapiens
attttctttttaataaaaag

SEQ ID NO: 3676909 - DNA, 18 bp, Homo sapiens
attttgccagtgggaact

SEQ ID NO: 3676910 - DNA, 19 bp, Homo sapiens
attttgctatcaacaataa

SEQ ID NO: 3676911 - DNA, 22 bp, Homo sapiens
attttggggggcagagaataaa

SEQ ID NO: 3676912 - DNA, 13 bp, Homo sapiens
attttgtgtaaaa

SEQ ID NO: 3676913 - DNA, 20 bp, Homo sapiens
attttgtgtaaaaaaaccac

SEQ ID NO: 3676914 - DNA, 12 bp, Homo sapiens
attttgttctgt

SEQ ID NO: 3676915 - DNA, 15 bp, Homo sapiens
atttttaaaaaatat

SEQ ID NO: 3676916 - DNA, 23 bp, Homo sapiens
atttttaaaaaatattttctctg

SEQ ID NO: 3676917 - DNA, 18 bp, Homo sapiens
atttttggagtttaccac

SEQ ID NO: 3676918 - DNA, 14 bp, Homo sapiens
atttttgtaaagtt

SEQ ID NO: 3676919 - DNA, 18 bp, Homo sapiens
atttttgtaaagtttccg

SEQ ID NO: 3676920 - DNA, 16 bp, Homo sapiens
atttttgttgttgttg

SEQ ID NO: 3676921 - DNA, 22 bp, Homo sapiens
attttttaaaacaagccaagaa

SEQ ID NO: 3676922 - DNA, 18 bp, Homo sapiens
attttttttgtattctta

SEQ ID NO: 3676923 - DNA, 21 bp, Homo sapiens
caaaaaaattaaaatggatgc

SEQ ID NO: 3676924 - DNA, 16 bp, Homo sapiens
caaaaaatgttttaaa

SEQ ID NO: 3676925 - DNA, 17 bp, Homo sapiens
caaaaaggatacataat

SEQ ID NO: 3676926 - DNA, 13 bp, Homo sapiens
caaaaaggttgct

SEQ ID NO: 3676927 - DNA, 12 bp, Homo sapiens
caaaaataaatt

SEQ ID NO: 3676928 - DNA, 11 bp, Homo sapiens
caaaactctac

SEQ ID NO: 3676929 - DNA, 15 bp, Homo sapiens
caaaactgcatttca

SEQ ID NO: 3676930 - DNA, 18 bp, Homo sapiens
caaaagatgcttctcact

SEQ ID NO: 3676931 - DNA, 15 bp, Homo sapiens
caaaagctgggcagg

SEQ ID NO: 3676932 - DNA, 11 bp, Homo sapiens
caaaataaaaa

SEQ ID NO: 3676933 - DNA, 22 bp, Homo sapiens
caaaataccagagccttcaagt

SEQ ID NO: 3676934 - DNA, 23 bp, Homo sapiens
caaaataccagagccttcaagtg

SEQ ID NO: 3676935 - DNA, 14 bp, Homo sapiens
caaaatagaaaagt

SEQ ID NO: 3676936 - DNA, 17 bp, Homo sapiens
caaaatagaaaagttat

SEQ ID NO: 3676937 - DNA, 13 bp, Homo sapiens
caaaatatttaaa

SEQ ID NO: 3676938 - DNA, 17 bp, Homo sapiens
caaaatatttaaaaatg

SEQ ID NO: 3676939 - DNA, 20 bp, Homo sapiens
caaaatatttaaaaatgtct

SEQ ID NO: 3676940 - DNA, 13 bp, Homo sapiens
caaaatctgtcca

SEQ ID NO: 3676941 - DNA, 21 bp, Homo sapiens
caaaatctgtccaaaggaggc

SEQ ID NO: 3676942 - DNA, 13 bp, Homo sapiens
caaaatttgacta

SEQ ID NO: 3676943 - DNA, 16 bp, Homo sapiens
caaacacacacaaaag

SEQ ID NO: 3676944 - DNA, 22 bp, Homo sapiens
caaacagagtatgtccgatggt

SEQ ID NO: 3676945 - DNA, 15 bp, Homo sapiens
caaacagtagagaac

SEQ ID NO: 3676946 - DNA, 22 bp, Homo sapiens
caaactcttcagttaattctta

SEQ ID NO: 3676947 - DNA, 17 bp, Homo sapiens
caaactgaagcagcctc

SEQ ID NO: 3676948 - DNA, 17 bp, Homo sapiens
caaactgcctaagccct

SEQ ID NO: 3676949 - DNA, 16 bp, Homo sapiens
caaactgttaaatgtg

SEQ ID NO: 3676950 - DNA, 21 bp, Homo sapiens
caaagaagctgtcttggaagt

SEQ ID NO: 3676951 - DNA, 15 bp, Homo sapiens
caaagaggcaagagg

SEQ ID NO: 3676952 - DNA, 16 bp, Homo sapiens
caaagattgagaagcc

SEQ ID NO: 3676953 - DNA, 16 bp, Homo sapiens
caaagccaagaaagaa

SEQ ID NO: 3676954 - DNA, 17 bp, Homo sapiens
caaagcctcctccagcc

SEQ ID NO: 3676955 - DNA, 21 bp, Homo sapiens
caaagctagggtggcccttgc

SEQ ID NO: 3676956 - DNA, 22 bp, Homo sapiens
caaagctagggtggcccttgca

SEQ ID NO: 3676957 - DNA, 14 bp, Homo sapiens
caaagctgagcctg

SEQ ID NO: 3676958 - DNA, 18 bp, Homo sapiens
caaagctttcctgcccca

SEQ ID NO: 3676959 - DNA, 11 bp, Homo sapiens
caaaggcagct

SEQ ID NO: 3676960 - DNA, 16 bp, Homo sapiens
caaaggcagctgtgtc

SEQ ID NO: 3676961 - DNA, 18 bp, Homo sapiens
caaaggcagctgtgtctg

SEQ ID NO: 3676962 - DNA, 13 bp, Homo sapiens
caaaggcatgctg

SEQ ID NO: 3676963 - DNA, 15 bp, Homo sapiens
caaaggcatgctgga

SEQ ID NO: 3676964 - DNA, 23 bp, Homo sapiens
caaagtacttgtcatagactcct

SEQ ID NO: 3676965 - DNA, 19 bp, Homo sapiens
caaagtattgtaaattata

SEQ ID NO: 3676966 - DNA, 13 bp, Homo sapiens
caaatatgtcctg

SEQ ID NO: 3676967 - DNA, 15 bp, Homo sapiens
caaatatgtcctggg

SEQ ID NO: 3676968 - DNA, 17 bp, Homo sapiens
caaatatgtcctggggt

SEQ ID NO: 3676969 - DNA, 14 bp, Homo sapiens
caaatcaccacaaa

SEQ ID NO: 3676970 - DNA, 15 bp, Homo sapiens
caaatcacccaatcc

SEQ ID NO: 3676971 - DNA, 17 bp, Homo sapiens
caaatccttagatctgg

SEQ ID NO: 3676972 - DNA, 18 bp, Homo sapiens
caaatcgtagcgtttgtt

SEQ ID NO: 3676973 - DNA, 16 bp, Homo sapiens
caaatctcagaacctt

SEQ ID NO: 3676974 - DNA, 18 bp, Homo sapiens
caaatgcagtatatttct

SEQ ID NO: 3676975 - DNA, 14 bp, Homo sapiens
caaatgtaaacatt

SEQ ID NO: 3676976 - DNA, 17 bp, Homo sapiens
caaatgtaaacattttc

SEQ ID NO: 3676977 - DNA, 18 bp, Homo sapiens
caaatgtcctccagaagc

SEQ ID NO: 3676978 - DNA, 18 bp, Homo sapiens
caaatgtgtgttcctgct

SEQ ID NO: 3676979 - DNA, 16 bp, Homo sapiens
caaattcgcaaacttt

SEQ ID NO: 3676980 - DNA, 17 bp, Homo sapiens
caacaaagattgagaag

SEQ ID NO: 3676981 - DNA, 22 bp, Homo sapiens
caacaacatgtataatattttt

SEQ ID NO: 3676982 - DNA, 24 bp, Homo sapiens
caacacttccagcatttagctggc

SEQ ID NO: 3676983 - DNA, 14 bp, Homo sapiens
caacagatctggaa

SEQ ID NO: 3676984 - DNA, 23 bp, Homo sapiens
caacagatctggaacctcagcct

SEQ ID NO: 3676985 - DNA, 21 bp, Homo sapiens
caacaggagctgggatcctaa

SEQ ID NO: 3676986 - DNA, 16 bp, Homo sapiens
caacagtgaagacaga

SEQ ID NO: 3676987 - DNA, 16 bp, Homo sapiens
caacagttacataatt

SEQ ID NO: 3676988 - DNA, 13 bp, Homo sapiens
caacagttttcct

SEQ ID NO: 3676989 - DNA, 22 bp, Homo sapiens
caacagttttcctatgctttga

SEQ ID NO: 3676990 - DNA, 18 bp, Homo sapiens
caacatgtataatatttt

SEQ ID NO: 3676991 - DNA, 19 bp, Homo sapiens
caacatgtataatattttt

SEQ ID NO: 3676992 - DNA, 23 bp, Homo sapiens
caacatgtataatatttttaatt

SEQ ID NO: 3676993 - DNA, 22 bp, Homo sapiens
caacatgttgggaaacttggct

SEQ ID NO: 3676994 - DNA, 19 bp, Homo sapiens
caaccactctgtggccagc

SEQ ID NO: 3676995 - DNA, 24 bp, Homo sapiens
caaccactctgtggccagcctggc

SEQ ID NO: 3676996 - DNA, 19 bp, Homo sapiens
caaccaggcacctcttcct

SEQ ID NO: 3676997 - DNA, 17 bp, Homo sapiens
caacccccaccccacac

SEQ ID NO: 3676998 - DNA, 22 bp, Homo sapiens
caacccttaccccttagcctcc

SEQ ID NO: 3676999 - DNA, 13 bp, Homo sapiens
caacgaggaagcc

SEQ ID NO: 3677000 - DNA, 17 bp, Homo sapiens
caacgtggcccagagaa

SEQ ID NO: 3677001 - DNA, 21 bp, Homo sapiens
caacgtggcccagagaagcca

SEQ ID NO: 3677002 - DNA, 17 bp, Homo sapiens
caactatgatttggaaa

SEQ ID NO: 3677003 - DNA, 14 bp, Homo sapiens
caactattttcaga

SEQ ID NO: 3677004 - DNA, 21 bp, Homo sapiens
caactattttcagatgtgaac

SEQ ID NO: 3677005 - DNA, 13 bp, Homo sapiens
caactatttttgt

SEQ ID NO: 3677006 - DNA, 18 bp, Homo sapiens
caactcaaaaaacattgt

SEQ ID NO: 3677007 - DNA, 16 bp, Homo sapiens
caactcgtatagcatg

SEQ ID NO: 3677008 - DNA, 13 bp, Homo sapiens
caactctagctgg

SEQ ID NO: 3677009 - DNA, 17 bp, Homo sapiens
caactgctggggagaca

SEQ ID NO: 3677010 - DNA, 19 bp, Homo sapiens
caacttctacttctgccct

SEQ ID NO: 3677011 - DNA, 16 bp, Homo sapiens
caacttggctgcagga

SEQ ID NO: 3677012 - DNA, 16 bp, Homo sapiens
caacttgtaaatgtgg

SEQ ID NO: 3677013 - DNA, 16 bp, Homo sapiens
caacttgtatttccaa

SEQ ID NO: 3677014 - DNA, 22 bp, Homo sapiens
caagaaagaaacccgacagagg

SEQ ID NO: 3677015 - DNA, 14 bp, Homo sapiens
caagaaagatgtat

SEQ ID NO: 3677016 - DNA, 20 bp, Homo sapiens
caagaaagctcactgtagct

SEQ ID NO: 3677017 - DNA, 21 bp, Homo sapiens
caagacagatgccccagagct

SEQ ID NO: 3677018 - DNA, 22 bp, Homo sapiens
caagacagatgccccagagctg

SEQ ID NO: 3677019 - DNA, 20 bp, Homo sapiens
caagagcagcctgtggcatc

SEQ ID NO: 3677020 - DNA, 22 bp, Homo sapiens
caagaggaaggggtgctgtgag

SEQ ID NO: 3677021 - DNA, 19 bp, Homo sapiens
caagagtagttatataatt

SEQ ID NO: 3677022 - DNA, 18 bp, Homo sapiens
caagcaagaaacactggg

SEQ ID NO: 3677023 - DNA, 18 bp, Homo sapiens
caagcagaggaccagggc

SEQ ID NO: 3677024 - DNA, 22 bp, Homo sapiens
caagcagaggaccagggccttt

SEQ ID NO: 3677025 - DNA, 12 bp, Homo sapiens
caagcaggaagc

SEQ ID NO: 3677026 - DNA, 15 bp, Homo sapiens
caagcaggaagctca

SEQ ID NO: 3677027 - DNA, 18 bp, Homo sapiens
caagcagtcgtgcctgtg

SEQ ID NO: 3677028 - DNA, 21 bp, Homo sapiens
caagcatcttgggggggtggc

SEQ ID NO: 3677029 - DNA, 15 bp, Homo sapiens
caagccaagcagcca

SEQ ID NO: 3677030 - DNA, 18 bp, Homo sapiens
caagccaagggaacctgt

SEQ ID NO: 3677031 - DNA, 13 bp, Homo sapiens
caagcctgagaac

SEQ ID NO: 3677032 - DNA, 16 bp, Homo sapiens
caagcctgtgcaaaaa

SEQ ID NO: 3677033 - DNA, 21 bp, Homo sapiens
caagcctgtgcaaaaaaatta

SEQ ID NO: 3677034 - DNA, 13 bp, Homo sapiens
caagcgcctggct

SEQ ID NO: 3677035 - DNA, 17 bp, Homo sapiens
caagctcctcctccctg

SEQ ID NO: 3677036 - DNA, 23 bp, Homo sapiens
caagctcctcctccctgcatctg

SEQ ID NO: 3677037 - DNA, 15 bp, Homo sapiens
caagctgtgctggga

SEQ ID NO: 3677038 - DNA, 23 bp, Homo sapiens
caagctgtgctgggaagcccgga

SEQ ID NO: 3677039 - DNA, 18 bp, Homo sapiens
caagctgttagttgctgt

SEQ ID NO: 3677040 - DNA, 18 bp, Homo sapiens
caagcttagtcctgggag

SEQ ID NO: 3677041 - DNA, 19 bp, Homo sapiens
caagcttagtcctgggaga

SEQ ID NO: 3677042 - DNA, 22 bp, Homo sapiens
caagcttagtcctgggagagga

SEQ ID NO: 3677043 - DNA, 18 bp, Homo sapiens
caaggaccaggactccct

SEQ ID NO: 3677044 - DNA, 16 bp, Homo sapiens
caaggactttgcagcc

SEQ ID NO: 3677045 - DNA, 11 bp, Homo sapiens
caaggagctgc

SEQ ID NO: 3677046 - DNA, 12 bp, Homo sapiens
caaggagggaga

SEQ ID NO: 3677047 - DNA, 15 bp, Homo sapiens
caaggatagatgctg

SEQ ID NO: 3677048 - DNA, 17 bp, Homo sapiens
caaggatagatgctggc

SEQ ID NO: 3677049 - DNA, 17 bp, Homo sapiens
caaggccagagtggcct

SEQ ID NO: 3677050 - DNA, 15 bp, Homo sapiens
caaggccccttccac

SEQ ID NO: 3677051 - DNA, 17 bp, Homo sapiens
caaggccccttccacgg

SEQ ID NO: 3677052 - DNA, 22 bp, Homo sapiens
caaggccccttccacgggggct

SEQ ID NO: 3677053 - DNA, 23 bp, Homo sapiens
caaggctcttctccttggaggac

SEQ ID NO: 3677054 - DNA, 18 bp, Homo sapiens
caaggctgggggaagaag

SEQ ID NO: 3677055 - DNA, 15 bp, Homo sapiens
caagggaccttcatg

SEQ ID NO: 3677056 - DNA, 22 bp, Homo sapiens
caagggatctgccattgggacc

SEQ ID NO: 3677057 - DNA, 20 bp, Homo sapiens
caagggatctggtcctaccc

SEQ ID NO: 3677058 - DNA, 22 bp, Homo sapiens
caaggggcttcaggtccaggct

SEQ ID NO: 3677059 - DNA, 18 bp, Homo sapiens
caaggtgatttcagactg

SEQ ID NO: 3677060 - DNA, 23 bp, Homo sapiens
caaggtgatttcagactgcagag

SEQ ID NO: 3677061 - DNA, 19 bp, Homo sapiens
caaggtgtggaggctcctg

SEQ ID NO: 3677062 - DNA, 20 bp, Homo sapiens
caaggtgtggaggctcctgt

SEQ ID NO: 3677063 - DNA, 18 bp, Homo sapiens
caaggttcaacttattaa

SEQ ID NO: 3677064 - DNA, 22 bp, Homo sapiens
caaggtttaggctggtggccca

SEQ ID NO: 3677065 - DNA, 23 bp, Homo sapiens
caaggtttaggctggtggcccag

SEQ ID NO: 3677066 - DNA, 19 bp, Homo sapiens
caaggttttataaggctga

SEQ ID NO: 3677067 - DNA, 20 bp, Homo sapiens
caagtaccaccaagggatct

SEQ ID NO: 3677068 - DNA, 19 bp, Homo sapiens
caagtacttaactatctgt

SEQ ID NO: 3677069 - DNA, 13 bp, Homo sapiens
caagtagaatctc

SEQ ID NO: 3677070 - DNA, 16 bp, Homo sapiens
caagtagaatctcagt

SEQ ID NO: 3677071 - DNA, 23 bp, Homo sapiens
caagtagaatctcagttgatttt

SEQ ID NO: 3677072 - DNA, 16 bp, Homo sapiens
caagtcagctccagct

SEQ ID NO: 3677073 - DNA, 15 bp, Homo sapiens
caagtgagaccctgt

SEQ ID NO: 3677074 - DNA, 16 bp, Homo sapiens
caagtgaggccggaga

SEQ ID NO: 3677075 - DNA, 21 bp, Homo sapiens
caagtgaggccggagaggagt

SEQ ID NO: 3677076 - DNA, 16 bp, Homo sapiens
caagtgatgtgtttac

SEQ ID NO: 3677077 - DNA, 20 bp, Homo sapiens
caagtgcacggggcacagcg

SEQ ID NO: 3677078 - DNA, 20 bp, Homo sapiens
caagtgccagggctgggccc

SEQ ID NO: 3677079 - DNA, 16 bp, Homo sapiens
caagtgccgcaaattg

SEQ ID NO: 3677080 - DNA, 12 bp, Homo sapiens
caagtgcctaga

SEQ ID NO: 3677081 - DNA, 16 bp, Homo sapiens
caagtgctgaacagtg

SEQ ID NO: 3677082 - DNA, 20 bp, Homo sapiens
caagtggtggtaaccctggt

SEQ ID NO: 3677083 - DNA, 22 bp, Homo sapiens
caagtggtggtaaccctggtgg

SEQ ID NO: 3677084 - DNA, 21 bp, Homo sapiens
caagtgtgggccactgtggtg

SEQ ID NO: 3677085 - DNA, 16 bp, Homo sapiens
caagtgttcactgctc

SEQ ID NO: 3677086 - DNA, 18 bp, Homo sapiens
caataaaatttttttaaa

SEQ ID NO: 3677087 - DNA, 20 bp, Homo sapiens
caataaatctgacccagtgc

SEQ ID NO: 3677088 - DNA, 20 bp, Homo sapiens
caatatagaaaaataaaaat

SEQ ID NO: 3677089 - DNA, 11 bp, Homo sapiens
caatattttcc

SEQ ID NO: 3677090 - DNA, 22 bp, Homo sapiens
caatattttccatgaaaatgca

SEQ ID NO: 3677091 - DNA, 18 bp, Homo sapiens
caatcaagtctgtttact

SEQ ID NO: 3677092 - DNA, 14 bp, Homo sapiens
caatctaacaataa

SEQ ID NO: 3677093 - DNA, 16 bp, Homo sapiens
caatctcagctcactg

SEQ ID NO: 3677094 - DNA, 19 bp, Homo sapiens
caatctggcttagtgccac

SEQ ID NO: 3677095 - DNA, 13 bp, Homo sapiens
caatgggaagcag

SEQ ID NO: 3677096 - DNA, 16 bp, Homo sapiens
caatggtttgcaagga

SEQ ID NO: 3677097 - DNA, 17 bp, Homo sapiens
caatggtttgcaaggaa

SEQ ID NO: 3677098 - DNA, 21 bp, Homo sapiens
caatggtttttaaattttgta

SEQ ID NO: 3677099 - DNA, 18 bp, Homo sapiens
caatgtgaggggtcccta

SEQ ID NO: 3677100 - DNA, 23 bp, Homo sapiens
caattaggcagactctttatgct

SEQ ID NO: 3677101 - DNA, 21 bp, Homo sapiens
caattataagaggatatgaac

SEQ ID NO: 3677102 - DNA, 17 bp, Homo sapiens
caattatagtttgacag

SEQ ID NO: 3677103 - DNA, 19 bp, Homo sapiens
caattcttacaaacatgtg

SEQ ID NO: 3677104 - DNA, 22 bp, Homo sapiens
caattgaaggatcatctgaagg

SEQ ID NO: 3677105 - DNA, 14 bp, Homo sapiens
caattgacaacagt

SEQ ID NO: 3677106 - DNA, 21 bp, Homo sapiens
caattgacaacagttacataa

SEQ ID NO: 3677107 - DNA, 22 bp, Homo sapiens
caattgacaacagttacataat

SEQ ID NO: 3677108 - DNA, 14 bp, Homo sapiens
caattgactgccct

SEQ ID NO: 3677109 - DNA, 14 bp, Homo sapiens
caatttcctggccc

SEQ ID NO: 3677110 - DNA, 22 bp, Homo sapiens
caatttctgtgttgccaagctc

SEQ ID NO: 3677111 - DNA, 23 bp, Homo sapiens
caattttaatttagtaaatgtta

SEQ ID NO: 3677112 - DNA, 17 bp, Homo sapiens
cacaaactgtaatacaa

SEQ ID NO: 3677113 - DNA, 11 bp, Homo sapiens
cacaaagccca

SEQ ID NO: 3677114 - DNA, 16 bp, Homo sapiens
cacaaggacttcctgt

SEQ ID NO: 3677115 - DNA, 21 bp, Homo sapiens
cacaaggatagatgctggccc

SEQ ID NO: 3677116 - DNA, 19 bp, Homo sapiens
cacaagtgccgcaaattgt

SEQ ID NO: 3677117 - DNA, 20 bp, Homo sapiens
cacaagtggtggtaaccctg

SEQ ID NO: 3677118 - DNA, 21 bp, Homo sapiens
cacaatctggcttagtgccac

SEQ ID NO: 3677119 - DNA, 23 bp, Homo sapiens
cacacaaaagggaacccagctct

SEQ ID NO: 3677120 - DNA, 18 bp, Homo sapiens
cacacaaaccttctgcct

SEQ ID NO: 3677121 - DNA, 19 bp, Homo sapiens
cacacacaaaagggaaccc

SEQ ID NO: 3677122 - DNA, 15 bp, Homo sapiens
cacacacacaaacct

SEQ ID NO: 3677123 - DNA, 11 bp, Homo sapiens
cacacacctgt

SEQ ID NO: 3677124 - DNA, 16 bp, Homo sapiens
cacacagatacacaca

SEQ ID NO: 3677125 - DNA, 20 bp, Homo sapiens
cacacatatatattacaagg

SEQ ID NO: 3677126 - DNA, 13 bp, Homo sapiens
cacacctcagttc

SEQ ID NO: 3677127 - DNA, 22 bp, Homo sapiens
cacacctcagttcccttggcct

SEQ ID NO: 3677128 - DNA, 12 bp, Homo sapiens
cacactcagtgg

SEQ ID NO: 3677129 - DNA, 13 bp, Homo sapiens
cacactgaggcag

SEQ ID NO: 3677130 - DNA, 15 bp, Homo sapiens
cacactgaggcaggg

SEQ ID NO: 3677131 - DNA, 17 bp, Homo sapiens
cacactgagtttgaaca

SEQ ID NO: 3677132 - DNA, 17 bp, Homo sapiens
cacacttgttccagctc

SEQ ID NO: 3677133 - DNA, 20 bp, Homo sapiens
cacagacattctgccaggcc

SEQ ID NO: 3677134 - DNA, 21 bp, Homo sapiens
cacagagctttggtctgtgtg

SEQ ID NO: 3677135 - DNA, 22 bp, Homo sapiens
cacagatcacagcttcagccag

SEQ ID NO: 3677136 - DNA, 15 bp, Homo sapiens
cacagcttcccctct

SEQ ID NO: 3677137 - DNA, 22 bp, Homo sapiens
cacagcttcccctctctcctcc

SEQ ID NO: 3677138 - DNA, 18 bp, Homo sapiens
cacagcttgacctgaggc

SEQ ID NO: 3677139 - DNA, 21 bp, Homo sapiens
cacagctttgaggaacatgca

SEQ ID NO: 3677140 - DNA, 14 bp, Homo sapiens
cacaggaggcaggc

SEQ ID NO: 3677141 - DNA, 21 bp, Homo sapiens
cacaggaggcaggcatggccc

SEQ ID NO: 3677142 - DNA, 22 bp, Homo sapiens
cacaggaggcaggcatggccct

SEQ ID NO: 3677143 - DNA, 16 bp, Homo sapiens
cacagggtctgctctt

SEQ ID NO: 3677144 - DNA, 16 bp, Homo sapiens
cacagggtgggcctcg

SEQ ID NO: 3677145 - DNA, 14 bp, Homo sapiens
cacagggttgggcc

SEQ ID NO: 3677146 - DNA, 23 bp, Homo sapiens
cacagggttgggcccagatctgg

SEQ ID NO: 3677147 - DNA, 13 bp, Homo sapiens
cacaggtgaaagt

SEQ ID NO: 3677148 - DNA, 19 bp, Homo sapiens
cacagtctcagttctcttg

SEQ ID NO: 3677149 - DNA, 22 bp, Homo sapiens
cacagtgaaggctgtccttacc

SEQ ID NO: 3677150 - DNA, 14 bp, Homo sapiens
cacagtgggagcca

SEQ ID NO: 3677151 - DNA, 18 bp, Homo sapiens
cacagttctttgggccag

SEQ ID NO: 3677152 - DNA, 20 bp, Homo sapiens
cacagttctttgggccagac

SEQ ID NO: 3677153 - DNA, 18 bp, Homo sapiens
cacatccgcgtgtgcctg

SEQ ID NO: 3677154 - DNA, 23 bp, Homo sapiens
cacatccgcgtgtgcctgtgtgc

SEQ ID NO: 3677155 - DNA, 14 bp, Homo sapiens
cacatctaagcctg

SEQ ID NO: 3677156 - DNA, 21 bp, Homo sapiens
cacatcttggctatgtaattc

SEQ ID NO: 3677157 - DNA, 17 bp, Homo sapiens
cacatgcccccacttcc

SEQ ID NO: 3677158 - DNA, 13 bp, Homo sapiens
caccaaaaacaaa

SEQ ID NO: 3677159 - DNA, 14 bp, Homo sapiens
caccaagccaaggg

SEQ ID NO: 3677160 - DNA, 19 bp, Homo sapiens
caccacagccagcacctgg

SEQ ID NO: 3677161 - DNA, 18 bp, Homo sapiens
caccaccccaacaaacca

SEQ ID NO: 3677162 - DNA, 22 bp, Homo sapiens
caccaccctagtcccttcccct

SEQ ID NO: 3677163 - DNA, 22 bp, Homo sapiens
caccacgggacatcacagggtg

SEQ ID NO: 3677164 - DNA, 14 bp, Homo sapiens
caccagcattcctt

SEQ ID NO: 3677165 - DNA, 15 bp, Homo sapiens
caccagcattccttt

SEQ ID NO: 3677166 - DNA, 12 bp, Homo sapiens
caccagccagcg

SEQ ID NO: 3677167 - DNA, 16 bp, Homo sapiens
caccaggagaaccact

SEQ ID NO: 3677168 - DNA, 17 bp, Homo sapiens
caccaggagaaccacta

SEQ ID NO: 3677169 - DNA, 19 bp, Homo sapiens
caccaggagaaccactaca

SEQ ID NO: 3677170 - DNA, 13 bp, Homo sapiens
caccaggccacct

SEQ ID NO: 3677171 - DNA, 15 bp, Homo sapiens
caccaggggtttctc

SEQ ID NO: 3677172 - DNA, 16 bp, Homo sapiens
caccaggtagaacaca

SEQ ID NO: 3677173 - DNA, 19 bp, Homo sapiens
caccaggtgcctttcaaat

SEQ ID NO: 3677174 - DNA, 22 bp, Homo sapiens
caccaggtgcctttcaaattta

SEQ ID NO: 3677175 - DNA, 13 bp, Homo sapiens
caccattctgact

SEQ ID NO: 3677176 - DNA, 14 bp, Homo sapiens
caccattctgactc

SEQ ID NO: 3677177 - DNA, 15 bp, Homo sapiens
cacccaaagctgagc

SEQ ID NO: 3677178 - DNA, 16 bp, Homo sapiens
cacccaaagctgagcc

SEQ ID NO: 3677179 - DNA, 21 bp, Homo sapiens
cacccaagagggctgcttccc

SEQ ID NO: 3677180 - DNA, 14 bp, Homo sapiens
cacccaatcccagt

SEQ ID NO: 3677181 - DNA, 14 bp, Homo sapiens
cacccacctccctg

SEQ ID NO: 3677182 - DNA, 18 bp, Homo sapiens
cacccacctccctgcctc

SEQ ID NO: 3677183 - DNA, 20 bp, Homo sapiens
cacccaggctggagtgcagt

SEQ ID NO: 3677184 - DNA, 11 bp, Homo sapiens
caccccacact

SEQ ID NO: 3677185 - DNA, 17 bp, Homo sapiens
caccccttcctcagcct

SEQ ID NO: 3677186 - DNA, 20 bp, Homo sapiens
cacccggcccatatccctgg

SEQ ID NO: 3677187 - DNA, 16 bp, Homo sapiens
caccctagtcccttcc

SEQ ID NO: 3677188 - DNA, 17 bp, Homo sapiens
caccctagtcccttccc

SEQ ID NO: 3677189 - DNA, 17 bp, Homo sapiens
caccctcattctactga

SEQ ID NO: 3677190 - DNA, 17 bp, Homo sapiens
caccctgcccctcagag

SEQ ID NO: 3677191 - DNA, 14 bp, Homo sapiens
caccctgggccctg

SEQ ID NO: 3677192 - DNA, 17 bp, Homo sapiens
caccctgggccctgggc

SEQ ID NO: 3677193 - DNA, 22 bp, Homo sapiens
caccctgggccctgggctggaa

SEQ ID NO: 3677194 - DNA, 16 bp, Homo sapiens
caccctggtgggccaa

SEQ ID NO: 3677195 - DNA, 20 bp, Homo sapiens
caccctgtccaaactgccta

SEQ ID NO: 3677196 - DNA, 23 bp, Homo sapiens
caccctgtccaaactgcctaagc

SEQ ID NO: 3677197 - DNA, 16 bp, Homo sapiens
caccgaggggcctttg

SEQ ID NO: 3677198 - DNA, 20 bp, Homo sapiens
caccggggacaggccgcagc

SEQ ID NO: 3677199 - DNA, 16 bp, Homo sapiens
cacctaaacggggcag

SEQ ID NO: 3677200 - DNA, 17 bp, Homo sapiens
cacctaatccaggcaga

SEQ ID NO: 3677201 - DNA, 16 bp, Homo sapiens
cacctacccctgactt

SEQ ID NO: 3677202 - DNA, 21 bp, Homo sapiens
cacctagtaagtgcctgctgt

SEQ ID NO: 3677203 - DNA, 19 bp, Homo sapiens
cacctataaaacaggtcaa

SEQ ID NO: 3677204 - DNA, 11 bp, Homo sapiens
cacctcagttc

SEQ ID NO: 3677205 - DNA, 18 bp, Homo sapiens
cacctcagttcccttggc

SEQ ID NO: 3677206 - DNA, 22 bp, Homo sapiens
cacctcagttcccttggcctca

SEQ ID NO: 3677207 - DNA, 23 bp, Homo sapiens
cacctcagttcccttggcctcag

SEQ ID NO: 3677208 - DNA, 12 bp, Homo sapiens
cacctccaggct

SEQ ID NO: 3677209 - DNA, 16 bp, Homo sapiens
cacctcccatcctaat

SEQ ID NO: 3677210 - DNA, 16 bp, Homo sapiens
cacctccccagcattc

SEQ ID NO: 3677211 - DNA, 14 bp, Homo sapiens
cacctccccagcct

SEQ ID NO: 3677212 - DNA, 21 bp, Homo sapiens
cacctccctatactgcttgga

SEQ ID NO: 3677213 - DNA, 10 bp, Homo sapiens
cacctccctg

SEQ ID NO: 3677214 - DNA, 12 bp, Homo sapiens
cacctccctgcc

SEQ ID NO: 3677215 - DNA, 17 bp, Homo sapiens
cacctcctgctgggcag

SEQ ID NO: 3677216 - DNA, 13 bp, Homo sapiens
cacctctggactg

SEQ ID NO: 3677217 - DNA, 17 bp, Homo sapiens
cacctctggactggcta

SEQ ID NO: 3677218 - DNA, 18 bp, Homo sapiens
cacctctggactggctag

SEQ ID NO: 3677219 - DNA, 18 bp, Homo sapiens
cacctgcccatcacaggg

SEQ ID NO: 3677220 - DNA, 22 bp, Homo sapiens
cacctgcccatcacagggttgg

SEQ ID NO: 3677221 - DNA, 18 bp, Homo sapiens
cacctgtaatcccagcac

SEQ ID NO: 3677222 - DNA, 21 bp, Homo sapiens
cacctgtcaaacaaagccaga

SEQ ID NO: 3677223 - DNA, 13 bp, Homo sapiens
caccttaggcagg

SEQ ID NO: 3677224 - DNA, 18 bp, Homo sapiens
caccttggacatcctcct

SEQ ID NO: 3677225 - DNA, 17 bp, Homo sapiens
caccttggcaccagaca

SEQ ID NO: 3677226 - DNA, 15 bp, Homo sapiens
caccttgtgcctggg

SEQ ID NO: 3677227 - DNA, 16 bp, Homo sapiens
cacgactgcccggcag

SEQ ID NO: 3677228 - DNA, 14 bp, Homo sapiens
cacgcccgtcctgc

SEQ ID NO: 3677229 - DNA, 20 bp, Homo sapiens
cacgcctgtaatcctagcac

SEQ ID NO: 3677230 - DNA, 15 bp, Homo sapiens
cacgtggagagctgg

SEQ ID NO: 3677231 - DNA, 23 bp, Homo sapiens
cacgtggagagctggtgcccgga

SEQ ID NO: 3677232 - DNA, 23 bp, Homo sapiens
cacgtggcctcttgagcagtggc

SEQ ID NO: 3677233 - DNA, 23 bp, Homo sapiens
cacgtggttggggccctgccctg

SEQ ID NO: 3677234 - DNA, 16 bp, Homo sapiens
cacgttgcctctactt

SEQ ID NO: 3677235 - DNA, 13 bp, Homo sapiens
cactaagcagagg

SEQ ID NO: 3677236 - DNA, 15 bp, Homo sapiens
cactaagcagaggag

SEQ ID NO: 3677237 - DNA, 13 bp, Homo sapiens
cactactgacatg

SEQ ID NO: 3677238 - DNA, 15 bp, Homo sapiens
cactactgacatgtg

SEQ ID NO: 3677239 - DNA, 20 bp, Homo sapiens
cactaggcccccacttgcct

SEQ ID NO: 3677240 - DNA, 21 bp, Homo sapiens
cactaggcccccacttgcctc

SEQ ID NO: 3677241 - DNA, 21 bp, Homo sapiens
cactatgaagatgtttcaaaa

SEQ ID NO: 3677242 - DNA, 15 bp, Homo sapiens
cactcaagccaagca

SEQ ID NO: 3677243 - DNA, 17 bp, Homo sapiens
cactcaaggcggtgctt

SEQ ID NO: 3677244 - DNA, 20 bp, Homo sapiens
cactcagtgggctgtttctg

SEQ ID NO: 3677245 - DNA, 14 bp, Homo sapiens
cactccagcctggg

SEQ ID NO: 3677246 - DNA, 16 bp, Homo sapiens
cactccagcctgggtg

SEQ ID NO: 3677247 - DNA, 19 bp, Homo sapiens
cactccgagaggtgggcca

SEQ ID NO: 3677248 - DNA, 14 bp, Homo sapiens
cactcgggtttctc

SEQ ID NO: 3677249 - DNA, 17 bp, Homo sapiens
cactctaccctcccacc

SEQ ID NO: 3677250 - DNA, 21 bp, Homo sapiens
cactctaccctcccaccccct

SEQ ID NO: 3677251 - DNA, 18 bp, Homo sapiens
cactctatgagttggact

SEQ ID NO: 3677252 - DNA, 14 bp, Homo sapiens
cactctccccacac

SEQ ID NO: 3677253 - DNA, 16 bp, Homo sapiens
cactctgcttctctga

SEQ ID NO: 3677254 - DNA, 17 bp, Homo sapiens
cactctgcttctctgac

SEQ ID NO: 3677255 - DNA, 14 bp, Homo sapiens
cactctgtggccag

SEQ ID NO: 3677256 - DNA, 24 bp, Homo sapiens
cactctgtggccagcctggcatca

SEQ ID NO: 3677257 - DNA, 17 bp, Homo sapiens
cactcttgttcccacac

SEQ ID NO: 3677258 - DNA, 15 bp, Homo sapiens
cactgaccagaacta

SEQ ID NO: 3677259 - DNA, 13 bp, Homo sapiens
cactgagctggct

SEQ ID NO: 3677260 - DNA, 15 bp, Homo sapiens
cactgagctggctga

SEQ ID NO: 3677261 - DNA, 21 bp, Homo sapiens
cactgagctggctgactaagc

SEQ ID NO: 3677262 - DNA, 16 bp, Homo sapiens
cactgaggcagggaag

SEQ ID NO: 3677263 - DNA, 19 bp, Homo sapiens
cactgaggcagggaagtcc

SEQ ID NO: 3677264 - DNA, 14 bp, Homo sapiens
cactgagtttgaac

SEQ ID NO: 3677265 - DNA, 19 bp, Homo sapiens
cactgatgctgcccctcat

SEQ ID NO: 3677266 - DNA, 15 bp, Homo sapiens
cactgcactccagcc

SEQ ID NO: 3677267 - DNA, 19 bp, Homo sapiens
cactgcactccagcctggg

SEQ ID NO: 3677268 - DNA, 13 bp, Homo sapiens
cactgccaggacc

SEQ ID NO: 3677269 - DNA, 17 bp, Homo sapiens
cactgccatgccagctt

SEQ ID NO: 3677270 - DNA, 19 bp, Homo sapiens
cactgccttcgcttcttgc

SEQ ID NO: 3677271 - DNA, 17 bp, Homo sapiens
cactgcgggagctctgt

SEQ ID NO: 3677272 - DNA, 16 bp, Homo sapiens
cactggaagcaggatg

SEQ ID NO: 3677273 - DNA, 14 bp, Homo sapiens
cactgtcttgaaga

SEQ ID NO: 3677274 - DNA, 22 bp, Homo sapiens
cactgtgaaccggctcccaccc

SEQ ID NO: 3677275 - DNA, 13 bp, Homo sapiens
cactgtgaaggac

SEQ ID NO: 3677276 - DNA, 19 bp, Homo sapiens
cactgttctgaaagtgact

SEQ ID NO: 3677277 - DNA, 14 bp, Homo sapiens
cacttacatttttg

SEQ ID NO: 3677278 - DNA, 15 bp, Homo sapiens
cacttacatttttgt

SEQ ID NO: 3677279 - DNA, 17 bp, Homo sapiens
cacttatcttctggatt

SEQ ID NO: 3677280 - DNA, 18 bp, Homo sapiens
cacttatcttctggatta

SEQ ID NO: 3677281 - DNA, 18 bp, Homo sapiens
cacttcaggtcaggagtt

SEQ ID NO: 3677282 - DNA, 19 bp, Homo sapiens
cacttccccctcttcagca

SEQ ID NO: 3677283 - DNA, 23 bp, Homo sapiens
cacttcgggaggtcgaggcagga

SEQ ID NO: 3677284 - DNA, 17 bp, Homo sapiens
cacttgcctcttccttg

SEQ ID NO: 3677285 - DNA, 21 bp, Homo sapiens
cacttgcctcttccttgaaga

SEQ ID NO: 3677286 - DNA, 15 bp, Homo sapiens
cacttgctgagtgaa

SEQ ID NO: 3677287 - DNA, 22 bp, Homo sapiens
cactttataagtcattgtatgt

SEQ ID NO: 3677288 - DNA, 23 bp, Homo sapiens
cactttattgccttttaattttt

SEQ ID NO: 3677289 - DNA, 13 bp, Homo sapiens
cactttgggaggc

SEQ ID NO: 3677290 - DNA, 13 bp, Homo sapiens
cactttgtaaatt

SEQ ID NO: 3677291 - DNA, 12 bp, Homo sapiens
cacttttctggg

SEQ ID NO: 3677292 - DNA, 18 bp, Homo sapiens
cagaaaaatatgtaccaa

SEQ ID NO: 3677293 - DNA, 22 bp, Homo sapiens
cagaaaaatatgtaccaagaat

SEQ ID NO: 3677294 - DNA, 14 bp, Homo sapiens
cagaaaacaaaact

SEQ ID NO: 3677295 - DNA, 11 bp, Homo sapiens
cagaacactgt

SEQ ID NO: 3677296 - DNA, 16 bp, Homo sapiens
cagaactaccaggtgg

SEQ ID NO: 3677297 - DNA, 20 bp, Homo sapiens
cagaactcaaatggggccag

SEQ ID NO: 3677298 - DNA, 22 bp, Homo sapiens
cagaactcaaatggggccagat

SEQ ID NO: 3677299 - DNA, 13 bp, Homo sapiens
cagaactcctacc

SEQ ID NO: 3677300 - DNA, 15 bp, Homo sapiens
cagaactcctacctg

SEQ ID NO: 3677301 - DNA, 21 bp, Homo sapiens
cagaacttgaccctgagctga

SEQ ID NO: 3677302 - DNA, 15 bp, Homo sapiens
cagaagaaggcagca

SEQ ID NO: 3677303 - DNA, 15 bp, Homo sapiens
cagaagcctctggct

SEQ ID NO: 3677304 - DNA, 13 bp, Homo sapiens
ttgacctgaggct

SEQ ID NO: 3677305 - DNA, 20 bp, Homo sapiens
ttgactgccctcttactgtt

SEQ ID NO: 3677306 - DNA, 20 bp, Homo sapiens
ttgacttgacagaacactgt

SEQ ID NO: 3677307 - DNA, 21 bp, Homo sapiens
ttgacttgacagaacactgtc

SEQ ID NO: 3677308 - DNA, 15 bp, Homo sapiens
ttgactttagtgaaa

SEQ ID NO: 3677309 - DNA, 17 bp, Homo sapiens
ttgactttagtgaaagc

SEQ ID NO: 3677310 - DNA, 17 bp, Homo sapiens
ttgactttttaaaattc

SEQ ID NO: 3677311 - DNA, 23 bp, Homo sapiens
ttgagaactggttttagcattta

SEQ ID NO: 3677312 - DNA, 19 bp, Homo sapiens
ttgagcagtggctggtcca

SEQ ID NO: 3677313 - DNA, 22 bp, Homo sapiens
ttgagctgcctccagcctggtg

SEQ ID NO: 3677314 - DNA, 22 bp, Homo sapiens
ttgaggaattcagaagtggaga

SEQ ID NO: 3677315 - DNA, 20 bp, Homo sapiens
ttgagggacgctttgtctgt

SEQ ID NO: 3677316 - DNA, 21 bp, Homo sapiens
ttgagggacgctttgtctgtc

SEQ ID NO: 3677317 - DNA, 16 bp, Homo sapiens
ttgagttcaggtagct

SEQ ID NO: 3677318 - DNA, 11 bp, Homo sapiens
ttgagtttgtc

SEQ ID NO: 3677319 - DNA, 23 bp, Homo sapiens
ttgagtttgtcgctcatgtgtgc

SEQ ID NO: 3677320 - DNA, 18 bp, Homo sapiens
ttgatcattttcccccca

SEQ ID NO: 3677321 - DNA, 22 bp, Homo sapiens
ttgatcattttccccccactct

SEQ ID NO: 3677322 - DNA, 18 bp, Homo sapiens
ttgatgagttaactgtga

SEQ ID NO: 3677323 - DNA, 19 bp, Homo sapiens
ttgatggaagtgggccagt

SEQ ID NO: 3677324 - DNA, 14 bp, Homo sapiens
ttgatggggaagga

SEQ ID NO: 3677325 - DNA, 18 bp, Homo sapiens
ttgatgtggccctggctg

SEQ ID NO: 3677326 - DNA, 14 bp, Homo sapiens
ttgatgttacagat

SEQ ID NO: 3677327 - DNA, 15 bp, Homo sapiens
ttgatgtttgtggcc

SEQ ID NO: 3677328 - DNA, 19 bp, Homo sapiens
ttgatgtttgtggcctcag

SEQ ID NO: 3677329 - DNA, 22 bp, Homo sapiens
ttgatgtttgtggcctcagaat

SEQ ID NO: 3677330 - DNA, 14 bp, Homo sapiens
ttgattacagtgca

SEQ ID NO: 3677331 - DNA, 22 bp, Homo sapiens
ttgattcaaaatatttaaaaat

SEQ ID NO: 3677332 - DNA, 17 bp, Homo sapiens
ttgatttaaacacacag

SEQ ID NO: 3677333 - DNA, 17 bp, Homo sapiens
ttgattttcacagcttt

SEQ ID NO: 3677334 - DNA, 14 bp, Homo sapiens
ttgattttctggat

SEQ ID NO: 3677335 - DNA, 19 bp, Homo sapiens
ttgcaaaaactacaaccaa

SEQ ID NO: 3677336 - DNA, 18 bp, Homo sapiens
ttgcaaagtattgtaaat

SEQ ID NO: 3677337 - DNA, 21 bp, Homo sapiens
ttgcaccactgcactccagcc

SEQ ID NO: 3677338 - DNA, 20 bp, Homo sapiens
ttgcagccggcacagggtct

SEQ ID NO: 3677339 - DNA, 23 bp, Homo sapiens
ttgcagctaaggaggggaaaaaa

SEQ ID NO: 3677340 - DNA, 14 bp, Homo sapiens
ttgcatatatacat

SEQ ID NO: 3677341 - DNA, 14 bp, Homo sapiens
ttgcatttcttgtg

SEQ ID NO: 3677342 - DNA, 15 bp, Homo sapiens
ttgccaaaaaggata

SEQ ID NO: 3677343 - DNA, 18 bp, Homo sapiens
ttgccaaaataccagagc

SEQ ID NO: 3677344 - DNA, 22 bp, Homo sapiens
ttgccaaaataccagagccttc

SEQ ID NO: 3677345 - DNA, 13 bp, Homo sapiens
ttgccaaaattca

SEQ ID NO: 3677346 - DNA, 22 bp, Homo sapiens
ttgccaagctccaagccccatc

SEQ ID NO: 3677347 - DNA, 13 bp, Homo sapiens
ttgccaccaggag

SEQ ID NO: 3677348 - DNA, 19 bp, Homo sapiens
ttgccagagatccaaaaga

SEQ ID NO: 3677349 - DNA, 13 bp, Homo sapiens
ttgcccctgagac

SEQ ID NO: 3677350 - DNA, 15 bp, Homo sapiens
ttgcctccaggtgca

SEQ ID NO: 3677351 - DNA, 20 bp, Homo sapiens
ttgcctccaggtgcagaggt

SEQ ID NO: 3677352 - DNA, 15 bp, Homo sapiens
ttgcctgcagggcca

SEQ ID NO: 3677353 - DNA, 23 bp, Homo sapiens
ttgcctttcagtattgacactga

SEQ ID NO: 3677354 - DNA, 21 bp, Homo sapiens
ttgcctttcctgctacatttg

SEQ ID NO: 3677355 - DNA, 22 bp, Homo sapiens
ttgctatcaacaataaaatttt

SEQ ID NO: 3677356 - DNA, 15 bp, Homo sapiens
ttgctcacctggggt

SEQ ID NO: 3677357 - DNA, 12 bp, Homo sapiens
ttgctgagtgaa

SEQ ID NO: 3677358 - DNA, 23 bp, Homo sapiens
ttgctgcttttccttggggcagg

SEQ ID NO: 3677359 - DNA, 20 bp, Homo sapiens
ttgctgtgaggctgtcctgt

SEQ ID NO: 3677360 - DNA, 12 bp, Homo sapiens
ttgctgttgaca

SEQ ID NO: 3677361 - DNA, 20 bp, Homo sapiens
ttgctgttgacatatttaat

SEQ ID NO: 3677362 - DNA, 18 bp, Homo sapiens
ttgctgttttcctccctt

SEQ ID NO: 3677363 - DNA, 19 bp, Homo sapiens
ttgctgttttcctcccttc

SEQ ID NO: 3677364 - DNA, 19 bp, Homo sapiens
ttgcttatcaacttcctaa

SEQ ID NO: 3677365 - DNA, 16 bp, Homo sapiens
ttgcttcaaactgaga

SEQ ID NO: 3677366 - DNA, 18 bp, Homo sapiens
ttgcttcaaactgagaca

SEQ ID NO: 3677367 - DNA, 17 bp, Homo sapiens
ttgcttccccttttgcc

SEQ ID NO: 3677368 - DNA, 20 bp, Homo sapiens
ttgcttccccttttgccaat

SEQ ID NO: 3677369 - DNA, 16 bp, Homo sapiens
ttgcttgcctgcaggg

SEQ ID NO: 3677370 - DNA, 19 bp, Homo sapiens
ttgctttgccaaaatacca

SEQ ID NO: 3677371 - DNA, 14 bp, Homo sapiens
ttggaaaggaccag

SEQ ID NO: 3677372 - DNA, 21 bp, Homo sapiens
ttggacggcctgatgctccct

SEQ ID NO: 3677373 - DNA, 14 bp, Homo sapiens
ttggagctgactgt

SEQ ID NO: 3677374 - DNA, 21 bp, Homo sapiens
ttggagctgactgttcttggt

SEQ ID NO: 3677375 - DNA, 13 bp, Homo sapiens
ttggaggacagtg

SEQ ID NO: 3677376 - DNA, 19 bp, Homo sapiens
ttggcaatttcctggccct

SEQ ID NO: 3677377 - DNA, 13 bp, Homo sapiens
ttggcaccagaca

SEQ ID NO: 3677378 - DNA, 21 bp, Homo sapiens
ttggcaccagacacccaggac

SEQ ID NO: 3677379 - DNA, 13 bp, Homo sapiens
ttggcaggctggc

SEQ ID NO: 3677380 - DNA, 22 bp, Homo sapiens
ttggccactccgagaggtgggc

SEQ ID NO: 3677381 - DNA, 23 bp, Homo sapiens
ttggcctgtctcatccccagggg

SEQ ID NO: 3677382 - DNA, 17 bp, Homo sapiens
ttggctcgaatctctgt

SEQ ID NO: 3677383 - DNA, 22 bp, Homo sapiens
ttggctcgaatctctgtgcctt

SEQ ID NO: 3677384 - DNA, 23 bp, Homo sapiens
ttggcttcacggaagagccttgc

SEQ ID NO: 3677385 - DNA, 17 bp, Homo sapiens
ttggcttctccctgggg

SEQ ID NO: 3677386 - DNA, 12 bp, Homo sapiens
ttgggacttcta

SEQ ID NO: 3677387 - DNA, 12 bp, Homo sapiens
ttgggcagagct

SEQ ID NO: 3677388 - DNA, 15 bp, Homo sapiens
ttgggcggggcttct

SEQ ID NO: 3677389 - DNA, 16 bp, Homo sapiens
ttgggcttccatgcct

SEQ ID NO: 3677390 - DNA, 19 bp, Homo sapiens
ttggggagttaagacctgg

SEQ ID NO: 3677391 - DNA, 19 bp, Homo sapiens
ttgggtatgaactaaaaag

SEQ ID NO: 3677392 - DNA, 19 bp, Homo sapiens
ttggtcctacctattatcc

SEQ ID NO: 3677393 - DNA, 20 bp, Homo sapiens
ttggtcctacctattatcct

SEQ ID NO: 3677394 - DNA, 16 bp, Homo sapiens
ttggtgcaacccttac

SEQ ID NO: 3677395 - DNA, 18 bp, Homo sapiens
ttgtaaaacaaaatttga

SEQ ID NO: 3677396 - DNA, 16 bp, Homo sapiens
ttgtaaatgtggtaaa

SEQ ID NO: 3677397 - DNA, 15 bp, Homo sapiens
ttgtaaattatattt

SEQ ID NO: 3677398 - DNA, 17 bp, Homo sapiens
ttgtaaattatatttgt

SEQ ID NO: 3677399 - DNA, 22 bp, Homo sapiens
ttgtaatgaattcctagaatta

SEQ ID NO: 3677400 - DNA, 20 bp, Homo sapiens
ttgtacatgtaacattaaag

SEQ ID NO: 3677401 - DNA, 15 bp, Homo sapiens
ttgtaccaactttta

SEQ ID NO: 3677402 - DNA, 21 bp, Homo sapiens
ttgtacctgtaggactctcat

SEQ ID NO: 3677403 - DNA, 16 bp, Homo sapiens
ttgtactaaagccaaa

SEQ ID NO: 3677404 - DNA, 23 bp, Homo sapiens
ttgtactaaagccaaacatatat

SEQ ID NO: 3677405 - DNA, 14 bp, Homo sapiens
ttgtactcagtgga

SEQ ID NO: 3677406 - DNA, 16 bp, Homo sapiens
ttgtagctaacagtga

SEQ ID NO: 3677407 - DNA, 19 bp, Homo sapiens
ttgtagctaacagtgaaga

SEQ ID NO: 3677408 - DNA, 21 bp, Homo sapiens
ttgtccaacccgaggcccgca

SEQ ID NO: 3677409 - DNA, 15 bp, Homo sapiens
ttgtccctctgcccc

SEQ ID NO: 3677410 - DNA, 19 bp, Homo sapiens
ttgtcctgatgcttttgtc

SEQ ID NO: 3677411 - DNA, 20 bp, Homo sapiens
ttgtctgaacccaggcagct

SEQ ID NO: 3677412 - DNA, 11 bp, Homo sapiens
ttgtctgtcct

SEQ ID NO: 3677413 - DNA, 12 bp, Homo sapiens
ttgtctgtctac

SEQ ID NO: 3677414 - DNA, 22 bp, Homo sapiens
ttgtcttaaaaagtggaaaaat

SEQ ID NO: 3677415 - DNA, 14 bp, Homo sapiens
ttgtgaactggaag

SEQ ID NO: 3677416 - DNA, 16 bp, Homo sapiens
ttgtgctcaaggaatc

SEQ ID NO: 3677417 - DNA, 16 bp, Homo sapiens
ttgttaaagagcactg

SEQ ID NO: 3677418 - DNA, 19 bp, Homo sapiens
ttgttattgatgttgctgt

SEQ ID NO: 3677419 - DNA, 14 bp, Homo sapiens
ttgttattgcctct

SEQ ID NO: 3677420 - DNA, 13 bp, Homo sapiens
ttgttcaagtttt

SEQ ID NO: 3677421 - DNA, 14 bp, Homo sapiens
ttgttcttatgaac

SEQ ID NO: 3677422 - DNA, 17 bp, Homo sapiens
ttgttgaacaggtgttt

SEQ ID NO: 3677423 - DNA, 14 bp, Homo sapiens
ttgttgtgctttta

SEQ ID NO: 3677424 - DNA, 13 bp, Homo sapiens
ttgttgtttgtaa

SEQ ID NO: 3677425 - DNA, 16 bp, Homo sapiens
ttgtttcgtggggagg

SEQ ID NO: 3677426 - DNA, 16 bp, Homo sapiens
ttgtttctgcatcttt

SEQ ID NO: 3677427 - DNA, 12 bp, Homo sapiens
ttgtttgctgct

SEQ ID NO: 3677428 - DNA, 14 bp, Homo sapiens
ttgtttgctgctat

SEQ ID NO: 3677429 - DNA, 14 bp, Homo sapiens
ttgttttaaaactg

SEQ ID NO: 3677430 - DNA, 19 bp, Homo sapiens
tttaaaaacatagaaaaat

SEQ ID NO: 3677431 - DNA, 11 bp, Homo sapiens
tttaaaaatgt

SEQ ID NO: 3677432 - DNA, 12 bp, Homo sapiens
tttaaaaatgtc

SEQ ID NO: 3677433 - DNA, 16 bp, Homo sapiens
tttaaaactggacctg

SEQ ID NO: 3677434 - DNA, 23 bp, Homo sapiens
tttaaaagagagagagagaaaaa

SEQ ID NO: 3677435 - DNA, 13 bp, Homo sapiens
tttaaacacacag

SEQ ID NO: 3677436 - DNA, 23 bp, Homo sapiens
tttaaacacacagatacacacac

SEQ ID NO: 3677437 - DNA, 19 bp, Homo sapiens
tttaaatattttctatttt

SEQ ID NO: 3677438 - DNA, 23 bp, Homo sapiens
tttaacaactatgatttggaaaa

SEQ ID NO: 3677439 - DNA, 24 bp, Homo sapiens
tttaactcaatattttccatgaaa

SEQ ID NO: 3677440 - DNA, 21 bp, Homo sapiens
tttaactgccaatccttaaat

SEQ ID NO: 3677441 - DNA, 13 bp, Homo sapiens
tttaactggtgca

SEQ ID NO: 3677442 - DNA, 19 bp, Homo sapiens
tttaactggtgcactttgt

SEQ ID NO: 3677443 - DNA, 15 bp, Homo sapiens
tttaagcaacatctt

SEQ ID NO: 3677444 - DNA, 17 bp, Homo sapiens
tttaagcaacatctttt

SEQ ID NO: 3677445 - DNA, 17 bp, Homo sapiens
tttaatacagtttattt

SEQ ID NO: 3677446 - DNA, 18 bp, Homo sapiens
tttaatgttttaaatgta

SEQ ID NO: 3677447 - DNA, 19 bp, Homo sapiens
tttaatgttttaaatgtac

SEQ ID NO: 3677448 - DNA, 13 bp, Homo sapiens
tttaattaaataa

SEQ ID NO: 3677449 - DNA, 15 bp, Homo sapiens
tttacaatgtcatat

SEQ ID NO: 3677450 - DNA, 23 bp, Homo sapiens
tttacagccagtgggagatgtta

SEQ ID NO: 3677451 - DNA, 19 bp, Homo sapiens
tttacctcgttctgctcag

SEQ ID NO: 3677452 - DNA, 21 bp, Homo sapiens
tttactgttatttaattgaaa

SEQ ID NO: 3677453 - DNA, 16 bp, Homo sapiens
tttagaaagctgacat

SEQ ID NO: 3677454 - DNA, 18 bp, Homo sapiens
tttaggaatcctttggtg

SEQ ID NO: 3677455 - DNA, 16 bp, Homo sapiens
tttataaaatggctgt

SEQ ID NO: 3677456 - DNA, 17 bp, Homo sapiens
tttataagtcattgtat

SEQ ID NO: 3677457 - DNA, 17 bp, Homo sapiens
tttatataatatctaaa

SEQ ID NO: 3677458 - DNA, 19 bp, Homo sapiens
tttatcacctcattctgaa

SEQ ID NO: 3677459 - DNA, 17 bp, Homo sapiens
tttatgagaaagccttc

SEQ ID NO: 3677460 - DNA, 13 bp, Homo sapiens
tttatggcctcag

SEQ ID NO: 3677461 - DNA, 22 bp, Homo sapiens
tttatggcctcagctgcctcac

SEQ ID NO: 3677462 - DNA, 17 bp, Homo sapiens
tttattcatctgtgaaa

SEQ ID NO: 3677463 - DNA, 14 bp, Homo sapiens
tttattccttgtga

SEQ ID NO: 3677464 - DNA, 22 bp, Homo sapiens
tttattgtctgtctacatttct

SEQ ID NO: 3677465 - DNA, 11 bp, Homo sapiens
tttatttaatt

SEQ ID NO: 3677466 - DNA, 13 bp, Homo sapiens
tttatttcttaaa

SEQ ID NO: 3677467 - DNA, 18 bp, Homo sapiens
tttattttattctatgta

SEQ ID NO: 3677468 - DNA, 15 bp, Homo sapiens
tttattttgtgtaaa

SEQ ID NO: 3677469 - DNA, 22 bp, Homo sapiens
tttcaaaaggaagggtggcttt

SEQ ID NO: 3677470 - DNA, 19 bp, Homo sapiens
tttcaaaatagaaaagtta

SEQ ID NO: 3677471 - DNA, 18 bp, Homo sapiens
tttcaaatttagaaacta

SEQ ID NO: 3677472 - DNA, 15 bp, Homo sapiens
tttcaactactcttt

SEQ ID NO: 3677473 - DNA, 23 bp, Homo sapiens
tttcaagcagtcgtgcctgtgtc

SEQ ID NO: 3677474 - DNA, 19 bp, Homo sapiens
tttcaagtgcctagactgt

SEQ ID NO: 3677475 - DNA, 23 bp, Homo sapiens
tttcaagtgcctagactgttact

SEQ ID NO: 3677476 - DNA, 21 bp, Homo sapiens
tttcaatggtttgcaaggaag

SEQ ID NO: 3677477 - DNA, 13 bp, Homo sapiens
tttcaattgcttt

SEQ ID NO: 3677478 - DNA, 19 bp, Homo sapiens
tttcaatttccaagagctg

SEQ ID NO: 3677479 - DNA, 17 bp, Homo sapiens
tttcacaaggtctttaa

SEQ ID NO: 3677480 - DNA, 17 bp, Homo sapiens
tttcacattagaagaca

SEQ ID NO: 3677481 - DNA, 18 bp, Homo sapiens
tttcagaacctcttcccc

SEQ ID NO: 3677482 - DNA, 15 bp, Homo sapiens
tttcagactgcagag

SEQ ID NO: 3677483 - DNA, 23 bp, Homo sapiens
tttcagcgactccgttggccact

SEQ ID NO: 3677484 - DNA, 19 bp, Homo sapiens
tttcagggaggtggctggg

SEQ ID NO: 3677485 - DNA, 18 bp, Homo sapiens
tttcagtattgacactga

SEQ ID NO: 3677486 - DNA, 18 bp, Homo sapiens
tttcatctgttctatgct

SEQ ID NO: 3677487 - DNA, 22 bp, Homo sapiens
tttcattgctgggcttgtctgt

SEQ ID NO: 3677488 - DNA, 14 bp, Homo sapiens
tttccaagagctga

SEQ ID NO: 3677489 - DNA, 16 bp, Homo sapiens
tttccaagagctgagg

SEQ ID NO: 3677490 - DNA, 16 bp, Homo sapiens
tttccactccattgtc

SEQ ID NO: 3677491 - DNA, 23 bp, Homo sapiens
tttccagcagaagacaaaaagac

SEQ ID NO: 3677492 - DNA, 11 bp, Homo sapiens
tttccagggag

SEQ ID NO: 3677493 - DNA, 22 bp, Homo sapiens
tttccatgggaccacaactatt

SEQ ID NO: 3677494 - DNA, 19 bp, Homo sapiens
tttcccagcccaaattctc

SEQ ID NO: 3677495 - DNA, 11 bp, Homo sapiens
tttcccaggac

SEQ ID NO: 3677496 - DNA, 16 bp, Homo sapiens
tttcccaggaccctga

SEQ ID NO: 3677497 - DNA, 23 bp, Homo sapiens
tttccccccactctccccacact

SEQ ID NO: 3677498 - DNA, 15 bp, Homo sapiens
tttccctgggtggag

SEQ ID NO: 3677499 - DNA, 17 bp, Homo sapiens
tttcctaaggctgcaag

SEQ ID NO: 3677500 - DNA, 15 bp, Homo sapiens
tttcctaatatcaaa

SEQ ID NO: 3677501 - DNA, 12 bp, Homo sapiens
tttcctggaagc

SEQ ID NO: 3677502 - DNA, 19 bp, Homo sapiens
tttcctggccctccactcc

SEQ ID NO: 3677503 - DNA, 14 bp, Homo sapiens
tttccttccatccc

SEQ ID NO: 3677504 - DNA, 19 bp, Homo sapiens
tttccttggggcaggcagt

SEQ ID NO: 3677505 - DNA, 14 bp, Homo sapiens
tttcgtgaactgca

SEQ ID NO: 3677506 - DNA, 16 bp, Homo sapiens
tttctaagagaagcaa

SEQ ID NO: 3677507 - DNA, 21 bp, Homo sapiens
tttctacccaacggccctgca

SEQ ID NO: 3677508 - DNA, 21 bp, Homo sapiens
tttctcttagaacattgtatt

SEQ ID NO: 3677509 - DNA, 14 bp, Homo sapiens
tttctgaactgtta

SEQ ID NO: 3677510 - DNA, 16 bp, Homo sapiens
tttctgaactgttaca

SEQ ID NO: 3677511 - DNA, 17 bp, Homo sapiens
tttctgatcaaggcctt

SEQ ID NO: 3677512 - DNA, 14 bp, Homo sapiens
tttctgcctggagt

SEQ ID NO: 3677513 - DNA, 23 bp, Homo sapiens
tttctggattccccatctcaggc

SEQ ID NO: 3677514 - DNA, 12 bp, Homo sapiens
tttctggcaccg

SEQ ID NO: 3677515 - DNA, 24 bp, Homo sapiens
tttctggtgccatttctgaactgt

SEQ ID NO: 3677516 - DNA, 15 bp, Homo sapiens
tttctggtggtctgt

SEQ ID NO: 3677517 - DNA, 20 bp, Homo sapiens
tttctggtggtctgttggca

SEQ ID NO: 3677518 - DNA, 22 bp, Homo sapiens
tttctgtaagaaacctactgcc

SEQ ID NO: 3677519 - DNA, 15 bp, Homo sapiens
tttcttattctgtat

SEQ ID NO: 3677520 - DNA, 18 bp, Homo sapiens
tttcttgtgttctgtaga

SEQ ID NO: 3677521 - DNA, 20 bp, Homo sapiens
tttcttgtttctgcatcttt

SEQ ID NO: 3677522 - DNA, 19 bp, Homo sapiens
tttgaaaaagctggtcttt

SEQ ID NO: 3677523 - DNA, 23 bp, Homo sapiens
tttgaaagtaaaaacctgcttgg

SEQ ID NO: 3677524 - DNA, 19 bp, Homo sapiens
tttgaaatagtctgtgtga

SEQ ID NO: 3677525 - DNA, 11 bp, Homo sapiens
tttgaatgtta
